United States Patent 11,078,247 (RNA ENCODING A THERAPEUTIC PROTEIN) - sequence listing, part 38

SEQ ID NO: 64253 - RNA, 3435 nt, Artificial Sequence
  derived and/or modified sequence opt3 from TRPA1__Homo_sapiens__XP_011515926
augagcaucuccaugaagaaaggcgccagagcuaggggagagcagcugcaccaaguggcaucuggggucgguucaaugaagcggagucuccgcaaaauguggcgacccggcgaaaagaaagagccucaggggguuguguacgaagacguaccagaugacaccgaggauuucaaggaaagccuuaagguggucuuugagggauccgccuauggccugcagaacuucaauaaacagaagaaauugaagcguugcgacgauauggacacauuuuucuuacauuacgcggcugccgagggucaaauugaacugauggagaaaauaacuagagauucuucgcuagaagugcuccacgagauggacgauuaugggaacacgccgcugcauugugcaguugagaagaaucagaucgaaucagugaaguuucuucugagcaggggagccaaccccaauuugcggaacuucaauaugauggcuccucuccacauugcaguccagggcaugaacaaugaggugaugaaaguacugcuggaacaucgcaccaucgacguuaaccucgagggcgaaaaugggaacacagccgugauuaucgcuugcacuaccaauaacagugaggccuuacagauacugcuuaagaaaggagcgaagccauguaaauccaauaagugggguugcuuucccauccaccaagcagccuucucuggcagcaaagaguguauggaaauuaucuugagauuuggggaggaacacggauacuccaggcagcugcauauuaacuucaugaacaauggcaaggcuacaccucuacaccucgccguccagaacggugaucuggagaugaucaagaugugccuugacaauggggcacagauagauccaguggaaaaaggacgguguaccgcuauucauuuugccgcgacucaaggcgccacagagaucgugaagcugaugauuucaaguuauagcggcucugucgacaucguuaacaccacggacgggugccacgagacuauguugcaccgcgcaucccucuucgaucaucacgaacuggcugacuacuuaaucucagugggagccgauauuaauaaaauagacagcgagggucgaaguccccugauccucgcuaccgccucugcauccuggaacauuguaaaucuucuguugagcaagggcgcccagguggauaucaaagacaacuuugggagaaauuuccuacaucugacaguccagcaaccuuauggacucaagaaccugaggccagaauuuaugcagaugcagcagauaaaggagcuugugauggaugaagacaaugauggcuguacuccgcugcacuacgcuugccggcaaggugggcccggcucgguuaacaauuugcucggauuuaacgugucuauucauuccaaaucaaaggacaaaaagaguccucugcacuucgcggcaagcuacggccguaucaauaccugucagcgcuuacugcaggauaucuccgacacaagacuacucaacgagggggaccugcacggaaugaccccacuucauuuggccgcuaaaaacggucacgauaaggucgugcagcugcuccugaagaaaggcgcccuuuuucugucugaccauaauggguggacggcauugcaccacgccagcaugggaggcuauacucaaacaaugaagguaauucucgauaccaaccugaaaugcacugacagguuagaugaggacgguaauacagcucugcauuucgccgcacgggaagggcacgcgaaggcuguugcccuacuccugucacauaacgcagauaucgugcuuaauaaacagcaggccaguuucuugcaccuggcucuccauaacaagcgaaaggaggucgugcugaccauuauacgcuccaaaagaugggacgaaugcuuaaagaucuucagccacaauucucccggcaacaaauguccuauuacggagaugaucgaguaccugccagaaugcaugaagguccuuuuggauuuuuguaugcuccacucaaccgaggacaaaaguugcagggauuauuacaucgaauauaauuucaaguaccugcaguguccccuagaguuuacuaaaaagacaccgacccaagacgugauuuaugaaccucugacagcccucaacgcaaugguucagaauaaccggauagagcugcuuaaucaucccgugugcaaggaguacuugcugaugaaaugguuagcuuacggauuccgcgcccacaugaugaaccucggcagcuauugucuggggcuuaucccaaugacuauucugguagucaauaucaagccuggaauggcguuuaacuccaccgguauuaucaacgaaacaucugaucauucggagauauuggacaccacuaauagcuaccucaucaaaacgugcaugauucugguguuccuauccucaaucuuuggcuauuguaaggaagccgggcagauuuuccagcagaaaagaaacuacuucauggacaucaguaauguucuggaguggauaauuuauacaaccggaaucauuuuugugcucccccuguucgucgaaaucccagcucaccuucaauggcagugcggcgcaauagccguguacuuuuauuggaugaacuucuugcuguacuuacaaagguuugagaauugugguaucuucauuguaaugcucgaggugauccugaagacucuucugcguucuaccguugucuuuauuuuccuacuccuggcuuuuggguugagcuucuacauccuguuaaaccuccaggaucccuuuuccucaccucugcuuagcauaauucagacauucucuaugaugcugggcgacaucaauuaucgggaauccuuuuuggagccauaccuccgaaacgaacuggcccauccggugcuaaguuucgcacagcuggugagcuucaccaucuuuguccccauuguucuuaugaaucuccugaucggauuggcggugggcgauauugccgaggugcaaaagcacgcuucucugaaaagaauagccaugcagguagaauuacacacuucccucgagaagaaacugccucuuugguuccugaggaaggucgaccagaaaucaacaaucguguauccaaacaagccccgcagugggggaauguuguuucauauuuucugcuuucucuucugcacgggcgagauccggcaggaaauuccuaaugcagauaagagccuggagauggaaauccuaaaacaaaaguacagacugaaagaccuuaccuuucuccuggagaagcagcacgaguugauaaaauuaaucauucagaagauggaaaucauuucggagacugaagaugacgauucccauuguucuuuccaggacagguuuaagaaagagcaaauggaacagcgcaacagccgauggaauacaguucugcgggcugugaaggccaaaacccaccaccucgagccauga

SEQ ID NO: 64254 - RNA, 2382 nt, Artificial Sequence
  derived and/or modified sequence opt3 from TRPC1__Homo_sapiens__NP_001238774
augauggccgcucuguaccccagcaccgaccucuccggcgcaucuucaaguagccuuccuuccucuccaucgucaagcaguccgaacgaggugauggcccugaaggaugucagagaaguuaaagaggaaaauacauugaacgagaaguuauuccugcuagcgugcgacaaaggggauuauuacauggugaagaaaauccucgaagaaaauuccucuggagaccugaacauuaauuguguagaugugcuugguaggaacgcugucacuauaacgaucgagaaugaaaaccuggacauuuugcagcuccugcuggauuauggcugccaaagcgccgacgcacucuuaguggccaucgauuccgagguugugggggcugucgacauucugcuuaaucaccggcccaagcgcucaagucgaccuaccaucgugaaguugauggaacguauacagaacccagaguacagcacaacuauggauguagcacccguuauccuggccgcucauagaaauaacuaugagauucuaaccaugcuccugaaacaggacgugucucuuccuaagccacacgccgucggaugugaaugcacacuguguuccgcgaaaaauaagaaagauucauugaggcauagccgguuucgccucgacaucuacagaugccuggcaagucccgccuuaauuaugcugaccgaggaagacccuauccucagggcuuucgagcuuucugccgaucugaaggaauugucccuaguggagguggaguuucggaacgacuaugaggagcuggcacgccaguguaagauguucgcuaaagaucuccuggcccaagcgcgaaauagcagagaacuugaggucauacugaaccacacuucgucugacgaaccauuggauaagaggggccuccuggaggagcggaugaacuuaucccgucugaaacuagccauuaaguacaaucagaaagaauuuguuucacagaguaacugccagcaauuccucaauacagugugguuuggucagaugagcggguaccgcagaaagccgaccuguaaaaagaucaugacgguacugacugugggaauuuucuggcccguccuuuccuugugcuaucugaucgcaccuaagucucaguuuggcaggaucauucauaccccauucaugaaauuuauaauccacggcgcuagcuacuucacauuucuccugcuucugaacuuguauucacucguguacaaugaggacaagaaaaacacuauggggcccgcccuggaacggauugauuauuuacugauccuauggauaauuggaaugaucuggagugacaucaagcgacucugguacgagggucuggaagauuuccuugaggagucccgcaaucaguugagcuucguuaugaacucucuguaucucgcuaccuuugcccugaaaguggucgcacacaauaaguuccaugacuuugccgauagaaaggacugggacgcuuuccacccuacauuaguggcggaaggccuguuugcauucgccaacguacuuucauacuugaggcucuuuuucauguacaccacgaguagcauucuggggccacuacaaaucuccaugggacagaugcugcaggauuuuggcaaauuccucgguauguuucugcuuguuuuguucucuuuuacuauugggcugacacaauuauaugacaagggauacaccucgaaagagcagaaggauugugugggcauauucugcgaacagcagagcaaugacacuuuccauuccuuuaucggcacaugcuucgcucucuuuugguauauuuucucacuggcccacgucgcaaucuuugugacccgguucaguuacggggaggagcuucaaucuuuugucggagccgugaucguugguacguauaacgugguagucgugauuguucugaccaaauugcucguggcuaugcugcacaagagcuuccagcuaauagccaaucaugaagauaaggaguggaaauuugcacgcgcgaagcuguggcucuccuacuucgacgauaaauguacacugcccccgccuuuuaacaucauucccucaccaaagacuaucugcuauaugauuagcucucuuuccaaauggaucuguagucacaccagcaagggcaaggucaaaagacaaaauucuuugaaggaauggaggaaccugaaacagaagcgugacgagaacuaccagaaagugaugugcuguuuaguacaucgguaccucacauccaugcgacagaagaugcagucaacugaucaggcuaccguggaaaaucugaacgagcuuagacaagaccugaguaaauucaggaaugagauacgcgaucuacucggguuucggacaagcaaguaugccauguucuacccuagaaacuga

SEQ ID NO: 64255 - RNA, 2766 nt, Artificial Sequence
  derived and/or modified sequence opt3 from TRPC3__Homo_sapiens__NP_001124170
augagcaccaaggugagaaaaugcaaggagcaggccagggucacauuccccgcuccugaagaggaagaggacgaaggcgaggaugagggggcagaaccacaacggcgccgacguggauggagagguguuaacggcgggcuggagccgagguccgcccccucucagcgggaaccucacggauacuguccacccccuuuuucacauggcccagaccucaguauggaggguagccccucccuucgcagaaugacugugaugagggagaaagggcggcgccaggcgguacgaggaccugcuuucauguuuaaugauagaggcacgucucugaccgccgaagaggaaagguucuuggacgcagccgaguauggcaacaucccagugguccggaagauguuagaagagucgaaaacacugaaugugaacugcguugauuacauggggcagaaugcucuacaacucgcagugggaaacgagcaccuggaagucacugagcuucuguugaagaaggaaaaucucgcccguauuggugacgcucugcugcucgccauaucaaaaggcuaugugcgcaucguagaggcgauuuuaaaccauccgggguuugcagccagcaagagacugacccuuagucccugugaacaggaguugcaggaugacgauuucuacgcuuaugacgaggauggaacaagguuuuccccugacaucaccccaauuauccuggccgcacacugccagaaauacgaaguugugcauaugcuacucaugaagggcgcucggauagagcgaccccacgauuauuucuguaaaugcggugacuguauggaaaagcaacgccacgacucuuuuagccauuccagaucaaggaucaaugccuacaaggggcuggcgaguccugccuaccuuagccugucuuccgaggauccagucuugacugcacucgaacugucaaacgaguuagcuaaacuggccaauauugagaaggaguucaaaaacgacuaucggaagcucagcaugcagugcaaagauuuuguggugggaguccuugaccugugucgcgauagugaagaaguugaggcuaucuugaauggcgaccuagagucugccgaaccccuggaggugcacagacauaaggcaucccucagcaggguaaaacuggccauuaaguacgaagugaagaaauucgucgcucacccgaacugccagcagcaacuucugacaaucugguaugagaauuugucgggccuccgugaacagaccauagcgauuaagugucuggugguuuuaguggucgcacuggggcuaccuuuucucgccaucggauacuggauugcucccugcucucggcuggguaaaauccuucgauccccauucaugaaguucguggcccacgcagccucauuuaucauuuucuugggccugcucguauuuaacgcuagugauagauucgaggggauaacgacucugccuaacaucaccguuacagacuaucccaaacagauuuuuagggugaagacuacccaauucacauggaccgagaugcuuaucauggucugggugcugggaaugauguggagcgaaugcaaggaguuguggcucgaaggcccacgcgaguacauacugcaguuauggaauguccuggauuuugguaugcuauccauuuucaucgccgcauuuacggcgcgguuccucgcuuuucugcaggccacuaaagcacagcaauauguggacucuuacguucaggaaagcgaucuuucagaggugacauugcccccugagauccaguacuucaccuaugccagagacaaguggcugccaagugacccgcagauuaucuccgaagggcucuacgcuauugccguaguccugagcuuuucuaggauagcauauaucuuacccgcuaacgagucauucggcccucugcaaauuagucuuggacgcacugugaaagauaucuucaaguuuaugguuuuguucaucaugguguuuuucgccuuuaugauuggcauguucauacucuacagcuauuaccugggggcgaaagucaaugccgcuuuuacaaccguggaagaguccuucaagacgcuauuuuggucuaucuucggacugucggaaguaaccagcgugguucucaaguaugaccauaaauuuauugagaacaucgguuacguccuguacggcauuuauaaugugacaaugguggucguucuuuugaacaugcugaucgcaaugauaaauuccucauaccaggagaucgaagaugacagugauguggaguggaaguucgcccgaucuaaauuauggcucagcuauuuugacgaugggaagacucugccacccccuuucucccuugugccaucacccaagagcuucguauacuuuauuaugcggaucgucaacuucccgaaaugucguagaaggcgccugcagaaggacauugaaaugggaaugggcaauucuaaaucccgguugaaccucuuuacccagaguaauagcagaguguucgagucucacuccuuuaacucaauccugaaucaaccuacaagguaucagcagauaaugaagcgacuaauuaaacgcuacguucugaaggcucagguggauaaagagaacgacgaagucaaugagggugaacucaaggagaucaaacaagauauuaguagccugcgguaugaacuuuuggaggacaagucgcaggccacugaggaacuggcaaucuuaauacauaagcucuccgagaaacugaacccaucuaugcuuagaugcgaauga

SEQ ID NO: 64256 - RNA, 2370 nt, Artificial Sequence
  derived and/or modified sequence opt3 from TRPC4AP__Homo_sapiens__NP_955400
auggccgcugcacccguggccgcgggcagcggggcuggaagagguaggcgguccgccgcaaccgucgccgcuuggggcggguggggaggccgcccucgaccagguaacauccugcuccagcuucgucaagggcagcugacaggaagaggcuugguuagggcagugcaguucacugagacguuuuuaaccgaacgggacaagcagucuaaauggucaggcauuccgcaacugcuacucaagcugcacacaacuucccaucuucacagcgauuucguagagugccagaauauacugaaagaaaucucccccuugcucucuauggaggccauggcuuuugugaccgaagaacgcaagcugacacaggagaccacuuacccuaacacauauauuuucgaccuguuugggggagucgaucucuuaguggaaauccugaugagaccaaccauuucgaucaggggucagaaacuuaagauaucagacgagaugagcaaggauuguuugaguauccuguacaauacgugcguuuguacugaaggcgugaccaaacggcuagccgagaagaacgacuucgucauuuuucucuucacacugaugacuuccaaaaagaccuuucuucaaacagcgacccugaucgaggauauuuugggggugaaaaaggaaaugauccgccucgacgagguacccaaucugucuagcuuaguuuccaacuucgaucagcagcagcuggcaaauuuuugccgaauacucgccgugacgauuucagaaauggacacuggaaacgaugacaagcauacacuucuggcuaaaaaugcccaacagaagaaaaguuugagccuaggcccuucugcagcugagaucaaccaggccgcgcugcucuccauuccagguuucgucgaaagacuguguaaguuggccaccaggaaagugucagagagcacugggacagcaaguuuucugcaagaguuggaagagugguauaccuggcucgauaaugcucugguguuagacgcccugaugcgggucgcuaacgaagagucugaacacaaucagggagccuccgaggagaacggccuaccccauacgagcgcacguacccagcucccucagucgaugaagaucaugcacgaaaucauguacaaacuggagguucuuuauguguugugcguacugcucaugggccgccaaagaaaucaggugcacaggaugauugccgaguucaagcugauaccagggcuuaacaaccuguucgacaaguugaucuggcggaaacauucugcuuccgcgcucguccugcacggacauaaucagaacugugauugcucaccggacauuacauuaaagauccaguuucugcgacuacuccaaaguuucagcgaucaccacgagaauaaauaccugcuuuugaacaaucaggaacugaacgagcucuccgcaauaucucugaaggccaauauucccgagguggaagcuguuuuaaacacugaccgcagccuggugugugaugguaaaagaggccuuuugaccaggcuccugcaggucaugaagaaggagccugccgaaucaaguuuucgguucuggcaggcacgcgccguggaguccuuucuaagagggacaacuagcuaugcugaccaaauguuccugcucaaaaggggacugcuugagcauaucuuguacugcaucguagauucugaauguaagucacgugacguucugcagaguuacuuugauuuacucggcgagcugaugaaauucaauguggacgccuuuaagcgguucaacaaauauauuaauaccgaugcaaaguuucaggucuuccuuaagcagaucaacagcucccugguggacucuaauauguugguccgaugcgugacacucucgcuggacagauuugaaaaccaaguugauaugaaaguggcggagguacuaagcgaaugcaggcugcucgcuuacauuucccaggucccaacccagaugucauuccuguuccgccuuauaaauaucauucacgugcaaacuuugacgcaggagaacguuaguugucugaacacaucuuuagugauccucaugcuggcccggagaaaggagaggcuuccccuguaucuacgccuccugcagcgaauggaacauagcaaaaaguacccugguuuucuucugaauaacuuccacaauuuacuccgguuuuggcagcaacauuaucugcacaaagacaaggauaguaccugccuugagaacucaagcuguaucucuuucuccuacuggaaggaaacugucaguauucuguugaauccagaccgucagagccccucugcacucguguccuauauagaggaaccguacauggauaucgacagagauuuuaccgaggaguga

SEQ ID NO: 64257 - RNA, 2682 nt, Artificial Sequence
  derived and/or modified sequence opt3 from TRPC4__Homo_sapiens__NP_001129427
auggcccaguucuacuauaagagaaacgugaaugcucccuacagggaccggaucccucugcgcauuguccgagcagagagcgaacucuccccaucugagaaagccuaucuuaacgcgguugaaaagggcgauuacgcuucagugaaaaagagucuggaggaagccgagauauauuuuaaaaucaauauuaacugcaucgacccguuggggcguaccgcauuacugauugccaucgagaaugaaaaccuagagcucauagaacugcuucugagcuucaauguauacgugggagaugcuuugcuccacgcaaucagaaaggaggucgugggugccguugagcugcugcucaaccauaagaaacccuccggcgaaaagcaagugccuccaauuuuacuggacaaacaguuuucugaguucacacccgauaucacuccuauuauccuugcugcccacacgaauaacuaugaaauaauuaaguugcugguccagaaaggggugucgguaccaaggccccaugagguucgguguaauugcguggaaugugucucaagcagugacguggauucccuacgccacucuagaagcaggcucaacaucuacaaggcgcuggcauccccuucacuuauugcccugaguagcgaggacccauuuuugaccgcuuuccagcucucuugggagcugcaagaauuauccaagguggagaaugaauuuaaaucagaguacgaagaacugagccggcagugcaagcaguucgccaaagaucuccuugaccagacacgcaguucucgagagcuggaaaucaucuugaacuauagagaugacaauucccuaauugaggaacaaagcggaaacgaucuggcaaggcucaagcuggcuauaaaauaccggcagaaggaguuugucgcccagccgaacugucagcaacuucuggcgucgcguugguaugacgaguuccccggcuggcgcagaaggcauugggccguuaaaauggugacuugcuuuaucauuggucuacucuucccuguauuuucuguguguuaccugaucgcaccaaagucccccuuagggcuguucauacggaagccuuucauuaaauuuaucugccacaccgcuucauaucuaacauuccucuuucugcuuuugcuggccagucagcacaucgaccgaagcgaucucaaucgccagggaccacccccgaccauugucgaguggaugauccugccuugggugcuuggcuucauuuggggcgagauaaagcaaaugugggacgggggacugcaggauuacauccaugacugguggaacuugauggauuuuguuaugaauagccucuaucuggcuacuauuucuuuaaaaaucguggccuucgucaaguacagcgcacugaaccccagagaaucaugggacauguggcacccaacauugguggccgaggcucucuuugcgaucgcaaauauuuucaguucccugaggcuuauauccuuguuuaccgccaacucucaucuggguccucuccagaucucacugggccggauguuacuggauauucuuaaauucuuguuuaucuacugucucguacugcuagcuuucgccaaugggcugaaccagcucuauuuuuacuaugaagagacgaagggacugacuugcaagggcauucgcugugagaaacaaaauaacgcauucaguacccuuuucgaaacauugcagagccuguuuugguccaucuucgguuuaauaaaucucuacguuacuaacgugaaggcccagcacgaguuuaccgaguucgucggggcuacaauguuuggaaccuauaaugugaucucucuggucgugcuucugaacauguugauugccaugaugaauaacucguaccagcucaucgcagaccacgcggauauugaauggaaauucgcuagaacgaagcuguggaugagcuauuuugaagagggcggcacucuacccacaccauucaacguuauccccuccccuaaaucacugugguaccucauaaaguggauuuggacccaucugugcaagaaaaagaugaggcguaaaccagagaguuuugggacuaucggacggcgagccgcagacaaucuuagaaggcaccaucaauaccaggaagugaugcgcaacuugguaaagcgguaugucgccgcuaugauuagagaugccaaaacagaggaaggucugaccgaggaaaauuucaaggaguuaaagcaggacaucucuagcuuuagguucgaggugcucggccugcuucgcggguccaaacugucaacgauacagagcgcaaacgcuucuaaggaauccaguaauagcgccgacucugaugagaaauccgacucagaagaggaaguugcgcgacaacaggccgcuggaccgcuagagcggaacauccagcucgagagucguggccuggcaagcagaggugauuugucgauucccgggcuguccgaacagugcguguuagucgaccacagggagcgcaauaccgauacacucggccugcaagugggaaagcggguauguccuuuuaaaucugaaaaggugguugucgaggacacugugccaaucauucccaaagagaagcaugccaaggaagaggauagcucaaucgacuacgaucuuaaccugccugacaccgugacacacgaagauuaugucacuaccagauuguga

SEQ ID NO: 64258 - RNA, 2922 nt, Artificial Sequence
  derived and/or modified sequence opt3 from TRPC5__Homo_sapiens__NP_036603
auggcccagcuguacuauaagaaagugaacuacagccccuauagagacaggaucccucuccaaauuguccgggcugagaccgaacuuuccgcagaggaaaaggccuuccugaaugcgguugagaaaggcgauuacgcuacagugaagcaggccuugcaggaagcagagauauauuacaacguaaauaucaacugcauggacccauuagggcgcucugcccugcuaauugcuaucgagaaugaaaaccucgagauuauggaacugcuucugaaucacucaguguaugucggagaugcauugcucuacgccauccgaaaagaggugguuggugcuguggagcugcugcucaguuaccguagaccgagcggcgaaaagcagguccccacuuuaaugauggacacgcaauuuuccgaguucaccccugauauaacaccaaucaugcuggccgcgcauacuaacaauuaugaaauuaucaagcucuuggugcagaaaaggguaaccauuccccggccucaccagauccgcuguaacugcguugagugugugucuucgucagaagucgacagccugagacauaguaggucccggcuaaauauauacaaggcacucgccucuccaagccugauugcucuuuccucagaggaucccauccugacagccuuucgcuuggggugggagcucaaagaacugaguaagguggagaacgaguucaaagcagaauaugaagaguuaagccagcaaugcaagcuguuugcuaaggaccuccuugaucaggcccgaucuuccagagagcuggaaauuaucuugaaucacagggacgaucauucagaggaacuagacccucagaaauaccacgaucuggcgaagcucaaaguggccaucaaguaucaccagaaagaguucgucgcacaaccaaacugucagcagcugcuugcuacccugugguacgacggauuuccgggcuggcggcguaagcauuggguugugaaauugcucacuugcaugacaauugguuuccuguuucccauguuaagcauagccuaucugaucaguccucgcucuaaucuagggcuuuucauuaagaagccauuuaucaaauucauaugucacaccgcuuccuaccugacguuucuuuucauguugcugcucgccagccaacauauuguaagaacugaccugcacgugcagggacccccuccaaccgucguggaauggaugauccuucccuggguucugggcuucaucuggggcgagauuaaggagaugugggaugggggauuuacagaauacauccacgacugguggaacuugauggauuucgcaaugaacucgcucuaucuggccacuauuucuuuaaaaauaguggcuuacgucaaguauaaugguuccaggccgcgggaggaaugggagauguggcauccuacccugaucgcggaggcacuauuugccauuucaaacauccucaguagccugcgacuuaucuccuuguucacagcuaauucucaccugggcccccuccagauuagccuggggcgcauguuacuggacauacuuaaauuuuuguucaucuacugccucgugcugcuagccuuugcaaacggacugaaucagcucuauuucuacuaugaaaccagagccauugaugagccaaacaauuguaagggcaucaggugcgaaaagcaaaacaaugcuuuuucaacgcuguucgagacucuucagaguuuguuuugguccguauucggucuguuaaaccucuacguuacaaaugugaaagcccggcaugaauuuaccgaguucgucggggcaacuauguucggaacauacaacgugauuagccuggucgugcuucugaauauguugaucgcgaugaugaacaauucuuaucagcucauagcugaccacgccgauaucgaguggaaguuugcacgcaccaaacuguggaugucauacuucgacgaaggcggcacgcuaccucccccauuuaacauuauccccaguccuaagagcuuccuguaucucgggaacugguuuaauaacaccuucuguccaaaaagagauccggacggaaggcgucggcgaagaaaucugagguccuuuacagagcgcaacgccgauucucuuauucagaaucaacauuaccaggaaguuauccggaacuuggugaagagauauguagcugccaugauacgcaauucgaagacucacgagggucugaccgaagagaacuucaaagaguuaaagcaggacauuagcuccuuuagguacgaaguccucgaccugcuuggcaaucgaaaacacccccggucauucaguacaucuagcacugagcugucccagcgugaugacaacaaugaugggucaggaggcgcaagagcuaagagcaaaucuguguccuuuaaccuagguugcaagaagaaaaccugccaugggccuccacucaucaggacaaugccccgcaguagcggcgcccaaggaaagucuaaagcggaauccucaaguaagcggagcuucaugggcccuucgcugaaaaaguuggggcuguuauuuuccaaauucaauggacacaugucugagccaagcucagaacccauguauaccauuagugacgguaucguucagcagcauuguauguggcaggauauaagauacucccaaauggagaagggcaaggccgaggcuugcucucagagcgaaaucaaccucuccgagguggaacugggggagguccagggagcagcccaaucaagcgaguguccgcuugcuugcaguucuucccugcacugugccagcucgauuugcucaucuaauaguaaauugcucgacuccagcgaagauguguucgagacuuggggcgaagcaugugaccugcuaaugcacaaguggggugaugggcaggaggaacagguaacgacaaggcuguga

SEQ ID NO: 64259 - RNA, 2796 nt, Artificial Sequence
  derived and/or modified sequence opt3 from TRPC6__Homo_sapiens__NP_004612
augagccagucccccgccuucggcccuagaagggggucuucaccacggggagcugccggugccgcggcucgccgaaacgagagucaagacuaccugcucauggauagcgaacuuggcgaggacgggugcccgcaggcaccccugccuuguuauggauacuauccaugcuuucguggcuccgauaauagauuggcacacaggcggcagaccguguuacgcgaaaaggguagaaggcuggccaaccgggggcccgcuuacauguucucugaccgcucgacaucacuaagcaucgaggaagaacgauuucucgaugcagccgaguauggaaauauuccugucguuagaaaaaugcuggaagagugucauagucuuaacgugaauugcguagacuacaugggccagaacgcucugcaauuggccguggcgaaugaacaccucgagauaacugagcugcugcucaagaaagaaaacuuauccagggucggcgaugcacugcuuuuggccaucucuaagggguaugugcggauuguugaggcuauccugagccauccagccuucgcagaaggaaaacgucuagcuacgucccccucacagagugagcuccagcaggacgauuuuuacgccuacgacgaagaugguacccgcuucagccacgacgugacaccuauuauccuggcggcccauugucaagaguaugagauaguccacacucuucugagaaagggcgcaaggaucgaacggccacacgauuacuuuugcaaguguaaugacugcaaccagaaacagaagcaugacucuuucucccacucacgaagccgcauuaaugcuuauaaaggguuggccaguccggcuuaccucucucuguccagcgaggaucccgugaugaccgccuuagaacugucgaacgagcucgcaguacuugccaauaucgaaaaggaguuuaaaaacgacuauaagaagcugucuaugcaguguaaagauuucguugugggauugcuagaccugugcagaaauacagaggaagucgaggcuauucucaacggcgauguggaaacccugcaauccggugaccaugggaggccuaaccuuucacggcugaaguuggcgaucaaauacgaggugaagaaauuugucgcacacccaaauugucagcagcaacuccugaguauaugguaugaaaacuuaagcggacugcgccagcagacuauggccguuaaguuccuagugguacucgcuguggccauuggccugcccuuucuugcauugaucuacugguucgccccuugcuccaaaaugggcaagauuaugagagggccauucaugaaguuugucgcucacgccgcaucuuucacaaucuuucugggacuccuggugaugaaugcggcugauagguucgaggguaccaaacuucugcccaacgagacgagcacugacaaugccaagcaguuguuucguaugaaaaccucaugcuucaguuggauggaaaugcucaucauuuccuggguuauaggcaugaucugggcagaguguaaggaaauuuggacacaagggccgaaagaguaccuguuugaguuauggaacaugcuggauuucggaaugcuagccaucuuugcugccagcuucauagcacgguuuauggcuuucuggcaugccucuaaggcgcagucaauuaucgacgccaaugauacucucaaggaccugaccaaagugacacuuggcgacaacgucaaguauuacaauuuggcucgaaucaaaugggauccuagugacccccagauuaucagcgaaggucuguaugcaauugccgugguacucuccuuuucuagaauagcuuacauccugccagccaacgagucguucgggccuuuacagauuagccugggcaggaccguuaaggauaucuucaaauuuauggugaucuucauuauggucuuuguggcauucaugauaggaauguuuaaucuuuauuccuacuauaucggcgcgaagcaaaacgaagccuucacgacugucgaggaaucauuuaagacauuguucugggcuauuuuugggcucagugaggugaaaucuguugugaucaauuacaaccacaaguucauugagaauaucggauacguacuguauggugucuacaacgugaccaugguuauagugcuacugaacaugcucaucgccaugauuaauagcuccuuucaggaaaucgaggacgaugcagacgucgaauggaaauucgcucgcgccaagcugugguuuucauauuucgaggaaggccggacucuucccgugccauucaacuugguacccagcccuaaaucucuguuuuacuuacuccugaaacuuaagaaauggauuuccgagcuguuccaggggcauaagaaaggauuucaggaggaugcagaaaugaauaagaucaacgaggaaaagaaguugggcauacucgguagucacgaggaccugagcaaacuaucucuggauaagaagcaaguggggcauaauaaacagccauccauuagaucaagugaagacuuccaccucaacagcuuuaauaacccgcccaggcaguaucagaagaucaugaaacgccugauuaagcgauacguucuucaagcccagaucgauaaagagucggacgaggucaaugaaggcgaguugaaggaaauaaagcaggauaucuccucucugcgguaugaguuacucgaggagaaaagccaaaacacagaggaccuggcugaacuuauucgugagcugggagaaaagcuaucaauggagccuaaucaggaggaaaccaacagauga

SEQ ID NO: 64260 - RNA, 2241 nt, Artificial Sequence
  derived and/or modified sequence opt3 from TRPC7__Homo_sapiens__NP_001161048
augcugagaaacagcaccuucaagaauaugcagaggcggcacacaacucuccgcgagaaaggccgacgucaagccaucagagggcccgcuuacauguuuaacgaaaagggaacgucccuuaccccugaggaagagagguuccuggacucugcagaauaugguaauauuccagugguccggaaaauguuggaggagucaaagacauuaaacuuuaauugcguugauuacaugggccagaacgcccugcagcuagcgguggggaaugaacaucucgagguaacugaacugcuucugaaaaaggagaacuuggcucgcgugggagacgcccuccugcuggcaauaaguaagggcuaugucagaaucguggaggccauucucaaucacccggcuuucgcacagggucaaagguuaacccugagcccccuugaacaggaguugcgggaugacgauuuuuacgccuaugacgaagaugggacacgcuucucccaugacaucaccccuauuauccuggcugcccacugucaggaguacgaaauaguucauauccuacuccugaaaggagcgcgaauugagagaccacacgauuauuuuugcaaguguaacgagugcacugaaaaacagaggaaggacucuuucucgcacucacggagccguaugaaugcauacaaaggccuugccagugcugccuaccuguccuugucuagcgaggaucccgugcucacagcacuggaauuauccaacgagcuggcucgccucgccaauaucgaaaccgaguuuaagcugggcagaacgcugaggucaccuuucaugaaguuugucgcgcaugccgugaguuucacuaucuuuuuggggcuacugguaguuaacgcaagcgaccgguucgagggagugaaaacccucccaaaugaaacauucacugauuaucccaagcaaauuuuucgagucaaaaccacacaguucucuuggaccgagaugcugauaaugaagugggugcuugguaugauuugguccgaauguaaagagaucugggaagagggcccucgcgaguacgugcugcacuuguggaaccuccuggacuuugggauguuaucaauuuucgucgcuagcuuuacggccagauucauggcuuuucugaaggccacugaagcacagcuauauguugaccagcaugugcaagaugacacacuccacaacguaagucugccaccggagguggccuacuucaccuaugcuagggauaaaugguggcccucugacccucagaucaucuccgaaggacuuuacgcgauugcagucguguugagcuuuucgcggauagccuauauccugccagcuaaugagucuuucggcccccuccagauuucccugggucgcacuguuaaggauaucuuuaaguucauggugauauuuauuauggucuucguggccuucaugaucgggauguuuaaccuuuacucauacuauagaggagcaaaauacaauccugccuucacaaccguagaggaaaguuuuaagacgcuguucuggagcaucuuuggcuuguccgagguuauuucugugguccucaaauaugaccacaaguucaucgaaaacauuggcuacgugcuguauggggucuacaaugugaccaugguugugguauuacugaacaugcuaauagcuaugaucaauaacagcuaucaagagauugaagaggaugccgacgucgaguggaaauuugcaagggcgaagcucuggcugucauacuucgaugaaggacguacacuuccagcucccuuuaauuuggugccgaguccuaaguccuucuacuaucugaucaugcggaucaaaaugugccucauuaagcuguguaaaagcaaggccaaaucuugcgagaacgacuuagaaauggguaugcuuaauucaaaguuuaagaaaacucgauaccaggcaggcaugagaaacagugagaaucuuaccgccaacaauacauugagcaagcccacuagguaucagaaaauaaugaagcgccucaucaaacgguacguucugaaggcucagguggauagagaaaacgacgaggucaacgagggggaacuaaaggagauuaaacaagacaucuccucucugagguaugaacuccuggaggaaaagucgcaggccaccggagagcuugcagauuugauucagcagcugagcgagaaauucggcaagaauuuaaacaaagaccaucuccgcgugaauaaggguaaagauaucuga

SEQ ID NO: 64261 - RNA, 4929 nt, Artificial Sequence
  derived and/or modified sequence opt3 from TRPM1__Homo_sapiens__NP_001238949
augagcuccuucaagagaggcucucugaaaucaaguaccagcgggucccagaagggacaaaaaucuuggaucgagaagacauuuugcaaaagggaauguauuuucgugauacccucgaugaaggacucaaaccggugcuguugcggucaguuuacuaaucagcacaucccuccacucccgagcgccacgcccaguaagaacgaggaagaguccaaacaggucgaaacccaaccugagaaguggucuguugcuaaacauacacagagcuacccaacugauuccuauggcgugcuugaguuccagggaggaggcuacucaaauaaggcaauguauauucgcguaaguuacgacaccaaacccgauagccuguugcacuuaauggugaaggacuggcagcuggaacuaccuaagcuccugaucucuguccauggugggcuucaaaacuuugagaugcagccaaaacugaaacagguguucggaaaaggcuugauuaaggccgcgaugacaaccggcgcuuggaucuuuacugggggaguuuccacaggugugauaucacacgucggcgaugcccucaaagaccauagcaguaagucucgagggcgugugugugcaaucggaauugcccccuggggcaucguagaaaauaaagaggaucugguugguaaggacgugaccagagucuaucagacgauguccaacccucugagcaagcucucgguguuaaauaacucucacacucacuucauucuggcugauaaugggacccuuggaaaauacggcgcagaggugaaguugaggcggcugcuagaaaaacauaucucccuccaaaagauaaacacacgccugggccagggggucccacuuguuggacuggugguagaggguggcccgaauguggucucaauuguguuggaauaucuccaggaggaacccccuaucccaguugugauuugcgacgggagugggagagccagcgauauccuguccuuugcucacaaauacugugaggagggcgguaucauuaacgaaucuuuaagggagcaacugcucgucacuauacagaagaccuucaauuacaacaaggcccagagccaucagcuuuuugcgaucauuauggaaugcaugaaaaagaaagagcuggugacaguauuccggauggggucagaaggccaacaggacaucgagauggcaauauugaccgcccuacugaagggaacgaauguuagugcucccgaucagcucucccuggcccuugcauggaaccgcguggacauugcucgaagccagaucuuugucuucggcccucacuggccaccccuggggucuuuggccccgccuacugacucaaaagcgacagagaaggaaaagaaacccccaauggccaccacuaagggagguagaggcaaagggaagggaaagaagaagggcaaagugaaggaggaagucgaggaagagacagauccuaggaaaaucgagcuccugaacugggugaaugcauuagaacaagcuaugcuggacgcccuaguucucgaucggguggacuucguaaagcugcuuauugagaacggugucaauaugcagcacuuuuugaccaucccccgucuggaagaacucuauaacacgcgccuggggccacccaauacccuucaucuguuggugagagauguuaaaaagaguaaccucccuccagacuaccacauuagccugauagauaucggcuuagugcuggaguaucuaaugggaggcgcuuacagguguaauuauacacggaaaaacuuccgaacucucuacaauaaccuguuugggccgaagcgccccaaggcccuuaaauugcugggaauggaagacgaugagccuccagcaaaggguaaaaagaaaaagaagaaaaagaaagaagaggaaauugacaucgaugucgacgaccccgccguguccagauuccaguauccuuuucaugagcucaugguaugggcugugcugaugaagaggcagaaaauggcgguuuucuuauggcaacggggcgaggaaucuauggcaaaggcccuggucgcuugcaagcucuacaaagccauggcacacgagucgagcgaauccgauuugguggacgauaucucacaggaccucgauaauaacaguaaggacuuugggcagcuggcccuagagcugcucgaucagucuuacaaacaugacgaacaaauugcuaugaagcugcuuaccuaugaguugaaaaauuggagcaacuccacaugucugaaguuagccguggcagcgaagcaccgcgauuucauagcucacacuugcucacagaugcuccugaccgacauguggaugggaagacuuaggaugcguaaaaauccaggccugaaggucaucauggguauuuugcuucccccgacaauccuguuucuagaguuccggaccuacgaugacuuuagcuaucagacuucuaaagaaaacgaggaugggaaggaaaaagaggaagagaacacggacgccaaugcagacgccggcucccgaaagggagaugaggaaaacgagcauaaaaagcaaagaaguauuccuaucggcacaaagauaugcgaguucuacaaugcuccaaucguuaaauuuugguucuauaccauuagcuaccugggguaucuccugcuuuucaacuacgugaucuuggugaggauggacggauggcccucucugcaggaguggauuguaaucuccuacauagucucauuagcccucgagaagauucgcgaaauccugaugagugagccuggcaaacuuagccagaagauuaaaguguggcugcaggaauauuggaauaucacugaucuaguugcaauaucgaccuuuaugaucggugcuauucuccggcugcaaaaccagcccuacaugggguauggaagagugaucuacugugucgacauuaucuucugguauauaaggguguuggauauuuuuggcguuaauaaguaccuggguccauaugugaugaugaucggcaagaugaugaucgacauguuauacuucguagucauuaugcucguggugcugauguccuuuggggucgcccgccaggcgauccuucacccugaggaaaaacccucuuggaagcuggcccgaaacauuuucuacaugccauauuggaugauauacggagagguuuuugcugaucagaucgacuuguaugcaauggagauuaauccgccuugcggcgaaaaccucuacgaugaggaagggaaacggcugcccccauguauccccggagccuggcuaaccccugcucugauggccugcuaucuucucguggcaaauauucuguugguaaaccuguuaaucgcgguguucaauaacacauuuuucgaggucaagagcauaucaaaucaaguguggaaauuucagcguuaccagcucaucaugacuuuccaugacagaccaguucugcccccuccgaugauuauccuuagucacauuuauaucauaauuaugaggcuguccggccgcugucggaagaagagagaaggugaucaggaggagagggaccgaggguugaaacucuuucugucugaugaggaacuaaagcgccugcacgaguucgaagaacaaugcgugcaggagcauuuccgggagaaagaagacgagcagcaaagcuccucagacgaaagaaucagggucacaagcgagcguguggagaacaugaguaugcgccuugaagagaucaacgaacgggagacguuuaugaagaccucucuccagacuguugaucugagauuggcccaguuagaggaacuguccaauaggauggugaacgcucucgagaaucuggccggaauugaccgaagcgaucuuauacaggcacggucgcgcgcuucaucugaaugugaggccacauaccuguugagacaaaguuccaucaacagcgcagacggcuacucucuauauagguaccacuucaauggugaggaacugcucuuugaagauaccagccuguccacaucaccaggcacugggguccggaaaaagaccugcaguuuccgaauuaaggaggagaaagacguaaagacgcaucuugugcccgaaugucagaacagcuuacaccugucucucggaaccuccacaucagccacuccugauggcagucauuuggcuguugacgaucugaaaaaugcggaggaaagcaagcucgggccagacaucggaauuuccaaagaggaugacgaaagacagaccgacucuaagaaggaggagacaaucucgcccagccugaacaaaacugaugugauacacggccaggacaagucagauguccaaaauacccagcuuacgguggaaacaaccaacaucgaggguacuauuuccuauccucuggaagagacaaaaaucacccgcuacuuuccggacgagacuauuaaugccugcaagaccaugaaaaguaggucuuucguauauagccgugggcggaaguuggugggaggcgucaaccaggauguugaauacuccucaaucacagaccagcaacuaacgaccgaguggcagugucaggugcagaaaauaacuagaucucacagcacagauauucccuauaucgugagugaagcagcuguccaagccgagcauaaggaacaguuugccgacaugcaggaugagcaccauguggcugaggcaaucccaaggauuccucgccugucccucaccaucacagaccgaaaugguauggaaaacuuacugagcguuaagcccgaucaaacucuuggcuucccaucucugagaucaaaaucccuccacgggcauccucggaauguaaagaguauacagggaaaauuggacaggagcggccacgccucgucuguguccagccuggucauugugucagggaugaccgcggaggaaaagaaaguuaagaaggagaaagcuaguacggaaacagagugcuga

SEQ ID NO: 64262 - RNA, 4512 nt, Artificial Sequence
  derived and/or modified sequence opt3 from TRPM2__Homo_sapiens__XP_005261228
auggaacccagcgcccugagaaaggcuggcuccgaacaggaggaaggguucgagggacucccuaggcgggugaccgaccuugguauggucucuaaccugcgccgaucaaauaguagcuuguuuaaauccuggcguuuacaaugcccauucggcaacaaugauaagcaggaaucucugucgucauggaucccggagaacauuaaaaagaaagaguguguuuacuuuguggaaagcaguaagcuauccgacgcagggaagguagugugccaguguggauauacacacgagcagcaucucgaagaggccacuaaaccccacacguuccaaggcacccagugggauccuaagaaacauguccaggagaugccaacagacgcguuuggugauauaguguucacugggcugucucagaagguuaaaaaguacgugagagucagccaagacacccccuccucagugaucuaucaccuuaugacacagcauuggggacuggauguaccuaauuugcucauuaguguuaccggcggcgcuaagaacuuuaauaugaaaccaaggcuuaagagcaucuuccggcgcgggcuggugaaagucgcccagacuacaggagcauggauuaucaccgguggcucucacacgggggugaugaaacaggugggagaagccgucagagacuuuucccucucaagcaguuacaaagagggcgaauuaauaacuaucgguguugcuaccugggggacagugcacaggcgggagggacugauucaucccacuggcucuuucccugcagaauauauccuugaugaggacggccaagggaacuugaccugccuggauuccaaucacagccauuuuauucuaguagacgauggaacacacggucaguacggcguggagaucccacuccgcacccgacuggaaaaguucauaucggagcagacgaaagaaagagggggagucgccauuaagaucccgauuguguguguugugcuugagggcggucccgggacucugcacacaaucgacaacgcuaccacuaauggcacaccuugcgucgugguagaaggaucuggcaggguugccgacgugaucgcgcaagucgcaaacuugccaguguccgauauuaccauaucacucauccagcagaagcugagugucuuuuuccaggagauguucgagacguuuaccgaaagccggauuguggaguggacaaagaagauccaagacauaguucgucgcagacaguuacugacuguguucagggaagggaaagauggacagcaggacguagaugucgccauucuccaagcucugcugaaggccucccggucucaggaccauuuuggucacgagaauugggaucaucaguugaaacuagcaguggcuuggaaccgaguugacaucgcccgcagcgaaaucuucauggaugaguggcaguggaagcccucagaccugcacccuaccaugacagcggcccucauuaguaauaagccagaguuugugaaacuguuccuugaaaacggcguccaacugaaggaguuugugacuugggauaccuugcucuaucuguacgaaaacuuagaccccuccugucuguuccauagcaaacuacagaagguacucguggaggacccggagagaccugcaugcgcucccgccgcuccaaggcugcagaugcaccacguugcccagguccuucgggaauugcugggggauuuuacacaaccucucuacccccgcccaagacauaaugacaggcugcgucuucuguugcccgugccucacgugaaacucaacguccagggaguuucucugcggucauuauauaagcgaaguagcggccaugugaccuucacuauggauccaaucagagaccugcuaauuugggcaauagugcagaauaggcgcgagcucgccgguaucauuugggcucaaucccaggauuguaucgcggcagcccuggcuugcucuaagauccuuaaagaauugucgaaggaggaagaggacacggauagcuccgaggaaaugcuggcccucgcagaggaauacgagcaccgggccauugggguauuuacagaauguuauagaaaagacgaggagagggcucagaagcuguuaacccgcgucucagaagccuggggcaaaacuaccugccugcagcuugcauuggaggcgaaggauaugaaguucgugagucacggaggcauacaggcuuuucucacaaaaguuuggugggggcagcugucuguggacaacggacuauggcgagucacccugugcaugcucgccuucccgcugcuuuugacuggucugaucagcuuccgggaaaagcguuuacaggaugugggcacacccgcagccagagcuagggccuuuuucacggcaccuguugugguauuucaucucaauauucuguccuacuucgcuuuucuuugucuguucgccuaugucuugaugguggacuuucagccagugcccucauggugcgagugugcgaucuaccucuggcuguucagccuagucugcgaagagaugcgccaacuguuuuaugauccugacgagugugggcucaugaaaaaggccgcucuguacuucucugacuuuuggaacaaacuugauguuggagcaauuuugcuguucguggccggcuuaaccugccggcucaucccagcuacucuguaccccgguagaguaauacuuucccuggacuuuauccuauucugucucaggcugaugcacauuuucacaaucaguaagaccuuggggccgaaaauuaucauagugaagcgaaugaugaaggaugucuuuuucuuucuguucuuacucgccguguggguugugagcuuuggcgucgcaaaacaggcgauucugauccauaaugaacgccggguggacuggcuuuucagaggagccguuuaucacucuuaccugacaauuuuuggccagaucccuggguauauagauggagugaacuucaauccagagcauugcucccccaacggcacugacccuuacaagcccaaauguccagaaucagaugcuacccagcaaaggccugccuuucccgagugguugacgguccuccugcuaugccuguaucuucucuucaccaauauccuguugcugaacuuacucauugcaauguuuaauuacacauuccagcagguacaagagcacacugaccagaucuggaaguuccagcgucacgaucugauugaagaguaucauggucgcccagcugccccgccucccuuuauccuucugagucacuugcaacucuucauaaaacgggugguucugaagaccccagcaaagagacauaaacaacuaaagaacaaacuggaaaagaaugaggaagccgcgcuucucagcugggagauuuaccugaaagagaacuacuugcagaacaggcaguuucagcaaaagcagcgacccgaacagaagaucgaggacaucucgaauaaaguggaugcuauggucgacuuacuggaucucgacccucugaagcgguccgggucuauggaacagcgccuugccagccuggaggaacaaguggcacagacagcucaggccuugcacuggauuguaagaacucuaagggccucaggauucaguuccgaggcugacgugccaacccuggcaucucagaaagccgcggaggaacccgaugcugagccuggcggucggaagaaaacggaggaaccgggcgacagcuaucaugucaacgcccgacaccuccuguacccaaauugucccguuacaagauuuccugugccaaacgaaaaggugcccugggagaccgaguuccuuaucuaugauccuccguuuuacacugcagaacgcaaggacgccgcugcaauggaucccaugggggacacauuagagccacuguccaccauucaauauaaugucguggauggacucagggaccgucggucauuccacggcccuuacacuguucaggccggguugccccugaacccaaugggaagaaccggccucaggggucgcgggagccugaguugcuuuggaccuaaucauacacuuuaucccaugguaacgcgauggagacggaacgaagauggcgcgauaugcaggaaaucuaucaagaaaaugcuggagguguuggucgugaagcuaccacuguccgagcacugggcucucccggguggcagccgcgaaccuggggagauguuaccccguaaacugaagcggauucuuagacaggaacauuggccaucguucgagaaucugcucaaauguggaauggaaguuuacaagggcuacauggacgaucccaggaacaccgacaaugccuggaucgagacuguggcagucucagugcacuuucaagaccagaacgauguagaguugaaucgccugaacucuaaucuccacgccugcgacaguggggcuuccauucgauggcaggucguggauagacggaucccucuguaugccaaccauaagacacuucuacagaaagcagcugccgaguucggagcgcacuacuga

SEQ ID NO: 64263 - RNA, 5124 nt, Artificial Sequence
  derived and/or modified sequence opt3 from TRPM3__Homo_sapiens__NP_001007472
augcccgagccuuggggcaccguguacuuccuggggaucgcacaggucuuuagcuuccucuuuuccugguggaaccuugaaggaguuaugaaucaagcugacgcaccaagaccgcugaacuggacaauuagaaaguugugccacgccgcguucuuacccucugugcggcugcuaaaggcucagaagucauggauagagcgcgccuuuuauaaacgagaauguguacauaucauuccuaguacuaaggauccacaccguugcuguugcgguagacucaucggccagcauguggggcugacgcccagcauuuccguccuucagaaugagaaaaacgaaucuaggcugucgcggaaugacauccaaucagagaaguggagcauaaguaagcacacccaguuguccccuacagaugcauucggaacuaucgaguuucagggcggugggcauucuaacaaagccauguacgugcgcguuagcuucgacaccaagccagaucuccugcugcaccucaugacaaaagaauggcaguuagagcugcccaaacuuuugauuuccgugcacggaggccugcaaaauuuugaacuacagccuaaacucaagcaggucuucggcaaggggcugaucaaagcugcaaugaccacuggagccuggauuuuuacagguggcgugaacaccgggguaaucagacauguuggagacgcucuuaaggaucacgccucaaaaaguaggggcaagauauguacgauugguaucgcgccaugggggauuguggagaaucaggaggaccugaucggacgggaugucgugcgcccguaucaaacuaugagcaaccccaugucuaaauugaccgugcucaauuccaugcauucacacuucauccuggcagacaacggcacaacuggcaaguacggggccgaagucaaauuacgaagacagcuggagaagcacauuagccuccagaagauaaauaccaggaucggacaagguguuccugugguagcucuuauuguggaaggcgggccaaacgucaucaguauagugcuggaguauuugcgggauacacccccuguuccaguggucgugugcgacggaucuggccgugccuccgauauucuagcauuuggucauaaauacagcgaagaagggggccugaucaaugagucgcuccgcgaccagcugcuuguaaccauccagaagacguucacuuauacaagaacccaggcucaacaccuguucauuaucuugauggaauguaugaaaaagaaagagcucauuacuguuuuuaggaugggaucugaaggccaucaggacauagaucuggccaucuuaacagcgcugcuaaagggggccaacgcauccgcucccgaccagcucucacuggcccuugcuuggaaccggguggauauugcccgaagucagaucuucaucuacggacaacaguggccggucgguagcuuggagcaggcaaugcuggacgcccucgugcuggaucgcgucgacuuugugaaacuucugauugaaaauggcguuuccaugcacagauucuugaccauaucuaggcucgaggagcuguacaacacgcggcaugggccuagcaauaccuuauaucaccuggugcgcgaugucaaaaagggaaaccuacccccagacuacagaaucucacucauugauaucggccugguaauugaauaucuuauggguggggcuuacaggugcaauuauacacguaaacgguuucgaacuuuguaccacaaccuguucggcccuaagagacccaaagcgcucaagcuguuaggaauggaggacgauaucccacugaggcgcggccggaagaccacuaagaagagagaagaggaaguggacauagaccuugaugaccccgagaucaaucauuuuccuuucccauuucacgaguugaugguuugggcagugcucaugaaaaggcagaagauggcccuguucuuuuggcaacauggggaagaggcuauggccaaagcccuagucgccuguaagcugugcaaggcuauggcccacgaagcaagugagaacgauaugguggacgauauuucccaggagcucaaucacaacagccgcgacuucggacagcuggcgguagaacuuuuggaucagucuuauaaacaagacgagcagcuggcuaugaaguuacucacuuacgaacugaaaaauuggucaaacgccaccugucuucagcuggcaguggccgcuaagcaucgagauuuuaucgcccacacaugcagucaaauguugcucaccgacauguggaugggucggcugcguaugaggaagaauagcggccuaaagguuauucuggggauccuccugccgcccuccauacuuucuuuggaguucaaaaacaaggaugacaugccuuacaugucgcaggcacaggaaauucaucugcaggagaaggaggcugaggaaccagaaaaacccacuaaggagaaagaagaggaggauauggaauuaacggccaugcucggaaggaauaacggcgagagcucccgcaagaaagacgaagaggaaguccaaucaaagcaccggcugaucccucuugguagaaagauuuaugaguucuacaacgcgccaaucgugaaauuuugguucuauacacuggccuacauaggguaucuaaugcucuuuaauuacaucgugcuggucaagauggagagguggcccaguacccaggaauggauuguuaucucuuauauuuucacuuugggcaucgagaaaaugcgagaaauacugaugagcgagccgggaaaguuacuccagaaagugaagguguggcugcaggaguacuggaacguaaccgaccuuauugcuauccuguuguuuuccgucggcaugauccuccgccugcaagaucagccuuuccggucagacgggagagugauuuacugcguuaauaucauuuauugguacauaaggcuacuggauaucuuuggagugaacaaguaucuuggcccauacgucaugaugauugguaaaaugaugaucgacaugauguauuucgugauuaucaugcucguugugcugaugagcuuugggguagcacgucaggccauauuguuccccaaugaggagccuucuuggaagcuggcuaaaaacaucuuuuacaugcccuauuggaugauuuacggagaagucuucgccgaucagaucgacccaccuuguggccaaaaugagacacgcgaagaugguaagauuauccaguuacccccaugcaaaaccggcgcauggauagugccggcgauuauggccuguuaccuccugguggcuaacauccuucuggucaauuugcucaucgccguuuuuaacaauacuuucuucgaggugaaguccauuaguaaccagguauggaaguuucaacgguaucagcugauaaugacauuccaugagagaccugugcuacccccaccccugaucauuuuuagccacaugacgaugaucuuccagcaccuuugcuguagguggcgaaaacaugaaucugacccugaugagcgggacuacgggcucaagcuguuuauuaccgaugacgaauugaaaaagguccacgauuucgaggaacagugcaucgaggaguauuuucgcgaaaaagacgacagauucaauuccucaaacgaugagaggauacgggugacaagugaacgaguugagaauaugagcaugagauuagaagaggugaacgagcgcgaacauucgaugaaggcaucccugcaaacagucgacaucaggcucgcucagcuggaggaucuuauuggacguauggccaccgcacuggaacgguugacaggccuagagagagccgagucuaacaaaaucaggagccgcacuucaagugacuguaccgaugcugcguacauugugcgacaguccucuuuuaauagccaggaagggaacacguucaagcugcaagaguccaucgacccagccggagaagagaccaugucacccacaagcccuacucucaugccgagaaugcggagucacucuuuuuauuccguuaauaugaaggauaaaggcgguauagaaaagcuggagagcauuuucaaagagaggucgcuuucauuacaucgcgcaaccucuagucacuccguggcuaaggaaccaaaagcccccgccgcuccugcaaacacacuggccaucgucccagacagccguagacccucuagcugcaucgauauuuacguauccgcgauggacgagcuccacugugauaucgacccuuuggacaauucagugaacauacuggggcucggagaaccgaguuucagcacucccguuccaucuaccgcuccuuccucaagugccuaugcaacgcuggcccccacagaucggccaccuagcagguccauugacuuugaggauaucaccucuauggacacucgcucguucagcucagauuacacacaucuucccgaaugccagaauccaugggacuccgagccgccuauguaccacaccauugagcgaaguaagucuagcagauaucuggcuacuacccccuuuuugcuagaagaggcaccaaucgugaagucccauucauucauguuuucucccagccggaguuacuaugccaacuucggcgucccugugaaaacagcggaauacacguccauaaccgauuguauugacacuaggugcguaaaugcuccacaggccaucgcagaucgcgccgcuuuucccgguggccugggggacaagguggaggaucucacaugcugucacccugaaagagaggccgaguuaagccacccgucuucagacuccgaagagaacgaagcaaaaggaaggcgggcuaccaucgccauuaguagccaggagggcgauaauucggagcguacacugucuaacaauaucacugucccaaagauugaacgcgcgaacuccuauagcgccgaggaacccucagcaccuuacgcucauacccgaaaaaguuucucuauauccgacaaacuugacagacaaaggaauacggccagccugcggaaccccuuucagcgcucaaagaguagcaaaccagaggggagaggagauucccucucuaugaggcgguugagccgaacauccgcuuuccagucauuugaaucuaagcacaacuga

SEQ ID NO: 64264 - RNA, 3210 nt, Artificial Sequence
  derived and/or modified sequence opt3 from TRPM4__Homo_sapiens__NP_001182156
auggugguccccgagaaggaacagagcuggaucccuaaaauuuucaagaaaaagaccugcacaacuuuuauaguugacuccacggauccaggcgggacccugugucaaugcggaagaccgaggacagcccaccccgcuguggcaauggaggacgccuucggugcggcuguagugacugucugggauucugacgcccauaccacagaaaaaccuaccgaugcauacggcgagcucgacuuuacuggggccggacggaagcacucaaacuuccuucgccugagugaucgaacagacccagcugcaguguauagcuugguuacccguacguggggcuuuagagcccccaauuuaguggucuccgugcugggugggucuggaggcccuguacuacagacuuggcuccaggaucugcuuaggcggggccugguucgcgcugcccagucgaccggggcguggaucgugacaggagguuugcauacuggcauugggagacacgucggaguggcagugagggaccaucaaauggccucaaccggcgguacaaaggucguugcuauggggguggccccauggggaguagugcggaaccgcgauacccucaucaaucccaaaggcagcuucccugcacgauacagauggaggggcgacccagaagaugggguccaguuuccgcuggacuauaacuacagugcuuucuuucugguggacgauggaacgcacgguugucucggcggggagaaucgguuccguuuacgccuggaguccuauauuucucagcagaagacuggaguuggcgguacagggaucgacauacccgugcuuuugcugcuaaucgauggcgacgaaaagaugcucaccagaauugagaacgccacucaagcgcagcugccuugccuucuggucgccggaagcggcggggcagcugauuguuuggccgaaacacucgaggacacccuggcuccaggauccgguggcgccaggcagggggaggcacgggaucgaauccgcagauuuuuccccaagggagacuuagaagugcugcaggcccaaguagagaggauuaugacgcggaaagaacuccuuaccguuuacucaagugaggauggcagcgaagaguuugagacaaucgugcugaaggcuuuggucaaggcgugcgguucuuccgaagcaucagccuaucuagacgagcugcgccucgcuguggccuggaauagagucgauauagcacagagcgaacuguuccguggggacauucaguggaggaguuuccaccuugaggccucucugauggacgcuuugcucaacgaucggccugaauuugugcgacuguuaaucucccauggccugagccuaggacacuuccucacuccaaugagacuggcccaacuuuacucggcagcgcccucuaauuccuugauuaggaaccugcucgaccaggcuucacauagugccggcaccaaagcaccggcccugaaagggggagcugccgagcuucgcccucccgauguuggucacgugcugcggauguugcucggcaaaaugugugcaccaagauacccuagcgggggagcuugggacccccacccaggccaggguuuuggggaguccauguaucuguuaucugauaaggccacaagcccccugucacuagacgcgggccucggacaggccccuuggagugaucugcuuuugugggcucugcuccugaauagggcacaaauggccauguacuucugggaaaugggcuccaacgcuguaagcucugccuuaggggcaugccugcuuuugcgcgucauggcgcgacucgagccagacgccgaagaggcugcccggcguaaagaucuggcauuuaaguucgaaggaaugggcguggaccuauuuggugaguguuauagaucaagugagguuagggcugcccgccugcuccugcggagaugcccgcuuuggggagaugcaacuuguuugcagcuggccaugcaggcugacgcgagggccuucuuugcacaggauggggugcagagcuuacucacccaaaaaugguggggcgacauggcuuccacaacccccaucugggcccugguccuugccuucuuuugcccuccacugaucuacacucgauugauuacguuccgcaagucugaagaggaacccacacgggaggagcucgaauuugacauggauucggugauaaauggugagggcccuguagggcugaccccaggacuauaucaucugggcagaacugugcucugcaucgacuucaugguuuucaccgucaggcugcuucacauuuuuacagugaacaagcaguuggggcccaaaaucgugauagucagcaagaugaugaaagauguuuucuuuuuccuguuuuucuuaggaguguggcucguggcuuacggcguagcaaccgaaggucugcuucguccgcgcgacuccgauuuuccuucaauucugcggagagucuucuauaggccauaccuacagaucuuugggcaaaucccccaggaggacauggauguggcccucauggaacauaguaauuguucuagcgagccuggauucugggcgcaucccccaggcgcucaggccgguacuugcguuucccaguacgcaaacuggcugguggucuugcuguuagugauuuuucuccugguugccaacauccuucuggugaauuugcucauugcuauguucucauauacauuuggcaagguacaagggaacagcgaccuguacuggaaagcacagcgauaucggcuaauacgcgaguuccacucuagaccugcccuggcgcccccauucaucgucauuucccaccuuaggcuccuguugcggcagcugugucgaagaccgcgcaguccucaacccagcucuccagcuuuagaacacuuuaggguguaccucuccaaggaggccgaacguaagcugcuuacgugggagucagugcauaaagaaaauuuccuguuggcacgggccagagauaagagggagagugacagcgagcgccucaaacgaaccucgcagaaggucgaucuggcucuaaaacagcugggacacaucagagaauaugagcagcggcuuaagguucucgaaagggaggugcaacagugcucccgcguacugggcuggguggccgaagcauugucucguagcgcuuuacugcccccugggggaccacccccuccggaccucccaggcucaaaggauuga

SEQ ID NO: 64265 - RNA, 3498 nt, Artificial Sequence
  derived and/or modified sequence opt3 from TRPM5__Homo_sapiens__NP_055370
augcaggacgugcaaggccccagaccugggagcccaggagaugccgaggacaggcgggaacugggucuccaccgcggcgaggucaacuucgggggauccggcaagaaacgagguaaguuuguucgugugccgucugggguagcucccucagugcuuuucgaucuguuguuagcagaauggcaucugccugccccaaaucuagucgugagucucguuggagaggaacagcccuuugcgaugaaaagcuggcugagagacgugcuuaggaagggccuggucaaagcugcccaguccaccggcgcauggaucuugacaucugcccuccggguggggcuggcucgccacguaggacaggcaguuagagaucauucgcuggccucaacuagcacgaaggugagggucguggcuguggguauggccagucucggccgggucuuacaccgccgaauacuggaggaggcgcaagaagacuucccuguucauuacccagaggaugacgggggaucccagggcccccuuugcucuuuggauagcaaccugucccacuuuauucuaguggaaccugguccaccggggaagggagacggccucaccgagcugagacuuaggcuggagaaacacaucucagaacagcgggcaggcuaugggggaacagguaguauugagauccccguauugugucuccuggugaauggcgauccuaacacuuuagaacguauuagccgcgccgucgagcaggcugccccauggcugauccucguggggucuggaggcauagcagacguucuugcugcccuggugaaucaaccccauuugcuagucccuaagguggcggaaaaacaguucaaggagaaauuuccauccaagcacuucucaugggaggauaucguaagauggaccaagcugcuccagaacauuacaagccaucagcaucugcuuaccguuuacgacuuugaacaagaggguagugaagaacuggacacugugaucuugaaagcccucgucaaggcaugcaaaucucacucccaggaaccccaggauuaucuggacgaguuaaagcuggcuguggccugggauagggucgacauugcuaaaagcgagaucuucaauggggauguggaauggaagucgugugaccuagaggaaguuaugguggaugcccucguaucuaacaaaccggaguuuguccggcuguucguggacaauggcgcagauguugccgacuuucuuacauacggacgauugcaagaacuguaucgcuccgugucaagaaagagucuccuguucgaucuucugcagaggaagcaggaggaggcucgguugacccucgcgggccuggggacgcagcaagcacgcgaaccucccgccggacccccugcuuucagcuuacacgaggucuccagagugcugaaagacuuucuacaggacgccugcagggguuucuaccaggauggccgucccggggaccggagacgagcagaaaagggaccagccaaaaggcccacuggccagaaguggcuccuggaucuuaaccaaaaaucugagaauccuuggcgcgacuuguuucugugggcuguacuccagaaccggcacgagauggccaccuauuucugggcaaugggucaggaagggguggcggcugcccuggcagccuguaagauauuaaaggagaugagccaucuggaaacagaggcugaagccgcaagagcuacuagggaggccaaauacgagcgccuugcguuggaucucuuuucagaaugcuacaguaauuccgaggcccgagcuuucgcacugcuaguucggcguaacagauguuggagcaagaccacaugccugcaccucgccaccgaagcugacgccaaagcauuuuucgcgcaugauggcguccaggccuuucugacgaggauuugguggggagacauggcugccggcacuccaauccuucgcuugcugggggcauucuuauguccggcucucguguauacaaaucugauuaccuuuucugaggaagccccacuucggacuggacuggaggauuugcaagaccucgauucacuggacacagagaagaguccucuauacggucugcagagcagaguggaggagcucgucgaagcaccaagggcccagggcgaucgagggccccgcgcuguuuuccugcuuacccgguggagaaaauuuuggggagcgccugugacgguguucuugggcaacguagucauguauuucgccuuucuguucuuauuuaccuacgugcuccugguugacuucaggccacccccgcaggguccuuccgggccagaggugacacuuuauuuuugggucuucacucuggugcuagaagagauccgucaaggcuuuuucaccgacgaggauacacaccucguuaagaaguuuacucuguacgugggagacaacuggaauaaaugcgauaugguagcaaucuucuuguuuauugucggcgugaccugucgcaugcugcccucugcuuucgaagccgggcggacaguguuagccauggacuuuauggucuucacccucagacugauacacaucuucgcuauucauaagcagcuuggaccuaaaaucauaguuguggagaggaugaugaaggauguauuuuucuuucuguucuuuuugucgguguggcucgucgcauauggcgugacuacgcaggcccugcuacacccccaugacggucgacuggaauggauuuuccggcgcguucuuuacagaccauaccuccaaaucuuugggcagaucccucuggaugagauugacgaggcgagggugaacugcagcacacaccccuugcuguuagaagauuccccaucaugcccgagucucuaugcuaauuggcuggucauccuucuguuggugaccuuccuccugguuacuaacgugcuacugaugaaucuucucauugccauguuuucuuacaccuuccaggucguacagggaaacgcagacauguuuuggaaauuccaacgguauaaucugauaguggaguaccacgaacgaccugccuuggcucccccauucaucuuacugagccaucucucccugacacuuagacgcguuuuuaagaaggaggcagaacacaaaagggagcaucuggagcgugauuugcccgacccucuagaucagaagguggucaccugggaaacugugcagaaagagaacuuccugucaaagauggaaaaacggagaagggacagcgagggcgaaguacuccgcaagacagcccaccgaguggacuuuauugcgaaauaucuggguggccuuagagagcaggagaagcggaucaaguguuuagaaucucaaaucaauuacugcuccguccugguuaguagcguggcugaugugcucgcccaagggggaggcccaaggucuucccagcauuguggggagggaucacaguuggucgcagccgaccaccgcggcggucuggaugggugggaacagcccggagcuggccagccuccgagugacacguga

SEQ ID NO: 64266 - RNA, 6054 nt, Artificial Sequence
  derived and/or modified sequence opt3 from TRPM6__Homo_sapiens__NP_001170781
augaucauucugagcaaaucccagaaaucuuggauaaagggcguguucgacaaaagagagugcucaacaaucauucccaguagcaagaacccucacagguguacaccagucugccaaguuugucagaaucucauccggugcuacugugggcgccuuauuggagaucaugccgguaucgacuauuccuggacuauaucugcugcaaaaggcaaggaaucggagcaguggucaguggaaaagcacacgaccaaaagcccgacagauacuuuugggaccaucaacuuccaggacggagagcauacacaccaugccaaguacauucgaaccaguuaugauacuaaacuggaccacuuguuacaccugaugcugaaggaauggaaaauggagcuccccaagcugguuaucuccgugcauggcgguauucaaaauuuuacaaugccuucuaaguucaaagagaucuuuagccaggggcuugucaaggcggcugaaaccacgggagccuggauaauuacugagggcaucaacaccggcguguccaaacacguuggggaugcacugaagucacauaguagccacucuuugcguaaaauuuggacagugggaaucccacccuggggugucaucgaaaaucagagagaccucauuggcaaggaugugguaugccuguaccagacucuggacaacccucucuccaaauuaaccacacuaaauucaaugcacagccauuucauacuuagugaugacgggaccguuggaaaguauggcaacgagaugaaguugaggcggaaucuggagaaauaccuaucucuccaaaagauccacugucgcuccagacagggugugccagucguggggcugguggucgaaggaggccccaacguuauucuuagcgugugggagacgguaaaagauaaggacccuguggucgugugcgaaggcacugggagggccgcugaccuguuggcauuuacacauaaacaccucgccgaugagggaaugcugcggccacagguuaaggaagagaucauauguaugauucagaauaccuucaacuuuucguuaaagcaaucuaaacaucuguuccagauccucauggagugcauggugcaccgcgacuguaucacuauuuuugaugcugacuccgaagaacagcaagaucuugaccuggccaucuugacagcgcuacugaaggguaccaaucucucagcaagugaacagcugaaccuugccauggcuugggaucgagucgacauugccaaaaagcacauacugaucuaugagcagcauuggaaaccggaugcauuggaacaggcuaugagcgacgcccucgugauggauagaguagacuucguuaagcuguuaauugaguacggcgugaaucugcacagguuucuaacgaucccccggcucgaggaacuguacaacaccaagcaagggccuacaaacacucuuuugcaucaccugguccaggacgugaaacagcacacccuccuguccggauaucguaucacacuuauugauauaggccuggucguggaguacuugaucggucgcgcguauagaucuaauuacacuaggaagcauuuccgggcccucuauaacaaucuguaccgaaaauauaagcaccagcgccauagcucagggaacagaaaugaaagugcagaguccaccuuacacagccaauucauuaggacagcucagccauacaaauuuaaggaaaagucuaucguucugcauaaaucacggaagaaaaguaaggagcagaacgugagcgacgaucccgaguccaccggcuuccuauacccuuauaaugaccuccugguaugggccguccuuaugaaacgccagaagauggcuauguuuuucuggcaacacggagaagaggccacugugaaagcaguuauugccugcaucuuguacagagcuauggcgcacgaagcaaaggagucucauaugguggaugacgccucggaggaacugaagaacuauagcaaacaguuuggccagcucgcucuggauuuacuggagaaggccuucaaacagaaugaaaggauggcaaugacgcuuuugacauacgagcuccguaacugguccaauucaaccugccugaagcuagccgucagugggggacugcggccauuugugucucacacuuguacccaaaugcuccugacagacauguggaugggucgacuuaaaaugagaaagaacagcugguugaagauaaucauuuccaucauucugcccccgaccaucuuaacucucgaguucaaaucaaaggcugagaugagccauguaccucagucucaggauuuucaauucaugugguauuacuccgaccagaaugccaguagcucuaaagaguccgcaucagugaaggaauaugaucuggagaggggccacgacgaaaaacuugaugagaaccagcauuuugggcuggaaaguggacaccagcacuugcccuggacacgcaagguuuacgaguucuacagcgcgccaauagucaaguuuugguucuauacgauggcuuaccucgccuuccugaugcuauuuaccuauacugugcugguggagaugcaaccucagcccucgguccaggaauggcucguuuccauuuacaucuucacaaaugcaauugagguggugcgggaaaucugcauaucugagccaggcaaauuuacccagaagguaaaagucuggaucagcgaauauuggaaccugacagagacuguggccauuggucuuuucucagcuggguuuguuuugagauggggcgaucccccuuuccauaccgccggaaggcugaucuacuguauugacaucauauuuugguucagucgcuuacucgacuuuuucgcagugaaccaacacgcuggcccauaugucacgaugauugccaagaugaccgcgaauauguuuuacaucgugaucauuauggccaucguucugcuuuccuucgggguggcucgaaaagcaauucugucuccgaaggagcccccuagcuggucccuagcccgggacauaguauuugaaccauacuggaugaucuauggagaggucuacgcuggugaaauugaugugugcucaagccagcccaguuguccuccaggcucuuuccucacacccuuccugcaggccguguauuuguuuguccaguacaucauuaugguuaaccuguuaaucgcauucuuuaauaacguguaucucgacauggaguccauaagcaauaaccuguggaaguacaaucguuauagauacaucaugacuuaccaugagaaaccguggcuuccuccaccccugauuuugcucucgcacguagggcugcuacugaggcgccuuugcugucaccgggcgccucaugaucaagaagagggagacgugggccucaagcuguauuugucaaaagaagaucugaagaaauuacacgacuucgaggaacagugcgucgagaaguacuuucaugagaaaauggaagaugugaacuguucuugcgaggaaagaaucaggguuaccagugagcgagugacagaaauguauuuccagcucaaggagaugaaugagaaggucuccuuuauuaaagacagccugcuuucucuggauagccaagugggucacuugcaggaccucuccgcccugacuguugauacccuaaaggugcugucagcugucgacacgcuucaggaagacgaggcccuccuggcaaaacgcaagcauaguacauguaaaaaguugccccacagcuggucuaacguaaucugcgcugaaguguuaggguccauggagauagccggcgaaaagaaauaccaguauuacucaaugccaaguagccugcuccggucccuggcaggaggcagacacccucccaggguucaacguggggcccuucuggagauuaccaauucuaagcgcgaggcuacuaacgugcggaaugaucaggaaagacaggagacacagucgagcaucgucgugucaggaguauccccaaacaggcaagcgcauaguaaauauggccaguucuugcuagugccgucuaaucugaagcgagucccuuuuagcgccgaaaccguucucccccugucccggccaucagugcccgacgugcuugcaacugagcaggauauccagaccgaggucuuagugcaccugacaggucaaacgccuguuguaucugacugggcuagcguggaugaaccaaaagagaagcaugaacccauugcccaccucuuggacgggcaggauaaggccgagcagguccugccuacccucaguugcacuccggaaccaaugacaauguccagcccccugucucaggcuaaaauaaugcaaaccggaggcgguuacgugaacugggcauucucagagggcgacgagacagggguauuuuccaucaagaaaaaguggcagacuugucuuccuaguaccugcgauagcgacucgucucgcuccgaacagcaccaaaaacaggcccaggauagcucacugagugacaacucuacgagauccgcgcagagcucagaguguagugaagugggaccaugguugcaacccaauaccagcuucuggauuaacccucuaaggcgguaccgaccguucgcuagaucccauucuuuucgcuuccacaaggaggaaaagcugaugaaaaucugcaagauuaaaaaucucagcggcuccucagagaucgggcagggagccugggucaaggcaaaaauguuaaccaaggacaggcgucugucuaagaaaaagaaaaacacucagggccuucaggugcccauaaucaccguaaaugccuguagucaaucggaucagcugaacccagagccuggugaaaauagcauuuccgaggaagaguauucuaagaacugguuuacagucucaaaauucagccauacugggguggaacccuacauccaccagaagaugaaaaccaaggagauuggacagugcgcuauccaaauauccgacuaucucaagcagagucaggaggauuugucuaaaaauagccuguggaacucacgguccacaaaucucaacagaaauagucugcuuaagagcucuauuggcguugacaaaaucuccgcaucacuaaagagcccacaagaaccucaucaccacuacucggccaucgagaggaacaaucugaugcgcuugucucagacgauucccuuuaccccagugcaguuauucgcgggugaagagaucacugucuaucgacuggaggaaaguuccccgcucaaccuggauaaaagcaugucauccuggucucagagaggccgggcugccaugauacaagugcuuagcagggaggaaauggacgggggacugcgcaaggcaaugcguguugugaguacaugguccgaggaugacauucucaagccuggccaggucuuuaucguaaagagcuucuugcccgaaguggugagaaccuggcauaagauuuuucaggagucuacuguucugcaccuaugucugcgggagauccagcaacagagggccgcucagaaacucauauacacauucaaccaggucaagccacaaaccauucccuauacgccucgcuuucuugaaguguuccugaucuacugccauucagccaaucagugguuaacuaucgagaaauacaugaccggggaauuucgaaaguauaacaauaacaauggagaugagauuacaccaaccaacacuuuggaggaacugaugcucgcauucagucacuggacauacgaguauaccagaggcgaacugcuugugcuggaccuccagggugucggggagaauuugacagaucccuccguaaucaagccugaagugaaacagagccggggaaugguuuucggcccggcuaaccugggugaggacgccauuaggaauuuuauagcgaagcaccauuguaacucuugcugucgcaaauuaaagcuaccagaucugaaaagaaaugacuacucgcccgaaaggaucaacucaacuuucggccucgagauuaagaucgagagcgccgaggaaccucccgcacgggaaaccgggcguaauuccccagaggacgauaugcaacuuuga

SEQ ID NO: 64267 - RNA, 5598 nt, Artificial Sequence
  derived and/or modified sequence opt3 from TRPM7__Homo_sapiens__NP_060142
augagccagaaauccuggaucgagucuacccugacaaaaagggaaugcguguacauuauacccucaaguaaggacccucacaggugucucccaggcugccaaaucugucagcagcuuguccggugcuucugugggcgccugguuaaacagcaugccugcuuuacugcuagcuuggcaaugaaguauuccgaugugaaauuaggagaccacuucaaccaagccauugaggaauggucuguagagaagcauacggaacagucgccgaccgaugcguacggugugaucaauuuucagggcgggucacacagcuaucgagcuaaguacguccgucugaguuaugacacaaaacccgaggugauuuugcagcuccugcuuaaggaguggcaaauggaacugccuaaauugguuaucuccgugcauggaggcaugcagaaguucgagcuccacccaagaauaaaacagcugcuggguaaggggcucaucaaggccgcagucacuaccggagccuggauuuuaacaggcggcgugaacaccgggguagcuaaacacguuggagaugcacugaaggaacaugccucuaggagcucccggaaaaucuguacuauugguaucgcucccuggggcgugauagagaaucgcaacgaccuugucgggagagaugugguggccccuuaccagacauugcugaauccacuaucaaagcucaacguccugaauaaccuucacagucauuuuauucugguugacgauggaaccgugggcaaauauggugcggagguaagguugcggcgcgaacucgagaagacgaucaaucaacagagaauccacgcaagaauugggcagggagugcccgucguggcccugaucuucgaaggcggcccuaacguuauuuuaacugugcuggaguaccuccaagaaagcccaccgguccccgugguaguuugcgaggggaccggaagggcugccgaccuucuggcauacauacacaaacagacagaggaagguggcaauuugccugaugcugccgagccagacaucauuucuacuaucaagaagaccuuuaacuucgggcagaaugaagcgcuacaucuguuucagacacucauggaguguaugaaacggaaggaacugauaaccguguuccacauuggauccgaugagcaucaagacaucgacgucgccauccuuacggcacuguugaaaggcacuaacgcuucagccuuugaucagcucauucugacauuagcuugggaccguguggauaucgccaagaaucacgucuucguguauggucagcaguggcugguugggagccuagagcaagcaaugcucgacgcccuggugauggaucgcguagcuuuugucaaacuuuugauugaaaacggcgugaguaugcauaaguuccugaccauacccagacucgaggaacuguacaacacuaagcagggaccuacaaauccaaugcuuuuccaccugguuagggacgugaaacagggcaacuugcccccgggguauaagaucacccucauugauaucggacuggucaucgaguacuuaauggguggcacguaucggugcaccuacacacgaaaacgcuuuagacugauuuauaauucucuagggggaaacaauaggcgguccggccgcaacacuagcucgucuaccccucagcucagaaagucccacgaaucauucgguaauagggcggacaaaaaggagaagaugcgucauaaccacuuuauaaaaacagcacaacccuaccggccaaagaucgauacugugauggaggaagggaaaaagaaacgaaccaaggacgagauuguagauaucgacgacccugaaacaaagagauuccccuacccacugaaugagcuuuugauuugggccugucugaugaaaagacaggugauggcucgcuuucucuggcagcauggcgaggaaaguauggccaaggcacugguugccugcaaaaucuaucggagcauggcuuacgaggccaagcaguccgauuuagucgacgauaccucugaagaacugaaacaauauagcaacgacuucggacagcuugcaguggaauugcucgagcagucauuuagacaagaugagacuauggcgaugaagcugcuaacguacgaacugaaaaauuggaguaacuccacaugccucaagcuggcugugagcucuaggcuucgccccuucgucgcccacaccuguacucagauguugcugucagacauguggaugggccgauuaaauaugcggaagaacaguugguauaaaguuauacucagcauccuggugccuccagcaauucuucuguuggaguacaagaccaaagccgaaaugucccacaucccgcagucucaggaugcucaucaaaugacaauggacgauucggagaauaacuuucagaacauuaccgaagagauccccauggagguguucaaggaaguacguauacucgacagcaaugaggggaaaaacgaaauggagauucagaugaaguccaagaaacugccuaucacuagaaaguuuuaugccuucuaccacgcaccaauugucaaauuuugguucaauacacuagcuuaccugggauuccucaugcuguauacguuugugguucuugugcagauggaacaauugcccucaguccaggaguggaucgugauagccuacaucuucaccuaugcgauugagaagguuagggaaaucuuuaugagugaggccgguaaagugaaccagaagauuaagguaugguucucugauuacuuuaauaucagcgacacuauagcuauuaucuccuucuuuaucggcuucgggcugcgcuuuggagcaaaauggaacuucgccaaugcuuaugauaaccaugucuuuguggccggccgguuaauuuacugccucaauaucauuuucugguaugugagacugcuugacuuucuggcagucaaccagcaagcggguccuuacguuaugaugauagggaagaugguggccaauauguucuacaucguagugauuauggcucuaguccuccugucauucggcgugccaaggaaagccaucuuguauccccacgaagcaccgagcuggacacuggcuaaggacauuguuuuucauccuuacuggaugaucuucggagagguguaugccuacgagauagaugucugugcaaacgacucugugaucccacagauuugcggccccgggaccugguuaacaccuuuucuccaggccguuuaucuguucgugcaauacaucauuauggucaaucuucugaucgcauuuuucaacaauguauaucuacaggugaaagcgauauccaacauuguuuggaaguaccagcgauaccacuuuaucauggccuaucacgaaaagcccgugcucccaccuccccugaucauucuaagucauauagucagccuguucuguugcaucuguaaacgccggaagaaagauaagacuucugacggaccaaaacuuuuucucaccgaggaagaucagaagaaacugcacgacuucgaggaacaaugcguggagauguacuuuaacgagaaggaugacaaguuccauuccggcucagaagagagaauuaggguaacguucgaacguguggagcagauguguauccagauuaaagaagucggugaucgcguuaauuauaucaagcggaguuugcagagccuggacucgcaaauagggcacuuacaggaucucuccgcacugaccguggacacacuuaaaacucugaccgcucagaaggccucugaggccagcaaagugcauaacgagaucacaagagaauugucaauuaguaagcaccucgcucagaaucugaucgaugacggaccggucaggccuuccguguggaagaaacacggcguuguaaacacucuaucuagcucccugccccaaggugaccuugagucaaauaacccauuucauugcaauauucucaugaaggaugacaaagauccccaguguaacaucuucggccaggaccugccugcagugccacagcgaaaggaauuuaauuuccccgaggccgggagcaguucuggagcguuguuuccuuccgcugucagcccgccagaauuacggcaacgccugcacggcguggagcuccugaaaauauucaacaagaaucagaaacuugggucgucaucuaccaguauuccccaucuguccagcccuccaacgaaauuuuucguuucuacacccagccagccuuccugcaagucacacuuggagaccggaacuaaagaucaagaaacagugugcaguaaggccaccgagggcgacaacacugaauuuggugcauucgucgggcacagagauagcauggaccuacagagguuuaaagagaccucuaauaagaucaagauccuguccaacaauaacacaucagagaacacgcucaaacgggugaguagccuggccggauucaccgauugucaucgaacuuccauuccgguacacucuaagcaggcugagaagaucucgagacgccccagcacagaggacacccaugaagucgauucaaaggcagcccuuauaccagacugguuacaggacaggccuuccaaucgugagaugcccagugaagagggcacacugaacggucucacuucuccauuuaaaccugcgauggauaccaauuacuauuacagcgcuguggagcggaacaauuugaugagacugucccaaucaauucccuucacgccaguuccgccuaggggcgaacccgugacagucuaucgccucgaggaaucuagcccaaacauccugaauaacaguauguccagcuggucucagcuugggcugugcgccaagauugaguucuugucaaaggaagagaugggaggcgggcuacgacgagcugugaaaguucaguguaccugguccgagcacgacauccugaagaguggacaucucuacauaauuaagagcuuuuuacccgaaguggucaauacuuggucgucuaucuacaaggaggauaccgugcugcaccuuugccugcgggaaauccagcaacagagggccgcucagaaacucacauucgccuuuaaccagaugaagccuaaauccauuccauauagcccccgcuucuuggagguauuucugcucuacugucacucagcaggccaaugguucgcuguggaagagugcaugacuggugaguuucguaaguauaauaacaauaacggggacgaaaucauuccuaccaauacacuggaggaaauaaugcuugccuucagucauuggacguacgaguauaccagaggagagcuacugguuuuggauuuacagggcgucggugaaaaccugacugacccgucugugaucaaggcggaggaaaaacgguccugugauaugguguuuggcccagccaaucucggggaggacgcaauuaagaacuucagggcuaaacaccauugcaacagcuguugccgcaagcugaaacuucccgaucugaagcgaaaugacuacacaccugauaagaucaucuuuccccaggacgaaccaucagaucucaacuugcaaccuggaaauaguaccaaagagagcgaguccacuaacucugucagacugaugcuauga

SEQ ID NO: 64268 - RNA, 3315 nt, Artificial Sequence
  derived and/or modified sequence opt3 from TRPM8__Homo_sapiens__NP_076985
augagcuucagagccgcuaggcuguccaugcggaaccgccgaaaugacacccucgauucuacacguacucuuuacucaagugcaagcagauccacggaccugucuuauucggagucagauuuggugaacuuuauccaggccaauuucaagaaaagggaaugcgucuuuuucaccaaggacagcaaagcgacagagaacguuuguaagugcggcuacgcucaaagucagcacauggaagggacucagauuaaucaguccgagaaauggaacuauaagaagcauaccaaagaauuucccacagaugccuucggagacauacaauuugagaccuuagguaagaaaggcaaguacauccggcugucuugugauacugacgcagagauucuauaugaacuccugacacagcacuggcaucuuaaaaccccuaaucuggugaucagcguaacugggggagccaagaacuucgcuuugaagccacgcaugagaaaaaucuuuuccaggcucauuuacauagcacagucaaagggcgccuggauccugacgggugggacccacuauggacugaugaaauacauuggcgaggugguccgggauaauacaaucagucgcagcucugaagagaacauuguggcuaucggcauagccgcgugggggaugguuuccaaucgagacacucucauuagaaacugcgaugcagagggauacuucuuagcccaguaucugauggacgauuuuaccagggacccgcuuuacaucuuggacaauaaccauacacaccuucuacucguggauaaugguugucacggccaucccaccgucgaagcuaagcugcggaaccaacuugagaaauauauuucagaacguacgauccaggacagcaacuacgggggaaagaucccuauugugugcuucgcccagggcggugggaaagagacucugaaggcaauaaauacaaguaucaagaacaaaauuccauguguaguuguggaaggaucuggccagaucgcugaugucauagccuccuugguggagguggaggacgcgcucaccagcucggccgucaaggaaaaacugguucgcuuuuuacccagaacugugucuaggcugccugaggaagagacagaauccuggauuaaguggcucaaagagauccuugagugcucacaccuguugaccguaaucaagauggaagaggcaggcgaugaaauugugaguaaugcuaucagcuaugcccuauacaaggcuuucuccacgucugagcaagacaaagauaacuggaaugggcagcugaagcuccugcuugaauggaaccagcuggacuuggccaaugaugagauuuucaccaacgaccggcgaugggagagcgcagaucuccaagaagucauguuuacagcccugauaaaagaccgcccaaaguucgugagauuauuucuggagaauggacuaaaccucaggaaauuccugacucaugacguucuuaccgaauuguuuucaaaucacuucaguacacugguguaucggaaccuccagaucgcuaaaaauuccuacaacgaugcgcugcuuacuuuugucuggaagcugguggcaaauuuccgcagagguuuuaggaaggaggaccguaacggccgggaugagauggacauugaauugcacgauguaagccccaucacccgacauccucuccaggcccuguucaucugggcuauuuuacagaacaagaaagagcugucuaagguuauaugggaacaaacaagaggguguacccuagccgcacucggagccucaaaacugcuuaagacuuuggcuaaggugaaaaaugacaucaacgccgcaggcgagagugaggaacuggcgaaugaguacgaaacgagggcugucgagcucuuuacagaaugcuauagcuccgaugaggaccuggccgaacaguuacugguguacucuugugaggcauggggugggucgaacugccuugaguuggccgucgaagcuaccgaucagcacuucauugcccagccaggcgugcaaaauuuucucagcaagcagugguauggagagaucucccgcgacacuaaaaacuggaagauuauccugugccuauucauaaucccgcugguuggcuguggguucgugucauuucggaaaaagcccguagauaaacauaagaagcuccugugguacuaugucgcauucuuuaccaguccuuucgugguguuuucuuggaauguugucuucuacauugcuuuucuuuugcuguucgccuauguguuacucauggacuuucacagcguaccacaucccccugaacuggugcuuuacucccugguuuucgucuuguuuugcgaugaggugagacagugguacgugaacggagucaauuauuucacagaccucuggaacguuauggacacccugggucuauuuuacuucaucgcgggcauuguguucaggcugcacucaagcaauaaaucuucccucuauagugggcgcgugaucuuuugucuggauuacauaauuuucacucuucgauugauccacauuuuuacaguaagccggaaccugggaccaaagaucauaauguuacagcguaugcucaucgacgucuucuuuuuccuguuucuuuucgccguguggaugguugcuuuuggcguggcaagacaagguauucugaggcagaaugaacagcgcuggcgguggaucuucagaucugucauuuaugagcccuaccuagccauguuuggccaggugccguccgauguugacgggacgaccuaugauuucgcucauugcacuuucacaggaaacgagucaaaaccucucuguguggaacuggacgagcacaauuugcccagguuuccagaauggaucaccauaccucugguaugcauuuacauguuaaguacaaacauccuccuggucaaccuucugguggccauguucggcuacacuguggggaccguccaagagaauaacgaucagguuuggaaguuucagcgauauuucuuggugcaagaguacuguagccgccucaauauccccuuuccauucauuguauuugcauauuucuacaugguggucaaaaagugcuuuaaguguugcuguaaagaaaagaacauggagucguccgugugcugcuucaaaaaugaagacaacgagacgcuggcgugggaaggaguuaugaaggagaauuaucuagugaaaaucaacaccaaggccaaugauacaucugaggaaaugcggcauagauuuaggcagcuggacacuaagcugaacgaucucaaaggucuguugaaggagauugcuaauaaaauaaaguga

SEQ ID NO: 64269 - RNA, 3858 nt, Artificial Sequence
  derived and/or modified sequence opt3 from TRPS1__Homo_sapiens__NP_001269831
augcagagcaacauggugagaaagaaaaaucccccucugaggaacgucgccuccgagggcgaagggcaaauccucgagccaauuggaaccgaaucuaagguuucagguaaaaauaaggaguucagugcugaccagaugagcgaaaacacagaucaguccgacgcagccgagcuuaaucacaaagaggaacauucucugcacgugcaggauccgucgucaagcaguaagaaggacuugaaauccgcgguauuaucugagaaggcuggcuuuaacuacgaaagccccuccaaagggggaaauuucccuucauuuccacaugaugaggugacugaccggaacaugcuggccuucaguagccccgcagccggcggugucugcgagccucuaaagucuccacaacgcgcugaagcagaugacccccaggauauggccuguacgccuuccggggacucacucgagaccaaagaagaucagaagaugagcccaaaggcuacagaggaaacuggacaggcccaaaguggccaggcgaauugccagggccugucuccgguguccguugcaagcaaaaacccccaggugccuucggacgggggaguccgacuuaauaagucuaaaaccgaucuguuggugaacgacaauccagaccccgccccucucuccccagagcugcaagauuuuaaguguaacauaugcgguuauggcuacuaugggaaugaccccacagaucugaucaaacacuuccguaaguaccaucucggauuacacaacagaaccaggcaggacgcugagcuggauucaaaaauucuugccuugcacaacaugguacaguuuagucauagcaaggacuuccaaaagguuaaucgguccguguuuucuggcguccugcaggauaucaacagcucacgcccggugcuacucaaugguacuuaugacgugcaggucacaagugggggaaccuucauuggcaucggcagaaaaacgccugauugucaggggaacacuaaguacuuuaggugcaaauucuguaauuuuaccuauaugggaaacuccagcacagaacuggagcaacacuuccuucagacucaucccaauaagauaaaagcaucucugccaucaagugaaguugcuaagccuagcgagaagaacuccaauaaaucuauccccgccuugcagucgagcgacuccggugaucucggcaaguggcaggacaaaauuaccgugaaggcgggggacgauacaccaguaggauacucagugcccaucaaaccucuggacaguucucggcaaaacggcaccgaagccacgagcuacuauuggugcaaguucuguuccuuuucaugcgagucuagcuccaguuuaaagcugcucgagcacuacgguaaacagcacggggcaguccagagcggcggacuuaauccagaacugaacgauaaguugucucgcggcuccgugauuaaucagaacgaccuagcuaaaucaagugagggggaaacuaugacaaagaccgauaaaagcucguccggagccaagaagaaagacuucucuagcaagggugcugaggauaauaugguuacuucauauaacugucaauuuugcgacuuccgauacaguaaaucccauggcccggaugugaucgucguggggccccugcucagacacuaucagcagcugcauaacauacacaagugcacaauuaaacauuguccuuuuugcccaaggggacuuuguucucccgaaaagcaccugggcgagaucaccuacccuuucgccugccggaaaagcaauuguucccacugcgcauugcuccuguuacaucugucaccaggugccgcugggagcagucguguaaagcaccagugucaucaaugcucuuuuacgacccccgacguugaugugcuacucuuccacuaugaguccguccacgaaagccaggcgucggacgugaagcaggaggcaaaccaucugcaaggcucagauggacagcagucugucaaagaaaguaaggagcacuccuguacaaaaugcgacuuuauuacucagguggaggaagagaucagccgccauuacagaagggcccacucuuguuacaagugccggcaaugcagcuucaccgcugccgacacacagucccuuuuggaacauuuuaauacuguucacugucaggagcaggauaucaccacagcaaacggcgaagaggacgggcacgccauuucaaccauaaaagaggaaccgaagaucgauuuccgaguguauaaucugcucacuccugacaguaagaugggagagccaguaagcgaaucugucgugaaacgcgagaagcuggaagagaaagauggucuuaaggagaaaguuuggacggaauccucaagugacgaucugagaaacgugacauggaggggcgcugacauuuugcgggggagccccuccuacacccaagccucucucggacuguuaacuccugucucgggcacccaggagcagacaaagacccugcgcgauagccccaauguggaagcagcgcaucuagcuagaccaaucuauggucucgccguagagacuaagggguuucugcagggcgcuccugccggaggcgaaaaaucaggggcacuuccccaacaguacccagccuccggagagaacaagaguaaagacgagucucagagcuugcugaggcgucggcgaggcuccgguguguucugcgcaaauugucucacaacgaagaccucacuguggaggaaaaacgcuaaugggggauauguuugcaacgccuguggcuuauaccaaaagcugcacucuacuccgagaccucuuaauauaauuaagcagaacaauggugaacagaucauccgccggagaacaaggaaacgcuugaaccccgaggcgcuccaggccgaacaacugaacaagcagcagcgaggcagcaaugaggagcaggucaacgggaguccacuagaacggcguuccgaggaucaucugaccgaaagccaccaaagagagauuccccucccuucucugucaaaauaugaagcucagggaucccuuacaaagagucauagcgcacagcagccaguguuggugucgcaaacucuggacauccacaaaaggaugcagcccuuacacauucagauaaagucuccucaggaguccaccggcgauccggggaauagcucaagugucucugagggaaaaggcuccagcgaacgcgguucaccaaucgagaaguacaugcggcccgccaagcauccuaacuacaguccacccgggagcccuauugaaaaauaucaauacccccucuucggacugccguuuguucacaaugacuuccaguccgaggcugacuggcuuagauuuuggucuaaguauaaacugagcgugccaggcaacccucauuacuugucccacgugcccggucucccaaauccuugccagaacuauguacccuacccaacguucaaucugccgccucacuuuucagccgucggcucugauaacgacaucccccuagaucuggcaaucaagcauaguaggccagggcccaccgcgaauggagccucgaaagaaaagacaaaggcuccuccaaacgugaaaaaugagggcccccucaacguugugaagacugagaaagucgaccgaagcacccaagaugaacuguccacaaagugugugcacugcgggauuguuuuccuugacgaggugauguaugccuugcauaugucuugucacggagauucaggcccuuuucagugcagcauaugucagcaucugugcacugacaaauacgauuucaccacgcacauccagcgcgguuuacaccggaauaacgcacaaguagaaaagaacgggaagccgaaagaguga

SEQ ID NO: 64270 - RNA, 2520 nt, Artificial Sequence
  derived and/or modified sequence opt3 from TRPV1__Homo_sapiens__NP_542437
augaagaaauggagcuccaccgaccugggcgccgcugcagauccccuccagaaggacacaugcccugauccacuugacggggauccgaacucuagacccccuccagccaaaccccaacugucaacugcgaagaguaggacgcgguuguucggaaaaggugacagcgaggaggcuuuuccuguggauuguccacacgaagaaggcgaguuagacuccugccccaccaucacagucucuccuguuauuacuauacagcgcccaggggauggaccgaccggcgcccgacugcuaucgcaggacucaguggcagccagcacagaaaagacccuccgucuguacgauagaaggaguaucuucgaggcuguagcacagaauaacugucaagaccuugagucccuguugcucuuucugcagaagucuaaaaagcaucugacugauaaugaguucaaagaccccgaaacagguaagaccugccucuuaaaagccaugcugaaccuucacgacgggcagaauacgacuauuccuuugcugcuagaaaucgcucggcagaccgauagccucaaggagcuggugaacgccuccuauacagacucauacuauaagggacaaacugcgcuucauauugcaaucgagcgcagaaauauggcccuggucaccuugcucguggaaaacggcgcugauguucaggccgcagcucacggcgacuuuuucaaaaagacaaaagggaggccaggauuuuacuucggugagcugcccuuaagucuggccgcguguaccaaucagcucggcauagugaaguuucuucugcagaacagcuggcaaacggccgauaucucugcacgggacuccgucgggaauacuguguugcaugcucuaguagaaguugccgauaacacagcugacaauaccaaauucgugacuucaauguauaacgagauucugaugcucggagccaagcugcacccuacacuuaaacuggaagaguugaccaauaagaagggcaugacgccacucgcacuggccgcugguaccgggaaaaucggagucuuagcguacauucugcagcgcgagauccaggaacccgagugccgacaccuaagcagaaaguuuacagaaugggcauauggcccggugcauaguucucucuacgaucuguccuguauagacacuugcgagaaaaacagcgugcuugaagucauugccuacucgucuuccgagaccccuaacaggcacgauauguugcugguugagccccucaaucggcugcuucaagacaagugggaccguuucgugaaacgcaucuuuuauuucaacuuccugguauacuguuuguauaugauuaucuuuacaauggcugccuacuauagaccaguggauggccucccucccuucaagauggaaaagacuggggacuacuuuagggucaccggagagauccugucaguguuagguggcguuuauuucuuuuuccgggggauucaguacuuucugcagcgacgcccaaguaugaaaacacuauucguggauagcuacuccgaaaugcucuuuuuccugcagucucuuuuuauguuggcaaccgucgugcuguauuucagccaucucaaggaguacguagccucaaugguuuuuagucuggcuuuaggauggacuaauaugcuguauuacacgagaggcuuccaacagauggguauauaugccgugaugaucgagaaaaugauucuuagggacuugugccgguucauguuugucuacaucguguuccucuuuggguucuccacagcagucgugacccugauagaagauggcaagaacgacagccuacccucugagucaaccagucaccgcuggagaggaccugcguguaggccaccggauagcuccuauaauucucuguacucgacuugccucgaacuguuuaaauucacaauuggcaugggggaccuugaguuuaccgaaaacuacgauuucaaggcuguuuuuaucaucuugcuguuagccuaugugauucucacuuacauccugcuucugaauauguugauugcacucaugggagagacaguaaacaagauagcccaggagagcaaaaauaucuggaagcugcagcgugcuauuacgauccuagacaccgaaaaauccuuccugaagugcaugcggaaagccuuucgaucagguaagcuccugcaagucggcuauacucccgaugggaaggacgauuacagaugguguuucaggguggacgagguuaacuggacaaccuggaauacaaacgugggaaucauuaaugaagacccuggcaacugcgagggugucaaacgcacucuuaguuuuucuuugcggagcuccagagugucagggaggcacuggaagaauuucgcacugguaccauuacuccgcgaagcuagcgcccgagaucggcagucugcgcagcccgaggagguguaucugcgucaguucuccggcagucuuaaaccugaagacgccgagguuuuuaagagcccagcugcaucuggagaaaaauga

SEQ ID NO: 64271 - RNA, 2295 nt, Artificial Sequence
  derived and/or modified sequence opt3 from TRPV2__Homo_sapiens__NP_057197
augaccagccccuccucuucaccuguguucagacuggagacacucgacggcgggcaggaagauggaagugaggccgacagggguaagcuggauuuuggcagcgggcugccaccgauggaaucccaauuccagggagaggaccggaaauuugcuccccagauccgcgucaacuugaauuaccgaaagggcacuggugcaucucagccugauccaaaccguuucgacagagauagguuauuuaaugccguuucgcgcggggugcccgaagaccuggcgggacuaccugaguaucucucaaaaacgagcaaguaccugaccgauagugaguauacagaaggcuccacuggcaaaaccugccuuaugaaggcuguacugaacuugaaggacggggugaaugccuguauucucccacugcugcaaauagaucgggacucuggaaacccccagccucucgucaaugcacagugcacagaugacuacuauagaggucacagcgccuuacauaucgcuauugagaaaaggucccugcagugugugaaacuuuugguugaaaacggcgcaaaugugcacgcccgggcuugcgggcgcuucuuucaaaagggacagggcaccuguuucuacuuuggugagcugccacuaucacucgccgcgugcacuaagcagugggacgucgugaguuaucugcuugagaacccgcaucagcccgcaagccugcaagccacagauucucaggggaauaccguauugcacgcucucguuaugaucuccgacaacucagccgaaaauauugcacuggugacgagcauguacgauggauuacugcaggcuggcgcccgacucuguccuacuguccaacuugaggacaucagaaaccugcaggauuugaccccacuaaaacuggcggccaaggaaggcaagauagagaucuucaggcauauucuccagcgggaauuuagugggcugucucaccuuucccguaaauucacagaguggugcuacggacccgugcgcgugagccuguaugacuuggcaucggucgauucuugugaggaaaauuccguucucgagaucauugcuuuucacugcaagucaccucauagacacaggauggugguacuggaaccauuaaacaaacugcuacaggccaagugggaccuccugauccccaaauucuuccuuaacuuuuuguguaaucugauauacauguucauuuuuacugcuguggccuaucaucaaccgacccucaagaaacaggcagccccucaccugaaggcugaggucgguaacaguaugcuucugacaggccacaucuugauucuccuugggggaaucuacuuacuggugggccagcuaugguauuucuggcggcgacauguuuuuaucuggauuagcuucauagauuccuacuuugaaauccucuuccuguuucaggcgcuuuugaccguggucucucaagugcugugcuuccucgcaauugagugguaucugcccuuacugguaagcgcccuuguuuuggguuggcucaaucugcuauacuacacgcgcggguuucagcacacuggcaucuauucagugaugauacagaaggucauucugagagaccuccugagguuccuuuugaucuaccugguguuuuuauucggauucgcugucgcccucgugagucugucccaggaggcauggcggccagaagccccuacaggccccaacgcuaccgagagcguucaaccaauggaagggcaggaggaugaaggaaauggugcccaguaucgcggcauccuugaggcaucucuggaguuguuuaaauucacuauugggaugggagaacucgcguuucaggagcaacugcauuucagaggcauggugcuacugcuccugcuugcuuacguauugcugacauauaucuuacuccugaacaugcuuauugcccugaugucagaaaccgucaauaguguggcaacggacagcugguccauauggaagcuacagaaagccaucucuguucucgagauggagaacgguuacugguggugcaggaagaaacagcgugcuggggugaugcugaccgucggcacaaagcccgacggaucgccugaugaacggugguguuuucgaguggaggaaguaaauugggccagcugggagcaaacuuugccaacccugugcgaagacccguccggcgcaggggugcccagaacauuagagaacccuguucucgcuucaccacccaaggaggaugaagacggagccagugaggaaaauuaugucccugugcagcugcuucagucuaacuga

SEQ ID NO: 64272 - RNA, 2376 nt, Artificial Sequence
  derived and/or modified sequence opt3 from TRPV3__Homo_sapiens__NP_001245134
augaaggcccaccccaaagagauggugccucugaugggcaagagagucgcugcaccaagcgggaacccggccauccuccccgagaaaaggccugcggaaauuaccccaacaaagaaauccgcucauuucuuucuugaaauagagggauucgaacccaauccuacuguugccaagacgucuccacccguguuuucaaagccuauggacaguaacauccggcagugcauuagcgguaauugugaugacauggauuccccacaaucuccgcaggacgauguaaccgagacacccucgaacccuaauucaccaagcgcacagcuggccaaagaggaacagcgccgaaagaaacguagauugaagaaaaggaucuucgcugcagugagugagggcugcgucgaagaguuaguggagcugcuaguugaacuccaagagcugugucggcgcagacacgacgaagaugugcccgacuuucuuaugcauaagcugacugccuccgauaccgggaagacaugcuugaugaaagcucuccugaacauuaauccuaacaccaaggagaucgucaggauacugcucgccuucgcggaagagaaugacaucuuaggacgguuuauuaacgcagaguacacugaagaggccuaugaaggccagacagcucugaauaucgccauugagcgccgacagggugauaucgcagcucuuuugauagccgcgggggccgacgugaacgcacacgcuaaaggagccuucuuuaauccaaaguaccagcaugaaggcuucuauuuuggcgagacccccuuggcucuagccgcauguacgaaccaaccggagauuguacagcuccugauggaacacgagcagacugauaucaccucuagagacagcagggggaauaacauucuucacgcccugguuacaguggcugaagacuucaaaacucagaacgauuuugucaagcggauguacgacaugaucuugcuccguuccggaaauugggagcuggaaaccacacgcaacaaugaugguuuaaccccucugcaacucgcggcaaaaaugggcaaggccgagauccuuaaguauauucugucaagagagauaaaagaaaagagguugcggagucuaagccgaaaauucacggacugggcuuacgggcccgugucuuccucacuguaugaucucacuaacguggacacaaccacugauaauagcguccuggagaucacaguuuacaacaccaauauugacaaccgccaugaaaugcuuacgcuggagccauugcacacccuccugcauaugaaguggaaaaaguucgccaagcacauguuuuucuuaaguuuuugcuucuacuuuuucuauaauaucacacugacucuagugucuuacuauagaccuagggaggaagaggcaauaccccacccacucgcccugacccauaaaaugggauggcuucaguugcugggccggauguuuguacucauuugggcuauguguaucuccgugaaggaagguaucgccauuuuccugcuucgccccagcgaucugcagucgaucuugucugacgcaugguuucacuucgucuuuuucauucaagcggugcucguuauacuguccguguuuuuauaccuguucgcuuauaaagaguaccuagccugccucguccuggcaauggcccuugggugggcuaacauguuguauuacacaagaggauuccagucaaugggcauguacagugugaugauccagaagguaauucugcaugauguucucaaauuucuguucguguauaucgucuuuuuacugggcuucgggguggcccuugcaagccugaucgaaaaguguccuaaggacaauaaagacugcuccucuuacgguagcuuuucagaugcuguccucgagcuguucaagcuaacuauuggacugggcgaccucaacauacagcaaaauaguaaauauccaauccuguuucuuuucuugcugauuaccuacgugaucuuaacauuuguucuccugcuuaacaugcugauugccuugaugggggagaccguggaaaauguauccaaggagagcgaaaggaucuggcgucuccagcgggcgcgaacuauacuggaguucgagaaaaugcuaccggaauggcugagaucuagguuucgcaugggagagcucuguaaggucgccgaagaugacuuccggcugugccuuagaaucaacgaggugaaguggacggaauggaaaacacacguuucauuuuugaacgaggaucccggcccugugaggcgcaccgcugacuucaauaagauucaggauaguagccgaaacaauuccaaaacuacccugaacgcauucgaagaggucgaggaauuuccagagacaucuguguga

SEQ ID NO: 64273 - RNA, 2514 nt, Artificial Sequence
  derived and/or modified sequence opt3 from TRPV4__Homo_sapiens__NP_001170902
auggccgacagcuccgagggccccagagcugggccuggagaaguggcagagcugccaggugaugaaucuggcaccccgggggacggaaggcccaaccuccggaugaaguuccagggcgccuuucgcaaaggugucccuaauccaaucgaucuucuggagucaacauuguacgaaaguagcguugugcccgggccuaagaaagcgccaauggacuccuuauucgauuauggaacuuaccgacaccauucuucggacaacaagcguuggaggaaaaagauuauagagaagcaaccccagucaccuaaagcuccagccccgcagcccccuccaauccugaagguauuuaauagacccauucuauucgauaucgugagccggggcaguacggcagaccucgauggccugcuuccuuuucuguugacccacaaaaagcgccucacagacgaggaguucagagaaccauccacugggaaaaccugccugcccaaggcccugcucaacuuaucuaauggaaggaacgauacaauuccgguccugcuugacaucgcugaacggaccgguaauaugcgcgaguuuauaaacagcccuuuccgagauaucuauuacagaggccagacugcauugcauauugccaucgagaggcgguguaagcacuauguggaacugcuaguugcucaaggggccgacgugcaugcgcaggcacguggacgcuuuuuccagcccaaagacgagggcgguuacuuuuauuucggggaacucccacugucccuugccgcuugcacaaaucagccucacauugucaacuaccugaccgagaauccccacaagaaagccgauaugagaaggcaagacucacggggaaacacgguguugcaugcacucguagcuaucgccgauaauacucgagaaaacaccaaguuuguuacaaaaauguacgaccuguuacugcucaagugugcgcgccuuuucccagauaguaaucuggaggccguguugaacaacgacggccuaagcccccugaugauggcagcuaaaacuggcaagauagggauuuuccagcacaucauuagaagggaggucaccgaugaagacacacggcaucucucucgcaaguuuaaagauugggccuauggaccuguguacuccucacuguaugaccuuagcagucuggauaccugcggugaggaggcuucuguguuggaaauccucgucuacaauuccaagaucgaaaacagacacgagaugcuggccguugagccaauuaaugaauuacugagggacaaauggcguaaguucggcgcagugagcuuuuauauaaacguagugucguaccuaugugccauggucaucuucacgcucacugcuuauuaccagccgcuggaggggacacccccuuacccauaucggaccacuguggacuaccuucgauuggcgggagaaguuauuacacuguuuaccggcguccucuucuuuuucacgaauaucaaagaucuguuuaugaagaagugccccggugugaacucucuuuucauagacggguccuuucagcuguuguauuucauuuacucagugcucguaaucguuagugcagcccuguauuuagcuggcaucgaggccuaccuggcagugauggucuuugcccuagugcucggauggaugaaugcucuguauuucaccagaggccuuaaauugacagggacuuacagcauuaugauccaaaagauucuguucaaagaucucuuuagguuccuguuagucuaccugcuuuuuaugauaggauaugccuccgcauuggugucucuccugaacccuugugcgaauaugaagguuugcaacgaagaccagaccaauuguacagugccaacuuaccccagcugccgcgauucagagaccuucaguacauuucuacuggaccucuucaaacugaccaucgguaugggcgaucuugagauguuguccagcacuaaguauccgguagucuuuauuauccuguuagugacguacaucauucucacauucguucugcuucugaacauguugauagcucucaugggggaaaccgugggacaggucucuaaggagucaaaacacaucuggaagcugcaaugggccacuaccauucuagacaucgaacggaguuuuccuguguuccugagaaaagcauuuaggagcggcgagaugguaacaguggguaaguccucugaugggaccccagaccgccgaugguguuuccggguugaugaggucaauuggucgcauuggaaccagaaucucggcauuaucaacgaagaccccggcaaaaacgagacuuaucaguacuauggauuuagccacacaguggggcgucugagaagggaucgcugguccucaguggucccucggguuguggaacuuaauaagaacaguaaucccgacgaggugguagucccauuggacucuaugggaaacccuagaugcgauggucaucagcaaggcuaccccaggaaguggcgaacggacgaugccccacuguga

SEQ ID NO: 64274 - RNA, 2190 nt, Artificial Sequence
  derived and/or modified sequence opt3 from TRPV5__Homo_sapiens__NP_062815
augggcggguuccugcccaaggccgagggaccugguagccagcuccaaaaacuucugccauccuuuuuggugagagaacaggacugggaucagcacuuagacaagcugcauaugcuacagcaaaagaggauccucgagucuccgcugcuucgggcuucaaaggaaaacgaucugagugucuugcgccagcuccugcuggacugcaccugugauguucgacagcguggcgcacucggggagacagccuuacacauugcggcucuguacgacaaucuugaagccgcauuggugcugauggaggccgcucccgagcuaguauucgaaccuacuacgugcgaggcauuugccggacagaccgcucuccauauagccguggucaaccaaaaugugaaccugguuagagcgcuucugacaaggcgggcaagcguguccgcccgcgcuacuggcaccgccuucagacacucuccaaggaauuugaucuauuuuggugaacauccccucucguucgcagcuugugucaacucagaggagauugugcggcuguuaaucgaacacggggccgauauucgcgcgcaggacagccugggaaauacaguacuccacauccuuauacugcagccuaacaaaaccuuugccugccagauguacaauuugcuacugaguuaugauggccauggcgaccaccuccaaccacuggaucuuguucccaaccaucaggggcugacuccuuucaaguuggcaggaguggaggguaauacagucauguuucagcaccucaugcaaaagcgaagacacauccaguggaccuacggcccacugacguccauuuuauaugaccugacugaaaucgauucuuggggagaggaacucagcuuccuagagcuggugguguccucagacaaaagggaggcucggcagauucuugaacagaccccggucaaggaguugguuaguuuuaaauggaacaaguacgggcgucccuauuucuguauccuggccgcucucuaccugcuuuacaugauaugcuuuacaacuuguugcguguaucgcccucugaaauucagaggcgguaauaggacccauagccgggacauuacaaucuugcaacagaagcuccugcaggaagccuacgagacccgagaagauauuauccgcuuaguaggggagcuggugucuaucgucggagcagugauuauacuacuccuggagaucccagacauuuucagaguuggcgccuccagguauuuuggcaagacgauccuugggggacccuuccacgugauaauuaucacuuacgcuucauugguccuggugacaaugguaaugcggcucaccaacacuaauggugaaguugugccuaugagcuuugcgcuggucuuaggcugguguagugugauguauuucacacgcggguuucagaugcugggaccauucaccaucaugauucagaaaaugaucuuuggcgaucuuaugagauucugcugguugauggcagucgugauucucgguuuugccucugcuuucuacauaaucuuucaaacggaggaccccaccucccuggggcaguucuaugauuacccgauggcccuauuuacaacuuucgaacuguuccucaccguuauugacgccccugcaaacuacgauguggaccugcccuuuauguucagcaucguaaacuuugcuuucacaaucauugccacucuuuugaugcugaauuuauuuauagcaaugaugggcgauacccauuggagggucgcgcaggagcgugacgaacucuggcgggcucaagugguugccacaaccgugaugcuggagcgaaaacuuccaagaugucuguggccuaggucgggaaucugcggcugcgaguucggguugggagaucgcugguuucuccgggucgaaaaccacaaugaccagaacccccugagagugcuaagguauguagagguguucaaaaauucugacaaggaagaugaccaggagcauccauccgagaaacagcccucaggugcagaaaguggcacucuggcccgcgcuagccucgcccugccuacguccucucuuagccgaacagcaucacaaaguuccagccaccgggggugggagauuuugcgucagaacacccugggacacuuaaaucucggccugaaccuuucugaaggugauggggaggaaguuuaccauuuuuga

SEQ ID NO: 64275 - RNA, 2298 nt, Artificial Sequence
  derived and/or modified sequence opt3 from TRPV6__Homo_sapiens__NP_061116
augggcccccugcagggggacggagguccugcccucggcggggcugauguggcaccaagacuuagcccggucaggguuuggccccggccucaagccccaaaggagcccgcgcugcacccuaugggauuguccuuaccaaaagaaaagggccugauccuaugccucuggucuaaauucugucgcugguuucagcgacgugagucaugggcucagaguagagacgaacagaaccugcuucaacagaagaggauuugggagagcccccuguugcucgccgcaaaagauaaugacgugcaggcccugaacaagcugcucaaguacgaagauugcaaaguacaucagcggggugcuaugggggagaccgcauuacacauagccgcucuguaugacaaucuugaggccgcgaugguguugauggaagcagccccugagcuggucuucgaaccaaugacauccgagcuauacgagggacaaacugcucuccauaucgccgugguuaaccagaauaugaaccuggugcgcgcacuucuggcuagaagggccucugucucggcgcgggccacgggcaccgcauuucgccgaucaccguguaauuugauuuauuucggcgaacacccccucagcuuugcugccugcgugaacagugaggaaaucguaagacuguuaauugagcauggggcugauaucagggcccaggacucccugggaaauacaguucuccacauacuuauccugcagccuaacaagacuuucgcaugucaaauguacaauuugcuacugucuuaugaucggcacggugaccaucuccagccacuggaucuugugcccaaccaccagggccugaccccuuuuaaauuggccggggucgaaggaaauacagugauguuccaacaucucaugcagaagcguaaacacacccaguggacuuacggcccacugacaagcaccuuauaugaccugacggagauugauuccucaggugacgagcagagucuacucgaacugaucauuacuaccaagaagcgcgaggcuagacaaauccuugaccagacacccgugaaagaauuggucagccugaaguggaaaagguacgggcggccguacuuuugcaugcucggagcgauauaucugcuuuacauuaucuguuucacuaugugcuguauuuaucgaccucugaagccccgcaccaacaauagaacaucuccaagggauaacaccuugcuccagcagaaacuguuacaagaggcauacaugacgccuaaggacgauauccggcugguuggcgagcuagugacuguaaucggcgccauuauaauccuccugguggaaguccccgacauuuuucgcaugggggugacaagauucuuuggacagaccauccuugguggcccauuccacguuuugauaauuacuuaugcuuucauggugcuggucacaauggugaugaggcucaucuccgccucaggggagguaguucccaugagcuuugcacugguguuaggauggugcaacgucauguacuucgcccguggcuuucagaugcuggguccuuucaccaucaugauucagaaaaugaucuuuggggaucuuaugcgguucuguugguugauggcuguggucauucucggcuuugccagugcauucuauauaaucuuucaaacggaagacccagaggaacugggacauuucuacgauuacccgauggcgcuauuuucuaccuucgagcuguuucucacaauuaucgacggccccgcuaauuauaacguggaucugccuuucauguacuccaucacuuaugccgcauucgccauuauagcuacccuuuugaugcugaauuuacucaucgccaugaugggggacacacacuggcgaguugcacaugaaagagaugagcuguggagggcucagauuguggccacuaccguaaugcuugagcgcaagcugccacggugcuuguggcccagaagcggaaucugcgguagggaauacggccucggggaccgcugguuucugcgagucgaggaccggcaggaucuaaaccgucagaggauucaaagauaugcgcaggccuuccacacacgcggaucggaagaccuggauaaggacucuguggagaaacucgagcugggcuguccuuuuuccccacaucuuucauugcccaugccgaguguuagccgguccaccucuagaagcucagcuaauugggaaaggcugcgacaggguacuuuacgccgggaucucagagggaucauaaacaggggccuggaggacggagaaaguugggaguaccaaaucuga

SEQ ID NO: 64276 - RNA, 11580 nt, Artificial Sequence
  derived and/or modified sequence opt3 from TRRAP__Homo_sapiens__NP_001231509
auggcauucguggcuacccagggagcaacagucguugaccaaacuacgcugaugaagaaauaccuccaguuuguggccgcgcuuaccgaugugaacacaccagacgaaacuaagcugaaaaugaugcaggaagugagcgaaaauuucgaaaacgucaccuccucuccucaguauucaacauuuuuggagcacaucauuccacguuucuuaaccuuucugcaagauggggaagugcaguuccuacaggagaagccggcucagcaacucaggaaacugguucuugagauaauccaccggauucccacuaaugaacaucugcgcccucacacaaagaacguguugagugucauguuucgauuccucgagaccgaaaaugaggagaacgugcugaucugccugcguauuaucauagaacuccacaagcaguuuagaccacccaucacgcaggagauucaucacuucuuagacuuuguaaaacagaucuacaaggaacugccuaaaguugugaauagguauuucgagaacccacaagucauucccgaaaauacugugccuccaccggagauggugggaaugaucaccacaauagccgucaagguuaaccccgagcgggaagauagcgagacucgcacccacuccauuaucccuagagguucucuuucguugaaagugcuggcagaacuaccaauuaucguagugcucauguaccagcuguauaaacuuaauauccauaacgucguggccgaguuuguuccccugauuaugaauacaauagcuauccaggugucagcacaagccaggcagcacaaguuguacaacaaagaacucuaugcugacuucauugccgcgcagaucaagacccugagcuucuuagcauacauaauucggaucuaccaggagcuggucacgaaauauagucaacagauggugaagggcaugcuccagcuucuguccaauuguccugccgagacugcucauuugcgcaaagaacuacugaucgccgcaaagcacauucucacaaccgagcugcgaaaccaguuuaucccaugcauggauaaacuuuucgacgaaucuauucugauagggagcggauacacugcuagagagacauugaggccccucgccuauuccacccuggcggauuuaguacaccauguucggcaacaucugccgcuaucagaccucagucuggccgugcagcuuuuugcaaagaacaucgaugacgagagcuugccuucuuccauucagacgaugucauguaagcugcuccugaaucuugucgauugcauccguagcaaaagugagcaggagucuggcaacggucgcgacgugcugaugagaauguuggaagucuucgugcucaaguuucauaccaucgcuagguaccaacuguccgccauuuucaaaaaguguaaaccccagagcgaguuaggggcuguugaagccgcacugccaggagugccuacagcccccgcugcgccaggccccgcaccuucgccagccccgguacccgcuccuccacccccuccacccccgccuccacccgccacuccugucacccccgcaccagugccucccuuugagaagcagggcgagaaggacaaagaagauaagcagacauuccaaguuacugacugccggucucuagugaaaacccucgucuguggggugaagacaauaaccuggggaaucacuuccugcaaagccccaggugaggcucaguuuauuccgaauaagcagcugcaaccuaaggaaacgcagaucuauauuaaacuuguaaaguacgccaugcaggcauuggauaucuaucaggugcaaauagcgggcaacgggcagacauacauccgaguugcuaauugucagaccguccgcaugaaagaggaaaaggaggugcuggagcacuucgccggaguguuuacuaugaugaacccccucaccuucaaagaaauuuuucagacaaccgucccauacaugguugagagaaucucaaagaauuaugcacugcaaauuguggccaacaguuucuuagcuaaucccacuacaagcgcccuguucgcaacgauccuuguggaauacuugcucgacaggcugccugagaugggcuccaacguagaacuaucuaaucuguaucucaagcuguuuaaacuugucuucgguagcgugucauuguuugcugccgagaacgagcagaugcugaagccacauuuacacaaaauaguuaauaguuccauggaacucgcgcagaccgccaaggagcccuacaacuauuuccugcuucugcgggcuuuguuucgcagcauugggggaggcucucacgaucuccuguaccaggaguuccuaccucugcucccgaaucugcuucaaggcuugaacaugcugcagucaggguuacauaaacagcacaugaaggaccucuuuguggagcugugccuuacugucccagugagacugaguagccuacuccccuaucugccuauguugauggauccacugguuuccgcauuaaacggaucucaaacacucgugucgcagggucugaggacccuugaacuguguguagacaauuugcagcccgauuuccucuacgaccauauccagccuguccgugccgagcugaugcaagcucuauggcggacacugcgaaacccggccgauagcauuucccacguggcauacagagugcuuggcaaauuugggggaucaaauaggaagaugcucaaggagagucagaaacugcacuaugucguuacugaagugcagggccccucuaucaccguagaguucagcgacugcaaggcguccuugcagcugccaauggaaaaagccauagagacggcuuuagacugccucaagucagccaacaccgagccuuacuaucgccggcaagcaugggaagugaucaaauguuuucuggucgcuaugaugagccuugaggauaauaagcaugcccuguaccaguugcucgcacaccccaacuucacagaaaagacuauuccaaaugugaucauuucucauagauauaaagcccaggacaccccugcuaggaagacauuugagcaggcgcugacuggugccuucauguccgcaguuaucaaagaucuacgccccagugcucugccauucguggccagccuuauacgacacuacaccauggucgccguggcucaacagugcgggccguuucuccugccuuguuaucagguuggcucucagcccuccacggcaauguuccauucagaagagaacggaaguaagggcauggacccauugguguuaauugaugccaucgcgaucugcauggcuuacgaggaaaaagagcuguguaagauuggggaagucgcccucgcaguaaucuuugacguggccagcauuauacugggaucgaaggagcgggcuugccaacuuccccuguucuccuacaucguugaacguuugugugcaugcuguuaugagcaggccugguacgcgaaacuagguggcguggucucuauuaaguuucugauggagagacucccucugacaugggugcuucagaaucaacagaccuucuuaaaagcucugcucuuuguaaugauggauuugacuggggaagugagcaacggagccgucgcaauggccaagacaacccuggagcagcuccugaugaggugcgcuacuccacuuaaagacgaggaacgcgccgaagagaucguugcagcucaggagaagucauuccaccacgugacccaugaucuggugcgggaagucacaagucccaauuccacggugagaaagcaagccaugcacucuuugcagguucuagcgcagguaaccggcaaaagcgugacugucauuauggagccucauaaggaagugcugcaggacaugguuccgcccaagaagcaccucuuaaggcaucaacccgccaacgcacagaucggucugauggaggggaauacauuuuguaccacacuucagccucgacuguucacuauggaucucaacguggucgagcacaaaguguuuuauaccgaauugcugaaucucugcgaggcugaagacuccgcccugacgaaacuucccugcuacaaaucacuaccaagccugguaccuuugcgcauagcugcauuaaacgcccuggccgcuuguaacuaucucccccagagucgggagaagaucauugcggcacuguucaaggcccuuaauucuacaaacuccgaacugcaagaggcuggcgaggccugcaugagaaaauuccucgaaggagcaaccaucgaggucgaucagauucacacucauaugaggccauugcugaugaugcuaggcgacuaccguagccugacccucaaugugguuaaccgccuuacaucggugacucggcuguuuccuaauucauucaacgacaaguuuugugaucagaugaugcaacacuuaagaaaauggauggaagucgugguuaucacccauaaaggugggcagaggucugacgggaaugagaguauauccgaaugcggccgauguccguugagccccuucugccaguuugaggagaugaaaauuuguucugccaucaucaaccuguuccaccucauuccagcugcgccucagacacuggugaagccccuucuggaagucgugaugaagacggagcgggccaugcucauagaagcagggagcccauuucgcgagccuuugaucaaauuccugaccagacaccccucccaaacuguagaauuauuuaugauggaggcuacacuaaaugauccgcaguggucaaggauguucaugaguuuucugaagcauaaagacgcccggccacuccgagaugugcuugcagccaacccuaauagauucauuacccuguugcugcccggaggcgcucagacugccguucgcccagguagccccucuacauccaccaugaggcucgaccugcaguuucaagcgaucaagauuaucucaauaaucgucaaaaacgaugacaguuggcuugcaagccagcacucccucgugucucagcugcgucgggugugggucucggagaauuuccaggaaagacauaggaaggagaacauggccgcuacgaauuggaaggaaccuaaauugcuggccuauugcuuacuaaacuacuguaagcgcaacuacggggauauugagcugcuauuccaacuucugcgagcuuuuacuggcagauucuugugcaauaugaccuuucugaaagaguauauggaagaggaaaucccgaagaacuacagcauugcacagaaacgggcccucuucuuuagguucguagacuuuaaugaucccaacuucggagacgagcugaaggcuaaggugcuucagcacaucuuaaauccagccuuucuguauucauucgaaaaaggcgagggggagcagcucuugggaccucccaacccugaaggcgauaauccagaguccauaacaaguguuuuuauuaccaaggugcuggaccccgaaaaacaagcagacaugcuagauucucugcgcaucuaccuccuucaguaugcgacucuguuggucgagcaugccccucaccacauccaugacaacaauaagaaccguaauagcaaacugagacggcucaugacauucgcuuggccaugucuguuauccaaggccugcguggaucccgcaugcaaguacucaggucaccuucugcucgcucauauuaucgccaaauuugcaauacacaagaaaauuguucuacagguguuccacucucuguugaaggcccaugcuauggaagcgagggccaucguccgccaagcaauggcuauucugaccccggccgugccugcccgaauggaggacgggcaccagaugcucacacauuggacuagaaaaaucauaguagaggaaggacacaccgugccacagcuuguucauauucugcacuugaucguccagcacuucaagguguauuaccccgugcggcaucaccugguccaacauaugguuagcgcaaugcagaggcucggcuuuacgccuagugugacaaucgagcagcgcagauuagcuguagaucuguccgaaguggucauuaaaugggagcuucagaggaucaaggaccaacagccagauagcgacauggaucccaacucuucaggugaaggcguaaauuccguuaguagcucgauuaagcgggggcugucuguggacuccgcccaggaggucaaacguuuccgcaccgcgacuggagcuauaagcgccguauuuggccgaucacagagucuaccgggggcagauucucuccuggccaagccuaucgacaaacaacacaccgacacagugguuaacuucuugauuagaguggcuugucaggucaaugauaacacuaauaccgcaggaucccccggcgaggugcugagcaggcggugcgucaaccuccuuaagacggcccugcgcccagacauguggccuaaaucagaauuaaagcugcagugguuugauaaguugcucaugacaguggagcaacccaaccagguuaauuacgguaacaucuguaccgggcuggaagugcuaaguuuccuucugacuguacuccagagcccagcgauccuguccucuuuuaaacccuugcagagaggaauugcugccugcaugacauguggcaauaccaaggugcugagggcaguccacagccuccuuucccggcugaugucaauauucccuacugagccaucuacaaguucgguugccagcaaauaugaggaauuagagugccuguacgcugccguggguaaggucaucuaugaaggcuugaccaacuacgagaaagcaacgaaugcuaacccgucccaacucuuugggacucugaugauucuaaagucugccuguucaaauaaccccagcuauaucgaccgacuuauuuccguguucaugagaagucugcagaagaugguacgcgaacaucucaauccucaggcggccucuggaagcaccgaggcaacaucaggcaccuccgagcuggugauguugaguuuagaacugguuaaaacaaggcucgcugugaugagcauggagaugcggaagaacuuuauccaggccauacuuacuucucugaucgaaaaauccccagaugcaaagauucuacgugcugucgugaaaaucgucgaggaaugggugaagaauaacucacccauggccgccaaucaaaccccuacgcugagagaaaagagcauucucuugguuaaaaugaugacauacaucgagaagagguucccagaagaccuggagcuuaacgcgcaguuucuggaucucguaaauuauguguaccgcgacgaaacuuuaucggggucugagcugaccgcuaaauuggaacccgcauuccugaguggacuccggugcgcccagccucuuauacgagcuaaguucuuugaggucuucgauaacuccaugaaaagaaggguguacgagcgccugcuauauguuacauguagccagaacugggaagccaugggcaaucacuuuuggauuaagcaaugcaucgagcugcucuuggcagugugugaaaaaucaaccccgauugguacuuccugccagggggccaugcugccaucuaucaccaacgucauaaaucuugcugacagccaugaucgggcggccuucgcaauggugacacacguaaagcaggagcccagagagcgugaaaacagugaguccaaggaagaggacguggaaaucgauauugagcuggcuccuggagaccaaacgagcacucccaaaaccaaggaguuaucugaaaaagacaucggcaaucagcuccauaugcugacaaacaggcacgauaaguuuuuggacacccugcgggagguuaaaacuggugcccuccuuucagcauucguccagcugugccacauuaguacaacccuagccgaaaagacgugggugcagcuguuuccacgccucuggaagaucuuguccgaucgacaacagcaugcucuggccggcgagauaagcccuuucuuauguucugggucgcaccaggugcagagagacugccaacccucagcgcuuaauuguuuugucgaagcaaugagccagugcguuccaccgauuccuaucaggcccugugugcugaaauaccucggaaagacucauaaccugugguuccgguccacauugaugcuggagcaccaggccuuugagaaaggccucagucuucagaucaagccaaaacaaaccaccgaguucuaugagcaggaaucuauuacucccccucagcaggagauccuggauagccuagcugaacuguacuccuuacuccaagaggaggacaugugggccgggcuguggcagaagcgcugcaaguauucagaaacagcaaccgcuauagccuacgagcagcauggauuuuucgaacaagcucaggagaguuaugagaaagccauggauaaggccaagaaggaacacgagagaucuaaugcgagcccagccauuuuccccgaauaccaguugugggaggaccacuggaucagguguuccaaagaacuuaaccagugggaggcucugacagaguacggccaaucaaagggucauauuaauccuuaucucguacuggaaugcgccuggcgagugagcaacuggacugcaaugaaggaggcuuugguccagguggaaguuucuuguccgaaagagauggccuggaaggugaauauguaccggggguaucuggcaaucugccacccagaagaacagcagcuauccuuuauagagcgucucgucgaaauggccaguagccuugcgaucagagaguggcgcaggcugccccaugugguaucgcacguucacacgccuuuacugcaagcugcccagcagauuaucgaacuccaggaggcagcccaaauuaacgcuggacugcagccaaccaauuugggccggaacaacucccuucaugauaugaaaacaguggucaagacuuggagaaaucgccugcccaucgugucugacgaucucucacacuggagcaguauuuucauguggaggcagcaucacuaccaaggcaaaccuaccugguccgggaugcauucuagcucaaucgugacagccuaugaaaacuccagucagcacgaccccagcucuaauaacgcaaugcugggaguccacgcuucagccuccgcgauaauucaguacgguaagaucgcucgaaaacagggccuaguuaauguggccuuggauauccugagccggauucauaccauaccaacuguaccgaucguggacuguuuucaaaagauuagacagcaggucaagugcuaucuccagcuugcaggggugaugggcaagaacgagugcaugcaaggccuggagguuaucgaaucuacgaauuuaaaguacuucaccaaagagaugacagccgaauuuuacgcucugaaggguauguuccucgcacagauuaacaaaagugaggaggccaauaaggcguuuucggccgcugugcagaugcacgacguccuggugaaggcaugggccauguggggagauuauuuggaaaacaucuucguaaaagagaggcagcuucaucugggaguuuccgcuauaacuuguuaccuccacgccugccgccaccaaaaugaaagcaagucacguaaauaucuggcaaaggugcuaugguuacugucuuuugacgaugacaaaaacaccuuggcugaugccgucgacaaguacuguaucggcgugccucccauucaguggcucgcguggaucccacagcugcuuacaugccugguuggcagcgaggggaagcuccuguugaaucuuauuucccaggugggacgggucuauccucaagccguguacuuccccaucagaacccuguaucuaacucucaaaauagaacagagggagcgcuacaagagugauccagguccuauucgagcaacagcucccauguggcgguguucaagaaucaugcauaugcagagggagcugcacccgacguuacugucuagcuuggaaggcaucguagaccaaauggugugguuucgcgagaacuggcaugaagagguccucagacagcugcagcaggggcuugccaaaugcuacuccguugcauucgaaaagaguggagccgugagcgaugcuaaaauuaccccacacacucugaauuuugucaagaagcucguguccacauucggcguagguuuggagaacgugucuaacguuucaaccauguucagcucggccgcguccgagagucuggcucggagggcacaagccaccgcucaggacccuguguuucagaaacuuaaggggcaguucacaacugauuuugacuucucuguccccggaagcaugaaacugcauaauuuaauaucaaagcucaagaaguggaucaagauucucgaagccaaaacgaagcaacugccaaaauuuuuccugaucgaggaaaaguguagauuuuuguccaacuucucugcacagaccgccgagguggaaauucccggcgaguuucucaugccuaaaccgacacacuauuacaucaagauagcucgauucaugccacgcguugagaucguccagaaacacaauacugcggccagacggcuguauauuaggggccauaacgggaagaucuaccccuaucuugugaugaaugacgcaugccugaccgaaagucgcagagaggaacggguguuacagcuccugagguugcuuaacccuugucuggagaagcgaaaagagacaaccaagcgucaccuauuuuucacuguacccagagucguggccguuagcccacaaaugcgccucguggaagauaauccuuccucacugagccuggucgagauuuacaaacagcggugcgcuaagaaaggaaucgaacaugacaaccccauuucuagguauuacgauagauuggcaacggugcaggcccgcgguacacaagcuagucaccagguucuccgggacauacugaaggaggugcaguccaauaugguaccaaggagcaugcuuaaggaaugggcccugcauaccuuuccuaacgcgacugauuacuggaccuuccgaaaaauguucacaauccaguuagcacucauuggcuuugccgaguucguccugcaccuaaauagauugaacccggagaugcugcaaaucgcucaggacacugggaaacuuaauguggccuauuuucgguucgauaucaacgacgcaaccggagaucucgacgcuaauaggcccgugccauuucgccugacaccuaacauuucagaguuccugacgaccauaggcguuucuggucccuugacugccuccaugaucgcggucgcccguuguuuugcucagccaaacuucaaaguggaugggauucuuaagacaguacucagagacgagaucauugcauggcacaaaaagacccaggaagauacuucgagcccucugagugccgcuggacaacccgagaauauggacucucagcaguuagugucccugguccagaaggcagugacagccaucaugacccgacuacauaaccucgcucaauuugaaggcggcgagagcaaaguuaauacgcugguggccgcagccaacucauuggacaaucugugcaggauggauccggcguggcacccauggcuuuga

SEQ ID NO: 64277 - RNA, 432 nt, Artificial Sequence
  derived and/or modified sequence opt3 from TSACC__Homo_sapiens__NP_001291755
augggcgagagacccgccgggcuggcucagggaaccacaccuguggguguccaaauggaaaggcacacuagccacccaaaccggaagguuccggcaaaagaggaagccaaugcggugccccucugccgcgcuaagccuuccccaucuuacaucaaccuucaggccucaagucccccugcaacguuccugaauauucagaccacaaaauugccaagcguagaccacaagcccaaagaguguuuaggccugcuagaaugcauguaugccaaccuccagcugcaaacucagcuugcucagcagcaaauggcagugcuggagcauuugcaggccuccgucacccagcucgcuccugggcgaggaucuaauaacucgucacugccagcccugagcccgaauccccucuuaaaccaucugccucaguuuaguaaguga

SEQ ID NO: 64278 - RNA, 3342 nt, Artificial Sequence
  derived and/or modified sequence opt3 from TSC1__Homo_sapiens__NP_001155899
auggcccagcaagcuaacgugggcgagcugcucgcaaugcuugacagccccaugcugggggucagagaugacguuaccgccguguucaaggaaaauuugaacuccgauaggggaccuauguuaguaaauacacugguggacuacuaucuagagacuucuucacagccagcgcuccacauccugacgacccuucaggaaccgcaugauaaaauggacacagaugucgugguucugacuaccgguguguugguccucauuacaaugcugcccaugauaccucagaguggcaagcaacaucugcucgacuuuuucgauaucuuugggcgguuaagcuccuggugccugaaaaagccaggacacguggcugagguauaccuuguucacuugcaugccucuguguaugcacuguuccaccgccuauacggcauguaucccuguaacuuugucucguuccuccgaucacacuacagcaugaaagaaaaucuggagaccuuugaggaaguggugaagccuaugauggagcauguccguauucacccagaacuuguuacugguaguaaggaccaugagcuggaucccagaagguggaaacgguuggagacacacgacgugguaaucgaaugcgccaagauuucccucgauccuaccgaggcuucuuaugaagacggguacagcgugucccaccagaucucagcacgcuucccacauagaagugccgacgucacgacuagcccguacgcugauacccagaacucuuauggaugugccacauccacucccuacucaaccagcaggcugauguuacugaauaugccuggccagcucccacaaacacuuaguucucccuccacccggcugauaacggagccuccacaggcgacuuuguggagccccucgauggugugcggcaugacaaccccgccuacuucucccgggaacguuccaccugaccuaucccaccccuauucaaaaguguuuggaacaaccgcugguggcaaggggacgccacugggaacccccgccacaaguccuccaccggcuccccucugucauagcgaugacuacguccacaucucccugccucaggccacugugaccccaccccgcaaagaagaacgaauggauucugcaagaccuugccuucauaggcagcaccaccuguugaaugaccggggcagcgaggaaccacccgguucaaaggggaguguaacacucuccgaucugccgggauucuuaggcgaccuggcuagcgaggaagauucuauugagaaggacaaagaagaggccgcgaucucacgugagcuaagugaaauuacuaccgccgaggcagaaccuguugugccacgcggcggguuugauagccccuucuauagagacucccucccuggaucucaaaggaagacacauucggcugccagcuccucacagggugcuagugucaaccccgagccacugcacucuagccuugacaaauugggcccugauacccccaagcaggccuuuacuccaaucgaccugccguguggguccgcagaugaaucgccugccggagaccgggagugccaaacgagccucgagacaucuauauucacccccuccccauguaaaauucccccuccaacucgagugggcuucgguagugggcagcccccuccguacgaucaucuguuugaagucgcuuuaccaaagaccgcgcaccacuucgugauccgcaaaacagaggaacuguugaagaaggcaaaaggcaauaccgaggaggacggaguucccagcacuucuccuauggaagugcucgauagacugauucagcagggcgccgacgcucauuccaaggaguuaaacaaacugccacuacccucaaagaguguagauuggacacacuuugggggaagcccuccgucggacgaaaucaggacgcuccgggaucaacugcuuuugcugcauaaucagcuccuguaugagcgcuucaaaagacagcagcacgccuuaaggaaccgucggcugcuucgaaaggucaucaaggcagccgcuuuggaggagcauaaugccgcaaugaaagaccaacucaagcugcaggagaaagauauucagauguggaaggugucccuacagaaagaacaagcgagauacaaccagcugcaggagcagagggacaccaugguuacuaagcuccacucucaaauacgccagcugcagcacgaccgggaagaguuuuacaaccaaagccaggaacuucagacaaaguuggaggauugcagaaauaugaucgcugagcugaggauugaacuuaaaaaggccaacaauaaagugugucauaccgagcuccugcuuucacaggucagucaaaagcuguccaacucugaaagcgugcagcagcagauggaguucuugaaucgccaacuccugguacuaggugaagugaacgagcuguaucucgagcagcugcagaauaaacacuccgacacaacuaaggaaguugagaugaugaaggcagccuaccgaaaagaacuugagaagaaccggucacaugucuugcagcaaacccagcgucuggauacgagccagaaaagaaucuuagagcucgaaagucaccuggcuaagaaagaccaucuucugcuagagcaaaagaaauaucucgaagaugugaagcugcaggccaggggccaguugcaggcagcugagucucgcuacgaagcccaaaagcggauaacccagguguuugagcuggagauuuuagaccucuaugggagacuggaaaaagauggacuucugaagaaauuggaggaagagaaggcggaagccgcugaggcagccgaggaaaggcucgacugcugcaaugauggcuguuccgacagcauggucggucacaacgaggaagcaucggggcacaauggcgagacaaaaacuccccgaccaucaucugcccgcggaaguuccggcagcagagggggagguggcucuagcuccucaaguagcgaacugucuaccccugagaagcccccacaucagcgggcagggccuuucuccucaaggugggagacaacuaugggagaagcgagugccagcauccccaccacgguuggcucccuaccaucuucaaagagcuuucuggguaugaaagcucgugagcuuuuccgcaacaagucagaaucccagugcgaugaggacgggaugacaaguucucucagcgagucccugaaaaccgaauugggcaaggaucugggaguggaggccaaaaucccguuaaaucucgacggcccucaccccucaccacccacuccugacucuguggggcaacugcauauuauggauuacaacgaaacacaccacgagcauagcuga

SEQ ID NO: 64279 - RNA, 1713 nt, Artificial Sequence
  derived and/or modified sequence opt3 from TSC22D1__Homo_sapiens__NP_001230728
augcaccagcccccugagagcaccgccgcugcagccgcggcugccgacaucuccgcaagaaagauggcccauccagcuauguucccgaggcggggcucugggucaggaagugcaagcgcccugaacgcugccgguacaggcgugggguccaaugcgacuucuucggaagauuuucccccuccaucacuccuucaacccccuccacccgcagccagcaguacguccggaccucagccaccgcccccucagucucugaacuuguuaagccaggcucaacugcaggcccagccacuagcacccggcgguacccagaugaaaaagaaauccggguuccaaauuacaucagucacuccugcucagauaagugccagcaucucuuccaauaacucaauugcggaggacaccgaaagcuacgaugaccucgaugagagucacacagaagaccugucuuccagcgagauccuugauguuucgcugucucgcgccaccgacuugggagagccagaacgauccucaagugaggaaacucucaauaacuuucaggaggcagagacacccggcgcugugagcccgaaucagccucaucugccccaaccacaccuuccucaucucccccagcagaacguagugauuaauggcaacgcccacccacaccauuuacaccaucaccaccaaauccaucacgggcaucaucugcagcacggacaccaccaucccucccacgucgcuguggccucugcaagcauaaccgguggcccuccaucaaguccgguuucccguaagcugagcacgacugggucuucagauaguaucacccccguggccccuacaagcgcugucuccucuucgggaagcccagcguccgugaugacuaauaugagagcacccucaaccacaggcgguauugggaucaacaguguaaccggaacgucuacuguuaauaacgugaauauuacagccgucggcagcuucaacccuaacgugaccuccucaauguugggcaaugugaacaucagcacuucuaauauaccauccgcugccggggucaguguuggacccggugugacaagcggcguaaacgugaauauucugucugggaugggaaacggcaccaucuccucaagugcagccgucagcucggugccgaaugcugccgcagguaugaccgggggcuccguuucuagccagcagcaacagccuacggugaacacaucaagguuucgggucgugaaacuagacaguuccucugaaccauucaagaagggacgcuggacuugcaccgaguuuuaugaaaaagagaaugcgguacccgcuacagaaggcguucucauuaacaagguggucgagacugugaaacagaauccuaucgaggucaccagcgaaagagaguccacaucagggagcagugugucuuccagcguuucgacccugucacauuacacugaaucugugggaaguggugagaugggcgcccccacgguagucgugcagcaacagcagcagcaacagcagcagcaacagcagcaaccagcacuucaggggguuacacugcagcagauggauuucggauccaccggcccucaaagcauccccgccgugucuauuccacagagcauaucccagucacagaucagucaaguccaguugcagagccaggaacucucuuaucugacuaugaaggugguauuacugauuguguaccucuguauguga

SEQ ID NO: 64280 - RNA, 234 nt, Artificial Sequence
  derived and/or modified sequence opt3 from TSC22D3__Homo_sapiens__NP_001015881
auggaccuggugaagaaccaccucauguacgccgucagagaggaaguugagauccuuaaagaacagauuagggagcugguggaaaagaauagccaauuggagcgggagaacaccuuacugaaaacacuagcuucccccgaacagcucgagaaguuccagucuugccugucaccugaggaaccagcaccggagaguccccagguaccugaagccccaggcgggagcgcgguguga

SEQ ID NO: 64281 - RNA, 1188 nt, Artificial Sequence
  derived and/or modified sequence opt3 from TSC22D4__Homo_sapiens__NP_001289972
augagcggcgggaagaaaaaguccucuuuccagaucaccucagugacaacugacuacgagggacccgguaguccuggcgccagcgauccaccgacgccccaaccuccaaccgggcccccuccaagacugcccaacggagaaccuuccccagacccgggcgguaaagggacacccaggaauggaucuccuccacccggcgcuccuucgucacgguuucgcgucguuaagcucccacacggccuuggggagcccuaucgacguggaagauggacuugcguggauguauacgaaagggaccuggagccgcauagcuucgguggcuuguuagaagggauucggggagcaaguggcggugccgggggacgcucccuggauucuagacuagagcucgcgagccugggccuuggcgcuccuacacccccauccgggcugucacagggaccuaccaguugguugaggcccccacccaccagcccugguccacaggcccggucuuuuacuggcgggcucggacagcugguggucccguccaaagcaaaggccgagaagcccccucugucagcuagcaguccacaacagcgacccccugaaccagagacaggcgaaucugcagguaccucccgcgccgcuacgccccucccgagcuuaagaguggaggccgaggcagggggcucgggagcgaggacuccuccacugucucggcguaaagccguugacaugcgccuuagaauggaauugggcgcucccgaggaaaugggacaggugccuccccuggauuccaggccaucaaguccugcccuauauuucacccacgacgcaagccucguccauaagucccccgauccauuuggggcuguggccgcgcagaaauucucucuggcccacagcaugcuugcaauaucaggucaucuggacagugaugacgauuccggcagcgggucuuugguaggaaucgacaacaagauugagcaagcuauggaccucguuaaaucacaccugauguuugccgugcgggaagaggucgagguguuaaaggaacagauccgagagcuggcugaacgcaaugccgcacucgagcaggaaaacggccuucugagagccuuggcuaguccggagcagcuagcgcaacugccuagcuccggugugcccaggcucgggccacccgcaccuaauggcccaucugucuga

SEQ ID NO: 64282 - RNA, 5424 nt, Artificial Sequence
  derived and/or modified sequence opt3 from TSC2__Homo_sapiens__NP_000539
auggccaagcccaccagcaaagacuccggccugaaggagaaauucaagauccuccuugggcugggaacaccuagaccaaacccgaggucugcugaagguaaacagacugaguuuauuauaacggcagaaaucuugcgggaguuaucaauggaaugcggccugaauaaccgcauucgaaugaucgggcaaauuugugagguggccaagaccaagaaauucgaggaacacgcggucgaggcucuauggaaggccguugcagaucuccugcagcccgaacguccucuugaggccagacaugcugugcuggcauugcucaaagccaucguacagggacagggcgagaggcugggugugcugcgggcucucuuuuucaaggucauaaaagacuacccaaguaaugaagauuuacacgagcgccuggaaguguuuaaggcccuuacagacaacgggagacauaucacuuauuuggaggaagagcuggcggauuucguucuacaauggauggacgugggacucagcuccgaguuucugcuuguccuggugaauuugguaaaguucaacucuugcuaccucgaugaauauauugcaaggaugguucagaugaucugucuguuaugcgugcggaccgccucgucagucgacauugaggugagccugcaggugcucgaugcugucguuuguuacaauugccuucccgccgaaagucugccuuuguuuaucgugacacuaugucgcaccauaaacguaaaagagcugugcgaaccauguuggaagcucaugcgaaaucugcuuggcacucaccugggccauuccgcaauuuauaacaugugccacuugauggaggacagagcuuacauggaggaugccccccuccugaggggggcgguguucuuugucggaauggccuuauggggugcacaccggcuguauucucuacguaauagcccuacauccgugcucccaucauucuaccaggcuauggccuguccgaacgaaguugugaguuacgagaucguccugagcauuacccgccuuaucaaaaaguauagaaaagaauugcaagugguagcuugggacauccugcucaauauuauagagaggcugcuucagcagcugcagacguuggauucucccgaacuccggacuaucguucaugaccuguuaaccacaguggaggagcugugcgaccaaaacgaauuucacggcucccaggagcgauacuucgaacuagucgagcgcugcgccgaucagagaccugagucaagccuccugaaucuuauuaguuauagggcacaaucuauccauccagccaaggacggguggauacagaacuugcaggcucugauggaacgguucuuucgcuccgagagcagaggagcggugaggauuaaaguccucgaugugcugucguucguuuuacugaucaaccgucaguuuuacgaagaggaacuuaucaauucugugguaauuucccaauugucacacauccccgaggacaaggaucaccagguccggaagcucgcaacucagcugcuaguggaccuggccgagggcugucauacccaccauuucaacagucuccuggauauuauagaaaaaguuauggcucgaagccuuuccccuccacccgaguuggaagagagagacguggccgcauauucugccagccuggaagaugucaagacagcuguguuaggucuccugguaauccuucagaccaaacuguacacguugccggccucacacgcaacuaggguguaugagaugcucguuagucauauucaacugcacuacaagcacuccuacacacuaccuaucgcgagcucuauccgccugcaggcuuuugacuuccuccugcuuuugcgggccgauucacugcauagauuagggcuccccaauaaagacggagucgugagguuuaguccauauugcgugugugacuacauggagccugaacgcggcagcgagaagaagaccuccggcccccugucuccacccacugggccuccaggaccggcacccgccgguccugcuguccgacuuggcucgguuccauauagccugcuauuccgggugcuccugcagugcuugaaacaggaauccgauuggaaggugcugaaauuaguacucgggcgucugcccgagucacuuagauacaagguccugauuuuuacaaguccuuguucuguggaccaauugugcagcgcccucuguuccaugcugucaggaccaaaaacccuagaaaggcugcgcggcgcacccgaggguuucagccggacggaucuucaccucgcuguugugccgguccugaccgccuugauaucuuaucauaacuaccuggacaagacaaagcagagagagaugguguauugcuuagaacaggggcucauccacaggugugcgucccagugcguuguggcccugaguauuuguagcguagagaugccugauaucauuaucaaagcucuuccaguccugguggugaaguugacucacauaucugcaaccgccuccauggcugucccccuccuggaauuucuaucaacacuggcccgacuuccucaucucuaccgcaauuucgcagcggagcaauacgccaguguuuuugcuaucagccugcccuauacuaacccaucgaaauucaaucaguacauugugugcuuggcccaccauguaaucgcaaugugguucauucggugcagauuaccuuuuaggaaggacuucgugcccuuuaucaccaaaggccugcguuccaacguccuccugucuuucgaugacacaccagagaaggauagcuuucgcgcucggucaaccagucuuaaugaaagaccgaagucccugaggauagcccgaccucccaaacagggauugaacaauucuccacccgugaaggaguucaaagaaagcuccgcagccgaggcuuuucggugucgcucaauuagcguuagugaacacguggucagaucuaggauccaaacuucccuaacgagcgcgucgcugggcucagccgacgagaacucuguggcacaggcugaugacagucucaagaaucugcaucuugaguuaacagaaaccugccuggauaugauggcccgguauguuuucuccaacuuuacugccgugccuaaacgaagcccagucggggaguuccucuuggcuggagguagaaccaagacauggcugguaggcaauaaacucgugaccguuacuacaucuguggggacgggaacccgcagccugcuuggccuggacuccggugaauugcagucagggcccgagaguagcucuuccccuggcguccacgugaggcagacuaaggaagcaccggccaagcuagagucacaagcgggacagcagguaagucguggcgcucgggacagagugaggagcauguccgggggacacggucugcgcgucggcgcccucgauguuccagcaucucaguuuuuagggucggccacaagccccggaccucgaaccgcuccagcagccaaacccgagaaggcgucagcuggcacaagagugccugugcaagaaaaaacuaaccuggccgcauacgucccgcuucugacccaggguugggccgagauucucgugcggaggcccacggggaacaccuccugguugaugagucuggaaaauccacucucuccuuucagcuccgacaucaacaauaugccccugcaggagcuuucaaacgcucuaauggccgcagaacgcuuuaaggagcaucgugauacagcucuguauaaaucuuugagcguuccagccgcgaguacugccaagccucccccauuaccgagauccaauaccguagcaagcuucucuucacuguaccaguccaguugucaaggccagcuccaccggagcgugucgugggcugacucugccgucgugauggaggaaggauccccuggcgagguucccgugcuggucgaaccacccgggcuugaggauguggaggcugcacugggaauggacaggcgcacagaugccuauagccgaucaaguucuguauccagccaggaagagaagucacuccaugccgaagaguuggucggcagagguauaccuaucgaacgggugguuaguagcgaggggggaaggccauccguggaccugucuuuccaacccagccagccucuauccaaaucaucuaguucgccggagcugcagacucuccaggauauucuuggcgacccaggugauaaggcugacgucggccgccugagccccgaagugaaagcgagaucccaaucugggaccuuagauggagagucagcagccuggagcgcuuccggcgaagacaguagggggcagccugagggacccuugccaucuagcucaccucggucccccaguggccugcguccacgcgguuacacgaucagcgacucugccccuucccgaagagggaagaggguugaacgggaugcacucaaaucacgcgccacagcuagcaacgcggagaaggugccgggaauuaaucccucguuugucuuccugcagcuuuaccacucuccauuuuucggcgacgagaguaacaagccuauccugcuccccaaugaaucccagagcuuugagagaucagugcaauugcuggaucagauaccauccuaugacacccauaaaauugccguauuauacgugggugaaggccagucuaacagcgagcuagcaauccugaguaaugaacacggguccuauagguacacugaguuccucacaggacuuggccggcugaucgaguugaaggauugccagccugacaaaguuuaucuggggggacucgaugucuguggcgaagacggucaauuuaccuacugcuggcacgaugacauuaugcaggcuguguuccauaucgccacucugaugcccaccaaggauguggacaaacaccgaugugacaagaagagacaucuugggaacgauuuugucagcauuguauauaaugacucuggagaggauuucaaacucggcacaauaaagggucaguuuaacuucgugcacguuaucgugacgccgcuggacuacgaaugcaauuuggucucacugcagugucgcaaagauauggagggcuuaguggacaccaguguugcaaagauuguguccgauaggaaccuaccauucgucgcccggcaaauggcucugcacgccaacauggcgagccaggugcaucacucucguucgaauccuacugacaucuaccccucaaaauggauugcaagacucaggcauaucaagcgccuucggcagcgaauaugcgaggaagccgcuuauagcaacccaucccugcccuugguacacccuccgagucauucuaaagcccccgcucaaacaccagcagagccuacccccggguacgaagugggacagagaaagaggcugaucagcuccguugaggauuuuacagaauucgucuga

SEQ ID NO: 64283 - RNA, 1320 nt, Artificial Sequence
  derived and/or modified sequence opt3 from TSEN2__Homo_sapiens__NP_001138865
auggccgaggcuguguuccacgcacccaagagaaaaaggcgggucuacgaaaccuaugagagcccucugccaaucccguuuggccaggaccaugggccccucaaggaguucaaaauuuuucgcgccgaaaugauaaacaauaacguuaucgugcgaaaugcggaagauauugagcaacuuuacggaaaggguuauuucggcaaagggauccugucccguucuagaccuucauuuacaauuagugacccaaaguugguagcuaaguggaaagauaugaagacuaacaugcccaucauaacgagcaaaagguaccagcacuccguggagugggccgcagaauuaaugcggcgccagggacaggacgagucuaccgucagaaggauccugaaggauuauacaaaaccucuagaacauccacccgugaagcggaaugaggaggcccaaguucacgacaagcucaacucgggcauggugucaaauauggaagguacugcugggggagagcgcccuagcgucgugaacggcgauaguggcaaauccgggggaguaggugacccacgagaaccgcugggcugccuucaggaggggucuggaugucaucccaccacagagagcuucgaaaaguccguuagagaggaugcaucaccucugccacacgugugcuguugcaaacaggacgccuugauucuccagaggggccugcaccaugaagaugguagucaacacaucgggcugcuccaucccggagaccggggcccugaucacgaguacgucuuaguggaagaggcugaaugugccaugagcgagcgugaggcggcaccaaaugaagaggccuuuuuccugguguaugcucuuggcugcuugucuauuuacuacgaaaaggagccccugaccaucgucaaacuauggaaggccuuuacuguugugcagccgacauuccgcaccacguauauggcauaccacuauuuuagauccaaaggguggguaccuaaggugggacucaaguacgguacugaccugcuucuguauaggaaagggcccccauucuaccaugcuucauauagcgucauaauugaauugguggacgaucacuuugagggcagucuccggcgaccucugucuuggaaguccuuagccgcgcugagccgcguuucggugaacgucucuaaagagcucaugcuuuguuaccugaucaagcccuccaccaugacagacaaagaaauggagucaccagaaugcaugaagagaauuaaggugcaggagguaaucuugaguagguggguuagcucccgggagcgcucugaucaggacgaucuauga

SEQ ID NO: 64284 - RNA, 933 nt, Artificial Sequence
  derived and/or modified sequence opt3 from TSEN34__Homo_sapiens__NP_001269261
augcugguggucgagguugccaacggcagaagccucguguggggagcugaagcaguacaggcccuuagggagcggcuggggguggguggccgcaccgucggggcguugccccgaggaccucgucaaaauuccagauuaggccugccacuacuccugaugccggaagaggcuaggcuucuggccgaaaucggugcagugacauugguuucugcuccccggccugacucacgccaccauagucucgcccugacuagcuucaagagacagcaggaggaguccuuucaggaacaaucugcacuggccgcugaggccagggaaacgcggcgccaggagcucuuagagaaaauuaccgaagggcaggcggcaaagaaacagaagcuggagcaagccucgggagcuucaagcagucaggaagccggcuccucucaggcagcuaaagaggaugaaacaagcgacggccaggccuccggggagcaagaggaagcgggaccaucaaguagccaggccggucccucuaacggcguggcaccucuuccacgauccgcuuugcugguccagcuagccacugcuagacccaggccugugaaggcccggccacucgauuggcguguacaaucaaaggacuggccgcacgcagggcgccccgcccaugagcugagauacagcauauauagggaucuuugggaacggggauucuuucugagugcugcgggcaaauucgguggggacuuuuugguuuacccuggagauccacuccgauuccacgcacauuauaucgcccagugcugggcucccgaggacaccauuccucugcaggauuuaguggccgcaggccgccugggcacaucugucagaaagacccuccuucuguguuccccacagcccgacgggaaagugguguacacuagcuugcaaugggccucgcuacaguga

SEQ ID NO: 64285 - RNA, 1581 nt, Artificial Sequence
  derived and/or modified sequence opt3 from TSEN54__Homo_sapiens__NP_997229
auggagcccgaaccugagccagccgcuguggaagucccggcaggcagaguucugagcgccagggagcuuuucgcggcucggucccgcucucagaagcucccccaacgaucacacgggccuaaagacuuucugccagauggaagugccgcacaggccgaacguuugagaaggugccgggaggaguuauggcagcugcuagcugaacagcgcguggagagacucgguagccugguagcagccgaauggaggcccgaggagggcuucguggaacuuaaguccccugcugggaaauuuuggcaaaccaugggauucucugagcagggccggcagcgccugcauccagaagaggccuuguaccuccuggaaugugguucgauccaccuguuucaucaggaccuccccuuaucaauucaagaggcguaucagcugcuuuugacagaucacacugucacguuccugcaguaccagguguuuagccaucuaaagcgacucggguauguugugagaagguuccaaccuaguuccguccugucuccauacgagcggcagcuuaaccuggacgcaagcgugcagcacuuggaagauggagacggcaaacguaagcgcuccucaaguagcccgagaucuauaaauaagaaagccaaggcucucgauaacucccugcaacccaaaucauuagccgcaagcaguccuccacccugcucucagccuucccaguguccagaggaaaagccccaggagagcucgccgaugaaaggcccugggggacccuuucaacugcucgguucucuuggcccauccccugggcccgcuagggaaggaguaggcugcucaugggagaguggucgggccgagaaugggguuaccggagcgggcaagcgacgcuggaacuucgaacagaucagcuuuccaaauauggccuccgacucuagacacacacuguugagggcacccgcuccugagcuacugccagccaacguggcuggccgggaaacugaugccgagagcuggugucagaagcucaaucagcgcaaagaaaagcugucaagaagggagcgugagcaucacgcagaagccgcucaauuccaggaggacgucaacgcggauccggaagugcagcggugcaguuccuggcgagaguauaaagagcuucugcagagaaggcaagugcagcgcagccagcggagagcaccccauuugugggggcagccugucaccccacuccugucucccggacaagccucaaguccugcuguuguguuacagcacauuagcguacugcagacaacccaccuaccagacgguggcgccaggcuccuggaaaaguccgggggacuugagaucauuuuugauguguaccaagcagacgccgucgcuacuuuccgcaaaaauaaccccggcaagccguaugcccgaauguguaucucugguuucgacgaaccugugccagauuugugcucgcugaaacggcucagcuaccaguccggggacguuccccugauauuugcacuuguggaucauggcgacaucucauucuacaguuuucgugauuucacacugccucaggacgucggacacuga

SEQ ID NO: 64286 - RNA, 504 nt, Artificial Sequence
  derived and/or modified sequence opt3 from TSFM__Homo_sapiens__NP_001166166
augagccugcucagaucccuuaggguguuccuggucgcccggaccggcucuuaccccgcugggucauuguuacgccagaguccucaaccacgacacacauuuuaugcaggaccgcgucugagcgccuccgcgucuucgaaggaacuacucaugaaacugagaaggaagacugguuacucauucguuaacugcaaaaaggcucuugaaacguguggcggggaccugaaacaggccgagaucugguugcauaaggaagcacagaaggagggauggagcaaagccgcuaagcuccagggccggaaaaccaaggaaggucugauugggcugcuccaagagggaaauacaacuguguuaguagaggugaacugcgaaaccgauuuugucagucgcaaucugaaauuccagcuuuuggugcagcagguugcacugggcacaaugaugcacugucaaacccuaaaggaccagcccuccgccuauucuaaggagaacugggagaaaacuuga

SEQ ID NO: 64287 - RNA, 1173 nt, Artificial Sequence
  derived and/or modified sequence opt3 from TSG101__Homo_sapiens__NP_006283
auggccgugagcgagucccagcugaagaaaauggucucuaaguacaaauauagagaccucaccguuagggaaacagugaacguaaucacucuuuacaaggaucugaaacccguguuggacucauaugucuucaaugauggcaguagccgggaguuaaugaaccugacggggaccauuccugugccauaccgcggaaauacauauaacauaccgaucugccuauggcuccuggacacuuaccccuauaauccuccaauuuguuuuguuaagcccaccuccucuaugacaaucaagaccgguaaacacguggaugcuaacggcaagauuuaccuuccuuaccugcaugaauggaaacacccacaaucggacuugcucgggcugauccaggucaugauagugguauucggagaugagcccccuguguuuucacgaccaaucagcgcaaguuauccgcccuaccaggccacuggcccuccaaauacauccuauaugcccgguaugccugggggaauuucuccauaccccagcggcuauccgccuaaccccuccggcuacccagggugcccuuaucccccaggaggucccuacccugcgaccacgucaagucaguacccaagccaaccgcccguuacuaccgucggcccuucucgugacgggacaaucuccgaagauacuauuagagcuucacugaucagcgccgugagugacaagcucagguggcggaugaaagaggagauggaucgcgcacaggccgaauuaaaugcucugaagagaaccgaggaagaccuuaagaaaggacaucagaaguuggaggagauggugacaaggcuggaucaggaagucgcagagguugacaaaaacauagaacuacucaagaaaaaggacgaggaacugucuuccgcccuugagaaaauggagaaucaaagcgaaaacaaugauauugacgaggugaucauuccaaccgcuccccuguauaagcagaucuugaaccucuacgccgaagagaaugcgaucgaagauacgauuuucuaucugggcgaggcauuacggcgcgguguaauagaccuggauguguuucucaagcacguccgacuucugucgagaaaacaguuccaguugagggcccuaaugcaaaaggcucggaaaacugccgggcugucugaccucuacuga

SEQ ID NO: 64288 - RNA, 2097 nt, Artificial Sequence
  derived and/or modified sequence opt3 from TSGA10__Homo_sapiens__NP_878915
augaugagaagcagguccaagucuccccggcgcccuucaccaaccgcccgaggcgcuaacugcgacguggagcugcucaaaacaacuacgcgugauagagaggaacuuaaguguaugcuggaaaaauacgagaggcacuuggcagaaauccaggggaaugucaagguuuuaaaaagugagcgggacaagauuuuccugcuauaugagcaagcccaggaagagauaacccgccucagaagggaaaugaugaaguccugcaaauccccgaagucuacaacugcgcaugcuauccugcggcgcguggagaccgagcgagauguagccuuuacagaccuuagaaggaugaccacugaacgggauucgcugcgugagcgcuugaaaauugcacaggaaacagccuucaacgagaaggcucaccucgaacagagaaucgaggagcuggaauguaccgugcauaaucuggacgaugagaggauggaacaaaugucaaacaugacgcucaugaaagagacuauuagcaccgucgaaaaggagaugaagaguuuagcacggaaagccauggacacagaguccgaacugggacgacagaaggcugagaauaacucucuucgcuugcuguacgaaaauacugagaaagaucuaagcgacacccagagacaccucgccaagaaaaaguaugaacugcagcuuacacaagagaaaaucaugugccuggaugagaagauagacaacuuuaccaggcagaauaucgcgcagcgggaagagauuuccaucuuggguggcacgcucaacgaucuggcaaaggaaaaagaguguuuacaggccugccuggacaagaaaucagagaauauugcuagucucggggaaagccuugccaugaaggagaaaacuaucucuggaaugaagaacauaauugcagaaauggagcaagcuagccgccaguguacagaagcccugaucgugugcgagcaggacguuucaagaaugaggcgucaauuggaugagaccaaugacgaacuagcgcagauugcccgggagcgagauauccuggcacaugacaacgauaaucuccaggaacaguucgcuaaggccaaacaagagaaccaggcucugagcaagaaacuuaacgacacucacaaugaacugaacgauaucaagcagaaagugcaggacacaaauuuggaggucaacaagcucaagaauauucugaaaagugaggaaucugagaacagacaaaugauggaacaguuaaggaaggccaaugaggaugcagaaaacugggagaauaaagcccgccaguccgaggcugacaacaauacccugaagcuagaacucauaacggcggaggcagaaggcaaccggcugaaagagaagguggauagccuuaauagagagguagaacagcacuugaacgccgagaggucguacaagucucaaaucuccacccugcauaaaucaguugugaagauggaagaggaacuccagaaaguccaguuugagaaggugagugcucuggccgaccuuagcuccacacgcgagcuguguauuaaauuggacucuagcaaggaacuccugaaucgacaguuaguggcaaaagaucaagagaucgaaaugcgggagaacgaacuggacucagcccacagugagauagagcuacuccguucccagauggcuaacgaaagaauuagcaugcagaaucuggaggcccuuuuggucgcaaacagggauaaggaauaucaaucucagaucgcgcugcaggagaaggaaucagagauccagcuccugaaagagcauuuaugccuggcugaaaauaagauggccauucaaagucgcgacguugcacaguuccggaacgugguaacucagcuugaggccgauuuggacaucaccaaaagacagcucgguacagaaagguuugagcgagagcgcgcugugcaagaacugcggagacagaauuacagcuccaacgccuaucacaugucuucgacuaugaagcccaauaccaaaugucacagcccugagagggcacaucaccguuccccagaucgcgggcuagaccggucacuggaagagaaccucugcuacagagauuucuga

SEQ ID NO: 64289 - RNA, 2295 nt, Artificial Sequence
  derived and/or modified sequence opt3 from TSHR__Homo_sapiens__XP_005268094
augagacccgccgaccugcuccagcuugugcuguuguuagaucugccuagggaccuaggcgggaugggaugcagcuccccaccgugugagugccaccaagaagaggauuuccgggucaccuguaaggacauccagcgcauucccucucucccuccaucaacacagacucugaaacuuauagaaacgcaucugcgaaccauccccagucacgcuuuuagcaacuugccuaauauuucccguaucuacguuucuauugaugugacacuccagcaacuggagucgcauucauucuauaaccugagcaagguaacucacaucgaaauaagaaauaccaggaaccucacauacaucgacccagaugcauuaaaagagcugccccuuuugaaguuucuggguauuuucaauaccggccuaaaaauguuuccugaccucacuaagguguauaguacagauaucuucuuuauucuggagaucaccgacaacccauacaugacguccauaccggucaaugccuuccaggggcuuugcaacgaaacucugaccuugaagcucuauaauaacggauuuacaucugugcagggcuacgcguucaaugguacuaaacuggaugcuguuuauuuaaacaagaauaaauaccugaccgugauugacaaggaugccuuugggggagucuacagcggccccucccuccuugacgugucacagacaaguguaaccgcacugccuagcaaaggcuuggagcaucuaaaggaacugaucgcccggaacacguggacucucaagaaacugccacuuucucuguccuucuugcaccucacacgcgcugaccugucauaucccagccacuguugcgcauuuaagaaucagaaaaagauuagagggaucuuagagagucugauguguaacgagucuuccaugcaaagccuaaggcagcggaaaucgguuaacgcccucaauucuccucugcaucaggaauacgaggaaaaccuuggagauuccaucguggguuauaaggagaaaucaaaguuccaagacacccacaauaacgcucauuacuaugucuucuuugaggaacaggaggaugaaauuauaggcuucgggcaggaguugaagaauccacaagaagagacucugcaggccuuugacagucacuacgauuauacaaucugcggagacagcgaagauaugguguguacccccaaauccgacgaguucaacccgugcgaggauauuaugggcuacaaguuucuccgcaucguggucugguucguuucucugcuugcgcuguuggguaauguguuuguacuccugauauuacugacgagccacuacaaacuaaacgugccucgauuccucauguguaaucuggcauuugccgacuucugcauggggauguaucuuuugcugauugcuucagucgaucucuacacccauagugaauauuacaaccacgccaucgacuggcagacaggacccggcugcaauacugcaggcuuuuucaccguguuugcuuccgagcugagcguuuauacauuaacugugaucacccuggaaagaugguacgccauuacauucgcgaugaggcuugaccggaagauccguuugcgccaugccugugcaauuauggucgggggaugggugugcuguuuccuccuggcucuacugccacucguagguauaucuucauaugccaaaguuaguaucugccugccuauggauaccgagacuccccuugcuuuggccuacauuguguuuguccugacguuaaacaucguggcauucgucaucguguguugcuguuacguuaagauuuauauaacagugagaaauccacaguacaaccccggcgacaaggauaccaaaaucgccaagaggauggcuguacucauuuuuacugacuucaucugcauggcgccuauuagcuuuuaugcacuguccgccauccuuaauaaaccacugauaaccgucucuaacucgaagaucuugcucgugcuguucuacccgcuaaacagcugugcuaaucccuuucuguaugccauuuucacaaaagcauuucaacgggauguuuucauccuccuguccaaguuugggauuugcaagcgacaggcccaggcuuaccgcggacagagagugccuccaaagaacucaaccgacauccaaguccagaaagugacucacgaaaugaggcagggccuucauaauauggaggauguauaugaguugauagaaaacagucaccugacacccaaaaagcagggucaaauuucugaggaauacaugcagacgguguuauga

SEQ ID NO: 64290 - RNA, 3099 nt, Artificial Sequence
  derived and/or modified sequence opt3 from TSHZ1__Homo_sapiens__NP_005777
augugcaacgaggaaaccgagaucaaggaagcccagagcuaccaaaauucccccgugucuucagcuacaaaccaggacgcaggcuaugggaguccuuucagcgaguccucugaucagcuggcccacuuuaaaggaucgucaagcagagaagagaaggaggacccacaguguccggauagugucuccuacccccaagacucucucgcgcagauuaaagcuguuuaugccaaucuuuucagcgaauccugcuggucaagucuggcauuggauuuaaagaaaagcgguucuacuacguccaccaacgacgccucacagaaggagagcagugcuccuacaccaacucccccuaccuguccagugucuacaaccggccccacuacauccaccccuagcacgucgugcagcuccucaacuucccauagcuccaccacaucuacuagcucaaguuccggguacgauuggcaccaggcagcccuggcuaagacccuacaacagacaagcucuuauggacuccugccagaaccgucacuuuuuaguaccguacagcuguacaggcagaauaacaaauuguauggcagcguguucacgggugccuccaaguuucgguguaaagacugcucugcggcauacgauacucucgucgagcugacagugcauaugaaugagaccgggcacuaccgcgacgauaaccgagacaaggauucggaaaagacuaagcguuggagcaagcccagaaaaaggucccugauggagauggaaggaaaggaggacgcccaaaaaguucucaaguguauguauugcggccauucauucgaaaguuuacaggaccugucugugcacaugauaaaaacaaagcacuaccagaaagucccucuuaaggagccagugcccgcuaucaccaaguugguaccuagcacgaaaaagcgggcccugcaagaucuagcaccacccuguuccccggagccugcuggcauggccgcggaaguugcccucucagagagcgcaaaagaccagaaggcugccaaucccuaugugaccccaaacaaucgcuacggguaucagaacggagcuucuuacacauggcaguuugaagccagaaaagcacaaauucugaagugcauggagugugguuccagucaugauacucuucagcagcugaccgcccacaugauggucacaggccauuucuugaaggugacuaccagcgcuucuaaaaaggggaaacagcucgugcuggacccugucguugaagagaagauccaauccauucccuuaccacccacaacccacacuaggcugccugcgucaaguaucaaaaagcagccagauagcccggcaggaucgacgacauccgaggaaaagaaagagcccgaaaaggagaaaccuccaguggccggcgacgcugaaaagauaaaagaggagucugaagauagccucgagaaguuugaacccucaacccuuuauccuuaccugcgggaggaggacuuggaugacaguccaaagggugggcuagauauccugaaaucccucgaaaauacuguaucuaccgccauuagcaaggcacagaacggagcccccuccuggggcggcuacccgucaauccacgcugccuaucagcugccugggacagugaaaccacuucccgcagcgguccaaagcgugcagguucagccuaguuacgcuggaggugugaagucucuguccagcgccgagcauaaugcauugcuccacucgcccggcucacugaccccaccuccccauaaaucuaacgucagugccauggaagaguuaguggaaaagguaacugggaaaguuaacauuaagaaggaggagcgcccaccggaaaaagagaaguccagccuggcuaaagccgcaucuccuaucgcuaaggaaaauaaagacuuccccaagacagaggaagugagcggaaagccacagaaaaagggccccgaggccgagacggguaaagcgaagaaagaagggccucuagacguccacaccccaaacggcacugagccccucaaggccaaggugacaaauggaugcaacaaucugggcauaauuauggaucauuccccugaaccgucauuuaucaacccacuuagugcuuugcaaagcauuaugaauacccaccuggggaaagucucuaagcccguguccccuucacucgacccacuggcaaugcuuuauaaaaucaguaacagcaugcuggauaagcccguuuacccugccacaccggugaaacaggcugacgccaucgaucgauauuacuaugagaauagugaccagcccauugauuugacuaagucuaagaacaaaccacucguaucgagcgucgcagacucaguggcguccccucugagagaaagugccuuaauggauauaucugacaugguuaagaaucugaccggaaggcuaacgcccaaaagcuccaccccaucaacagugucugagaagucugaugcugacgguaguuccuucgaggaagcccucgaugagcugagcccuguccacaaacggaagggccgucaaucuaacuggaauccccagcaucuuuugauccugcaggcacaguuugcuucaucccuccgcgaaacuaccgaggggaaauacauuaugagugaccugggaccacaagagagagugcacaucagcaaguucacaggcuuaucgaugacuaccauaucucauuggcuggccaacguaaaguaccagcuuaggcggacgggugggacaaaauucuugaagaaucucgacaccggccacccgguguuuuucugcaacgauugugcaucccaguuucgaacugccagcacauauauuucacaccuggaaacccaucuaggauucagucugaaagaccucucuaagcugccucuuaaccagauccaagagcagcagaauguuuccaaagucuugacuaacaagacccugggccccuuaggggcuacagaagaggaucucggaagcacguuucagugcaagcuguguaaucgcaccuucgcgucaaaacacgccgugaaacuucaucugaguaaaacucacgguaagagcccagaagaccauuugaucuacgugacagagcucgagaaacaauga

SEQ ID NO: 64291 - RNA, 3096 nt, Artificial Sequence
  derived and/or modified sequence opt3 from TSHZ2__Homo_sapiens__NP_001180350
augauggccgcugcacugcuccacuacaccggcuaugcccaggaggaacaacuuaaggaggaagaggaaaucaaagaggaggaagaggaagaggacagcggguccguggcgcagcugcagggagguaacgauacaggcacugacgaggaauuggagacggggcccgaacagaagggaugcuucucuuaccaaaauucaccuggcagucauuuaagcaaccaggaugcugagaaugaaucccugcuaucugacgccucggaucaggucucagacauuaaaagcguuugugguagagaugcaagugacaagaaagcccacacccaugugaggcucccaaacgaggcucacaauugcauggauaagaugacagcaguauaugccaacauacuguccgacucuuacuggagcgggcuuggacugggcuuuaaguuguccaauucagagcggcgcaacugugauacucgaaauggcaguaacaaaagcgacuucgauuggcaucaggacgcucucucuaagucccugcaacagaaucugccgucacguagcgugaguaaacccucucucuuuuccagcguccaguuauauagacagucgucuaagaugugcgggaccguguucacaggagccuccagguuucggugucgccaaugcucagcggcauacgacacccugguugaacuuacugugcacaugaacgagacaggucacuaucaggaugacaauaggaaaaaggauaaguugaggccuaccaguuacagcaaaccacggaagcgcgccuuccaggacauggauaaagaagacgcucaaaagguccugaaauguauguuuugcggcgauuccuucgacucucuacaggaucucagcgugcauaugaucaagacgaaacacuaccagaagguaccccugaaggagccuguuccaacuauuucaaguaaaauggugacccccgccaagaaacgagucuuugacgugaacagaccuuguuccccagauagcacaacugggucuuucgcagacucauuuaguagccagaagaaugcuaaccuucaacuguccucuaacaauagguauggauaccagaacggcgccucguauaccuggcaguucgaagcgugcaaaagccagaucuugaaguguauggagugcgguuccucacaugacacacuccaacagcugaccacgcacaugauggugacugggcacuuuuuaaaggucacaaguucugccagcaaaaagggaaaacagcugguucucgauccgcuugcaguggagaagaugcagucccugucagaagcucccaauagcgacucuuuggccccuaaaccauccaguaacagcgcuucugauugcaccgccuccacuacagagcuaaagaaggaaagcaaaaaggagcggcccgaagagaccaguaaagacgagaagguagugaaaagcgaagauuacgaggacccucugcaaaagccacucgaucccacgauuaaguaucaguaccugcgugaagaggaccuugaggauggcucgaaaggcgggggagacauccugaaguccuuggaaaauaccgucacaacugcaauaaacaaagcccagaauggugcuccgucuuggagcgcguauccuucaauccaugcagccuaccagcucagugagggcaccaagcccccacugccuauggggucccaaguguuacagauucgccccaaccugacaaauaaacuaagaccaaucgcucccaaguggaaaguuaugccucucgugucuaugccaacucaccuggccccguacacccaggucaagaaggaaagcgaggauaaagacgaagcagugaaggaguguggaaaagaguccccucaugaagaggccucaucauucagucacucugaaggcgauuccuucagaaagagcgagacaccuccagaagcuaaaaagaccgagcuuggucccuugaaggaggaagagaaacugaugaaggaagggucggagaaagaaaagccucaaccacucgagcccacuucagcccugucuaacggcugcgcacuugcgaaucaugcuccggcccugccuuguauuaacccauugagugcacuccaguccguacugaauaaccacuuaggaaaagccacggagccccugcggagcccuucuugcagcucccccucaaguagcacaaucucuauguuucacaaguccaaucuaaacguuauggacaagccagugcucucacccgcuaguacccgaagcgccuccgucucucgcagauaucuguucgaaaacucggaccagcccauagaucuuacuaaaagcaagaguaaaaaggcagaguccagucaggcucaaucuuguaugagcccaccgcagaaacaugccuuguccgacauugcggauauggugaagguccugccuaaggccaccacacccaaaccagcuucaucuagcagggugcccccuaugaagcucgaaauggacguucggcgcuuugaggaugugaguuccgagguaagcacccugcacaaaagaaagggcaggcagucuaauuggaacccacagcauuuacugauccuucaagcacaguucgccucauccuuguuucagacuucagaagggaaauaccuccugagcgaccuaggaccccaggagcguaugcaaauuucgaaguucacaggucugucuaugacgaccaucucccacuggcucgcuaaugucaaauaucagcugcggaagacuggcgggacaaaguuucuuaaaaacauggauaagggacacccuaucuucuacugcagcgacugugccucacaguuucgaaccccgaguacauauauuucucauuuggaaucccaccugggcuuccaaaugaaagauaugacuagauuaagcguggaccagcagucaaagguugagcaggaaauaaguagggugagcuccgcacaacgcucuccagagaccaucgcggccgaggaagauacggacagcaaauuuaagugcaagcucuguugccggaccuucgucuccaaacaugcugugaagcugcaccuuucaaaaacacauucuaagagucccgagcaccacucgcaguuuguaacugauguggacgaagaguga

SEQ ID NO: 64292 - RNA, 3246 nt, Artificial Sequence
  derived and/or modified sequence opt3 from TSHZ3__Homo_sapiens__NP_065907
augcccagaaggaagcagcaagccccucggcgcgcugcagccuacgugagcgaggaacugaaagcggcugcccucgucgacgagggccuugauccagaggaacacaccgcagacggggaaccguccgccaaguauaugugccccgagaaagagcuggcucgagcauguccuucuuaccagaacucaccagccgcugaguucaguugccaugaaauggauagcgaaucccacaucucugagacaucggaccguauggccgauuuugagucaggaagcauuaagaaugaagaggaaacuaaagagguuacggugcccuuggaagacaccacaguaagugauuccuuagagcagaugaaggcgguguauaacaauuuccugucuaacagcuacugguccaaucuaaaccucaaucugcaucagccuucaagugagaagaacaaugguaguucuuccucaagcaguucuuccagcucgucuuguggcuccgggucauuugacuggcaccaaagugcaauggccaaaacucuucagcaggucagccaguccagaaugcugccagaacccucuuuguucagcaccgugcaacucuauaggcagucaaguaagcuguacggauccauauuuacaggcgcuagcaaauuccggugcaaggauuguucugccgcauaugacacccugguugagcucacugugcauaugaacgaaacaggucacuaccgcgaugacaaucacgagaccgauaacaauaacccuaaaagauggucaaagccaaggaagcggaguuuacuggaaauggaggggaaagaggacgcucagaagguccuuaaaugcauguacuguggacauagcuuugaauccuugcaggaccugucugugcacaugaucaagacgaaacauuaucaaaagguaccgcuaaaagagcccguuacuccuguggccgcgaagauuaucccagccacccgcaagaaagcaucgcucgaacuggagcuucccagcuccccugauucaacaggcggcacuccaaaggcuaccauuagugacacaaaugaugcccugcagaaaaacucuaaccccuacaucaccccgaauaaccgauaugggcaccagaauggagcuagcuacgccuggcacuucgaagcaagaaagucccaaauauugaaaugcauggagugugguucaagccaugacacgcuccaggagcugacugcccacaugauggucacaggccauuuuaucaaggugaccaacucugcuaugaagaaagggaagccuauuguggaaacucccgucacaccaaccaucacgaccuuacuggaugagaaaguucaguccgugccucucgcggcaacaacuuucaccagucccagcaauacaccagccucuauuucccccaaacuuaacguagaagugaaaaaggaggucgacaaggagaaagcugugacugaugaaaagccuaaacagaaggacaaaccaggagaggaagaggaaaagugcgauaucucaaguaaguaucacuaccugaccgagaaugacuuggaggaaagcccgaaaggcggucuagauauacugaagucgcucgagaacacaguuaccuccgccauuaauaaagcacaaaacgggacucccucuuggggaggcuauccuagcauccaugccgcuuaccagcugccaaauaugaugaaacuuucacugggcaguuccgggaagucuacgcccuugaagccuauguuuggaaacagcgaaauuguguccccaacaaagaaucagacccucgucucacccccgagcagucagacuucuccuaugccaaagaccaacuuccacgccauggaggaacuggugaagaaaguaacagagaagguugcaaaaguggaggaaaagaugaaagagcccgacgguaaguuauccccucccaagagggcgaccccaagcccuuguucgucagaagucggcgagcccaucaaaauggaggcuucuagugacgggggauuucggucccaagaaaauagcccaucuccgccucgugauggcugcaaggacgguagcccccuggccgagccaguggaaaacgggaaagagcuagucaagccccucgcauccucacugaguggcagcacugccaucauuacagaucacccuccagaacagcccuucgugaacccucuuucugcuuugcaguccguuaugaauauacaucugggaaaagccgcaaagccgucacucccagcucuggaccccaugaguaugcuuuucaagaugagcaacucccuggccgagaaagcggccguggcuacgccuccacccuugcagucuaagaaagcagaucaccucgaccgcuacuuuuaucauguaaauaacgaucaaccuaucgaccugaccaagggcaaaucggauaaggggugcagcuuaggaucaguccugcuauccccgacuagcacagcccccgcuaccucuagcuccacagugacuaccgccaagacgucagcaguugugucuuucaugagcaauaguccacucagagagaacgcgcuguccgacauuagcgauaugcuuaaaaauuugaccgaaucucacacaucaaaguccaguacuccuagcucgaucucugagaaauccgacauagauggugccacccuggaagaggcugaagagagcacacccgcccagaagaggaaaggccggcagucaaacuggaauccacagcaccuccugauuuuacaagcacaguuugcugccagucugcgacagacuucugaggggaaguacaucauguccgaccuuagcccucaagaacgcaugcauaucucaagauucaccggauugaguaugacgacaauuagccacuggcucgcaaacgucaaauaucagcugaggcggaccggcgguacuaaguuucuaaagaaucuggacacagggcaucccguguucuuuuguaacgauugcgccucccagauccgcaccccaucuacuuacauuagccaccucgagucccaucugggcuucagacuuagggacuugucaaaacugucuaccgaacagauaaauagucaaaucgcucagacaaagucgccgagcgagaaaaugguaacguccucuccugaagaggauuuaggaaccucauaucaguguaagcucugcaaccguacuuuugcgagcaaacacgccgugaagcugcaccuuuccaagacacauggcaaaagucccgaggaccaccuguuguacguuucugaacucgagaagcaguga

SEQ ID NO: 64293 - RNA, 480 nt, Artificial Sequence
  derived and/or modified sequence opt3 from TSLP__Homo_sapiens__NP_149024
auguuccccuuugcccugcucuacgugcuuagcgucuccuucagaaagaucuuuauucugcaguugguuggcuuagugcugaccuaugacuucacaaacugcgauuuugagaaaauaaaggcugcauaccuaucuacuaucucaaaagaccucauuacguauaugagugggaccaagagcacagaguucaauaacacuguauccuguucuaauaggccucacugccugaccgaaauccaaucgcuuacauuuaacccaaccgccggaugugcgucacuggcuaaagaaauguucgccaugaagacuaaggcagccuuggcuauuuggugcccggguuacagcgagacacagaucaaugcaacccaggccaugaaaaagcggcgcaaacgaaaggugacgacuaacaaaugucucgaacaggucagucaacugcagggccuguggcguagauuuaauaggccccucuuaaagcagcaguga

SEQ ID NO: 64294 - RNA, 873 nt, Artificial Sequence
  derived and/or modified sequence opt3 from TSNAX__Homo_sapiens__NP_005990
augagcaacaaggagggcuccgggggauucagaaaaaggaagcacgacaauuuuccccauaaccagcggcgcgaagguaaagaugucaauucuucaaguccugugaugcuggccuucaagagcuuucaacaggagcucgacgcucgacacgauaaauacgaacgucuuguuaagcuguccagagacaucaccguggagucuaagaggacaauuuucuuguuacaucggauaacuucggcaccagauauggaagacauccugacggagucagagauuaaacuagauggcguacgccagaagaucuuucagguggcccaagaacucagcggggaggacaugcaccaguuccauagagcgauuaccacaggacugcaggaauaugucgaggcugugaguuuucagcacuucaucaaaacuaggucccuuauaucuauggaugagaucaacaagcaacugauuuuuaccacagaagacaauggcaaagagaacaagaccccgagcuccgaugcccaggacaagcaguucgguacuuggcgguugcgcguuacacccguggauuaccuccugggggucgcagaccugaccggagaacucaugcgaaugugcaucaauucagugggcaacggcgacauugauacgccuuuugagguaagucaguucuuaagacaaguuuaugacggguuuagcuucaucggaaauacugguccauacgaagugucuaaaaagcuguauacccuuaaacaguccuuggccaaggucgagaacgcuuguuacgcacugaaagugaggggcucagagauacccaagcacaugcuagccgauguguucagcgucaaaacagaaaugauugaccaggaggaagggaucaguuga

SEQ ID NO: 64295 - RNA, 447 nt, Artificial Sequence
  derived and/or modified sequence opt3 from TSN__Homo_sapiens__NP_001248330
augagcguguccgagaucuucgucgaacugcagggcuuucucgccgcugagcaagacauuagagaagagauaaggaagguugugcagucucuugaacagaccgcacgggagauccugacauuguuacaggggguacaccaaggagccgguuuccaggauauucccaaacgcugccugaaggcgcgagagcacuuuggcacugugaaaacgcaccuaaccucacucaagacaaaauucccugcugaacaguacuaucguuuucaugagcacuggagauucguccugcagaggcuuguguuucuggccgcauucguuguguacuuggaaacugagacccucgucacacgggaggccgugaccgaaauccuggggauugaggcuguaugucaacagcgcgacugcuggagacugcucccaacuccgccccauuuacaucugcaccaguga

SEQ ID NO: 64296 - RNA, 1182 nt, Artificial Sequence
  derived and/or modified sequence opt3 from TSPAN10__Homo_sapiens__NP_001277141
augcacagacuggcccagggcaggagccaagaccagcccuccucuccugcuaccgaggaaccagcaaaccucucacggcgccuuugcugggggcugagugugccggccagccgaauggaggaaggagagcguucccccuuguuaucucaggaaacagcgggucagaagccucugucgguccauagaccacccacuucaggcugucuagggccuguuccaagggaggaucaagcugaggccuggggaugcagcuguugucccccugaaacgaaacaccaggcacucaguggcaccccaaagaaagguccggcccccucccugucuccugggagcuccugcgugaaguaccuuaucuuccugucaaauuuuccauucaguuugcucggacugcuggcucucgcaauuggcuuauggggccuggccguaaaagggagccuuggaucugacuuggguggcccccugccugcugauccaaugcuagggcucgcccugggaggccuuguggucuccgcggugucacuggcagguuauuugggggcccucugcgagaacacaugucuguuacggggauuuagcggcggcauacuggcuuuccucguucuugaagccguggcaggggcucuggucguggccuuguggggaccccuacaggacagucuggagcauacucuccgcguagcgaucgcccacuaccaggaugacccggaucugagauuucuucuggaccaaguucaguugggucucaggugcuguggcgcagcuucuuaucaggauuggcagcaaaaucuguacuucaacugcuccagcccuggggugcaggccuguucguuacccgcuucuugcugcauugacccacgggaggauggagccuccgucaaugaccaguguggcuuuggugugcugcgccuagaugcagacgccgcucaacgaguggucuaucucgaagggugcggcccuccccugagaagguggcuucgggcgaacuuggcagccucaggaggcuacgcuaucgccguugugcugcuccagggggcagagcugcuucuggccgcucguuugcucggagcccuggcagcgcgcagaggugcugccuauggcccaggggcaaggggagaagaccgggccggcccccagaguccuagcccaggugcuccgcccgccgcaaagccugcucgaggguga

SEQ ID NO: 64297 - RNA, 762 nt, Artificial Sequence
  derived and/or modified sequence opt3 from TSPAN11__Homo_sapiens__XP_011518982
auggcccacuacaagaccgagcaggacgauuggcugaucauuuaucucaaauaccuucuguucguguuuaacuucuuuuucugggucggcggggcugcaguuuuggccgugggaauauggacauuaguagaaaagagcgguuaucuguccgugcuagcgucuucaacuuuugcugccagugcauacauccucauuuucgccggcguccuggugaugguuacgggguuucuuggauucggcgcuauccugugggagagaaaagguugcuugagcaccuauuuuugucuccugcuggugauuuuccucgucgaauuaguggcagggguacuggcccauguuuacuaucaaaggcuuuccgacgaguugaagcagcaccugaaucggacacuagcugaaaacuacggacagcccggcgccacucagaucaccgcgucuguggaucgccuccaacaggacuuuaaaugcuguggcucaaauucgagcgcagauuggcagcauaguacauacauacugcuucgagaggccgaggggcgucaggucccugacuccugcuguaagaccgugguggucagaugcggacaaagggcucacccaucuaacaucuauaagguugaagguggcugucugacuaaauuggagcaguuccucgccgaucaucuguuacugaugggggcagugggaauuggcguagcuugccuccagaucugugguauggugcuuacaugcugucugcaccagcgguugcaacgccacuuuuacuga

SEQ ID NO: 64298 - RNA, 918 nt, Artificial Sequence
  derived and/or modified sequence opt3 from TSPAN12__Homo_sapiens__XP_011514296
auggccagagaggacagcgugaagugccugaggugucuccuuuacgcucugaacuuguuauucuggcugauguccaucucuguccuagcaguuucagccuggaugcgggauuaucucaauaacgugcugacccuuacagcggaaacucgcguagaggaagcugugauucugacguacuuucccgucgugcacccuguuaugauagccgugugcuguuucuugaucauugucggcaugcucggguauugcggaaccgugaaacgaaaucugcugcucuuagcaugguacuuugguagucugcuuguaaucuucuguguugaguuggccugcggcguguggacauaugaacaggagcugauggucccagugcaauggagcgacauggugacucuaaaggcucguaugaccaacuacgggcucccgagauauagguggcugacacaugcauggaacuuuuuccagcgggaguuuaaauguugcggagucguuuacuucaccgauuggcuugaaaugacugagauggacuggcccccugauuccuguugcgugcgcgaauuuccaggcuguucuaagcaggcccaccaggaggaccugucggauuuguaccaagaggguugcgggaaaaagauguauucauuccucagaggaacaaagcagcugcagguauuaagguuucugggcauuagcaucggcgugacccagauacucgcuaugauccuuacgauuacucuguugugggcccuauacuaugaccggcgcgaacccgggaccgaucaaaugaugagucugaaaaaugacaauucccagcaucucucuugcccuagcgucgagcugcuuaagccaucccugucacgaaucuucgaacacacaaguauggcgaacagcuuuaauacucauuucgagauggaagaguuguga

SEQ ID NO: 64299 - RNA, 615 nt, Artificial Sequence
  derived and/or modified sequence opt3 from TSPAN13__Homo_sapiens__NP_055214
auggugugcggcggguucgccuguagcaagaacugccugugugcucucaaucuucuguacaccuuggucuccuuacugcuaaucggaauugcagccugggguauaggcuuugggcucaucucuucacugagaguugugggaguagugauugcggucggcaucuuccuuuuucugauugcuuuggugggucucaucggggccguuaaacaccaucaggugcugcuguucuuuuauaugauaauccucuuacuggucuucauugugcaauuuaguguaagcugcgcaugucuugccuugaaccaggagcagcagggacaacugcuagaaguuggcuggaauaacacagcuuccgcaaggaaugacauccagcggaaccucaauugcuguggcuuccgcucugugaaccccaaugauacuugccuggccucgugugucaagucagaccacagcugcaguccuugugcuccaauuaucggggaguacgccggagaagugcuucgauuuguggguggcauagggcuguucuuuuccuucacggagauuuugggagucuggcucaccuaucguuacagaaaccagaaagauccgagggcgaaucccucugcauuucuguga

SEQ ID NO: 64300 - RNA, 444 nt, Artificial Sequence
  derived and/or modified sequence opt3 from TSPAN14__Homo_sapiens__NP_001121781
augcacuacuauagauacagcaacgccaagguguccugcugguauaaauaccugcucuuuucuuauaauaucauuuucuggaaccaguguugcggcgcuuacgggcccgaggacugggaucuuaaugucuauuucaacuguucaggagcaaguuacagcagggaaaagugcgguguuccuuuuuccuguugcgugccagacccggcccaaaaaguagugaauacccaguguggcuacgauguccggauacagcugaagucuaaaugggacgagucgaucuucacaaaggggugcauucaggcguuggaaucaugguuaccccgcaacaucuauauuguggcuggaguuuuuaucgccauaagccugcuacaaaucuucggcauuuuucucgcacgaacucugaucagugauauugaggccgugaaggcuggucaucacuucuga

SEQ ID NO: 64301 - RNA, 735 nt, Artificial Sequence
  derived and/or modified sequence opt3 from TSPAN16__Homo_sapiens__NP_001269438
auggccgagauccacacccccuacagcucccugaagaaacuccuuucucuguugaacggcuucguggcugucucagggauuauauuaguuggacuggguaucggcgggaagugcggaggcgcaagucuaacaaaugugcucggucugagcuccgccuaucuucugcauguagggaacuugugucucgugaugggaugcauuacuguccugcugggcugugcgggcugguacggggcuacgaaagaaucuagaggaacccucuuauuuugcauccugucgauggugauuguucuuaucauggaggugacagccgcaacugucguguugcuguucuuuccuauaguaggugacguugcccuagaacacaccuucgugacacucaggaagaauuaucggggcuacaacgagccagaugacuauucaacccaguggaaucuggucauggaaaaacuuaaguguugcggggugaacaauuacacugauuuuagcggaaguuccuucgagaugacaaccggccauacguauccgcgcucuuguugcaagagcaucgguuccgugucaugugacgggcgagaugucagucccaacguuauucaccaaaaaggaugcuuucauaagcuguugaaaaucacuaagacccagagcuucacacucucuggcuccucacugggcgcugcagugauucaguuaccugggauccuggccacucuccuucuguuuauaaaauugggauga

SEQ ID NO: 64302 - RNA, 777 nt, Artificial Sequence
  derived and/or modified sequence opt3 from TSPAN18__Homo_sapiens__XP_006718435
augcccgaggaacugccuagauggagcaccauggagggcgacugccucuccuguaugaaguaccuuauguucguguuuaacuucuuuaucuuccugggaggggccugcuuguuagcuauugguauaugggucaugguugauccaacaggcuuuagggaaaucguggcagccaauccgcugcuacucacuggggcguauauucugcuugcuaugggaggccuguuguuccuccuggguuuucugggguguugcggagccguacgggagaacaaaugucucuuacuguucuuuuuccuuuuuaucuugauuaucuuccuggcagaacuaucugccgcuauacucgcauuuaucuuccgcgagaaucugacgcgagaguucuuuaccaaggaacuuacaaaacacuaccagggcaacaaugacacugauguguucucagccaccuggaacagugucaugauuacauuuggcugcuguggggugaauggacccgaggacuucaaguuugcuagcguuuuccgucuguugacccucgauuccgaagaggugccugaggccugcuguagaagggaaccacaaucucgggacgguguccuguuaucgcgcgaggaaugccugcucggcagaucacuuuuucugaacaaacagggguguuauacugugaucuugaauacauucgagaccuacguauaucuagcgggagcacuggccauuggcguucucgcuaucgaacuguuugccaugauauucgcaaugugccuuuuuagggguauucaguga

SEQ ID NO: 64303 - RNA, 633 nt, Artificial Sequence
  derived and/or modified sequence opt3 from TSPAN31__Homo_sapiens__NP_005972
auggugugcggcggguucgccuguagcaagaacgcucugugcgcacucaaugucguuuacaugcuugugucccuguuguuaaucggaguagccgcgugggguaaaggccuggggcuagugucuucaauucacauaaucggaggcgucauugcuguggguguuuuucuccugcuuaucgccguggcagggcuggucggagccgugaaccaucaccagguacucuuguucuuuuauaugauuauccugggccugguuuucauauuucaauucgugaucaguuguagcugccucgcuauuaauagauccaagcagaccgacgucaucaacgcaucuuggugggugaugucgaauaaaacaagggaugaguuagaacggucauuugacuguugcggccuguucaaccuuacuacguuguaccagcaggauuaugacuuuuguaccgccauuugcaagagccaaagucccacaugucagaugugcggggagaaauuccugaagcauuccgaugaagcucuaaagauccucggaggugugggccuguuuuucucuuuuacugagauacuuggggucuggcuggccaugcgcuuccgaaaucagaaagacccucgugcgaacccaagcgcauucuuguga

SEQ ID NO: 64304 - RNA, 963 nt, Artificial Sequence
  derived and/or modified sequence opt3 from TSPAN32__Homo_sapiens__NP_620591
augggccccuggagcagagugagggucgccaagugccagaugcugguuaccuguuucuuuauccuccuucugggguuguccguggcuacaaugguaacuuuaacguacuucggagcacacuuugccgugauucggcgcgcgucucuggagaaaaacccuuaucaagcuguccaucagugggccuucucagcaggucuaagucucgugggccugcuuacccugggggccguuuugagcgcugcagccacagugcgagaagcucagggacucauggccggcgguuuucugugcuucucccuggcguuuugugcacagguccaagugguauucuggcgucuccacucuccaacucagguugaggacgccauguuagauaccuacgaccugguguaugaacaggcuaugaaggggacaucgcaugucagaaggcaggagcuugccgcaauacaagauguguuuuugugcuguggcaaaaagucaccguucagccggcugggaaguaccgaagcugaccuaugccagggcgaggaggccgcgcgcgaagauugucuccaggggaucagauccuuucugaggacucaccagcaaguggccucuagccuuacauccauuggacuggcauugaccgucucagcucuccuguucaguagcuuuuuaugguucgccauccggugcgguuguucucuggaccgcaaaggcaaguacacgcucacuccccgagcuugcgggagacagccucaggagccaucccuucugagguguucacaaggaggccccacccauugcuugcacagcgaagccguugcaauugguccucgggggugcaguggaucucuacguuggcugcaggaguccgaugccgcuccacucccccugagcugucaccuugcggcacaucgcgcccugcagggcagaucgaggggcggguugucuggaugcccugagcggggucucuccgacuga

SEQ ID NO: 64305 - RNA, 852 nt, Artificial Sequence
  derived and/or modified sequence opt3 from TSPAN33__Homo_sapiens__NP_848657
auggccagaaggccccgggcuccugcagccagcggcgaggaguucuccuuugugucuccacuggucaaguaccuccuuuucuuuuucaacaugcuguuuuggguuaucucaauggugaugguagcggugggggucuaugcucgcuugaugaaacacgccgaagcagccuuagcuugccuggcaguggacccggccauucuacucauaguugugggaguccugauguuccuucugaccuuuugugguugcaucggcaguuugcgagaaaauauuugucuccugcagacauucagccugugccucacugcuguguuuuuacugcaacuugccgcggggaucuugggauucguauuuuccgauaaggcacguggcaaaguuucugagauuaucaacaaugccauagugcauuacagagacgaucuggaccuacagaaccucaucgauuucggucagaagaaauuuucguguugcgggggaauuucauauaaggacuggagccagaauauguacuucaacuguagugaagauaaucccuccagggagcggugcucugucccuuauagcuguugccugccaacgcccgaccaagcugugaucaacaccauguguggccagggcaugcaggccuucgauuaccuugaggcauccaaggugauuuauacaaaugggugcaucgacaaacuggucaacuggauacacucaaauuuguuucuccugggagguguugcuuuaggccuggccauuccucagcucguggggauccuucugagucaaauuuugguaaaccagaucaaggaucagaucaaacuacagcuguacaaucaacagcaucgcgcggacccaugguacuga

SEQ ID NO: 64306 - RNA, 717 nt, Artificial Sequence
  derived and/or modified sequence opt3 from TSPAN4__Homo_sapiens__XP_005253159
auggccagagcuugccugcaggcagugaaguaccucauguucgccuuuaaccuucuguucugguugggcggguguggagucuuagguguuggcaucuggcuggcggcuacccaagggagcuuugccacacuauccucuucauuccccagucucagcgcagccaaucugcuuauuauaacuggagcuuuugugauggcaaucggcuucguagguugccugggggccauuaaagagaacaaguguuugcuccugacguuuuuccugcucuuacugcuuguguuuuugcuggaagcuaccaucgccauucuauucuuugcguauacagacaaaaucgauagguacgcacagcaggaccucaagaaaggacugcaccuuuauggcacucagggcaaugucgggcugaccaacgccugguccauaauccaaacagauuuccggugcuguggagugucuaauuacaccgacugguuugagguuuauaacgcuacucgcgugccugauucgugcuguuuggaguucucagaaagcugcggucuccaugccccaggcacaugguggaaggcaccguguuacgaaaccgucaagguguggcugcaggagaauuuacuggcuguagggauuuucggacucugcacggcccuuguucagauccugggcuugacuuuugcgaugaccauguauugucagguggucaaagccgacacauacugcgcauga

SEQ ID NO: 64307 - RNA, 738 nt, Artificial Sequence
  derived and/or modified sequence opt3 from TSPAN6__Homo_sapiens__NP_003261
auggccagccccuccagaaggcugcagaccaagccugugaucacaugcuucaaaucuguccuccuuauuuacacuuuuauauucuggaucacgggcguuauucuguuggcuguggggaucuggggaaagguaucauuagagaacuauuuuagucugcuaaaugaaaaagcaaccaacgugccauucguccucauugccacagguacugugaucauacugcuuggcaccuuuggguguuucgcgacaugccgggcuagcgccuggaugcugaaguuguacgcaauguuucucacccugguuuuccugguggagcucgucgccgcuaucgugggauuuguauuccgccacgaaauuaaaaauuccuuuaagaacaauuaugagaaggcauuaaaacaauacaacucuacuggcgacuaucgaucgcaugccguugauaagauccagaauacacugcacuguugcggugugaccgacuaccgugauuggacggacacuaacuauuacucagaaaaaggguuccccaagagcuguugcaaacuugaggauuguaccccgcagagagacgcugauaaggucaauaacgagggaugcuuuauuaaggugaugacaaucauagaaagugagaugggcguggucgccggcauuuccuucgggguugcguguuuccaguugaucggaauuuuucuggcauacugccuaucuagggccaucacuaauaaccaauaugaaaucguguga

SEQ ID NO: 64308 - RNA, 750 nt, Artificial Sequence
  derived and/or modified sequence opt3 from TSPAN7__Homo_sapiens__NP_004606
auggccagcagaaggauggagaccaagcccgugaucacaugccugaaaacucuccuuauuauauacuccuucgucuuuuggaucacgggcguuauucuguuggcuguggggguauggggaaaguuaacccuggguacauauaucucucuaauugcagaaaacucaacuaaugccccuuacgugcucaucggcaccgggacaaccauagucguguucggacuguuuggcuguuucgcgacuugccgggguaguccauggaugcuuaaacuguaugcuauguuuuugagccucguuuuccuggccgagcugguggcagggaucuccggauuugucuuccgccacgaaauuaaggacacauuucuccgaaccuacacggaugccaugcagacuuauaacggcaaugacgagcguucuagagcuguggaucauguacaaaggucguuaucauguugcggcguucagaacuacaccaauuggagcacaaguccguauuuccuggaacacgggauucccccuuccuguugcaugaacgagacugacuguaauccacaggaucuucauaacuugaccguggcagccacaaaagucaaucagaagggaugcuacgaccuggugaccucuuuuauggagacgaacauggguaucaucgcuggcguggccuucgggauagcguuuagccaacuaauuggaaugcuccuggcauguugccuuucccgguucaucacugccaaucaguacgaaauggucuga

SEQ ID NO: 64309 - RNA, 714 nt, Artificial Sequence
  derived and/or modified sequence opt3 from TSPAN8__Homo_sapiens__XP_006719646
auggccggcgugagcgcuugcaucaaguacuccauguucaccuuuaacuuccuguuuuggcucugugggauucuuauacuggcauuggccaucugggucagaguuucuaaugacucacaggcgauuuucggaagugaggauguggguagcuccucuuauguagcuguggacaucuuaauugccgucggcgcaaucauaaugauccugggguuucuaggaugcuguggcgccauuaaagaaucgaggugcaugcuccugcuuuucuuuaucggucuguugcucauucugcugcuccaaguggcuacagggaucuuaggagcaguuuucaagucaaaaagcgaucggauagugaacgagacucuguacgaaaauacgaaacuuuugagugccaccggcgaguccgaaaagcaguuucaggaggcuauuaucgucuuccaggaggaauuuaaguguugcggccuggugaacggggccgcggacuggggaaauaacuuccaacacuaucccgagcuaugugcaugccucgauaagcagcgcccuugucagucuuacaaugguaaacagguauauaaggaaacaugcauuagcuuuaucaaagacuuccuggccaagaaccuuaucauuguuauaggcaucuccuucgggcuggcugugauugagaucuugggacucgucuuuucaauggugcuguacugucaaauaggcaauaaauga

SEQ ID NO: 64310 - RNA, 720 nt, Artificial Sequence
  derived and/or modified sequence opt3 from TSPAN9__Homo_sapiens__NP_001161792
auggccagaggcugccuguguugccucaaguacaugauguuccuuuuuaaccugaucuucugguugugugggugcggauuacugggugugggcauuuggcuaagcgucucccaggggaauuuugcuaccuucucucccucauuuccuagucucagcgcagccaaccugguuauagcgaucggaacaauugugaugguaacuggcuuccuugguugucugggggcuaucaaagagaauaagugcuugcuccuguccuuuuucauugugcugcucgucaucuuacuggccgaacuuauauugcugauccuauuuuucguguauauggacaaaguuaacgagaaugcaaagaaagaucucaaggaaggacugcuucuguaccacacggagaacaaugugggcuugaagaacgccuggaauauuauccaagcugaaaugagguguugcggcgucaccgacuauacagauugguacccagugcucggggagaacacuguaccggaccgguguugcauggaaaauucucagggauguggucgcaacgcaaccacaccccuguggcgaaccggcugcuaugagaaaguuaagaugugguuugaugacaauaaacauguguuagggacugucggaaugugcauucugaucaugcagauacucggcauggccuucucgaugacacuuuuucagcacauucaucguaccgguaagaaauacgaugcuuga

SEQ ID NO: 64311 - RNA, 1806 nt, Artificial Sequence
  derived and/or modified sequence opt3 from TSPEAR__Homo_sapiens__NP_001258966
augagcuuccccgccuccagaaucuuuucucagugcgaccuguucccugaggaauuuucaauuguggucacccucaggguuccaaaccuuccgcccaagcggaaugaguaccuguugacagugguagcugaagagagugauuuacugcuacucggccugcgccuuagcccugcacaacugcacuucuuguuucuccgagaagacacugccggggcguggcagacgcguguguccuucagaucuccagcucuggucgauggaagguggcauacccuggugcucgccguuucggcugguguguuuucauuaacaacugacuguggccugcccgucgauauaauggccgacgugccuuucccagcuacccuuagcguaaaaggggcacgguuuuucguuggaagucgcagaagggccaagggcuuguuuaugggucuggugcggcagcuaguccuccugcccggguccgaugcuacaccucgccuuugcccaucucgaaacgccccgcuggcgguguugagcauccccagagugcuccaggcacugaccggaaaaccugaggacaaugaggucuuaaaguauccauacgaaacuaacauuaggguuacacugggcccccaaccuccauguaccgagguggaagaugcccaguucugguuugacgcuucccggaaaggccucuaucuuugcguagggaaugagugggugucaguccuggccgcaaaggagcguuuggauuacguggaagaacaccagaaccuaaguacgaauagcgaaacucugggaaucgagguuuuccgcauuccccaggugggucucuucgucgcuaccgccaacagaaaggcgacaucugccguguauaaauggacugaagagaaguuuguauccuaccaaaauaucccgacccaucaggcacaggcuuggaggcacuucacaauaggcaaaaagaucuuucuggccguugcuaacuucgagccugacgaaaaagggcaggaguuuucagugauuuauaaguggagccaucggaaacuuaaguucacccccuaccaaaguaucgccacgcacucugcacgagauugggaagccuuugaggucgacggagaacacuuccuggcuguggcgaaucaucgcgagggcgacaaccacaauauugauuccgucaucuacaaguggaacccagcaacuagauuguuugaggccaaucagacaauagcuaccagcggugccuaugacugggaguucuuuucgguggggccuuacucuuuccucguuguggcaaacacuuuuaacggaacauccaccaaaguacauucacaccuguauauuagguuacugggcaguuuccagcuauuccagagcuuucccacguucggcgccgcugauugggaggucuuucagaucggggaacggauuuuccucgccguggcaaauucccacucuuacgacguugagaugcaagugcagaacgauagcuaugucaucaauucagugaucuacgaacugaacguaaccgcgcaagcauuugugaaguuccaggacauucuuacauguagugccuuggauugggaguuuuucuccguuggagaggacuauuuucuggucguggcaaauagcuucgauggucgcacuuuuucugugaacucaauaaucuacagauggcagggcuacgaaggguucgucgccguucauagucucccaaccgugggaugcagggacugggaggcuuuuagcacaacugccggcgcauaucugauuuacuccucugcuaaagaaccccuuucgcgugugcugcgguugcgaaccagauga

SEQ ID NO: 64312 - RNA, 513 nt, Artificial Sequence
  derived and/or modified sequence opt3 from TSPO2__Homo_sapiens__XP_011512699
augagacugcagggcgccaucuucgugcuccuuccccaccuggggccuauuuuggucugguuauuuaccagggaccauaugagcggauggugcgaggguccacggaugcuguccugguguccguucuacaagguucuacuccuggugcaaacagcuauauauucuguagugggcuacgcaucauaucuugucuggaaagaucuugggggaggcuuggguuggccccucgcccugccucuggggcucuacgcggugcaguuaacuaucaguuggacgguucuggugcuguuuuucaccguccacaacccaggauuggcucugcuacaucuccugcuucuguauggcuuggugguaagcacagcccucauuuggcaccccaucaauaagcuggcagccuuacugcuccuuccuuaccuggcuugguugacuguuaccuccgcacuaacauaucaucuguggcgcgacucucucugcccagugcaccagccccagccuaccgaaaaaucggauuga

SEQ ID NO: 64313 - RNA, 510 nt, Artificial Sequence
  derived and/or modified sequence opt3 from TSPO__Homo_sapiens__NP_001243459
auggcucccccuugggugccagccaugggcuucacccuggcaccgagccucgggugcuuugucggauccagauucguucacggugagggccuuaggugguacgccgggcugcagaagcccucuuggcauccuccacacuggguguugggacccguauggggcacauuauauucagcgauggguuacgggaguuaucugguguggaaagaacuaggaggcuuuacugagaaggcugucgugccucucggccuguacacggggcaacuugcccugaacugggcauggccacccaucuucuuuggagcccggcagauggguugggcuuugguugaccuccugcuggugagcggcgcagccgcugccaccacagucgcgugguaucagguguccccucucgcagcccgcuuacuguacccauaucuugcuugguuggccuucacuaccacacugaauuacuguguauggcgagauaaccauggguggcguggaggcagaaggcuaccggaauga

SEQ ID NO: 64314 - RNA, 927 nt, Artificial Sequence
  derived and/or modified sequence opt3 from TSPY10__Homo_sapiens__NP_001269398
augagacccgagggcagccugaccuacagggugccugaacggcuccgccagggguucugcggagucggucgagccgcucaagcacuuguuugugccuccgcgaaggagggcacagcuuuucguauggaagccgugcaggagggggcagccggaguagaaucugagcaggcugcacugggcgaggaagccguguuguuacuggacgauaucauggcugaggucgaagugguugccgaggaggaaggucuaguggagagaagggaagaggcgcagcgggcacaacaggccgucccagggccgggacccaugacuccugaaucagcucucgaggagcugcuugccgugcagguagaacuggagccaguuaacgcacaggcucgcaaagccuucaguagacaaagggaaaagauggagcggcgccgaaaaccccacuuggacagaaggggcgcggugauucagagcgucccuggcuuuugggccaaugugauagcaaaccauccacagauguccgcucucaucacggaugaagacgaggauaugcugucuuauauggugucgcuggaggucgaagaggaaaagcaccccguucaucucugcaaaauuauguuauucuuucggucaaauccuuacuuccagaacaaggugaucaccaaggaguaucugguaaauauuacagaauaccgugccagccacaguacuccaaucgagugguauccggacuacgagguggaggcuuaucgcagaaggcaucacaacuccucucuuaacuuuuucaauugguuuagcgaucacaauuucgccggguccaacaaaauagcagaaaucuuguguaaggaccuguggcggaauccccuacaauacuacaaacgaaugaagccuccagaagagggaaccgagacaucaggugauagucagcuccugagcuga

SEQ ID NO: 64315 - RNA, 927 nt, Artificial Sequence
  derived and/or modified sequence opt3 from TSPY1__Homo_sapiens__NP_003299
augagacccgagggcagccugaccuacagggugccugaacggcuccgccagggguucugcggagucggucgagccgcucaagcacuuguuugugccuccgcgaaggagggcacagcuuuucguauggaagccgugcaggagggggcagccggaguagaaucugagcaggcugcacugggcgaggaagccguguuguuacuggacgauaucauggcugaggucgaagugguugccgaggaggaaggucuaguggagagaagggaagaggcgcagcgggcacaacaggccgucccagggccgggacccaugacuccugaaucagcuccagaggagcuccuggccgugcagguagaacuugagcccguuaacgcacaggcucgcaaagccuucaguagacaaagggaaaagauggagcggcgccgaaaaccucaccuggacagaaggggcgcggugauucagagcgucccaggcuuuugggccaaugugauagcaaaccauccccagauguccgcuuugaucacggaugaagacgaggauaugcucucuuauauggugucgcuggaggucggggaagagaagcacccuguucaucugugcaaaauuauguuauucuuucggucaaauccauacuuccagaacaaggugaucaccaaggaauaucucguaaauauuacagaguaccgugccagccacaguacuccgaucgaaugguaucccgacuacgagguggaggcuuaucgcagaaggcaucacaacuccucucugaacuuuuucaauugguuuagcgaucacaauuucgccggauccaacaaaauagcagaaauccuuuguaaggacuuguggcggaauccucugcaauacuacaaacgaaugaagccacccgaggaagguaccgagacaucaggcgauagucagcuacucagcuga

SEQ ID NO: 64316 - RNA, 867 nt, Artificial Sequence
  derived and/or modified sequence opt3 from TSPY3__Homo_sapiens__XP_011542306
augagacccgagggcagccugaccuacagggugccugaacggcuccgccagggguucugcggagucggucgagccgcucaagcacuuguuugugccuccgcgaaggagggcacagcuuuucguauggaagccgugcaggagggggcagccggaguagaaucugagcaggcugcacugggcgaggaagccguguuguuacuggacgauaucauggcugaggucgaagugguugccgaggaggaaggucuaguggagagaagggaagaggcgcagcgggcacaacaggccgucccagggccgggacccaugacuccugaaucagcucucgaggagcugcuugccgugcagguagaacuggagccaguuaacgcacaggcucgcaaagccuucaguagacaaagggaaaagauggagcggcgccgaaaaccccacuuggacagaaggggcgcggugauucagagcgucccuggcuuuugggccaaugugauagcaaaccauccacagauguccgcucucaucacggaugaagacgaggauaugcugucuuauauggugucgcuggaggucgaagaggaaaagcaccccguucaucucugcaaaauuauguuauucuuucggucaaauccuuacuuccagaacaaggugaucaccaaggaguaucugguaaauauuacagggcuuuugaucccacugcaacuaagcggaauacguaucaugaaauggcgcagaauugccgcugacacuaccacagccgcacucaccaguuccacugguucucugacaaccacgagccaggaucuuacuaggcuguugcgguccuacgugcgaaccuguggcgccaucccgugcaacacaacucgcggguga

SEQ ID NO: 64317 - RNA, 945 nt, Artificial Sequence
  derived and/or modified sequence opt3 from TSPY4__Homo_sapiens__NP_001157943
augagacccgagggcagccugaccuacagggugccugaacggcuccgccagggguucugcggagucggucgagccgcucaagcacuuguuugugccuccgcgaaggagggcacagcuuuucguauggaagccgugcaggagggggcagccggaguagaaucugagcaggcugcacugggcgaggaagccguguuguuacuggacgauaucauggcugaggucgaagugguugccgagguggaggucguggcggaagaggaaggucuaguagagagaagggaagaggcacagcgggcccaacaggcuguuccagggccgggacccaugacuccugagucagcccucgaggaacugcuugcagugcaggucgaacuggagccagugaacgcucaggcccgcaaagcguucaguagacaaagggaaaagauggagcggcgccgaaaaccccacuuggacagaaggggcgccgugauucagagcgucccuggcuuuugggcaaauguuauagcuaaccauccacagauguccgcccucaucacggaugaggacgaagauaugcugucuuauauggugucgcuggagguagaagaggaaaagcaccccgugcaucucugcaaaauuauguuauucuuucggucaaauccuuacuuccagaacaaggucaucaccaaggaguaucuggugaauauuacagaguaccgugcuagccacaguacuccaaucgaaugguauccggacuacgagguugaagccuaucgcagaaggcaucacaacuccucucuuaacuuuuucaauugguuuagcgaucacaauuucgcaggguccaacaaaauagccgagaucuuguguaaggaccuguggcggaauccccuacaauacuacaaacgaaugaagccuccagaggaaggaaccgagacaucaggugauagucagcuccugagcuga

SEQ ID NO: 64318 - RNA, 1314 nt, Artificial Sequence
  derived and/or modified sequence opt3 from TSPYL1__Homo_sapiens__NP_003300
augagcggccuggacggggugaagagaaccacaccccuccagacucacuccaucauuauaucugaucaagucccuucagaccaggaugcccaucaguaccuuaggcugcgggaccagagugaggcuacgcaaguuauggcagaaccaggagaggguggcagcgaaaccguggccuugccgcccccuccacccuccgaggaagggggaguaccucaggaugcggcuggccgcggugggacaccacagauccgaguggucggaggccguggccacguggccauuaaagcagggcaggaggagggacaacccccugccgaagguuuagcugcagccucuguugugauggcugccgacagaucgcugaagaaaggcguccaagggggagagaaggcgcuagaaaucugcggcgcacagaggucagccagcgagcucacugcuggugccgaggcagaagcugaggaagugaaaaccgggaagugugccacaguaagugcggccguugcagagcgggaauccgcugagguggucaaggagggacuggccgaaaaagaggugauggaggaacagauggaaguggaggagcagccaccggaaggcgaggaaauugaggucgcugaagaggaucgccuugaggaagaggccagagaagaggagggccccuggccucugcaugaagcauugaggauggacccacucgaggccauccagcuggaacuggauaccguuaacgcucaggcggaccgggcauuccaacagcucgagcacaaguuugggcgcaugcgaagacauuauuuagaaaggcggaauuacauaauccagaacauucccggauucuggaugacugccuuucguaaucacccucagcugucugcuaugauccgcggucaagaugccgagaugcuuagauauauuacaaacuuggaggugaaagaacugaggcacccacggaccggcugcaaguucaaauuuuucuuucgacgcaaucccuacuucagaaacaagcuaaucguaaaggaguaugaagugaggagcuccgggcgggucgugucacucaguacgccgauaauuuggcgcagaggacaugagccucagagcuuuaucaggcguaaucaggaccugauuuguucuuucuuuacuugguucuccgaucacucacuucccgaaagcgacaaaaucgcagagaucauuaaggaggaccuguggccaaacccuuugcaguacuaucuccugcgggaaggcguuagacgagccaggcgccggcccuuaagagagccaguggaaauacccaggccuuuugguuuccaaaguggguga

SEQ ID NO: 64319 - RNA, 2082 nt, Artificial Sequence
  derived and/or modified sequence opt3 from TSPYL2__Homo_sapiens__NP_071400
auggacagacccgaugagggcccuccagccaagaccaggcggcugagcuccucugaaucaccgcagcgcgaucccccuccacccccuccacccccuccacuccuucgacugccguugcccccuccacaacagcgucccagauuacaggaggaaacagaggcugcacaggugcuggccgacaugaggggagucgggcuagguccugcgcucccacccccgccucccuacguuauccuggaagagggcgggauucgggcuuauuucacucuuggagccgagugcccaggcugggacaguacgauagaaagcgguuacggggaggcaccucccccaaccgaaucccuggaggccuugcccacaccugaggcuucuggaggcucgcucgaaaucgauuuucaagugguacagucaagcaguuucggcggggagggagcacuggaaacuuguuccgccguggguugggcuccacagcgccuggucgacccgaaaucuaaggaggaagccauuaucauuguggaggaugaggacgaagaugagagagaaagcaugagguccucacggcgccgaagaaggcggcgucgcagaaaacagaggaagguuaaacgggagagucgagaacgcaacgcggagagaauggagagcauccuccaagcauuagaagacauacagcuggaucuugaggccgugaauaucaaggcuggcaaggccuuuuugaggcugaaacggaaguucauucagaugcgcagacccuuucuagaaaggcgugaccucaucauucagcacaucccuggguucugggucaaagcauuucugaaccauccacggauaucuauucuuaucaaucgaagagaugaggacauuuucagguaucugaccaacuugcaagugcaggaccuccgccacaucuccaugggauacaagaugaaacuguauuuucagacaaaucccuacuucaccaacaugguaaucguuaaggaauuucaacggaauagaucaggcagguuagugagccauaguacuccuauucgcuggcaccgaggucaggagccacaggcucggcgucaugggaaccaggaugccucucacuccuucuuuagcugguucucgaaucacucucugcccgaggcggacagaauagccgaaaucauuaagaacgaucucugggucaauccgcuuagguauuaccugcgcgagcggggauccagaaucaaaaggaagaaacaagaaaugaagaaacgaaagacacgcggccggugcgagguggugauaauggaggacgcaccugauuacuaugcugucgaagacauuuucucagagaucagugauaucgacgaaaccauucaugauaucaaaauuagcgacuuuauggagacgacugauuacuucgaaaccacagacaacgagauaacugacaucaaugagaacauuugugauuccgaaaauccagaccacaacgagguucccaacaaugaaaccacagauaacaaugagucugccgacgaucaugaaaccacggacaacaaugagagcgcugaugacaacaaugagaacccugaagauaauaacaagaauacugacgauaacgaggaaaaucccaacaauaacgagaacacauauggcaauaacuuuuucaaagggggauuuugggguucacacggcaauaaccaggacaguuccgauagcgacaaugaagccgacgaggcaucugaugacgaggauaacgacgggaaugaaggagauaacgagggcucagacgaugacgguaaugaaggggauaacgagggcagugacgaugacgauagagacaucgaguacuaugaaaaggugaucgaggacuucgauaaggaccaggccgauuacgaagacguaauugagauaaucagcgaugaauccguggaggaggaaggaauugaggaaggcauccagcaagacgaggauauuuaugaagaggggaauuacgaggaagagggaucugaagacgucugggaggaaggugaggauucggacgauagcgacuuggaggacgugcuacagguuccaaacggcugggcuaauccugggaaaaggggaaagaccggcuga

SEQ ID NO: 64320 - RNA, 1245 nt, Artificial Sequence
  derived and/or modified sequence opt3 from TSPYL4__Homo_sapiens__NP_067680
augagcggccuggacgggggaaacaagcucccccuugcccagaccgguggccuggcugcaccugaucacgccuccggggacccagauagagaccaaugccagggauugagggaggaaacagaggcgacucaggugauggcuaauacgggcggugggucuuuagaaaccgucgccgagggaggcgcaucacaggauccgguugacuguggccccgcccugcgggugccuguagcugggagucgcggaggugcagccacaaaagcuggccaagaagaugccccacccagcacuaaggggcuagaggcggcauccgccgcugaggccgcagacucuucgcagaaaaacggaugccagcucggcgaaccucgagguccagcugggcagaaggcccuggaggcguguggagccggcggccuugggucacaaaugauccccgguaaaaaggcaaaggaagugaccaccaaaaagcgugcuauuagcgccgcugucgagaaagagggagaagccggcgcagccauggaggaaaagaaagugguucagaaggagaagaaaguggcugggggagucaaggaagagacaagaccuagggcgccaaaaauaaauaacugcauggauagucuggaggcaaucgaccaggaauuguccaaugugaacgcccaggcugaucgggccuuccuccaacuggagcgcaaguuuggcagaaugaggcggcugcauaugcagcgccgaucuuucauuauccagaauauuccggguuuuuggguaacugcauucagaaaccacccccaacucagcccuaugaucuccgggcaggacgaagauauguuaagguacaugauaaaucuggagguugaggaacuuaaacauccacgggccggcuguaaguuuaaauucaucuuucagggaaaccccuauuuccguaaugagggcuuggugaaggaauacgagcgcagaucaagugggagggucgugagccugucuacaccuauucgguggcaccgaggacaggacccacaagcucauauccaccgcaacagagaagguaauaccauucccuccuuuuucaacugguuuucagaccacagccuacucgaguucgauaggaucgccgaaauaauuaagggcgagcuguggccgaauccucuucaguauuaccugaugggggagggaccccggcgcggcaucagagguccaccuaggcagcccguggaaagugcacguucuuuucgguuccaguccggguga

SEQ ID NO: 64321 - RNA, 1254 nt, Artificial Sequence
  derived and/or modified sequence opt3 from TSPYL5__Homo_sapiens__NP_277047
augagcggcagauccagggggcggaagucuucacgcgccaaaaaccgaggaaagggucgugcuaaagcaagagugaggcccgccccugacgaugcgccacgggacccggaucccagucaguaccaaagccugggcgaggacacccaggcugcccagguccaggcaggggccggauggggcggucucgaagcugcagccuccgcucaacuucugcgcuugggggaggaagccgcgugcagauuaccucuggauuguggacuagcacucagggcccgggcugccggcgaccacggccaggcagcugcccgcccagggcccggaaaggcggccucucugucggagcgacuugcagcugauacaguuuucguggguacugccggcacgguagggagaccuaaaaaugcuccaagggugggaaaccggcguggccccgccgguaagaaggcaccugaaaccugcucaacagccgggcgcggaccacaggucaucgcuggcggcagacagaaaaagggggcggcaggagagaauacuagcgugagugccggugaggagaaaaaggaggaaagggacgcuggcuccgggccgcccgccaccgagggaucuauggauacacuggagaacguucaauugaaacucgaaaauaugaacgcacaggccgaccgggcuuaucugcgacugagccgcaaguuuggccagcucagauuacagcaucuggagaggcggaaucaccuuauucaaaacauaccugguuucugggggcaggccuuucagaaucauccacaauuggcauccuuccugaacucacaggaaaaggaggugcuaaguuaccucaauagccuggaagucgaggagcuuggccuggcgcgcuugggauauaaaaucaaguuuuacuucgauagaaaccccuauuuucagaauaaagugcucauuaaggaauacggcugugggccuucuggacagguaguuuccaggucaaccccaauccaauggcugcccggucacgacuuacagagccugagucagggcaacccggagaauaaccguucuuucuuugggugguucuccaaccauagcucgauugaaucugauaaaaucguggagauaaucaaugaagaacucuggccuaacccccuucaguuuuaucuguuguccgagggagcucgggucgaaaagggcaaagagaaggaaggucgacaagggccaggcaagcagccuauggagacuacacagcccggagugucacagaguaauuga

SEQ ID NO: 64322 - RNA, 2415 nt, Artificial Sequence
  derived and/or modified sequence opt3 from TSR1__Homo_sapiens__NP_060598
auggccgcucacagacccggcccucugaagcagcaaaacaaagcacauaaagggggaaggcaccggggucgcggcagcgcccagcgagacgggaagggacgucucgcgcuuaagacccuguccaaaaaggugagaaaggaguugucuagggucgaucagcggcaucgcgcuucacaguuaagaaaacaaaagaaagaagccguucuggcagagaagaggcagcuaggcgguaaagacgggccaccgcaccaggugcucguagugccccugcauagucggaucagccuuccugaagccaugcagcuguugcaagaucgcgacacaggaacuguccaccucaaugagcugggcaacacgcagaauuucaugcugcucugcccacgauuaaagcacagaugguuuuucaccuccgcuaggcccggcgaucugcaugugguucuugacauggcaaagguggccgauacaauuuuguuucugcuagacccucucgaagggugggauucuacuggagacuacugucugucgugccuuuucgcucagggucugccaaccuauacauuggccguccagggcauaucagggcucccccugaaaaagcaaaucgauacccggaaaaaguuaagcaaagcgguggagaagcguuuuccucacgacaaacugcuccuucuggauacucagcaggaggcaggaauguugcuacgccaacuggccaaccagaagcagcagcaucucgcuuucagagacaggcgggccuaccuguuugcacacgcuguagacuucguuccaagugaagagaauaaccuugugggcacacugaagauuuccgguuauguccgagggcaaaccuugaaugugaaccgccuccugcacaucgugggauacggcgauuuucagaugaaacagauugacgccccgggcgaucccuucccuuuaaauccaagagggaucaagccccagaaagacccugauauggcgauggaaauaugugccacggacgcagucgaugacauggaggagggacugaagguucuaaugaaagcugauccagguaggcaagaaucucuccaggccgaggugauccccgacccgauggaaggcgagcagacuuggccuaccgaagaggagcugagcgaagcuaaggauuuucuuaaggaguccucaaaaguagugaagaaaguccccaaggggacaaguagcuaucaggccgaauggauuuuggacggaggcucucaauccgguggggagggcgacgaauacgaguaugaugacauggagcaugaagauuucauggaggaagagucacaggacgaaagcagugaggaggaagaggaauacgagacuaugaccaucggagagucugugcacgaugaccuguacgauaaaaagguugacgaagaggcagaagccaagaugcucgagaaauauaagcaggaacggcuggaggagauguuuccagaugaaguggacacaccucgcgaugucgcugcgagaauuagguuccagaaauaccguggccuuaaguccuuccggaccagccccugggacccaaaagagaaccugccccaagauuaugcacgaaucuuucaguuccagaauuuuacgaacacuagaaagucgauauucaaggaaguggaggaaaaagagguagagggggccgaaguuggaugguacgugacauugcaugucucugaggugccugucuccgugguugaaugcuuuaggcaagguaccccacucauugcuuucucacuguuaccgcacgagcagaagaugagugugcugaauaugguaguccgccgggaccccggcaacacugaaccugugaaagccaaggaggagcuaaucuuucauuguggguucagaagguuucgcgcaagcccacucuucucccagcacacagccgcugacaaacacaagcugcagcgauuucuuaccgccgauauggcauugguugcgacgguguaugcucccauuaccuucccuccagccucuguccugcucuuuaaacaaaagagcaauggaaugcauucacugaucgcaacaggccacuuaaugaguguggaccccgaucggaugguaaucaagcgugugguucuguccggucauccguucaaaauuuucacuaagauggccgucgugagauacauguuuuucaacagggaagacgugcuuugguuuaaaccugucgaguugcgcaccaagugggggcggagaggccacauaaaagaaccacucggaacacacggccauaugaagugcagcuucgaugggaagcugaaaucucaggacacuguucuaaugaaccuguauaagaggguguuucccaaauggaccuacgauccuuacgugcccgagccaguaccuuggcucaagucagagaucaguagcacagucccccagggagguauggaauga

SEQ ID NO: 64323 - RNA, 1164 nt, Artificial Sequence
  derived and/or modified sequence opt3 from TSSC1__Homo_sapiens__NP_003301
auggaggacgaugcccccgugaucuacggccuggaguuccaggcuagagcacucaccccucaaacagccgaaacugacgcgauuagguuucuugucgggacgcagagccugaaguaugauaaccagauacacaucauugacuucgaugacgaaaauaacaucauuaauaaaaacguuuuguuacaucaggcuggagagaucuggcacauauccgccucuccagcagaucggggugugcugaccacaugcuacaaucgcacuucagacaguaagguacuaaccugugccgcuguguggcgaaugccgaaagaacucgagagcggcucccaugagucucccgaugacucgucaagcacagcacaaacccuggaacuucugugccacuuggauaacacugcccaugggaauauggcuugugucgugugggagccuaugggagacggcaagaaaaucauuagucucgccgauaaccacauccugcugugggaccuccaggaauccucuagccaggcgguuuuagcauccucagccagucuggaggguaaggggcagcuuaaguuuacaagcggacguuggucuccacaccauaauugcacccaaguggcuacggccaacgacacuaccuugagaggcugggauacaagguccaugucacagauuuauuguaucgagaaugcacacggccagcugguccgggaccuagauuucaaccccaauaaacaguacuaucucgcuagcugcggggacgauuguaaggugaaauuuugggacacucgcaacguaaccgaaccuguuaagacacuggaggaacauagucacuggguguggaaugucagauacaaccacucucaugaucaacuugugcugaccggauccagcgacucgagggugauauugucuaacauggucuccauuucaagugagccauucggucaccucguugaugacgaugacaucagcgaccaggaagaucaucgguccgaggagaaaucuaaggaaccccugcaggacaaugugauugccacguaugaggaacacgaggauagcguauacgcgguggacuggucaagugccgauccuugguuauuugcaucccugagcuacgacggccgccucgucaucaaccgagugccaagagcucuuaaguaucauauccuguuguga

SEQ ID NO: 64324 - RNA, 1104 nt, Artificial Sequence
  derived and/or modified sequence opt3 from TSSK1B__Homo_sapiens__NP_114417
auggacgaugccgcugugcugaagagaaggggcuaccuccuugggaucaaccugggagaggguagcuaugcaaaagucaaguccgccuacucugaacgguugaaauucaauguugcgauuaagauaaucgaccgcaaaaaggcucccgccgacuuuuuagagaaguuccugccucgagaaauugagauccuagcaaugcucaaccacugcucaauuaucaaaaccuaugaaauauuugagacaagucauggcaagguguacaucguaauggagcuggccgugcagggggaucuucuggaauugauuaaaacucguggagcucuccacgaggaugaagcaagaaagaaauuccaucaacugagccuggccaucaaguauugucacgaccucgaugucgugcauagggacuuaaagugcgauaaucugcuuuuggacaaagauuuuaacauuaagcuguccgacuucucuuuuucgaaacggugucuacgcgaugacucaggcagaauggcucucagcaagacguucugcgguaguccagccuacgcggcaccggagguucugcaggggauccccuaucagccuaaaguguacgacauauggucccuuggagucauucuguacaucaugguguguggcucuaugccauaugaugacagcaauauuaagaaaauguugaggauccagaaggagcaccggguaaacuuuccccgcuccaagcaccucaccggcgaaugcaaagaucugaucuaccauauguuacaaccugacguuaaucgaagacugcacauugaugagauacucucacauuguuggaugcagccaaaggccagggggagucccagcguggcuaucaacaaagaaggagagucuucccgggguacagaaccucuuuggacuccagagccgggcucagacaagaaaagcgccaccaagcuggagcccgaaggggaggcacagccucaggcucaaccagaaacaaagcccgagggaaccgccaugcagaugagucgucagucugaaauuuugggcuucccuuccaaaccaagcacuauggagacagaggaaggucccccgcagcaaccucccgagacccgcgcgcaguga

SEQ ID NO: 64325 - RNA, 1077 nt, Artificial Sequence
  derived and/or modified sequence opt3 from TSSK2__Homo_sapiens__NP_443732
auggacgaugccaccgugcugagaaagaaaggcuacaucgucgggauuaaccucggaaaggguagcuaugcuaaaguuaaguccgcauacucugagaggcuuaaauucaauguggccguaaagauaaucgaccggaagaaaacacccacugauuuuguggaacgcuuccugccucgagagauggacauuuuggcgacggucaaccacggcucaaucauuaagaccuaugaaaucuuugagacaagugaugggcguauauacaucauuauggaauuaggagugcagggcgaccugcuagaguucaucaaaugccaaggugcucuccaugaggauguugccagaaagauguuuaggcagcugagcuccgcagugaaauauugucacgaccuugauauuguccaucgggaccugaagugcgaaaauuugcuccuggauaaggacuucaacaucaaacugucugauuuuggguucucgaagcgcugucucagagacucaaauggaaggauaauuuuaagcaaaacuuuuugcggcagugccgcuuacgcagccccagaggugcugcaguccaucccguaucagcccaagguauacgacauuuggucucuuggcguuaucuuguacaucauggugugugggagcaugccuuaugaugacuccgauauucggaaaaugcugcgcauacaaaaggaacaccgagucgacuucccaagaaguaaaaaccuaaccugcgaguguaaggaucucaucuacaggaugcugcagcccgacgugucacagcggcuucauauugaugagauccugagccacucuugguugcagccuccaaagcccaaagcuacauccucagccagcuuuaagcgugaaggagaggguaaauaucgcgcggaaugcaagcucgacaccaaaacuggccugagaccugaucacaggccagaccauaaguuaggggcaaagacacaacaccggcugcucguggucccggagaaugaaaaccgaauggaggaucgccuugccgagaccaguagagcuaaagaccaucacauaucuggagccgaaguuggcaaggcauccacguga

SEQ ID NO: 64326 - RNA, 1017 nt, Artificial Sequence
  derived and/or modified sequence opt3 from TSSK4__Homo_sapiens__NP_001171668
augggcaagggggacgugcuggaggccgcucccaccacaacugcauaccacagccucauggaugaauauggauacgaggucgguaaagccaucggccauggguccuauggaucuguuuacgaagcguucuauacgaagcagaaagugaugguagcugugaagauuauaaguaaaaagaaggccucagacgauuaccuuaacaaauuucugccuagagagauccaagucaugaagguguugaggcacaaauauuuaauuaauuucuaccgggcaaucgaaagcaccucccgcguuuacauuauccuggagcuagcccagggcggugacgugcucgaguggauacagcgauauggggcuugcucugaaccacuggcaggaaagugguuuucgcagcuuacacugggcaucgccuacuugcauucaaaaagcauuguccaccgucucaugccgagucuguccgcugccggcagagaucugaagcucgagaacuuacugcuugacaagugggaaaaugugaaaaucucugauuucggguuugcgaagaugguacccagcaaccaaccuguuggauguuccccaucauauaggcaagugaauugcuucagucauuugagccagacuuacugugguucuuuugcauaugccugccccgagauucugcggggccuaccuuacaacccauuccucuccgacaccuggucaaugggggucauccuguauacacuugugguggcucaucugcccuuugaugacaccaauuugaaaaagcuccugcgcgagacucagaaagaagucacauucccugccaaccacaccauaagccaggaguguaagaauuuaauucugcagaugcucagacaggcaacgaaaagggcuacuauccuugauauuaucaaggacaguuggguucugaaguuucagccagaacaaccgacccacgagauccgguugcuagaagccaugugccagcugcacaacacaacuaaacagcaucaaucucuccagauuaccacauga

SEQ ID NO: 64327 - RNA, 966 nt, Artificial Sequence
  derived and/or modified sequence opt3 from TSTA3__Homo_sapiens__NP_003304
augggcgagccccaggggagcaugagaauccuggugaccggagguuccggccucgucgggaaggccauucaaaaaguuguggcugacggagcaggccuuccuggugaagauuggguauucgugucuucaaaggacgccgaucugacagacacugcgcagacgagggcuuuguuugagaaaguccagccaacccacgugauacauuuagccgcaaugguugggggacuguuccggaacaucaaguacaaucuagauuuuuggcgcaaaaacgugcacaugaaugacaacguccuccauagugccuucgaagugggcgcucgaaagguaguuagcugccuguccacauguauuuuuccggauaagacuaccuaucccaucgacgagacaaugauucacaauggcccuccacauaacucuaauuucggguacucguaugcaaaacguaugaucgaugugcagaacagagccuacuuucaacaguauggaugcaccuucacugcugucauacccacaaauguguuugguccucacgacaacuucaauaucgaagauggccacgugcuuccagggcugauucauaagguccacuuggccaaaucaagcggaagugcgcucaccguuuggggcacggguaaccccaggcggcaguuuaucuacucccuggaccuggcacaacucuucauuuggguguuacgcgaguauaaugagguagaaccuaucauacugucugugggggaggaagaugaggucagcauuaaggaggccgcugaagccgugguugaggcaauggacuuucauggagaagugacuuucgacaccacaaaauccgauggccaguucaagaagacugcuucaaacaguaaacuuagaaccuacuugccagacuuuagguucacaccguuuaagcaggccgucaaagagaccugugcgugguucacggauaauuacgaacaggcccggaaguga

SEQ ID NO: 64328 - RNA, 330 nt, Artificial Sequence
  derived and/or modified sequence opt3 from TSTD1__Homo_sapiens__NP_001106676
auggccggcgcucccaccgugagccugccugagcucagaucccuucuggcaucugggagggcccgguuguucgacguccgcucacgagaagaggcggcugccggaacaaucccaggugcauuaaacauuccgguuagugaacuggagagcgcccuacagauggaacccgcugcauuucaagcccucuacuccgcugagaagccuaaacuggaggaugaacaccuuguguucuuuugccagaugggcaagcgugggcugcaggccacucaguuggcgagaucucucggauauacgggcuacggugagguauggcugcuggcagggagguga

SEQ ID NO: 64329 - RNA, 894 nt, Artificial Sequence
  derived and/or modified sequence opt3 from TST__Homo_sapiens__NP_003303
auggugcaccagguccuguacagagcccucguuagcaccaaguggcuugcugaguccaucaggacaggcaaacuggggcccggauugcggguguuagacgcaucuugguauucaccugguacucgcgaagcccgaaaggaguaccuggaacgucauguaccaggcgcgaguuucuuugauauugaggaaugcagagacacggcuagcccguaugagaugaugcuacccuccgaggccggguucgcagaauacgugggaaggcucggcauaucuaaccacacccaugucgugguuuaugauggugagcaccuggggucguuuuacgccccucgggugugguggauguuccgcgucuuuggacauagaacagugucaguacuuaauggcggcuucaggaacuggcugaaagaagggcacccaguuacuagcgagcccagucggccugagccagcuguguuuaaggcaaccuuggaccgcucccuccugaaaacauaugaacaaguccuggagaaucucgaaucuaagcgauuccaguuaguggauagcagaucccagggaagguuucuggguaccgagcccgaaccugacgccgugggccuugauucagggcacauccggggagcugucaacaugccauucauggacuuuuugacugaggauggcuucgagaaggguccggaggaacugcgugcccuauuucagaccaaaaagguugaccucagucaaccccugauugcgacaugucgcaaaggggugacggcaugccauguagcccuugcugccuaccuguguggaaagccugauguggcagucuacgacggcagcuggucugaaugguucagaagggcuccacccgagucccgggugucacagggcaaaagcgaaaaggccuga

SEQ ID NO: 64330 - RNA, 3966 nt, Artificial Sequence
  derived and/or modified sequence opt3 from TTBK1__Homo_sapiens__NP_115927
augcagugccuggccgcugcacucaaggacgagaccaacaugagcggcgggggagaacaagccgauauccuucccgcgaauuacguggucaaagacagauggaagguucugaaaaagauugguggcgggggauucggcgagauauaugaagcuauggauuuguuaacaagggagaacguggcccugaaaguagaauccgcacagcagccuaaacaggugcuaaagauggaggucgccgugcucaagaagcugcaagguaaagaccacguuugucgguuuaucgggugcggacgcaaugagaaguucaacuacguggucaugcagcuucagggccgaaaucuggcugauuugcguagaucucagccaaggggcacuuuuacgcucucaaccacacugcggcuggggaaacaaauucucgaaaguaucgaggcaauucauagcgugggauucuuacaccgcgacaucaagccguccaacuuugccauggguagacugcccucuacuuauaggaaguguuacaugcuugauuucggcuuggcucggcaguauaccaauacaaccggggacguacgcccuccacgaaacguugccggauuuagaggcacugugagguacgcgucggucaaugcacauaaaaaccgggaaaugggucgucacgaugaccuguggucacuauucuauaugcucguggaguuugccguggggcagcugcccuggcgcaagauaaaagauaaggagcaggucggaaugaucaaagaaaaguacgagcauagaaugcuucugaaacacaugccuagcgaguuccacuuguuucucgaccauauugcuagucuggauuacuucacaaagccagacuaucaauuaaucauguccguuuuugaaaauucuaugaaggaaaggggcauugccgagaacgaggcauucgacugggaaaaagcuggcaccgaugcccugcucagcacguccacuucaacucccccucagcagaauacacggcaaacugcggccauguucggggugguaaacgugaccccagucccgggagaccuucugcgagagaauacagaagauguguugcagggugagcaccuaagugaccaggaaaacgcacccccuauccugccaggccgccccagcgaggggcucggaccuucuccacaucugguuccccacccgggcgguccugaggcugaagugugggaggaaaccgaugucaacagaaauaaacuuaggauaaacauugggaagucccccugcguggaggaggaacagucacggggcaugggaguaccaagcaguccuguucgcgcucccccagacucucccacgacuccugugagaucccugagguaccgucgggucaauagcccagagucggaacgauugucuacagccgauggcagaguggagcucccggaaaggcgcucccggauggaccugcccgggucaccuaguagacaagccuguagcucccagccagcacagauguuaucugucgauaccggacacgccgacaggcaggcuagcggucgcauggaugugucagcgaguguugagcaagaggcacuguccaacgccuuucgaagcgugccccuagcugaagaggaagacuucgacucuaaggaguggguaaucauugauaaagaaacugagcucaaggacuuuccuccaggcgccgagcccucaacaagugggaccacggaugaggaaccggaggaacugcggccucuuccagaagagggagaggaacguagaagguugggcgcagagcccaccguccgcccucgggguagaagcaugcaggcccuggcugaagaggaccuccagcaucugcccccacagccucuucccccacaacugucccagggggauggcaggucugaaacaucgcagccgccuacucccggaagcccaucccacucacccuugcauaguggcccucgaccacgccggagagagucugaccccaccgggccucagaggcaaguguucagcguugccccgccauuugaggugaauggacucccccgugcagucccucuguccuuaccauaucaggauuucaagcgcgaccugucagauuaccgggaaagagcgaggcuacucaaccgagugcggcgcguagguuuuagccacaugcugcuuacaacuccccaggugccuuuggcuccgguucaaccccaggccaauggcaaagaggaagaggaggaagaggaagaggacgaagaggaggaagaggaagaugaggaagaggaggaagaggaagaggaagaggaggaagaggaagaggaggaagaggaagaggaagaggaggcagccgcugccgucgcacugggggaagugcucggaccaagaucuggcuccaguagcgaggguucugaaagguccaccgaccggucacaggagggggcuccuaguacacuguuagccgaugaccagaaggaaagccgaggcagagcgucgauggccgacggagaucuggagcccgaggaaggcuccaaaacccuuguguuggucucuccaggggacaugaagaaaagcccuguuacugcugagcucgcacccgauccagaccugggaacgcuagccgcucugacaccgcaacaugaacgcccucagcccaccggcucacagcucgaugugagugagccagguacucuguccucugugcuuaagagcgaacccaagccuccagggcccggagccggcuugggugcaggcaccguaacaaccggggucggaggcguggcgguuacuuccucaccuuucacaaaaguggagaggacguuuguccacaucgccgagaagacccaccugaacgugaugagcagugggggacaggcuuuacguucugaagaguucuccgccggcggugaacucgggcuggagcuugcaagcgacggaggcgcuguugaggaaggugcccgggcaccgcuggagaauggcuuggcccucucggggcugaacggagcugaaaucgagggcucagcgcuaucuggggccccaagagaaacucccagugagauggcaacaaauucccugccuaacggacccgcucucgccgauggcccagccccugugagcccccuggagccaucuccugaaaaaguagcuaccauuagcccgaggcgccaugcaaugcccgguucccgaccaagaucacggauaccuguccuuuugagugaggaagacacagggagcgagcccucuggaucccugucagccaaggaaagguggaguaaacgcgcgcguccacaacaggauuuagcuagacucgugauggagaagcggcagggcaggcugcuucugcgccuagccagcggugcauccucuucgagcucagaggaacagaggagagccuccgagacucucaguggcaccgggucugaagaggacacgccugcuagcgaacccgcagccgcgcugccgcggaaguccggaagggcugccgcaacccgcucaagaaucccaaggccuauuggcuugcggaugcccaugccaguggccgcucaacagcccgccucucguagccacggggcagcuccugcccuggauacagcgaucaccagucgcuuacagcuccaaaccccgcccggauccgccacagcagcugaccugcgaccaaaacagccucccggcagaggucuugggccuggaagggcccaggcuggcgcacggccacccgccccucgcagcccaagacugcccgccucuacuucagcugcgaggaaugcauccgccaguccgcggagccagucguugucucgaagagaguccccuagcccaucacaucaagcucgccccggcgucccuccaccccgagggguuccgccugcccgggcacagcccgauggaaccccaaguccugguggcucuaagaaagggccccguggaaagcuccaggcccagagagcuacgacaaaaggcagggcggguggggccgagggacgcgcaggcgcucgguga

SEQ ID NO: 64331 - RNA, 3735 nt, Artificial Sequence
  derived and/or modified sequence opt3 from TTBK2__Homo_sapiens__NP_775771
augagcggcgggggagagcagcuggacauccucuccguggguauucuugucaaggaaagauggaaaguucugaggaagauaggcgggggaggcuucggugagaucuacgaugccuuggacauguuaacccgggaaaacguggcucugaaaguagagucugcacaacagcccaaacaggugcuaaaaauggaagucgccgugcucaagaagcugcaggggaaagaucacguuugccgcuuuauuggauguggccgaaaugaccguuucaacuauguggucaugcaacuucagggcagaaaucuggcggauuugaggcggucacagagucgcgggacauuuacuaucagcacgacccucagacugggaaggcagauucuggaguccaucgagucuauacauucgguggguuuccuccaccgggacaucaagccuucaaacuuugcuaugggccgcuucccaagcacaugccgaaaauguuacauguuagauuuugggcuggccagacaauucacuaauaguugcggagacguaaggccgccccgggcaguugccggcuuucgugguaccgugcgcuaugcuuccauuaacgcacauagaaauagggaaauggggcggcacgaugaccuuuggucuuuguucuacaugcuggucgaguuuguggugggacagcuaccuuggcgaaagaucaaagauaaggaacaggucggcagcauuaaggagcgcuaugaccauagacucaugcugaaacaccuuccacccgaguucuccaucuuucuggaucacauaucaaguuuggacuacuucacaaagccugacuaucagcuccugaccagcguuuucgauaacucuauuaaaacuuuuggcgugaucgaauccgacccauucgauugggagaagacagggaaugacggaucauuaaccacgacuaccacaagcacuacaccccaacugcauaccaggcucaccccugccgcuauugguaucgccaacgcgacgccaaucccgggcgaucuucugcgggaaaauacugacgagguauuucccgaugaacaguugagugacggggagaacggcauuccugugggagucucuccagauaaacuacccgguucccuggggcacccucgcccacaggagaaggacgugugggaagagauggaugcaaauaaaaacaagauaaagcucggcaucuguaaagccgcuacagaagaggaaaauagccauggacaagccaacggccugcuuaacgcacccucgcuggggucuccgauuagaguuagguccgagaucacccagccugaccgugacauacccuuggugcggaagcuccgaucaauucacaguuucgagcuggaaaagagauuaacucuggagccaaagccugauacagacaaauuucuagaaaccugccucgagaagaugcagaaggauacgagcgcuggaaaagaauccauccugcccgcccuuuugcacaagccauguguccccgcggugucuaggaccgaccauaucuggcacuacgaugaggaguaccugccugacgccagcaaaccagcaucagcuaauacaccggaacaggccgaugguggcgggaguaacggauucauugcuguaaaucucuccagcugcaagcaagagaucgacucuaaagaauggguuauuguggauaaggagcaggaccugcaggauuuucgcacuaacgaggccgucggccauaagaccacagguucacccagugacgaggaaccugaagugcuucagguccuggaggcaagcccacaagaugaaaaauugcagcucgggcccugggccgagaaugaccaccugaagaaagagacuuccggcgugguuuuagcucugucugcggaaggaccuccaaccgcagccucggagcaguauacagaccggcuagaacuccagcccggcgcugccagccaauucauagcagccaccccgacuucccugauggaggcucaggccgaagggccucuuacggcaaucacaauuccaagacccucaguggcgaguacccagucuacuagcggauccuuucauuguggucagcaaccugagaagaaagauuugcagcccauggagccaaccguagaacuguacucaccuagggagaacuucagcggccucgucgugacagaaggggagcccccaucuggaggcucccgcaccgaccuggguuuacagaucgaucacaucgggcacgacaugcugccgaauauucgagaaaguaacaagagccaagaucuuggcccuaaggaguugcccgaccauaaucggcucguugugcgugaguuugaaaaccugccaggagagacugaagagaaaucuauacuacuggaguccgauaaugaagacgagaagcucucaagaggccagcacugcaucgaaauuaguagccugcccggggaucuugucaucguggagaaagaccauucggcuacaacggaaccuuuggauguaaccaagacucagacauucuccgugguuccaaaccaggacaaaaauaacgagauuaugaagcuguuaaccgucggaacaucugagaucagcucaagggauauagacccccacguggaaggccaaaucggucagguggccgagaugcagaaaaauaagauuaguaaggacgaugacaucauguccgaagaucucccugggcaccagggagaccugucuacuuuucuucaucaagagggcaaacgcgaaaagauuaccccgcggaacggugagcuguuccacugugucagcgagaacgaacauggcgcaccaacgagaaaagauaugguuagguccucauucgugacccgacacagccgcauccccguguuggcccaggagauagacaguacacucgaaucuuccagcccuguaucggcuaaggagaaacugcuacagaagaaggccuaucagccagaucuggucaaacuccugguggaaaagcggcaauuuaaaucauuccuuggggacuugucuagugcauccgauaagcuguuagaggagaaacucgcuacuguucccgccccuuuuugcgaagaggaagugcugaccccguucagcagacuuacagucgacucucaucugagcagguccgcggaggauucauuucuaagucccauuaucagccagucucguaaguccaagauuccacgcccugugucauggguuaauacugaccaggugaacaguagcaccuccucucaauucuuuccccggccaccucccggaaaaccaccgacgagaccuggcguagaggccaggcuccgacgguacaagguccuggggucgagcaauucagacuccgauuuguucagucgccuggcucagaucuuacagaacggaucucagaaacccagaagcacaacccaaugcaaguccccaggcucaccccacaauccuaaaacuccacccaagucuccuguggugccgaggcggagcccaagugcaagcccccgauccucuucacucccuagaacauccaguagcucgcccucucgcgccgguaggccacaccaugaccagcguuccagcucaccucaccuggggcggaguaagucucccccaucccauagcggaucaaguagcuccagaaggucuugucagcaggaacacugcaaaccuagcaagaacggccuuaaagguuccggcucacugcaucaccacucugcuaguaccaagacuccgcaagggaaaucgaagcccgccagcaaauugucccgcuga

SEQ ID NO: 64332 - RNA, 2118 nt, Artificial Sequence
  derived and/or modified sequence opt3 from TTC12__Homo_sapiens__NP_060338
auggacgccgauaaggagaaagaccugcagaaguuccucaaaaacguggaugaaaucagcaaucuuauucaagagaugaacuccgacgaucccgucguucagcagaaggcugugcuggaaaccgagaaaagauuguuacugauggaagaggaccaggaggaagaugagugcaggacaacucuaaauaagacgaugauaucuccuccacaaaccgcaaugaagucagccgaagagaucaacagugaggcguuucucgcuagcguagaaaaagacgccaaggagcgggcaaaacgccgacgugaaaauaaggugcuggccgaugcucuuaaagagaagggcaacgaagcauucgccgaggggaauuacgagacagcuauucugagauauuccgaaggauuggagaagcucaaagacaugaagguccuguacacuaacagggcccaggcguauaugaaacuggaagauuacgagaaggcacucguggacugugaaugggccuuaaaaugcgaugagaaguguaccaaggcuuauuuucacauggguaaggccaaucuggcacuuaagaacuacucuguuucgcgggagugcuauaaaaagaucuuggaaauuaauccgaaacugcagacacaggugaagggcuaccuaaaccaagucgaccuccaggagaaagcugaccugcaggaaaaggaggcccaugaacuucuggauucagggaagaauaccgcggugacuaccaaaaacuugcucgagacacugagcaagcccgaccagaucccuuuauucuacgccggaggcauagagauccugacggaaaugauuaaugaguguacugaacaaacccucuuucgcaugcacaacgguuucaguaucauuuccgauaacgagguaaucagaaggugcuuuucuacagcagggaaugacgcuguugaggaaauggugugugucagcgugcuuaaacuguggcaggccgugugcucccggaacgaggaaaaucagcgcgucuugguuauacaucacgaucgagcuagacuacuggccgcacuccugucaaguaaggugcuugccauuaggcaacagagcuucgcucuguugcuccaucuggcgcagacugagucuggacgguccuuaaucauuaaccaccuggaccuaacccgucuccuggaagcacuuguaucauuuuuggauuucagcgacaaagaggccaauacagcuaugggccuguuuaccgaucucgcccuggaggaacgcuuccaggugugguuucaagcaaaccuuccaggcguccugcccgccuugacgggggugcucaagacugacccuaagguuaguucuuccagcgcucugugucagugcaucgccaucaugggaaauuuaucggcagagccaacaaccagaaggcacauggcggcuugugaagaguucggugauggcugccugucucuacucgcccggugcgaagaggacguggaccuguuccgagaggucauuuauacucuuuuggggcugaugaugaaccucugucugcaggcacccuuuguguccgaaguaugggccguugaggugucacgcagaugcuuaagucugcuuaauagccaggauggaggcauauugacaagggcugccgguguccucucccggacccugucuagcucacuaaaaaucguggaagaggcacugcgcgcuggggucgugaagaaaaugaugaaguuccucaaaacgggaggcgaaaccgccaguagauacgcgauuaagauccuggccauauguacaaacuccuaucaugaggcuagggaggaaguuauucgucuugacaagaaauugagcgugaugaugaagcuguuaucuucagaggaugaaguacucgucggcaaugcagcccugugccuugggaacuguauggaggugccuaauguugcuaguagccuguugaaaacugaccuccugcaagugcuacugaagcucgccggauccgauacccagaaaacagcaguccaggugaacgcggguaucgcccugggcaaacuuugcacugcugagccacgguuugccgcacaguugcgaaaacugcacggguuagaaauccucaauucuaccaugaaguacauuucggacagcuga

SEQ ID NO: 64333 - RNA, 3426 nt, Artificial Sequence
  derived and/or modified sequence opt3 from TTC17__Homo_sapiens__NP_060729
auggccgcugcagugggcgucagagggagguacgagcugcccccuugcagcggaccagguuggcuccuuucccugucugccuuguuaucaguugcggcucggggcgccuucgcaaccacacacugggugguaacugaagacgggaagauccagcaacagguggauaguccgaugaaccugaaacauccccacgaccuagucauucucaugcgccaggaggccacggugaauuaucugaaggaacuugagaaacagcugguugcucaaaagauacauaucgaagagaacgaggaucgagacaccggauuggaacagcgucacaauaaagaggauccugacuguauuaaggcaaaggugccacucggcgaucuggaccuguacgaugguacauauaucacucucgaaagcaaagacauuucccccgaggauuacaucgacaccgagucuccugucccacccgauccugaacagccagacugcacaaagauauuagagcugccguauucgauccaugccuuucagcaccuuagaggggugcaagaaaggguaaacuugucagcuccccugcuaccuaaagaggacccaauuuucaccuaccucagcaagcggcugggacgcaguaucgaugacauuggccaccuuauccaugaaggccugcagaaaaauacuuccucuuggguuuuguauaacauggccagcuuuuacuggagaauaaagaaugagcccuaccagguggucgagugugcgaugagggcacuccacuucuccucacggcauaacaaggauauugcccuggugaauuuagcuaacgugcugcaccgcgcccacuuuagugcagacgcugccgucguugugcaugcggcccucgaugacagcgauuucuuuacaucuuauuacacccuugggaauaucuaugcaaugcugggagaauacaaccacuccguauugugcuaugaccaugcucuacaggcccgaccugguuucgagcaagcuauuaaaagaaagcacgccgugcugugucagcagaaacucgaacaaaagcuggaggcacagcauaggucacuucagcggacgcugaaugaauugaaagaguaccagaagcaacacgaucacuaucuccgucagcaggagauccuggaaaaacauaaguuaauccaggaggaacaaauucugcgcaacauaauccacgagacucagauggccaaggaagcucagcuaggcaaucaucagauuugcagacucgucaaccaacagcacagccugcacugucagugggaccagccagugagguaccaucgaggggauaucuuugagaacguugacuacgugcaauucggagaggacaguucuaccuccagcaugaugucggucaauuuugaugugcagucuaaccaguccgacauaaaugauucaguaaaaaguagccccguugcgcacuccauucuuuggaucuggggccgggacucugaugcauaucgcgacaagcaacauaucuuguggccgaaaagagccgauugcacagaaagcuacccuagggugcccgucgguggggagcugccaacuuauuuccucccucccgaaaacaagggacugcggauucacgagcuuucaagugacgauuacuccaccgaggaagaggcucagacaccagacuguagcaucaccgauuuucgcaaaucucauacgcugucauauuuggugaaggaacucgaggucagaauggaccugaaggccaaaaugcccgaugaccacgcaaggaagauuuuacugagucguauaaauaacuacacuaucccugaagaggagauuggcagcuuccuauuccacgccaucaauaaaccaaacgcuccgaucuggcucauucugaaugaagccggccuuuauuggcgggcaguggggaacuccacauuugcgauagcuugcuugcagcgagcccugaaucucgcaccccugcaguaccaagacguuccuuuagugaaccuggccaaucuuuugauccauuacggacuccaccuggaugcuaccaagcuacugcuccaggcccuggcaauuaacucuucggagccacuuacuuucuugagccuggguaaugcuuauuuagcccucaaaaacaucuccggcgcgcuggaagccuuuagacaggcucuuaagcugacaaccaagugucccgagugcgaaaacucauugaaacucauuaggugcaugcaguucuacccuuuucuguauaauaucacgaguucuguauguagcgggaccgucguggaggaguccaacggaucagacgaaauggagaauagcgaugaaacaaagaugucugaggaaauacuagcacugguugacgaguuccaacaggccuggccacucgagggcuuugguggggcucuggaaaugaaaggccgccggcuugauuugcagggaaucagagugcugaagaaaggcccccaggacggggucgccagguccaguugcuacggagauugucgcagcgaggacgaugaagcaacugaguggauuaccuuccaagugaagcgaguaaagaaaccgaagggugaccauaaaaagacaccuggcaaaaagguggagacugggcagaucgaaaacggacaccgguaucaggcgaauuuagagauuaccggcccaaaaguugccucucccgguccucaagggaagaagcgugauuaccagagacucggcuggcccuccccagacgaaugccugaaacuuaggugggucgagcugacagcuaucgugucaaccuggcuagccgugaguagcaagaacauagauauuacugaacauaucgacuuugcaacgccuauucagcagcccgcuauggagccacucuguaauggaaaccugccgacaucgaugcacaccuuggaccaucugcacggcgucuccaaucgcgccucuuuacacuauacuggggagagccaacucaccgaaguucugcagaaccuuggaaaagaucaguacccucagcaaucacuggagcagaucgguacacggauagcaaagguguuggagaaaaaucagaccaguugggugcucuccucuauggccgcucuguacuggagaguaaagggccaggggaagaaagcgaucgacugccuaaggcaagcccugcauuaugcaccccaccagaugaaggaugucccacuuauuagccucgcuaacauccugcacaaugccaaauuguggaacgacgccgugauuguugcuacuauggcaguggaaaucgcgccccauuucgccgucaaucacuuuacacugggaaacguguacguugcuauggaagaguucgagaaggccuuagugugguaugaauccacgcucaaacugcagccugaguuuguaccagcaaagaaccgaauacagaccauucaaugucaucuuaugcugaagaaaggccgccggucacccuga

SEQ ID NO: 64334 - RNA, 1143 nt, Artificial Sequence
  derived and/or modified sequence opt3 from TTC19__Homo_sapiens__NP_060245
auguucagacugcucagcuggucccuuggcaggggguuucugcgggccgcuggacgccgaugccgugguuguucugcaagauuguuacccggccuggccgggggaccuggcccagaggugcaggucccgcccucaaggguugcgccucacggucgggggccaggacuacucccccugcuugcugcccuggcaugguucagucgcccugccgcugcagaagaggaagaacaacagggcgccgacggcgcugccgcggaagauggggcagacgaggccgaggcugaaaucauucaguugcucaagagagccaaacugagcauaaugaaggaugagccagaagaggcagagcugauccuccaugacgcuuuaaggcuggccuaccagaccgauaacaaaaaggcgauuacauauacuuacgaccuuauggccaauuuggcauuuauccggggacaacuggaaaacgcugagcagcuauucaaagccacgauguccuaucuccuggguggcgggaugaagcaggaagauaaugcuauuaucgagauaucucuuaagcuggccucgaucuacgcagcccagaaccgccaagaauuugcuguggcgggauaugaguucugcauuucaaccuuggaggagaaaaucgagcgagaaaaggagcucgcagaagacauuaugagcguagaggagaaagccaauacacaccuguuacugggcaugugucucgaugcuugcgccagauaccuucuguuuaguaagcagcccucccaggcacagaggauguaugaaaaagccuugcaaaucucugaggaaauacagggugagcggcauccucagacuauugugcuaaugagcgaccuggcuaccacacucgaugcccaagggcguuucgacgaagcauacaucuacaugcagcgcgcguccgaucuggcuagacagauuaaccacccagagcuucauaugguccugucaaauuuggccgcagugcucaugcacagggagcgguauacccaggccaaggaaaucuaccaagaggcucugaagcaggccaaauuaaagaaagacgaaaucaguguucagcacauucgagaggagcuggcagaacuaagcaagaaaucucgcccgcucacuaacuccgugaagcuguga

SEQ ID NO: 64335 - RNA, 879 nt, Artificial Sequence
  derived and/or modified sequence opt3 from TTC1__Homo_sapiens__NP_001269429
augggcgagaaaagcgaaaacugcggggugcccgaggaccugcucaauggacuuaaagucaccgauacacaggaagccgagugugcugguccuccaguuccggaccccaagaaccaacacucccagucuaaacuguugagagaugacgaagcacauuuacaggaggaucagggcgaggaagagugcuuccacgacuguucagccaguuuugaagaggagccuggggcggauaagguggaaaauaaaagcaacgaggacguaaauuccucugaacuggaugaggaauaccuaaucgagcucgagaagaacaugucggacgaagagaagcaaaagaggcgggaagagucaacucgccugaaggaagagggaaaugagcaguucaaaaagggcgauuauauugaagcugagagcaguuacucccgagcccuugaaaugugcccaucuuguuuucagaaagagcguagcauacuguucuccaacagagcagccgcuaggaugaagcaggacaagaaagaaauggcaaucaaugauugcucaaaggccauucaauugaaccccaguuauauccgggcuauucuccgcagagccgagcuguacgagaaaacggacaagcuggacgaagcgcucgaggauuauaaaagcaucuuagaaaaggacccuucuauacaucaggcaagggaggccuguaugcggcugccaaaacagaucgaggaacgcaaugagcgacuuaaggaagagauguuggguaagcugaaagaucuagggaaccucgugcugagacccuuuggacuuuccaccgaaaauuuccagauuaagcaagacucaagcacaggcaguuacucuaucaacuuuguccagaauccuaacaacaauagguga

SEQ ID NO: 64336 - RNA, 3951 nt, Artificial Sequence
  derived and/or modified sequence opt3 from TTC21B__Homo_sapiens__NP_079029
auggacagccaggagcugaagacccucaucaacuacuauugccaagaaagauacuuccaccaugugcuucuggucgccuccgagggcauuaaaagguaugggucugaucccguuuuucgguucuaccacgcuuauggaacauugauggaagguaagacucaggaggcauuacgcgaauuugaggccaucaaaaauaagcaggacgugucacuguguagucuacucgcgcugauauacgcucauaaaaugagcccuaacccagaucgagaggccauucuugaauccgacgcacguguaaaggagcagagaaagggcgccggggaaaaagcucuguaucacgcaggauuguuccucuggcauaucggcaggcacgauaaggcccgggaguacauugaccgcaugaucaaaauaucugaugguucgaagcaagggcacgugcugaaggcuuggcuggacaucacgagaggaaaggagccguacaccaagaaagcccucaaguauuuugaagagggcuuacaggauggcaaugacacauucgcgcugcuugggaaagcacagugcuuggaaaugaggcagaacuacucaggagcccuggagacugucaaucaaauuaucgugaacuuucccagcuuccuaccugcuuuuguuaagaaaaugaagcuccagcuggcccuucaggauugggaccagaccguggaaacagcacaacggcuguugcuccaggauagucagaaugucgaggcucugcgcaugcaagccuuauauuacgugugucgagagggugacauugaaaaagcguccaccaagcuggagaaccucggcaauacucuugacgccauggaaccacagaacgcacagcuguucuauaauaucacauuggcuuuuucuagaaccugcgggaggagccagcuaauacugcaaaagauucagacgcuccuggagcgggccuucucccuuaacccccagcagucagaauuugcuacugagcugggauaccaaaugaucuugcagggccguguaaaagaggcccucaagugguauaaaaccgcaaugacacuggaugaaacuagcguuagcgccuuaguggguuucauucagugucagcugaucgaggggcaacuacaggacgcugaucagcagcucgaguuccugaaugaaauccaacagucuauuggaaaguccgcggaacuuauauacuugcaugcaguccuggccaugaaaaagaacaagcgccaggaggaggugaucaaucuccugaacgacgugcuugauacccacuuuucacaacuggaaggcuugccucucggcauucaguacuucgagaaacugaacccagacuuuuuacuggaaaucgucauggaguaucuaaguuucugccccaugcagccugcuaguccagggcagccgcucuguccccugcuuagaaggugcauaucuguuuuggagacagugguacggaccgugccuggacugcuccaaacggucuuucugauugccaaggugaaauacuuauccggugauaucgaagcagccuucaauaaccugcagcauugucuugagcacaauccaagcuaugcugacgcccacuugcuccuggcacagguuuaccuaucgcaggaaaaggugaaacugugcucucaaucccucgagcugugucuuucauaugauuuuaagguccgagacuaccccuuguaucaucugaucaaggcgcagagucagaaaaagaugggcgaaauugcugaugccaucaaaacuuuacacauggcaaugagccucccugggaugaagcgcauuggagccuccacaaaaucuaaggacagaaagaccgagguggacacuagccauaggcugucaauauuccuugagcugaucgauguacaccgguugaacggcgaacagcaugaggcuacaaaaguucuccaagacgccauucacgaauuuagugguaccuccgaggaagugcgcgucacgaucgcaaaugcugaucuggcccuagcgcagggggacaucgagagagcccugagcauucuccagaacgugaccgcugagcaaccauacuucauagaagcaagggagaagauggccgauaucuaccugaaacaccguaaggacaaaaugcuuuauauuacaugcuuucgggaaaucgcugagcgaauggccaaucccagaucuuucuugcuguuaggcgaugcauacaugaacauucucgaaccggaggaggcgaucgucgccuaugaacaggcucugaaucagaacccuaaggacggaacucuugccucaaaaaugggcaaggcacugauaaagacccauaauuacaguauggcuaucacauauuacgaggccgcacuaaaaacugggcagaagaacuaucucugcuacgaucuggccgaauugcuguuaaaacucaagugguacgacaaagcugagaaggugcugcaacacgcgcuugcccaugagcccguuaaugaacugagcgcauugauggaggauggaaggugucaggugcuccuggcuaagguauauuccaaaauggaaaagcuaggugacgccauuaccgcccugcagcaggcucgcgagcuucaagcacggguccucaaaagagugcagauggaacagccagaugccguuccugcgcagaagcaccuggcugccgagaucugcgcagagauugccaaacacucuguggcucaaagggacuacgaaaaggcaaucaaguuuuaucgcgaggccuugguccauugugaaacagacaacaaaauaaugcuggaguuagcgcgacucuaccuggcucaggaugaccccgauucgugccuucggcagugugcccuguugcuccagagcgaccaagauaaugaagcagccaccaugaugauggcugaccugauguuccguaagcaggauuaugagcaggccguguuccaccuacaacagcugcuugagagaaaaccagacaacuacaugacucucuccaggcugauugauuuguuacgccggugcggcaagcuggaagacguacccagauuuuucucaauggcagagaaaaggaacagucgagcuaagcucgaaccuggguuucaguauuguaagggacuguaccuuugguacacgggcgagccaaaugaugcccugcgccauuucaacaaagcgcggaaggacagagauuggggucagaaugccuuguauaacaugaucgaaauuugccuaaauccggacaacgagacaguugggggcgagguguuugaaaaucuggacggagaucucggcaacucuaccgagaaacaagaaagcguccagcuggcagugaggacugcugagaaacuuuuaaaagagcugaagccccagaccgugcaggggcacguccaacuccguaucauggaaaauuacuguuugauggccacaaaacagaaguccaacguugagcaggcucugaauaccuucacugaaauagcagccucagagaaggaacauaucccugcccuccugggaauggcuacagcguauaugauucuuaaacagacgccacgcgcacggaaccaacugaagagaaucgccaaaaugaauuggaacgcuauugacgccgaggaguuugaaaagagcugguugcuacuggcagauaucuacauacagucugccaaauaugacauggcugaggaucucuuaaagaggugccugcgacacaaucgguccuguugcaaggcguacgaauauauggguuacauuauggagaaagaacaggccuacaccgacgcagcucuuaacuaugagauggccuggaaguacaguaaccgcacuaaucccgcagugggcuauaaacuggccuucaacuaccucaaggcuaaaagauauguggauagcaucgacaucugccaccaaguauuggaggcccauccuacauacccaaagauuaggaaggauauccuggacaaagcgcgggcaucucuccgacccuga

SEQ ID NO: 64337 - RNA, 7446 nt, Artificial Sequence
  derived and/or modified sequence opt3 from TTC28__Homo_sapiens__NP_001138890
auggagcagagcccucccccagccccggaacccacccaaggcccuacaccagcuagguccaggcggcgccgagagcccgagucuccuccagcuucagcccccaucccucuguucggggcggacacuauuggacagcguaguccagaugguccggugcucagcaaggcugaguuugucgaaaagguuagacaguccaaccaggccugccacgacggcgauuuccauacggccauagugcuuuacaaugaggcccuggcuguagacccccaaaacugcaucuuguauucuaauaggucggcagccuacaugaagauucagcaguaugauaaggcuuuagacgaugccaucaaggcgcggcugcuaaacccuaaguggccaaaggcauacuuucgccaggggguggcccuccaauaucugggaagacacgcugacgcccuugcagcuuucgccucaggccuggcgcaggaucccaagagcuugcagcuccuggucgguaugguggaggccgcaaugaaaaguccuaugagggacucccuggaaccaaccuaccagcaacuccagaagaugaaauuagauaagucucccuuuguuguggucagcgugguagggcaggagcugcuuacagcuggacaucacggcgccuccguuguggucuuggaagcugcccugaaaauuggcacuugcucacuaaagcuccgggggaguguguucagcgcacugucuuccgccuauuggucacuuggaaauaccgagaaaagcacagguuacaugcaacaggaccuggauguggcuaaaaccuugggcgaccagacuggggagugucgcgcgcauggaaaccucggcagugcauuuuucucuaaggguaauuaccgagaagcccugacaaaccacagacaccaguuaguccuggcuaugaaacucaaggacagggaggccgcauccagcgcccuuucgucucuggggcauguuuauaccgcuaucggagauuacccgaaugccuuggcaucccacaaacaaugcgugcuacuggcgaagcagucaaaagacgaacucagugaggcucgggaacugggcaacaugggcgccguauauauagcaaugggggauuuugagaaugccgugcagugucaugagcagcaccuuaagaucgcuaaggaccugggaaacaaacgugaagaggcccgcgcauacagcaauuuggguuccgcuuaucacuacagaaggaacuucgauaaggccaugucuuaucauaauuacguccucgaacuggcgcaagaguuaauggaaaaagccauugagaugcgggcuuacgcaggccuggggcacgccgcucgaugcaugcaggaccuagagcgcgccaagcaguaucaugaacagcaacucggaaucgcagaggaucugaaagacagagcggccgaaggcagggcuagcucaaaccuugguauuauccaccagaugaagggggauuacgacacggccuugaagcugcauaaaacucaccucuguauagcacaggagcugagugauuaugcugcccagggccgggcauacggaaacaugggcaaugccuauaacgcucuugggauguacgaccaagcggugaaguaucaccgccaggaacugcagauuuccauggagguuaaugacagagccagccaagcaucuacccauggaaacuuggcuguggccuaccaggcccucggugcucacgauagggcacugcagcauuaccagaaucacuuaaacaucgcccgugagcugcgggacauucaaucagaagcgcgagcucuaaguaaucucggcaacuuucacugcagcagaggggaguauguccaggccgcaccuuacuaugaacaguaccugaggcuugcccccgauuugcaggacauggagggagagggcaaagugugucauaaucuggguuaugcucacuacugccucgggaacuaucaagaagcaguaaaguacuacgagcaggaucuggccuuagcgaaagaccugcaugauaaacuuucccaggcuaaggccuauuguaauuugggccucgcauucaaagcccugcuaaacuuuucuaaggcugaagagugccagaaauaccugcucucgcuggcccaaagccuuaauaacucccaggcaaaguuccgcgcuuugggaaaucugggcgacaucuucaucugcaaaaaggauauuaacggggccauaaaguuuuaugaacagcaauuaggacucgcgcaccagguuaaagaccggagacuggaggccucagcauacgcugcccuugguacagcuuauaggaugauccagaaguacgauaaagcacugggcuaucauacucaggaguuggaaguguaccaagagcucagugaccugccaggggaaugucgcgcccacggacaccuagccgcugucuacauggcgcugggcaaguauaccauggcauucaaaugcuacgaggaacagcucgaucugggucagaaacuuaaagacccuucuuuggaggcccagguguaugggaacaugggcauuacaaagaugaauaugaacgucauggaggaagcuaucggauacuuugagcaacagcuggccauguuacagcagcucagcggcaaugaauccgugcuggaccgagggcgggcauauggaaaccuuggcgauuguuacgaggcccugggugacuaugaagaggcuauaaaguacuacgagcaauaucuaucaguugcgcagagccucaaucguaugcaggaucaggccaaagcauacagagggcugggaaacggccauagggcuauggguucuuugcaacaggcccuggugugcuucgaaaagcgcuuaguagucgcacacgagcucggcgaagccuuuaauaaagcucaggccuauggggagcugggaucccuucauagucaacugggcaacuacgagcaggcgauuagcuguuuggaacggcagcucaauaucgcaagagacaugaaggauagggcccuggagucugacgcugccugcgggcuaggaggcguguaucagcaaaugggugaauacgauaccgcucugcaguaucaccagcuugaccuccagaucgcagaggaaacgaacaaucccacuugucaagggcgagccuacggaaaccugggcuugacauacgagucccuggguaccuucgagcgcgcuguuguguaucaggaacagcauuuaucaauugccgcacagaugaaugaucucgcggccaaaacugucaguuacagcucgcugggccggacacaccacgcacuucaaaacuauucccaggccgugauguaccugcaggagggguugagacucgcagaacaacugggaaggcgugaggacgaagcuaagauccgccauggccuagggcugucucuuugggccagcggaaaucucgaggaggcacagcaccagcuguaucgggccucagcuuuguuugaaaccauuagacaugaggcgcaguuaaguacggauuacaagcugucccucuucgaccugcaaaccucuagcuaucaggcccuucagaggguacugguguccuugggccaccacgaugaagcacuagcuguugccgagcgaggucggacacgcgccuuugcagaccugcucgucgaaagacagacugggcaacaggacucagauccauacagccccgugaccauagaccagauccuggagauggugaacggacagaggggccuugucuuauacuauagucuggcugccgguuaccucuauucuugguugcuggcgccuggcgcugggauuguuaaauuccaugagcacuaccucggagaaaacacaguggaaaauuccagcgauuuucaagccucgucaucugugacucugccaaccgcaacaggcagugcccuugaacagcauaucgcuuccguacgggaggcacugggggucgagagccacuauucucgagccugcgcgagcuccgaaaccgagucagaagcuggagacaucauggaucagcaguucgaggaaaugaacaauaaguugaacagugugacugacccgacgggcuuucuaagaaugguucgcaggaauaaccuguucaaucguagcugucaaucuaugacaucccucuucucaaacaccgugagucccacucaggaugguaccagcuccuuaccucggagacagucuucguuugccaaaccaccccugagggcacuuuacgaccugcucauugccccuauggaagggggauugaugcauagcucaggcccagucggccgccaccgacaacugauacucgugcuggagggggaacuuuaucuaauccccuucgcucuguugaagggauccaguucuaaugaguacuuauacgaaagauuuggucugcucgccguuccgagcauucggucccugucagugcagucuaaaagccaccuuaggaagaacccuccaacauauaguuccagcaccucuauggcagcuguaaucggcaaucccaagcugccuucagccgucauggaucgcuggcucugggggcccaugccauccgcggaggaagaggccuacauggugagugaguugcugggaugccagccucuagugggcagcgucgcaacuaaagaacguguuaugucggcucugacacaggccgagugugugcauuucgcaacgcacauuucuuggaagcucuccgcucuuguacugacccccagcauggacgguaacccagccucaaguaaaucuuccuuugggcauccguauacuaucccugagagcuuaagagugcaagaugacgccucagacggagagaguauaagcgauugucccccauugcaggaacugcuccugacagcggcugacguccuugaucugcagcuccccgugaaguugguugugcugggcuccucucaggagagcaauuccaaagucaccgcagacggcgugaucgccuuaacacgggcuuuccuagccgcaggggcccaaugcguucuggugucacucuggccugucccaguagcugcgucuaagauguuuauucacgccuucuacaguucgcuucugaacggauugaaggcaagcgcugcccugggugaggcaaugaaagugguucaguccucuaaggccuuuucacaccccagcaauugggcuggcuucaugcucaucggguccgaugugaaacugaacaguccuucuagccuuauuggacaggcccucacugaaauccugcagcauccggagagggcgcgcgacgcauugcgaguccuguuacaccuaguggaaaagucacugcaaagaauacagaacggccagcggaaugccauguauaccucccaacagaguguagagaacaaagugggugggauuccaggauggcaggcucuccuuacggccgucggcuuuaggcuggaucccccuaccagcggcuugccagcagcuguuuucuuucccacaucugacccuggggaucgccugcagcaauguuccucaacucuccagagccugcuuggauuaccgaaucccgcccugcaggcucucugcaaguugaucaccgccucggagacaggugaacagcugauuucuagagcagugaaaaacauggugggcaugcuacaucaaguccuggugcagcuccaggcgggggagaaggaacaggaccuugccagugcuccaauccaaguuuccauaagcguacagcuguggagguugccuggaugucacgaguuccuggccgcacucggcuucgaucugugcgaagugggucaggaggaggucaucuuaaagacugggaaacaagcuaaucggcguaccgugcauuuugcccuucagucacugcucucccuauucgacucuacggaacugcccaagcgcuugagccuggauaguuccagcucucucgagucacuugcaagugcccaguccguuagcaacgcgcugccauugggauaccagcaaccucccuuuucuccaacaggcgcugacucgauugccucagacgcaaucagcguguauucccugaguucuauugccagcuccaugucauucgucaguaaaccggaaggcgggucugagggagguggcccugggggacgacaggaucacgacagaagcaagaaugcuuaccuccagagguccaccuuaccccggucacagcugccaccccaaacucgcccugccggcaacaaagaugaagaggaguacgaagguuuuagcaucauaucuaaugagccacuugcaacauaucaggaaaacagaaauaccuguuucucccccgaccacaagcagccucagccggggacugcuggaggcaugagggugaguguaagcucgaagggcuccauuucuaccccaaacucacccgucaaaaugacacugaucccuagccccaauaguccauuucaaaagguggggaaacuagccuccucugauacgggagagagcgaccagucauccaccgaaacugauaguacaguuaagagccaggaggagucuaacccuaaacucgacccccaggaacuggcgcaaaagaucuuggaggaaacccagucacaucugauugcuguggagcggcuccagcgauccgguggccaagucagcaagucuaauaacccagaggauggggugcaggccccuaguucgacagcaguuuucagagccuccgaaacuagcgcuuuuucacgcccggugcuuucucaccagaaaagccagcccuccccagucaccgugaagccuaaacccccagcaaggaguucaucucugccuaagguaagcuccggauacaguagccccacgacauccgagaugucuaucaaagacucaccgagccaacauucgggccggccauccccugguugcgauagucagaccucucaguuagaccagccccuguucaaguugaaguauccaagcucacccuacuccgcccacauuucuaaaaguccucguaauaugagcccguccucagggcaccaaagccccgcgggcucugccccaaguccugcucucuccuauagcucagcaggaucugccagauccucgcccgcugaugccccugacauagacaagcugaaaauggcagcuaucgaugaaaaggugcaggccguucauaaccuaaaaauguuuuggcagagcacuccacagcacaguaccggccccaugaagauuuucagaggggcgccuggaacaaugacuucuaagcgcgacguccuuucccugcucaaccugagcccacggcauaauaaaaaggaggaagguguggauaaauuggagcugaaggagcucucacuucaacagcacgacggcgcacccccgaaagcaccuccaaacgggcauuggcgaaccgaaacaacgagucugggauccuuaccccugccugcuggcccacccgccaccgcaccggccagaccuuugaggcuccccagcgguaauggguacaaguuccugucuccaggccgcuuuuucccuucaagcaaauguuga

SEQ ID NO: 64338 - RNA, 1506 nt, Artificial Sequence
  derived and/or modified sequence opt3 from TTC29__Homo_sapiens__NP_001287690
augauccccauguucaccgugacacuggaggacagcggcacucucuggaagucccuucacucuucaagugaaagcgagaugacgacccugccuccauugccgaugacaagacccaaauuaacugcccuggcuaggcagaagcuaccuugcuccucucggaaaauuccacgcucgcaacucauaaaggaaaaagaugacaucgaucauuaccuggaggucaacuuuaaggggcuuucaaaggaagagguugcagccuaucgaaauagcuacaaaaagaacauuuguguggacaugcugcgugauggauaucacaaaaguuucaccgaguuguuugcgcucauggaaagaugggacgcucugagggaggccgcacggguacgcucccuguucuggcuccagaagcccuuagaagaacagccugauaaacuggacuaccuuuaucauuacuugacaagagccgaggaugcugaaaggaaggagucuuuugaagacgugcacaauaaccuguaugcacuagccugcuacuucaauaacagcgaggauaaguggguccggaaucauuuuuacgaacgcuguuucaaaaucgcucagcucauuaagaucgacugcgguaaaaaggaggccgaggcgcacaugcacaugggccugcuuuaugaagaggaugggcaacuguuggaagcagccgagcauuacgaggcuuuucaccagcucacccagggacgaauauggaaagacgagacuggcagaucccugaacuuacuggccugugagucacuccuuaggacauaucggcuguugagugacaagaugcuagaaaauaaagaguacaagcaggcaaucaagauucugaucaaagcuagcgaaauugccaaggaggguucugauaaaaagauggaagcggaggccuccuauuaccucgggcuggcacaucuugcugccgaggaauaugagaccgcucugacgguguuggacacuuacugcaaaaucucaaccgaucucgacgaugaccugagcuuaggacguggcuacgaagccauagcaaagguucugcaaagucagggcgagaugacagaggccauuaaguaucucaaaaaguucgugaaaaucgcucgcaacaauuuucagucucuagaucuggucagagcguccacuaugcuuggggacauuuacaacgaaaagggauauuacaauaaagcaagcgaguguuuccagcaagccuuugauaccacaguggaauugaugucgaugccacugauggacgagaccaagguacacuaugguaucgcuaaggcccaccagaugaugcucacgguuaacaauuacaucgaaucugcagaucugacuucccuuaacuaucuguugucauggaaagagaguaggggcaacauugagcccgacccugugacagaagaguuccgggggagcaccgucgaagccgugucccaaaauucugagcgacucgaggaacugagccgcuucccaggagaccagaagaacgagacuuga

SEQ ID NO: 64339 - RNA, 4695 nt, Artificial Sequence
  derived and/or modified sequence opt3 from TTC37__Homo_sapiens__NP_055454
augagcuccaaggaggugaaaaccgcccugaagucugcuagagacgcaaucaggaacaaagaauacaaggaggcccucaaacacugcaagacaguccuuaagcaggaaaagaauaacuauaaugcguggguuuucauuggcguggcugccgcagagcuggaacaacccgaucaggcccagucagcuuacaagaaagcagccgaguuggagccugaccaguuacuggcuuggcaagggcuagccaaccucuaugaaaaguacaaucauauaaacgcgaaagaugaccugccaggaguauaucagaaguugcuggauuuguacgagaguguggacaagcagaaauggugugaugucugcaagaaacucguggaccuguauuaccaggaaaagaaacaccuggagguugcacggacuuggcauaagcucaucaaaacgcgccaagagcagggugccgaaaaugaggaauuacaccagcuguggcgaaaacuuacccaguuuuuggcugagagcacagaagaucaaaacaaugagacucagcagcugcuauucaccgccuuugagaacgcacucggccuguccgacaagauuccgucugaagaucaucaagugcuuuaccgucacuucauccagucgcugucaaaauuuccccacgagagcgcuagauugaagaaagccugugaagggaugauuaauaucuauccuacaguccaguacccacucgaggugcugugcuuacaucugauagaaaguggaaaccucaccgacgagggccagcaauauuguugcaggcuuguagagauggauuccaagucuggucccgggcugaucggauugggcauuaaagcgcuacaggacaagaaguacgaagacgccguucggaaucugacugagggccucaaagaaagcccuguguguacauccgggugguaucaccuggcagaggcucaggucaagaugcaucgcccaaaagaagccgugcuuucaugcagucaggcucugaagaucguggauaacuugggagccagcgguaauucucucuaccaaagaaaccuguguuuacaccugaaagcagaggcccuaauuaagcucuccgacuaugauucaagcgaggaagcuaucaggacccuggaccagauaagugaugcggacaacauucccggccuuuugguccugaagucucucgcauaccggaauaaaggguccuucgaugaggccgcuaagaucauggaagaccugcuuagcucguacccugaucuggccgagguucacgcauuggaggcccucauucauuuuacgaaaaaggacuaucugcaggcugaaaaaugcuuccagcgcgccuuagagaaggauacugaaguggcagaguaccacuaucaacugggacuaaccuacugguuuaugggcgaagagacacgaaaggacaaaacuaaggcgcucacccauuuccugaaagcugccagacuugacacauauauggguaagguauuuuguuacuuggggcacuauuacagggauguggucggagacaaaaaccgggcacguggcugcuaccgcaaggccuucgagcuggaugacaccgaugcugaaucuggcgccgcagcuguggaccucuccguugagcuggaagauauggagauggccuuagcgauccugacgacugugacacagaaagccucagcugggaccgcaaagugggccuggcuuagaaggggauuguauuaccucaaggcuggucagcauagucaggccgucgcagaccugcaagcggcccuacgggcugauccaaaagacuuuaauugcugggaaagccugggcgaggccuaucucucccgagggggauacacuacagcacugaagucuuucaccaaagcuagcgagcuuaacccggaaucaaucuauaguguguucaagguagccgcaauucagcagauauugggcaaauacaaggaggccguugcucaauaucagaugaucauuaagaaaaaggaagauuacgugcccgcgcugaaagguuuaggggagugucaccucaugauggccaaggcagcucuggucgacuaccuugauggcaaagccguggacuauaucgaaaaggcccuggaguacuuuacgugcgcuuugcagcaccgcgcagacgucuccugucucuggaagcuggccggagaugcgugcaccugucuauaugcuguggccccuagcaaaguuaaugugcauguacugggcguccuccuggggcagaaggagggaaaacaagugcuuaagaaaaacgaauugcugcacuuagguggcagaugcuacgggagggcacucaagcugaugucuacaucaaauacuuggugugaccuuggaauaaacuauuaccggcaggcccagcaucuggcugagaccggcaguaauaugaacgaucuaaaggaacuccuggagaaaagccuucacugccugaagaaagcaguucgcuuagacuccaauaaccaccucuauuggaaugcccuggguguggucgcguguuacucugggauuggcaacuacgcucuugcccagcauugcuucaucaagucgauccaaagcgagcagauuaaugcaguggccuggacaaaccugggaguauuguaucucacuaacgaaaauaucgagcaggcucacgaagccuuuaaaauggcacagucccuggauccaucauaccuaauguguuggauuggccaagcucugauagccgaggcgguggggaguuaugacaccauggaucuuuucagacauacaaccgaacucaacaugcacacugagggagcccuggguuacgcauauuggguuugcacgacauugcaggacaagucuaauagggagaccgaacuguaccaguauaacaucuuacaaaugaaugcuauucccgccgcucaggucauccucaacaaauacguggagcguauccagaauuacgccccugcauuuacuaugcugggcuaucuuaacgaacaucugcaguugaagaaggaggccgcuaaugcguaccaacgggcaauucuccugcuacagaccgccgaagaucaggacacauauaacguggcuauacgaaauuacgggagacugcuuugcagcaccggagaguaugauaaagccauccaggcauucaaguccacuccacucgagguccuggaagacauuaucggcuuugccuuggcuuuauucaugaaaggucuguacaaggagucaagcaaagcguaugaaagggcccucucuauuguugaguccgaacaagauaaggcacacauccugacagcucuugccauaacggaguacaagcaggggaaaaccgacguggcaaagacucuguuguuuaaauguaguauccuaaaggagcccacaaccgaaagccugcaggcccucugcgcucugggccuugccaugcaggacgcgacauuaucuaaagcagcccugaacgagcucuugaagcacauuaagcauaaagauuccaauuaccaacgcugucugcucacuucagcuaucuaugcccugcagggacggaguguggcuguacagaagcagauuagcaaagcaguccacucgaacccgggcgacccugcccuuuggucccuguugucuagagugguugcucaauacgcccagaggaaugcaaaagggggaguggucgcgggcaacguggcccauauccuagauagcaaccacgguaaaaaggcucugcucuauaccgccguuaaucaguuagcaauggggucaaguuccgcugaagacgagaagaacacggcccugaaaaccauacaaaaggcagcccuucugucucccggagauccagcuauuugggcgggccucauggccgcaugccaugcugacgauaaauuggcccuggugaauaacacacagccuaagcgcaucgaccucuaccuggcccuucuaagcgcaguauccgcuucaauuaaagaugagaaguucuuugaaaauuauaaccagagccuggagaaguggaguuugucucaggccgucacugguuuaaucgacaccggccgaauauccgaagcggagacacuguguacuaaaaaucucaagagcaaccccgaucaaccagcugugauccugcuucugcgucaggugcagugcaaaccccucuuggaaucgcagaagccucugccagacgccguccuagaggagcugcaaaagaccguuaugucaaauucuacgagugugccggcauggcaguggcucgcccacguauaccagucccaggggaugaugcgggcugcagaaauguguuauagaaagagccuucaacuggccucucagaggggaagcugguccggcaaauuaucaaguuugcugcgccucgcgcugcuugcucugaaggugugcauggccaacauuagcaaugaccacuggcccucucucguccaggaggcaacaaccgaagccuugaagcuguguuucugcccuuuagcugugcuacugcaagcccuccuucaguuuaaacggaagaugggggcaagagagacuaggcgacuguuggaacgcguuguguaccagccaggauaccccaaauccaucgcuucaacagcccggugguaucugcucagacaucuguacgcgaaggaugacuaugagcuuauugauguccucgugaacaaugccaaaacccacggcgacacuagggcacuggaguugaaccagcgucugaguagccaauga

SEQ ID NO: 64340 - RNA, 1734 nt, Artificial Sequence
  derived and/or modified sequence opt3 from TTC39A__Homo_sapiens__NP_001284592
augaccagcgccggcggggcucccggagcacugccugccgguacaccagaguccucucuccacgaagcgcuugaccagugcaugacugcucuggauuuguucuuaacgaaccaauuuucagaggcccugaguuaccuaaagccgagaaccaaagaaagcauguaucauucccucacauacgcaacuauccuggagaugcaggccaugaugaccuucgacccccaggauauucuucuggcuggcaauaugaugaaggaagcacagauguugugucaaaggcaccggcgcaaaucuucggugacagacucauuuagcagucucgucaaccgaccuacccuggggcaguucacugaggaggaaauacaugccgagguuugcuaugcugaaugucugcuccagcgugccgcguuaacauuucugcaggaugagaauaugguguccuucaucaagggaggcauuaaaguaagaaacucuuaccaaaccuauaaggagcuugacagcuuggugcaguccucacaguacugcaagggugaaaaucacccacauuuugaagggggagucaaacugggcgugggcgcauucaaccuaacgcucaguaugcugcccacuaggauccuucggcuguuggaguuuguuggguucagcggaaauaaggauuauggucuccugcaguuagaggaaggcgccucugggcacuccuuucgcucagugcugugugucaugcuccuucugugcuaccacaccuucuugacauuugugcuaggaacuggcaacguaaauauugaggaggcugaaaaacugcucaagccuuaccugaacagauauccaaaaggugccaucuuccuuuucuuugcagggaggauagagguuaucaagggaaauauugacgcugccauccggcgcuucgaagaguguugcgaagcgcaacagcauuggaagcaguuucaccauauguguuacugggagcugauguggugcuucaccuauaaaggccaauggaagaugagcuacuuuuaugccgauuugcucaguaaagagaacuguuggucuaaggcaacauacauuuauaugaaagcugccuaccuguccauguucggcaaggaagaccacaaacccuuuggggaugacgagguggaauuauuccgagcugucccuggacugaagcuaaagaucgccgguaaaagccucccaaccgagaaguuugcaauaagaaaaucgaggcgguacuucucuuccaauccgauuucacugcccgugccugcccuugaaaugauguauaucuggaacggcuacgcugugauugggaagcagccaaaauugacggauggaauccuggagaucauuacuaaggcggaggaaaugcucgagaagggccccgaaaaugaguauagugucgacgacgagugccugguuaaacuucugaaggguuugugccucaaauaccuggggcgugugcaggaagcagaggaaaacuuucgcagcauauccgccaacgagaagaaaaucaaguaugaucacuacuuaauuccuaaugcucugcuagaacucgcccugcuuuugauggagcaggacagaaacgaggaagcaaucaagcugcucgagucugccaaacaaaauuauaagaacuacagcauggaaucaaggacacauuuccggauacaggcugccacccugcaggcaaaaaguuccuuagagaauagcucucgaucaaugguaaguagcgugucccuguga

SEQ ID NO: 64341 - RNA, 2010 nt, Artificial Sequence
  derived and/or modified sequence opt3 from TTC39B__Homo_sapiens__NP_001161812
auggacgccgugcuggcuugcagacucaggggccgggggaaccgcgucgcagcccuucgaccccguccuagaccaggagguagcgcgggcccgucccccuucgcucuguugugugccggguuaucuccugagccaagggcaggaguuggcucagaauuucccgccugguuccugggugggaguagccagcggcgcaauauggcucuacucggauccagagcagagcuggaagccgaugaggacguguuugaagaugcucuugagaccaucucuauuucgucacacagcgacauggccacaaguucccugcauuucgcgucuugcgauacucaacaggcaccuaggcagcggggcgccagcacgguauccucaaguagcucuaccaagguggacuugaaauccggccucgaggaaugugcugucgcccugaaccuguuucucucaaauaaguucacagaugcauuagagcugcuucgcccaugggcuaaagaaagcauguaccacgccuugggguauaguacuauagugguucugcaggcggugcuaaccuuugagcaacaggacauccagaacggaauuucugccaugaaggaugcacuccagacaugccaaaaauaccgaaagaaguauaccgucguggaguccuucagcucgcugcuuucuagagguucccuggaacaguugucagaggaagagaugcaugcugaaaucuguuacgccgagugccuccugcagaaagcugccuuaacuuuuguacaggacgagaauaugauuaacuucaucaagggcgggcugaaaauaaggacaaguuaucaaaucuacaaggaaugucucagcauucuucacgagauccagaaaaauaagcugcagcaagaauuuuucuaugaguuugaaggaggcguuaaguuggguuccggggcauucaaccuaaugcugucucuccugcccgcccggauuauccgucuucuggaguucauaggauuuagcggcaaucgcgaguugggccuccugcaguuaagagaaggggcuucaggaaggaguaugcgguccgcgcugugcugucuaaccauucucgcauuccauacguacaucagccugauucuugguacuggcgaggugaacgucgccgaagcugagcgauugcuggccccuuuucuccagcaguucccaaaugugcgcucuguguuucaaucagcacaggaagucuuccagaaaugcaucaguguucaggaggaguggaagcaauuucaccaccuguguuacugggaacuuauguggaucaacguguuccagcagaauuggaugcaggccuauuacuauagcgaucuguugugcaaagaguccaaguggucuaaagcuaccuacguauuucucaaggccgcaauucugucgauguuaccggaagaggacguggucgcgacaaacgagaaugugguuacucuguucagacaaguggauagccuaaaacagaggauagcugggaaguccauccccaccgaaaaguuugccguccggaaagcacgcagauauucagccagucucccugcuccagugaagcugauucuucccgccuuggagaugauguacguauggaacggauucucuaucguuagcaaaaggaaggaccuguccgaaaaccuccuggugacagucgagaaagcagaagcugccuuacagucacagaauuuuaacagcuucucuguggacgaugagugccuggucaaacuuuugaagggcuguugccucaagaaucugcaacguccucuacaggcggagcuguguuauaaccaugugguugaauccgagaagcuccugaaauacgaccacuaccuugugccauucaccuuguuugaacuggccaguuuauauaagagccagggugagauagauaaagcuauuaaguuccucgaaacggcacggaauaacuacaaggacuauucucuggagucccgacuucauuuuagaauccaagccgcucugcacuuguggaggaaacccucaagugauuga

SEQ ID NO: 64342 - RNA, 6078 nt, Artificial Sequence
  derived and/or modified sequence opt3 from TTC3__Homo_sapiens__NP_001001894
auggacaacuucgccgaaggcgauuuuaccguggcugacuacgcacugcucgaagauugcccccacgucgacgauuguguuuucgccgcggaguuuaugagcaaugacuaugugagaguaacacagcuuuacugcgauggggugggaguccaauauaaggacuacauccaguccgaaaggaaccuggaguucgauauuuguucuauuuggugcucaaaaccuaucagcguguugcaggacuauugugaugcuauuaagaucaauauauuuuggccauuacuguuccagcaucaaaacagcuccguuaucucucggcuacacccgugcguggacgccaauaacucgcgcgcaucagaaauuaaucucaaaaagcugcagcaucuugagcugauggaggauaucgucgacuuggccaaaaagguggcuaacgacagcuuucucauugguggccugcugcgaaucggguguaagauugaaaauaaaauccucgcaauggaggaagccuuaaacuggauaaaguacgcuggagauguaacuauucugacgaaacuuggcaguaucgacaauugcuggcccauguuguccauuuucuuuaccgaguauaaguaccacaucacaaaaaucguuauggaggauuguaaccugcuagaagaacuaaagacucagucuugcauggacuguauugaagagggugaacugaugaagaugaaagggaaugaggaguucagcaaggaacguuuugauauagccaucauuuacuauaccagagcgaucgaguacaggccugaaaacuaucuucuguacggaaaucgggcauugugcuuccuccgcacaggccaguuuagaaacgcccugggcgacgggaaaagggcuaccauauuaaagaacacuuggccaaaaggacauuaucgguacugcgaugcccuguccaugcucggugaguaugacugggcacuucaagcuaauauuaaggcccagaaacuguguaagaacgaucccgaaggcaucaaggacuugauccagcagcacgugaaacuacaaaagcagauugaggaucugcaggggcgcacagcgaauaaagacccuaucaaggccuucuacgagaaccgagcauacaccccaagaucacucagugcucccauuuucacgacuagccugaauuuugucgaaaaagagagggacuuccggaagauaaaccacgaaauggccaauggaggcaaccaaaaucuuaagguggcugaugaggcccugaaaguggacgauugcgacugucauccugaauuuucuccaccguccucacagcccccuaagcacaaagguaagcagaaaagccguaacaaugagagugagaaguucucuuccagcucgccauugacccuccccgcagaucugaagaacaucuuagaaaaacaguuuucuaaguccucacgcgccgcucaucaagacuucgcgaauauuaugaaaaugcugagaagucuaauccaggauggguauauggcacuccuggagcagaggugccggagcgccgcucaggccuuuacagaacuuuugaacggacuggacccucaaaagaucaaacagcucaaucuggcaaugauuaacuacguccuuguuguguauggccuggccauauccuugcucggcaucgggcagccagaggagcugucugaagcugagaaccaguucaagcgaauuaucgaacacuaccccagcgagggauuagauugucuggccuauugcgguauuggcaagguauaccucaagaagaaucgcuuucucgaagcacugaaccacuucgagaaagcgagaacucuuaucuauagguugccgggggugcugaccuggccuacaucaaaugucauaaucgaggaaagucaaccccagaagauuaaaaugcuccuggagaaguuuguggaagaguguaaauucccaccuguucccgacgcuaucugcuguuaccagaagugccauggauacuccaagauucagaucuauauaaccgauccagacuuuaaaggcuucauucggaucagcuguugccaauacugcaagauugaguuccacaugaacuguuggaaaaaguuaaaaacgacuacauuuaaugauaagaucgacaaggacuuccugcaggguauaugccuuacccccgauugugagggggugaucucuaaaauuaucauauuuucaaguggcggagaggucaagugcgaguucgagcauaaagugaucaaggaaaaaguaccuccacgcccgauauugaagcagaaguguagcucccucgagaaacugagacuaaaggaagacaaaaagcugaaaaggaagauucaaaagaaagaggccaagaaacucgcacaggagcguauggaagaggaucugcgggaaucuaaucccccuaagaaugaggagcagaaagaaacuguugacaacgugcagcgaugccaauuucuugaugacagaaucuugcaguguaucaagcaguaugccgauaaaauuaagucgggcauccagaauacagcuaugcuguuaaaggagcuccugagcuggaaaguccuuuccaccgaagacuacacgaccugcuucucaaguaggaacuuucugaaugaggccguggauuaugucauucgccacuugauacaagaaaacaaucgggugaagacaagaaucuuccuccauguucugucugagcuaaaagagguggaaccaaagcuggcagcuuggauucagaaacucaacagcuuugggcuggacgccacuggaaccuucuuuuccagguacggugcgucacuuaaguugcuggauuucagcaucaugacauuuuuauggaaugagaaguauggccacaaacucgacucuauugaagggaagcagcuggauuacuucuccgagcccgccagucuuaaagaagcucgcugucugaucuggcuacucgaggagcaccgagacaaguucccugcacugcauagcgccuuggacgaauuuuucgauauaauggacucucggugcacuguacugcguaaacaggauuccggagaggcuccauuuucaaguaccaaggucaagaacaaaagcaagaaaaagaaacccaaggacucgaagccgauguuagugggcuccgguacaaccucuguuacuagcaacaaugaaaucauuacgucaagugaggaucacuccaacagaaauucugacagcgccgggccuuucgcagugccagaucaucucaggcaagacgucgaagaguuugaggcgcuguacgaucagcacuccaacgaauaugugguacgcaauaagaaacuuugggacaugaaccccaaacagaaauguucaacacuguacgauuauuucagccaauuuuuggaggaacacggcccucucgacaugaguaauaaaauguucucugccgaguacgaguuuuuccccgaagagacccggcagauccuggaaaaggcuggaggccuaaagccauuucugcuugggugcccuagauucgugguuauugacaacugcaucgcccucaaaaaggucgcauccaggcugaaaaagaaacgaaagaaaaagaauauaaagacuaaaguggaggaaauuagcaaggcuggagaguaugugcgcgucaaauugcagcugaaccccgccgcacgggaguucaagccagauguuaaaucgaagccggugucagacucuaguuccgccccugcuuuugaaaaugugaagcccaaaccaguaagcgcgaacucucccaagccugccugugaggaugucaaagcaaagccagugagcgacaauuccucaagacagguuagugaagauggucaacccaaaggcgugagcucuaacuccccuaagccggggucagaggacgcuaauuacaagagggucaguugcaacagcccaaaacccguguuagaagauguuaagccuaccuauugggcccagucccaucucgugacaggauacuguaccuaccugccauuccagcguuuugacaucacucagacacccccugccuauaucaacguacuuccgggccugccccaauacacgucuauuuauaccccauuggcuucgcucagcccugaguaccagcugccccgcucagucccaguggugccuuccuucgucgcaaaugaucgggccgacaaaaacgcggcugccuauuuugagggucaccaucuaaaugcagaaaacguugccgggcaccagauagcuagugagacucagauccuggaaggcucucuuggaauuagcgugaagucccauugcucaacaggcgaugcacacaccguacucucugagagcaauagaaacgacgaacacugugggaauaguaacaauaaaugcgaggugauccccgaguccacaagcgccgucacuaacauuccacaugugcaaaugguugcgauccaggugucuuggaauauaauccaccaggaagucaacaccgagccguacaauccuuucgaagagaggcagggagagauuucacgaaucgaaaaggagcaucaagugcugcaggaucaguugcaagaaguuuaugagaacuacgaacagauuaaguuaaaaggccuggaggagacgcgggaccucgaagagaagcugaaacgccaccuugaagagaauaagaucuccaaaaccgaacuggacugguuuuugcaggaucuagagagagagauaaagaaauggcagcaagaaaagaaggagauucaggaaaggcugaaaagucucaagaaaaagaucaaaaaggugagcaacgcuucggagauguacacacagaagaaugacgguaaagaaaaggagcaugagcugcaccuugaucagucuuuagaaaucuccaacacucugaccaacgagaaaaugaagauugaagaguauaucaaaaaggggaaggaggacuacgaagagagccaccaacgggccgucgcagccgaaguaucagugcucgagaauuggaaagaaagugagguuuauaaguugcagauaauggagucucaggcugaagccuuccugaaaaagcucggacugauuucccgagaucccgcagcuuacccagacauggagagcgauaucagaucaugggaacuuuuucugaguaacgugacaaaagagauugaaaaggccaagagccaguucgaggagcaaaucaaagcgauaaagaauggcucccgcuugucugaacuaagcaaaguccagauuuccgagcugucauuucccgccuguaacacugugcauccugaacucuuaccagagucuaguggugacgauggccaggggcugguaaccucggcaagcgacgugacgggaaaucacgcugcccuucauagggaucccuccgucuucucugcuggcgacucaccuggggaagcaccgagcgcccugcucccaggacccccucccggccaaccagaggccacacaguugaccgguccuaagcgugcugggcaggcggcacuguccgagcggagucccguugccgauagaaaacagccagugccuccgggaagggcugcccgcucuagccaaucacccaagaaaccauuuaacuccaucaucgaacaccucaguguggucuucccuugcuauaauagcacugagcuggcaggcuucauuaagaaggugcgaucuaaaaacaagaacucccuuucaggucuaagcaucgacgaaauuguucagagaguaacagagcacauacuggacgagcagaaaaagaaaaagcccaacccaggcaaggauaaacggaccuacgaaccuucgucugccacucccgugaccaggaguucccaggggagcccgucagucgugguugcuccauccccuaagacaaaaggacaaaaggcggaggacgugcccguccgcaucgccuugggcgcaucuagcugugaaauuugccaugagguguuuaaaaguaagaauguacgugucuuaaagugugggcacaaauaucauaagggaugcuucaaacaguggcugaagggccaguccgcuugcccagccugucaggguagagaucuccugacggaagagagccccucugggcggggauggccuucacaaaaccaggagcuuccgaguugcuccaguagguga

SEQ ID NO: 64343 - RNA, 1323 nt, Artificial Sequence
  derived and/or modified sequence opt3 from TTC5__Homo_sapiens__NP_612385
augauggccgacgaggaagaggaagugaagcccauccugcagaaacuccaagagcuugucgaucagcuguacagcuucagagacugcuauuuugaaacccacuccguugaggaugcuggcaggaagcagcaggacgugcaaaaagagauggaaaagacauugcagcagauggaggaaguaguggggucuguccagggaaaagcacaaguguuaaugcugacugguaaggcccuaaacguuacgccugauuacucaccaaaggcggaggagcuccugaguaaagcugugaaacuugaaccggagcuggucgaagccuggaaucaguugggcgagguguauuggaaaaagggggacguagcagccgcucauaccuguuucagcggagcacucacacacugccggaacaaaguuucccugcagaaucugucuauggugcuccgccaguuacgaacugauaccgaagacgagcauucgcaccaugucauggauucagugcgucaagccaagcuggcugugcagauggacguccacgauggcagaagcugguacauucuugguaacaguuauuugucccuguacuuuucuacagggcagaaucccaagauaagccaacaggcccuauccgcguaugcacaggccgagaaaguugacaggaaggcuucaaguaacccugaucuccaccugaaucgggccacccuucauaaauacgaagagagcuacggagaagcacuggagggcuucucucgcgcugccgcguuggacccagccuggcccgaaccuagacagagggagcaacagcuccuggaguuuuuagaccggcugacuucccuccuugaaucaaagggcaaagugaagacaaagaagcugcagagcauguuggggagucuacgcccagcacaccugggacccuguucugauggucauuaucaguccgcuagcggccaaaagguaacccucgagcugaaaccucuuucgacgcugcagccaggggugaacucuggagccgucaucuugggcaaggugguuuucucccucacuaccgaagagaaagugccguuuacauucggucuggucgacucagaugggcccugcuacgcugugaugguauauaauauuguucagaguuggggaguguuaaucggcgacagcgucgccauuccugaaccaaaccugcgacuacacagaauccagcacaagggcaaagauuacuccuuuucuagcgugagggucgagacuccccuccugcuugugguuaaugggaagccucaaggaucaaguucccaggcaguggccaccguagcuagccggccacagugugaguga

SEQ ID NO: 64344 - RNA, 3972 nt, Artificial Sequence
  derived and/or modified sequence opt3 from TTC6__Homo_sapiens__XP_011535733
auguacgccuaucccgaguucaccaagcuguuuuggaacacagcugcaccuaaauucagcgugccagaauccgucaugaaggagacucucuacccgaaauaugaaucuguucaggccucaagacuucugacggacaaguugaguuacaaaagcuccgugaucaccuuacaccaacauucuaggacaaauuuuuggugcuuccugccccggaagucggcgucauuugagagcauucagaagugguucagugcucagccuacucagcuacgccgaguaaaauccucuguggaucuccguaaggaaaagauaaucgccccacuggagauuaagaacgacaugcaaagcuccaucaaagaggucauguuucagaaggcaaaggaacuuaaaagacagcugcaguugaccaagcaaaauaaaacagaggaacccaacuaugugaaggagucaauugaugacaucuucgauaauaugugugagaaacacagucucaggaaccugagccugacccucauagaagccucuaagaaagcuggcaucuccuacauuguuuauccuaagaagaaaaagaugcgguggaaaaagcgcuuaaaacagcagaagcugaucuuugugcaugaggaacuuucaaagccacccaagagcuuggagagaagugcaucucacgggauucugccuggacagaagaaauaccuauucaaggucccacucuacgaaaggcaaauccggugcccgucccugccccuuuaucugaauuuugagaaauucgugcaggccaaggguggcauaccugagaacauugacccacgcacuugggcuuuggaucgacucaucgaauacaaggacgccagcauucccguaaaagagaaggaugacaaaaucucgguuccugaagauccacccgagagagugaaggaaccgccuaaacugaaguuaaaugacuaugucgagucugaucugccccaggaggugaucaaguacuaugaauccgaggugaaaauucucacagaagagauaaacgacaagaccaaauacccagcguuugcauauuguaggcggggagccaucuaccguaaacuugggaaacugcaaucagcuaugaaugacuugcagcgcgucauucuacuggaaccucucuuccugaacgccuacuggcauagacaccuuaucuaucuguuccaggauaagauaaaugaggcauuggacgaucucaacuacauucacaaauauaauaagaacaacacggaggcuuaccugaguaaggccgaaaucuauaggggcaaaaaggacaucacuuuagcgauucugaauuacacccaggccaucaaaagcacacccacugaugcagacauuuauuuucggcgaggugagauguacgaaauaaccaacaagguucuagcuaucgaugacuucuccaaaugcaucuuuuacgauccaaagcgcacagacgcccuccugaagagagggcuuuucuauugugagaaugagaacugguuugcugccauugaagauuucaccgcauugcugaauaucgaccaucaaaacucucaggccaggacguaccggggaauugcuuaugugaaauggaaguuuuacaaagaggcgacucaggacuucagcgcagccauacaccucgaucccaauaacuggcuggcucuuuauuaccgcggcugccuguuuagaaagucaaauccuuucagggccuugcaggacuauaguguauccgcacucaucaacgauggcuacgaaaaucuggggugcuuuuuacaucguggaauuguguacgcccaccugaaacuauggcuccuggcuaucugugacuucgagacagucauuagccuugaacggaccaucacuuuggccuaugugaacauaggucugauccaccuccugcauuuagauaauuacacagaggcaauuuggcaauuuucugaggcgauccgaauugacccacuguguauccagucauaucuuugcagagcugaaaccuacuucaaguugcacaagcucaaaaaggccguuaacgagcugaguagggcaauacaucuacagccggauggcauucagcuguauauccgccgggggcaauaccuccugaugaugaaauauuacgaccuugccaaguucacgauuuaccagaucgcugaaauggauaaaggauugagcgagcugucccccaugcagcaggccuuaauauauucuuuuugugaaaaucacgacaaggcaaucgaggugcucgauggcauuucguggaacagagcugagaugaccaugugcgcccugcuugcgaagguccaaaugaaagccaagaggacaaaagaagcuguggagguacugaagaaagcauuggacgccaucagccauuccgauaaggguccugacgcuacugccauuucagcagacugccucuacaaccuggggcuauguuauauggaagagggaaaucugcagauggcguucgauaguuuuaccaaagccguuaaggcuaacccagacuucgccgaaucuuuuuaccagcgcggccucugcaaggugaaacugcacaaggauagcuccauccuugacuucaaucgagcaauaacauugaaccccaaacacuaucaagagaugcauacuggcgggcugggagcuuacuuaucacgggucgccuuuuauggucucaagggccguuacagcaaagcaauucugaauuguaacaaggccaucaagaucuacccugagucugugagagcuuaucuuuaccgcgggguccugaaauauuacaauaagaccuauaaacuagcgauuacagaucucaccacugccaucuccauggacaagaacaguuacacggcauucuauaauagggcucugugcuacacaaaaauucgggaauugcagauggcccugaccgauuacggaauaguguuacuccuggacgccacugagaccguuaaacuuaacacauuucugaauagaggcuugaucuauguggaacucggucaguacggguucgcucuggaggauuuuaagcaggcagcccuaauuagcaggaccaacggcucucugugucacgcgacugcuaugugccaucaccgaaucaaugaguucgaagaggccguaaacuuuuucacaugggcacuuaaaauuaauccauguuuccucgacgccuaugucggacgcggcaacuccuacauggaauaugggcacgaugaggcuacgaagcaagcacagaaagacuuucugaaggccuugcauaucaaccccgcguacauaaaagcucggaucucauucggauauaaucugcaggcccaggguaaguuucaaaaggcauggaaccacuucaccauugccaucgauacugacccgaaaaauuacuuagcuuacgaaggcagagccgugguuugccuccagauggggaacaauuuugcagcuaugcaggacauuaacgccgcgaugaagaucaguacaaccgccgaguuccugacaaauaggggagugauacaugaguuuaugggccacaaacagaacgcaaugaaggauuaucaagacgcuauuacucuuaauccuaaauacagccuggccuauuucaacgcugguaauaucuacuuucaucaccgucaguucucgcaggcauccgauuauuuuucuaaggccuugaaguucgacccagaaaacgaguacguccucaugaaucgcgccaucaccaacacgauucugaaaaaguaugaagaggcuaaagaagauuucgcgaaugugauagagagcugucccuuuugggcagccguauacuucaaccgggcucacuuuuacuauugccuaaagcaauacgagcuggccgaagaggaccuuaacaaagcacucucacugaagccuaaugaugccuugguguauaacuucagagcuaaaguuagggggaagaucggcuuaauugaagaggcgauggccgacuacaaucaggcacuggaucucgaagacuaugcuagugucaucuga

SEQ ID NO: 64345 - RNA, 2475 nt, Artificial Sequence
  derived and/or modified sequence opt3 from TTC7A__Homo_sapiens__NP_001275882
auggugcccagcuccucuagaaccccuggcuucaagcagucaagucaccaucugaggcucccaaaaugcugggacuaccgggaugacuuugggaaacuucuguuggccgaggcuuuacuggaacaaugucuaaaagagaaccacgcaaagaucaaagauagcaugccgcuccuggaaaagaaugagcccaagauguccgaagccaaaaacuaucuuucuucgauucugaaucauggacgcuugucaccucaguacaugugcgaggcgaugcucauacuggguaagcugcacuaugucgagggcagcuaccgagacgcuaucaguauguaugcccgugcagggauugaugacauguccauggaaaacaaaccacucuaccagaugagauuacugucugaggccuucguuaucaagggacuuagcuuggaaaggcugcccaauuccauugcuucacgguuucgccuaacagagagagaggaagaggugaucacuuguuucgaaagggcaaguuggauagcccagguauuucuccaagagcuggaaaagacgaccaacaauagcacaucucggcaucuuaagggcugccacccucuggauuaugaguugacuuacuuccucgaggcugcccugcaguccgcguacgugaagaacuuaaagaaggguaauaucgucaaagggaugcgcgaacugcgagaggugcucagaaccguugaaacaaaggcaacccagaacuuuaaagugauggccgcuaagcaccuugccggaguccuguugcauucacuaagcgaggaauguuauuggaguccacugucucacccccucccugaguucaugggcaaagaggaauccagcuuugcaacucaggcucugaggaagccacaucuuuacgagggcgacaaucuguauugcccgaaggauaacauugaagaggccuugcuccuguuacugaucucggaaucuauggcgacacgggacgugguacuaucccguguucccgagcaagaggaagaucgcaccgugucacuccagaaugccgcagcuauuuacgaccugcuuaguaucacguuggggagaaggggacaguaugucaugcugagcgagugucucgaacgggccaugaaauucgcuuuuggugaguuccaccugugguaccagguggcccuuuccaugguggcaugcggcaagucugccuaugcugucagccuguugcgagaguguguuaaacuccgcccuucagauccaacugugccccugauggcggcaaagguaugcauagggaguuuaagauggcuggaagaggccgaacacuuugcuaugauggugauuucccuaggagaggaagccggcgaguuccucccuaaagguuaccuggcacuuggguugaccuacagccugcaagccacagacgcuacucucaagucuaagcaggacgagcugcauaggaaagccuuacagacccuggaacgggcacaacagcuugcgccaucagauccccaggucaucuuguaugugagucuccagcuggcucuaguucgccaaauuagcuccgccauggagcagcugcaggaagcacucaaggugagaaaagacgaugcccacgcucugcaucuuuuggcccuguuauucucugcacagaagcaccaucaacacgcucucgacgucgugaacauggccaucacagagcacccggaaaauuuuaaccugauguucaccaaaguaaaacuugagcagguucugaagggaccugaggaagcguuggugacguguaggcagguccuccgucuguggcagacucuauacucguuuagccaacugggcggccucgagaaagauggguccuucggagaaggucugacaaugaagaaacagucaggcaugcaucuuaccuugcccgacgcccacgaugcugacagugggucucggcgagcaagcuccaucgccgcuucaagacuggaggaagccaugagcgaguuaacuaugccaucuuccgugcucaagcagggaccuaugcagcuguggacaacccuugagcaaauuuggcugcaggcagcggaacuauuuauggagcagcaacaucucaaagaagccggcuucugcauacaggaggcugccggucuguuucccacgagucacagcgucuuguauaugagggggcgccuggcagaggugaagggcaacuuagaagaggcuaagcagcucuacaaagaagcccugaccguuaauccagauggagugcggaucaugcacucucuuggccugauguuguccagacucgggcauaagucacuggcacagaaaguacuaagggacgccgucgagcgccaaaguacaugccacgaggcuuggcagggacugggugaagugcuucaggcgcagggccaaaacgaggccgcaguugauuguuuccucacugcucuggaauuggaggccagcucgcccgugcugccuuuuuccauuaucccacgagaauuauga

SEQ ID NO: 64346 - RNA, 2532 nt, Artificial Sequence
  derived and/or modified sequence opt3 from TTC7B__Homo_sapiens__NP_001010854
auggccaccaagaaagcuggcagcagacuggagacagaaaucgagaggugccgguccgaaugucagugggagcgcauucccgaacucgugaagcaacuuucugcaaaacugauagccaacgacgauauggcggaguuguuacugggggagucaaagcuagaacaguaccucaaagagcacccucugcgacagggagcuaguccacgugguccgaagccccagcuuacugaagucagaaagcaucugacggccgcauuggacaggggcaaucucaaaagcgaguuccugcaagaguccaaccugaucauggccaagcucaauuauguugaaggggauuacaaagaggcuuuaaacauuuaugcacgggugggacuggacgaucuuccuuugaccgccguaccacccuaccgccugagagugaucgcugaagccuaugcgacaaagggccuaugccucgagaaacugccuauuucuucgucaacuagcaaucuucacgucgacagggaacaggaugugaucaccuguuacgagaaggccggugacauagcacuguuguaucuccaggagaucgaacggguuauucugaguaacauccagaaucgcuccccaaagcccgggccugcuccacaugaucaagaguuaggauuuuuccuggaaacaggccuccagcgagcccacgugcuuuacuuuaaaaacggcaaucugaccagaggggucggaagguuccgggaguugcuacgugcaguggaaacucgcacaacccagaaccugagaaugacgauugcuaggcagcucgccgagauccugcuucgggguaugugcgagcaaucuuacuggaauccgcuggaagaucccccuugucagagcccauuggacgacccccuccgaaagggcgcgaacacuaaaaccuauacacugacucgcagagccaggguauacuccggggagaauauauuuugcccucaggaaaacaccgaggaagcauuacugcuacuccugauuucagagaguauggcuaaucgggaugccguucuuagccgcaucccagagcauaagucugacagauugauuucccugcaaucagcuagcguggucuaugaccuccugacaaucgcccuuggaaggcguggccaguacgaaaugcugagugaguguuuggaacgggcaaugaaauucgccuuugaggaguuccaccucugguaucaguuugcucugucuuuaauggcggcagguaaguccgcccgagcugugaaagugcugaaggaaugcaucagacuaaagcccgaugacgccaccauuccgcuccuggcagccaaacuuuguauggggagcuugcacuggcuggaggaagcugagaaguucgccaaaacggucguugaugugggagaaaagacuucggaguuuaaagcaaagggcuaccucgcgcugggcuuaacauauucucugcaggcuaccgacgccucccuuagggggaugcaagagguauugcagcgcaaggcacuccuggccuuccagcgggcucauucacuaaguccuacugaucaccaggccgcauuuuaccuggcucuccaacuggccauaagcagacagauccccgaagcgcuuggauacgugaggcaggccuugcagcugcaaggugacgaugcuaacuccuuacaucuccuggcacuucuguugucugcccagaaacacuaucacgacgcucucaacauuaucgauauggcccugagcgaguacccagaaaauuucauacuacuguucucaaaggucaaacuccagagucugugccgcggcccugacgaggcacuuuugacauguaagcauaugcugcagauuuggaaauccugcuauaacuuaaccaaucccagcgauucugggcgaggaucaagucuccuggaccggacgaucgcggaccguagacaacuuaacaccaucacacugccagauuuuagcgaccccgaaacuggcuccgugcacgccaccucuguugcugccucgaggguggagcaggcacuaagcgaggucgcuuccucacuccagaguucugccccuaagcaagguccacugcauccguggaugacauuggcacagauuuggcugcacgccgcugaaguguacaucgggauuggcaagcccgcggaggccacugcaugcacccaggaagcugccaauuuauucccuaugagccauaacguacucuauaugcgcggacagauagccgagcugcggggcuccauggaugaagcuagaaggugguacgaggaggcacuugccaucucaccaacacacguuaaaagcaugcaacgacuggcguugauucuccaccagcuggggcgcuauucucuagcugaaaagauccugcgggacgccgugcaggucaauuccaccgcacaugagguguggaacggacuuggugaaguccuccaggcccaaggcaaugaugcugcagccacugaguguuuucugacggcguuggagcuggaagcuaguagccccgccgugccuuucacaaucauuccaagaguuuuauga

SEQ ID NO: 64347 - RNA, 1596 nt, Artificial Sequence
  derived and/or modified sequence opt3 from TTC8__Homo_sapiens__NP_001275710
augagcuccgagauggaaccccugcuccuugccuggucuuacuucagaaggcggaaguuucagcugugcgcugacuuguguacccaaauguuagagaaaucaccuuaugaucaggcagccuggauccugaaggcgcgcgcucuaacagaaaugguguacauugacgagauagaugucgaccaggaaggcaucgccgagaugaugcucgaugagaacgcaauugcccagguuccacgaccggggacgagucugaaacuucccggaacuaaucaaaccgguggcccuagccaggcugugcguccaaucacacaggcagggagacccauuacuggauuccugaggccuuccacccagucuggccggccagguacaauggaacaagccauccgcacccccagaacugcuuauacagccaggccuauaaccucgucaagcgggcgguuuguacgcuugggaacggcgaguaugcucacuuccccagacggcccguucaucaaccugucucgacugaaucucaccaaguacagccagaaacccaaguuagcaaaggcccuguuugaguauauuuuccaccaugaaaacgaugugaaaacaauccaccuugaggacgucguguugcaucugggcauuuacccuuuucuacucagaaauaagaaccacaucgagaaaaaugcucuggaucuugccgcacuguccacugaacauucacaguauaaggacuggugguggaaaguucagauagggaagugcuacuacagguugggaauguaucgggaggcugaaaagcaauucaaaagugcccucaagcagcaggagaugguggauaccuuucuguacuuagcgaaagucuaugugagccuggaccaaccaguaacagcccucaaccuuuucaagcagggucuggauaaauuucccggcgaaguuaccuugcuaugugggauugcacguaucuacgaggagaugaauaacaugucuuccgcugccgaauauuacaaggaggugcugaaacaggacaauacgcacgucgaagcuauugccugcaucggaucaaaccacuucuauagcgaccagccugagaucgcacuccgcuuuuacagaaggcugcuucaaaugggcauuuacaauggucagcuguucaacaauuuggggcucuguugcuucuaugcccagcaguacgauaugacucugacaaguuuugaacgggcuuuaucucuggcggagaacgaggaagaggcagccgacgugugguauaaccuaggacauguggcugucggcauaggcgauaccaaucucgcccaccaauguuuccgacuggcacuuguuaacaauaacaaucaugccgaggcuuacaacaauuuggccgugcuggaaaugcgcaaggggcacguagaacaggcaagagcgcuccugcagacugcuuccagccuugccccacacauguaugagccccauuuuaacuucgcaacaaucucggacaagauuggagaucugcagaggucuuacguggccgcucaaaaauccgaggccgcauuuccggaccacgucgauacccagcauuugaucaagcagcuccggcagcacuucgcuaugcuguga

SEQ ID NO: 64348 - RNA, 720 nt, Artificial Sequence
  derived and/or modified sequence opt3 from TTC9B__Homo_sapiens__NP_689692
augcagagaggcgcccugagccccgugcucaugcuuuccgcugcaccugagccaccgcccaggccuccacccgcccugucuccuccagggucaggacccgguaguggcagccggcacggguccgcgcgcccuggaccaaccccggaacccucuggcucguugggugcugccuuagacucaagccugcgagcagccgucgcuuucaaggcagaggggcaacguugcuacagagagaaaaaguuuagggaggccaucggaaaauaucaucgggcucuacuccagcugaaggccgcgcagggcgcacgcccuaguggccuuccagcccccgcuccugggccaacauccucucccggaccggccagacugagcgaagaacagaggcgguugguugaguccacugaaguggaguguuacgauucacucacggcaugccugcugcaaagugaacucguaaacuaugagcgcgugcgagaguacuguuuaaaaguccuggaaaagcagcaggguaauuucaaggcuaccuauagagccggcauugcguuuuaccaccuuggggacuaugccagggcauugcgguaccugcaggaggcucguagccgcgaaccuacagauacuaacgugcuaagauacauacaacucacccagcugaaaaugaauaggugcucucuucagcgggaggacuccggagccggcucacagacacgagauguuaucgguuga

SEQ ID NO: 64349 - RNA, 516 nt, Artificial Sequence
  derived and/or modified sequence opt3 from TTC9C__Homo_sapiens__NP_776171
auggagaagagacugcaggaagcccaacucuacaaagaggaaggcaaccagagguaucgggaggggaaguaccgcgacgcugugagccgauaucaccgugcacuucugcaguugagaggauuagaucccucccugccuucuccacuaccgaaucucgguccccagggcccugcccugaccccagaacaagagaacauccuucauacaacucagacggacugcuacaauaaccuggcggcuuguuugcuccagauggagcccgucaauuaugaaaggguucgggaguacucacagaaagugcuggaacgccaaccugauaacgccaaggcacuguauagagccgggguagcuuucuuucaccuccaggacuacgaucaggcaaggcauuacuuacuggccgcugugaaucggcagccaaaagacgccaacguccgccgauaucuucaauugacccagagugagcugagcuccuaccacagaaaggagaagcagcuauaucucggaauguucggcuga

SEQ ID NO: 64350 - RNA, 669 nt, Artificial Sequence
  derived and/or modified sequence opt3 from TTC9__Homo_sapiens__NP_056166
auggagagaaagggcagcgccgcuggggcaaaaggaaaccccuccccuccagccgcgggugaaggccagaggccgcccccuccacugugcgugcccgggggaggcgguggggcuccugcccggggacaagucggcgcagccgcugagccagcagaacucauccgccgagcccacgaguucaagucucagggcgcucaguguuacaaagacaagaaauuucgugaagccauugggaaguaucauagagcgcuucuggaguugaagggauuacugcccccuccaggugagagggaacgggauucacgcccggcaagucccgccggcgcucuaaaaccugggagacucagcgaggaacaguccaagaccguugaggccauagagaucgacugcuacaauucucuggcagcuugucuucugcaagccgaauuggugaacuaugagaggguaaaagaauacugccucaaggugcugaaaaaggagggagaaaauuucaaggcgcuguaucggucgggcgucgccuuuuaccaccucggugauuaugacaaagcauuauacuaccugaaggaggcucgcacacagcagccaacugauacgaacgugauucgauauauccagcuuaccgagaugaaauugucaagauguagccaaagggaaaaggaggccauguga

SEQ ID NO: 64351 - RNA, 2718 nt, Artificial Sequence
  derived and/or modified sequence opt3 from TTF1__Homo_sapiens__XP_006717336
auggagggcgaaagcuccagauucgagauccacacccccgugucugacaagaaaaagaaaaagugcucaauucauaaagaaaggccucagaagcacagucaugagauauuucgggauagcucccuggucaacgaacaaucucagaucacacgccgaaagaaacguaagaaagacuuccagcaccucauuucgucaccacuuaagaaaagcagaaucugugaugagacugccaaugcuacgaguacccugaagaagaggaaaaagcggcgcuacuccgcauuggagguugacgaagaggccggggugacaguaguguuagucgauaaagaaaacauuaauaacacuccgaagcauuuuagaaaagacguggauguugugugcgucgacaugucuaucgagcagaagcugcccaggaaaccuaagaccgauaaguuccaagugcuagcgaaaagccacgcucacaaguccgaggcccuccauucaaaaguacgggaaaagaaaaauaagaagcaccagcgcaaagcagccaguugggagagccagcgagcuagagacacacugccacagucugaaucccaucaagaggaaucauggcuuagcguuggacccgguggcgagauaaccgagcugccugcaagugcccacaagaacaaaucuaagaaaaagaagaaaaaguccagcaauagggaauaugagacuuuggcuaugccagaagggucgcaggccggacgggaggcgggcacagauaugcaggaaucucagcccaccgugggucucgacgaugagacgccucaacugcuggggccaacucacaaaaagaaauccaagaagaaaaagaaaaagaaaucaaaccaucaggaguuugaagcacucgccaugccggagggaagucaggucggcagcgaagugggcgcugacaugcaagagucccgucccgccgugggguuacacggagaaaccgcagguaucccugcuccagccuacaagaauaaaucuaagaagaaaaagaaaaagagcaaccaucaggaguucgaggcggucgccaugcccgaaucacuggagagugcauauccugaaggcucccagguugggagcgaggugggaacaguagagggcucuacugcucuuaaagguuuuaaggaaucaaauaguaccaagaaaaagagcaaaaagcgcaaauugacauccgugaagagagccagggucucuggggacgauuucucggugccaagcaagaacuccgagucaacccuguuugacaguguugaaggagauggcgcuaugauggaggaaggcgugaaaucucggccccgacagaagaaaacgcaagccugucuagcaagcaagcacguccaggaggccccgcgccucgagccugcuaaugaagaacauaacguggaaacugcggaggacuccgaaauuagauaccugucagcagauagcggggacgccgaugacucugaugcugaccuuggauccgccguaaaacagcugcaggaguucauccccaauauuaaggauagggcaacaaguaccaucaagcggauguaucgcgacgacuuggagagauuuaaagaguucaaggcccaagguguugcuauaaaauuuggcaaguucagcgugaaagagaacaagcagcucgagaaaaacgucgaagauuuccuggccuuaacugggauugaaucugcagacaagcugcucuacacagauagguauccagaggagaaguccgugaucaccaaucuuaaacgucgguacucauuucgacugcacauuggaagaaacaucgcgaggccuuggaaguugaucuacuaucgcgcuaaaaagauguucgacgucaauaacuacaaaggccgguauagugaaggugauacggagaagcuaaagauguaccacagccugcucgggaaugacuggaaaaccauuggcgaaaugguggccagaucgucccugucuguugcacuuaaguuuagccagauaucaagucagaggaaccgcggagccugguccaaaucugagacacgaaagcugaucaaagcuguggaggaaguaauuuugaagaagaugagcccccaagagcucaaagaagucgauuccaagcugcaggagaauccagaaucaugcuuaagcaucgugcgggagaaacuguauaagggcauaaguuggguugagguggaagccaaaguccagacucguaacuggaugcaguguaagucuaaguggaccgagauucuaacaaaaagaaugacuaaugggaggcgcaucuacuauggaaugaacgcacuccgggcuaaggugucccugaucgaaagacuuuacgagauuaauguagaagacaccaacgagaucgauugggaggacuuggccagcgcgauuggugaugugcccccuucguacguucaaacaaaauucucaaggcugaaggccgucuaugugccauuuuggcagaaaaagaccuucccggaaauaaucgacuaccucuaugagacuacgcugccccuucugaaggaaaaauuggagaagaugauggagaaaaagggcacaaaaauucagaccccugcugcaccaaagcaaguguuucccuuccgagauaucuuuuacuaugaagacgacucugagggggaagauaucgagaaagaaagugagggacaggccccuugcauggcucaugccuguaauuccagcacucucggcggucaggggcgcuggauuauauga

SEQ ID NO: 64352 - RNA, 3453 nt, Artificial Sequence
  derived and/or modified sequence opt3 from TTF2__Homo_sapiens__XP_011540606
auggccagaaucaaggagagggcuagcacaugcgcaggccagacccgggccgcguccugugggcccccuucuucaauuccagugagucacugccugcuccaugaagacuucgucguugagcuucaaggacuguuguuaccgcaggauaaaaaggaauaccgccuguuuuuccgauguauacguagcaaagcugaggguaagagauggugcggcuccauccccuggcaggacccugauucuaaagaacacucggugucaaacaagagccagcaugccagugagacuuuucaccauuccucuaauuggcuaaggaacccauucaagguacucgacaaaaaucaagagcccgcacuguggaagcagcuuauuaaaggggaaggagaggaaaagaaagccgauaagaagcagcgggagaaaggcgaccagcuguuugaucaaaagaaagagcagaagccugaaaugauggagaaagacuugagcuccggucucgugccaaagaaaaagcagucagucgugcaggaaaagaaacaagaggaaggggcugagauccagugugaggcagaaacgggaggcacccacaagcgcgauuucagugagauuaaaagccagcaaugccagggcaacgaacugacaagacccucugccuccucacaggaaaagagcagugggaaaucucaggacguucaaagggaauccgagccucugcgggagaaggugacucagcucuuaccacagaauguccacagccauaacucgaucucuaagccgcagaaaggagguccccugaauaaggaauauaccaacugggaggcuaaagaaacaaaggccaaagauggcccuuccauacaagcgacccagaagucacuuccacaggggcacuuucaggagcgccccgaaacucauagugugccugcaccaggaggccccgccgcucaagccgcaccggcugccccugguuugagccugggggagggacgagaggcggccacauccucugacgaugaagaggaagacgacguaguuuucgugagcucaaagcccggcaguccacuacucuuugauuccacccuggaccuugagacgaaagagaaucugcaguucccugauagaagcguccagaggaaggugucucccgcaucaggcgugaguaaaaaggucgaaccaagcgaccccguugcucggcguguguacuugacuacccagcucaaacaaaagaaguccacacuggccucuguaaacauccaggcuuuaccugauaaagggcagaagcugauuaaacaaauccaggagcucgaagaggugcuuucgggacugacuuugagcccagaacaggguaccaaugagaaguccaacucacaggucccgcaacagagucacuuuacaaaaaccacgacugggcccccucaccuagugccaccccagccucugccacgcagaggcacacagcccguuggaucucucgagcugaaaagcgccugucaagugaccgcaggcgguuccucacagugcuauagggggaauacuuaccuuuaugccggccauacaaaccaggaccacguccaugcuguguggaaaauuaccagcgaagcgaucggacagcugcaccggucuuuggaguccuguccgggcgaaacgguaguugcagaggauccugccgggcucaaggugccacuguuacugcaucaaaagcaggcucuagccuggcuccuguggcgagaaagucagaaaccccaaggagguauacuugcagacgauaugggcuuggggaagacccugacaaugauugcccucauccugacucagaaaaaucaggagaagaaagaggaaaaggaaaagagcaccgcucuuacauggcugucuaaagacgauuccugcgacuucacuucacacggaaccuugauuaucuguccugccagucucauccaccauuggaagaacgaagucgagaaacgcgugaacagcaauaagcugagagucuacuuauaucacggccccaacagggacucgcgggcacgcgugcuguccacauacgauauuguuauaaccacuuacucucuaguggcgaaagaaaucccaacgaauaagcaggaggcugagauuccuggugccaaccucaauguagaagggacaagcacuccccugcuuagaaucgcaugggccaggauaauuuuggacgaggcucauaacgucaagaauccacgugugcaaaccucaaucgccguuugcaaacugcaggcaugcgcucggugggccgugaccggcacaccgauccagaacaaucuccuggauauguauaguuuacugaaguuucuucgauguuccccuuucgacgaguucaacuuguggagaucucaggucgauaauggaagcaaaaagggcggggagaggcucuccauucugaccaaaucacuacugcuccgccggacuaaggaccaacuggauagcacaggaagaccccuugugaucuugccacagaggaaguuucagcugcaccacuuaaaacucagugaggacgaagagacgguauacaacguguucuuugcgcgcucucgauccgcccugcagagcuaucuuaagcggcaugaaucgcgugguaaucaaucaggcagaucucccaacaauccuuucaguaggguugcucuggaguuuggguccgaggagccacgccacagcgaggcagccgauucuccccggagcuccaccguccauauuuugucacagcuccugagacuaaggcagugcuguugccaccugagucuccugaaaagcgcucuugacccuauggaauugaagggagagggccugguguuaucucucgaggaacagcuguccgcccuuacucugucagaacuacgagauagugagccgagcuccacagugucucucaacgguaccuucuuuaaaauggagcuguucgaagggaugcgcgagucgacaaagauaagcucauugcuggcagaauuagaggcgauccaacggaacuccgccagucagaaaucugucauuguuagccaguggacuaauaugcucaaggugguggcucugcaucuuaagaaacacggccugaccuacgccacgaucgacggauccguaaacccaaagcaaagaauggauuuggucgaagcauuuaaucacucaaggggcccccaggugaugcucaucucucugcuagcugggggaguuggccugaaccuuaccggugggaaucaucucuuccuguuggacaugcacuggaacccuagccuggaggaccaggccugugaucguauuuaucgcgugggacagcaaaaagacgucgugauacaucgguuuguuugcgagggcacaguggaagagaagaucuuacagcuccaggaaaagaagaaggaucuggcaaaacagguacuuagugguuccggcgagagcgucacuaagcugaccuuggccgaccucagagugcuguucgggauuuga

SEQ ID NO: 64353 - RNA, 3270 nt, Artificial Sequence
  derived and/or modified sequence opt3 from TTI1__Homo_sapiens__NP_001290386
auggccguguucgacacccccgaggaagcauuuggcguccugagaccuguuugcgugcagcucacaaagacucaaacgguagagaacguggaacaccuucagaccaggcugcaggcagucagcgauuccgccuugcaggaguuacaacaguacauccuguucccacuacgguuuacacucaaaacuccggggcccaagcgcgaacgacugauucagucugugguugagugucuuaccuucgugcugucaaguacaugcgucaaagagcaggaauugcuccaagagcuguuuagcgaacuguccgcgugucucuauucuccuucgucacagaagccagcugccgugagcgaggaguuaaaacuggcaguaauacagggacuuaguaccuugaugcauuccgccuacggugacaucauucugacuuucuaugaacccucuauccuaccucgucucggcuuugcuguuagccugcuucugggguuggcagagcaggaaaaguccaagcaaauuaaaaucgccgcucucaagugccuacagguguuacugcuccagugugauugccaagaccacccaagaucacuugaugagcuggaacagaaacaguugggagaccuauucgccaguuuucugcccggcauaagcacagcgcucaccaggcugaucacgggugauuucaagcaggggcauucuauugucguguccucacuuaaaaucuuuuacaagacugugagcuucauuauggcagacgagcaacugaagcggaucaguaaaguccaggccaagccugcuguugagcaccgcguggccgaauugaugguauauagagaggcagauugggugaaaaagaccggagacaaacucacaauacugauuaagaaaaucauugaaugugucucugugcauccacacuggaagguuagguuagagcugguggaacuggucgaggaucuccugcuuaagugcucccagagcuugguggagugugcuggcccgcugcucaaagcccugguaggccuuguuaaugacgaaucgcccgagauccaggcgcaaugcaacaaggugcugcggcacuuugccgaucagaaagucguggucgggaauaaggcauuggcugacauccucucugaaucccugcauucauuagccaccagucugccucgccuaaugaacagccaggacgaucagggaaaauucuccacucucucucugcuuuuggguuaccugaagcuccugggcccaaagauuaauuucguguuaaacagcguugcucaucugcaacgacuuucaaaagccuugauacaggugcucgagcuggacguagcagauaucaagauugucgaagagagaagguggaauagugacgaucuaaacgccucccccaaaacaagcgcuacccagccuuggaaucggauccagcgucgcuauuuuagauucuuuacggacgagaggauauucaugcugcuccggcaagugugucagcugcuuggguacuacggaaacuuguaucuguuaguugaucacuuuauggaacucuaccaccagucuguggucuaucgaaagcaagcggcaaugauucugaaugagcuugugacuggcgccgcuggucuggaaguagaggacuugcacgagaaacauaucaagacaaacccagaagaacuccgcgaaaucgugaccucaauucuggaggaauacacaagucaggagaauugguaucuaguuacuugccuggagaccgaagagaugggggaggagcucaugauggaacaccccggacugcaggccaucacgagcggcgagcauaccugccaggucacauccuuccuugcauuuucuaagccgucgccuacuauuuguagcaugaacuccaauauauggcaaaucugcauucaguuggagggcaucgggcaguucgccuacgcucugggaaaagauuuuuguuuacuccugaugucagcccuuuaucccgugcuggaaaaggcuggugaccagacccuacucaucagucaaguggcgacaucuacuaugauggaugucugcagagcuuguggcuacgacagccugcagcacuugauuaaccagaacuccgacuaccugguuaaugggauaucauuaaaccucaggcaucuggcccuucacccacacaccccuaaagugcuggaggugauguugcggaauagcgaugcaaaccuccugccccuaguagccgacgucgugcaggauguucuggcuacacuugaccaauucuaugauaagcgcgccgcaucuuuuguguccguccuccaugcucugauggccgcguuggcccagugguucccagacaccggaaaucugggccacuuacaggaacaaagucucggugaggaagggagccaucugaaccagagacccgcugcacuugagaaaucuacuacgacagccgaggauaucgaacaguuucuguugaauuaccucaaggagaaggacguggcugauggcaacguuuccgacuucgauaaugaagaggaggaacagucagugccuccaaaaguagacgagaacgauaccaggccggacgucgaacccccucugccacuacaaauucagaucgccauggacgugauggagcguugcauucaucugcuuagugauaagaaucuccagauccggcugaaaguguuggacgucuuagaucuguguguugugguacuccagagccacaagaaccaacugcuuccccuggcacaccaggcguggccuucguuggugcaccgacuaacuagagacgccccacuggcuguccucagggccuucaaagugcugcgcacccuuggauccaagugcggcgacuuuuuacggucuagauucuguaaagauguucugcccaagcucgcagggagcuuggugacacaggcuccgauaucagccagggcaggaccugucuauagucauacccuggccuuuaagcuccagcuggcugugcuucaaggucugggcccauugugcgaacgccuagaucugggggagggagaccucaauaaaguugcggaugccuguuuaaucuaccuguccgugaagcagcccgucaaacuucaggaggcagcucgaucuguauuccugcaccucaugaagguggacccugauagcacuugguuuuugcugaacgaacucuauugccccguucaguucacaccaccucaucccucccugcacccagugcaacuucacggcgccucaggucagcagaauccguacacgaccaacguccuacaacuguugaaagaguuacaguga

SEQ ID NO: 64354 - RNA, 1527 nt, Artificial Sequence
  derived and/or modified sequence opt3 from TTI2__Homo_sapiens__NP_079391
auggagcuggacagcgcccucgaagcucccucccaggaggauucuaaccuuucagaagaguugagucacagcgcauucggccaggccuuuuccaagaucuugcauugcuuagcgagaccugaagcuaggcgggggaaugugaaagacgccguccugaaggaucuaggagaccucauugaggcaaccgaguucgaucgccuguuugaagguacaggcgcccgacuucgugggaugccagagacucugggacagguugcuaaagcauuggaaaaguacgccgcuccgucuaaagaggaggaaggcgguggggacggacacucggaggccgcggaaaaggcagcccaggugggccuccuguuccugaagcucuuaggcaaaguagagacggcuaagaacucacugguggggcccgccuggcagaccggacuucaucacuuggcagguccugucuauauauuugcuaucacacauagccuggaacaaccauggacuacccccagaaguagggagguggcccgggagguucuaacaucccuccuucaggugaccgaauguggcucugucgcgggguuccugcacggagagaaugaagaugagaaaggccgccugagcgugauuuugggucuccugaagccugacuuauacaaagaauccuggaagaacaauccagccaucaagcacguauuuucauggacucugcagcagguuacaagacccuggcucagucaacaucuugagagggugcugccugcaagccuggucauuucugaugacuaucagaccgagaacaaaauccuaggggugcacugccugcaucacauagugcucaaugucccagcugccgaucugcuucaguacaaccgggcucagguucuguaucacgccaucuccaaucauuuguacacgccggaacaccaucucauucaagcagugcuguuaugucugcuagaccucuuccccauccuggagaagacucuucacuggaaaggagauggcgcccgcccuaccacacauugcgacgaaguauugcgacugauucucacucacauggagccagaacacagacugcuucugaggcggaccuaugcucguaacuugcccgcguuugugaaucgccucggcauccugacagucagacauuuaaagaggcuggagcgggugauaauuggguaccuagagguuuacgacggaccugaagaggaagcacgacucaaaauccuggagacccuuaaguugcugaugcagcacacguggccacgcgugucauguagacucgucgugcuguuaaaagcccugcuuaaguugauuugcgauguagcuagggaccccaaccucacuccggagagcguuaagagugcccugcuacaggaagcaacagauugucugauccuccuggaccggugcucucaaggucgcgugaaaggccuuuuggccaagaucccucaguccugugaggauagaaaagucgugaauuauauuaggaagguccaacaggugagcgaaggggcucccuacaacggaaccuga

SEQ ID NO: 64355 - RNA, 2574 nt, Artificial Sequence
  derived and/or modified sequence opt3 from TTK__Homo_sapiens__XP_011534401
auggagagcgaagaccuguccggcagagagcucaccaucgauucuauuaugaacaaggugagggacaucaaaaauaaguucaaaaacgaagaucuuacagacgagcugucauugaauaagauaagugccgauacuacggacaacagcgggaccgucaaucagauuaugaugauggcuaacaaucccgaagauugguuaucccugcuacucaaacuggagaagaacucuguuccucuuucggacgcacuguugaauaagcucaucggacgguacucacaagccauugaggcgcugccaccggauaaauauggucagaacgagagcuuugcucgcauccaggugcgauucgccgaacugaaggcaauacaggaacccgacgaugcccgugacuacuuucaaauggcuagagcaaauugcaaaaaguucgccuuuguacacaucaguuucgcucaguuugagcucucccagggcaacgugaaaaagucuaagcaguuacugcaaaaagccgucgagaggggagcggugccucuugaaauguuggagauugcacugcggaaucuaaaccuccagaagaaacagcugcuuagcgaagaggaaaagaaaaaucuguccgccucaacaguuuugacugcucaggagaguuucagcgggucucucggccaucugcaaaaccgcaacaauuccugugauucaagaggucagaccacaaaggccagguuuuuauauggggagaacaugccaccccaggacgcagaaaucggauaccggaauagccugcgccaaaccaacaaaacuaagcagaguugcccuuucggccgagugccagucaaucuccuuaacucucccgacugugaugugaagacagacgauuccguaguuccuugcuuuaugaaaagacagaccagcaggucggagugucgggaccugguggucccaggcucuaagccguccgggaaugauucaugcgaauugcguaaccuaaaaagugugcagaauagccacuucaaggagccccugguguccgacgaaaaaucuagcgagcucauuaucacggauucaauaacucugaagaacaagaccgagaguucccuucuggcuaaauuggaagagacaaaggaauaucaagagccugaagucccagagagcaaucagaaacaguggcagucuaagcgcaaaucagaguguauuaaccaaaaucccgccgcgaguagcaaccauuggcagaucccugaacucgccagaaagguuaauacugagcagaagcacaccacauuugaacagccaguguucuccguaucuaaacaaucgcccccgauuagcaccuccaagugguucgacccuaaaucaaucugcaagacgcccaguucuaacacucuggaugacuacaugagcuguuuuaggacaccaguggucaaaaacgauuucccucccgcaugccaguuauccaccccauauggacagcccgcuuguuuucagcaacagcagcaucaaauccuggccacuccucuacagaaucuccaggugcuggcuucaagcucugccaacgagugcauuuccguuaagggucggauauacaguauccuuaagcagauuggcagcgggggaucuuccaaaguguuccaagucuugaaugagaagaaacagaucuacgcaauaaaguaugugaaccuggaagaggccgacaaucagacacucgacucauaccgaaacgaaauugcuuaucugaauaaacuucagcaacacagugauaagaucauccgccuguacgacuaugagauuaccgaucaguacaucuauaugguaauggaaugcggcaacauugacuugaauagcuggcucaaaaagaagaaaucgauagauccaugggagagaaaguccuacuggaaaaacaugcuggaggcgguucacacgauccaucagcacgguauugugcauucugacuuaaagccggcaaauuuucugaucgucgaugggaugcuaaaacucaucgacuucggaauugccaaccagaugcaacccgauaccacaagcguggucaaggacucacaggugggcacuguuaauuacaugccuccagaagcuauaaaggauaugaguuccucuagggagaacggcaaaagcaaguccaaaaucucacccaagagcgacguguggagucugggguguauucuuuauuacaugaccuauggaaaaacaccuuuucagcaaaucauuaaucagaucucuaaguugcacgccauaaucgauccaaaccacgaaauugaguuccccgacaucccggaaaaggaccugcaggauguacucaaaugcugucugaagcgggacccuaaacagcgcauuuccaucccagaguuacuggcacaucccuacguccaaauacagacucacccugugaaccagauggccaaggguaccacagaggaaaugaaauauguucuuggccaguugguggggcucaauagccccaacucgauucugaaggcugccaagacccuauacgagcauuauucaggaggcgaaucucacaauaguuccagcucuaaaacuuuugagaagaaaagagguaagaaauga

SEQ ID NO: 64356 - RNA, 1134 nt, Artificial Sequence
  derived and/or modified sequence opt3 from TTL__Homo_sapiens__NP_714923
auguacaccuucguggucagagacgagaacagcuccguuuaugccgaagugucuaggcugcuccuugcuacaggccacuggaagcggcugcgccgagauaauccccguuuuaacuugauguuaggggagagaaauaggcugccuuucggacggcuaggucaugaaccaggccucguacagcuggugaacuacuaucgcggggcagacaaacuuugcagaaaggccucacuggucaaauugaucaagacgaguccggagcucgcggaaagcuguacuugguuucccgaguccuacgugauuuauccuaccaaucugaaaacaccaguugcucccgcccaaaacggaauacagccuccaaucucuaauucgaggacugaugagcgggaguucuuucuggcaucauacaaccgcaagaaggaagacggcgaagguaauguguggauugccaaaagcagugcuggggcaaagggagagggcauccucauuuccucugaggccagcgaauuacuggauuucaucgacaaccagggccagguccacgugauacaaaaauaucuugagcaucccuugcugcuagaaccugggcaccgaaaguuugauaucagauccuggguacucguugaccaucaguacaauauuuaccuguauagggagggagugcuucggaccgcuucagaaccauaccacgucgauaacuuccaggacaaaacaugccaccugaccaaucauuguauccagaaggaguauaguaagaacuacgguaaauaugaggaaggcaaugagauguuuuucaaggaauuuaaccaauacuugacuagcgcccucaacauuacacuggagucuuccaucuuacugcagauaaaacacauuauccguaauugccuccuuucaguggaaccggcgauuagcaccaagcaucugcccuaucagaguuuccaguuguuuggguucgauuucaugguggacgaggagcuaaaagucuggcugaucgaaguuaacggagccccugcaugugcucaaaagcucuacgccgagcugugccagggcaucguggauauugcaauaucuuccguauuuccacccccugacguggaacagccacaaacgcagcccgcugccuucaucaaacuuuga

SEQ ID NO: 64357 - RNA, 1578 nt, Artificial Sequence
  derived and/or modified sequence opt3 from TTLL10__Homo_sapiens__XP_011539472
auggaccacagcugcaccagauucauccauaggcgggggcccccuacacgcacucgagccggguuuaagcguggaaaaagaccaaggauucagcaacggccgcgcgcuagaguguccgguacgauacccgcaucuaggcugcacccugccccagcgucacagcccggcccuuguccagcucccgggcauugcccugucggaccagcccacgagcggccgaugggcaguagccaggaagagggucuccgcugucagcccucccaaccugaucaugacgcagaugggcacugcggaccagaccuugaaggcgccgagcgagcuucugcaacccccggcccuccagggcuguugaacucgcacagacccgccgauucagacgauacaaaugcugccggaccgagcgcggcauuacuggaaggucuacuccugggcgggggaaagccuaguccccauuccacuaggccaggcccuuucuuuuacaucggugggucuaacggagccaccauuaucagcuccuauuguaaaucaaagggcuggcagcggauucacgacagucgucgcgaugacuacacacuuaaauggugcgagguuaagagcagagauucuuauggcuccuucagggagggggaacagcuguuguaccagcuccccaauaacaagcugcugaccacuaaaaucggacucuuaucaacacugcggggucgagcucgcgccaugagcaaggcaaguaaagugccaggcgggguacaagcuagacuugagaaggacgccgcggcccccgcauuggaagaucugccuuggaccucuccaggauaucuaaggccgcagcgggugcuccgcauggaggaguuuuuccccgaaacguacagacuggaccuuaaacaugagagggaagccuuuuucacucuguuugacgagacccagauauggaucuguaagccuacagcuuccaaucagggcaaggguauuuucuugcuccguaaccaagaagaggucgcugcccugcaggcaaaaacucggagcauggaggaugacccaauccaccacaagacccccuuucgagggccucaggccagagugguucaaaggugcggcggaggcuguccagaaggguauauucagaaucccuuacugguggauggacgcaaauucgacguccggucguaccuccuuaucgcuugcacaaccccguacaugauauuuuucggucauggcuaugcgagacugacguugucucuauacgauccucacuccucagaccugggcggacaucucacuaaccaguucaugcagaagaaaaguccacuguauaugcuucugaaggagcacacaguguggagcauggaacauuugaauagguacauuuccgauaccuuuuggaaagcacgcggccucgccaaggacuggguauucacuacacugaagcgauuauguucucugagcuggcaaugccuaucacccgcugccaguaaagguccugaugggaagcccucccggggcagcguuggaaccucuccagcaggcucacucgccguggggaguggagacagcuccgcuucugucacggccaccauguga

SEQ ID NO: 64358 - RNA, 2403 nt, Artificial Sequence
  derived and/or modified sequence opt3 from TTLL11__Homo_sapiens__NP_001132914
auggccgcugcagccagcgugaccggcagagucacaugggcggcuucccccaugaggucucuggggcucggacggcgccuuucacugccugguccacgauuggacgccguuacugcagccgugaacccgaguuuaagcgaucacggcaaugggcugggacguggcacgagagguuccgggugcucuggaggcucgcuaguagcugacuggggcgggggagcagccgcugccgcggcaguggcccucgcucuggcccccgcacuuucaaccaugaggcgggguagcagugaguccgaacuggcugcccgcugggaggcggaagccgucgcagcugccaaggcugccgcaaaagccgaggcugaagcgacagcagagacuguggccgagcagguuagaguggaugcuggcgccgcaggggaaccugaguguaaggccggagaagaacaaccaaaagucuuggcucccgccccugcacagccaucugcggcugaggaaggcaacacccaggugcuccagaggcccccuccaacacugccgcccagcaagccuaaaccaguacaaggucugugcccccaugggaagccucgggacaagggacgcuccuguaaacgaucaaguggccacggcagcggggagaauggaucucagagaccaguuaccguggauuccucaaaggccaggacuagccucgacgcauuaaaaaucaguauucggcagcugaaguggaaagaguuccccuuuggucgucgccuuccgugcgauauauacuggcauggcgucucuuuccacgacaacgauaucuuuuccggacaggugaauaaguucccugggaugacagagauggugagaaagauuaccuugagcagggccguccggacgaugcaaaaccuguuucccgaagaguauaauuucuacccacgaucguggauccuaccugacgaguuucaacucuucguugcucaggugcagaugguaaaagaugacgaucccucuuggaagccaacuuuuauugugaaacccgacggcgguugucagggggacggcaucuaucugauaaaggauccuuccgacauccgccuugccggaacccugcagucaagaccagcagucgugcaggaauacauuugcaaaccguugcucaucgauaagcugaaauucgacauuagguuauauguucugcucaagagucuugauccccuggagaucuacauagcuaaggacggcuugagccgguuuuguacagaaccuuaucaagagccaacucccaaaaaccuacaucgcauuuucaugcaccugaccaauuacucccucaacauccacucugggaauuuuauucauagcgauucagccaguacaggauccaagagaaccuucagcucuauccugugcaggcuuucaaguaaagguguggacaucaagaaagucuggagcgauauuauauccgugguaaucaagacgguuauugcgcugacuccugaauugaagguguucuaccagucugacaucccaacaggccgucccgggccgaccuguuuucagauacucggauucgauauucuguuaaugaaaaaccugaagccuauccuacucgaggucaaugccaacccaucgaugcggaucgagcacgaacaugagcugagccccggcguguuugaaaaugucccuucccuuguggacgaggaaguuaaaguggcuguaauucgagacacuuugagacugauggauccccucaagaaaaagagggagaaccagucacaacagcuggagaagccauucgcagguaaagaagacgcccuugauggggagcugacaagugcuccugacugcaacgccaaucccgaagcacacuugccaucuaucugucucaagcaggucuuuccgaaauaugcgaagcaguucaacuaccugcgcuuaguggaucggauggccaaucuguuuauuagauuccuaggcauaaaaggaaccaugaagcucggcccuacgggguuuaggaccuucauccgcagcugcaagcuguccucaagcucucuuuccauggcugccguugacauuuuguauaucgauaucacacgacgguggaacaguaugacucuggaccaacgugauagcggaaugugccuccaggcauuuguggaggcuuucuuuuuccuggcccagagaaaauucaagauguuaccccugcacgagcaggucgcaucucuuauugacuugugugaauaccaucucucccugcuagaugagaaaaggcuggugugcggucgcggcguaccaucagggggacggcccccucacagaggcccaccccaagaaccuaguccgagcgcccagccagcuggugacaaucccccuccaaggaccucgugugcgaacaagcucucccauccccgacacacacugucuuga

SEQ ID NO: 64359 - RNA, 1935 nt, Artificial Sequence
  derived and/or modified sequence opt3 from TTLL12__Homo_sapiens__NP_055955
auggaggccgaaagaggccccgagaggcggccugcugaacgcagcuccccagggcagaccccggaggaaggagcacaagcccuggcggaguucgcugcccuccacggucccgcacuucgagccucuggcgugccugagcguuacugggggagacuguugcauaaguuagaacacgaggucuuugacgcuggagaaguuuucggcaucaugcaaguggaggagguagaagaggaagaggaugaagcagccagggaggugcggaaacagcagccaaaccccgguaaugagcugugcuauaaggucauugugacacgcgaaucagggcuacaggcugcccauccuaacaguauauuucucaucgaccacgcguggacuuguagaguugagcaugcaaggcagcagcugcagcaagugccaggacuucugcaccggauggccaauuugaugggcauugaguuccacggcgaacuccccagcacggaagcugucgcccuggugcuggaggagauguggaaauuuaaccagaccuaccagcucgcacaugggacagcugaagagaagaugccuguaugguauaucauggaugaguucggaucccgcauucagcacgccgacguuccaucuuuugcgacugccccguucuuuuacaugccccaacagguggcauauaccuuacuguggccucuucgagauuuggacacaggugaagaagucaccagagauuucgcuuacggcgagacugacccacugaucaggaaaugcaugcuacuccccugggccccuacagauaugcuggaccuuucgucauguaccccagagcccccggcugaacauuaucaggccauacuggaggaaaauaaggagaaguugccucucgauaucaaccccguggugcacccacacgggcauauuuuuaaagucuacacggacguucaacagguggcaagcagucugacucacccucgguucaccuuaacacaguccgaggccgaugcugacauccuguuuaauuucucucauuucaaggacuaccguaaacucagccaggaacgccccggaguacuucugaaccaauuuccaugcgagaauuugcuaacugugaaggauugucuggcguccauugcaagaagggccggcggucccgaagggccuccauggcucccgcggaccuucaaccugcgaacagagcuuccccaguuugucucauauuuccagcagcgcgaaagauggggagaggacaaucacuggaucugcaaaccuuggaaccuggcuaggaguuuggauacccaugugacuaagagccuccacucuauaauucggcaccgcgaguccacgccaaagguugugucaaaauacaucgaaagccccguccuguuuuuaagagaggacgugggcaagguaaaauucgauauuagguauaucguucugcuacguagugugcggccucuccgacuguuugucuacgacguguucuggcuuagauuuucuaauagggccuucgcauugaacgaucuggacgauuaugaaaagcauuuuacagucaugaauuacgacccagaugugguucucaaacaagugcacugugaggaguucauccccgaauuugagaagcaguauccggaguucccuuggaccgacguacaggccgaaauuuuccgcgcuuuuacugaacuguuccaggucgccugcgcaaaaccacccccucuuggccugugugacuaccccuccagccgggcgauguacgcuguggauuugaugcucaagugggacaacgggccagauggaagaaggguuaugcaaccucagauacuggaggugaacuuuaaucccgacugcgaacgcgccugucgauaucauccaacauucuuuaacgaugucuucucgaccuuauuucuggaccagccggguggcugccacgugacgugccuaguauga

SEQ ID NO: 64360 - RNA, 1272 nt, Artificial Sequence
  derived and/or modified sequence opt3 from TTLL1__Homo_sapiens__NP_036395
auggccggcaaggugaaaugggucaccgacaucgaaaagagcguucugauuaacaauuucgagaaaagagggugggugcagguaacagagaacgaagauuggaauuuuuacuggauguccgugcaaacuauaaggaacgucuucucuguggaggcuggauaucggcucucagacgaucagaucguuaaucacuuucccaaccauuacgaacuuacgcgcaaggaccugauggugaaaaauauuaagcgauaucguaaggaguuggagaaagaagguaguccuuuagcagagaaggaugaaaacggcaaauaccuguaucuagacuucgucccagugaccuacaugcucccggccgauuauaaucuguuuguagaggaguucagaaagagccccuccucuacauggaucaugaaaccuugcgggaaggcgcagggaaagggcauuuuucuuaucaacaaacugucgcagauaaagaaauggucaagggacagcaagaccaguuccuucguuucucaaagcaauaaagaggcuuacgugaucuccuuguacauuaacaauccacuccugaucggugggcggaaguuugaucugcgccucuaugucuuagugucaacuuacagaccccugagguguuauauguacaaacuuggauucugccgguuuuguacagugaaguauaccccuaguacuagcgaauuggacaacauguucguccaccugacaaauguugccauucagaagcauggcgaagauuacaaccacauccauggcgggaaauggaccgugucuaaccuacgccucuaucuggaguccacgcgaggaaaggaaguaacuucaaaacuuuuugacgagauacacuggauuaucgugcagagccugaaggcagucgccccagugaugaauaacgauaaacacugcuucgaguguuacgguuacgacauuaucaucgacgauaaguugaagcccuggcucauugaaguuaaugcuaguccuucucugaccuccagcacagcaaacgacagaauauuaaaauauaaucugaucaacgauacucucaauauugccgugccaaacggcgagaucccggacugcaaguggaauaaaucgcccccuaaggaaguccuugggaacuacgagauacuguaugaugaagaguuggcucagggagacggcgccgauagggagcuacggucucgucaaggucagucccuggggccacgcgcgggaagaucaagggacaguggccgggcagugcucaccacauggaaauga

SEQ ID NO: 64361 - RNA, 2748 nt, Artificial Sequence
  derived and/or modified sequence opt3 from TTLL3__Homo_sapiens__NP_001021100
augcagggccccgacgccccucugcuccuuagcgcuagagaacuggggccaggaaggcgggguuccgcaucuugguaccgccaagaaggcggggccgugugcaacugguugcgaaagccgcagcccuuagagccucguaccucauucccaagugcgagaaggagcgaauuucggcccccucgcagacugccaugggcuggacccgccuccgcacagucugaggaaggccacgccggugggaggugucaggcuggaucgccugcaccagcccggcgccuaucaggcgcuuucaaaacacucgucccgggcacucaugcccaaggggcgagcgauacgcacccccugggaccuccacauacccccguucuugacccuaguccacaggaugguuuucccgugcuguggcgaggcuccucuaaggcaagccacaugaauagauugaggaacgccaaaaucuauguagagcgggcugugaagcagaaaaagauuuucacaauacaggggugcuacccggucauccguugucuccugcgcagaaggggauggguggagaagaaaaugguucaucgguccggcccuacucuguuacccccacaaaaggaccucgauucaagugccaugggugacagcgauaccacagaagacgaggaugaagacgaggaugaggaauuucagccuucucagcuguucgacuuugaugaccuuuugaaauucgacgaucuggacgggacccacgcacuaauggugggacucugccugaaucuucgaaaccugcccugguuugaugaggucgacgcuaauuccuucuuuccacgcuguuauugcuugggcgccgaagaugacaagaaagcguucauugaggauuuuuggcucacugccgcaagaaacgugcugaaguuaguaguuaagucagaauggaaaagcuaccccauccaggcuguggaggaggaagccaguggcgacaagcaaccuaaaaagcaggagaaaaauccaguccuggugucuccggaguucguggaugaagcucucugugccugcgaagaguaucuuuccaaccuggcacacauggacauugauaaggacuuggaggcuccccuauaccugacaccugaaggguggagccucuuccugcagagguauuaccaagucguucaugagggagcugaacuucggcaccuggacacccaggugcagcgcugugaggauaucuugcagcaacuccaggcgguagugccacagauagacauggaaggugauagaaauaucuggauugucaaacccggcgcaaagucgagggggcguggaaucaugugcauggaccaucuggaggagauguuaaagcuggugaacggcaauccuguugugaugaaagaugguaagugggucgugcagaaauacauugaacggccacuacucaucuuugggacgaaguucgaccugcgacaaugguuucuuguaacugauuggaaccccuugaccguuugguucuauagagacucuuacauaagguuuuccacacagccguucucacugaaaaaucucgauaacagugugcaccuguguaauaacagcauucagaagcaccuugagaacuccugccaucgccacccucuguugccacccgacaauauguggucuagccagcgguuucaagcccaucuccaggaaaugggcgcuccuaacgccuggucaacuaucauuguccccggaaugaaggaugcagugauccacgcccugcagaccagucaggacacaguccaaugcagaaaagccuccuucgaguuauauggcgccgauuuuguguucggggaggacuuucagccauggcugaucgaaauuaaugcaagcccuaccauggcgcccucuacggcuguuacugccaggcuaugugcaggagugcaggccgacacacuccgcguagucauagaucgaaugcuggaccggaacugcgauaccggugcuuucgagcuuaucuacaagcaaccagccguggaaguuccgcaguaugugggcauucguuugcuggucgagggguuuacuaucaaaaagccuauggcaaugugucauagaaggaugggagugcgccccgcuguaccacuccugacacagcggggcucaggugaagccagacaccacuuccccaguuuacauaccaaagcgcagcugccuagcccacacgugcuuaggcaucaagggcagguuuugcgacgccagcacuccaagcucgucggcacgaaggcccugucuaccacaggaaaagcucuacggacucugcccaccgcaaagguguucauaucgcucccuccgaaucuggacuuuaaaguggccccaagcauucuuaagcccagaaaagcuccugccuugcugugcuuaaggggcccacagcucgagguccccuguugccuguguccucuuaaguccgagcaauuccuggcaccgguugggcguucacgccccaaggcgaacagucggccagauugcgacaaaccuagagccgaggcuugucccaugaagagguugucuccacucaaaccucugccccuagugggaacauuucagcgacggcgcggucugggcgauaugaagcucgggaaaccacugcuuagauucccgacugccuuggugcuggacccuacccccaauaagaaaaagcagguaaaguacuuaggacucgauagcaucgcagucggcgguuccaggguggacggggcucggccaugcacacccggcucaaccgcccgagcauga

SEQ ID NO: 64362 - RNA, 3600 nt, Artificial Sequence
  derived and/or modified sequence opt3 from TTLL4__Homo_sapiens__NP_055455
auggccagcgcuggcacccagcacuacuccaucgggcugagacaaaagaacucuuucaaacagucaggacccagugguacagugccugcaacuccaccggagaagcccagcgaaggcagggucuggccucaggcccaucagcaaguuaaaccaauuuggaagcucgagaaaaagcaaguggaaacgcuuuccgcggggcugggacccggcuuguuagguguaccuccacagcccgcuuacuuuuucugcccuucuacccuguguucgucagggacaacugccgugauagcaggacacagcaguuccugcuaucuacauucucucccagaccuguuuaauagcacccuucuguaucggcgcuccucauaccgacagaagccguaucagcaguuggagaguuucugucuccguagcucucccuccgaaaaaucaccuuuuagccugccacagaagagucugcccgucucucucacagccaacaaagcuaccuccagcaugguguucucgauggcacagccuauggccucuuccucaacugagccauacuuaugccuggcugccgcgggcgagaaucccaguggcaagagccuugcauccgccaucucugggaaaauuccgagcccuuugucaaguuccuauaagcccaugcugaacaauaacagcuuuauguggccaaauucuacaccuguuccccuacuccaaaccacgcagggacugaagccagugucacccccuaaaauccagccagucaguuggcaccauagcgguggcacuggggauugugcuccgcaacccguggaccacaagguaccuaaauccauuggaaccguuccagccgaugcaucugcucacaucgcccuuucgacagcgagcucccaugacacuucaaccacaaguguggccucuagcugguacaacagaaauaaccuggcaaugagggcugaacccuuguccugcgcccucgaugacucaagcgauucucaggacccuaccaaggagauacgguucacggaagcuguccgcaaacugacugccagaggcuuugagaagaugccaaggcaggguugucaguuagagcaauccaguuuccugaaucccagcuuucaguggaacgugcucaaucggucucgccgauggaaaccgccugcagugaaccagcaguucccacaagaagaugccggguccgucagaaggguucuucccggagcuucagacacacugggcuuggauaauaccguguuuugcacuaagcggaucaguauucaccuacuggcgagccaugcaucgggccucaaccacaacccugccugugaguccguaaucgacucuagcgcuuucggggaaggaaaggcccccgguccaccuuucccccagacacugggcauugcaaauguggccacccgucuuucaaguauccagcuggggcaguccgagaaagaacgcccagaggaggcuagagaauuggauucuagcgacagggacauauccucagccacggaucuccaaccggaccaggcagagaccgaagauacagaggaggaacuggucgacggauuagaggauugcuguagccgggacgaaaacgaggaagaggaaggcgauagugaguguucuucccugagcgcggugucgccuucagagucuguugcuaugauuagucgauccugcauggaaauccuaacuaagccccucagcaaucacgagaaagugguccgcccagcccugauuuacucucuuuuucccaacgugccuccaaccaucuauuucgguacaagagacgaaaggguagagaaguugcccugggagcagcggaaacugcuccgcuggaagaugagcacuguuaccccuaauaucgugaagcagacaauugggagaucccauuuuaaaauaucaaagaggaacgaugacuggcugggcugcuggggacaccauaugaaaaguccgagcuuccguucuauccgggaacaccaaaagcuaaaucauuuuccaggcuccuuccagauugggcgaaaagauagacuguggaggaacuugucacgcaugcagagucgguuuggaaagaaggaguucagcuuuuucccccaauccuuuauccucccucaggacgcaaaacuguuaagaaaggccugggaaucuucgagcaggcagaaauggauagucaagccacccgcuucagcccgcgguauuggcauccaggugauccacaaauggucccaacugccuaagcgacggccgcuacucguccagcguuaccugcacaagcccuaucuuauuagugggucuaaauucgacuugagaaucuacguguauguuaccagcuacgauccacugaggauuuaucucuuuuccgacggacuggugcgcuucgcaucaugcaaguacucuccuagcaugaaaaguuuaggcaauaaguucaugcaucugacuaacuacuccguaaauaaaaagaacgcugaguaucaggccaaugcggaugaaauggccugucagggucacaaaugggcucuuaaggcauuguggaacuaccucagccaaaagggggucaauucugacgccauaugggagaaaaucaaggaugugguugugaaaacgauuaucucauccgagcccuaugucacaagucugcuaaagauguacgugcggagaccauauagcugccaugaacuguuuggcuucgacaucaugcucgaugagaaccugaaaccuuggguacuugaagugaacauuucgcccucuuugcacuccagcucaccacuggacauaaguaucaagggacagaugauuagggauuuacucaaucuggcuggcuuuguucuuccgaacgccgaggacaucauuucuuccccuagcucauguaguagcuccaccacuucucugcccaccagcccaggggauaagugccgaauggcacccgaacacgucacagcgcagaaaaugaagaaagccuacuauuugacccagaagaucccugaccaagauuucuacgcuuccgugcucgacgugcugacuccagacgauguccgcauacuuguugagauggaggacgaauuuucacggagaggacaguucgagaggaucuuucccucucauauuaguucgcguuaccugcgcuucuuugaacagccucgguauuucaauauccucacaacgcaaugggagcagaaauaccacgguaacaagcugaagggcguggaucuuuugagaagcugguguuauaaaggguuucauaugggagugguauccgacucugccccggucuggucacugccaaccagcuuacucacuauuuccaaggaugacgugauccugaaugcauucaguaaaucugaaacaagcaaacuuggcaagcagucauccugcgagguuagucugcuacucagcgaggaugguaccacacccaagucuaagaaaacucaggcugggcuguccccuuacccccaaaagccaucaagcucgaaagacucugaagauaccaguaaggagccuuccuugagcacgcagacccugcccgugauaaaauguucaggccagacauccagguuaucugccagcaguacuuuucaguccauuagcgacucucuccuggcagucucaccauga

SEQ ID NO: 64363 - RNA, 3846 nt, Artificial Sequence
  derived and/or modified sequence opt3 from TTLL5__Homo_sapiens__NP_055887
augcccaucgugauggccagagaccuggaggaaaccgcuagcuccucugaggaugaagaggucauuucacaggaagaccacccuugcauaauguggacaggcggguguaggcggaucccaguucucguguuccaugcagaugccauucuuacuaaggacaacaauauccgcguaauuggagagcgauaccaccugaguuauaaaaucgugcguacggauagcagauuggucagguccauauuaaccgcgcaugguuuucacgaggugcauccgucuucgacagacuacaaccugauguggacuggcucacaccuaaagcccuuccuccugcggacccuuagcgaagcucaaaaaguuaaucacuuuccucgcaguuaugagcugacaagaaaggauagguuguacaaaaacaucauucggaugcagcauacccacggguucaaggccuuucauauccucccacagacuuuccugcugcccgcagaauaugccgaguuuugcaauuccuacucuaaggaccgcggaccuuggauugugaaaccagucgcuagcucccgaggcagagguguguaucucaucaacaaucccaaccagauaucauuagaggaaaauauucugguaaguagguacaucaacaauccucuuuugauugaugacuucaaguuugauguucggcuguacgugcuagucacaagcuaugacccacucgugaucuaccuguaugaggaagggcuugcacguuucgccaccgugcgcuacgaucaaggagcuaaaaacaucagaaaucaguuuaugcaccugacgaacuauucugucaauaagaaauccggcgacuacguuucaugugacgauccggagguggaagacuauggcaacaaguggagcaugagugccauguugagguaccucaagcaggaggggcgggauacuaccgcgcugauggcacacguagaggacuuaauuauaaaaacaaucauuucugccgaacuggcuaucgccacugcaugcaagaccuucgugccccaucgauccagcuguuuugagcucuacggauucgauguccuuauagacucgacacugaaaccuugguugcuagaagugaaccugucuccaucccucgcuugcgaugcccccuuggaccuuaagauuaaagcgucaaugaucagugauauguucaccguuguggguuuugucugucaggacccugcccaacgcgcaagcacgagaccaaucuaucccacuuucgaguccucuaggcggaauccguuucagaagccucagcgcugcagaccccugagcgcuucagaugccgaaaugaaaaacuuggugggcagugcuagggagaaggggccaggaaagcucggcgguuccguacugggguuaagcauggaggaaauuaaaguucugcgucgggugaaggaggaaaaugaccgaagaggaggcuucaucaggauuuuuccuacaucugagaccugggaaauauacggcucauaucuagagcacaaaacuagcaugaacuacaugcucgccacacgccuguuccaggaccggaugaccgcagauggggcccccgagcuuaagaucgaaagccugaacuccaaagcuaagcugcaugcggcacucuaugagagaaagcugcuuucucuggaagucaggaaacgccgacggcguucgagcagauugagggccaugcgcccaaaguaccccgugauuacgcaaccugcugagaugaaugucaaaaccgagacagaauccgaggaagaggaagagguggcccucgacaaugaggaugaggaacaggaagcaucacaggaggaaagugccggauuucugcgggagaaccaagcuaaguauacuccaucuuuaaccgcccugguugagaauacaccgaaagaaaacagcaugaaggugagagaguggaauaacaaggguggccacuguugcaaacuagaaacucaggagcucgaacccaaguucaaucugaugcagauccuucaggacaacgggaauuuguccaaaaugcaagcaaggaucgcguuuucagcuuaccugcagcauguacagauucgacucaugaaggauagcggaggccagaccuucucugccuccugggcagccaaagaggacgagcaaauggaacuggucgugcgcuuuuuaaagcgggcuaguaacaaccugcagcacagccuuagaaugguuuugccuucuaggcgucucgcccugcuagagcgccggagaauacuggcacaccagcucggugauuucaucauuguguacaauaaggaaacagagcagauggcugagaaaaaguccaaaaagaaagucgaagaggaagaggaagacggggugaacauggagaauuuucaagaguucaucaggcaggccucagaagcggagcuggaagagguacuuaccuucuauacucagaagaacaaaagugccagcguguuuuugggcacgcauucgaagauuuccaagaauaacaauaacuacucugauagcggagcuaaaggcgaccacccagaaacaaucauggaggagguuaagauaaaacccccuaagcagcaacagaccacugaaauccauucagauaaacugagucgauucaccacauccgcagagaaggaagccaaguuagucuauucuaauagcuccucagggccaaccgcuacucuccagaaaauucccaacacacaccugagcagugugacgaccucugaccuuuccccgggaccuugucaccauagcucgcugucacaaaucccaucugccauucccaguaugccucaccagcccacuaucuugcucaauacaguguccgcaagcgcgucuccaugccugcauccuggugcccagaacauacccagcccaaccggccuaccgcggugccgcuccgggucacacacaauuggaccuuuuaguagcuuccagucugcugcccauaucuacucccaaaagcugucaagacccaguagcgcaaaagcuggcuccuguuaucucaauaagcaccacucugguauugccaaaacucagaaggagggggaagaugcaucgcuguacagcaagagguauaaccagucaauggucaccgccgagcuucagcgguuggcugagaaacaagcggcccgacaguacuccccaaguucucauaucaaucuguuaacgcagcagguuaccaaccucaaccuggcaacaggcauaaucaauagaagcuccgcuucagcucccccuacucuucgcccaauuaucucucccagcggaccuaccuggaguacacaauccgacccgcaggccccagaaaaccacaguucuucacccggcuccaggagucugcagacugggggauuugccugggagggugaaguggagaauaacguguacagccaagcaaccggcguagucccucagcauaaguaucacccaacggccgggucguaccagcuacaguucgcgcuccaacagcuggagcagcagaaauugcaaucucgucagcuguuagaccagucccgggcuagacaucaggccauuuuuggaagccaaacacuccccaauucaaaccuguggaccaugaauaacggcgcagguugcaggaucaguucugccacugcuuccgggcagaagccuacaacccuuccgcagaaagugguucccccaccuagcucaugugcaagucuggugcccaagccaccucccaaucacgaacaggucuugcgccgagccacuagccaaaaggcguccaaaggcucuagcgcugagggacagcucaacggccugcaguccucacuaaauccagccgcauucgugccgauaaccucuaguacagauccugcccacacgaagauuuga

SEQ ID NO: 64364 - RNA, 2676 nt, Artificial Sequence
  derived and/or modified sequence opt3 from TTLL6__Homo_sapiens__NP_001124390
augggcgcccugcuccuucaccccagcagaagggggccugcuggaguggucgcauccuggacaucuucaccagccggucgggacggcgggguuggaaucgcgggcgcuugguacuucccgcgcgccaguagccaggcacgagagaugccccaaugcccuacacuggaaucccaggagggugaaaacucugaggaaaagggggauucgucaaaagaggacccaaaggagacuguggccuuggcuuuuguacgugaaaaucccggagcacagaacggcuuacagaaugcccaacagcagggcaaaaagaaaagaaagaagaaaaggcuggugauuaaccuaagcaguugucgguaugaguccguccgcagagcugcccagcaauacggguucagggaaggaggugaggaugacgauuggacgcucuauuggaccgacuacucugugagccuggagcggguuauggaaaugaaguccuaucagaaaauaaaucauuuuccuggcaugucagagaucugccgcaaggaucuucuggcgcgaaacaugaguagaauguugaaaauguucccaaaggacuuuagguucuuuccccggacauggugucucccugcagauuggggagaccugcagacuuacagccguucucgcaagaauaaaaccuauauuugcaagccagauuccgggugucagggcaaagguaucuucauuacaagaaccgugaaggaaaucaaaccgggggaggacaugauaugccaacuguacaucucaaagcccuuuauuaucgauggauucaaauuugaccucaggauuuacgucuuagugacuagcugugacccucugcggaucuucguauauaacgaaggccuugcccgauuugcuacaaccaguuacucucgcccaugcacggauaauuuggacgauauauguaugcaccugacuaacuauuccauuaauaagcauagcucgaacuucucuagagacgcccacuccggcucaaagaggaaacuaaguaccuucagcgcauaccucgaggaucauuccuauaauguugagcagaucuggcgggacauugaagaugugaucaucaagacacugauuucugcucaccccauaauccgccacaacuaccauacuugcuuuccuaaucacacccuuaacagcgccuguuucgagauucugggguuugacaucuugcucgaucauaaacugaagccaugguuacuggaagucaaccacucacccaguuucuccacagacagcagacucgauaaagaggugaaggacggacuucuguaugacaccuuggugcuaauaaaucuggaaucuugcgauaagaaaaagguccucgaggaggaaaggcagcguggucaauuucugcagcagugcuguucacgggagaugcgaauugaagaggcgaaaggcuucagagccguucagcuuaagaaaacggaaacuuacgagaaggagaacugcgggggauuuaggcugaucuacccgaguuugaauagcgaaaaguaugagaaauucuuucaagacaacaauucccucuuccagaacacaguggcaucucgcgcucgggaagaguacgccagacagcugauccaggaguuaaggcugaagcgcgagaaaaagccuuuucaaaugaaaaagaagguagagaugcagggcgaaucggcuggugaacaggugcgaaagaaggggaugcggggcuggcagcaaaaacagcagcagaaggauaaagccgcaacccaagccagcaagcaguauauucagccccuaacucucgucuccuacacaccagaccugcuuuugucagugcguggagaaaggaaaaaugagaccgauaguucucugaaccaagaggcuccuacggaagaggcgagcuccguuuuccccaagcucaccucagcaaagccauuuagcucucugcccgaccuuagaaauaucaaccuguccaguagcaaauuggaaccuucuaagccaaauuucuccauuaaagaggccaagucagcuagugccgugaacgucuucacaggcacugugcaccucaccagcguagaaacaacuccggagucgaccacacagcuguccauaucucccaaaagcccuccaaccuuagcaguuacugccucaagugaguauuccgggcccgaaacggaucgcguggucucuuuuaaguguaagaaacagcagacaccuccacaucugacccaaaagaaaaugcuaaagagcuuccuccccacuaaauccaagucauuuugggagagcccgaauaccaacuggacacugcuuaagagugacaugaauaaaccucacuugaucucugaacugcucaccaagcugcaguuauccggaaaacugagcuucuuuccagcucauuacaaccccaaacuugguaugaacaauuugucgcagaacccuucacuccccggcgagugccacucucggagugauuccagcggggagaaaagacagcuggacgugucuagccuacugcuccaauccccacagucauauaaugucacucugagggaucuuuuggugauugccaccccugcacagcuggacccccgaccaugucgcagucaugcgagcgcuaugcgggauccgugcaugcaggaccaagaagccuacucucacuguuuaaucuccggacagaagggcugcgagagaucauga

SEQ ID NO: 64365 - RNA, 2490 nt, Artificial Sequence
  derived and/or modified sequence opt3 from TTLL7__Homo_sapiens__XP_011540457
augcccagccugccucaggagggcgugauccaagggccauccccgcucgaccuuaacaccgaacugcccuaccagucuacaaugaagagaaaagucaggaagaaaaagaaaaagggaacuauuacggccaauguugcugguaccaaguucgagauagugcgguugguaaucgaugaaaugggcuuuaugaaaacaccugacgaggaugaaacuucaaacuuaauuuggugcgacagugcagugcagcaggagaagaucagcgagcugcaaaauuaucagcgcauuaaccacuucccagggaugggagaaaucugucgaaaagauuuucuagcccguaauaugaccaagaugauaaaauccagaccccucgacuacacauucgucccuaggaccuggaucuuuccagcggaguauacucaguuccagaacuacgugaaggaacugaagaaaaagcggaaacaaaagacauuuauuguuaaacccgcuaauggcgccaugggucaugggaucucucuuauucgcaacggagauaagcugccuucgcaggaccacuugaucgugcaggaguauauagagaaaccauuccucauggaaggcuacaaguuugaucugagaauuuauauccuggucaccucaugcgacccgcucaagauuuucuuauaccaugauggccuggugaggauggggacggagaaauacauucccccuaaugaaagcaaccuuacucaguuguauaugcaccugaccaauuacaguguaaacaagcauaaugagcacuuugaacgggacgagacagagaacaaaggauccaagcgcucuaucaaaugguucacugaauuucuacaagcaaaucagcacgauguugccaaguucuggagcgacaucuccgagcucguggucaagacccugauaguggcugaaccacaugugcuucacgcauaucgaauguguagacccggucagccuccaggcucagagagugucugcuucgaaguucugggguuugacaucuugcucgauaggaaacugaagcccugguuacuggagauuaaccgggccccgagcuucggaacagaccagaaaaucgauuacgacgugaagcguggcguacuccuuaacgcucugaaauugcuaaauauacgcaccucugauaagagaaggaaccuggccaagcagaaagcggaggcacagcggcgacucuauggucaaaauuccauuaagcgccugcuuccugggucaagcgacugggaacaacagagacaucagcuggagaggcggaaagaagaguugaaggaacgccucgcccaggugagaaaacaaaucaguagggaggagcacgaaaaccgucacaugggaaauuaccggcgaaucuaucccccagaggauaaggcucuguuagaaaaguacgagaaccugcuagccgucgcauuucagacguuccucucuggcagagcugccuccuuucagagggagcugaauaacccucuuaaacgcaugaaggaagaggacauuuuggaucugcucgaacagugugagaucgacgaugaaaaacugaugggcaagacuacaaaaacccgggggcccaagccacuuugcagcaugcccgagucgacugagauuaugaaaagaccuaaguacuguucuuccgacucaaguuaugacagcuccucuagcucaagugaauccgaugagaaugaaaaggaggaauaccaaaacaaaaagagggagaaacaggugacauauaaucugaagccaagcaaccauuacaaauugauacagcagccgucuucaauccgccgaaguguuagcugcccccgguccauuucugcgcaaucgccuagcuccggagacacccguccauucucagcccagcagaugaucagugugucuagacccacgagcgcauccaggucacacagccucaaucgcgcuucuuccuauaugcggcaucugccucacaguaacgaugccuguagcaccaauucucaagucuccgagucauuaagacagcugaagacaaaggaacaggaggacgaucuaaccagucagacucucuuugugcugaaagacaugaagaucagguucccagguaaaagcgaugcugaaucggagcuuuugauugaagacauaaucgauaacuggaaguaccauaaaacaaagguagccuccuauuggcugauuaagcucgacucuguuaaacaacgaaaggugcuggauaucgucaaaacuagcauucgcaccguguuaccccggaucuggaaggucccggacguggaggagguuaaccuguacagaauauuuaauaggguguucaaccgucuuuuguggucacgcggccaggggcucuggaauugcuuuugugauaguggauaccugcuaccuggcuccacacaguucuuucugcggaccccaacuuauaaccucaaauacaauucucccgguaugacgagaagcaacguacuguucacauccagguaugggcaccuuuga

SEQ ID NO: 64366 - RNA, 2424 nt, Artificial Sequence
  derived and/or modified sequence opt3 from TTLL8__Homo_sapiens__XP_011529043
augaagaccagcagacuguggaaaguggccagguccgagggccccgggggagcugguguccggggcgcaaaggggaaacucucugaagccucaauggagccugaacgcaagggacuuagucuggcgagcuccucugacggcgauggucgagaggaaaacaaauugaagcaggggaucucgcaagacuuagcuucaagcagucgucuggauagauacaagauugccaggcagcuaacagagaaagcaauaaaggagaaaaagaucuucuccauuuauggacacuacccaguugugcgggccgcucuccgcagaaaaggcuggguagaaaagaaguuucauuuccugccgaaagugauccccgacgucgaggaugaaggcgcaagggugaaugacgauacuugcgccaagguuaaagagaaccaggagauggcucuugaaaagacggacaauauucacgaugugaugucucggcuggucaaaaacgagaugccuuauuugcucuggaccaucaagcgcgacauaaucgauuaccauagccugacauaugaccagaugcugaaucacuacgccaaaacugcguccuuuaccacaaagauugggcucugugugaacaugcgaucauuaccaugguauguacccgcaaauccugauaguuucuuuccaagaugcuacagccuguguaccgaaucugagcaacaggaguuccuugaagacuuuaggcggacuauggccuccucaaucuugaaguggguugugagccaucagaguugcucucguuccagccgcucgaaacccagagaccagagggaggaagcuggaucuuccgaucugucaagucggcaagacgccgagaacgcagaagcuaagcuacgaggucucccuggccagcuggucgauauugccuguaaagugugccaggcguaccuugggcagcuggagcacgaagacaucgauacaagcgccgacgcaguggaggauuugaccgaggcugaaugggaggaccucacgcaacaguauuacucccugguccacggagaugccuucauaucuaauagccgcaacuauuuuucacagugucaggcuuuacugaauagaauuacuuccguuaacccacaaaccgacaucgauggccucaggaauauuuggaucaucaagccggccgcaaaaucccggggucgcgacauugugugcauggacagaguagaagagauacuugaacuggccgcugcggaucaucccuugagcagggacaacaagugggugguccagaaguacaucgagacaccucuacugauuugugauacuaaauucgacauccgucagugguuucucgugaccgauuggaauccacugacaauaugguucuauaaggagucuuaccuucgguuuucaacccaacgauucagucuggacaaauuggauagcgcaauucaccucugcaacaacgccguucagaaguaucugaaaaaugacguggggagaucccccuuacugccugcucauaacauguggacgucuacuagguuccaggaauaccuacagcgccaaggacggggcgccgucuggggcucggugaucuacccaagcaugaagaaggcaaucgcccacgcuaugaaaguagcccaggaucacguugagcccagaaagaauaguuuugaacucuauggggcagacuucgugcugggaagggauuuucgcccguggcuuauugagaucaacucaaguccuacaaugcaucccucuaccccagucacugcgcaguugugugcucaggugcaagaggacacaauuaaagucgccguggaucgaagcugcgacauagguaauuucgaacugcucuggcggcagccuguuguggagcccccacccuuuuccggcucagaccugugcguagcaggggucagcgugcguagagccaggcgccagguucuuccuguguguaaccugaaggcuucugccuccuugcucgaugcacagccacugaaagcucggggaccgagugccaugcccgacccugcgcaaggcccacccagcccugccuuacagagagaucugggucuaaaggaagagaaggggcucccacuggcucuuuuggcaccccugaggggcgccgcugaaucuggaggcgccgcacagccgacccgaacgaaagcggccgggaaggucgagcucccugcuugcccaugucgccacguggacucccaagcccccaauaccggaguaccuguggcacagcccgcuaaaucaugggauccaaaccagcugaaugcccauccuuuagagcccguucugcggggucuuaagacagcagaaggcgccuugagaccaccgccugggggaaaaggccaccagagggaggcugcgggugggcucgcccaaugccagaucacuaugcugaagcguaaagaccuacugugucucuga

SEQ ID NO: 64367 - RNA, 1320 nt, Artificial Sequence
  derived and/or modified sequence opt3 from TTLL9__Homo_sapiens__NP_001008409
auggugcccagcagagaggcccugcucggcccugggaccacagcuaucaggugcccaaagaaacuucagaaccaaaauuacaagggacacggucuguccaaaggcaaggaacgggagcagcgcgcaucuauucgauucaaaacuacguugaugaacaccuuaauggacguccugcgucauagaccgggguggguugaagugaaggaugagggagaaugggacuuuuauuggugugauguaucauggcuaagggagaauuucgaccacacauacauggaugagcaugugcggauaagucacuuucgcaaccauuaugaacucacuagaaagaauuacauggucaaaaaccugaagagguuccggaaacagcuugagcgcgaagccggcaagcuggaggcggcuaaaugcgacuuuuuccccaagaccuuugagaugccuugugaauaucacuuguucguggaggaauuucgaaagaauccagguaucacauggauuaugaaacccguugccagaagccaggggaagggaaucuuccucuuuaggcggcugaaagauauuguggacuggcguaaggauacccgcuccucugacgaucaaaaagacgauaucccugucgagaacuacguggcacagagauauauagaaaauccauaccugaucggcggcaggaaguucgaccuccggguauacguuuuagugaugucggucuuugccgagugccugcuuuggucagggcaccgacgccaggacgugcauuugacuaacguggcuguccagaaaacaagccccgauuaucacccuaagaagggauguaaauggacccugcaaagauucaggcaguaccuagcaaguaagcaugguccagaggccguugaaacgcuuuuccgggacauugauaauaucuuugugaaaucccugcagucuguacagaaggugauuaucagcgacaaacacugcuucgagcuuuauggcuacgauauacugauugaccaagauuugaagccguggcuccuggaagucaacgcuucccccucauuaacugccaguagccaggaggacuaugaacugaagaccugucuccuugaggauacacugcacgugguugacauggaggcgcgcuugacugggagagagaaaagggugggaggcuuugaucuaauguggaaugacgguccugucucucgugaagaaggggcaccagaccuguccggaaugggcaacuucgugaccaauacacaucucggcugcguaaacgaucggaagaaacagcugcgacaacucuuuuguucacugcagguucagaagaaagccagcaguuga

SEQ ID NO: 64368 - RNA, 837 nt, Artificial Sequence
  derived and/or modified sequence opt3 from TTPA__Homo_sapiens__NP_000361
auggccgaggcuagaagccagcccuccgcaggcccucaacugaacgcccucccagaccacucuccgcuucugcagcccggguuggcggcuuuaaggcggcgcgcccgagaagcaggagugccucuggccccacuaccccucaccgauucauuccugcuucguuuucugagagcuagggacuucgauuuggaccucgcauggcggcugcugaagaauuacuauaaauggcgcgccgagugcccugaaaucagugcugaucuccauccaagaagcauuauagguuuacugaaggccggcuaccacgggguccuuaggucccgggaccccacaggaucuaaaguuuugaucuaucgcauugcgcauugggauccuaagguguuuacugcauacgacguauuccgagugucgcugaucacgucagagcuaauuguccaggaaguggagacccagagaaacggcaucaaagccauauuugaucucgaggguuggcaauucagccacgcuuuucagaucacaccaaguguugccaagaagauugcagcugugcugacugacuccuucccgcuuaaagucagggggauccaucugauuaaugaacccgugaucuuucacgccguauucucuaugauaaagccauuuuugaccgagaaaauuaaggaacggauccacaugcauggaaacaauuauaaacagagccuccugcagcacuucccugauauuuuaccccuggaguacggcggcgaggaauuuuccauggaggacaucugucaagaauggacaaacuucaucaugaagucagaggauuaucucaguagcauuucugaauccauacaguga

SEQ ID NO: 64369 - RNA, 444 nt, Artificial Sequence
  derived and/or modified sequence opt3 from TTR__Homo_sapiens__NP_000362
auggccagccacagacugcuccuucugugcuuggcuggcuuaguguucgucuccgaggcagggcccaccggaacaggugaaucuaaguguccucugaugguuaaagugcuagacgccguaaggggcucaccagcgaucaacguggcuguccauguguuucggaaggccgcagaugacacuugggagccguucgccagugggaaaacgagcgaauccggagagcuccacggccugaccacagaagaggaguuuguugaagguauuuacaagguggagauagauacuaaaucuuauuggaaggcucuugggaucucgcccuuccaugaacacgcagaggucguguuuaccgccaaugacucaggaccucgccgauacacaauugcugcccuguugagcccauauaguuacuccaccacugcgguaguuacaaaccccaaggaguga

SEQ ID NO: 64370 - RNA, 1383 nt, Artificial Sequence
  derived and/or modified sequence opt3 from TTYH1__Homo_sapiens__NP_001005367
augggcgcucccccuggguacagaccaagcgccugggugcaucugcuccaccagcuuccgagggcagacuuccaacugcggcccgucccuuccguuuucgccccacaggagcaggaauaucagcaagcguuguuacugguggcugcccuagcaggacucggucugggccuuucucugaucuucauugccguauacuugauacgcuuuugcuguugccgacccccugagccacccgggucaaagaucccuaguccaggaggcgguugugugaccuggagcugcauugucgcucuccuggcaggguguacaggaaucggcauuggcuucuaugggaacuccgaaacuucugauggagugucgcagcugucaagcgcccucuuacacgcuaaucauacgcugaguaccaucgaccaccuuguuuuggagacaguggaacgucugggugaggccgucagaacugagcuaaccacacucgaagaggugcuggaaccgaggaccgagcuuguagcggcagcccggggcgcucgcagacaggccgaggcagcugcccagcaacugcagggguuggcguuuuggcagggaguuccccucuccccuuuacagguggccgaaaacgucucuuucguggaggaauacagguggcuggcauaugugcugcuccuucuguuggagcuacuggucugccucuuuacucugcuuggccuggcuaaacaaagcaagugguugguuauagugaugacaguaaugucccuccugguguuaguccugucaugggguaguauggggcuagaagccgcuaccgccgugggacucagcgauuucuguucuaauccagaccccuacguucugaaccuuacgcaggaggagacuggcuuguccucagauauccugagcuauuaccuccugugcaaucgggcagugaguaacccuuuucagcaacgccuuacccugucucagcgagccuuggcuaauauucauucccagcuccugggcuuagaaagagaggcggucccacaguuccccagcgcacaaaaaccgcugcuaucgcucgaagagacacugaacgugacugaagggaauuuucaccagcuuguagccuugcugcacuguaggucucuccauaaggacuacggagcugcccugcgggguuuaugcgaggaugcacuggagggccuuuuguuccuccugcuauuuucccugcucucagccggggcucuggccaccgcacuuuguaguuugccucgugcgugggcucuguuucccccacgcaacccuagcgccuuaugcuccggaucuagacucagcgaaccccugcuuccagcaggccuggagcccgguucaccuuugaggaguuucccagggugccggcgacgcccgcacuga

SEQ ID NO: 64371 - RNA, 1605 nt, Artificial Sequence
  derived and/or modified sequence opt3 from TTYH2__Homo_sapiens__NP_116035
augcaggccgcuagaguggacuacaucgcacccuggugggucguuuggcugcacagcgugccucauguaggccucaggcuucaaccagugaacuccaccuucucuccgggggaugagucauaucaggaaagucuguuguuuuuaggacuggucgccgcggugugccuaggucucaaucugauuuuccuuguugcuuaccuggugugugccugccacugucggcgcgacgaugcaguccagacaaagcagcaucacagcugcuguauaacuuggacggccgugguagcuggcuugaucugcugugcagccguuggggugggauuuuauggcaacuccgagaccaaugacggugcuuaccaacucauguauucucuggaugacgccaaccauacauucucggggauugaugcgcuggucucaggaacuacccagaaaaugaagguggaccucgaacagcacuuagcacgacugagcgagaucuuugccgcucguggcgauuaccuucagacauugaaauucauucaacagauggccggcaguguggucguucagcuguccgggcuacccguguggagagaaguaaccauggagcucacuaagcugucugaccagacaggauauguggaguacuacagguggcuuagcuaucuguugcucuuuauccuggauuuagucauaugccugaucgcaugucucggucuugcuaaacgguccaagugccuguuggccucaaugcuauguugcggcgcgcugagucuccugcuuagcugggccucucuggcagcugacggguccgccgcuguggccaccucagauuucugcguugcaccugacacguuuauuuugaaugugacugaaggacaaaucagcaccgaggucacacgcuacuaucucuacuguagucagucuggcuccagcccauuccagcaaacucugaccacauuucagagagccuuaaccacgaugcagauucagguggcuggucugcuacaauucgcgguaccccucuuuucgacugcagaagaggaccugcuugccauccaguugcugcucaacucuuccgagucaagucugcaccagcuuacagcuaugguugauugcagggggcugcauaaggacuauuuggaugcccucgcaggaauauguuacgacggccugcagggcuuacuguaucuaggacucuucagcuuccuggccgcucuugccuuuuccaccaugauuugcgcagggccucgggcguggaaacacuucacuacacgcaaucgagauuacgacgauaucgacgaugacgauccauuuaacccccaggcuuggagaauggccgcacauucuccuccaaggggucaauugcacagcuucuguucauacaguuccggccuggggagccagaccucucuccagccgcccgcccaaacgauuucaaaugcuccugugagugaauauaugaaccaggccaugcuguuuggacggaauccacguuacgagaacguccccuuaaucggccgcgcaagcccuccacccaccuauuccccgucuaugagagcuacauaccugucgguggccgacgaacaccuuaggcauuaugguaaucaguucccugcguga

SEQ ID NO: 64372 - RNA, 1356 nt, Artificial Sequence
  derived and/or modified sequence opt3 from TUBA1A__Homo_sapiens__NP_001257328
augagagagugcaucagcauucacgugggccaggccgggguccaaauaggaaacgcuuguugggaacuguacugccucgagcaugguauccagcccgacggccagaugccuuccgauaagaccauugggggaggcgacgauucuuucaauacauuuuucucagaaacuggugcagggaaacacguuccaagggccguguuuguagaccuugagccgacggugaucgaugaaguccggaccggaacauaucgccagcuguuccaucccgagcaauugauuacuggcaaggaggacgcggcuaacaauuacgcccgaggccacuauaccaucgggaaagaaauaaucgauuuagugcuggaccguauuagaaagcuagcagaucaguguacaggacuccaggguuuucugguuuuccauaguuuuggcgggggaaccggcagcgguuucacuucccuucugauggagagguugucuguggacuacgggaaaaagucgaagcucgaauuuucaaucuauccugccccacaggucagcacagcugugguagagcccuacaacaguauucugaccacgcacacuacccuggagcacuccgauugcgcauucaugguugacaaugaagccaucuaugauauaugucggcgcaaccucgacauugagagaccuacauacacuaauuuaaacaggcugaucggacaaauugugucuagcaucaccgcuucccuucgguuugacggcgccuugaaugucgaucugacagaguuccagaccaaccuagugccauacccccgcauccauuuuccucucgcgacguaugcaccagugauuucagccgaaaaggcuuaccacgaacagcugagugucgccgagauaacuaaugcaugcuucgagccggcuaaccagaugguuaaaugugacccccgacauggcaaauauauggccugcugucuucuguacagaggggaugugguaccuaaggacgugaaugcggccaucgcaacaauuaaaaccaagaggacuauccaauucgucgauuggugcccaacaggauuuaagguggguauaaacuaucagcccccuaccguugugccaggcggggacuuggcuaaaguccagcgggccguguguaugcucagcaauacgaccgcuauugccgaagcaugggcccgucuggaucacaaguucgacuuaauguacgcuaaacgcgcguuuguacacugguauguuggagagggcauggaagagggugaguucucugaagcaagagaggauauggccgcucuggaaaaggacuacgaggaagugggggucgauuccguggagggcgaaggagaggaggaaggcgaggaauacuga

SEQ ID NO: 64373 - RNA, 1356 nt, Artificial Sequence
  derived and/or modified sequence opt3 from TUBA1B__Homo_sapiens__NP_006073
augagagagugcaucagcauucacgugggccaggccgggguccaaauaggaaacgcuuguugggaacuguacugccucgagcaugguauccagcccgacggccagaugccuuccgauaagaccauugggggaggcgacgauucuuucaauacauuuuucucagaaacuggugcagggaaacacguuccaagggccguguuuguagaccuugagccgacggugaucgaugaaguccggaccggaacauaucgccagcuguuccaucccgagcaauugauuacuggcaaggaggacgcggcuaacaauuacgcccgaggccacuauaccaucgggaaagaaauaaucgauuuagugcuggaccguauuagaaagcuagcagaucaguguacaggacuccaggguuuucugguuuuccauaguuuuggcgggggaaccggcagcgguuucacuucccuucugauggagagguugucuguggacuacgggaaaaagucgaagcucgaauuuucaaucuauccugccccacaggucagcacagcugugguagagcccuacaacaguauucugaccacgcacacuacccuggagcacuccgauugcgcauucaugguugacaaugaagccaucuaugauauaugucggcgcaaccucgacauugagagaccuacauacacuaauuuaaacaggcugaucucucaaauugugagcuccaucaccgcuucacuucgguuugacggagccuugaaugucgaucugacagaguuccagaccaaccuagugccauacccccgcauccauuuuccucucgcgacguaugcaccagugauuagugccgaaaaggcuuaccacgaacagcugagcgucgccgagauaacuaaugcaugcuucgagccggcuaaccagaugguuaaaugugacccccgacauggcaaauauauggccugcugucuucuguacagaggcgaugugguaccuaaggacgugaaugcggccaucgcaacaauuaaaaccaagaggucuauccaauucgucgauuggugcccaacuggguuuaaggugggaauaaacuaucagcccccuacaguugugccagguggcgacuuggcuaaaguccagcgggccguguguaugcucuccaauaccacggcuauugccgaagcaugggcccgucuggaucacaaguucgacuuaauguacgcuaaacgcgcguuuguacacugguauguuggggagggaauggaagagggcgaguucucagaagcaagagaggauauggccgcucuggaaaaggacuacgaggaagugggugucgauagcguggagggggaaggcgaggaggaaggagaggaauacuga

SEQ ID NO: 64374 - RNA, 1245 nt, Artificial Sequence
  derived and/or modified sequence opt3 from TUBA1C__Homo_sapiens__NP_001290046
augcccagcgacaagaccaucggcgggggagaugacuccuucaacacauuuuucucugagacuggugccggcaaacacgugccuagagcugucuuuguugaucuggaaccaacggugauugacgagguaaggaccgggacauaccggcaacucuuccauccggaacagcuuauaacuggaaaggaggaugcagccaauaacuaugcgcgcggccacuacaccaucgguaaagaaauuaucgaccugguguuggaucguauucgaaaguuagcugaccagugcacagggcugcagggauuucuagucuuccauucauuuggcggcgggaccggaagugguuucacuagccuccugauggagagacuuuccguggauuauggcaaaaagucuaagcuggaguuuucgaucuaccccgccccucagguuucaacagcaguggucgaaccauauaauagcauauugaccacgcacacuacccucgagcauagugacugugccuucaugguggauaacgaagcuaucuacgacauuugcaggcggaaucuggauaucgagcgccccacauauacuaaccugaauagacucauuucccaaaucguaucuagcauaaccgcauccuuaagguuugacggggcccugaacguugaccuuacagaguuccagaccaauuuggugccuuacccacggauucacuuuccccuggcuacguacgccccugucaucucagcggaaaaagcauaucacgagcagcuaacuguggccgaaauuacaaacgcuuguuucgagccagccaaucagauggugaagugcgauccgcgccauggaaaauacauggcauguugccuccuguaucgaggcgacgucguucccaaggaugugaacgcugccaucgcgaccaucaaaacuaagagaacaauucaauucguagacugguguccuaccgguuuuaagguggggauaaauuaccagccacccacggucgugccuggaggcgaucuugccaaaguucagagggcagugugcaugcugaguaacaccacagcugucgccgaggcuugggcccgguuggaccacaaguucgaucucauguaugcaaaacgugccuuugugcauugguacguaggcgaagggauggaggaaggagaguucagcgaagcucgcgaggacauggcggcacuggaaaaggauuaugaggagguuggugccgacucugcugauggcgaagacgagggggaagaguacuga

SEQ ID NO: 64375 - RNA, 1353 nt, Artificial Sequence
  derived and/or modified sequence opt3 from TUBA3D__Homo_sapiens__NP_525125
augagagagugcaucagcauucacgugggccaggccgggguccaaauaggaaacgcuuguugggaacuguacugccucgagcaugguauccagcccgacggccagaugccuuccgauaagaccauugggggaggcgacgauucuuucaauacauuuuucucagaaacuggugcagggaaacacguuccaagggccguguuuguagaccuugagccgacgguggucgaugaagugcggaccggaacauaucgccagcuguuccaucccgagcaauugaucacuggcaaggaggacgcggcuaacaauuacgcccgaggccacuauaccauugggaaagaaaucguugauuuagugcuggaccguauaagaaagcuagcagaucucuguacaggacugcaggguuuucuuaucuuccauaguuuuggcgggggaaccggcagcgguuucgccucccuguugauggagaggcucucugucgacuacgggaaaaagucgaagcuggaauuugcuauuuauccugcaccacaggugucaacugccguaguugagcccuacaacagcauccugacaacccacacgacucucgagcacagugauugcgcuuucaugguggacaaugaagccauuuaugauaucugucggcgcaacuuagacauagagagaccuaccuacacaaaucugaacaggcuuauuggacagaucgucuccucuauuacugcgagcuugcgguuugacggcgcacugaauguggaucuaaccgaguuccaaacaaaccucgugccauacccccgcauccauuuuccucuggccaccuaugcuccagucaucuccgccgaaaaagcauaccacgaacagcuuucaguugcugagauuacgaaugccugcuucgagccggcgaaccagauggugaagugugacccccgacauggcaaauauauggccugcuguaugcuguacagaggggauguagugccuaaggacgucaaugcagcuauagccacuaucaaaacaaagaggaccauucaguucguggauuggugcccaacuggauuuaagguugguaucaacuaucaacccccuacaguggucccaggcggggacuuggcuaaagugcagcgggccguauguaugcucaguaauaccacggcaauagccgaggcuugggcgcgucuggaucacaaguucgacuuaauguacgcaaaacgcgccuuuguucacugguaugugggagaaggcauggaagagggugaguucagcgaagcuagagaggaucuggccgcacucgaaaaggacuacgaggaagucgggguggauucugucgaggccgaagcugaggagggcgaagaguacuga

SEQ ID NO: 64376 - RNA, 1302 nt, Artificial Sequence
  derived and/or modified sequence opt3 from TUBA4A__Homo_sapiens__NP_001265481
augggcaacgccugcugggagcuguacugucucgaacacgggauccagccggacggacaaaugccuagcgauaagaccauugguggcggggacgauuccuucacaacguuuuucugcgagacuggagcuggcaaacaugugccaagagcagucuuuguugaccuugaaccgaccgugauagaugagaucaggaauggucccuaucggcagcuguuccacccugaacaguugauuacagggaaggaggacgccgcgaacaauuacgcucgcggacauuauacuaucggcaaagagauuaucgauccaguauuagaccgaauacguaagcugucugaucaguguaccggccuacaaggguuucucguguuccacucauuuggagguggcacagggaguggauucaccagccugcuuauggaaagacuguccgucgacuacggcaaaaagucuaaguuggaguuuucgaucuaucccgccccucaggugucaacugcaguuguggaaccauacaacagcauucucacaacccauacgacucuggagcacagugauugcgccuucauggucgacaaugaggcuaucuaugauauuuguaggcggaaccuggacaucgaacgccccaccuacacaaaucucaacagauuaauaucccagauugugucuagcaucacugcaucccugagguuugacggugcccuuaauguagauuugaccgaguuccagacaaaccugguuccuuacccacggauucacuuuccgcuagcuaccuaugcccccgugaucucagcggaaaaagcauaccaugagcaacucagugucgccgaaaucacgaaugcuugcuucgagccugccaaccagauggugaagugugacccacgccacgggaaauauauggcaugcugucugcuuuaccgaggagaugugguccccaaggacguuaaugcugccauugcggccauaaaaacuaagagaagcauccaguucguggauuggugcccuacaggcuuuaagguaggcauuaacuaucagccacccaccgugguccccgggggagaccuggcaaaagugcaaagggcuguuuguauguugucuaauacuacagccaucgcugaggccugggcacggcucgaucauaaguucgaccugauguacgccaaacgugcuuuugugcacugguaugucggugaaggcauggaggaaggggaguucuccgaagcgcgcgaggauauggcagccuuagagaaggacuacgaagaggugggaauagauucauacgaagacgaggacgaaggcgaggaguga

SEQ ID NO: 64377 - RNA, 1152 nt, Artificial Sequence
  derived and/or modified sequence opt3 from TUBA8__Homo_sapiens__NP_001180343
augaucgaccuggaacccaccguggucgaugaaguuagagccggcacauacaggcaacucuuccacccugagcagcuuauuacugggaaggaagacgcugcaaacaauuaugcccggggacauuacacgguggguaaagagagcauagaucugguauuggaccgcauccgaaaguuaaccgaugcgugcuccggccugcagggguuucuaauuuuccacucuuuuggaggcgguacagggucaggauucaccagucuccugauggaacgucuuagccuggacuauggcaaaaaguccaaauuggaguuugcuaucuacccagccccgcaagugucuacugcagucguggagcccuauaacucgauucucacaacccauacuacacuggaacacucagauugugccuucaugguugacaaugaggcuaucuacgauauaugcagaaggaaccuggacaucgaacggccuaccuauacgaaucucaaccgcuuaauuagccagaucgugaguuccauuacugcaucucugagauuugauggcgcccuuaaugucgacuugaccgaguuccagacaaaccuggugccauaccccaggauccauuuuccucuaguaacuuacgcuccaauaauuagcgccgagaaggcguaucacgaacagcucuccguugcagagaucaccucaaguuguuucgaacccaauagccagauggugaagugcgauccucggcacgggaaauacauggccuguugcaugcuguaucgcggagacgucgugccaaaggacgugaacgucgcuauugccgcaaucaaaacaaagcgaaccauccaguuuguugauugguguccgacggguuucaaagugggcauuaauuaccaacccccuacuguagugccagggggagaccuugcuaagguccagagagccgugugcaugcugucuaacacaaccgcgauagccgaggcaugggcuagguuggaucauaaguuugaccucauguaugccaaacgggcuuucguucacugguacgugggcgaagguauggaggagggggaguucuccgaagcccgugaagaucuggcagccuuagagaaggacuaugaagaggucggaacugauucauuugaggaagagaaugaaggcgaggaguucuga

SEQ ID NO: 64378 - RNA, 1356 nt, Artificial Sequence
  derived and/or modified sequence opt3 from TUBB1__Homo_sapiens__NP_110400
augagagagaucgugcacauucagauaggccaaugcgggaaccagaucggagccaaguucugggaaaugauuggugaggaacauggcaucgaccuggcugggagcgauaggggagcauccgcccuccagcuugagcggauuucugucuacuauaaugaagcguacggccgcaaauauguuccccgagcugugcugguagacuuggagccugguaccauggauucaauccguaguagcaaguuaggggcccuguuucagccagacuccuucgugcacggaaacucuggcgcaggcaauaacugggccaaagggcauuacacagagggagcugaacuaauagagaauguccucgaagugguuagacacgagucggagucaugugauugccugcaagguuuucagaucgugcauagccuuggcgggggaacuggcagugguauggggacgcuguugaugaacaagauuagggaagaguauccggaccggaucaugaacuccuucucugucaugcccagcccuaaaguguccgauaccguaguugaaccauacaaugcagugcucucaauucaccagcugaucgagaaugccgacgcuuguuuuugcauagauaacgaagcccuguaugacauuuguuuccgcacacucaaguuaacuacccccacauacggagaucugaaucaccuugucaguuugaccaugagcggcaucacuacaucucugagauuuccuggccagcuaaacgcggaccucaggaagcuggcagugaauauggugccauucccccggcuucacuuuuucaugccuggguuugccccacugaccgcucaaggaucccagcaguaccgcgccuugucagucgcagagcucacgcagcaaauguucgaugcucgaaacacuauggccgcgugcgaccugagaaggggucgguauuuaaccguugccuguauuuuucguggcaaaaugagcacaaaggagguggaccagcagcugcucaguguacaaacucgcaauucuuccugcuucguggaauggaucccgaacaacgucaaaguggcaguuugugauauucccccuagagggcuuagcauggcugccaccuucaucggaaauaacacagcuauacaggagaucuuuaauagggugucggaacauuucucugccauguuuaagcggaaagcauucguccauugguacaccuccgagggcauggacauuaacgaauuuggugaggccgagaauaacauccacgaucuggugucagaauaucagcaguuccaagacgcuaaggcgguauuggaggaagaugaggaaguuacggaggaggcagaaauggagccagaagacaaggggcacuga

SEQ ID NO: 64379 - RNA, 1338 nt, Artificial Sequence
  derived and/or modified sequence opt3 from TUBB2A__Homo_sapiens__NP_001060
augagagagaucgugcacauucaggccggccaaugcgggaaccagauaggagcuaaguucugggaagucaucagcgacgagcaugguauugaucccaccggcuccuaccacggggacucugaucugcagcucgaaaggaucaauguuuauuacaacgaggcagccggaaauaaauaugugccucgggcgauucuuguagaccuggaaccaggcacaauggauucagugcgcagugguccguuugggcagaucuuccgacccgacaacuuugucuucggacaaagcggcgcuggcaauaacugggccaaggggcauuacacugagggagcagaguugguggauuccguuuuagacgugguccguaaagaaucugagucgugugauugccugcaggguuuucagcuaacgcacucacucggcgggggaaccggcagcgguauggggacacugcuuauaaguaagaucagagaagaguauccugacaggauuaugaauacuuucuccgugaugccaucucccaaaguaagcgauaccguuguggagccuuacaacgccacacuguccguccaucaguugguggaaaauaccgacgagacuuauucaaucgauaacgaagcucucuacgacauuuguuuucggacacugaagcugaccacgccaacuuacggagaccucaaucacuuagugagugcaaccaugagcggcgucacaacuugccugcgcuuccccggccaacuuaacgccgauuugagaaagcuggcuguuaauauggugccuuuuccaaggcuacacuucuuuaugccgggguucgcgccccucaccucucggggaucccagcaguaucgcgcccugacaguaccugagcuuacccagcaaauguuugacagcaaaaacaugauggcagccugugauccacgacaugguagauaccugacgguggcugccaucuucaggggccggaugucaaugaaggaagucgacgagcagauguugaaugugcagaacaaaaacaguucuuauuucguugaguggauacccaauaacgugaagacugcagucugcgauauuccuccacgugggcucaaaauguccgcuacauuuaucggaaauagcaccgccauucaagaacuguucaagcgcaucucggagcaguuuacugcgauguucagaaggaaggccuuuuuacacugguacacaggcgaagguauggacgagauggaguucaccgaagcagagucuaacaugaaugaucugguguccgaauaucagcaguaccaagacgcuacggccgaugagcagggggaauuugaggaagaggagggcgaagacgaggcuuga

SEQ ID NO: 64380 - RNA, 1338 nt, Artificial Sequence
  derived and/or modified sequence opt3 from TUBB2B__Homo_sapiens__NP_821080
augagagagaucgugcacauucaggccggccaaugcgggaaccagauaggagcuaaguucugggaagucaucagcgacgagcaugguauugaucccaccggcuccuaccacggggacucugaucugcagcucgaaaggaucaauguuuauuacaacgaggcaacaggaaauaaauaugugccucgggccauucuuguagaccuggaaccaggcacuauggauucagugcgcagugguccguuugggcagaucuuccgacccgacaacuuugucuucggacaaagcggcgcgggcaauaacugggcuaaggggcauuacacggagggagccgaguugguggauuccguuuuagacgugguccguaaagaaucugagucgugugauugccugcaggguuuucagcuaacccacucacucggcgggggaacaggcagcgguauggggacucugcuuauaaguaagaucagagaagaguauccugacaggauuaugaauaccuucuccgugaugccaucucccaaaguaagcgauacaguuguggagccuuacaacgcaacccuguccguccaucaguugguggaaaauacugacgagacauauuguaucgauaacgaagcccucuacgacauuugcuuucggacccugaagcugacgacuccaaccuacggagaccucaaucacuuagugucagcuacaaugaguggcgucacuaccugucugcgcuuccccggccaacuuaacgcagauuugagaaagcuggccguuaauauggugccuuuuccaaggcuacacuucuuuaugccgggguucgcuccccucacaagccggggaucucagcaguaucgcgcccugaccguaccugagcuuacgcagcaaauguuugacuccaaaaacaugauggcggcaugcgauccacgacaugguagauaccugacuguggccgcuaucuucaggggccggaugucaaugaaggaagucgacgagcagauguugaaugugcagaacaaaaacagcaguuauuucguugaguggauacccaauaacgugaagacagccgucugugauauuccuccacgugggcucaaaaugucugcaaccuuuaucggaaauuccacugcuauucaagaacuguucaagcgcaucagcgagcaguuuacagccauguucagaaggaaggcguuuuuacacugguacaccggcgaagguauggacgagauggaguucacggaagccgagucgaacaugaaugaucuggugucugaauaucagcaguaccaagacgcaaccgcugaugagcagggggaauuugaggaagaggagggcgaagacgaggccuga

SEQ ID NO: 64381 - RNA, 1137 nt, Artificial Sequence
  derived and/or modified sequence opt3 from TUBB3__Homo_sapiens__NP_001184110
auggacagcgugagauccggcgccuucgggcaccuguuuaggcccgauaacuucaucuuuggacagucuggugcuggcaauaacugggcaaaggggcauuacaccgagggagccgaacucgucgacucaguucuugaugugguacggaaagagugcgaaaauugugacugccugcaaggcuuccaguugacacacaguuuaggugggggaacuggcagcggcauggggacgcugcuaauuuccaaggugcgcgaggaauauccugaucgaauaaugaacaccuuuucugucgugccaucgccgaaaguuucagacacaguggucgagcccuacaaugcgacucucagcauccaucagcugguggagaacaccgaugaaacauauuguauugacaaugaggcucuuuacgauaucugcuuccguacccugaaguuggccacuccuacauauggagaccucaaccaccugguaagugcaaccauguccgguguuacgacuucucugagauuuccaggccagcucaaugccgauuuaaggaaacuggcugugaacaugguccccuucccucggcuucacuuuuucaugccaggguuugcacccuugaccgcccgcggaagccaacaguacagagcucugacagugccugaacuaacucagcagauguucgacgccaagaauaugauggcggcaugugauccaaggcauggccgguaucucaccguggccacagucuuucgcggucgaauguccaugaaggagguugacgagcaaaugcuggcuauucagaguaaaaacucaagcuacuucguggaauggaucccgaauaacguaaagguggccgucugcgacauacccccuagagggcuuaaaaugucuuccaccuucaucggaaauucaacggcaauucaggagcuguuuaagaggaucagcgaacaguucacugcuauguuucggcguaaagccuucuugcacugguacacaggcgagggcauggaugaaauggaguuuaccgaggcggaaaguaacaugaacgaccucgugucugaguaucaacaguaccaggaugccacugcagaagaggaaggggagauguaugaggacgaugaagaggaauccgaggcucaaggaccaaaguga

SEQ ID NO: 64382 - RNA, 1470 nt, Artificial Sequence
  derived and/or modified sequence opt3 from TUBB4A__Homo_sapiens__NP_001276056
augagaaggggcgccgcugaccgggagaccgaagggcccugcagcgcaguguccgccgcgucuucaacacuggcugccgcagccgcuccucgcgcacgagccacugcugccgcgaguacgcucagcgcaaccgccaugcgugagaucguccaccuucaggcuggacaaugugguaaccagauuggcgccaaguucugggaaguuauauccgaugagcaugggaucgacccaacaggaacuuaccacggcgauucugaccugcaguuggaaagaauuaauguguauuacaacgaggcaaccggugggaauuauguaccgagggcuguguuagucgaucuggagcccggaacaauggacucggugcggucaggcccuuuuggccagaucuuccgcccagauaacuuuguuuucgggcaaagcggagccgguaauaacugggcgaaaggccauuacaccgaaggggccgagcuaguggacgcaguccucgaugugguaagaaaggaagcugagaguugcgacugucugcagggauuucagcuuacucacucccugggcggugggacaggaucuggcaugggcaccuugcucauuagcaaaaucagggaggaguuccccgaucggauaaugaauacguuuuccguugugccuucaccaaaggucagugacacugugguggaacccuauaacgccacccugagcguccaucagcugguugaaaauacagaugagacuuacugcaucgacaacgaagcucucuaugacauuuguuuccgcaccuuaaaacugacaaccccuacguacggggaucuuaaucacuuggugucugccacuauguccggaguaacaaccugccugcgauuuccaggucaacuaaacgcagaccucagaaagcuggccgugaauauggucccguuccccaggcuucacuuuuucaugccuggcuuugcuccacugacuucacgggggagccagcaguaccgugcguugacagugcccgagcucacccagcaaauguucgaugcaaagaacaugauggccgcuugugacccucgccauggaagauaucugacgguugccgcaguguucaggggccggaugaguaugaaagaggucgaugaacagauguuaucugugcaguccaagaauagcucguacuuuguagaguggaucccaaacaacguuaaaaccgccgugugcgacauucccccgcgaggucugaagauggcugccacauucaucggcaauucuacugcaauacaagaacucuuuaaacgcauuuccgagcaguucaccgcgauguuuagaaggaaggcuuuccuucacugguauacaggggaaggaauggaugagauggaguuuacugaagccgagucaaacaugaaugaccuggucagugaauaccagcaguaucaagaugcaaccgccgaggaaggcgaguucgaggaagaggcugaagaggagguggccuga

SEQ ID NO: 64383 - RNA, 1338 nt, Artificial Sequence
  derived and/or modified sequence opt3 from TUBB4B__Homo_sapiens__NP_006079
augagagagaucgugcaucugcaggccggccaaugcgggaaccagauuggagcuaaguucugggaagucauaagcgacgagcacgguaucgaucccaccggcacauaccacggggacuccgaucuccagcuugaaaggauuaauguuuauuacaacgaggcaacuggaggcaaauaugugccucgggccguacugguggacuuggaaccagguacgauggauucuguccgcucagggccguuuggacagaucuuccgacccgacaauuuuguguucggccaaaguggcgcggggaacaauugggcuaagggacauuacaccgagggugccgaguuaguugauagcgugcuggacgucgugcguaaagaagcagaguccugugauugccuacagggcuuucagcucacacacucucuugggggaggcacugguucggggaugggaacccugcugauuucaaagaucagagaagaguauccugacaggauaaugaacacauucagcguaguuccaagucccaaaguguccgauaccgucguggagccuuacaaugccacuuugucugugcaucagcucgucgaaaacacagacgagaccuauuguaucgauaaugaagcucuguacgacauuugcuuucggacgcugaagcucacuaccccaacauacggcgacuuaaaccaccugguuagcgcaacuauguccggcgugaccacaugucuucgcuuccccgggcaauugaaugccgaucugagaaagcuagcuguaaacauggugccuuuuccaaggcuccacuucuuuaugccgggauucgcaccccugaccucacgggguagucagcaguaucgcgcgcuuacggucccugagcugacucagcaaauguuugacgccaaaaauaugauggccgcuugcgauccacgacauggcagauacuugacaguggccgcaguuuucagggggcggaugagcaugaaggaaguggacgagcagaugcucaacguccagaauaaaaacucuuccuauuucguggaguggauccccaacaauguaaagaccgcuguuugugauauuccuccacguggacugaaaaugucagccacuuuuaucggcaacagcacagcgauacaagaauuauucaagcgcauuagugagcaguuuaccgccauguucagaaggaaggcauuucugcacugguacacgggugaagggauggacgagauggaguucaccgaagcugagucuaauaugaacgaucucguguccgaauaucagcaguaccaagacgccacagcugaggaagagggcgaauuugaggaggaagccgaggaagaggucgcauga

SEQ ID NO: 64384 - RNA, 1230 nt, Artificial Sequence
  derived and/or modified sequence opt3 from TUBB6__Homo_sapiens__NP_001290455
augagagagaucgugcacauucaggccggccaaugcgggaaccagauaggaaccaaguucugggaagucaucagcgacgagcaugguauugaucccgcuggcggguacguuggagacuccgcacugcagcucgaaaggaucaauguguauuacaacgagucuucaugucagacaggcgccgguaauaacugggcgaaagggcacuauacugaaggagcugagcuuguagaugccgugcuggacgucgugcggaaggagugcgaacauugugauugcuugcaaggcuuucaguuaacgcacagucugggcgggggaaccgguagcggcauggggacacuacucauuuccaaaauccgcgaggaguucccugaccgaauaaugaauacuuuuucuguuaugccaucgccgaaggugucagauaccgucguggaacccuacaacgcaacacugagcguacaucagcuuguugagaauaccgacgaaacuuauuguaucgauaacgaggcccuguacgacauuugcuuccguacauugaaacucaccacgccuacuuauggagaucugaaucaccuggugagugcuaccauguccggcgucacaacuucucucagauuuccaggucaguuaaacgcagaccugaggaaacuugccgugaauauggugcccuucccucgguugcacuuuuucaugccaggguuugcuccccugaccagccgcggaucccaacaguacagagcccuaacagucccugaacucacccagcagauguucgaugcgaggaacaugauggcagccugugacccacggcauggccgcuaccugacgguugcuacuguguuucgaggcccgaugucaaugaaggagguagacgaacaaaugcuugccauccagaguaagaauagcucuuauuucguggaguggauucccaacaaugucaagguggcaguuugcgauaucccuccaagagggcugaaaauggcuuccacauuuauaggaaacucaaccgccauucaggaguuguucaagaggaucagcgaacaauucagugcgauguuucggcguaaagccuuccuccacugguuuacuggugagggcauggacgaaauggaguucacagaagcagagucuaacaugaaugaucugguguccgaguaccagcaguaucaggacgcuaccgccaacgauggggaagaggcuuuugaagacgaggaagaggagauugauggauga

SEQ ID NO: 64385 - RNA, 729 nt, Artificial Sequence
  derived and/or modified sequence opt3 from TUBB__Homo_sapiens__NP_001280142
augagagagaucgugcacauucaggccggccaaugcgggaaccagauaggagcuaaguucugggaagucaucagcgacgagcaugguauugaucccaccggcacauaccacggggacuccgaucugcagcucgacaggaucucuguuuauuacaaugaagcaacuggaggcaaauaugugccucgggccauucuuguagaucuggagccagguacgauggacucagugcgcagugggccguuuggacagaucuuccgacccgauaacuuugucuucggccaaagcggcgcggggaauaacugggcuaagggacauuacaccgaaggugccgaguugguggacuccguuuuagaugugguccguaaagagguggacgaacagaugcugaauguacagaacaaaaauucuucguauuuuguugaguggauaccuaacaaugugaagacagcagucugugauaucccacccagaggccuaaagauggccgugacuuucauugggaacucaaccgcuauccaggaacucuuuaagaggauuagcgagcaauucacagcaauguuucggcgcaaagccuuccugcacugguacaccggagagggcauggacgaaauggaguuuacugaagcugagaguaauaugaacgaucuuguguccgaauaucagcaguaccaggacgccacagcggaggaggaagaggacuucggugaagaggcagaagaggaggccuga

SEQ ID NO: 64386 - RNA, 1197 nt, Artificial Sequence
  derived and/or modified sequence opt3 from TUBD1__Homo_sapiens__NP_001180538
augagcaucgugaccguccagcugggccaaugcgggaaccagauuggauucgagguuuuugacgcccuccuuuccgauucucacucaagucagggucuguguagcaugagagagaaugaggcuuaccaggcauccugcaaggaaagguucuuuucugaggaagagaacggcgugcccauagcccgggcgguauugguggacauggagccuaaagucaucaaucaaauguuaucgaaggcugcccagucagggcaguggaaauauggacagcaugcauguuucugccaaaagcagggcagcgguaacaauugggccuacggguauagugugcacggaccacgccaugaagaguccauuaugaacaucauucgaaaagaaguugagaagugugauucuuuuagcggcuucuuuaucauaauguccauggcuggcgggacaggaucaggucugggcgcauucgugacucagaaucuagaggaccaguacaguaacagccucaagaugaaucaaaucauuuggccguaugggacgggagaagucaucgugcagaacuacaauucuauucugacccuuucccaccuguaucguucaagcgaugccuugcuccugcaugagaacgacgcuauccacaaaauaugcgccaagcugaugaauauuaaacagaucaguuuuucugauauuaaccaaguacucgcgcaccaguuaggcuccguuuuccagcccacauacagcgcagaaucgucuuuucauuacagaaggaauccucuggguaucgaccggcacguguggccaccccuuuccggguugccuccacugucaaagaugagucuaaacaaagaucuccauuucaacacuagcaucgccaaucuggucauucuucgcggaaaggacgugcaguccgcugauguggagggcuuuaaggaccccgcccuguauaccucuugguugaaaccugucaacgcauucaauguuuggaagacacaaagagcuuucagcaaauacgaaaagucagccgugcucguaaguaacucccaguuucuggugaaaccauuagauaugauagucggcaaggcguggaauauguucgccagcaaagcauauauccaccaguacaccaaguuugggauugaggaggaagacuuccuggacucuuuuacuucacucgaacaggugguugcuaguuauuguaaccuuuga

SEQ ID NO: 64387 - RNA, 1428 nt, Artificial Sequence
  derived and/or modified sequence opt3 from TUBE1__Homo_sapiens__NP_057346
augacccagagcguggucguucaagugggccagugcgggaaccagaucggauguugcuucugggaccuggcccucagagagcacgcugcaguaaaucagaaggguauuuacgaugaagccauauccucauuuuucaggaacguggacacacgggucgugggcgaugggggaucuaucaguaaaggcaagauuuguagccuuaaagcgcgcgcuguucugaucgacauggaggaagguguggucaaugagauuuugcaagggcccuuacgagauguguuugacacuaagcagcugaucacggauauauccggaucuggcaacaauugggccguaggccauaaaguuuucgggucgcuauaucaggaccagauccucgaaaaguuucguaagucagcagagcacugcgauugucugcaaugcuucuuuauuauccauagcaugggagguggcaccgggaguggacuuggcacauuccuguugaaagugcucgaggacgaauuuccugaggucuacagauucgugacuuccauuuauccaucuggugaagaugacgugaucaccagcccguacaacuccauacuggccaugaaggagcugaaugagcacgcugauuguguccuccccauugacaaccagucauuauuugacaucauuaguaaaaucgaucugaugguuaauagcgggaagcugggaacaaccgugaaaccuaagucuuugguaacuuccucaagcggcgcacugaagaaacagcauaagaaaccauucgacgccaugaacaauaucguggcuaaccuacuccugaaucuuacaaguucugccagguuugaaggcucccugaacauggauuugaaugagauuagcaugaaccucguccccuucccucagcugcacuauuuagugucgucucugaccccacucuacacgcuuacugacguuaacauacccccucggcgccuggaucaaauguucuccgacgcguuuucaaaggaucaccaguugcuaagagcagacccaaaacauagucuguaucucgccugcgcucugauggugagggggaauguccagaucagcgaucuucggcgcaacauugaacgacugaagccguccuugcaauucgugucuuggaaucaggagggauggaaaaccagccucuguucaguacccccuguuggucacagucauucccuguuagcccuggcaaacaauacaugcgugaagccaacuuuuauggaacuaaaggagagauucaugaggcucuacaaaaagaaagcucaccuucaccauuaccuucaggucgagggcauggaagagagcuguuuuaccgaagccgugucuucauugagugcgcugauccaggaguaugaccaacucgaugccacaaagaacaugcccguccaggaccugccucggcuuagcauagcaauguga

SEQ ID NO: 64388 - RNA, 1356 nt, Artificial Sequence
  derived and/or modified sequence opt3 from TUBG1__Homo_sapiens__NP_001061
augcccagagagaucauuacccugcagcucggccaaugcgggaaccagauaggauucgaauuuuggaagcagcuuugugccgagcacgguaucagcccugaaggcauuguggaggaguucgcuacagaagggacugacaggaaagaugucuuuuucuaccaggcagacgaugagcauuauaucccacgggccguucuguuggacuuagaaccgcgcgugauucacuccauccugaauagccccuacgcgaagcuauauaacccugagaauauauaccucucagaacauggaggcggugcugggaacaauugggccaguggauuuagccaaggcgagaaaauccacgaggauauuuucgacaucauugaucgagaagcagacggcuccgauucucuggagggguuuguacuuugccauucgaucgccggagguacgggcucagggcugggaagcuauuugcucgaacgucugaacgacagauacccaaagaaacuggugcagaccuauagugucuuccccaaucaggaugagauguccgacgugguugugcagccuuacaacucucucuuaacacugaagaggcuuacucaaaaugcugauugugucgugguauuggacaacaccgcacugaaucggauagccacagaccgccuacacauucagaacccaucuuuuucccagaucaaucagcucguuucaaccauuaugagugcuagcacuacaacccugagauaccccggcuauaugaacaaugaucuuaucggucugaucgccucuuugauuccuacgccaaggcuccacuuccugaugacuggguacaccccguuaacaacugaccaauccguggcgucaguccggaagaccacagugcuggaugugaugcgccgacuccuucagcccaaaaacgucaugguuagcaccggaagagacaggcagacgaaccauugcuauauagcaauccugaauauuauccaaggcgaaguggauccuacucagguacacaagaguuugcagcggauacgugagcgcaaacuagccaacuuuauuccauggggccccgcuucuauccagguggcccuguccagaaagagcccuuaccucccaucggcacauagggucucugggcugaugauggcuaaucacacauccaucucaagucuuuucgagcggaccugucgacaauaugacaaacugcgcaagagagaagccuuuuuggagcaguucaggaaggaagauauguucaaagacaacuuugaugagauggacacuagccgggaaauugugcagcagcucaucgaugaguaccacgcggccacacgccccgacuauauuuccuggggaacccaagagcaguga

SEQ ID NO: 64389 - RNA, 1356 nt, Artificial Sequence
  derived and/or modified sequence opt3 from TUBG2__Homo_sapiens__NP_057521
augcccagagagaucauuacccugcagcucggccaaugcgggaaccagauaggauucgaauuuuggaagcagcuuugugccgagcacgguaucagcccugaaggcauuguggaggaguucgcuacagaagggacugacaggaaagaugucuuuuucuaccaggcagacgaugagcauuauaucccacgggccguucuguuggacuuagaaccgcgcgugauucacuccauccugaauagccccuacgcgaagcuauauaacccugagaauauauaccucucagaacauggaggcggugcugggaacaauugggccaguggauuuagccaaggcgagaaaauccacgaggauauuuucgacaucauugaucgagaagcagacggcuccgauucucuggagggguuuguacuuugccauucgaucgccggagguacgggcucagggcugggaagcuauuugcucgaacgucugaacgacagauacccaaagaaacuggugcagaccuauagugucuuccccuaccaggaugagauguccgacgugguugugcagccuuacaauucucucuuaacacugaagaggcuuacucaaaacgcugauugugucgugguauuggacaauaccgcacugaaccggauagccacagaccgccuacacauucagaauccaucuuuuucccagaucaaccagcucguuucaaccauuaugagugcuagcacuacaacccugagauaucccggcuacaugaauaacgaucuuaucggucugaucgccucuuugauuccuacgccaaggcuccacuuccugaugacuggguauaccccguuaacaacugaccaauccguggcgucaguccggaagaccacagugcuggaugugaugcgccgacuccuucagcccaaaaaugucaugguuagcaccggaagagacaggcagacgaaccauugcuacauagcaauccugaacauuauccaaggcgaaguggauccuacucagguacacaagaguuugcagcggauacgugagcgcaaacuagccaauuuuauuccauggggccccgcuucuauccagguggcccuguccagaaagagcccuuaucucccaucggcacauagggucucugggcugaugauggcuaaccacacauccaucucaagucuuuucgagagcuccugucaacaguuugacaaacugcggaagcgagaugccuucuuggaacaguuccgcaaggaggacauguuuaaagauaauuucgacgaaauggauagaucuagggaggugguucaggaacucauugacgaguaccacgcggccacccaacccgacuauaucagcuggggaacucaggagcaguga

SEQ ID NO: 64390 - RNA, 2793 nt, Artificial Sequence
  derived and/or modified sequence opt3 from TUBGCP2__Homo_sapiens__NP_001243546
augagcgaguucagaauccaccaugacgugaacgaacugcucucccuucugaggguccacggcggggauggagccgagguuuacauugacuuguuacagaagaaucggacccccuaugugacaacuacgguaucugcucauucagcaaaagugaagauagccgaauuuagucgcaccccugaggauuuccugaaaaaguacgacgaacuaaaaagcaagaacacacgaaaucucgauccacuggucuaucuucuguccaaguugacugaggacaaagagacccuccaauaccugcagcagaacgcgaaggaacgugcugagcuggccgcagccgcuguggguucuucgacaaccucaaucaauguuccggcagccgcuagcaaaauuaguaugcaggaacucgaggaguuaagaaagcaacugggcuccguggccacugggucuacacuucagcagagcuuggaacugaaaaggaagaugcuacgggauaagcagaacaaaaagaacuccggacaacaccuccccaucuuuccugcgugggucuaugagcgcccagcacugauuggcgacuuccuuaucggugccgggauaucaaccgauacggcucugcccaucguguugcucagauggaaucuggccuuaaguccuaggcugaaaugcagcggaguaauuucugcacauuguaaucuccaccuuccaggcacucugcccuuggcuucccaggaaucagccguuguggaggaccuacuguacguccucgugggcguggaugggcgguaugucagcgcgcagccucuggccggacgccagagucgaaccuuucuuguugacccaaaccuggauuugucuaucagagaacucgugcacaggauucugccgguagcagcuuccuacagcgccgugacacgguucaucgaggagaagucgucuuuugaauacggucaagucaaucaugcuuuagccgcagccaugcguacucuggugaaagagcaccuaauacucguuucccagcuggaacagcuucaucgccaaggcuugcugucacuccagaagcugugguucuauauucagcccgcuaugagaaccauggacauccuugcgagucuggcaacaagcguggacaaaggggagugcuugggaggcuccacccucucucuguuacacgauaggagcuuuucauacacgggugacagucaggcccaagaacugugucuauaucucacuaaggcugccuccgcaccuuacuucgagguccuggagaaguggauuuaucgggggaucauccacgauccauacagcgaauuuaugguggaggaacaugagcuucgaaaagaacgcauucaggaggacuauaacgauaaguacugggaccagagauacacaauaguacagcaacagauccccucuuucuugcagaaaauggccgauaagauucugucaaccggaaaauaucucaauguugugagggagugcggccacgacgucacuuguccuguggcuaaggaaaucauauacacacugaaggagcgggccuaugucgaacagauugagaaagcauuuaacuacgcgaguaagguguuacuggauuuccuuauggaggaaaaagaguugguugcucaucuccgcagcaucaagagauauuuccugauggaccaaggcgacuuuuucgugcacuuuauggaucuagccgaagaggaacugaggaaaccaguagaggacaucaccccuccgcgucucgaggcacugcuugaauuggcccugcggauguccacggcuaauaccgauccuuucaaggacgauuuaaagauugaccucaugccccaugaucugaucacacagcuucugcgagucuuggccauugagacuaaacaggaaaaggcaauggcucacgccgacccaaccgagcucgcgcugucugggcuagaagccuuuucguucgauuacauagugaaauggccucugagccucaucauuaacagaaaggcucugacaagguaucagaugcuuuuucgccacauguucuacugcaaacauguugagcggcaauuguguuccguguggaucucaaacaagacugcaaagcagcacagucugcauucugcccagugguuugcuggagccuucaccuuaagacaaaggaugcucaauuuuguccagaacauccaguacuauaugauguucgaggugauggaacccacauggcacauucuggagaaaaaucuuaagagcgcauccaacauagacgauguacugggucaccauaccggcuuucuagacacuugccucaaagauuguaugcugacgaauccagaauugcugaagguguucucaaaauuaaugagcguuugcgucauguucacaaacuguaugcagaaguuuacccaaucuaugaaacucgacggggagcugggaggccagacucuugaacacuccaccgugcuggguuugcccgcgggggccgaggagcgcgcucgaaaggaacucgcccggaagcaucuggcagagcacgcugauacagugcagcuagucaguggcuucgaagccaccaucaauaaauuugacaagaacuucagcgcacaucugcuugaccuccuggcccguuugucuauuuacuccacuucagauugcgagcacggaauggcuaguguuaucagcagacuggacuuuaauggcuucuauacagagagguuagaacgccucucggcggagcggucccagaaagccacgccucaagugccagugcugagagggccgcccgcacccgcuccaaggguagccgucaccgcccaguga

SEQ ID NO: 64391 - RNA, 2724 nt, Artificial Sequence
  derived and/or modified sequence opt3 from TUBGCP3__Homo_sapiens__NP_006313
auggccacccccgaccaaaagagcccuaacgugcugcuccagaaucuuugcuguagaauccugggcagguccgaggcugaugucgcacagcaguuccaguacgccguucgggugauugggucuaacuuugcgccaacaguagaacgcgacgaguucuugguggcugaaaagauaaagaaagaguuaauccgacaacguagagaagccgaugcagcccuguuuucagagcuacacaggaagcuccauagucagggaguccugaaaaauaaguggagcauucuuuaucuguugcucucccugucugaggacccgcggcgccagcccucgaaggugucaagcuacgcuacucuguucgcacaggcccucccuagagaugcucacaguacgccauauuacuaugccaggccccaaaccuuaccucuguccuaccaggaccggucugcgcagagcgcacaguccucagguaguguuggcagcucugggaucuccucaauuggacuuugcgccuugagcggcccagcucccgccccucaaagucugcuaccaggucagucuaaccaggcaccgggggugggagauugucuccgccaacagcugggcucccgacuugcuuggacacugacugccaaucagcccagcucgcaggcgaccacaucuaaaggcgucccuuccgccgugucaagaaacaugaccaggagucggcgugaaggggacacuggagguacaauggagaucaccgaagcagcuuugguacgcgauauacucuauguuuuucaaggcaucgacgggaagaauauuaaaaugaacaauacggagaacugcuacaagguggagggaaaagccaaucugagcagauccuuaagggauacugcuguccggcugucugaacucggcuggcuucauaacaagauccgacgcuacaccgaccagagaagccuggauaggucauucgguuugguggggcagaguuuuugugccgcacuacaccaggagcugcgggaauauuaccgccuccuguccgugcuucauagccaacugcaguuggaggacgaccagggagucaaucucggccuggaaucuucauuaacacugagaaggcuacucguuuggacuuaugauccaaagauucgucugaaaacccuugccgcuuugguggaccacugccagggccggaaagggggagagcuggcgagugcaguacacgccuacacaaaaaccggugaucccuauaugcgaagccucgugcaacauauccugucccuugucucucacccugugcugucguucuuguacagauggauauaugacggcgagcucgaagauacguaccaugaguuuuucguugcuagcgacccaacugugaagacagauaggcuguggcacgacaaauacaccuuacgcaaguccaugauucccucauuuaugacuauggaucagagucggaaaguccugcuaaucgggaagucuauuaacuuccuccaccaggugugucaugaccagacaccgaccacgaagaugaucgccguaaccaaaagcgcagaauccccucaagaugccgcugaccuguuuacagaccuugagaaugccuuccagggaaagaucgaugcagcguauuucgaaacuucaaaauacuugcuggacguucucaacaagaaauauagccuguuagaucacaugcaggcuaugagaagguaccugcuuuugggccaaggugacuuuauucgccaucucauggaucugcuaaagcccgagcuggugcgaccagccaccacacucuaucagcacaaccugacugggauacuugagaccgcaguccgggccacaaaugcucaguucgacucuccugaaaucuugcguagacuggaugugagguuacucgaggucucccccggcgacaccggaugggauguguuuagucuggacuaccauguugauggcccaauugccacuguguucacgcgcgaaugcaugagccacuaucuucggguauuuaacuuccuguggagagcaaagaggauggaguacaucuugacagacauacgaaaagggcacauguguaaugcuaagcuccugcgcaacaugcccgaauuuucuggaguccuacaucagugccacauucuggccuccgagauggugcauuucauccaccaaaugcaguacuauaucaccuuugagguucucgaauguucaugggaugagcuguggaauaaagugcagcaggcgcaagaccuugaccacauuaucgccgcucaugaagucuucuuggauacuauuauaagucggugccuguuagacagcgauucgagagcacuccugaaccagcuuagggccguguuugaccagaucauugagcugcagaaugcucaagaugccaucuaccgugcagcgcuagaggaacuccagcgccggcugcaguucgaggaaaagaaaaagcaaagagagaucgaaggucaguggggcguaaccgccgcugaggaggaagaggaaaacaagaggauuggggaguuuaaagaauccauaccuaagaugugcucucaguugcgaauccugacacacuucuaucagggaauugugcaacaguucuuaguucuccugaccacuagcucagacgagagucuucgguuucuguccuuccgcuuggauuuuaaugagcauuacaaagccagagaaccaaggcuccgggucucucugggcacacgagguagacgcagcucccacacguga

SEQ ID NO: 64392 - RNA, 2004 nt, Artificial Sequence
  derived and/or modified sequence opt3 from TUBGCP4__Homo_sapiens__NP_001273343
augauccacgagcugcuccuugcccugagcggcuaccccggguccauuuucaccuggaacaagagaucuggauuacaggugucacaagacuuuccuuucuugcauccaagugaaacaagcguccugaauaggcuaugccggcucgguacugauuauauacgcuuuacggaguucaucgaacaguacaccggccacguucagcagcaagaccaucacccgucccagcaggggcagggaggccugcaugguauuuaucuucgagcuuuuuguacagggcuggauucuguguugcaacccuaccgucaggcacuccuggaccuggagcaggaguuccucggagauccucacuuaucgaucucacacguaaacuauuuucuggaccaguuccaacuuuuguuuccaagcgugauggucgugguugaacagauuaaaagucagaagauccauggcugccaaauacuggagacuguguacaaacacuccuguggcgggcuacccccugucagaucugcccucgaaaagauccuggcggugugccauggaguaauguauaaacagcuuagcgcuuggaugcugcacgguuugcuccuggaucagcacgaggaguucuuuauuaagcagggcccauccucagggaauguuagugcccaacccgaagaggacgaagaggauuuaggaaucggcggucugaccgggaagcagcucagggaacuucaggaccugcgguugauugaggaagagaacaugcuagcaccuagccugaaacaguucucucuccgcguggagauccugccauccuacauaccggucagaguggccgaaaagauucuuuuugugggagagucaguccaaauguucgaaaaucagaacguuaaucugacaaggaaaggcagcaucuugaagaaccaggaggauaccuucgcugcagaacuccaucggcugaaacagcaacccuuauuuagucugguggacuucgagcagguaguggaucgcauucgaucuacugucgccgagcaccuauggaagcucaugguggaagaguccgaccugcuuggccaguugaagaucaucaaagacuuuuaccugcucgggagaggagaacuguuccaggcuuuuauugauacagcccaacauaugcuuaagaccccuccaacggcgguuacugagcacgacgugaaugucgcauuccagcagagcgcccauaaagugcuguuggaugacgauaaccuccugcccuuacugcaccuaaccauagaauaucacgguaaggagcauaaagcugacgccacacaagcaagggagggcccuucgcgggaaacuucuccacgugaggcucccgccuccgggugggcggcccucggacugucauacaagguacaguggccgcuucacaucuuguuuaccccugcaguucuggaaaaauauaauguggucuucaaguaccuccugagugugcgcagaguccaggcugaguuacagcauuguugggcccugcaaaugcagaggaagcaccuuaaaagcaaccagacagaugcuauuaaguggcgguugcgaaaucacauggccuuucucguggacaaccugcaguauuaccuacaaguugaugugcuggagucccaguucucucagcuccugcaucagaucaauagcacccgcgacuuugaaucaauaagacuugcacacgaucauuucuugaguaaccuguuagcccaauccuuuauucuccugaaacccguauuccacugccuuaacgagauccuggacuugugucauagcuucugcucucucgucucacagaaucugggcccacuagacgaaaggggugcugcgcagcugaguauccucgugaagggguuuagccggcaauccucucugcuuuucaaaauuuugucgagcguucgcaaccaccagaucaauuccgaucuggcacaguuacuccugagacuugacuauaacaaguacuacacgcaggccggcggaacucugggcucauuugggauguga

SEQ ID NO: 64393 - RNA, 3075 nt, Artificial Sequence
  derived and/or modified sequence opt3 from TUBGCP5__Homo_sapiens__NP_001096080
auggccagacacgggcccccuuggagcaggcuggacgcucagcaagagcgggaugugcgcgaacucguccgagggguugcaggacuucaggacgaggccgauccaaacuuccagcuggcguugaauuuugcuugguccaacuuccguuuucauagauucuuagacguaaauucucacaagaucgagaaaaccauugaagguauauacgaaaaguuugugauccauucagaucugaguaaagccgcaagcuggaagaggcuaacagaggaguuccucaacgccccgcugcccuccauuaaagaaaucaagacugacgcucacuauucuauucuuucgcuguugcucugccugucagauagcccuaguaauuccucuuacguggagacgccacggaacaaggaagucgagaaaaaggacgauuuugacuggggcaaauaucugauggaggaugaagagauggacaucgggcccuacauggauaccccuaauuggagcgaagaguccgaagaggagaacgaccagcaaccacucucacgcgaagacaguggaauacagguggauagaacacccuuagaggaacaggaccagaauaggaagcuggauccuuguaucagcuggaaagacgagccagaugaccggucuuggcuugaacaucacguugugcaccaauauuggacugcacgcccgucccaguucccccauucauugcaucugcacagcaaccuagccgcugucugggaucagcaccucuacaguucugacccucuguaugugccagaugaccgaguacuuguuaccgagacacaggugauuagagagacccugugguugcucuccggcgucaagaagcuguuuaucuuccaauuaauugaugguaaagugacugugaggaauaacaucauagucacacaccugacccauagcugccuccggucgguucuugaacagauugccgcguacggccaggugguauuucgucugcaagaguucaucgacgaagugaugggacacucuuccgagucaauguugcccggcaguggcagcgucccuaagaaauccacggaagcaccauuucgcacuuaccaggccuucaugugggcucuauauaaguacuucauuucuuuuaaagaggagcuggccgaaaucgagaaguguaucauuaauaacgacaccacaauaacucucgcaaucgugguugauaaacuggcucccagacuuagccagcugaagguguugcauaaggucuucucaaccgggguggccgaaguaccgccugacacaaggaauguugugcgggcgagucaccuccugaacaccuuauauaaagccauucuggaguacgauaacgucggagaggcauccgaacagacggugagccuacucuuuucucugugggucgagacugugcgacccuaucuucaaacaguugacgaauggaucgugcauggucacuugugggauggcgcucgcgaguucauaauucagagaaauaagaacguaccagucaaucacagggacuuuugguacgccaccuauacucuguacucagugagugagaaaacagaaaacgaggaaaagaugagcgauaaugcuuccgccucuucggggagcgaccagggaccuuccucacggcagcauaccaugguuaguuuccucaaacccgugcugaagcaaaucaucauggcaggcaagucuaugcagcuucugaaaaacuugcagugcgccgagagcacgaccugucaggcuggugcgcgcgaugcagaaagaaagucccucuacacacuguuuuuagagucaguccaaagcaggcugcgucacggggaagacucuacuccacaggugcuaaccgagcagcaggccacaaaagagaaucucaugaagaugcaauccauugcugaaagucaucuggagcuugaugacguacacgaucccuugcuggccaucaacuucgcacggauguaucucgaacagagcgacuuucacgagaaauucgccggaggcgacgugugcguugaucgaucuuccgaaucagucacuugucagaccuuugagcugacauuaagaaguugccuguacccucauauugacaagcaauaucuugauuguugcggcaauuugaugcagacccucaagaaagacuacaggcugguggaguaucuacaggcuaugcgcaacuucuuucugauggaagggggagauacuauguacgacuucuauacgagcauauucgauaagauccgggagaaagaaacauggcagaaugugucguuucucaacguccaacugcaggaggccguuggucagagauacccagaggacuccucuaggcuuagcauuucauucgaaaauguggauaccgcaaagaaaaaguugccggugcacauccuggacggcuuaacucucaguuacaagguacccuggccugucgauaucgugauuucccuggagugucagaaaauauauaaccaaguuuuucuucuguugcuccagaucaagugggcgaaauacucucuggacgugcuacuguucggggaacucgucagcaccgcugagaagccacgccugaaagaaggacuuauucaugagcaggauacaguggcccaguuuggcccccaaaaggagccuguucgacagcagauccaccggauguucuugcugcgugugaaauuaaugcauuuuguaaauucccuccacaacuauauuaugaccagaauccugcacucaacuggucuugaguuccaacaucaggucgaagaagcaaaggaccuggaccagcuaauaaagauccacuacagguaucucagcacaauucaugaucgcugccuguugcgggagaaagugaguuuugugaaggaagccaucaugaaaguccugaacuuagcucucauguucgccgacggguggcaggcaggccugggaacguggagaauggagucuauugagaagauggaauccgauuuuaaaaauugccacauguuccuuguuaccauccugaacaaggcuguguguaggggcagcuuuccacauugcgaguacauaauguugaaguauuucuaccucuguauuucgcuguga

SEQ ID NO: 64394 - RNA, 5460 nt, Artificial Sequence
  derived and/or modified sequence opt3 from TUBGCP6__Homo_sapiens__NP_065194
auggccagcaucacccagcuguucgacgaucucugcgaagcacuucugcccgcagccaagacccacuugggccagcgguccgugaacaggaagcgggcgaagcgcucucugaaaaaggucgcuuacaaugccuuauuuacuaaccuauuccaggacgaaacgcagcagcuccaaccugauaugucaaaacugccagcacgaaauaagauucuuaugcugaguuuugacuugcguguugggggccucgguccgaaggccgauaggcuggaggaacugguggaggaacucgaggcugcacccuguugcccuuuacuggagguaggcagcgugcuugacuugcugguccagcuagccggguccggaccaccccaggugcucccuaggaaacgggauuauuuccugaacaauaagcauguuggccgcaacgugccauauucugguuaugacugugaugaccuuucggucuuugaaauggaugugcagucacugauaagccgggaggaaugcuugugucacaguaugauccaagagacccuccagguaauggaggcugcccccgggacaggacugccuacuguuggcuuauucuccuuuggcgacccaugcggggauagguucgaacgggacacccgcgugucucuguuuggagcgcucguccauagccgaacauacgacauggaugugagacuuggucugccgcccgugccugacaaugcagauuuguccggccuagccauuaaagucccacccucaguugaccagugggaggaugaaggguuccagagugcuagcaaccugaccccugacucucaauccgagccaucagugacucccgauguagaccucugggaagccgcacugacauaugaggcuagcaagaggcgguguugggagcgugugggaugcccgccuggccaccgcgaagaacccuaccuuaccgaagccgguagagaugcguuugacaaauucuguaggcugcaucagggggaguugcagcuccuggccggaggcgucuuacaagcaccacagccugugcugguuaaggaaugcgagcuagugaaggauguccucaaugugcugaucggcguaguuagugcuacguuuucucuuugucagcccgcccaggcuuucguggucaaaagaggggugcacgucuccggagccagcccagagucgauuucuuccuugcugucagaaguggcagaguaugguacuugcuacacccgacucagucacuucagccugcaacccguucuugacucccuguacucuaagggcuugguguuucaggccuucacaagcgggcuccgcagauaucugcaguacuauagggcuugcguauuaucaacuccuccaacccugagucuacucacaaucggauuucuguucaagaaacuuggccggcaguugcgcuaccuggcggaacucuguggugucggggcagugcugccgggaaccugcggaggcgggcccagagccgcuuuuccuacgggaguuaaauuacuguccuaucuuuaccaagaggccuugcauaacuguagcaaugaacacuauccagugcuccugucucuacugaaaacuucaugcgagcccuacacaagguucauacaugacugggucuacagugguguguuucgugaugcauauggcgaguucaugauccagguaaaccacgaauaccucagcuuucgggacaaacuguauuggacccacggguacgugcuuauuuccaaggagguugaagauugugucccuguguucuugaagcauaucgcccacgacauuuaugugugcggaaaaacuaucaaucuguuaaagcucuguugcccacgacauuaccuguguuggucugauguccccguuccgagaauaucggugauuuuuagccuugaggagcugaaagaaaucgagaaggacugcgcuguguauguaggcaggauggaacgcgucgcccggcacuccucagugaguaaagaggaaaaggaguugagaauggagauugcaaagcaggaacucaucgcgcaugcuagggaggccgcaucucgcguucugagcgcccuauccgaucgacagaugucagaacggauggcucuggacgcccguaaaagagagcaauuccagaggcucaaggaacaguuugugaaagaucaggagcgccggcaagcagcuagacaggaggaacuggacgaugacuucagcuacgccagggagcuucgagaucgcgaacggagauugaagucucuggaggaagaguuagagaggaaagcgcgucaggcccucgucgaccacuacuccaagcugagugcugaagcagcccgccgggagcaaaaggcucuuuggagaauccagaggcaccgacuggaaagcgcccggcuacgcuuccuccuggaggacgagaaacauauucaggaaauguugaaggcagugucugaggcgcaccagccucaagaaccacccgauguucuguuauccgugcauccucagguaacaucacccgguccagagcacccugaagggggccagggaugugacaguggcagcgccgagcagcacucgcccgcuugggauggguggaacagaccaggacuccugaccccgcaaccucuuaaaccccuggccgucggugcaggcgggaggggauugcagcaggcugagggcgcccggccauuuuccgacucucucagcauaggugauuuccugcccguggggccuggcgcagaaccaucagugcagacgggaauggucccccuacuggagguugcccuucaaaccaucaaucucgaccugccuccgagugcuccaggcgaagcgcccgccgcagcuuccacacagccuucucgaccacaggaguaugauuuuagcacuguguugagacccgccguagccaccuccccugcuccggggccccugcaagcagccgaaugcucauuaggaagcaguggccuccagcugugggaggacucuugcgguaagauggaugcguguggguccgcuagccgcgagacacuucugccaucgcauccucccaggcgugccgcauuggaagagggaucaucucagccaacugaaagacucuucggccaggugagugguggcgggcugccuaccggagacuacgccuccgagauugcucccacaagaccaagguggaacacccacggccaugucagcgaugcaucuauccgcgugggggaaaacguuagcgacguggccccgacucaaccucgauggaauacgcacggacaugucuccaacgcgucaauaagucuaggcgagagcgugucugauguugcucccacaagaccacgguggaauauucacggucacguguccaacgccucaaucagggucggggagaauguaagugacguggcacccacccgcccucguuggaacacucauggacacguuagcaaugccuccaucagagugggcgaaaacgucucugacguggcuccaacccggcccagguggaauacacauggucacguaucggaugccagcauuucacugggcgaguccgugagugacauggcuccugcucgcccgcgauggaacacccaugggcacgucucugaugccagcaucucccuuggagaaucaguuucugacauggcgccaacuagaccccgguggaauacacacggccaugugagcgauacgaguauuagggugggggagaacgucuccgacguggccccuauacgcagcagaugcaauacccacggacauguuucugaugcaucaaucucccucggcgagcccguaagugacguggucagcacuaggccacgguggaacacacacgugccuauucccccaccucacaugguucugggugcuuugucgccggaagccgagcccaauaccccacguccucagcagucucccccagggcauacaucccagagcgcuuuaucacugggagcacaaaguacugugcucgauuguggcccucgccugcccgucgaaguggguccgucucuuuccagcccaucaaguggcugcggggagggaagcaucuccguaggcgaaaacgucucugacguggccccuacccagcccugguggccaaacacgcccggggauagcguuuccgaggagcugggaccuggccgaucaggugacaccgaagacuugucuccgaauuggccccuaaacagucaggaggauacagccgcucagucgagcccagggagaggagaagaggcggaagcauccgccgcugaggcccaaggcggcgagcaggcauaucuggccgggcucgcuggacaguaccaccuggaaagguauccugacucuuacgagucaaugagcgaacccccuaucgcgcaucuuuuacggccagugcugccccgcgccuuugcauucccugucgauccacaggugcaauccgcugccgacgagacugcaguucagcucagugaauugcugacccuccccgugcugaugaaaagaucuauuacagccccgcuugcugcccacauaagccuggucaauaaggcggcaguggauuacuuuuucguagaguugcaucuagaggcccacuacgaagcucugaggcacuuucucuuaauggaggacggugaguucgcccagucacuguccgaucuucuguuugagaagcucggcgcugggcaaacuccuggagaguugcugaacccacucgugcugaauaguguucuuagcaaagcacuacaguguucucugcauggcgacacaccccacgccuccaacuugucauuagcucugaaguaccucccugaagucuucgccccaaaugcacccgaugugcugagcugccuugagcugcgguauaaaguggacuggccgcucaacaucgucauuacggaagguuguuugucgaaguacucugggguauuuaguuuccugcuacagcugaaacucaugaugugggcgcuuaaggaugugugcuuccaucugaaacgaacagccuuauugucccacauggcuggaagcguucaguuuagacaacugcaacucuucaagcacgagaugcagcauuuugugaaggucauccagggcuauauugccaaucaaauccugcacgugaccuggugugaguuccgcgcaaggcuugcuacuguuggcgaccuggaggagauacagcgggcccaugcagaauaccuccacaaagccguguuucguggguugcugacagagaaggcugcgccugucaugaacgugauccauucaauuuucuccuuaguacuaaaauuuagaucucagcugaucagccaggccuggggacccccagguggcccuagaggggcagaacaccccaauuucgcucucaugcaacagaguuauaacaccuuuaaguacuauucccacuuccuuuuuaaagugguuacuaagcuggucaaucgcggauaccagccacauuuggaggauuuccugcuccggauuaacuucaauaacuacuaucaagacgccuga

SEQ ID NO: 64395 - RNA, 1686 nt, Artificial Sequence
  derived and/or modified sequence opt3 from TUB__Homo_sapiens__NP_003311
augggcgccagaacaccccugccuagcuucuggguguccuuuuucgcugagaccgggauccucuuuccaggagguacuccguggcccaugggcucucagcacucaaagcaacauaggaaaccugggccacuuaagcggggacaccgccgagaccguagaacgaccaggcggaaauacuggaaggaaggccgcgagauugcaagaguccuggaugacgaagguaggaacuugcggcagcagaaauuagaucgccagcgagcccugcuagagcaaaagcagaagaaaaagagacaggaaccccucaugguucaggcgaaugcugacgggaggccucggagucgucgcgccagacaaagcgaggagcaggcaccacugguggaauccuaucuuucuucgucaggaagcacaaguuaccagguacaggaggccgauucccuggcuucugugcaauugggcgcaacuaggcccaccgccccugcuagcgccaaacggacaaaggcggcagccaccgcuggcgggcagggaggugccgcacgaaaagaaaagaagggcaaacauaaggggacuuccggaccagcugcccucgcggaggacaaaucagaggcccagggcccgguccaaauacugacagugggucagagugaucacgcacaggacgcuggggaaaccgccgcuggaggcggcgagcgccccagcgggcaggaucugagagccacgaugcaaaggaagggaaucucuuccucaaugagcuucgacgaagaugaggaagacgaggaggaaaacaguucuuccagcucgcagcucaauucuaacacucggccuuccucagcaaccagucgcaaaagcguuagagaggccgcuuccgcgccaucucccacagcaccugaacagccaguggaugucgaggugcaggacuuagaagaguuugcccugaggcccgcuccgcaagguauuacuaucaagugccguauuacccgggacaaaaagggcauggaucgagggauguauccuacauacuuccuucauuuggacagagaggauggaaagaaaguauuucugcuagccggcaggaagcgcaaaaagagcaaaaccucaaauuaucucaucaguguugaccccacggaucugucccgggguggggacagcuacauaggcaaacuuagaucuaaccugaugggaacuaaguucacaguguaugauaauggcgucaacccacagaaggcaucaaguagcaccuuggaauccgggacucucaggcaggagcuggccgcuguguguuacgaaacaaauguguuaggauuuaaggguccucgcaaaaugucugucaucguucccggcaugaacauggugcacgagcgaguaucgauucggccacguaaugaacacgagacccugcucgccagauggcagaacaagaauacggagagcaucauugaacuucaaaacaaaacccccguguggaaugacgauacacaguccuacguccugaacuuccaugggagggugacucaggcaucaguuaagaacuuucagaucauacacggaaaugacccugauuauauugugaugcaauucggccgcgucgcggaggacguguuuaccauggacuacaacuauccauugugcgcucuacaggccuucgcaaucgcccugaguucuuucgauagcaagcucgcuugugaauga

SEQ ID NO: 64396 - RNA, 1368 nt, Artificial Sequence
  derived and/or modified sequence opt3 from TUFM__Homo_sapiens__NP_003312
augaccacaauggccgcugcaacucugcucagagccacgccccacuucagcggccuugcggcugggaggaccuuucuguugcagggauuacugcggcuacucaaggccccugcacugccacuucugugccgcgguuuggccguggaggcuaaaaagacauacguccgagacaaaccgcauguuaacgugggcacuaucgggcacguagaucauggaaagaccacacucaccgcagccauuacuaaaauacuggcugaaggcgguggggccaaguucaagaaauaugaggaaaucgacaaugcgcccgaggaacgugcaagaggaauuacaaucaacgccgcucacguggaguacuccaccgccgcaaggcauuaugcucacacggauuguccuggccacgccgacuacgucaagaauaugauuacuggcaccgcgccacuggaugggugcauccucgugguugccgcaaacgacggacccaugccucaaacacgggagcauuuacugcuugcucgccagauagguguggaacacgucgugguauauguuaauaaagccgaugcugugcaggacucugagauggucgaauugguggagcuggagaucagagaacuacucacugaguuuggcuacaagggggaagagaccccagugauugucggaucagcccugugugcacuugaaggcagggaucccgagcuggguuugaaaaguguucagaagcuccuggacgccguggauacauauaucccuguaccagcucgggacuuagagaagccguuccugcuccccguggaagcggucuacagcgugccugggcgcggaaccguugugacgggcacucuugagcgaggcauucugaaaaagggggaugaaugcgaguugcuaggacauuccaaaaacaucagaacagucgugaccgguauagaaauguuucacaagucucuggagagggcagaggccggcgacaaucucggggcucugguacggggacuuaaacgugaagaccugcgcagaggcuugguuauggugaagccagguucgauuaaaccccaccaaaaggucgaggcccagguguacauccucucaaaggaagaagggggcaggcauaaaccuuucgucagccacuuuaugccagugauguucagucugacuugggauauggcaugucggauuaucuuacccccggagaaggagcuggccaugccuggagaggaccuaaaauuuaaccucauccugcgacagcccaugauucuugaaaagggccagcgcuucacauugagagaugggaauaggaccauaggaacgggucugguuaccaacacacucgcuaugacugaggaagagaaaaauaucaaguggggcuga

SEQ ID NO: 64397 - RNA, 1098 nt, Artificial Sequence
  derived and/or modified sequence opt3 from TUFT1__Homo_sapiens__NP_001119809
augaacggcaccagaaauuggugcacacugguggacguccaccccgaggaucaggccgcugcagggaggaagacuuacgccaugguuagcucccauucugcgggacacucacucgcuagugaacuuguggagagccaugacggucacgaagagaucauuaaaguauaucugaagggccgguccggggauaaaaugauacaugaaaagaacaucaaucaauugaaaucugaggugcaguacauucaggaggcccgcaacuguuuacagaagcugcgagaagacaucucgucaaagcuagaucguaaucucggagacagccugcacagacaagagauucaggucgugcuugaaaaaccuaacggcuucagucaguccccaacggcacuguauucuagcccgcccgagguugauaccugcaucaaugaggacguggaauccuugaggaagacaguccaggaucuccuggccaaacugcaagaggcuaagcggcagcaccagucagacuguguggcauuugaaguaacucucagucgcuaccagagagaggccgaacaaagcaacguugcuuuacagagggaggaggaucggguggaacagaaagaggccgaagucggugagcugcaacgccgacuuuuggggauggaaaccgagcaucaggcgcugcuagcaaaggugagagagggagaaguggcccucgaggaacugaggucuaauaacgcugacugccaggccgagcgggaaaaggcagcuacacuugagaaagaggucgccggccugcgugaaaagauacaccauuuggaugacaugcucaaaucccagcaacgcaagguuagacagaugaucgagcagcugcaaaauucaaaagcggugauucagagcaaggacgccaccauccaggaauuaaaagagaagauugcauaucuggaggcugaaaaccucgagaugcacgauaggauggaacaccuuaucgagaagcagauaagucauggcaauuucucuacucaggcccgggcuaaaacagaaaacccuggguccauucgaaucagcaagccacccucgccuaaaccaaugcccguaauucgcguggucgagaccuga

SEQ ID NO: 64398 - RNA, 1470 nt, Artificial Sequence
  derived and/or modified sequence opt3 from TULP1__Homo_sapiens__NP_001276324
augccccugagagacgagacccucagggaagugugggccagcgauuccggccacgaggaagagucucuuucaccugaagcuccacggcgcccgaagcagcgacccgcaccagcccaacgucugaggaaaaagagaacagaggcgccagagagucccugcccuacugggagcaaaccacggaagcccggagaagaggaagaggaggaagaggacgaagaggaugaagaggaggaagcugaggagaaaaaggaaaagaucuuguuaccuccuaaaaagccgcugcgcgaaaaauccucugccgaccuaaaggagagaagggcaaaagcccaggguccccggggcgaucucgggucgccugacccacccccuaagccacugcgcguccgaaacaaggaggcucccgcaggagaaggcacgaaaaugagaaagaccaaaaagaaagguucaggggaggccgauaaggacccgagcggaaguccugcuuccgccaggaaaucucccgcggcaauguuccuuguuggcgaaggcagcccagauaagaaggcccugaaaaagaaagggacaccuaagggagcucggaaagaggaagaggaggaagaggaagccgcaacugugauuaagaaguccaaucagaaagguaaggcuaaaggcaaggggaaaaagaaggccaaagaggagcgugcgcccucaccacccguagaaguggacgagccucgcgaauuugucuugagaccagccccgcagggaaggaccgugcggugucgacucacacgcgauaagaaaggcauggacagagguauguaccccaguuauuuccugcaucuggauaccgagaagaaaguuuuucucuuagcagggaggaagcggaagcgcagcaaaacugcuaacuaccugauaucuaucgacccuacaaaucuuuccagaggaggcgaaaacuucauuggcaaguugaggucaaaucugcuagggaaccguuuuaccguguucgacaauggacaaaacccacagcgggguuauagcacgaaugucgccagucuccgacaggagcuggcugccgugaucuacgagacuaacguacuuggcuuuagagggcccaggcgcaugaccguuauuaucccuggaaugucugcagaaaaugagcgggugccaauaagacccaggaacgccuccgauggccuguugguccgcuggcagaauaaaacacucgaaagccugaucgaguuacacaacaagccgccuguguggaaugacgauucggguucuuauacucugaacuuccaagggcgagugacccaggcuuccgucaaaaacuuucagauuguucaugcggacgauccagacuacaucgugcuccaguucggccggguagcagaagaugccuuuacacuugacuaucguuacccccugugcgcuuugcaagccuucgcaauugcccuaucaaguuuugauggaaagcuggcuugugaguga

SEQ ID NO: 64399 - RNA, 1563 nt, Artificial Sequence
  derived and/or modified sequence opt3 from TULP2__Homo_sapiens__NP_003314
augagccaggacaacgauacccugaugagagacauccucggccacgagcuugccgcuaugaggcugcaaaaguuggaacagcagcggcgcuuauucgagaaaaagcagcgacaaaaacgucaggaacugcuaauggugcaggcaaaucccgaugccuccccuuggcucuggagaucuugccugagggaggaacggcuucugggggaccgcggauuggguaacccauuucucagaaagaaagucucagaggcgcaucugccgaguggcauucacagcgcucuggggacaguuuccuguggaggcgaugguaggggagagcgggggcuccccacuccucgcacggaagccguguuccgaaauuuaggccugcagucuccauuucuuucgugguugcccgacaacucagaugcagagcuggaagagguaagcguggagaauggcagugucuccccuccacccuucaagcaaucuccuagaauaaggcggaagggguggcaggcccaucagcguccaggaacccgcgcugaaggugagagcgacucccaggauaugggcgacgcacacaaaucaccgaacauggggcccaauccuggaauggauggcgacugcguguacgaaaaccuagccuuucaaaaggaggaagaucucgagaaaaagagagaggcuagugaaagcacagguacuaauucuuccgccgcgcauaacgaggaacugucaaaagcacuuaagggggagggaggcaccgacagcgaccacaugaggcacgaagccagucuggcuauccggucuccaugucccggcuuggaggaggauauggaagccuauguucuccgaccugcacugccagggacaaugaugcagugcuacuuaacccgcgacaagcauggaguggauaaaggucuguucccccucuauuaccuuuaucuggagacuuccgacagcuugcagagauuucuacuggcuggcaggaagcggcgcagaucgaaaacaucuaauuaccucauuucccuggauccgacccaccuuucaagggacggggauaacuucgucggaaaggugcguaguaauguauuuagcacgaaauucacuaucuuugacaacggcguuaauccugaucgggaacaucugacccgaaacacagccagaauuaggcaagaguugggugcgguguguuaugaacccaacguccucggguaccugggcccacgcaagaugacugugaucuuaccuggaaccaauucccagaaccagcggauaaaugugcagccccugaacgagcaagagucucuacucagcagauaccagaggggcgacaaacaggggcugcuuuugcugcacaauaagacaccaucaugggauaaggaaaacggagucuauacccucaauuuccacggucgcguuacgcgagccagugugaaaaacuuucagaucguagaccccaagcaucaagagcaccuggugcuucaguucggccgggucgggccugacacuuucacaauggauuuuugcuucccauuuuccccgcugcaggcauucagcauuuguuugucuucauuuaauuga

SEQ ID NO: 64400 - RNA, 1506 nt, Artificial Sequence
  derived and/or modified sequence opt3 from TULP3__Homo_sapiens__NP_001153880
auggaggccagcagaugcaggcugucccccucuggcgacucaguguuccacgaagagaugaugaagaugcggcaggcuaaacucgauuaccaacgccuucuguuggaaaagcgacagcguaaaaagagauuagagccuuuuaugguccagccaaacccggaagcaaggcugcggcgcgccaaacccagagcgagugacgagcagaccccucuaguuaauugucauacaccacacagcaacgugauccuccaugggauugauggacccgcugccguacugaagccugacgaggugcacgcaccauccgucucuucgucagugguugaagaggaugccgaaaauacuguggacacggcuagcaagcccggucuucaagagaggcugcagaaacaugauauaagugaguccgucaacuucgacgaagagaccgauggcaucucucagagcgcaugcuuggaacggccuaauuccgccucaagucagaacagcacagacacugggaccucuggauccgcuacagccgcgcaaccagcagauaaucuccugggcgacauugaugaccuggaggacuuuguguauucaccggcuccccaggguguaaccguucgcugucgaaucauuagagauaagagggggauggaccggggacucuucccuacuuacuauauguacuuagaaaaagaggagaaccagaagaucuuucugcuugccgcccguaaacgcaaaaagagcaagacagcaaauuauuugauaaguaucgauccaguggaccugucuagagaaggcgaguccuacgucggcaagcuaaggagcaaccucauggggaccaaauucacgguguaugaucggggaauuugccccaugaagggucgaggccuggugggggcugcccacacucgccaggaacuugcggccaucucguacgagaccaauguccugggauuuaaaggcccuagaaagaugucuguuauuaucccagguaugacauugaaccacaaacaaauacccuaccagccgcagaauaaccaugacucccuccugucaagguggcaaaaucggacuauggaaaacuuaguggagcugcacaacaaggcaccuguauggaauagugauacccagagcuaugugcucaacuuccgcgggagagucacacaggcuuccgugaagaauuuucagauuguucauaaaaacgaccccgauuacaucgugaugcaauucggaagggucgccgacgauguguuuacccuugacuauaauuacccacugugugcuguacaggccuucggcauuggcuugucuagcuuugacaagugcauccagacgcuacguaugcaggagcugugugaacuccaccggcaacaccauucagcagccagucugguucaccgaacugugugccagagaugggucgggcauccuuggaggcuucugccccagacauccuugcucuggaccgaucugagcccacccccuguggucccagcuccgcaccagaucucuauguga

SEQ ID NO: 64401 - RNA, 2037 nt, Artificial Sequence
  derived and/or modified sequence opt3 from TULP4__Homo_sapiens__NP_001007467
auguacgccgcuguggagcacggccccguccugugcagcgacuccaacauccucugucuuucuuggaaggggagaguuccuaaaucagaaaaggagaaaccagugugcaggcggcgcuauuacgaagagggauggcuggcaaccgguaauggccgagggguagugggagucacauucaccaguagccauugucguagagauagguccacgccgcagcggauuaacuuuaauuugcgcggccacaacucugaagugguuuuagugagauggaaugagcccuaucaaaagcuggccacuugcgacgcggauggugggauauucgucuggauccaguacgagggaagguggucgguggaacuuguaaacgaccggggcgcucagguuucagauuuuacauggagccaugacggcacucaggcccucauuaguuaucgcgauggguucgugcuggucggauccgugucuggucaacgacacuggagcuccgagaucaaucuugaaucacagauuaccuguggcaucuggacaccugacgaucaacaggugcuguuugggaccgcagacggacaggucauaguuauggauugccauggcagaauguuggcccacgugcuccugcacgagagugacgguguacuggggaugagcuggaacuacccaaucuuccucguggaggauucuuccgaaucagacacugacagcgaugacuaugcucccccucaggauggaccagcagccuaccccauuccuguccagaauaucaaaccauuacugacagugaguuuuaccucuggcgacauuucccuuaugaacaauuacgaugacuugagcccgacgguuaucaggucgggccugaaggagguggucgcucagugguguacucaaggggaucuacucgccguggcgggaauggaacggcagacccagcugggugagcuucccaacggcccucuguugaagucugcaaugguaaaauucuauaauguucguggggaacauauauuuacacucgacacucuggugcaacgcccaauuaucuccauuugcuggggacacagagauucaagguuacugauggccaguggccccgcucucuacgucgugcgggucgagcaucgagugagcucccuucagcuguugugucagcaggccaucgcaucuacccuacgcgaggacaaggauguuagcaaacugacacucccuccaagacugugcucauaucuuaguaccgcuuucauccccacgauuaagccgccuauacccgacccaaacaauaugagggacuuuguguccuacccuagcgccgguaacgaacggcugcacuguacuaugaaacgcacagaggaugaccccgaaguagggggcccaugcuauaccuuguaccucgaguaucugggaggcuuaguccccauccugaaggggagaaggauuucuaagcuacguccugaguucgugaucauggauccacggacugacucaaaaccggaugaaauauacggaaacagucucauuagcacaguuaucgacuccugcaauuguucugauucgagcgacaucgagcuguccgaugacugggcggccaagaaaucacccaagauuagucgagcaucuaaaagcccuaagcuaccaagaaucuccauugaagcuaggaaaucacccaaguugccucgcgccgcucaagagcugagccggucuccaagacucccccugaggaagccguccguggguaguccuagccuuacccgccgagaauuuccauucgaggauauaacgcagcacaacuaccuggcccaggucaccucuaauaucuggggcacaaaauucaagauugugggguuggcagccuuucuccccacuaaccugggagcuguaaucuauaaaaccuccuuacugcaucuacagccucggcaaaugacaaucuaccuccccgaagugcguaagauuucaauggacuauauaaaucugccaguuuucaacccuaaugucuuuagugaggaugaggacgaccuucccggcgaugcgguguggacugacuga

SEQ ID NO: 64402 - RNA, 639 nt, Artificial Sequence
  derived and/or modified sequence opt3 from TUSC1__Homo_sapiens__NP_001004125
augggccccauguggagaaugaggggaggagccacccggcgcgguagcugcuguggcggggacggagcugcagauggccgagguccugggcguuccgggagagccaggggcggcgggucuccaucaggagguggcgggggagugggcuggcggggucgcgcggacggggcuagacagcaacuggaggaaagguucgccgaucucgcagccagucaccuugaggcuauccgggcacgcgacgaaugggaucgacagaacgccagacugaggcaggagaaugcucgguugcguuuagaaaaccgcagacugaagagggagaaucggagccuauuucgacaggcccuccgccugccgggagagggcggcaacgggacacccgcggaagcaagaagggucccugaggaagccuccacuaaucggcgcgcuagagacucuggaagggaggaugagccagguucgccccgugcccuucgggcacgacuggaaaaauuggaggcuauguacagaagggcccuccugcaacugcaucucgaacagcgcggcccucggccaucaggggacaaggaggaacagcccuuacaggagccugauagcggacugagaaguagggacuccgagccaucuggcccguggcuuuga

SEQ ID NO: 64403 - RNA, 333 nt, Artificial Sequence
  derived and/or modified sequence opt3 from TUSC2__Homo_sapiens__NP_009206
augggcgccagcggguccaaggcuagaggacuguggcccuucgcaucugccgcggguggcgggggaucagaggcugccggcgcagaacaggcccucgugaggccucggggucgcgcugucccaccguuuguuuucacccgacgugggaguauguuuuacgacgaggauggagaccuugcacacgaguucuaugaagaaacaaucgugacuaaaaacggccaaaagagagccaaacugaggcggguacauaagaauuugauuccccagggcauagugaaauuagaucacccucgcauccaugucgacuuuccagugauucuguacgagguuuga

SEQ ID NO: 64404 - RNA, 1047 nt, Artificial Sequence
  derived and/or modified sequence opt3 from TUSC3__Homo_sapiens__NP_006756
augggcgccagaggggcucccagcaggcggcgccaggcaggacgacgucugagauaccucccuaccgguuccuucccauuucuucuguuguuacugcuacucugcauccaacugggcgggggacagaagaaaaaggagaaccuucuggccgaaaaaguggagcaguugauggaauggucuucaaggcggaguauuuuccgcaugaauggcgacaaguuuagaaaauucauaaaggcgccgcccaggaacuauagcaugaucgucauguuuacagcucuccagccucaacggcaguguuccguuugccgccaggccaaugaggaauaccagauucuggcaaacucuuggcgauauucgucagccuucuguaauaagcuguuuuucagcaugguggauuacgacgaggguacugauguauuucaacagcucaacaugaauagugcuccaacguucaugcacuuucccccuaaagggagaccaaagagggcagacaccuucgauuuacagcggaucggauuugccgcugagcagcuggccaaauggauugcggaccguacagaugugcauauccgcgucuucagacccccuaacuauuccggcacuauagcacuugccuugcuggugucucuaguuggcgggcuccuguaccuuaggcggaauaaccuggaguucaucuauaauaagaccggaugggcuauggugagcuugugcauugucuuugccaugacauccggucaaauguggaaccacauccgaggcccaccguacgcacauaaaaauccccacaacggacaggugucauacauucaugggaguagccaggcucaauucguagccgaaucucacaucauacucguucugaaugcggccauuaccaugggcaugguguuacugaacgaagcagcuacuuccaagggugacgucgggaagcgcagaaucauuugucucgugggacuuggccugguggucuuuuucuuuucauucuugcuaagcaucuuuaggaguaaauaucacggcuacccuuauucugaucuggacuucgaguga

SEQ ID NO: 64405 - RNA, 534 nt, Artificial Sequence
  derived and/or modified sequence opt3 from TUSC5__Homo_sapiens__NP_758955
auggcccaccccgugcagagcgaguucccuuccgcucaagaaccaggcucugcagccuuucuggaccucccggagauggaaauccuucugaccaaggcggagaacaaagaugacaagacauugaauuuaucaaaaacucugagugggccccuagaucucgaacagaacagccagggacugccuuucaaggcuauuuccgagggucaucuugaggccccacugcccagaucuccuucgagggcaucaagccggcgcgccaguuccauagcuacgaccucuuacgcacaggaccaagaagccccacgagauuauuugauccucgcugucguugccugcuuuugucccguguggccucugaaucugauuccacucaucauuagcaucaugucccguucaaguaugcagcagggcaacguagacggggcgagaagguuaggacggcuggcacgccuuuugagcauaacacugaucauuaugggcaucgugauuaucauggucgccgugacuguuaauuucaccgugcagaaaaaguga

SEQ ID NO: 64406 - RNA, 2739 nt, Artificial Sequence
  derived and/or modified sequence opt3 from TUT1__Homo_sapiens__NP_073741
augagccugcccaucggcuccgccgagguggcuucugaaagagucgagcucuggaggucaggguuccggugguggcagcgcugccuuuguuuuugccgauaccguagaguugcaauggccgcgguggacagugauguagaaagccugccuaggggagguuuccgguguugcuugugucacgugaccacagcuaaccgcccauccuuagacgcccaucugggcgggagaaagcacaggcaucuagucgagcuccgggcagcccgcaaagcucaaggacugcgaucuguguuuguuucgggcuucccgagagauguggacucagcacagcuuagcgaauauuuucuggccuucggucccgucgcuagugugguaauggauaaggacaaagggguuuuugccauuguggagaugggagaugucggcgcgagggaggcaguguugucccagucucagcacagccucggcgggcaucggcugcgugugcgcccuagagaacaaaaggaguuccaguccccagccucaaaaagucccaagggagcugccccugacagccaccagcuggcaaaggcucucgccgaagcggccgaugucggugcacagaugauaaaauuaguuggccugagggagcuuucugaggcugaacggcaauugcgaucccuggugguagcccuaaugcaggagguguuuacugaguucuuuccagggugcgucgugcaccccuucggaucaagcaucaauaguuuugacguucauggcugugaucucgaccuguuccuugaucugggugacuuggaggaaccucagccagugccgaaggcucccgagucuccuucccucgacagcgcccuggcaucgccauuagauccccaggcccuggcuugcacgccugcgucuccacccgacucccaaccgccugcaucaccccaggauagugaggcccucgacuucgaaaccccaagcuccucucuugcuccucagacacccgauagcgcccuggcaucagagacuuuggccaguccacaaucccuacccccugcuagcccacugcucgaagaccgcgaggaaggggaucugggaaaagccucugagcuugcagagaccccgaaggaagagaaagcggaaggcgcugccaugcuggaguuggucggcucaauucucagagggugugugcccggaguauacaggguucagacagugccuagugcacggcgcccagucgugaaguuuugccacagacccagcggucugcauggcgacgucuccuuaucuaacaggcuggcccuacacaauucgcguuuccucagccuguguuccgaacuugaugggcgggugcgaccuuugguuuauacccugagaugcugggcucagggaaggggccucucagguagugggccacugcuuucuaacuacgcccugacuuugcucgugaucuauuuucugcagacacgcgaucccccgguauuaccuaccgucagccaacugacgcagaaggcaggcgagggagaacagguggaaguugacggcugggacugcuccuucccacgggacgcuucaagacuagagcccagcauuaauguggaaccucucucuucccugcuugcccaguuuuucaguugugucagcugcugggauuugagggggucucugcucucccugcgcgagggacaagcguuacccguggccgguggccugccaucaaaccuuugggagggguugcgacucggaccucugaaucuacaggaccccuuugaucugagucacaacguagcugcaaaugugacuagccggguugccggccgucuccagaacuguugcagagcugccgcaaauuacuguaggucgcugcaguaucaacgccgguccucuagagguagggacugggggcuuuugccacuguuacagccgagcucaccuaguucccuccugucugcgacccccaucccacuuccccuggccccuuucacacaguugacugcugcccucguccagguguuucgagaagcacugggcugccauauagagcaagcuaccaaacgcacacggagcgaaggaggcgggaccggagaguccucacaggguggcacgagcaagagacuaaaaguggaugggcagaagaacuguugcgaagagggaaaagaggaacaacagggcugugccggugacgggggcgaggauagggucgaagagaugguuaucgaagugggagagauggugcaggacugggcaaugcagaguccaggccaacccggggaucugccucucacuacaggaaagcacggcgccccgggugaggaagggcagccaucucaugcugcgcuggccgagcguggacccaaaggccacgaagcagcucaggaguggucccagggugaagccggcaagggggccagccuuccuucgucagcuucuuggcgcugcgcauuguggcaucggguauggcaaggaagaaggcgagcccggcgcagacugcagcagcagaccaaggagggcgcugggggaggcgcggguacuagggccgggugguuagcaacagaggcccaagucacccaggaacucaaaggacugaguggcggugaggaacggccagagacggagccccuucuguccuucguggcuagcguuucuccugcagaccgaaugcuaaccgugacaccgcuccaggauccccaaggccuguuuccagacuugcaccacuuccugcaggucuuuuuaccucaggccauuagacaucucaaguga

SEQ ID NO: 64407 - RNA, 618 nt, Artificial Sequence
  derived and/or modified sequence opt3 from TVP23B__Homo_sapiens__NP_057162
augcugcagcaagacagcaacgaugacaccgaggaugugucccucuucgacgccgaagaggaaacaacuaauagacccaggaaggcuaaaauccggcacccugucgcaucauuuuuccaucuguuuuuccgcguuucugccauuauaguguaccuuuugugcggcuuacugaguagcuccuuuaucacguguaugguaaccauuauccuacuccugucuugcgauuucugggcggugaagaacgucacagggcgacuuauggugggacugcguugguggaaucacauugacgaggaugguaaaucgcauuggguuuuugaaucaagaaaggagagcagucaggagaacaaaacuguguccgaagcugagucuaggaucuucugguugggccucauagccuguccaguccugugggugaucuuugcauucagcgcccuguuuuccuuccggguaaaguggcucgcuguugugauuaugggggucguguuacagggagcaaaucuguauggcuacauccgcugcaaggugagaucaaggaaacaccuuaccaguauggccacaagcuauuuugguaagcaguucuugcggcaaaacaccggggacgaucagacuucuuga

SEQ ID NO: 64408 - RNA, 1074 nt, Artificial Sequence
  derived and/or modified sequence opt3 from TWF1__Homo_sapiens__NP_001229326
augagccaccagaccggcauccaagccuccgaggacgugaaggaaauuuucgcuagagcaaggaacgggaaauaccggcugcucaagauaucuaucgagaaugaacagcuugucauuggaucauauagucagcccagcgauuccugggacaaagauuacgacucuuuuguucugccuuuguuagaggauaagcagccaugcuauauccuguuccgccuagacucgcaaaacgcccaggguuacgaauggauuuuuaucgcguggucaccggaucauagccacgugcgacagaaaaugcucuaugcugccacacgugcaacucugaagaaggaguucggcgggggacauauaaaagacgagguauuuggcacggugaaggaagaugucagucuucacgguuacaaaaaguaucuguugucccagucuagccccgccccucucaccgcugcagaggaagaguuaagacaaaucaaaauuaaugaguccccagaagaccauaucggggugcagacagauguuggaguggacacuaagcaccagacccugcagggcgucgccuuccccauuucaagggaggcuuuucaagcccucgaaaaguuaaacaaucggcagcugaacuacgugcagcuugagaucgauauuaaaaaugaaauaaucauuuuggcgaacacaaccaauacugagcugaaggaccuaccuaaacgcaucccaaaggacagugcaagauaccacuucuuucucuauaaacauagccacgagggcgauuaccuggaaucuaucguauucauuuauuccaugcccggguacacauguucaauaagggagcggaugcuuuauagcaguugcaagucucgccuguuggaaaucguugagcgacaacuccagauggacgugauuagaaaaaucgaaauagauaacggagacgagcugaccgccgauuuucuguacgaggaaguccauccuaagcagcacgcucacaagcaguccuucgccaaaccaaaggguccggcaggcaaaagggggauucggcgucugauccgcggacccgcugagacggaagccacuaccgacuga

SEQ ID NO: 64409 - RNA, 609 nt, Artificial Sequence
  derived and/or modified sequence opt3 from TWIST1__Homo_sapiens__XP_011513798
augaugcaggacgugagcuccucucccgucaguccugccgaugacucacugagcaacuccgaggaggaaccagauagacaacagccgcccucuggcaagaggggagggcggaaacgccgaucgucacguagaagcgcugguggcggggcaggaccuggcggugccgcugggggaggcguuggcgggggagacgaaccagguagucccgcgcagggcaagagggggaaaaaguccgccggaugcggcggugggggaggcgcaggcgggggagguggcucuagcuccgggggaggcucaccucagaguuacgaggaacuccaaacccagcgggugauggccaauguacgcgagagacagaggacacagagccuuaacgaggcuuucgcagcccugcggaaaaucauuccaacuuugcccucugauaaguuauccaagauacaaacgcugaaacuagcugcccgcuauaucgacuuucucuaccaggugcugcagucagaugaacuugacagcaagauggcgaguuguucuuaugucgcacacgagcgacuguccuacgccuucagcguguggagaauggaaggugcuuggucgaugucugccucccauuga

SEQ ID NO: 64410 - RNA, 483 nt, Artificial Sequence
  derived and/or modified sequence opt3 from TWIST2__Homo_sapiens__NP_001258822
auggaggaaggcagcuccucucccgugucaccugucgacagucuggggaccagcgaggaagaguuggaaagacagccaaagagguucggacggaaacgccgauacuccaagaaaucuucggaggaugguucaccgacacccggcaagcgugggaaaaagggaagcccuagugcccaauccuuugaggaacuucagucucagagaauccuggcuaacguuagggagcggcagcgcacucaaagccucaaugaagcauucgccgcguuaagaaagauuauaccaacgcugcccuccgacaaacuaucaaagauccagacccucaaacuggcugccagguauauugauuuucuuuaccaggugcugcagagugacgagauggauaacaagaugacaagcugcucuuauguagcacacgagcgguuguccuacgccuucucaguguggcgcauggaaggcgcuuggagcaugagugcaucucauuga

SEQ ID NO: 64411 - RNA, 672 nt, Artificial Sequence
  derived and/or modified sequence opt3 from TWSG1__Homo_sapiens__NP_065699
augaagcugcacuacguggccguccucacccuugcuauccugauguucuugacaugguuacccgagagccuguccugcaacaaagcacuaugugccucugacguuucaaagugccucauucaggaacugugucaaugcagaccuggcgaggggaauuguaguugcuguaaagaaugcaugcuuugucugggagcguugugggaugagugcugugacugcguggguaugugcaacccaaggaauuauagcgauacuccgcccacguccaagucuaccguagaggaacuccaugagccuauaccaucgcuguuucgggcucugacagaaggcgacacucagcucaacuggaauaucgugucauuccccgucgccgaggaauuaagccaccaugagaaccuggugaguuuucuugagaccguuaaucagccucaccaucagaacguguccgucccaucuaauaacgugcacgcacccuacagcuccgauaaagaacacauguguacaguaguuuauuucgacgauugcaugucaauucaucaauguaagaucaguugcgagagcaugggggccucuaaguaccgcugguuucacaaugcuuguugcgaauguauuggaccugagugcaucgacuauggcuccaaaaccgugaaguguaugaacugcauguucuga

SEQ ID NO: 64412 - RNA, 1584 nt, Artificial Sequence
  derived and/or modified sequence opt3 from TXK__Homo_sapiens__NP_003319
augauccugagcuccuacaacaccauucagucuguguucugcuguugcuguugcuguucaguccaaaagagacagaugaggacacagauaagucucagcacugacgaggaacuucccgagaaauauacgcagcggcgccgaccuuggcugucccaauugucuaauaagaaacagucgaacaccggccguguucagccaucaaagagaaaaccguuacccccucugccacccagcgaaguggccgaggaaaagauccagguaaaggcucuauacgauuuucucccuagggagccaugcaaucuggcacuucggcgcgccgaggaauaucugauuuuggagaaauacaacccccacugguggaaggcgagagacaggcucgggaaugaaggacugaucccuaguaacuaugugacagagaauaaaauuacuaaccuggagaucuacgaaugguaucaucggaauauaacccgcaaccaagcugagcaccucuuacgacaggaauccaaggagggugccuucaucgucagagauucuaggcaucugggcagcuacacaauuuccguguuuaugggggcacggcguucaaccgaagccgcuaucaaacacuaccagauuaagaagaaugacaguggacagugguauguugcagagcgccaugccuuccaaagcaucccagagcuuauaugguaccaccagcacaacgcugccggcuugaugacuagacugagguauccggugggucuaauggggucuugucuccccgcgacagcaggauuuuccuacgaaaaaugggagauugauccuucagaacuggccuucaucaaggagauuggcagcggccaguuuggggucgugcaucuuggagaauggcggagucacauccaaguagcuaucaaagccauuaaugaggguucuauguccgaggaagacuucauagaggaagcaaagguuaugaugaaacugagccauucgaaguuggugcagcucuauggcgucugcauccagcgaaaaccacuguacauugugaccgaguuuauggaaaacggguguuuacugaauuaucuccgcgagaacaagggaaaacuuagaaaggagaugcuguugucugugugccaggauaucugugaaggcauggaguaccuagaaaggaacgguuacauacaccgggaccuggcugcccgcaauugccucgucuccucaacgugcauuguuaagaucagugauuucgggaugacuagauaugugcuggacgaugaguacguaagcuccuuuggagcgaaauuccccaucaaguggucuccuccagagguguuucuuuucaacaaauauagcucaaagagugacgucugguccuucggcgugcugaugugggaaguuuuuaccgagggcaagaugcccuucgaaaauaaaagcaacuugcaaguggucgaggccauuucugaaggguuuaggcucuaccguccgcaccuggcaccuaugucaaucuaugaggugauguacaguuguuggcaugagaagcccgaaggacggccaacauucgcugaguuacugcgagccguaacugaaauugcugagaccugguga

SEQ ID NO: 64413 - RNA, 1191 nt, Artificial Sequence
  derived and/or modified sequence opt3 from TXLNG__Homo_sapiens__NP_001162154
auggccaccagaguggaggaagcugcaaggggccggggagggggugccgaggaagcgacagaggcuggccgcgggggacgacguagaagccccaggcagaagcuggaagagucccggucuguccaaaaacagaugaagauccuccagaaaaagcaggcccaaauuguuaaagagaaggugcaccuucagucagaacauaguaaggcaauacuggcccgcagcaaauuggaguccuuaugcagagaacugcagaggcacaacaagacucuaaaagaggagaauaugcagcaagcucgggaagaggaagaacgccgaaaggaagcaacggcccauuuccagaucacccucaacgagauucaggcucagcuggagcaacacgacauccauaaugccaaacuuagacaggaaaacauugagcugggcgaaaaguugaagaaacucaucgagcaguacgcgcugagggaagaacacauagauaagguauuuaaacacaaggagcugcaacagcagcucguggacgcaaaauuacagcaaacaacucagcugaucaaggaagccgaugagaaacaucagcgggaacgugaguuccuuuugaaggaagcuaccgagucucgccacaaguaugagcagaugaaacaacaggaaguccagcugaagcagcaacuaucgcucuacauggacaaauuugaggaguuccagacaaccauggccaagucaaaugagcuguuuacuacauucagacaggagauggagaaaaugaccaagaagauuaaaaagcuggagaaagaaacgaucauuuggaggacuaagugggagaacaauaacaaagcacuuuugcagauggcugaagagaagaccgugcgggauaaggaguauaaagcccuccaaaucaagcuggaacgauuagagaaacugugucgcgcgcuccagacagaaagaaaugagcuuaacgaaaagguugaggugcugaaagagcaggucagcauaaaggccgcaauuaaggcugccaauagggacuuggcuacuccugugaugcaaccaugcaccgcccuagauagucauaaagaacugaacacauccucuaagcgggcacucggugcccaccuggaggcugaaccgaaaagccagcgcuccgcgguacagaagcccccuucaaccgggagugcaccagccaucgagagcguugacuga

SEQ ID NO: 64414 - RNA, 594 nt, Artificial Sequence
  derived and/or modified sequence opt3 from TXN2__Homo_sapiens__XP_005261565
auguacgugcccccuagaggcagcgacgauaggcgggcccuggaccgccaagggggacucgguugcgcuucccuucgaucucacugucgugagauggcacagagacuguuguuaaggcgguuccuggccucagucaucagucgcaagccaagccagggccaguggccgccccuaaccuccagagcgcuccagacaccucaaugcucuccagggggacugacuguuacgcccaacccugcuaggaccauuuauacaacucggauaucgcuuaccacauuuaauauccaggauggcccagacuuccaggaucgcgugguaaacucagaaacccccguggucguggacuuucaugcccaguggugugguccuugcaaaauucuggggccacgauuggagaagaugguugcaaaacaacacggaaagguggucauggccaaaguggauaucgacgaucauacugaccucgcuauugaauacgagguaagcgcaguuccgacagugcuggccaugaagaauggcgaugucguggacaaguucgugggcaucaaagaugaagaccagcuggaggcuuuucucaagaaauuaauaggguga

SEQ ID NO: 64415 - RNA, 1083 nt, Artificial Sequence
  derived and/or modified sequence opt3 from TXNDC15__Homo_sapiens__NP_078991
auggugcccgccgcuggcagaaggccuccacgggucaugcgccugcucgggugguggcagguucuucuguggguguugggauuaccgguacgagguguggaggucgcagaagagagcggccgucugugguccgaggaacaacccgcccacccucuacaggugggggcgguuuaccucggagaagaggagcugcuucaugacccaaugggccaggauagagcugccgaagaggcaaacgccgugcuggguuuggacacccagggggaucacauggucaugcucucugugauccccggagaagcugaggacaagguaucaagugagccuagcggcguuacaugcggcgcagggggagccgaagauuccagguguaaugugcgggagucucuguucucgcuggacggugcuggcgcccauuuuccagaucgcgaagaggaauauuacacugagcccgaggucgcggaaucagacgcagccccuacggaggauagcaacaauaccgaaagucucaaauccccaaaggugaacugcgaggaaagaaauauuacaggguuagagaacuucacucugaaaauacuuaauaugucucaagacuugauggauuuucugaacccgaauggaagcgacuguacccuaguccucuucuauacacccuggugcagguuuuccgcuucacuggccccucacuucaacagucuuccacgggcauuucccgcucugcauuucuuggcccucgaugcgagccagcacucuucccugucaacccgcuuuggcacuguggccguuccuaauaucuuacuguuccagggugcaaagccaauggcucgauuuaaccacacagacagaacccucgagacgcuuaaaauuuucaucuuuaaucagacugggauugaagccaagaagaacgugguagugacccaagcugaccagaucggaccccugccgagcacauugauaaaaagugucgauuggcuacugguguucucucucuucuuucugaucuccuucauuauguacgccacuaucaggaccgagagcauucgguggcuuaucccuggccaggaacaggagcauguugaauga

SEQ ID NO: 64416 - RNA, 2478 nt, Artificial Sequence
  derived and/or modified sequence opt3 from TXNDC16__Homo_sapiens__NP_065835
auguucagcggcuuuaacguguucagagucgggaucuccuuuguuauuaugugcauauucuacaugcccaccgugaauagccugccugagcucucaccacagaaguauuuuaguacacuucaaccgggaaaagccagccuggcuuacuucugucaggcagacucccccaggacuucuguauuuuuggaagaguuaaacgaagccgugcggccucugcaggauuaugguaucucggucgcgaaggugaauugcguuaaagaggaaauuucacgcuacuguggcaaggagaaagaccuaaugaaggcuuaucucuucaaggggaacauccugcuucgagaguuuccaacggauacccuguucgacgugaaugccauugucgcacacguguuguuugcccuccuguucagcgaaguaaaauacaucacaaaccuggaggaucuccagaauauagaaaacgcuuuaaagggaaaagcaaauaucauuuuuaguuauguucgugccaucggcauucccgagcauagagcugugauggaggccgcguucgucuacgguacuaccuaccaauucgugcugacaaccgaaaucgcacuuuuggaguccauagggucugaagacguggaguaugcccaccuguacuuuuuccauugcaagcuaguccucgaucugacucagcaguguaggcggacacuuauggaacagccucugaccacguugaacauucaccucuuuaucaaaacuaugaaggcuccacuguuaaccgagguugccgaggacccccaacaggugagcacaguacaucugcagcucggacuuccucugguguucauugucucccagcaagcaacuuaugaagcugaucgcagaaccgccgaguggguggcguggagguugcuaggcaaggccggcguucugcuccugcuucgggacucacuggaagugaauaucccacaggaugcaaacgucguguuuaaacgcgcugaggaagggguaccgguugaguucuuggugcuccacgacgucgaucugaucauuagucacguggagaauaacaugcauauagaagagauccaggaagacgaggacaaugauauggaaggacccgacauugauguccaagacgaugagguggccgagacaguuuuucgagacagaaagaggaaauuaccucuggaacuaaccguggagcucacggaagagacuuucaacgcuacaguaauggccagcgauucuaucguccuguuuuacgcagguuggcaggccguguccauggcuuuccuucagucauauauagacguugcggugaaguugaaaggcaccagcacuaugcugcucacacggauuaacugcgcagauuggagugacgucuguaccaagcagaaugugacggaguuuccaaucaucaaaauguacaagaagggggaaaaccccguaucuuaugccggaaugcugggcaccgaggaucuucugaaauucauucaauugaaucguaucuccuacccugugaacauuacaagcauacaggaagcugaggaauaccucucgggugagcuguauaaggacuuaauccuguacucuuccguuucaguccuagggcucuuuaguccaacuaugaaaaccgccaaggaggacuucagcgaagcaggaaauuaucugaaaggcuacgugauuacaggcaucuauuccgaggaagaugugcuuuugcugucuacuaaguacgccgcuagccuccccgcccuguuacuggcacgccacaccgaggggaagaucgaaucaauuccgcuugcgaguacacaugcucaggacauaguccagaucauuaccgaugccuugcucgagauguucccugagaucacuguugaaaaccugcccuccuauuuuagacuacaaaaaccacugcucauucuguucagcgacggaacggugaauccucaguacaagaaagcaauccuuacauuggugaagcagaaauaccuggauucuuuuacccccugcugguuaaaccucaagaauacuccaguagguaggggcauacugcgggccuauuucgacccccuuccuccacugccguugcucguccuggugaaccuacacucagggggacagguuuuugcuuuccccagugaucaagccaucauugaggaaaaucuggugcucuggcugaagaaacuugaggcaggcuuggaaaaccacaucaccauucugccugcucaggaguggaagccacccuuaccugccuacgacuuucucagcaugaucgaugcggccacaucccagcgagguacccgcaaagucccaaaguguaugaaagagacugacgugcaggaaaaugauaaggagcaacaugaagacaagucugcuguuagaaaagagcccauagagacacugaggauuaagcacuggaaccggucgaauugguucaaagaagcagagaagucuuuucgcagagauaaagaacuugggugcuccaaggugaacuga

SEQ ID NO: 64417 - RNA, 372 nt, Artificial Sequence
  derived and/or modified sequence opt3 from TXNDC17__Homo_sapiens__NP_116120
auggccagauacgaggaagugagcgucuccggcuucgaggaauuucacagggcuguugagcagcauaacgggaagaccaucuucgcauauuuuacaggaucuaaagacgccgguggcaagucauggugccccgauugugugcaagcggaaccuguagugcgggaggggcugaaacacauuagugagggaugcgucuucauauacugucaggugggcgaaaagccauauuggaaagacccgaauaacgauuuucgcaagaaucucaagguuacugcugugcccacgcuucugaaauacgguaccccucagaaguuggucgagagcgaaugcuuacaggccaaccugguggagaugcuauucuccgaggacuga

SEQ ID NO: 64418 - RNA, 975 nt, Artificial Sequence
  derived and/or modified sequence opt3 from TXNDC5__Homo_sapiens__NP_001139021
auggaggacgccaagguguacgucgcuaaaguugauugcaccgcacacagcgacguguguuccgcccagggcguaagaggguaucccacacugaaacucuucaagccuggacaagaagcggugaaguaccaggguccaagggauuuucagacucuugagaacuggaugcugcagacguugaaugaagaaccggucacccccgaaccugagguggagccacccucugcuccugaauuaaaacaaggccuguaugagcuaucagccaguaacuucgaacuccauguugcacagggggaccacuuuaucaaguucuuugccccauggugcggacauuguaaggcucuggcacccacaugggagcagcuugcccugggcuuggagcacagcgaaacugugaaaauugguaaggucgauugcacccagcauuacgagcucuguuccgggaaucaagugcggggauauccuacacugcugugguuccgcgacggcaaaaagguagaucaguacaaaggcaagcgagaccucgaaucuuuacgugaguauguugaaucgcagcugcagagaaccgagacuggggcuacagagaccgugacgccaucagaagccccgguccuugcggcagagcccgaagccgauaagggaacuguguuggcucugaccgagaacaauuuugacgauacaauagccgaagguaucacuuucauuaaauuuuacgcaccuuggugcggccacuguaagacccuagcuccaacaugggaggagcucagcaaaaaggaguuccccgggcuggccggagugaaaaucgcggaggucgacugcaccgccgaaaggaacauuuguaguaaguacuccguucggggcuauccuacgcuucuguuguuucgcggugggaaaaaggugucugagcacagcggaggcagagaucucgacucccugcauagguucguauuaucacaagcaaaggacgaacuguga

SEQ ID NO: 64419 - RNA, 258 nt, Artificial Sequence
  derived and/or modified sequence opt3 from TXN__Homo_sapiens__NP_001231867
auggugaagcagaucgagagcaaaaccgccuuccaagaagcucuggacgcagccggcgauaagcucgucguuguggacuuuuccgcgacauggugcgggcccuguaaaaugauuaagccuuucuuucacgauguagcuucugagugcgaagugaaauguaugccaacuuuccaguuuuucaagaagggacagaaagucggugaguuuucaggcgccaacaaggaaaaacuugaggcaacgauaaaugagcugguguga

SEQ ID NO: 64420 - RNA, 870 nt, Artificial Sequence
  derived and/or modified sequence opt3 from TXNL1__Homo_sapiens__NP_004777
auggugggcgucaagcccguugggagcgacccugauuuccagccagagcuguccggagccgguucuagacucgcugugguaaaauuuaccaugaggggcugcgggccgugucuucggaucgcacccgccuucucaaguaugagcaacaaguacccucaagcgguguuucuggaagucgacgugcaccagugccagggaacagcugccacuaauaacauuuccgcaacgccaaccuucuuguuuuuccgcaauaaaguucgaauagaucaguaucaaggcgccgacgcuguggguuuagaggaaaagaucaaacagcaucuggagaacgaucccgggucuaaugaagacacagauauuccuaagggauacauggaccuaaugccauuuaucaacaaggcaggcugugagugccucaaugagucggaugaacacggcuucgacaacugucugcguaaagauacuaccuuucuugagucagacugcgaugaacagcuguugauuacagucgccuucaaucagcccgugaagcucuauagcaugaaauuucaagggccugacaacggacaggguccaaaguacguaaaaaucuucauaaaucugccgagaaguauggacuuugaggaggcugaaagguccgagcccacccaggcccuggaacucacugaggaugacaucaaggaagauggcauuguuccuuuacgguaugugaaguuccagaacgucaauucugugacaaucuucgugcaaagcaaccagggggaggaggaaaccacgcgcauuuccuacuuuacuuucaucggaaccccaguccaggcgacaaauaugaacgacuuuaaaagaguugugggcaagaaaggugagucacauuga

SEQ ID NO: 64421 - RNA, 1017 nt, Artificial Sequence
  derived and/or modified sequence opt3 from TXNRD2__Homo_sapiens__NP_001269441
auggccgcuauggcaguggcccugagaggccucgggggaagguuccgguggcgcacccaggcggucgcugguggcguucgaggggccgcacguggagccgcugcaggccaaagagacuacgaucuucuggugguaggugggggaagcggcggcuuggccugcgcuaaggaggccgcgcaguuagggaggaaaguggcagucguggacuauguugaacccuccccucagggaacacgguggggucugggcgggacuugugugaacgucggaugcaucccaaagaaacuaaugcaccaggccgcucuccugggcggucuuauucaagaugccccgaauuacgggugggagguggcacagcccguaccucaugacuggcgcaagauggcugaagccguucagaaccacgugaaaucucugaauuggggacauagaguccaguugcaagauaggaaggugaaguauuuuaacauaaaagcgucauucguggacgagcacacggucuguggcguugccaagggcgggaaagaaauccuccugagugcagaucauauuaucauugcuaccggaggucggccacgcuaccccacacacaucgagggcgcccuggaguaugggauaacuagcgacgauaucuuuuggcucaaggaauccccuggaaaaaccuuagugguaggcgcuucuuacguggcccuggagugcgcagguuuccuuacagggauuggcuuggacaccacuaucaugaugcgaucgauuccacugagaggauuugaucagcagaugucaagcauggucaucgaacacauggccagucauggcacaagguuccuacgggggugugcucccucccgugugcgcagacucccugacggacagcugcaaguuaccugggaggauucuacgacugguaaggaggacaccggcacauuugacacugugcuuugggcgauagcaccaugcauuagcgccugucugccgaccacagucgggcacgcuggaaagaaucagaggcgggauuga

SEQ ID NO: 64422 - RNA, 402 nt, Artificial Sequence
  derived and/or modified sequence opt3 from TXNRD3NB__Homo_sapiens__NP_001034872
augagagaccugagcgagaggcggcucggccagcccgaacuuaaggccgagcaacagaugccucuggaaccagugcgcgcucgauuguccgucggguuagcaugcuguugcucucacaccacagccgaggcgucaagucuggaacauggagauaaaguuuucggucagggcuuuccgagcccccuagaggagaucaagcgucuccugaaaauuuccagagcccuucaggcuaggucugugccuucgacucaagaaaaggcaaaaugucugucaggggagccaggacagcccgaaggcaagggucaggagacguacccugggccaggaaagguagagggcaaagccgaacccgcuaugcggaaggacgaugugugcccuggcaugaaauguauaagcggguga

SEQ ID NO: 64423 - RNA, 3564 nt, Artificial Sequence
  derived and/or modified sequence opt3 from TYK2__Homo_sapiens__XP_011526547
augccccugagacacuggggcauggccagggggagcaagccugugggagacggugcucagccaauggcagccaugggcgggcucaaaguccuucugcauugggcgggaccgggcgguggggagcccuggguuaccuucuccgaaucuucauugacagcugaggaagugugcauccacauugcccauaagguaggaauaacuccuccauguuuuaacuuauucgcacuguuugaugcccaagcucagguguggcuacccccuaaucacauccucgagauuccacgggacgcaagucugaugcuuuacuuccgcauccgauuuuauuuccguaacuggcauggcaugaaucccagagaaccugccgucuacaggugcggcccaccggggacggaggcuagcuccgaucagaccgcccagggaaugcaacuguuggaccccgcgucuuuugaguaucucuucgaacaggguaaacacgaguuugugaacgauguugcaucgcugugggaacugucaacagaggaggaaauucaccauuucaagaaugagagccucggcauggccuuuuuacaccugugucaucuugcuuugcggcacgggaucccucuggaagagguggccaaaaagacgaguuucaaggacugcauaccacgcuccuuuagaaggcacauccggcagcauucugcacuaacccgccuccgacugagaaacgucuucaggcgguuccuucgugauuuucagcccggacgccugagccaacagauggugaugguaaaauacuuggcuacacucgaaagacuggccccuagguucggcaccgagcggguuccagugugucacuuacgacugcucgcgcaggccgagggugaacccugcuauauucgcgacuccggggucgcaccgacugauccuggacccgagucagcugccggcccaccuacacaugaagugcuugugaccggcacugggggaauccagugguggcccgucgaggaagagguuaauaaggaggaagguaguagcggaucuuccgggagaaacccacaagcuagccuguuuggcaaaaaggccaaagcacacaaggccgugggccagcccgcugacaggccucgggagccauugugggcguacuucugugauuuucgcgacauuacucauguagugcuaaaggaacacugcgucagcauccacagacaggauaauaaaugucuggagcucagucugccgucuagggcagccgcucuuuccuucgugagccugguugacgguuauuuucguuugaccgccgacucgucucauuaccucugccacgaaguggcacccccucggcuggucauguccauacgagaugggauucauggcccauuacuggagcccuucgugcaagccaagcuaagaccugaggacggacucuaccugauccacuggucaacaagucacccauauaggcuuauuuugacuguagcucagcgcagccaggcccccgauggcaugcagucccugcggcucagaaaauuuccgaucgaacaacaggacggggcauucguucuggagggaugggguaggucuuuuccuagcgugcgcgaacuuggcgcggcucugcagggguguuugcuccgagccggagaugacugcuucucacugcggcguugcuguuuaccacagcccggcgagaccaguaaccugaucauuaugagaggugcaagggccuccccucgcacacuaaaucucagccaacugucuuuucaucgggucgaucagaaggagauaacccagcuuucacacuuggggcagggcacgagaacuaacguguacgaaggaaggcugcgagucgagggcaguggggaccccgaagagggaaaaauggaugacgaagauccacucgugccuggucgcgaccggggccaagagcugagaguuguguuaaagguacuggaccccagccaucacgauaucgcucuugccuucuaugagacagcauccuugaugucucaggucucgcauacccaccucgcuuucgugcacgggguuugcgugaggggaccagaaaauauuauggucacugaguacguggaacauggcccgcuggacguauggcuacgucgcgagcggggucacgugccuauggccuggaaaaugguugucgcgcagcagcuggccagcgcucucuccuaucuggaaaacaagaaucuugugcaugggaacguguguggcagaaacaucuugcuggcaagguuaggacucgccgagggcacaucacccuuuauaaagcugagugauccaggggucggacuuggcgcucugucucgagaggaacggguugagcgcauucccugguuggccccugaaugccucccagguggggcaaauagccuguccaccgcgauggacaaauggggauucggcgccacgcuacuggagaucuguuuugauggugaagcuccccuccaaucaagaagcccuucugagaaggagcacuucuaccagaggcagcaucggcugccggaaccauccugcccccaacuugccaccuugacaagucagugucugacuuaugagccuacccagcgacccagcuuuagaacaaucuuacgcgaccucacuaggcugcagccacacaaccuugcagaugugcugaccgugaauccugacucuccggcuuccgaucccacaguauuccacaaacguuaccuaaagaaaauucgggaccucggcgaagggcauuuuggaaaggucucacuguacugcuaugauccaaccaacgacggcacuggggagaugguggccguuaaggcauugaaagccgauuguggaccucaacacagaaguggcuggaagcaggagaucgacauucugaggacguuauaccaugaacacauaaucaaauauaaggguugcugugaggaccagggggaaaaaucacuccagcuggugauggaguacgucccccuuggaucgcugcgcgauuauuugccacgacacuccauuggccucgcucaacugcuacuguucgcgcagcagaucugcgaagguauggccuaccuucaugcacagcacuauauccauagagaccucgcugcccggaaugugcuguuggauaacgacaggcugguuaagauuggcgauuuuggguuagccaaggcugugccugagggacacgaguacuaccgcguacgugaagacggcgauucucccgucuucugguaugcaccagagugccucaaagaauacaaguuuuauuacgccagcgacguguggucauucggggugacacuguaugagcuucugacccauugugauaguucccaaucuccgccuacuaaauuuuuggaacucauaggaaucgcgcagggccagaugaccguccugagacuaacagagcugcuugagcggggugaaaggcucccccgcccagacaagugccccugugagguuuaccaccugaugaaaaauugcugggaaaccgaggcuagcuuccgaccuacuuucgaaaacuugauuccaaucuuaaagacagugcacgagaaguaucaagggcaggcccccuccguauuuucaguguguuga

SEQ ID NO: 64424 - RNA, 1449 nt, Artificial Sequence
  derived and/or modified sequence opt3 from TYMP__Homo_sapiens__NP_001107227
auggccgcucugaugacccccggcacaggggcaccuccagccccgggagacuucagcggugagggcucccaggggcuccccgauccuucuccagaacccaagcaacuuccugagcugaucagaaugaaaagggacggaggccgguugucagaagcggauauucgcgguuuuguggcugccgucguuaacgggagugcacagggagcccagauaggcgcuauguuaauggcaauccgacugcguggcauggaccuagaggaaacuagcgugcucacgcaggcccuggcucaauccgggcagcagcuugaguggccagaggccuggagacagcaacugguagauaagcacucuaccggaggugugggcgacaaagucucguuggugcucgcgcccgcacuggccgcuugcggguguaagguuccuaugauuucaggaaggggccugggucauacagggggaacucucgauaaauuagaaagcaucccaggcuucaaugugauucagaguccggagcagaugcagguccugcuugaccaagccggcugcuguaucguggggcaguccgaacaguugguacccgcagauggaauacuguacgcugcccgggacguuaccgcgacaguggauucucuaccucucaucaccgccagcauucuguccaagaagcuggucgagggucugucagcauuggugguggacgucaaauuuggcggggcugccguuuucccaaaccaagagcaggcucgcgaacucgccaagacucuggugggaguaggcgcaaguuuaggucugagaguggccgcugcgcucacagcaauggauaaaccccuugggaggugcgucggccacgcccuggagguggaagaggcuuugcuauguauggacggagccggcccuccagaccugcgggaucucguuaccacgcuugggggagcacuucugugguugagcggucaugccggcacucaggcucagggggccgcacgcguggcggcugcccucgacgauggaucugcacugggccgauuugaaagaauguuagccgcucaaggugucgaccccgggcuggccagggcacuaugcuccggcucaccggcugagcggcgucagcuccugccucgcgccagagagcaggaggaacuuuuggcgcccgccgauggaaccguggaacugguaagggcucucccacuggcacuuguucugcacgaguugggcgccgggcggagccgagcuggagaaccucuccgccugggugugggcgccgaguuacuggucgacguggggcagagacuaaggcggggaacacccuggcuccgcguccauagagauggcccagcacugagugguccccaaucuagggcgcuucaggaggccuuggugcuguccgaccgugcuccuuucgccgcaccaagcccguuugcugaacucguucugcccccucagcaguga

SEQ ID NO: 64425 - RNA, 942 nt, Artificial Sequence
  derived and/or modified sequence opt3 from TYMS__Homo_sapiens__NP_001062
augcccguggccggcagcgagcugccuagaaggccacucccgcccgcugcacaggaacgggacgccgagccucgcccaccccacggggaacuucaauaccugggacagauccagcauauuuugcgaugcgguguccguaaggaugacagaaccggcacagggacuuuauccguuuucggaaugcaggcgagguauucucugcgggaugaguuuccucuacucacgaccaaacgcguguucuggaagggcguacuggaagaacuucugugguuuauaaaagguucaacaaacgcuaaggaguugaguagcaaaggggugaagaucugggacgccaauggauccagagauuuccucgacucucugggcuuuucgacuagggaagagggcgaucuggggccagucuacggauuccaauggcggcacuuuggugcagaauaucgcgacauggagucagauuacagcggccaggggguggaccagcuccagcgaguuauugauaccaucaagacaaaccccgacgauagaaggauuaucaugugugccuggaauccucgggacuuaccacugauggcacuuccgcccugccaugcuuugugucaauucuauguggucaacagugagcuguccugccagcuauaccagcguucuggagacaugggccucggugugccuuuuaauauagccagcuaugcucugcuuaccuacaugaucgcccacauuacugggcugaaaccaggagauuucauccauacauugggcgacgcgcacauuuaccucaaccacaucgaaccccugaagauacaguuacaacgcgagccuagaccauuucccaaacugaggauucuccggaagguagagaaaaucgaugacuucaaggcagaggauuuucagauugaaggcuauaauccgcauccuaccaucaagauggagauggccguuuga

SEQ ID NO: 64426 - RNA, 1590 nt, Artificial Sequence
  derived and/or modified sequence opt3 from TYR__Homo_sapiens__NP_000363
augcugcucgccgugcuuuacugccuguuguggagcuuccagaccuccgcuggccacuuucccagagcaugugucucuucaaagaacuuaauggagaaagaaugcuguccuccauggaguggggacaggagcccgugcggacaacuguccggucggggcucuugucagaauauccuacucucgaacgcccccuuggggccucaguucccauuuacaggaguugaugaccgcgagucauggcccagcguguucuauaaucgaacuugccaguguaguggcaacuuuauggguuucaauugcgggaacuguaaguuuggauucuggggcccuaauugcacggaacguagacuucugguaaggcggaacauuuuugauuuguccgcgccagagaaagacaaguucuuugcuuaccucacccuggccaaacauacaauaucuagcgauuaugugauccccauuggcacuuacgggcaaaugaagaauggauccaccccuauguucaacgacaucaauauuuaugaucuguuugucuggaugcacuacuaugugucaauggacgcacucuuagguggcagugaaaucuggcgcgauauagacuucgcccaugaggcuccagcauuccugccguggcacagacuuuuucugcugaggugggagcaggaaauccagaagcuaacaggggaugagaacuucaccauucccuacugggacuggcgggaugccgaaaaaugugacaucugcacugacgaguacaugggaggccagcauccuacaaauccaaaccuccugagccccgcuuccuuuuucucuucauggcaaauuguuugcagccgccuugaggaauauaauagucaccagucucuguguaacgguaccccugaggggccauugcgaagaaaccccggaaaucacgauaaguccaggacgccgcggcucccuagcucggccgacguggaauuuugccugucuuuaacucaguacgaguccggcucaauggauaaagcggcaaacuucaguuuucguaauacccuggaaggcuucgccagcccccucacagggaucgcugacgccucccagucuagcaugcauaacgcacuucacauauauaugaauggaacuaugucacaaguccaggguagugcuaacgauccaauuuuucuguugcaucacgccuucguggacuccaucuuugagcaguggcuacgcagacacaggccucugcaagagguauaccccgaagcgaaugccccaauuggccauaaccgggagagcuauaugguucccuucaucccucucuaccgaaauggggacuuuuucaucucuucaaaggaucugggauaugauuacaguuaccuucaggacagcgauccagacuccuuccaggacuauauuaaaucuuaccuggaacaggcaucgcgcauauggagcugguugcucggcgcugccauggugggugcuguccugaccgccuuacuggcagggcuagugucccuccuguguagacacaagaggaagcaacuuccggaggaaaaacagcccuugcugauggagaaggaggauuaucauucacucuaccagagucaccuguga

SEQ ID NO: 64427 - RNA, 2673 nt, Artificial Sequence
  derived and/or modified sequence opt3 from TYRO3__Homo_sapiens__NP_006284
auggcccugagaaggagcaugggccggcccgggcucccuccacuuccgcugcccccuccaccccgcuugggauuacugcuagcugcacucgccucccugcuucugccugagucugcggcugccgguuugaagcucaugggcgcaccagugaaacugaccgucucacaggggcaacccguuaagcugaacugcaguguggaaggaauggaggaaccugacauccaguggguaaaagauggcgccgugguccagaaucucgaccaguuauacauuccagugagcgagcaacacuggauagguuuccugucccuuaagucuguugaacgaucggaugcugggcguuauuggugucagguggaggacggaggcgagacagaaaucucacagccggucugguugacuguggagggcguacccuuuuucacgguugaaccuaaagaucuggcagugccacccaacgccccuuuucagcuaagcugcgaggcugucgggccacccgagccggugaccauugugugguggagaggaacaacuaagaucgguggcccugcccccaguccauccguccucaauguuaccggggugacacaaucuaccauguucagcugugaagcgcauaaccugaagggacuugcauccucaaggacugccacaguacaucugcaggcuuugccugccgcacccuuuaauauuaccgugacgaaacucaguagcucuaacgcuuccgucgccuggaugccaggcgcggacggucgggcccuguuacagucaugcacugugcagguuacccaagcacccgggggaugggaggugcuggcugucgugguaccuguuccaccguucacaugucuccuucgcgaucuggugcccgccacuaauuacagcuugagagucaggugcgcuaacgcccuaggcccuaguccauaugcagacugggugcccuuucagaccaagggccuggccccugcuucugcgccacagaaucuccacgcaauccggacagauuccgggcugauacuugaaugggaggaagucauccccgaggccccgcuggagggaccuuuggguccauacaaacucagcugggugcaagacaacggcacccaggaugaacugacgguugaggggacucgcgcuaauuuaacaggaugggacccccagaaggaucugauugugcgaguaugugucucgaacgccgugggcugcgguccuuggucucagccccuaguuguguccucacacgacagagcagggcaacagggcccaccucauaguaggaccagcuggguccccgugguacucggagugcugacugcccuuguuacagcugccgcauuggcgcugauccuccugcggaaacgucgcaaggaaaccagauucggccaggcuuuugacuccgucauggccaggggagagccagcagugcacuuccgggccgcucgaucuuuuaaucgcgaaagaccggagaggauugaggccacgcuugauagccuggggaucucagacgaauugaaggagaaacucgaagaugugcugauaccugagcagcaauucaccuuaggucggaugcugggcaagggggaauuuggaaguguccgcgaggcacagcuaaaacaggaggacggcuccuucguuaagguggcugugaaaaugcucaaggccgauauuaucgcgagcucugacauugaagaguuccugagagaagccgcuuguaugaaagaguuugaucacccccauguagcaaaguuagucggugugucauugaggagucgugccaaggggcggcugccaauccccaugguuauccucccuuucaugaaacacggcgaccugcaugcuuuucuucuggccagccgaauuggagagaacccauucaaucuucccuugcagacacucauaagauuuaugguggauaucgcaugcggcauggaauaucuguccucuaggaacuucauucaccgcgaccuagcggcccggaacuguaugcuggcugaggauaugacugucugcguggccgacuuugggcucucgagaaagaucuacagcggagacuauuacaggcaagguugcgcauccaaacugccuguuaaguggcuugcuuuggaaucacuggccgauaauuuauacaccgugcagagugacguaugggcauucggcgucacaaugugggagauaaugacucgcgggcagaccccguaugccggaauugaaaacgcugagaucuacaauuaucucaucggcgguaaccgacugaaacagccacccgaguguauggaagauguguacgaccuuauguaucaaugcuggucugcggauccuaagcagcggcccagcuuuacaugucugcguauggaguuggaaaauauucucgggcagcuguccgugcuaucagccagccaagacccacuguacaucaacauugagagagcagaggaaccuaccgcuggcggaucucucgagcugccgggcagggaucagcccuauuccggggccggagacggcagugguaugggggccgucggaggcacuccaagcgauugccgcuacauacuuacgccugguggcuuggcugaacagcccgggcaggcagagcaccaaccagaaucuccucugaaugagacacagcgguuacuccugcuucagcagggacugcuaccccauuccucauguuga

SEQ ID NO: 64428 - RNA, 309 nt, Artificial Sequence
  derived and/or modified sequence opt3 from TYROBP__Homo_sapiens__NP_001166985
augggcgggcuggagcccugcagcagacuccuucuguugccuuuacugcuagccguguccgacuguucuugcucaaccgucaguccaggaguucucgcugguaucgugaugggcgaucugguacuuacagugcugauugcauuggccgucuacuuccucgggaggcuggugccgcggggacgcggcgcggcugaagccgcaacucgaaagcagcguauaacggagaccgaaagccccuaucaagagcugcagggucagagauccgacguuuacucugaucucaacacacagaggccuuauuacaaauga

SEQ ID NO: 64429 - RNA, 1614 nt, Artificial Sequence
  derived and/or modified sequence opt3 from TYRP1__Homo_sapiens__NP_000541
augagcgcccccaagcugcucucccuuggcugcaucuucuuuccucuguuguuauuccagcaagcuagagcacaguuuccaaggcagugugccaccguggaggcgcugcggucugggaugugcuguccggaccuaucacccgucaguggaccugguacagaucgcugcggcagcuccucugggcgaggacguugugaagcuguuacugccgacucgagaccacacucaccccaguacccucaugauggcagggacgaucgggagguguggccacuccgcuucuuuaacagaacgugccacuguaaugguaacuucagcgggcauaauugcggaaccuguaggcccggcuggcggggcgcagccugcgaccaacgcguacugauugugcgaagaaaccuucuggauuugaguaaagaagagaagaaucacuuugucagggcucucgacauggcaaaacggacaacucauccucuguucgugauagccacccgucgcuccgaagagauccuggggccagauggaaacacaccgcaguuugagaauauuucuaucuauaacuacuucguuuggacccacuauuacagcgugaagaaaacuuuucucggugucggccaggaauccuucggggagguggacuuuucacacgaaggacccgcuuucuuaacauggcauagauaucaucugcuuagguuggagaaggauaugcaggagaugcugcaagaaccuaguuucagccuaccauacuggaauuuugccaccggcaagaacguaugugacauuugcacggaugaccucauggguucucgguccaauuucgacucaacucugaucagccccaacaguguguuuucucaguggcgaguugucugcgauucccuugaggacuaugauacccuggggacauuguguaauagcacugaagacggaccuauacgcagaaacccagcgggcaauguggcaaggcccauggugcagcggcucccggagccucaggaugucgcccaaugccuggaaguuggcuuauucgacacacccccauuuuacucgaacucuaccaacuccuuccgcaauaccguggagggguacucagauccuacgggaaaauaugaccccgcuguaagaagucugcacaaccucgcccaccuuuuucugaaugguacuggcgggcagacacacuugagcccaaacgaucccaucuucgugcuacugcauaccuuuacugacgcagucuucgaugaguggcucaggcguuacaaugcugacauuuccacauuuccucuggaaaacgccccaaucggacacaaucggcaguauaacauggugccguucuggcccccuguuaccaauacggagauguuugugaccgcgccagacaaccuuggcuacacauaugaaauucaauggcccucucgagaguucagcgucccugaaaucauagccauugcagugguaggugcucuguugcucguugcccugaucuucgggacugcuucauacuuaauuagagccaggcgcaguauggaugaggcaaaucagccacugcuaaccgaccaguaucaguguuacgccgaggaauacgagaagcuccaaaaccccaaucaguccguggucuga

SEQ ID NO: 64430 - RNA, 1197 nt, Artificial Sequence
  derived and/or modified sequence opt3 from TYSND1__Homo_sapiens__NP_001035363
augagaaggcaguggggcagcgccaugcgggcugcagagcaagccgggugcaugguguccgcgucucgcgcuggacagcccgaagccgguccuuggucauguaguggcgucauccugagccgauccccagggcucguucuuugccacggaggcauuuucgugccguuucugcgugcagguucugagguauugaccgccgcuggggcaguguucuuacccggagacucguguagagaugaccugaggcuacauguccagugggccccuacagcugccggcccaggcgggggagcggaacggggucgccccggccucugcacuccucagugugcaucacuggagccagggcccccugccccaagcagaggaaggccgcuucaaccccggcugccugcugaauugcuccugcugcucaguugcccagccuuuugggcacacuucgcucgcuuauuuggcgaugaggccgcggagcaguggcgauucuccucugccgcaagagacgaugaagugagcgaggacgaagaggcugaucagcugagggcccuugguugguuugcuuugcuggggguucggcuaggacaggaggaaguggaggaggaacguggccccgccauggcagucuccccucucggcgccgugccaaagggggcuccccugcuuguauguggaucaccguucggugcguuuugcccugacauauuccugaacacguugaguuguggcguucucagcaauguggcagggccccuguuacugaccgaugcccgcugccucccaggaacagaaggcgguggggucuuuacugcuagaccugccggcgcacuuguggcccugguggucgcucccuuguguuggaaagccggagaguggguuggcuucacccuacugugcgcagcggcuccacucuuuagggccgcacgggacgcccugcaucgacuuccccacucuacagcugcccuggcagcuuugcucccuccagagguggggguaccguggggacugcccuuacgcgauuccgguccucugugggccgcggccgcugugcuagucgaaugcggcaccgugugggggucaggaguugcaguggccccaagacucgucgugacuuguaggcauguaagcccccgggaggcugcccgcguucuggugagaaguacaaccccuaagcacaaccaccaacagcauccaggccaguga

SEQ ID NO: 64431 - RNA, 1833 nt, Artificial Sequence
  derived and/or modified sequence opt3 from TYW1B__Homo_sapiens__XP_011514532
auggaccccagcgccgauaccugggaccuguccucuccucucaucucacuuuggauuaacagauucuacauauaucugggcuuugcugugaguaucagcuuguggauuugcguccagaucguuauugagaugcaaggguucgcaacaguguuagccgaagcgguaacuucccuggaucuaccaguggcuaucauaaaucucaaggaguacgacccggaugaccaccugaucgaagaggucacgucuaaaaacguguguguuuuucuuguggccaccuauacagauggacugcccacugaaucggcagagugguucugcaagugguuggaggaagccucaauugacuuuagguucgguaaaaccuaccucaagggcaugcgggaugcugucuuugggcugggaaauagcgcauaugccagucauuucaacaaagugggcaagaauguagacaaguggcuguggaugcucgguguucaccgcgugaugucccgaggggagggagauugugacgucgugaaaucuaagcauggcagcaucgaagcuaacuuucgugccuggaaaacaaaguucauuucccaguuacaggcgcugcagaaaggcgagagaaagaagucaugcgggggacacuguaaaaaggguaaaugcgagagucaucaacacggcagcgaagagagggaagaggggucucaggaacaggaugagcuucaccaucgggacaccaaggaggaggaaccuuuugaauccucaagcgaggaagaguucggaggcgaggaccaccagagucuaaauucuaucguggaugucgaagaccuggguaaaauaauggaucauguuaagaaagagaagcgcgaaaaggagcaacaggaagagaaauccgggcuauuuagaaacaugggaaggaaugaggacggcgaacggcgcgcaaugauuacuccagcccuccgagaggcucugacaaaacagguggaugcccccagagaaaggagccuucugcagacccacaucuuguggaacgagucgcaccgguguauggagacgacuccuucucucgcaugcgcuaauaaguguguauucugcugguggcaucacaacaauccagugggcaccgaauggcuguggaagauggaccaacccgagaugauuuuaaaagaagccaucgagaaccaucagaauaugaucaagcaguucaagggggucccuggagugaaagcggaacguuuugaggaggguaugacaguuaagcacugugcccugucccucgugggcgaaccaauuauguacccggagauaaaccgcuuccuuaaacuguugcaucaaugcaagaucucaaguuuucuagucacuaacgcacaguuccccgcugaaauuagaaaucuggagccugugacccagcucuauguaagcguugaugccuccacaaaagacucucugaagaagaucgauaggccacuuuuuaaagacuucuggcagcaauuucuggauagcuugaaggcucucgccgugaaacagcagcggaccgucuaccgacugauguuagugaaggcauggaacgucgacgaacugcaggccuacgcucaauuggugucacucgggaaucccgacuucauagagguuaaaggagugacguauugccgcgagaguuccgcgagcucucugacuauggcacacguaccuuggcacgaagaggucgugcaguuuguuagagaacuuguggauuugauuccagaguacgaaaucgccugugagcaugagcacucaaacugccugcucaucgcucauaggaaggaccugggccggcuuccccgcgccgaagaugagggucacgucaguuga

SEQ ID NO: 64432 - RNA, 504 nt, Artificial Sequence
  derived and/or modified sequence opt3 from U2AF1__Homo_sapiens__NP_001020375
augcaggagcacuacgacgaguucuuugaagaaguguucaccgagauggaagagaaguauggcgaggucgaagagaugaacguuugcgauaaucugggggaccaucucgugggaaacguauacgugaaauuuagaagggaagaggaugccgagaaggcugucaucgaccuuaauaaccggugguucaauggucaacccauucacgcagaacugagcccugugacagauuuucgcgaggccuguugccgacaguaugaaaugggcgaguguacucgugggggauucugcaacuuuaugcauuugaaaccaauauccagagaauuaaggcgggagcuguacggccgcagaaggaagaaacaccggucucgcucacgaaguagagagaggcggagccguucccgcgacagagguaggggagggggcggcgggggagguggcgggggaggcggucgggaacgagaucgcagaaggucucgggaccgcgagagaucggggagguucuga

SEQ ID NO: 64433 - RNA, 1416 nt, Artificial Sequence
  derived and/or modified sequence opt3 from U2AF2__Homo_sapiens__NP_001012496
augagcgacuucgaugaguuugaaagacagcugaacgagaauaagcaagaaagggacaaagagaaccggcaccgcaagcgaucccauucucguucaagaaguagggaucggaaacgcagaagcaggucccgggaccgccgaaauagagaucagaggucugccucgcgggaccgucgcagaaggucaaagccccucacccggggcgcuaaagaagaacacgggggacuuauccgaagcccucgccaugagaagaagaaaaaggugagaaaauacugggaugucccaccgcccgguuucgaacacauuacaccuaugcaguauaaggcaaugcaggccgcgggccaaauaccagcuacugcccuguugcccacgaugaccccugacggguuagcaguuacaccaacucccgugccuguagugggaagucagaugaccaggcaggcccggcgccuguacgucggcaacaucccauuugguauuacagaggaagcuaugauggauuucuuuaaugcacagaugagacuagggggacucacccaagccccgggcaaccccgugcuggcuguucagaucaaucaggacaaaaacuucgccuuucuugaguucagguccguggaugagacuacacaggcgauggcauuugacggcauuaucuuccaagggcagucucugaagauacgucggccucaugauuaucagccauugcccggaaugagcgaaaauccuuccgucuacgugccagguguaguuucaaccgugguccccgacagugcccacaagcucuuuaucggcgggcugccgaacuaucugaaugacgaucaagugaaagagcucuuaacgagcuucggaccucugaaggcuuuuaaccuugugaaagacucugccacuggcuuguccaaggguuacgcauucugcgaauaugucgauauuaauguuaccgaccaggcuaucgccgggcugaacggaaugcagcuaggcgauaaaaagcuccuggugcagcgagcgucaguaggcgccaaaaaugcaacacuuagcacuauuaaccaaacccccgugacacugcaggucccaggguugaugaguucucaggugcagaugggaggucacccuaccgagguucucugucugaugaacaugguguuacccgaggagcugcucgacgaugaggaauacgaggaaaucgucgaggacgugagagaugaaugcuccaaguacggccuuguaaagagcauagagauuccaaggcccguugacgggguggaggucccuggauguggcaaaaucuucguggaauuuacgucggucuucgauugccaaaaggcuaugcagggucugacugggcgcaaauuugccaaucgggugguugugacaaaguauugugacccagacucuuaccauagaagggauuucugguga

SEQ ID NO: 64434 - RNA, 4212 nt, Artificial Sequence
  derived and/or modified sequence opt3 from UACA__Homo_sapiens__NP_001008225
augaugaacugcugguucagcuguacccccaagaauagacacgccgcugacuggaacaaauacgaugacaggcugaugaaggcagccgagcggggcgauguggaaaaagucacauccauccucgcgaagaaagggguuaauccuggaaaacuugacguggagggucgcucuguauuucauguggucacuucaaagggcaaccuggaaugcuugaaugcuauuuuaauacacgggguggauaucacgaccagugacacagccggacgaaacgcacugcaucuagccgcuaaguauggccacgcacucugucugcagaaacuucugcaauacaauugcccaacugagcaugccgauuugcagggucguaccgcucuccacgacgccgcgauggcagauuguccgagcuccauucagcugcugugcgaccacggggccucuguuaacgcuaaggauguggacggaagaacaccccucgucuuagccacccagaugucgaggccuacuaucugucaacugcuuauugaucggggcgcagacguaaauucacgcgacaagcagaacagaacagcuuugaugcugggcugcgaauauggguguagggaugccguggagguucuaaucaaaaauggagcggacauaagccuccuggaugcccuuggucaugacaguuccuacuaugcacggaucggcgauaaccuggacauuuugacccuccugaagacggcuucugagaauacuaacaaggggcgcgaauuauggaaaaagggaccaagccugcagcagcgaaaucucacccacaugcaagaugaggugaacgucaaaucccaucagagagaacaccagaacauccaggaccuugagauugagaaugaagaucugaaggagagguugcggaaaauccaacaggaacagcguauacuacuggacaaggugaacggccuccaacugcagcuuaaugaggaagugauggucgccgaugaccuggagucagagcgcgaaaaauugaagagucuccuggcugccaaggagaaacagcacgaagagagcuuaagaacaauugaagcacugaagaacagguucaaauacuuugagucugaccaucuagguuccgggucacacuucagcaaucggaaggaggauaugcuccugaaacagggacaaauguauauggccgacagucagugcacuucucccggcaucccugcucauaugcagucccgaagcaugcuucgcccauuggaacugucgcuccccucucagaccuccuacucagagaacgaaauucugaagaaggagcuugaagcgaugagaacauuuugugagagugcaaaacaagauaggcugaaguugcagaaugagcucgcccacaaaguugcugaaugcaaggcccuggcauuagagugcgaacgggugaaagaggacagcgaugagcagaucaagcagcuggaagacgcccuaaaggauguacaaaaacgcauguacgaguccgaaggcaaggugaaacagaugcagacccauuuccucgcucugaaggagcaccuuacgucugaagccgcaagcgggaaccacagauugacugaggagcugaaagaccagcucaaggaucugaaggucaaauaugaaggagcgucagcugagguggguaaguuaaggaaucaaaucaaacagaacgaaaugauuguugaggaauuuaagcgugacgagggcaaacugauagaggaaaauaagcggcuucagaaagaguugaguaugugugaaauggagcgagaaaagaaggggagaaaagugacagagauggagggacaagccaaggaacucuccgcaaaacuggcccuaagcaucccugcugagaaguucgaaaacaugaaaucuucacugaguaaugaggucaacgagaaggccaagaaacucguggaaauggagagggaacaugaaaagagccuguccgaaauucgccagcuuaaacgggaguuggagaauguaaaggcaaaacuggcucagcacguuaagccagaggagcaugaacaggugaagucuagauuagagcaaaaaucgggcgaacucgguaagaaaaucaccgagcugacucuuaagaaccagacacugcagaaagagauagaaaaggucuacuuggauaacaagcuccugaaagagcaggcccacaaucuaaccauugaaaugaagaaccacuaugugccgcugaaagucagcgaggacaugaagaaaucccaugaugcgaucaucgacgaccucaauaggaagcugcuugaugugacgcaaaaauacaccgaaaagaaguuggagauggagaaacuguuacucgaaaacgacucacugaguaaggauguuucucgccuugagacaguguuuguacccccugaaaaacacgagaaggagauuaucgcccugaaaagcaauauugucgaacuaaagaagcagcucuccgagcugaaaaagaaaugcggggaagaccaggagaagauacaugcuuugacuucagaaaacaccaaucugaaaaagaugaugagcaaccaguaugugccaguuaagacacacgaggaggugaaaaugacuuuaaaugauacccucgcaaagacaaaccgagaacugcuugacgucaaaaagaaauucgaggauaucaaucaagaauuugugaagauuaaggacaaaaacgagauccugaagcggaauuuggaaaacacccagaaucagaucaaagccgaguacauuucucucgcugagcaugaagccaagauguccagucugagccaaucuaugcguaaaguacaggauuccaacgcagagauacuagcgaacuauagaaagggccaggaagagaucgugacucugcacgccgaaauuaaggcucagaaaaaggagcuugacacgauccaagaguguauuaaaguuaaguacgcccccaucgucucauucgaagagugcgaaaggaaauuuaaggcaacagagaaagagcucaaggaucagcugagugaacagacccagaaguacagcgugucggaggaagaggugaaaaagaauaaacaagaaaacgacaaguugaaaaaggagauauucacucugcagaaggauuuacgcgacaaaaccguccucaucgagaagucccacgaaauggagcgggcucugucuagaaaaacagacgaacuuaauaagcagcugaaagauuugagccagaaguauaccgagguuaagaacgugaaagaaaagcucguggaggagaaugccaaacaaacuucagaaauucuggcaguacagaaccuacugcagaagcagcaugucccucuugagcaaguggaagcccucaaaaagagucugaauggaacaaucgagaacuugaaggaagaguuaaaauccaugcagagguguuacgagaaggaacagcaaacgguuaccaaacugcaccagcuccuggagaaucagaagaacucuagcgugccacuugcugaacaucugcagauuaaagaggcguucgagaaggaagucggcaucauaaaagccuccuugcgagagaaggaagaggaaucacaaaauaagauggaggaggugagcaaacuacagagugaaguucagaacacuaagcaggcacugaaaaagcucgagacacgcgaagugguagaccugucuaaauauaaggcuaccaaguccgaucuugagacacaaauuagcucguuaaaugaaaaacuggccaaccucaaucggaaguacgaggaggucugcgaagagguguugcacgccaaaaagaaagaaaucucagcuaaggacgagaaggaacugcuccauuuuucuauugagcaggagaucaaagaucagaaggaaagaugugacaaaagucugacuaccauaacggagcuucagaggcguauccaagaauccgcaaagcagauugaggccaaagauaacaagaucaccgagcuguugaacgacguggaacgccuaaagcaggcgcugaaugggcucagccaauuaacauauacuucuggaaaccccaccaaacggcagagccagcugauugauacacuucagcaccaagucaagucccuggagcagcagcucgcugacgccgauagacagcaccaagaaguuaucgcaauauacaggacucauuugcugucagccgcucagggucacauggacgaggacgugcaggaagcacuccugcagauuauccaaaugcgacagggccuuguaugcuga

SEQ ID NO: 64435 - RNA, 1518 nt, Artificial Sequence
  derived and/or modified sequence opt3 from UAP1__Homo_sapiens__NP_003106
augaacaucaaugaccugaagcucacccuuagcaaagccggccaggagcaccuguugagauucuggaacgaauuagaggaagcucaacagguggagcuguacgcagaacuacaggccaugaauuuugaggagcucaacuucuuuuuccagaaggcgauugaaggguuuaaucaauccucucaucagaaaaacgucgaugcuaggauggagcccguuccucgggaagugcugggaucagccacacgcgaccaggaucagcuucaagcaugggagagugagggucuguuccagauaagccagaauaagguagccguguugcuccuggcuggcgggcagggaacucgacugggcgucgcauauccaaaagguauguacgacguggggcucccgucccguaagacguuauuucaaauccaggccgaaaggauucugaaacuucagcaaguugcugagaaauauuacggaaacaagugcaucauucccugguauaucaugaccucuggcagaacaauggaaucgacuaaagaguucuuuaccaagcacaaauacuucggcuugaagaaggaaaaugugauauuuuuccagcaggggaugcugccugccaugucauuugauggaaaaaucauucuagaggagaagaacaaagucagcauggcgccagacgguaauggcgggcucuaucgggcacuggccgcucagaacaucguggaagauauggagcaacgcggaauuuggaguauccauguauacuguguugacaauauacuugugaaggucgccgaucccagauucauuggcuucugcauccagaaaggugcagacuguggggcuaaggugguggaaaagacaaacccuaccgagccagucggaguugugugcaggguagauggcguguaccaggucguggaauauuccgagauuucucuggccacugcgcagaagcggagcuccgacggccgcuugcucuuuaaugccgggaacaucgcaaaccacuucuuuacaguucccuuccugcgagauguggucaauguguacgagccucaauuacagcaucacguagcucagaagaaaaucccauauguugacacccagggacaacugauuaagccggacaaacccaacgguauaaagauggaaaaauuuguguucgauaucuuucaguucgccaagaaguuugucguguacgagguccucagagaagacgaguucucaccucuuaaaaaugcugauagucagaacggcaaggacaauccaacgacugccaggcacgcacugaugagcuugcaucacuguugggugcuaaacgccgggggacauuuuauugaugaaaauggcucucggcugcccgcuaucccucgucucaaagacgcgaacgauguuccaauacagugcgagauuucaccccugaucuccuaugccggugaggggcuugaaagcuacguggcagacaaggaguuccacgcuccgcugaucauugaugaaaauggcguacacgaguuggucaaaaacggaaucuga

SEQ ID NO: 64436 - RNA, 3261 nt, Artificial Sequence
  derived and/or modified sequence opt3 from UBA1__Homo_sapiens__XP_011542255
augcugacccucgagaaccuucaguucggcgacagcggguccaugcugugcgugaucuaccacuuggauaaucccgucggaaagaugucuucaaguccuuuaagcaaaaagagaaggguuuccgguccagacccgaaacccggcucuaacuguucgccugcccaaucagugcugagcgaaguaccaagugugcccacaaaugggauggcuaagaacggauccgaggcagauauugacgaaggccuauauucucggcagcucuacguccugggucaugaggccaugaaacgccuucagacuagcuccgugcugguuucaggguugcgaggacucggcguggaaauagcgaagaauaucauucugggcggggucaaggcugugacgcugcacgaucagggaaccgcccaaugggcagaccucaguagccaguuuuauuuacgugaggaggauaucgguaaaaacagagccgaaguaucucagccuaggcuggcugagcuuaauuccuacguuccagugacagcauauacuggccccuuggucgaagacuuccugucaggguuucagguggugguccuaaccaacacaccucucgaggaucaacugcggguuggagaguucugccauaaucgcggcauuaaguuggugguagccgacaccagaggucuguuugggcaguuguucugugauuuuggagaagagaugauccucacugacagcaacggcgaacagccacugagugcuauggugucuauggucacaaaagauaauccgggcgugguuaccugcuuagacgaggccaggcacggguucgaauccggagacuuugugagcuucucggagguccaggguaugguggagcugaacggcaaucaacccauggaaauaaagguacucgggccuuacacguuuucuaucugugauacuuccaacuucucagacuauauucggggaggcaucguuagucaggugaaagucccaaagaagauuagcuuuaaaucccuuguggcgucucuggcagagcccgauuucgucgugaccgacuucgccaaguuuagccgcccugcucaguugcauaucgguuuccaagcccuacaccaguuuugcgcacagcacgggcgaccacccagaccgaggaaugaagaggaugcugccgaacugguugcgcucgcccaggcagugaacgcucgggcccugccugcuguacaacagaacaaucuugacgaggaucugauacguaaauuggccuacgucgcagccggcgaccucgcucccauuaacgcguucaucggaggccuggcagcccaggaggugaugaaggcuuguucagggaaauuuaugccaauuaugcagugguuauacuucgaugcccuggaaugccuaccugaggacaaggaaguucucacagaggauaaaugucugcaacgccagaauagauaugacggacagguggcagucuuugguagugaccuucaggaaaaguugggcaagcaaaaauacuuccuggugggggccggagcuaucggcugcgagcuccugaagaacuuugccaugaucggucuuggguguggcgagggaggcgaaauuauaguaacugauauggacaccaucgagaaauccaaucugaacaggcaguucuuguuucggcccugggaugugacaaagcucaaaagcgacaccgcagcggcugccguucgacagaugaauccacauauucgcgucacgucucaccagaacagaguggggcccgauacugaaaggaucuaugacgaugacuucuuucaaaaucuggauggaguggcaaacgccuuagacaaugucgaugcucggauguacauggaccgcagaugcguuuauuacaggaagccucugcuagagucagguacacucggcaccaaggggaacguacagguggugauaccauuccugacugagaguuauagcuccucucaggauccgcccgaaaaaucgauuccuaucugcacacuuaagaauuucccaaacgccaucgagcauaccuugcaaugggcacgugacgaauuugagggacuguucaaacagcccgcugaaaaugucaaccaguaccucacggacccuaaguuuguggagcggacccugcgauuagccggcacacagccacuggagguucuugaagcggugcaaagaagccuuguccuccagaggccccagacuugggccgauugugugaccugggcuugccaccacuggcauacacaguacuccaacaauauucgccaacugcuacacaacuucccgccugaccagcugacuucaaguggugcaccauuuuggucugggcccaaacgguguccucauccccucaccuucgauguuaauaacccacugcaccuugacuaugugauggccgcugccaauuuguuugcacagacauacggccugaccggaagccaggauagagcggccguagcuacuuucuuacaauccguccaggugccugaguuuacgcccaagucaggcgugaagauccaugucagcgaccaggaacuccaaucugccaacgcauccguugaugacaguaggcuggaggaacuuaaagcuacacugccaagcccggauaaguugccuggguucaaaauguaucccauugacuuugagaaggaugacgauucuaauuuccacauggacuuuauaguggccgcauccaaccuccgcgccgagaauuacgacaucccaucagcugaucgacacaaaaguaagcugauugcgggaaagaucauccccgccauugcaaccacuaccgcugccguagugggccuagucugccuggaacucuauaaagugguucagggucaucggcagcuggacagcuacaagaacggguuccuuaauuuggcccugccuuucuuuggauucucggagccauuagcugcaccccgucaccaguauuacaaccaagaauggacacucugggauagauuugaggugcagggccugcagccuaauggugaagagaugacccuuaaacaguuccuggacuacuuuaagacugagcauaaacuagaaauaacaaugcucucccaaggcgucucuaugcuguauagcuucuuuaugccggccgcgaaguugaaagagaggcuggaucagccaaugacggaaaucgugucacgcguuaguaagcggaaguuagggagacacgugagggcucucguccuggagcuuuguugcaacgacgaguccggagaagauguagaggugcccuacguucgauauaccauucgcuga

SEQ ID NO: 64437 - RNA, 1923 nt, Artificial Sequence
  derived and/or modified sequence opt3 from UBA2__Homo_sapiens__NP_005490
auggcccugagcagaggccuccccagggagcuugcugaagcaguggccgggggacggguccugguugugggugcgggcgggaucggaugcgaguuguuaaagaaccugguacuaaccggcuucucccacauugaccucauagaucuggacacaaucgaugugucuaaucuuaaccgccaguuucuguuccaaaagaagcaugucggucgaucaaaagcucagguggccaaggaaaguguuuugcaguuuuacccuaaagcaaauauuguggccuaucacgacagcaucaugaacccagauuacaaugucgaguucuuucgucaguucauucucgugaugaacgcucuggacaauagagcagccaggaaccauguaaaucggaugugucuggcugccgauguuccgcucaucgaauccgggacugcgggauauuuaggccaagugacgaccauaaagaagggcgucacagagugcuacgagugucaccccaaaccuacucagcgcaccuuuccagggugcacaaucagaaacacccccucugaaccuauucauuguaucgugugggcaaaguaucuguucaaucagcuuuuuggagaggaagacgccgaucaggaggugucgccagacagggcugaucccgaggccgcaugggaaccuacugaggcugaagcccgggcgcgcgccucaaacgaggacggugauauuaaacgaaucagcacaaaggaaugggcaaaaaguaccggcuacgacccagucaaguuguucacgaagcuguuuaaagacgauauaagauaucuacucacuauggacaagcuguggaggaaacggaagccgcccguuccucuugauugggcugaggugcaaucccagggggaggaaaccaaugccucugaccagcagaacgagccacaacugggauugaaagaucagcagguacucgacgugaaaagcuacgcucgucuguucuccaaaucaauugaaacauuacgcguccaccuggccgagaagggcgauggugcagaacucaucugggacaaggaugaccccagugccauggauuuugugacuagcgcugcgaaucuuagaaugcacauuuucucuaugaacaugaaauccagguucgacaucaagucaauggcagggaacaucauuccugccauagcuaccacaaaugccguuaucgcaggacugauuguguuggagggccuaaaaauccugagcggcaagauagaccaaugccggaccauuuuucucaacaaacagccaaauccccgaaagaagcugcuugucccgugugcccuggauccucccaacccaaauugcuacgugugugcuaguaaaccugagguaacgguucgcuugaacgugcauaaggucacugugcucacacugcaggacaaaaucgucaaggaaaaauucgccaugguggcacccgauguucagaucgaggacgggaagggaaccauuuuaaucucuuccgaagagggugaaacugaggcgaauaaccacaagaaacugagcgaguuuggcauuagaaaugggucgaggcuacaagcugaugacuuccuccaggauuauacacugcuuauaaacaucuugcauucugaagaccugggaaaggauguggaguuugaaguagucggcgacgccccagagaaagugggucccaagcaggcagaggaugccgcuaaauccauuaccaaugggucagacgauggcgcccagccuaguacgagcaccgcacaagaacaggacgacguucucaucguggauuccgacgaggaagauucuagcaacaaugcugacgucucagaggaagaacggagucgcaagagaaagcuggaugagaaagaaaaccuuuccgccaagaggagccguaucgagcagaaagaggagcuggacgaugugauugcguuggacuga

SEQ ID NO: 64438 - RNA, 1392 nt, Artificial Sequence
  derived and/or modified sequence opt3 from UBA3__Homo_sapiens__NP_003959
auggccgacggcgaggaacccgagaagaaaagaaggcggaucgaagaacugcucgcugaaaagauggcaguggaugggggaugcggugacaccggcgauugggaggggcgcuggaaccacgucaaaaaguuccuugagcgaagcggaccuuuuacacauccagacuucgaaccguccacugagucucugcaguuuuuguuagauacguguaaaguucuggugauuggcgccggugggcuaggaugcgaacuccugaagaaucuugcgcugucaggcuuccgucaaauacacguaaucgacauggauaccauugacgugaguaacuugaauagacaguuucucuucaggcccaaggauaucggccggccuaaagcugaggucgccgcagaguuucugaacgaccgcgugccaaauuguaacguugugccccauuucaauaagauucaggauuuuaacgacacauucuacagacaguuucacaucauagucugcgggcuggauagcaucauugccaggcgguggaucaauggaaugcucauuuccuuacugaacuaugaagacggugugcuugacccuucuucgaucguaccauugauagauggcgggacugagggauucaaaggcaaugcucgcguuauucugcccgguaugaccgcauguaucgaaugcacacuagagcucuacccuccacaagugaacuuuccgauguguaccauugccucaaugccccgacugccugaacauugcaucgaguaugucagaaugcuucaguggccaaaggagcagcccuucggggaaggagugccucuggacggcgaugacccagagcacauccaguggauuuuccaaaagagcuuggaaagggcuagucaguacaauauacggggcgugacuuaucgucucacacagggggucguuaagcgcaucauucccgccguggcguccaccaacgcaguaaucgccgcugugugugccacggaggucuuuaagauagcaacuucugcuuacauuccgcugaauaacuauuuaguguucaacgauguugacggacuguacaccuacacauuugaagccgagagaaaagagaauugcccugcguguagccagcucccccaaaacauccaguucuccccaucagccaaacuucaggaagugcuggauuauuugacuaauagugcaagccuacaaaugaaaucuccugcuaucaccgccacacuggaggguaagaacaggacccucuaccugcaguccgucacgucaauugaggagcggacucgacccaaucuuagcaaaacacugaaggaauugggccucguggacgggcaggagcuggcuguagccgauguuaccacuccacagacaguguuauuuaaacugcacuucaccaguuga

SEQ ID NO: 64439 - RNA, 3039 nt, Artificial Sequence
  derived and/or modified sequence opt3 from UBA7__Homo_sapiens__NP_003326
auggacgcccuggaugcuagcaagcuccuugacgaggaacuguacuccagacaguuguauguguuaggcucucccgcaaugcaaaggauccagggggcccggguccugguuucaggacuacagggucucggcgcggagguggcuaaaaaccugguacuuaugggggugggaagucugaccuugcacgauccucauccaacaugcuggagcgaccucgccgcacaguuccugcuguccgaacaagaucucgagcgcucucgagccgaggcuucgcaggaguuacuggcacagcuuaaucgugccguccaggugguugugcacacuggcgacauuacggaggauuugcugcuagacuuucaagucgugguacucaccgcugccaagcuggaagaacagcuuaaaguugguacacugugucauaagcacggggugugcuucuuggcggcagauacuagaggacucgucggccagcuguuuugugacuucggcgaagauuuuaccgugcaggacccgacagaggccgagcccuuaaccgcugccauacaacauaucucacaggggagcccuggcauucugacucucaggaaaggugcaaacacacacuacuuccgggauggcgaccuugugaccuuuagugggaucgaaggaauggucgagcugaaugacugcgauccacgcuccauucacguuagagaagacggcucuuuggagaucggugauacgacuaccuucagcagguaucuacgcgggggagcuauaacagaagugaagcggcccaagacuguacgacauaaaucccuggacaccgcccuccugcagccucacguggucgcgcaaucaagucaggaggugcaucacgcccacugucuucaucaggcauuuugcgcucugcacaaguuccagcauuugcacggcagaccaccccaaccuugggauccaguugacgccgagacaguggucggccucgcuagggaucuggaaccguuaaaacggaccgaggaggaaccccuggaggaaccucuagacgaggcccucgugcguacgguagcacugagcucugccgggguucuuuccccaaugguggcuauguugggagcggucgcagcccaggaagugcugaaggcuaucucacgcaaauuuaugccccucgaucaguggcuguacuucgacgcccuugauugucugccugaggacggugaauugcucccaagccccgaggacugcgcacugagaggcaguagguaugaugggcagauugccgucuuuggagcuggcuuccaagaaaaguuacggcgacagcauuaccugcuagugggugccggggcaaucggcugugagcuccugaagguuuucgcgcuugugggauugggcgcugggaacucuggaggucugacuguagucgacauggaucacauugagcgcuccaaucucagcagacaguuucuguucaggucgcaggacgugggccggccgaaagccgaaguugcagccgcugccgcacgcggguuaaacccugaucugcaagugaucccccuuacauauccauuggacccuaccacugagcacauauacggagauaacuuuuucucuagagucgacggcguggcugccgcgcucgauuccuuucaggccaggcguuacguagcugcacggugcacacauuaucugaagccccuacuggaagccgguaccucagggacguggggcagugcuaccguguucaugccacacguuacagaggccuaccgagcacccgcgagcgccgcugccuccgaggacgcaccuuauccagucuguacugugagauacuuuccgucuaccgcugaacauacacuccagugggccaggcacgaguucgaggaacuguuucgccuuagcgcagaaacuauuaaucaccaucagcaagcccacaccucauuggcugauauggacgagccccagacacugaccuuacucaaaccugugcugggaguccuucggguuagaccacagaauuggcaagauugcguggcgugggcccugggccauuggaaguugugcuuccacuaugggaucaaacagcuccugaggcauuuucccccuaacaaggugcuagaggacggaacuccauucuggaguggucccaaacaguguccgcagccucuggaauuugacacgaaucaagauacacaccuccuguacguacuugcagcugccaacuuguaugcccagaugcacggccugccagggucccaggacuggaccgcuuuacgcgagcuccugaaacuucugccccagccugauccccaacagauggcaccaauuuucgccagcaaucuagaacucgcgucugcuucagccgaguucggaccugaacagcagaaggagcugaacaaggcauuggaggucuggagugugggacccccacugaagccguuaauguuugaaaaagacgaugacagcaauuuccauguugauuuuguggucgccgcugcaucccuccgaugccaaaacuacgguaucccucccgugaaccgggcccagucuaagcguaucguugggcagauuauaccagcgaucgcuacuaccacagccgcaguggccggccugcuuggacuggaguuguacaaaguagucucgggccccagaccuaggagcgcuuuccgccacuccuaucuccaucuggccgaaaauuaccuaauucgguauaugccauuugcacccgcuauccaaaccuuccaccaucugaaguggacuucaugggacagacuuaaggugccugccgggcagccggagaggacacucgaaagucuguuggcgcaucugcaggagcagcacggauuacgagugcgcauacuccugcacggcucugcccuucuguacgcagcugguuggagcccagagaaacaagcccagcacuugccccuccgggucacggaacugguucagcagcuaaccgggcaagcuccugcaccaggacagagagugcugguacuugagcucuccugugaaggcgaugacgaggauacugccuuucccccucugcauuaugaguuguga

SEQ ID NO: 64440 - RNA, 1218 nt, Artificial Sequence
  derived and/or modified sequence opt3 from UBAC1__Homo_sapiens__NP_057256
auguucgugcaggaggaaaagaucuuugccggcaaaguccugagacuccacauuugcgcuagcgacggggcagaguggcuugaagaggccaccgaagauacauccguugagaagcugaaagagagguguuugaagcauugcgcgcacggaucuuuagaagaccccaaaucaauaacucaucacaagcugauccaugcugccagugagcgggugcuaagcgaugcacgcacgauucucgaagagaacauccaagaccaggauguacugcuucugauuaagaaacgagccccuuccccauugccgaagauggcugacgugucugcagaggagaaaaagaaacaggaucagaaggcccccgacaaggaggcuauccuccgugccaccgcgaaucugccuucguacaacauggauagagcagccguccaaacaaauaugagggacuuccagacugaacugcggaaaauacucgugucauuaaucgagguugcucagaagcugcuugccuugaacccagaugcaguggaacuguuuaaaaaggcuaaugccaugcuagacgaggaugaggacgaacgcgucgacgaggcggcccucagacagcugaccgaaauggguuuccccgagaacagggcaacaaaagcccuucaacugaaucacaugagcgugccucaggcuauggaaugguugauugagcacgcugaggauccaaccaucgacacuccccucccuggccaggccccaccggaagcagagggggccacagcugcggcaagugaagccgcugccggagcauccgccaccgaugaggaagcucgggacgagcugacggagauuuuuaagaaaauccgccgaaagagagaguucagggccgaugcacgggcgguaauaucuuuaauggaaaugggcuuugacgaaaaggagguuauugaugcucugcgugugaacaauaaccagcaaaaugccgcaugugaguggcuccuuggugaccgcaaacccagcccugaagaacuggauaaggggaucgacccagauucccccuuguuccaggccauucuagacaacccugucgugcagcugggacucacuaauccaaaaacccugcuugcuuuugaagacaugcuggagaacccccucaauucaacacaauggaugaacgauccggaaacuggcccugugauguugcagaucaguagaaucuuccagacccugaacaggacauga

SEQ ID NO: 64441 - RNA, 1035 nt, Artificial Sequence
  derived and/or modified sequence opt3 from UBAC2__Homo_sapiens__NP_001137544
auguucaccagcacaggcuccucugggcuguacaaggcuccccucucaaaaagucuucuguuggugccuagcgccuuaucccugcuacucgcacugcuucugccacacugccagaaguuguuugucuaugaccuccaugccguuaaaaacgauuuccaaaucuggagacugauuuguggaaggauaaucugccuggaccucaaggauacuuuuuguucuucguuacugauuuacaauuuccggaucuuugagcgccgauaugguucacguaaauucgcgagcuuucuuuugggcaguugggugcuguccgcucuauucgacuuucuccugauugaagccaugcaguacuucuuugggaucacggcagccucuaaccuuccgagcggauuccuggcucccguauuugcauuguucgugccuuucuauugcuccauaccaagaguccagguggcccagauccucggcccccugucaauuaccaauaagacauuaaucuacauucugggucuccaacuuuuuacuucugggagcuauaucuggauaguugcuauuucuggacugauguccggcuuguguuacgauucaaagauguuccaggugcaccagguccuaugcaucccuagcuggauggccaaauuuuucaguuggacccuggagccaauuuuuaguuccagcgaacccacaucggaggcgaggaucggcaugggggcaacccucgacauccagcggcaacagcgcauggaacugcuugauagacagcugauguucucucaguuugcccaaggaaggcggcagcgccagcaacaggguggcaugauuaacuggaaucgauuguucccuccacucagacagaggcagaacgugaauuaccaagggggacggcaguccgagccggcugcacccccucuggagguaucagaggaacagguugcccguuuaauggaaaugggcuuuagucgcggugacgcucuggaggcccuaagagcgagcaacaaugaucucaacguggccacuaauuuccugcuucagcauuga

SEQ ID NO: 64442 - RNA, 1701 nt, Artificial Sequence
  derived and/or modified sequence opt3 from UBAP1__Homo_sapiens__NP_001164672
augagcggcgccgugagagggaggcggcgcgaggucggacugcagcacgguggcugcgggaccggaggcgguuacggggacggacucgcucgauccggccaaucuuggcguugguggagaucacuuagucugggcgcaguugggagcuccgccggaacagaacccgguaggccugcgggcgcuucuacuuuccgguuguuacgcagaaggcagcagcggcauucggggacguuuucauaucuggaugacgugccauucaagaccggagauaaauuuaagacaccggccaaaguaggccuacccaucgguuucagccucccugacugucuucaggugguccgcgaggugcaauacgauuuuagucuugaaaagaaaacuauugagugggcagaagagauaaagaagaucgaggaagccgagcgagaagcugagugcaaaauugcagaggccgaagcuaagguuaacuccaaaucugggccagagggagacagcaagauguccuucucaaaaacccacaguacagccaccaugcccccuccaaucaaucccauucuggcgagcuugcagcauaacucuauccucacuccuacaagaguguccucaagcgcaaccaagcagaagguccugaguccaccgcacauaaaagccgauuuuaaucuggcugacuucgaaugugaggaagaucccuuugacaaccucgaguuaaagacgaucgaugagaaagaagaacugaggaauauucuugugggcacuaccggcccuaucauggcccaguugcuggacaacaaucuaccacgugggggaucugguuccguacuccaagaugaagagguucuggcaagccuugaacgggcuacacuggacuucaagcccuugcauaaaccuaacggcuuuauuacucucccacagcuggggaauugcgagaagaugucguuaucuuccaaagugucacugcccccgaucccugccgucaguaacauaaagagccucuccuuccccaagcuggacucugaugacagcaaucagaaaaccgcgaagcuggccucaacauuucacaguaccuccuguuugcgcaacggaacguuccagaauagccuaaaaccaucuacucaaucaagugcaagcgagcugaacggccaccauacacucggucuguccgcucuuaaucuggauucugggaccgaaaugccugccuugacuucgagccagaugcccucccucucagugcugagugugugcacagaggaaucuagcccacccaacaccggcccuacggucaccccaccgaacuucuccguuucacaggugcccaauaugccuagcuguccacaggcuuauucugaguuacaaaugcugucccccagugaaagacagugcguagagacaguggucaacaugggauacagcuaugagugugugcuaagggccaugaagaaaaagggcgaaaauauugagcagauccucgacuaccuguuugcacacgggcaacuuugcgaaaagggauucgauccuuugcugguugaggaggcccucgaaaugcaucaguguucugaggagaaaaugauggaguuucugcagcuuauguccaaguucaaagaaauggguuuugagcugaaggacauuaaagagguguugcuccugcacaacaaugaucaggacaacgcuuuagaagaucugauggcgcgggcaggcgccucauga

SEQ ID NO: 64443 - RNA, 2559 nt, Artificial Sequence
  derived and/or modified sequence opt3 from UBAP2__Homo_sapiens__NP_001269458
auggacagcaagggccuggggagaauccucuggaaauccggacagcaaaagaccggucuuaaaauuauagaucugguggccuuguuacagaagcccgucccucacucucaggcuucagaggcaaacaguuucgaaacaagccagcaacagggcuuugggcaggcccugguuuucacuaauucccagcacaacaaucaaauggcgccaggaacggguucuucgaccgcugugaacucaugcagcccgcagagucuauccucuguacucggcagcggguuuggagagcuggcacccccuaaaauggccaauaucacauccucacagauucuugaccagcugaaggccccaaguuugggccaauucacuaccacacccagcacccagcagaacucuacuucccacccuacaaccacgacuucaugggaucucaagccacccaccagccaaaguucugugcugucccaucuggacuuuaaaagccagccugaaccaucgccgguccucucucaguuaucccagaggcaacagcaccagucacaggcugugacaguucccccuccaggccuggagaguuuccccagccaagcaaaacuucgggaauccacuccuggggauucuccaagcaccgugaauaaguugcugcagcuacccucaacaaccaucgagaacauuagugucuccgugcaucagccgcagccuaagcacaucaaacucgccaagcgccgaauacccccagcuagcaagaucccugccucugcgguagagaugcccggaucagcagacguuacgggucugaaugugcaauuuggcgcccuugaguucgggagugaaccaagccuguccgaauuuggaucugcucccucgagcgagaacuccaaucagauuccuaucucauuguacaguaaaucucucagcgagccacugaacacuuccuuaucaaugacaagcgccguccaaaauucuaccuauacuacauccgugauuaccaguuguagccugacgucuuccucacucaacagugcaagcccgguggcuaugucguccucuuacgaucagagcucaguccacaaucguauccccuaucagaguccuguuuccucuagcgaauccgccccaggcaccauaaugaacggucaugggggaggcagaucacagcagacacuugacacucccaagaccacaggcccuccaagcgcgcugcccagugugucuuccuugccgagcacuaccucgugcacagcccuacugccuucaaccucucaacacacuggggaucucacgaguuccccacugagccagcuuucuagcucccugucaagucaucagagcucuuuguccgcacacgcugcccucucaaguagcacaucccacacccaugcuucuguagagucggccagcucacaccaguccagugcaacuuucucuaccgccgcuacaagcguguccucaucugcgagcaguggagucucccugucaucuucaaugaacaccgcaaauuccuuaugucuggguggcacucccgccagugcuagcucgucuuccagcagggccgcaccucuagugacaucagggaaagcucccccaaaccucccucaaggaguucccccacugcuucauaaucaguacuuggugggcccgggugggcugcucccugccuaucccauuuacggcuaugacgaacugcagaugcuucagagucggcugccagucgauuacuacggaauccccuuugccgcaccuacggcguuggcuucucgcgacggcucccucgccaacaauccauaucccggggaugugaccaaguucggaagaggugacagcgcaagcccugccccggcuacuacaccagcccaaccccagcagagucagagccaaacccaccauacagcacagcagccuuuuguaaacccagcucugcccccuggcuacuccuauacuggguuaccguacuauaccggaaugcccucugccuuccaauacggcccaacgauguucguuccucccgcgagcgccaaacagcacggugugaaucuguccaccccaacaccucccuuucagcaggcuucaggguauggccaacacggauacucuacuggcuacgacgaucuaacccaggggacagcagccggagacuauaguaaggguggcuacgcugggucgagccaggccccaaacaaauccgcaggaucuggcccggguaagggggucucagugagcuccaguacuaccggccucccugauaugacgggaucugucuauaauaagacacagaccuucgacaaacaaggcuuucaugcggggacucccccacccuucagccugccuucagugcuuggauccacaggcccauuggccaguggugcugcccccggguacgcaccuccgccauuucugcacauucuccccgcucaucagcagccucacagccagcuguuacaccaucaucugccccaagaugcccagucuggauccggccagaggucacagccaagcucgcuucaaccuaagucucaggcaaguaaacccgccuaugguaacuccccauacuggaccaauuga

SEQ ID NO: 64444 - RNA, 1872 nt, Artificial Sequence
  derived and/or modified sequence opt3 from UBASH3A__Homo_sapiens__NP_001001895
auggccgcuggcgagacccagcuguacgcaaaggugagcaacaaacucaaguccagaucuucacccagucuucuggaaccuuuguuagccaugggguucccaguccacacagcgcugaaagcucuagccgcaacuggaaggaagacggccgaggaagcucucgcauggcugcaugaccacugcaaugauccgagccuugacgaucccaucccucaagaguaugcccuguuuuuguguccaaccgguccccuccuggaaaaacugcaggaguucuggcgggaguccaagcgccagugcgcuaagaaccgagcccaugaaguuuuuccucacgugacacucugugacuucuuuacuugcgaggaucagaaaguagaauguuuauacgaggcgcugaagcgugcaggcgacagacuuuuggggucuuucccaaccgccgugccccuggcucuacauucgucaauuagcuaucucggauuuuucgucaguggcuccccugccgaugugauaagggaguuugcaaugacauucgcuaccgaagccucucugcuugcggacugcagcguuaaaccauguacuaagcaacugcacuugacacucgcccacaaauuuuacccgcaucaccagcggacccuggagcaguuagcacgcgcuaucccccugggucauuccugccaguggacggccgcucucuauucaagagauaugagguucgugcacuaccaaacucuucgggcccuguuucaguauaagccucagaaugucgacgaauugacccuaaguccaggggauuacauuuucguggaccccacacagcaagaugaggcaagcgaaggauggguaaucggcauuucucagcgcacuggcugucgaggguuccugccugagaacuacaccgacagagccuccgagucagacacauggguuaagcacaggauguauaccuuuagccucgcuacggaucugaauagucggaaagacggagaagcgucuucccguugcagcggugaguuccuuccacagacugcacgcucgcugucuuccuugcaagcccuccaggcuacaguggccagaaagucaguccugguggugaggcauggcgaacgggucgaucagaucuuugggaaagcaugguuacagcaauguaguacccccgacggaaaguacuaucgaccggaucugaacuucccuugcagccuaccccgcagauccaggggcauaaaagacuuugagaaugauccaccucucucuagcugcgguaucuuccagucacggauugccggggacgcucugcuugauaguggaauccgcauuuccagcguuuuugccucucccgcauugagaugugugcagacugcgaagcugauccucgaggaacugaaacuugagaagaagauaaaaauuaggguagaaccaggcaucuucgaguggacaaagugggaagcuggcaaaaccacgcccacccugaugucauuggaggaacucaaggaggccaacuuuaauauugacacagauuaccguccugcauucccacugagugccuuaaugccggcugagagcuaucaggaauacauggaccggugcacugccuccauggugcaaaucgucaacaccuguccccaggacacaggggugauccugauuguuucucacggaucgacucuagauagcugcacccgaccucuccugggucuuccacccagagaguguggcgacuuugcacaguuggugaggaaaauaccuucccuggggaugugcuucugugaagagaauaaggaggaaggaaagugggagcucgucaacccacccgugaaaacacugacccauggcgcuaaugccgcguuuaacuggcgcaauuggaucucagguaacuga

SEQ ID NO: 64445 - RNA, 1950 nt, Artificial Sequence
  derived and/or modified sequence opt3 from UBASH3B__Homo_sapiens__NP_116262
auggcccaguacggccaccccagcccucuggggauggcugcaagagaggaacucuauuccaaggugaccccaaggcggaaccgccaacagcgaccgggaacaaucaaacaugguucugcccuugacguccuguugucaaugggcuucccccgugcgagagcucagaaggccuuagcaaguacugggggaaggagcguucaggccgcuugcgacuggcuguuuucccacgugggcgacccuuuccuagaugacccacucccccgggaguacguacuguaucuucgcccuacggguccacuggcacaaaaauugucugauuuuuggcagcagucgaagcagauuugugggaaaaauaaggcccauaacauauucccccacaucacccucugccaauuuuucaugugugaagacucaaagguggaugcucugggagaggcccugcagacaacugucagcagauggaaaugcaaguuuagugcgccucucccauuagaacuguacaccuccucuaauuucauuggccuuuuugugaaagaggacagcgcagagguuuugaagaaauucgccgcugauuuugccgcagaagcugccuccaagacagaggugcaugucgaaccgcacaagaaacagcugcacgugacccuagcguaucauuuccaggccucacaccuccccacucuggagaaguuggcacaaaacaucgacguaaaacugggcugugauuggguugcuacaauuuuuaguagggacauccgguucgccaaucaugagacccuucaggugauauacccuuauacgccacagaacgaugacgaacucgagcugguccccggggacuucaucuuuaugagcccuauggaacaaacuucuaccuccgagggauggauuuacgguacaucauuaacuaccggcugcagcgggcugcucccagaaaauuacaucacaaaggcugaugaguguaguaccuggauuuuccacggaucuuauuccauccuuaacacgagcucgucuaauucccugacuuuuggcgacgguguguuggagcgccgacccuacgaagaucaggggcuaggagagacaaccccgcugacuauaauuugccagccuaugcagccccucagagugaacucacaaccaggcccucagaaaaggugucuguucgucugccggcacggcgaacguauggacguuguguuugggaaguauuggcuuagucaguguuucgaugccaaaggacgcuacaucagaacaaaucugaacaugccccauagcuugccacagagguccgguggcuuucgggacuaugagaaggaugcacccauuaccguauucgggugcaugcaagcccgacucgugggagaagcucuguuagagucuaauacgaucaucgaccacgucuacugcagcccuucacugcgcugugugcagaccgcgcauaacauucuaaagggccuccagcaggagaaucaccugaaaauaagaguugaaccaggucuuuuugaguggacaaaguggguggcagggaguacuuugccggccuggauucccccuuccgaacuggcugccgcaaaccucagcgucgauaccacauauaggccacauauccccaucucuaaacuggugguaucagagaguuacgacacuuacauaagccgguccuuccaaguuaccaaggaaauuaucucugagugcaaaucgaagggcaacaauauccuuauuguggcccacgcuagcucccuggaggccuguacaugccaguugcagggacucucaccucagaacaguaaggauuuuguccaaauggugcgcaaaaucccauaucugggcuucuguucuugcgaagaguuaggggaaaccggaauuuggcagcugacugaucccccgauacuaccucucacgcacgguccaacaggcggguuuaauuggagagagacccugcuucaggaguga

SEQ ID NO: 64446 - RNA, 690 nt, Artificial Sequence
  derived and/or modified sequence opt3 from UBB__Homo_sapiens__NP_001268647
augcagaucuucgugaagacccugacaggcaaaacuauuacgcucgaggucgaacccagcgacaccauagagaacguuaaggccaaaauccaagauaaggaagggauuccuccagaccagcagagacuuaucuuugcuggaaaacagcuggaggaugguaggacauuguccgacuacaauauucaaaaggaaucuacuuuacaccuggugcuacggcuccgcggcgggaugcagaucuucguaaagacccugacaggaaaaaccauaacucuugagguggagccgucagauacaaucgaaaacgucaaggcaaaaauucaggacaaggagggcauucccccugaucagcaacgacugaucuuugccgguaaacaguuggaagacgggcguacccucagugauuauaauauccagaaggagagcacgcugcaucuggugcucagauuaaggggaggcaugcagauauucguuaagacucugaccggcaaaacaauuacucuugagguggaaccauccgacaccaucgagaacgucaaggcgaaaauucaagauaaggaagggauucccccugaccagcagcgguugaucuuugcuggaaaacaacuggaggauggucgcacacuaucugacuacaauauccagaaggaaucgacccuccaccuggugcuuagacugaggggcgggugcuga

SEQ ID NO: 64447 - RNA, 2058 nt, Artificial Sequence
  derived and/or modified sequence opt3 from UBC__Homo_sapiens__NP_066289
augcagaucuucgugaagacccugacaggcaaaacuauuacgcucgaggucgaacccagcgacaccauagagaacguuaaggccaaaauccaagauaaggaagggauuccuccagaccagcagagacuuaucuuugcuggaaaacagcuggaggaugguaggacauuguccgacuacaauauucaaaaggaaucuacuuuacaccuggugcuacggcuccgcggcgggaugcagaucuucguaaagacccugacaggaaaaaccauaacucuugagguggagccgucagauacaaucgaaaacgucaaggcaaaaauucaggacaaggagggcauucccccugaucagcaacgacugaucuuugccgguaaacaguuggaagacgggcguacccucagugauuauaauauccagaaggagagcacgcugcaucuggugcucagauuaaggggaggcaugcagauauucguuaagacucugaccggcaaaacaauuacucuugagguggaaccauccgacaccaucgagaacgucaaggcgaaaauucaagauaaggaagggauucccccugaccagcagcgguugaucuuugcuggaaaacaacuggaggauggucgcacacuaucugacuacaauauccagaaggaaucgacccuccaccuggugcuuagacugaggggcgggaugcagauauucguaaaaacguugacuggaaagacaaucacccucgagguugagccaucagacacuauugaaaacgugaaggccaaaauccaggauaaggagggcauacccccugaccaacagcggcugauuuuugcagguaaacaguuagaagaugggcgcacacugagcgacuauaauauccagaaggagaguacccuccaucuuguccugcgauugagaggaggcaugcaaaucuucgugaaaacgcuaaccggcaagacaauuacucuggaaguggagccauccgauaccaucgagaacgucaaggccaaaauucaggacaaggaagggauaccgcccgaucagcagaggcucaucuuugcuggaaaacaacuggaggacggucggacacuuucugauuacaauauucagaaggaaagcacucugcacuugguucuccgucugcgcggcgggaugcagaucuucgugaaaaccuuaacaggaaagaccaucacucuggagguagaaccuuccgacacgauugagaacgugaaggcaaaaauacaggauaaggagggcaucccacccgaccaacagagacuaauuuuugccgguaaacagcucgaagacgggaggacacugucagauuauaauauccaaaaggagaguacccuucauuugguccugcggcuccgaggcggaaugcagauuuucgugaaaacucugaccggcaagacaaucacccuugaaguugagccuagcgacacuauagagaacgugaaggcuaaaauccaggauaaggaagggauuccacccgaccagcaacgccugaucuuugccggaaaacaguuggaggaugguagaacacucucugacuacaauauucagaaggaauccacgcugcacuuaguccugaggcuacggggcgggaugcagaucuucgugaaaacccucacuggaaagacaauaacccuggagguagaaccgucagauacaauugagaacguuaaagcgaagauccaagacaaggagggcauuccucccgaucagcagcgccuuaucuucgcagguaaacaguuggaagacgggagaacucugagcgauuauaauauacaaaaggagaguacccuccaccugguguuaaggcugcguggcggaaugcagaucuuugucaaaacgcuuaccggcaagacaauuacuuuggaaguggagccaucugacaccaucgaaaacgucaaagccaagauucaggauaaggaggggaucccucccgaccaacagcggcucauauucgcuggaaaacagcuggaggacggucgaacacuauccgauuacaacauucagaaggaaagcacucugcaucucgugcugagacuuaggggcgggguuuga

SEQ ID NO: 64448 - RNA, 498 nt, Artificial Sequence
  derived and/or modified sequence opt3 from UBD__Homo_sapiens__NP_006389
auggcccccaacgcuagcugccugugugugcacgucagauccgaggaaugggaccucaugaccuucgaugcaaauccuuacgacucuguuaagaaaaucaaggagcaugugaggucaaaaacaaagguaccagugcaggaucaaguccuucuguugggcaguaaaauuuuaaagccgcggcgcagccuguccucuuaugggauagacaaggagaaaacuauccaccuaacgcucaaggugguuaaacccucggaugaagaacugccucuuuuucugguggagucaggagacgaggccaagcgacauuugcuccagguccguagaagcaguuccguggcgcagguaaaagcuaugauugaaaccaagacagguaucauuccagagacucagaucguuaccugcaacggcaagaggcuggaagaugggaaaaugauggccgacuacggaauacggaagggcaaucuccuguucuuagcauguuauugcaucgguggguga

SEQ ID NO: 64449 - RNA, 360 nt, Artificial Sequence
  derived and/or modified sequence opt3 from UBE2A__Homo_sapiens__NP_001269090
augguguggaacgccgucaucuucggccccgaggggaccccuuuugaagacggaacauucaagcugacuauugaguuuacggaagaguacccaaauaaaccgcccaccguuagauucgugagcaagauguuucacccuaacguauaugcugaugguuccauaugccucgacauccuucagaauagguggucuccaacauacgaugugucaaguauucugacuagcauccaauccuuguuagacgaacccaacccuaauucuccagcaaacucgcaggccgcgcagcuguaucaggagaauaaacgggaguacgaaaagcgcgucucagcuauuguggagcaaagcuggcgagauuguuga

SEQ ID NO: 64450 - RNA, 459 nt, Artificial Sequence
  derived and/or modified sequence opt3 from UBE2B__Homo_sapiens__NP_003328
augagcacccccgccagaaggcggcugaugcgcgacuucaagcgacuccaggaggauccuccagugggcgucuccggggcuccgucugaaaacaauaucaugcaauggaacgcaguuauuuuuggacccgaggguacaccuuucgaagacggcacuuuuaaacuugugauagaguucucagaagaguacccaaauaagcccccuacgguacguuuucugaguaaaauguuccacccaaacguguaugccgaugggagcaucugcuuggacauuuuacagaauagauggucccccaccuacgaugucucuucgauccugacaucaauucagagccuacucgacgagccuaacccaaauaguccggcgaacucccaggcugcccaacuguaucaggaaaauaagagggaguacgaaaaacgggugucugcaaucguugagcagagcuggaacgauuccuga

SEQ ID NO: 64451 - RNA, 240 nt, Artificial Sequence
  derived and/or modified sequence opt3 from UBE2C__Homo_sapiens__NP_001268671
auggccagccagaacagagaccccgcugcaaccuccguggccgcggcuaggaagggcgccgagccuucugggggagcagcccgggguccagucggcaaacgccugcaacaggaacucaugacacuuaugaugucaggggauaagggaaucagugcuuucccggagagcgacaaucuguuuaaauggguuggcacuauucacggugcagccgggacgaaccccaccuugauagugccuuga

SEQ ID NO: 64452 - RNA, 444 nt, Artificial Sequence
  derived and/or modified sequence opt3 from UBE2D1__Homo_sapiens__NP_003329
auggcccugaagagaauccagaaagagcucagcgaccuucaaagggaucccccugcucacugcuccgcaggcccagugggggacgaucuguuccauuggcaggccaccauuaugggaccgcccgacucugcguaccaggguggcgucuuuuucuugacaguucacuuuccuacugauuauccauucaagcccccuaaaauagcuuuuacgaccaagaucuaccauccaaacauuaauucaaacgggaguaucuguuuagacauucugcggagccaguggucccccgcccuaacagugucuaaaguacuccugucgaucugcucacuucugugugauccuaauccagacgauccguuggugcccgacauagcacaaaucuauaagagcgauaaggaaaaauacaaccgccacgcccgagaguggacucagaaguaugcuauguga

SEQ ID NO: 64453 - RNA, 444 nt, Artificial Sequence
  derived and/or modified sequence opt3 from UBE2D2__Homo_sapiens__NP_003330
auggcccugaagagaauccacaaagagcucaacgaccuugcuagggaucccccugcacagugcagcgccggcccagugggggacgauauguuccauuggcaagcgaccauuaugggaccgaaugacucccccuaccaggguggcgucuuuuuccugacaauacacuuuccuacugauuauccauucaagcccccuaaaguugcuuuuacgacccggaucuaccauccaaacauuaauucuaacgggucaaucuguuuggacauuuuacgcagucaguggagccccgcccugacaaucuccaaggugcuacucucuauaugcucgcugcuuugugauccuaauccagacgauccgcugguacccgaaaucgcacgaauuuauaaaacugaccgugagaaguacaacagaaucgccagggaauggacccagaaguaugcuauguga

SEQ ID NO: 64454 - RNA, 444 nt, Artificial Sequence
  derived and/or modified sequence opt3 from UBE2D3__Homo_sapiens__NP_003331
auggcccugaagagaaucaacaaagagcucagcgaccuugcuagggaucccccugcacagugcuccgccggcccagugggggacgauauguuccacuggcaagcgaccauuaugggaccgaaugacucucccuaccaggguggcgucuuuuuccugacaauacauuuuccuacugauuauccauucaagcccccuaaaguugcuuuuacgacccggaucuaccacccaaacauuaauucaaacgggaguaucuguuuggacauuuuacgcagccaguggucccccgcccugacaaucucuaaggugcuacucucgauaugcucacugcuuugugauccuaauccagacgauccgcugguacccgaaaucgcacgaauuuauaaaacugaccgugauaaguacaacagaaucagcagggaguggacccagaaguaugccauguga

SEQ ID NO: 64455 - RNA, 483 nt, Artificial Sequence
  derived and/or modified sequence opt3 from UBE2E1__Homo_sapiens__NP_001189405
augaaggaggugggcagacccagggaaguccgggggcgcccuggaaaaagccgaauccagaaggagcuggccgacauuacccucgauccaccgcccaacugcuccgcugguccuaaaggcgacaauauauacgaauggcguucuacaauccuugggccacccggaucaguuuaugagggcgguguguucuuucuggauauuacuuucacgccugaauacccauuuaagcccccuaaaguaaccuucagaacaaggaucuaucacuguaacauuaauagucaaggggugaucugcuuggacauauuaaaggauaacuggagcccagcacugacuaucuccaagguccuacucucuauuuguucgcugcuuaccgacugcaauccggccgauccccuggugggaucaaucgcgacacaguacaugaccaaccgggcugagcaugaccgcauggccagacaguggacuaaaagguaugcaacauga

SEQ ID NO: 64456 - RNA, 606 nt, Artificial Sequence
  derived and/or modified sequence opt3 from UBE2E2__Homo_sapiens__NP_689866
augagcaccgaggcccagagaguggacgauucccccucuacaucaggcgggaguagcgacggagaucaaagggaauccguccagcaggagccugaacgggagcagguucaaccaaagaaaaaggaagguaaaaucucuucgaagacugcugcaaaacugucaacgagcgccaagcgcauucagaaggagcucgcggagauaacccuugacccgcccccuaacugcagugcuggcccaaaaggggauaauaucuacgaauggcgauccacaauucugggacccccuggcucuguguaugagggugggguauucuuuuuggacaucacuuucagcccagauuaccccuuuaagccuccaaaagugaccuuccguacaagaauuuaucacuguaacaucaauucccagggagucauaugcuuagacauccugaaggauaacuggucaccggcccuaaccauuaguaaagugcuccugagcaucuguucucuucugacugacugcaaucccgcagauccuuugguuggcuccauugccacacaguacaugaccaacagggcugaacaugaccggauggcacgccaauggacgaagagauaugccacuuga

SEQ ID NO: 64457 - RNA, 624 nt, Artificial Sequence
  derived and/or modified sequence opt3 from UBE2E3__Homo_sapiens__NP_006348
augagcuccgacagacagaggucugaugacgagucacccaguaccagcuccgggucuucggaugccgaccaacgggauccugcugcaccagaaccggaggaacaggaggaacgcaagcccucagccacacagcagaaaaagaacacuaaacugagcaguaagacgaccgcgaaacucuccacaucugcuaagcgaauccaaaaggagcuugccgagauuacucuggacccuccacccaauugcagcgcagggccuaaaggagauaacauauacgaauggcguuccaccaucuuggguccacccggcucaguguaugagggcggagucuucuuuuuagacauuacauucaguagcgauuacccuuuuaagccaccgaaaguuaccuucagaacuaggaucuaucacuguaauauuaacucucagggcgugaucugccuggacauacuaaaggauaauuggucccccgcccucacaaucucaaaaguacugcuuagcauuuguagucuguugaccgacugcaacccugcugauccacucguggguucuaucgcaacgcaguaccugacuaaucgggccgaacaugaccgcauugcuagacaguggaccaagagguaugccacauga

SEQ ID NO: 64458 - RNA, 513 nt, Artificial Sequence
  derived and/or modified sequence opt3 from UBE2G1__Homo_sapiens__NP_003333
augaccgagcugcagagcgcccuccuucugagaaggcaauuggcugaauuaaacaagaaucccguggagggcuucuccgcagggcugaucgacgauaacgaccuauaccggugggaaguccucauuauaggaccuccagauacacuguaugaggguggcguuuuuaaagcccaccuuacuuucccgaaggacuacccccugcgcccuccaaaaaugaaguuuaucacggaaauuuggcaucccaauguggauaaaaacggggacguaugcaucucuauuuugcacgagccuggagaggauaaguauggcuacgaaaagccagaggaacgauggcuccccauccauaccguggagacaauaaugaucucagucauuaguaugcuggcggacccuaauggugauagcccagcuaacguggacgccgcaaaagaguggcgugaagauagaaauggggaguucaagaggaaaguugcccggugugugcgcaagucccaggaaacugcuuuugaguga

SEQ ID NO: 64459 - RNA, 498 nt, Artificial Sequence
  derived and/or modified sequence opt3 from UBE2G2__Homo_sapiens__NP_003334
auggccggcaccgcucugaagagacucauggcagaguacaaacagcuuacacugaaucccccugaagggaucguggccggaccaaugaacgaggaaaacuucuuugagugggaagcguugauuauggguccggaggacacuugcuucgaguuuggcgucuuccccgcuauacugagcuuuccuuuagauuauccacuaucucccccuaagaugagguucacgugugaaauguuucacccaaauaucuaccccgacgggcggguuugcauuuccauccuccaugccccuggagaugacccaaugggcuaugagucaagugcagaacgcuggagcccggugcaauccguagagaaaauucugcuuucuguggucucgaugcuggccgagcccaacgaugaaucaggugcuaauguggacgcaagcaagauguggcgagaugaccgugagcaguucuacaaaaucgccaagcagauaguucagaagaguuuggggcucuga

SEQ ID NO: 64460 - RNA, 552 nt, Artificial Sequence
  derived and/or modified sequence opt3 from UBE2H__Homo_sapiens__NP_003335
augagcucccccucuccuggcaagagaaggauggacaccgauguggucaaacugaucgagucaaagcacgaaguuacaauucucgggggacuuaacgaguucgugguaaaauuuuacgguccacagggcacuccguaugaagggggaguguggaagguccggguggaccugcccgauaaauacccuuucaagaguccaagcauaggcuuuaugaauaagaucuuccaucccaacauugacgaggccuccgguacgguuugcuuggaugugaucaaucaaaccuggacagcuuuauaugaccugacuaacauuuuugaaucuuuccuaccucagcuccuggcauacccaaaucccaucgauccucuuaacggggacgccgcggcuauguaucugcaccgcccagaggaguacaaacagaagauaaaagaauauauccagaaguacgccaccgaggaagcauugaaagagcaagaggaaggaacaggcgauucgucaagcgagaguuccaugucugacuuuagcgaagaugaggcccaggacauggaacucuga

SEQ ID NO: 64461 - RNA, 477 nt, Artificial Sequence
  derived and/or modified sequence opt3 from UBE2I__Homo_sapiens__NP_003336
augagcggcaucgcccuguccagacucgcucaggagaggaaggcauggcggaaagaccaccccuucggguuuguggccgucccuaccaagaacccagauggaacaaugaaucuuaugaacugggaaugcgcgauuccggguaaaaagggcacucccugggaagggggacuguucaaauugcgcauguuauuuaaggacgauuacccuucuucaccacccaaguguaaauucgagccuccacuguuucaucccaauguuuauccuaguggcacggugugccuaagcauacucgaggaagacaaggauuggcgaccagcuaucaccauuaaacaaauccugcuugguauucaggagcuguugaacgagccgaauauccaggaccccgcccaggcagaagccuacacaauauauugucaaaaccguguagaguacgaaaagagagugagggcucaggccaaaaaguucgcaccuuccuga

SEQ ID NO: 64462 - RNA, 957 nt, Artificial Sequence
  derived and/or modified sequence opt3 from UBE2J1__Homo_sapiens__NP_057105
auggagaccagauacaaccugaaaagccccgccgugaaaaggcucaugaaggaagcugcagagcuuaaagacccuacagaucacuaucaugcccagccacuggaagacaauuuguucgaguggcacuuuacuguccggggcccgcccgauuccgacuucgaugggggaguuuaccauggucgcaucguguuaccuccagaauaucccaugaagccuccaucuauuauacugcuaacggcgaacggccgauuugagguagggaaaaagaucugccucucaauuaguggacaccaucccgagaccuggcaaccuagcugguccauccguacagcucugcuugccauuaucggcuucaugccaacuaagggugaaggggcaauaggaucucuggacuacaccccggaggaaagaagggccuuggcuaaaaagucgcaggauuuuuguugcgagggcuguggcucagcaaugaaagacgugcuccugccccucaagagcgggagugauuccucucaggccgaccaggaggcuaaagaacuggcccggcaaaucagcuucaaggcggaggucaauuccucaggaaagacaauuagugaaagcgauuuaaaccacucuuuuucccugaccgaccuucaggaugacaucccuacuacauuccagggugcaaccgccucaacgagcuauggcuugcagaauaguucugcugccuccuuucaccaaccaacucagcccguggcaaagaacaccagcaugucgccucgccagagaagggcucagcaacagucucagcggcgccuguccacaucaccagacguuauucaagggcaucagccccgagauaaucacacugaccauggaggcagugccgugcuaaucgucauacucacccuggcgcuugccgcacugauuuucagaaggaucuacuuggcuaacgaguauauuuuugauuucgaacucuga

SEQ ID NO: 64463 - RNA, 474 nt, Artificial Sequence
  derived and/or modified sequence opt3 from UBE2K__Homo_sapiens__NP_001104582
auggccaacaucgcugugcagagaauuaagagggaguucaaagaaguccucaagagcgaggaaaccuccaaaaaucaaauaaagguugaccugguggaugagaacuuuacagaacuucggggcgagaucgcagggcccccugacacuccauacgagggaggucgcuaucagcuggaaauuaaaaucccggagacguaccccuucaauccuccaaagguacgauuuauuaccaagaucuggcaccccaacauaucuucagugacaggcgccaucugcuuggauauuuuaaaagaccagugggcggcugccaugacucugcguaccguccuacucagucugcaggcacuucuggccgcugcagaaccugaugacccacaagaugccgugguugcuaaucagaacgccgugaucgucgcguugagcuccaagucuugggacguggagacagcaaccgagcuccugcugucgaauuga

SEQ ID NO: 64464 - RNA, 639 nt, Artificial Sequence
  derived and/or modified sequence opt3 from UBE2L3__Homo_sapiens__NP_001243284
augcaaguggccgcuggcacaagaggggacacaaggcugcaggaggucgcacuccuuccccagcuguucgauuuguuaguucugggacagcggcgcgcccgacuacuccgucaggugccuagcgcgcuggcugguaaggaccuugcccaacugcaggcaggcgccacuuuggcuggguacagaagggcacacggaccagaggaacucgaagagauccggaaaugcggcaugaagaacuuucgcaauauucagguagaugaagccaaccugcugacguggcagggucucauagugccggacaaucccccuuaugauaaaggggcuuucagaaucgagauuaacuuuccagccgaguaccccuucaagccuccaaaaaucaccuuuaagacaaagauuuaucaucccaauaucgacgaaaaaggacaagucuguuuaccugugauauccgcggagaacuggaagccagcaacuaaaaccgaucagguuauccagucucugauugcccuugugaaugacccgcagcccgaacacccuuugagggcugaucuggccgaggaguacucaaaggaccggaaaaaguucugcaagaacgcagaagaguuuaccaaaaaguauggcgaaaaacgcccagucgauuga

SEQ ID NO: 64465 - RNA, 462 nt, Artificial Sequence
  derived and/or modified sequence opt3 from UBE2L6__Homo_sapiens__NP_004214
augauggccagcaugagaguggucaaggagcuggaagaccuccagaaaaagcccccuccauaccuuaggaaccuguccucugaugacgcuaauguuuugguguggcacgcauuacugcuaccggaucaacccccuuaucaucucaaagccuucaaccugcggaucucauuuccacccgaguacccuuucaagccacccaugauuaaauuuaccacaaagauauaucacccuaauguagacgaaaacggccagaucugccuuccaauuaucaguagcgagaauuggaagccguguacuaaaacgugccaggugcuggaagcguugaacguccucgugaaucgccccaacauucgagagccucugcguauggaucuggcugaccucuuaacccagaauccagagcuguucagaaagaacgccgaagaguuuacacuuagguucgggguugaucggcccuccuga

SEQ ID NO: 64466 - RNA, 552 nt, Artificial Sequence
  derived and/or modified sequence opt3 from UBE2M__Homo_sapiens__NP_003960
augaucaagcuguucagccucaaacagcaaaagaaagaggaagaguccgccggcgggaccaagggaucuaguaaaaaggcuucagcagcccagcuuaggauucagaaggacauaaacgaacugaauuugcccaaaacaugcgauaucagcuuuuccgacccugaugacuuacugaacuucaagcuagugauuuguccagaugaggguuuuuacaaaucuggcaaguucgucuuuucguucaaaguugggcagggauauccgcacgaucccccuaaggugaagugcgaaacuaugguauaccauccaaauaucgaccucgagggcaacgugugucugaauauucuuagagaggacuggaaacccguccugacgaucaacucaauaaucuaugguuugcaauaccucuuucuggaaccuaauccagaggauccccugaacaaggaagcggcugaggugcuccagaauaaccggcgcuuauucgagcagaauguucagcgaagcaugcgugggggauauauuggcaguaccuacuuugaaagaugccugaaauga

SEQ ID NO: 64467 - RNA, 459 nt, Artificial Sequence
  derived and/or modified sequence opt3 from UBE2N__Homo_sapiens__NP_003339
auggccggccugcccagaaggaucauuaaggagacccagcggcuccuugcugaaccugugccagggauaaaagcagagccggacgaaagcaacgcccgcuacuuccacgucguuaucgcgggaccccaagauuccccuuuugaggguggcacauucaagcuggaauuguuuuuaccagaggaguaucccauggcugccccuaaagugcgauucaugacuaagauuuaccauccaaauguagacaaacuggggcguaucugccuagauauucucaaggacaaguggucucccgcacugcagaucagaacggugcuucugucaauacaggccuugcucagugcuccuaacccagaugacccgcuggcaaaugaugucgccgaacaguggaaaaccaacgaggcucaagccaucgaaacagcgagggcauggacucggcuguaugccaugaauaacauuuga

SEQ ID NO: 64468 - RNA, 1080 nt, Artificial Sequence
  derived and/or modified sequence opt3 from UBE2Q2__Homo_sapiens__NP_001138807
augagaauggacagccugaccgaggaaaagcucgagugcaggcuuugguguugccuguccgaucccucuccuccaggcuuggccgcucgguguugcguguuagaacgcucaaucgucccgagucugcgacaggagagcuaccccuccucuucgccuauuugguucguugacucagaagauccaaaccuaacaagcgugcucgagcgucuggaggacacuaaaaauaacaaucuucugagacaacaguugaaguggcucauaugugaacugugcagucuguauaaccuccccaaacacuuagauguagagaugcuggaccagccucuuccaacggggcagaauggaaccacagaagaggugacuuccgaggaagaggaagaggaagaggagauggcagaagauaucgaggacuuggaucauuacgaaaugaaggaggaggaacccauuucugguaaaaagagcgaggacgaaggcaucgagaaggaaaaccuggccauucuagagaaaaucaggaagacccaacggcaggaucaccucaauggggcggucuccggaucagugcaggcuagugaccgccugaugaaagaacuuagagauauauauaggagccagucuuacaagacaggcaucuauuccguugagcugauuaacgacucauuguacgacuggcaugugaaacuccaaaaggucgauccugacagcccacugcacagugauuuacagauccugaaggagaaagaagguauugaguauauccuccuuaauuuuucuuucaaggacaacuuuccguucgaucccccuuuugugcggguaguucugccaguguuguccgggggauacguccuaggcggcggggcccuguguauggaacuccugaccaaacagggauggagcucggcauacucuauagaguccgugauuaugcagaucaaugccacucuugugaaggguaaagcucgcguccaauucggcgcaaacaagaaucaguauaaccuggcccgagcucagcaaucauacaauaguauuguucagauccaugagaaaaacgggugguauacacccccuaaggaagacggauga

SEQ ID NO: 64469 - RNA, 486 nt, Artificial Sequence
  derived and/or modified sequence opt3 from UBE2QL1__Homo_sapiens__NP_001138633
augaaggagcugcaggacaucgccagacucagcgauagguucauuuccguggaacuugucgacgagucucuguuugauuggaacguuaaauugcaccaaguggacaaggauucaguauuauggcaggacaugaaagaaaccaauacagaguucauacugcuaaaccucacuuuucccgauaauuucccuuuuaguccaccguucaugcgggugcugagcccccgccuugaaaacggcuacguccuggacgggggagcuaucugcauggaguugcucacgccucgagguugguccucugcauauaccguggaggccguuaugcgucaguuugcggcuucgcuggugaagggccaggggagaauuuguaggaaagccggaaagucaaagaaaaguuucagccggaaggaagcagaggccacauuuaaaucccuggucaagacucaugaaaaauacggcugggugaccccacccguaucugaugguuga

SEQ ID NO: 64470 - RNA, 717 nt, Artificial Sequence
  derived and/or modified sequence opt3 from UBE2R2__Homo_sapiens__NP_060281
auggcccagcaacagaugaccagcucccagaaggcucugaugcucgagcuuaaaucucugcaggaggaacccguggaaggcuucagaaucacauuggucgacgagucagauuuauacaacugggaaguugcaauuuuugggccuccaaauacucuguaugagggagguuacuucaaggcccacauaaaauuuccgaucgacuaucccuacaguccuccaacguucagguuucuaaccaagauguggcaucccaacauuuaugagaauggcgaugugugcaucagcauucuccacccuccaguagacgauccccaauccggggaacugccuucugagcgguggaacccaacacagaaugugcgcacuauccuucugucggucauaucauugcucaacgaaccgaauaccuucagccccgcgaacguggacgcuaguguuauguuucgaaaauggcgugauuccaagggaaaggacaaagaguacgccgagaucauuagaaaacaggugucugcaacaaaggccgaagcugagaaggauggcgucaaagugccuaccacucuggcagaauauuguaucaagacaaagguaccaagcaaugacaacuccucagaucugcucuacgacgauuuauacgacgacgauauugacgaugaggacgaagaggaggaagaugccgacugcuaugaugacgaugacagugguaaugaggaaagcuga

SEQ ID NO: 64471 - RNA, 669 nt, Artificial Sequence
  derived and/or modified sequence opt3 from UBE2S__Homo_sapiens__NP_055316
augaacagcaauguggagaaccugcccccucacaucauuagacucgucuacaaggaaguuaccacacuuacugccgacccaccggauggcauaaaaguguuccccaaugaggaagaccugacggauuugcagguaaccaucgaggggccugaaggaacaccauaugcugguggcuuauuuaggaugaagcugcuacucgggaaagacuuccccgcauccccuccaaagggauacuuucugacuaaaauuuuccaucccaacgugggcgccaauggugagaucugcgucaacgugcuuaagcgggauuggaccgcggagcuggggauucgccacguuuugcucacaaucaagugucugcugauacauccuaauccagaaucugcucucaacgaggaagccggacgauuacugcuugagaauuaugaggaauacgcagcccgugcuagauugcugaccgagauccacggcggcgcagggggaccgucagguagggccgaagcuggccgggcccuagcgagugggacugaggcaagcuccacagaccccggagccccuggcgguccagggggagcugaaggccccauggccaaaaagcaugcaggcgagcgcgauaaaaagcucgcugccaaaaagaagaccgacaaaaagagagcgcugaggcggcuuuga

SEQ ID NO: 64472 - RNA, 594 nt, Artificial Sequence
  derived and/or modified sequence opt3 from UBE2T__Homo_sapiens__NP_054895
augcagagagccagcaggcugaagcgggagcuccacaugcuugcuaccgaacccccuccaggcaucacaugcuggcaagacaaagaucagauggacgaucugcgcgcacagauuuuagggggagccaacacuccguacgagaaggguguguucaaauuggaagucauaauccccgagcgauauccuuuugaaccaccccagauucguuuccugacgccuaucuaccauccaaauauugacuccgcgggcagaaucugucuagauguucucaagcugcccccuaaaggggcuuggaggccaucucuuaacauagccaccgugcugacaucaauccaauugcucaugagugagccgaaucccgacgauccucugauggcagacauuagcuccgaguuuaaguauaacaagccagccuuccugaaaaaugcucggcaguggacugaaaagcacgcacgccagaaacagaaggccgaugaggaagagaugcucgacaacuuacccgaggcuggagauucuagaguacauaauucgacccagaaaaggaaggccucacaacuggugggcaucgaaaagaaauuucacccugacgucuga

SEQ ID NO: 64473 - RNA, 954 nt, Artificial Sequence
  derived and/or modified sequence opt3 from UBE2U__Homo_sapiens__XP_011539067
augcacggcagagccuaccugcuccuucauagggacuucugcgaucugaaggagaacaauuauaaagggaucaccgcuaagcccgugagcgaagacaugauggagugggaagucgagauugaaggauugcagaacuccguuuggcaagguuuaguguuucagcugacaauacacuucacuucugaguacaauuaugcaccuccaguagugaaauuuaucacgauuccguuccaucccaacgucgauccucacaccggccagccauguaucgacuuucuagauaaucccgagaaguggaacacaaauuacacucucucaaguauucugcuugcccugcaagugauguugagcaacccuguucucgaaaauccagugaaccuggaggcggcucggauccuggucaaagacgaaucccucuaucgcaccauauuacgacuguucaaucguccccuucagaugaaggaugacucucaggaguugccuaaggauccaagaaaaugcaucaggccgauuaagacaaccucguuuucagacuacuaucagacuuggagccggaucgccacaaguaaagcaaccgaguacuaccgcacgccccugcuaaaggugccuaacuucauugggcaguauuacaaauggaagaagauggaucuccaacaucagaaagaauggaaucugaaguauuccguaaucaaauguuggcuugccagaaagaggaugccacacgagguuacucacucuauggaagagauaaaacugugccccaccuugaacgaaauuuuucucgagagcccuacagcuaucaauuccauuacugacaucuacgagaccgaagaggaaggauggaagucagauacaagucuguaugagaacgacaccgacgaaccacgggaggaggaaguggaggauuuaaucagcuggacgaacacucugaauacaaacaccucugaagacuga

SEQ ID NO: 64474 - RNA, 444 nt, Artificial Sequence
  derived and/or modified sequence opt3 from UBE2V1__Homo_sapiens__NP_001027459
auggccgcuaccacaggcagcggggugaagguccccagaaacuucaggcugcucgaggaacuugaggaaggacagaaagguguuggcgacgggacuguguccuggggacuggaggaugacgaagauaugacguugacccgguggacaggcaugaucauugguccuccacgcacuauauacgagaaucgaaucuauucuuuaaagauugagugcgggccgaaauaccccgaagcaccuccauuuguacguuucgugaccaagaucaacaugaauggagucaacucaaguaauggcgugguugaccccagagccauuagcgugcuggcgaaauggcaaaacuccuauucuaucaaggucgugcuacaggagcucaggcggcugaugaugucgaaggaaaauaugaaacuuccucagccacccgagggccaguguuacucaaacuga

SEQ ID NO: 64475 - RNA, 438 nt, Artificial Sequence
  derived and/or modified sequence opt3 from UBE2V2__Homo_sapiens__NP_003341
auggccgugagcaccggcgucaagguucccagaaacuucaggcugcucgaggaacuugaggaagggcagaaaggagugggugacggcacaguauccugggggcuggaggaugacgaagauaugacuuugacgcgguggaccggaaugaucauuggcccuccacgcacaaauuacgagaaccgaauauauucuuuaaagguggagugcgguccgaaauaccccgaagcuccuccaucaguccguuuugugacuaagaucaauaugaacgggauuaauaacaguagcggaaugguugacgcaagauccauccccgugcuggccaaauggcaaaauucuuauucgauuaaggucgugcuacaggagcucaggcggcugaugaugucaaaggaaaacaugaaacuuccucagccacccgagggccagaccuacaauaacuga

SEQ ID NO: 64476 - RNA, 1065 nt, Artificial Sequence
  derived and/or modified sequence opt3 from UBE2Z__Homo_sapiens__NP_075567
auggccgagagccccaccgaagaggcugcaacagccggcgcgggggcugccggaccuggugcauccucuguggccggcgucguuggggugucaggaaguggcgguggguucggaccaccguuucugcccgacguaugggcugcagccgcugccgcgggcggcgcagggggaccugguagcggccucgccccacuucccgggcugccuccauccgcugccgcacacggagcugccuuguuaucucauugggaucccacucugucgucagacugggauggcgaaagaacggcgccucagugccuacucaggaucaagcgggacauuaugagcauauacaaagagccaccgcccgguauguucguggucccugauaccguggacaugacaaagauccacgcccugauuacugggccauuugauacccccuaugaaggaggcuucuuucuuuucguuuuucgcuguccuccagacuaccccauccauccgccucgagugaaacugaugacaaccggcaacaauacuguccguuucaaccccaauuuuuauagaaacgggaaggugugcuugaguauucucggaacauggaccgguccagcaugguccccugcucaaucuaucagcuccguacugauaucaauccagagucugaugacggagaaucccuaccacaacgagccaggcuucgaacaggagaggcaucccggggauagcaaaaauuauaacgaauguauucggcacgagacuauccgcguugccgugugcgacaugauggagggaaaguguccuugcccagaaccgcucagaggcgucauggagaaguccuuuuuagaauacuaugauuucuacgagguggcuuguaaagacaggcugcaccuucagggucaaaccaugcaggaucccuuuggggaaaagcggggccauuucgacuaccagucuuugcugaugcgccuaggacucauucgacagaaagugcuggagagacuucacaaugagaacgccgaaauggacucagauagcaguucuuccggcacagagacugaccugcaugggagcuugagggucuga

SEQ ID NO: 64477 - RNA, 2559 nt, Artificial Sequence
  derived and/or modified sequence opt3 from UBE3A__Homo_sapiens__XP_005268328
augaagagagccgcugcaaaacaccugaucgagagguacuaucaucagcucaccgaaggcugcgggaacgaggccuguacaaaugaguucugcgcgagcugucccacuuuucuucggauggacaacaaugcugccgcaauuaaggcccuggaguuguacaaaauaaacgcuaaguuaugcgauccucacccauccaaaaagggagcaucuucagccuaucuggaaaauaguaagggugcuccgaacaauagcuguuccgagaucaaaaugaacaagaaaggcgcccgcauugacuucaaggaugugacguaccuaaccgaggaaaaagucuaugagauccucgaacugugccgagagcgugaggacuacucuccccuuauuagaguuaucgggaggguguuuucgucagcggaagcacugguacagagcuuccggaaggugaagcaacauacaaaagaggaauugaagagucuccaggccaaagaugaggacaaggaugaagacgagaaagagaaggcugccuguuccgcagcugccauggaagaggauucugaagcgagcuccucacgcauaggagacaguagccagggcgauaauaaccugcaaaaacuggguccugacgaugucucuguggacaucgacgccauuagaaggguuuauacucggcucuuauccaaugagaagaucgaaaccgcauuucugaacgcucuuguguacuugucaccaaaugucgagugcgaucugacauaccacaacguguauagccgcgaccccaauuaccuaaaccucuucauuaucguaauggagaaccgaaaucugcauaguccugaauaucuugagauggcccugccauuguuuuguaaggcuaugucuaaacucccccuggccgcacaggggaaguuaauaagacugugguccaaauacaacgccgaucagauuaggcggaugauggaaaccuuccagcaacucaucacuuauaagguuauuagcaaugaguuuaacucgcguaaucuugugaacgacgaugacgcuaucgucgcggcaucuaaaugccugaagaugguguacuaugccaauguggucggaggcgaaguugauacaaaccacaaugaggaggacgaugaagaaccuaucccagaauccucagaguugacccuacaggagcugcucggcgaagaacgcagaaacaagaaagggccgaggguggacccccuggaaacggagcuuggaguaaagacucuggauugucggaaaccuuugauuccauucgaagaguuuauaaaugagccccucaacgaagugcuggagauggacaaggacuacaccuucuuuaaagucgaaacagagaauaaguucaguuucaugacuugcccuuuuaucuuaaacgcugugaccaagaaucugggucuauacuaugauaaccgcauucgaauguacagcgaaagaaggaucacaguucucuauucccuggugcagggccagcaacuuaacccauacuugcggcugaaaguccgcagagaccacauaauugaugacgcccucgugaggcuggagaugaucgcaauggagaaucccgccgaucuuaagaaacagcuguauguagaguucgagggggaacagggaguugacgagggcggugugucuaaggaauuuuuccaauuggucguggaggagaucuuuaacccggauauugggauguucaccuacgacgaaagcacgaaacucuuuugguucaauccuucaaguuuugagacugaaggacaguucacacugaucggcauugucuuaggccuggcuauauauaacaauugcauccuagaugugcauuuucccaugguuguguaccguaagcucauggggaagaaaggaaccuuccgggaccugggugauucccacccaguacuuuaccagagcuugaaggaccugcucgaguaugagggcaacgucgaagaugacaugaugauuacuuuucagaucucucaaacagaccuguucgggaauccuaugauguacgauuuaaaagagaacggagacaagauccccauuaccaaugaaaaccgaaaagaguucgugaaucuguauucagauuacauacuuaacaagaguguugaaaaacaguuuaaggccuucagaaggggcuuucauauggugacgaaugagagcccauugaaguaucucuuccgccccgaggaaaucgagcugcuaauuugugguucccggaaccuggacuuucaggcacucgaagagaccacagaauacgaugggggcuauacuagagacucuguccugaucagggaguucugggagauugugcacucguuuaccgaugaacagaaacgccuuuucuugcaauuuacaacuggaaccgaccgagcgccuguaggcgggcugggaaaguuaaaaaugaucauagcuaagaaugguccagauacagagcggcucccgaccagccacacuugcuucaacgugcugcuucugcccgaauacuccucaaaagagaaguugaaggaacgucuccugaaagccaucacguacgcaaagggcuuugggaugcuauga

SEQ ID NO: 64478 - RNA, 735 nt, Artificial Sequence
  derived and/or modified sequence opt3 from UBE3B__Homo_sapiens__NP_001257380
auguucacccugagccagacauccagagccugguuuaucgacagggcucggcaagcacgcgaggaacgacucgugcagaaggagcgugaaagagccgcggucguuauucaggcucacgugaggucuuuccuuugccggucacgccugcagagagauauaaggcgggagaucgacgacuuuuucaaagccgaugaucccgaaaguacuaagcgcagcgcauuguguauuuuuaaaaucgcccgaaaguuacuguuccuauuuagaauuaaagaggacaacgagagguucgaaaagcucugccgguccauccugucuucgauggaugcugagaaugaaccuaagguaugguacgugucacuugcauguagcaaagaccugacguugcucuggauacaacagaucaagaacauucugugguauugcugugauuuucugaaacagcucaagccagagaucuuacaggacagucgucugauuacccuuuacuugacaaugcuggucacuuucaccgauacauccaccuggaaaauccuacgcggcaagggggagucucucagaccggccaugaaucauauaugcgcuaacauuaugggacaccugaaucaacaugguuuuuauagcgugcuucaguguugcgacggccuguuccccgauuugguuuccuacgccccucacaacaauccagugagguggucagucgggcggaguugguaugacuggcagcucagccgauga

SEQ ID NO: 64479 - RNA, 3252 nt, Artificial Sequence
  derived and/or modified sequence opt3 from UBE3C__Homo_sapiens__NP_055486
auguucagcuuugagggcgacuucaagaccagacccaaagugucccuggguggagccucuaggaaggaagagaaggcuucacuccuucaccggacacaggaagaacgccgaaaacgugaagaggagagaaggcggcugaaaaacgcaaucauuauacaaaguuuuauccgcgguuacagagauaggaagcagcaguauagcauucagcgguccgccuucgaccgcugcgcgacuuugucucaaucgggcggggcuuuuccuaucgccaauggaccaaacuuaacgcugcuaguccgacagcuccuguucuuuuacaagcagaaugaagauucaaaaagacuuauuuggcuguaucagaacuugaucaagcauagcagucucuucguuaaacaacuggacggcuccgagaggcugaccugucucuuucagauaaagcgguuaaugucucugugcugucgucuuuugcagaauugcaacgaugacagccugaauguggcacuaccgaugcgcaugcucgaaguauucuccucagagaacacauaccugcccgugcuucaggaugccaguuaugucgugagcguuaucgagcaaauucugcacuacaugauccauaaugguuauuacagaucuuuguaccuccugauuaacuccaaauuaccuucaagcaucgaauauagugaccugucuagggugccaauagcuaagauucuccuugagaauguccugaagcccuugcacuuuacuuacaacuccuguccugaaggggcacggcaacagguguucaccgccuuuacagaggaguuccuagcugccccauucaccgaucagaucuuucauuucauuauccccgcgcuggcagacgcccagacuguauuuccuuaugagccauuccucaaugcucugcuucugaucgagagccgaugcucgcgcaaaucuggaggcgccccgugguuguuuuacuucguucucacagugggcgaaaacuaucugggggcauuauccgaggaaggacugcuagucuaccucagagugcugcagaccuuucuuucacaguugcccgugaguccugcuagcgccuccugucacgauucugcgagcgacucagaggaagagagugaggaagccgauaagccauccagccccgaggacgguaggcugucugucucauauauuacggaagagugccucaaaaagcuggacacuaaacaacagaccaauacacuucugaacuugguuuggcgggauagugcaagcgaagagguguucacuaccauggcuuccguaugucacacacucauggugcagcaucgcaugauggucccuaaggugagacuguuauacucucuggccuuuaacgcuagguuccuacgucaccucugguuucugauaucgagcauguccacccggaugaucacgggcucaaugguuccacuucuucaggugauuagucgagggucucccaugagcuucgaggacuccucaagaaucauaccgcuguuuuaccucuucagcucucuguucucccauaguuuaauuagcauccacgauaaugaauuuuucggagacccuaucgaggucgugggccaaaggcagucuuccaugaugcccuuuacucuggaagaguugauuauguugucacgcugccuccgggaugccugucuggguaucauuaaacuagcauauccagagacaaagccugaaguaagagaggaauacauaaccgccuuccagaguaucgggguuacuacaagcucggagaugcagcaaugcauucagauggaacagaagagguggauccagcuguuuaaagugaucaccaaccucgucaagaugcugaaaucccgcgacacgcgacggaauuucugucccccaaaccacuggcuuucugagcaagaggauauuaaggcugacaaagugacccaguuguauguccccgcgagccgucauguguggagauuuaggcgcaugggacggauaggcccucugcagucaacauuagauguuggccucgaaaguccaccgcuguccgugucugaggaaagacaacuugcaguacugacugaguugcccuucgucgugccuuuugaagagaggguuaagaucuuccagcgacucauuuacgccgacaagcaggaggugcagggggauggaccauuucuggacgguaucaaugucaccauucgccggaacuauaucuacgaagacgcuuaugauaaacuaagccccgagaaugaaccugaccugaagaaaagaauaagggugcaccuccugaacgcccauggccuugaugaggcagggaucgacggaggcgguauuuuccgugaauuuuugaaugagcuguuaaaguccggguucaacccaaaucaaggcuucuuuaaaacaacuaacgagggacuccuguaccccaauccggccgcucagaugcuuguaggcgauucauucgcccgccacuacuauuuucuggggcggaugcuaggaaaggcacucuacgaaaacaugcugguggaguugccuuucgcgggguuuuuccugagcaaguuacucggcaccagugcugacguugauauccaucaccuggccucucuugacccagaagucuauaaaaaucuguuguuucucaaguccuacgaggaugacguggaggaacuggggcuaaacuucacaguggucaacaaugaucugggagaggcacagguuguggaacuuaaauuuggcgguaaggacauucccgugaccagcgccaacagaaucgcuuauauacaccucguagccgauuacaggcugaaucgacagauucggcaacauugcuuggcauuccgccaggggcuggcuaacgucgugucguuagaguggcucagaauguuugaccagcaggaaauccaaguucugauuucaggcgcccaggugccuaucucucuugaggaccugaaaaguuucacuaauuauuccggaggcuacagcgcggaucaccccgucauaaagguguucuggaggguuguggagggguuuacggacgaagagaagcggaaauugcucaaguucguaacaucuugcagccgaccaccucugcuaggauuuaaagaacuguaccccgccuucuguauccauaacgguggcuccgaucuugagagacucccaaccgcuucaacuugcaugaaucuguugaaguuaccggaauuuuaugacgagacccugcuccgcaguaaacugcuuuacgcaauugagugugccgcuggguucgaacugagcuga

SEQ ID NO: 64480 - RNA, 3201 nt, Artificial Sequence
  derived and/or modified sequence opt3 from UBE4A__Homo_sapiens__NP_001191006
augaccgaccaggagaacaauaacaauaucagcuccaaccccuucgccgcucuguuuggcucucucgcagaugccaagcaauucgcggcuauucagaaagaacagcuuaagcagcaaucagacgagcugccugccaguccagaugacagcgauaauuccgugucugaaucguuggacgaguuugauuacucagucgcagaaauaagcagaaguuucaggucccagcaggagaucugcgagcaguuaaacauuaaucacaugauccaacggauuuuucugaucacacuagacaacucugauccgagccucaaauccgggaauggaauacccucacgcuguguuuaucuggaagagauggccguggaacuugaggaccaggauuggcuggacaugaguaacguagagcaggcuuuguucgcacgacuccugcugcaggauccugguaaucaccucaucaacaugacuagcucuacgaccuuaaaucuguccgccgaccgugacgcuggcgaaagacacauuuucugcuaccuuuauucauguuuccaaagggccaaggaggaaaucacaaaagugccagagaacuugcugcccuuugcgguccagugccggaaucuaacugugagcaacacccgcacaguucuccugaccccugaaauuuacguggaucagaacauccaugagcaacuugucgaccugauguuggaggcaauacagggggcccacuucgaagaugugacugaguuucucgaagagguaauugaagcucugaucuuagacgaggagguuagaacauucccagaagugaugauucccgucuuugauauccugcucggaaggaucaaggaccuugagcugugucagauuuugcuauaugccuaccuggauauacuccuguauuucacccggcagaaggacauggcaaaaguguucguggaauacauccaaccuaaggauccaacgaauggccagauguaccagaaaacucuucugggugucauuuugaguaucucuugccuccugaagaccccggggguuguggagaaccauggauauuuucugaaucccucccgcagcucgccucaggaaauaaaaguacaagaggcuaacauucaccaguucauggcccaguuucacgagaagaucuaccagaugcugaagaaucuacuccaacugucuccagaaacaaaacauuguauccuuuccugguugggcaacugccugcacgcgaaugccggccgaacuaagauuugggcaaaccagaugcccgagaucuucuuucagauguaugcuucagacgccuucuuucucaaucugggggcugcccuucugaaauugugucagccuuucugcaagccaagaaguagcaggcuccugaccuuuaaccccacauacugugcauuaaaagaacugaaugaugaggagcggaagauuaaaaacgugcauaugcguggacuagacaaggaaaccugccucauaccggccguccaagagccuaaguucccccagaauuauaaccuggugacggaaaaucuugcuuugacugaguacacacuguaucucgguuuucaccgccugcacgaccagaugguuaaaaucaaccaaaacuuacauagauuacagguggcguggagggaugcacagcaguccucuagcccagccgcugacaaucuucgggaacaauucgagcgauugaugaccauuuaccucucaacuaagacagccaugaccgagccucagaugcugcagaacugccuaaaucugcaggucaguauggcagugcuccugguacaacuugccaucggcaacgaagggucccagcccaucgaguugacguuuccacugcccgauggauacagcucuuuagcuuauguuccugaauuuuucgccgacaaucucggcgauuuucugauuuuccuucgcagauuugcagacgauauacuggagaccucagcggacaguuuggaacacgugcuccauuucaucacaauuuuuacugguagcaucgagaggaugaaaaacccacaucugcgggcuaagcuagccgagguccuggaagcagugaugccgcaccucgaucagacccccaauccucuggucuccucuguguuccaccgcaaaagaguuuucuguaacuuccaguacgccccacaacuugcugaggccuugauuaagguguuuguagacaucgaauuuacaggggauccccaccaguuugagcagaaguucaauuauaggcguccuauguacccaauacugcgguauauguggggaacugacaccuaccgagaaucgaucaaagauuuagcagacuaugcuagcaagaaccucgaggccaugaaucccccgcuguuucuuagauuccugaaccuacucaugaaugacgcgauuuuccuguuggaugaggccauccaauaccuguccaaaauuaagauccagcagauagaaaaagacaggggcgagugggauucauuaacaccugaagcucgccgggagaaggaggcaggccuccagauguuugggcaacuggccagauuccauaacauuaugaguaaugaaaccaucggaacucuugcuuuucugacgucugagauuaagagcuuguucguccacccauuucucgccgaaaggaucauauccaugcugaacuacuuccuacagcaucuggugggucccaaaaugggcgcacuuaagguuaaagacuuuucagaguucgauuuuaagccucagcagcucgugagcgacaucugcacaauuuaucugaacuugggggaugaagagaauuucugugcgaccguccccaaagacggacgcucuuacuccccaacucuguuugcccaaaccgugcgaguauuaaagaagaucaacaaaccuggcaauaugauuauggcuuucaguaaccucgccgagcggaucaagagccuggcagaucuucagcagcaggaagaggaaacauaugcugacgccugcgaugaguuccuggaccccauaaugucuaccuugaugugugauccagugguucucccguccucacgugucacuguggacagaaguacaauugcaaggcaucugcuaagcgaccaaacggauccuuuuaaucgcucgccccugaccauggaccagauccggccaaacacugaacuuaaagagaagauccagagauggcucgccgagaggaaacagcaaaaggaacagcuggaguga

SEQ ID NO: 64481 - RNA, 3519 nt, Artificial Sequence
  derived and/or modified sequence opt3 from UBE4B__Homo_sapiens__XP_011538792
auggaggaacugagcgccgacgagaucagaaggcggcgccucgcucgacuugcaggcgggcagaccucccaacccacaacuccucugacgucuccacagcgugaaaacccgcccggaccuccaauugccgcgucagcucccgguccuagucagagcuugggcuuaaaugugcacaacaugaccccagccacaucccccauaggggcaucuggagucgcccauagaucgcagucaagcgagggcguuaguucccugucuagcuccccuucaaauagucuagaaacucaaagccagucucucuccaggucacagagcauggauaucgacggugugaguugcgagaagucuaugucccagguagauguggacagcgggauugagaacauggaagucgaugagaaugaccggcgcgagaaaagaucgcugucugauaaggaaccauccucaggaccggaggugagugaggaacaagcacuucagcugguuuguaaaaucuucagggugagcuggaaggaccgggaucgcgacgucauuuuucucuccucucucagcgcucaguucaaacagaaccccaaggaaguguuuucagauuucaaggaccugaucggccaaauacugauggagguacucaugaugaguacccagacacgagaugaaaauccuuuugccuccuuaaccgcuacuagccagccaaucgccgcggcagccagaucucccgacaggaaccugcuuuugaauacaggcucaaacccugggaccaguccaauguucugcagcguugcuuccuuuggagccucuucgcugagcucccuauacgagucaagucccgcaccgacgccuucuuucuggagcuccgugcccgucauggguccaucacucgcuagcccuucucgggccgcgucccaacuggccgugcccaguacuccacuuagcccccacucugcagcuuccggcaccgccgcugggucacagccuaguagcccacguuaucgcccguacacagugacucaucccugggccucguccggagucucuauucugagcucaaguccuuccccacccgcauuggccucuagcccucaggcuguuccagcguccucaagcagacagaggcccaguucuaccggcccgccucucccacccgcauccccuagcgccacaucgcggcgacccucaucucugcgcaucaguccauccauguaugacaauccuuuuagcuucuuauuucuggcucucucuggugauagcuccgacgaggaagaugaggaagaggacgaugacgauggggacggagaugacgaaggcggcgggggaggugaugacuucucaugugugcaauuuggcaguagccuuggggccucuggaggcgcauccaacugggacucauacagugaucacuucaccauugagacgugcaaagagacugacaugcugaauuauuugaucgaauguuucgauagaguagguauagaggaaaagaaagcccccaagaugugcagccagccagcugugucccagcuacugucuaacauuaggucgcaguguaucagccauacagcccucguccugcaagggucacuuacccagccgcggucccugcagcagccuaguuucuuggugcccuacaugcucugccgcaaucugccauauggcuuuauucaagaguuaguuagaacuacacaccaggacgaagagguguuuaaacagaucuucauccccauucugcagggacuagcacucgcggcuaaggaguguucucuggauagcgacuacuuuaaguacccucuuauggccuugggcgaacugugcgagaccaaauucgggaagacgcacccagucuguaaccucguggcaucccugaggcuuuggcugcccaaaucauugucuccuggaugcggucgugaacuccaacggcugagcuauuuaggcgccuuuuucaguuuuuccguauucgcugaggaugacguuaagguggucgagaaauacuuuagcgggccggccauaacccuggaaaacacacgaguggucucucagucacuacagcauuaucucgagcugggaagacaagaacuuuucaagaucuugcacuccauucugcucaauggcgagacuagggaagcagcucugaguuacauggccgcggugguuaacgccaauaugaaaaaggcucagaugcagaccgaugaccgcuuagugagcacagaugguuuuaugcugaacuuccuuuggguauugcagcaacucucgacuaagaucaaacuggagaccgucgacccaacauauauauuccauccccggugcagaauuacccuaccuaaugaugagacuagggugaacgcaacgauggaagacguuaaugacuggcugacagagcucuacggggaucagccacccuuuucugaaccuaaguucccgaccgagugcuuuuuccugacucuucacgcccaccauuuguccauccugcccagcugucgccgauauauccggcguuuaagagcuauuagggaacucaaccgcaccguggaggaccugaaaaauaacgagucacaguggaaggauaguccacuugccacacggcacagagaaaugcugaaaagguguaagacccaguugaagaaacucguccgaugcaaggcaugugcggacgccggccugcuagaugagucuuuucugcgccggugccucaauuucuacggacugcuuauccaauugcuguuaagaauuuuggacccugcuuaccccgauauaacucugccacuuaacuccgacgugccuaaaguauuugccgcacugcccgaguucuauguggaagauguugcugaauuucuauucuuuaucguccaguacagcccacaggcccucuaugagccguguacacaggacauugugauguuccugguggucauguugugcaaucaaaacuacaucaggaauccuuaucugguugcaaaguuaguggaggugauguuuaugacgaaccccgccguacagccacguacccagaaauucuucgaaaugaucgagaaccauccccucucaacuaagcugcuugucccuagucugaugaaguuuuacacagauguggaacacaccggcgcuacaagcgaguucuaugacaaauuuacuauucgcuaccauauauccaccaucuucaagucuuuguggcaaaauauugcgcaccacgggacguuuauggaggaguucaacagcggaaaacaguuuguucgguacaucaauaugcucauuaacgauaccacauuccugcuagacgaaucccuggaaucacuuaagagaauccaugaggugcaggaagagaugaaaaauaaggagcagugggaccaacucccaagggaucagcagcaggcccgacaaucucagcuggcacaggacgaacgggucagucgcucguauuuggcucuggccacugagaccguggauauguuucacauauuaacaaagcagguucaaaaacccuuccucagaccucaugaacugagcuacuauccggugaucuccuga

SEQ ID NO: 64482 - RNA, 540 nt, Artificial Sequence
  derived and/or modified sequence opt3 from UBIAD1__Homo_sapiens__XP_011539606
auggccgcuagccaggugcugggcgagaagaucaacauucucuccggggaaaccgucaaagcaggagacagagauccccuugguaaugacugcccugagcaagauaggcugccacagcggucuuggcgccagaagugugccucauacguuuuggcguuacgaccguggaguuucagcgcuucccugacacccguggcccuaggcucugcacucgccuaucguucgcacgggguacuggacccuagacuucuggugggaugcgcugucgcaguguuggccguucauggcgcugguaaccucgugaauacuuacuaugauuuuucaaaagggauagaccacaagaaaagcgaugacaggacgcuggucgaucggauccuggaaccacaggacgugguacgcuucggaguuuuucucuacaccuuaggcugugugugcgccgcgugucuguauuaccuuagucccuugaagcuggagcaucuagcacucauuuauuucggcgggcuguccggaucuuuucuuuacacagguguccugaucuga

SEQ ID NO: 64483 - RNA, 354 nt, Artificial Sequence
  derived and/or modified sequence opt3 from UBL3__Homo_sapiens__NP_009037
augagcuccaacgugcccgccgacaugaucaaucugagacucauucuugucucuggcaagaccaaagaguuccuguuuucaccuaacgauagugcuagcgacauagcaaagcacguuuacgauaauuggccaauggacugggaagaggaacagguguccucuccgaacaucuugagguuaauuuaucaagggcgguuccugcauggaaauguaacacuaggugcccucaaacugcccuuuggcaagacuacggugaugcaccuugucgcgcgcgagacccugccugaaccaaacucgcaggggcagcgaaaucgugagaaaacaggagagucaaacugcugugugaucuuguga

SEQ ID NO: 64484 - RNA, 474 nt, Artificial Sequence
  derived and/or modified sequence opt3 from UBL4A__Homo_sapiens__NP_055050
augcagcugaccgugaaggcccuccaaggcagagagugcagccuucagguccccgaagacgagcugguuuccacauugaaacaguuagugucugaaaagcugaacguaccugugaggcagcaacggcuacucuucaaagggaaggcucuggcagauggaaaacgccuuucagacuacaguaucgguccaaauagcaagcugaacuuggucgugaagccgcucgagaaaguucugcuggaagagggcgaggcccagcgacucgcggauucucccccuccacagguguggcaguuaauuuccaagguccuggcucgucacuuuucggccgcagacgccucaagagugcuugaacaauugcagagggauuaugagcggagccugagucgccuaacucucgacgauauagaaagacuggcuuccagguuccuucaucccgagguaacggagaccauggaaaaaggguuuucuaaguga

SEQ ID NO: 64485 - RNA, 222 nt, Artificial Sequence
  derived and/or modified sequence opt3 from UBL5__Homo_sapiens__NP_001041706
augaucgagguggucugcaacgacagacugggcaagaaaguuagggugaaguguaauaccgaugacacaauuggggaucucaaaaagcugauagccgcucagacuggaacgcgguggaacaaaaucguacuuaagaagugguacaccauuuucaaagaccacgugagcuugggugauuaugaaauccaugacggcaugaauuuagagcuguacuaucaauga

SEQ ID NO: 64486 - RNA, 1143 nt, Artificial Sequence
  derived and/or modified sequence opt3 from UBL7__Homo_sapiens__NP_001273669
augagccuguccgacuggcaccucgccgugaaacuugcugaucagccccugaccccuaagucuaucuugagauuaccagagacagaacugggcgaguacucacuagggggauauaguauuagcuuccucaagcaacugauagcagguaaacuucaggaauccgucccggaccccgagcugaucgauuugauuuacugcggcaggaagcucaaagacgaucagacucuggacuuuuaugggauccagccuggaucuacgguucaugugcugcggaagucguggccagaacccgaucaaaagccugagccaguagacaaaguggccgcgaugcgcgaguuccgaguccuccacaccgcuuuacauucaagcaguuccuaccgugaagccguguuuaagaugcugucuaacaaagagagccuugaucagauuaucguugcaacacccggcuuguccucagacccuauagcccugggugugcuacaggauaaggaccucuucagugucuuugcugauccaaauaugcuggacacucuugugccggcacaccccgcccugguaaacgcuaucguuuuggugcuccauagcgucgccgggucugcgccuaugccaggaaccgacuccucaagcagaaguaugcccucuuccagcuauagggauaugccuggcggcuuccuguuugaaggguuaucggacgaugaggacgauuuccacccaaauacacggucuacccccuccucaaguacuccgagcucccgcccugcaucucugggauacagcggugccgcuggccccagaccaauuacacagucagagcucgccaccgcacuugcucuggccaguacgccugaauccagcucucacacucccaccccagggacacaaggacauucaaguggcacuagccccauguccucuggugugcagucggggaccccuaucacaaacgacuuguuuagccaggcgcuacagcacgcccugcaagcauccggacagccaucacuccagagucaauggcagccgcagcugcagcaacuuagggauaugggcauucaggacgaugagcugucuuugcgggcucuccaggccaccggcggggacauccaggcugcccuggaauuaauauucgcaggaggugcccccuga

SEQ ID NO: 64487 - RNA, 957 nt, Artificial Sequence
  derived and/or modified sequence opt3 from UBLCP1__Homo_sapiens__NP_659486
auggcccugcccaucauugugaaguggggcgggcaggaguacagcgucaccacacucuccgaagacgauacuguucuugaccugaaacaauucuugaagacguuaaccggagugcugccugagagacagaaacuacucggucugaagguaaaaggcaagccagcugaaaacgaugugaaacuuggggcacugaaguugaagccgaauacaaaaauaaugaugaugggaacuagggaggaaucucucgaggacguccugggucccccuccagauaacgacgaugugguuaaugacuuugauaucgaggacgaaguggucgagguggaaaaccgggaggagaaucugcucaagauuucacgccgaguaaaagaauauaagguugagaucuuaaaucccccucgugaaggcaagaaacugcuuguguuggaugucgacuacacccuguucgaucacagaaguugcgccgagacagggguggaacuaaugaggccauaucuccaugaguuucugaccagcgcguacgaggacuaugacauugugaucugguccgcuacuaacaugaaguggauagaagccaaaaugaaggagcuuggagucucuacaaacgcaaauuacaaaaucaccuucaugcuggauucggccgcuaugauuacgguucacacuccccggcgcggcuugaucgacgugaagccucucggcguaauuugggggaaauuuucagaguucuauagcaagaagaacaccaucauguuugaugacauaggaagaaauuuccugaugaacccacagaaugguuuaaaaauuaggccguuuaugaaggcacaucugaaccgggauaaagacaaggaacuccuuaaacugacacaguacuugaaggaaaucgccaagcuagaugacuuccuggaucucaaucacaaauacugggagcgcuaucugaguaagaaacaaggccaguga

SEQ ID NO: 64488 - RNA, 3405 nt, Artificial Sequence
  derived and/or modified sequence opt3 from UBN1__Homo_sapiens__NP_001072982
augagcgagccccacagagugcaguucaccucccugccuggcucucucaacccagccuuucuuaagaaaucaaggaaggaagaggcuggggcaggagaacaacaucaggacugcgagccggccgcggcugccguccggaucacacugacuuuguucgaacccgaucacaaacgcuguccugaguuuuucuacccagaguuaguuaagaauauucgagguaaagugaagggccugcagcccggggacaagaaaaaggaucuaagugacccuuuuaacgaugaagagaaagaacgucauaagguagaggcacucgccagaaaauucgaggaaaaguauggaggcaagaaaaggcggaaggaccgcauacaggaucugaucgacauggguuacggguaugaugagagcgacuccuuuauugauaauucugaagccuacgacgagcuugugccagcaucgcugacgaccaaauauggaggcuucuacaucaacucaggcacauugcaauuuagacaggccagcgaaagugaggaugacuucauuaaggagaaaaagaaaaagucccccaagaaaaggaagcucaaagaagggggagagaagaucaaaaagaagaaaaaggacgauacuuaugacaaagaaaagaaaucuaagaagaguaaauuuuccaaggcugguuucaccgcccugaaugcgucaaaagagaagaaaaagaagaaauacaguggcgcacugagcgucaaggaaaugcucaaaaaguuucagaaagagaaggaggcccagaaaaagcgggaagaggaacacaagccuguggcuguuccaucugccgaggcacaaggguuacgcgaacuggagggagcuuccgauccgcuuuugucacuguucggcagcacaagugacaacgaucuacuccaggccgcgaccgccauggacucucugacugaucuugaccuggagcauuugcucuccgaaagccccgaggguucgccuuuccgagauauggacgaugggucugacucccugggagugggcuuagaccaggaauuuagacagccaucaagucugcccgagggccucccugcaccacuugagaaaagggucaaggaacuggcucaagccgcucgggccgcagagggggaaagccgucagaaauucuuuacacaggauauaaauggaaucuugcuagacauugaggcccaaacccgcgaacuguccucucaggugagaagcgguguauacgcuuaucucgcgucauuccugcccugcaguaaggaugcacuucugaaaagggcccggaaguugcaccucuacgagcagggcgggcgacugaaggagccguuacagaaacugaaggaagcuaucggacgcgccaugccugagcaaauggcaaaauaucaggacgaaugucaggcccacacgcaggcuaagguugccaaaaugcuagaggaagagaaggauaaggagcaaagagacaggauuugcuccgaugaagaggaagacgaggaaaaaggcggucggcgcaucauggggcccagaaagaaauuucaguggaacgaugagauaagggagcuccugugucagguggucaagauuaaacuugaaagccaggacuuggagcguaauaacaaggcacaagcgugggaagauugcgugaagggcuuccuggacgcugaggugaaaccacucuggccuaagggauggaugcaggcccggacucuguuuaaagagucucgaagaggccaugggcaccuuaccucaauccuggcaaagaaaaaggucauggcccccaguaaaauuaagguuaaggaaagcuccacaaaaccagauaagaaagugucuguacccucgggacagaucgguggcccuaucgcuuugccaagcgaccaucagacugggggacucuccauuggcgccucaaguagggagcugccgucucaagcaagcgguggguuagcuaaucccccuccagugaaccuggaagacucccuagaugaggaccucauacgcaaucccgccucaagcgucgaagcggugucuaaggagcuggccgcucuuaacucccgggcagccggcaauagugaguucaccuugccugcuccaagcaaagcccccgcagaaaagguuggaggcgugcuguguacagaggaaaagagaaacuuugcgaaaccgucuccuuccgccccacccccugcuucaagucuccagagcccccugaacuucuuagccgagcaggcacuggcucuugggcaaucgucccaggaaaagaaaccagagucuagcggauacaaggaguugucaugccaggccccucucaauaaaggucugcccgaaguccaccagaguaaggcaaagcaccauucccuaccaaggaccucucacggcccgcaaguggccguaccuguucccgggccacaggugaaagucuuucaugcuggaacgcagcagcaaaagaacuucacucccccuagcccauuugcgaauaaacugcagggccccaaggccuccccuacacagugucaccgcucacuccugcagcuugugaaaaccgcagcuaagggucaaggguuccauccgagcgccccagccacuagcggcggauugucugcuuccagcucgucaucucacaagacacccgcaaguuccagcucugcccugagccacccugcgaaaccacauuccgucucaagugcuggcagcucuuauaagaacaaucccuucgccuccucaaucaguaaacacggggugagcuccggaucuucgagcucaggcgguaccccuguucaguccagugugucugggagcuuaguaccgggcauucagcccccauccgucggacaagcaacgucacgaccugugcccucuagcgccgguaagaaaaugccaguuagucagaagcucacccugguggcuccucccggcgggccaaacggagauuccagcggcgggacacagggagucgcaaaacuucugacuucuccgucauugaagccuuccgccgugaguagcguaaccucgucuacaucccucagcaagggcgcgucagguacugugcugcuagcugggaguucucugauggccucccccuacaaaagcucaaguccaaagcucagcggagcaauguccucuaauagccugggcaucauaacccccguuccuauuccaguccaugugcuuuccuuuucagccgacucuagugcuaaagccggugugucgaaggaugcaaucgucacaggccccgcuccugggagcuuccaccacggauugggccauucccuguuagccgggcuccacucuucaccgccacaugcggcuccccugccucacgcagcuguucccacccauaucccacagagccuuccuggagccucccaacugcacggcaaaggucccgcugugccacggaagcuauga

SEQ ID NO: 64489 - RNA, 1539 nt, Artificial Sequence
  derived and/or modified sequence opt3 from UBOX5__Homo_sapiens__NP_001254513
auggugaucaaccugugccucccccaguucagaccuaggauucacuguaauaagauaagcgccgacggcuacgaggucgaaaaccuuaucuccgaggaucugaccaaacggucucauggguuucgcacagaauauuucauuaagccaccgguuuacgugacuguaucauuucccuucaauguggagaucugccgaauuaacaucgacuugacggcuggagguggccaaaaugucaccggguuagaaauguauacaagugcaagcuccucucgugugucguggaacacuccucaguguagaacccugggaccagccgagcccucaguuccugauaaagaggcguuuacccuagugggcaagguccuccugaaaaaucagagccaggugguauucagucacagggguuuuaaggcucggccacccuucggggccauggaagcaacccuuccuuccccagccguuguggcucaagagcuguggaacaagggagcauugucucucagccaugucgcccaucugcgcauaugcaucacucacgugacaggcggcgggauuccguguaucaaaagacuggaaguguggggacagcccgcuaagaccugcucccaggaggucauugacucaauccucuuaguuacgagugagaaucugccucaggauguggcccuucaagcgccagcauugcccauggaaagcgacugugauccuggugaccagccagagucucagcaggcccccuccucacugcaaaaacuagcugaaauaauucaggauguaccggaggaauuucucgacccuaucacucuggagauuaugcccugcccaaugcuucugccuagcggcaaggugaucgaucagaguaccuuggagaaauguaacaggucugaagccacaugggggcggguccccuccgacccauucacuggaguggcauuuacaccccacagccaaccucucccacacccgucgcugaaggcucgcaucgaucauuucuuacugcagcacucuauucccggcugccaucuccuuggucgagcccagacagcgcuggccguuauaccuuccucaaucguguugccaagucagaagagaaaaauugagcaagcagaacacguccccgacagcaauuuuggggugaacgcuuccuguuucucugccaccagcccucuaguacugccaacgacuucagagcacacagcuaagaaaaugaaggccaccaaugaacccagucucacucauauggacugcuccacaggaccgcugagccacgagcagaaacuuucucagucacuggagaucgcauuggccaguacccucggcagcaugccuuccuucacggcuaggcugacccggggccaguuacaacaucuggggacacguggaucuaacacuucguggcgcccagguaccggcagcgcgugggaacaccccgggccuagaaugugccuacuccagaaguccauauuuucacugcuucagaaaggagcaggcguucccgccgcuuugaggccaccucccgugccaacacugccggguuga

SEQ ID NO: 64490 - RNA, 1515 nt, Artificial Sequence
  derived and/or modified sequence opt3 from UBP1__Homo_sapiens__NP_001121632
auggccugggugcugaagauggacgaggucaucgaaagcggccucguucacgauuucgacgcuucccuuucugggauuggacaggagcugggugcaggcgccuacucaaugagugauguguuggcguuacccauauuuaaacaagaagacagcucccugccucuagauggggagaccgaacauccaccguuccaguauguaaugugcgcugccacaucucccgcagugaagcuccacgacgagacucugacguaccuuaaccagggacagucguaugagaucagaaugcuggauaauaggaaaaugggcgacaugccugaaauuaacgguaaguuggucaaaucaaucauucgggugguuuuucaugaucgccgacuccaauacaccgagcaccagcagcuggaaggguggaaguggaaucguccaggagacagacugcucgauuuagacauccccaugagcgugggcauaaucgauacaaggacuaacccuagucagcugaaugccgucgaguuccuuugggacccagcuaagcggaccuccgcauuuauucaagugcauuguaucucuacagaguucacccccagaaaacacggcggggaaaagggaguaccuuuucgcauucagguugacacuuucaaacagaacgagaauggugaauauacagaucacuugcauagcgccuccugccagaucaagguguuuaaaccaaagggcgcugacaggaagcagaaaaccgaucgggagaagauggaaaaacgcacggcccacgagaaggagaaauaccaaccgucauaugacacuaccauacugacagaauguagucccuggccugaugcgccaacugcauacgucaacaauagccccucuccugccccaaccuucacauccccgcagcaaucaaccugcagcgugcccgacaguaacucuuccagcccuaaucaucagggggauggagcuucgcagacgucuggcgagcagauucaacccuccgccacuauccaggaaacacagcaguggcuacucaagaaccgauuuucaaguuacaccagacuguucagcaauuuuuccggugcagaccuucugaaauugacuaaggaggaucucgugcaaauuuguggggcugccgacggaaucaggcuguauaacucuuuaaagagccggucaguccguccacgccugacaaucuacguuugcagagaacagccuaguuccaccgugcuccagggccagcaacaggcggccagcucugcaucagagaauggcaguggggcucccuauguauaccacgccauuuaucuugaggaaaugauagcuagcgagguggccaggaaacuggcauuggucuucaacaucccacuacaccagauuaaccagguguaccggcaaggacccacggguauccauauacugguuuccgaucagauggugcagaauuuccaagacgaaucuuguuuucucuucucgaccgucaaggccgagagcuccgacggcauucacaucauccugaaauga

SEQ ID NO: 64491 - RNA, 1770 nt, Artificial Sequence
  derived and/or modified sequence opt3 from UBQLN1__Homo_sapiens__NP_038466
auggccgagagcggcgaauccgggggacccccugguucucaggacucagcugcaggcgccgagggggcgggagcuccagccgcagccgcuagugcagaaccgaagaucaugaaagugaccgucaagacacccaaagagaaggaagaguucgccguuccugagaacagcuccgugcaacaguuuaaagaagagauuucuaagagauucaagucgcacacugaucagcugguacucauauuugcuggcaaaauccuuaaggaccaggauacgcugucacaacaugguauucacgacggguugaccgugcauuuagucaucaaaacacagaauaggccacaggaucacagcgcccagcaaacuaacaccgcgggaaguaaugugacaaccuccucuacucccaacagcaauuccacaucaggcagugcaaccagcaacccuuucggccuagggggacuggguggccucgccgggcugucuucccuuggacugaauacgacuaacuuuucagaauugcagagccagaugcagcggcaacuccugaguaauccagagaugaugguucagauuauggagaaccccuucgugcagucuaugcuguccaauccugaccucaugcgccaauuaaucauggcuaacccacagaugcagcagcugauacaacgaaauccggaaaucagccauaugcuuaacaaucccgauauuaugcgucagaccuuggagcuggccagaaacccugcaaugaugcaggaaaugaugaggaaccaggaccgggcucuaucgaaucucgagucuaucccaggcgguuacaacgcccugcgcagaauguauacagauauucaagaacccaugcuuuccgcggcccaggagcaguuugggggaaauccuuucgcaucacuggucaguaacacuagcuccggcgagggcucucagccaagcaggaccgaaaaucgggaccccuugccgaacccuugggcuccccaaacaucacagaguuccagcgccucuucagggaccgcuaguacggugggagguacuacaggcagcaccgccuccgggacuucuggacagucgacaaccgcaccaaaucucguaccuggcguuggugccagcauguuuaacacgcccgggaugcagucccuguuacaacagaucaccgagaauccacagcugaugcaaaacaugcucucagcucccuacaugcgcaguaugaugcagucucuuagccagaauccugaucuggcggcacagaugauguugaacaauccacuauucgccggcaacccgcaacugcaggaacagaugcgacagcaacuccccacauuucugcagcagaugcagaauccugacacucuuuccgcuaugucaaacccaagagccaugcaagcacuguugcagauacagcaaggacuccagacccuggccacagaggcucccggcuuaauuccuggguucacuccaggacugggugcccuaggcagcaccgggggaucuuccggcacaaacgguaguaaugcaacccccagcgaaaacacuucuccgacggcggggacaaccgagccuggccaccagcaguuuauccaacagaugcuccaggcucuggccggagugaauccacagcuucaaaaccccgaggucagguuccagcagcaguuggaacaacuguccgcaaugggcuuccucaaucgggaggccaaccugcaggcucuuauugccacugggggagauaucaaugcagcuaucgaacgucuguuggguucacagccuaguuga

SEQ ID NO: 64492 - RNA, 1875 nt, Artificial Sequence
  derived and/or modified sequence opt3 from UBQLN2__Homo_sapiens__NP_038472
auggccgagaacggcgaaagcuccgggcccccuagaccaucuaggggaccggcugcagcccaggguucagcggcugcccccgcagagccuaagaucauuaaagugaccgucaagacaccaaaagaaaaggaggaguucgccguucccgaaaauaguagcgugcaacaguuuaaagaggcuauauccaagcgguucaagucucagacugaccagcugguacucaucuuugcaggcaaaauucuuaaggaucaagacacgcugauccagcacgggauucaugauggauugaccgugcacuuagucaucaaaucgcagaaccgcccucagggccaaucaacacagccaagcaaugccgcugguacuaacaccacaagugccuccacuccccgaucuaauagcacuccuauauccacaaacucaaauccauucgggcugggaagucuaggcggccucgcggggcugagcucucuuggacuguccucaaccaacuuuagcgaauugcagagucagaugcaacagcagcucauggcaucuccggagaugaugauccaaauuauggaaaaucccuucgugcaguccaugcugagcaacccugaccugaugcgucagcucaucauggccaauccacagaugcaacaguuaauucagagaaaccccgagaucucgcaucugcuuaauaacccugauauaaugaggcagacguuggagauugcucggaauccagccaugaugcaagaaaugaugcgcaaccaggaccuggcacuaucuaaccucgaguccauccccgguggcuacaaugcucugagaaggauguauacugauauucaggaaccgaugcuuaacgccgcgcaggagcaauuugggggaaauccuuucgccucaguuggcaguagcuccucuagcggugaagggacccagcccucacggacagagaaccgcgacccacugccuaaucccugggcaccacccccugcuacucagaguuccgccaccacaagcaccacgacuucuacaggaucaggcaguggcaacagcuccucuaaugcuaccgggaacacuguggccgcagccaauuacgucgcuucgaucuuuagcacaccaggaaugcaguccuugcuccaacagaucaccgagaacccgcagcugauucaaaauauguuaucagcgcccuauaugcgaaguaugaugcagucucugagccagaacccugaucucgcagcccagaugaugcuuaauuccccacuguucacggcuaacccccaauugcaggaacagaugagaccucagcuaccagccuuucugcaacagaugcagaaucccgacacccucucagcaaugagcaacccgagggccaugcaggcucugaugcaaauacagcagggucuucaaacacuggccacugaggcaccuggcuugaucccaucuuucacccccggggugggaguaggcguucucgguacagcgauugggccugugggccccgucacuccaaucggaccuauaggccccauugugccauuuaccccgaucgggccuaucggacccauugguccaacaggccccgcugccccuccaggguccaccggaaguggcggucccacugggccuacggugagcucugcagccccguccgaaacaaccucaccaaccagugagagcggccccaaccagcaguucauccagcaaaugguccaggcucuggccggagcaaaugcuccucaguuaccaaaccccgaaguucgguuccagcaacagcuggagcagcuaaaugccaugggcuuucucaaccgugaggcgaaucugcaggcccuuauugcuaccgggggagauauaaacgcagccaucgaacgcuugcuggguucgcaaccuuccuga

SEQ ID NO: 64493 - RNA, 1428 nt, Artificial Sequence
  derived and/or modified sequence opt3 from UBQLNL__Homo_sapiens__NP_659490
auguggcacgccaucagcagaaccuccaggaugucucagucaggcugccccagugggcugcucgcugacaagaacauuagcuccucugcaacacgggugauagucaaaacugccggaaaucaaaaggauuucaugguugcggacgauaucucggugcgccaguuuaaagagaugcuucuggcucauuuccagugucagauggaccaauugguauuaguguuuauggguugccugcuaaaggaucacgacacgcucucacagcgaggcauuauggaugggcauaccaucuaccuggucauuaaaagcaagcagggaagucguucccuugcccacucuuucagagaccugccuacaaacgauccaugucauagggaccggaauacuaagggcaacagcucccgcgugcaccagccgaccgguaugaaucaagcacccguugaauuggcccacuuuguggggucagaugcuccuaaaguccauacacagaaccucgaggugagucacccagaaugcaaggcacagaugcuggagaaucccagcauccagagacugcucucuaacauggaguucauguggcaauuuauauccgaacauuuagacacccagcagcugaugcaacagaauccugagguaucaaggcuuuugcuggauaacagcgaaauccuacuccagacucuggagcuugcccggaaucuggcuaugauucaggaaaucaugcaaauucagcagccaagucagaacuuggaguauccccucaauccucaaccauaccugggauuagagacaaugccgggcggcaacaaugcccuggggcagaacuaugcggacaucaacgaccagaugcucaauucuaugcaggaucccuucggagguaacccuuuuaccgcacuucuggccggccaaguuuuggaacaggugcaguccagcccacccccuccacccccgucgcaggagcaacaggaccagcuaacgcaacacccugcuacucgcgucauauacaauucuuccgggggauucucaaguaacaccagcgccaaugauacacugaacaaagugaaucacacuuccaaggcaaacaccgcuaugauuucuacaaaaggccagagccauaucugugccacccgacagcccgcguggauuccagcccucccuucaaucgaacugacgcagcaacuucaggaggaauauaaggacgcaacugugagucuguccagcucuagacagacauugaagggugaucuccagcugucagacgagcaaaguagcucccagaucaccgggggaaugaugcaguuacugaugaauaaccccuaccuagcugcccagauuaugcucuuuacuucuaugccacaacugucggagcaguggaggcagcaacuucccacauucuugcagcagacccagauaagcgaucugcucuccgcuuga

SEQ ID NO: 64494 - RNA, 5250 nt, Artificial Sequence
  derived and/or modified sequence opt3 from UBR1__Homo_sapiens__NP_777576
auggccgacgaggaagcuggcgggaccgagaggauggaaaucucugcagagcugccccagacuccucagaggcuagccuccuggugggaucagcaaguggacuucuacacugcguuucuucaccaucuggcucaguuggucccagaaauuuauuucgccgagauggauccggacuuagagaagcaagaagagucuguucagaugucaauauuuacgccccuggaaugguaccuauucggagaggauccugacaucugccucgagaaacugaagcacaguggugcauuucagcuuuguggccggguguucaaauccggggaaaccacauauuccugccgcgauugugccauugacccaacuugcguacuguguauggauugcuuucaggacucugugcauaagaaccaccgauacaaaaugcauaccucgacaggaggcgguuucugugauugcggggacaccgaggcuuggaagacuggacccuuuugugucaaucacgaaccuggccgugcaggcacaaucaaggagaacucaagaugcccauugaaugaagaggugauuguucaagccaggaaaaucuuccccagcgugauaaaguaugucguggagaugaccaucugggaagaggaaaaagagcucccuccagaacugcagauucgggagaagaacgagcgcuacuauuguguacuguuuaaugaugaacaccauaguuacgaccacguuaucuacucccuccagagagcuuuagacugcgagcuggccgaagcgcagcuucauacgacugcaauugauaaagaggggaggcgggccgugaaggcuggagccuaugcagcuugccaagaagccaaggaggacaucaaaucucacagcgagaacgucucccagcacccguugcauguggaagugcugcacucagagauaauggcgcaucagaaguucgcccuacgccucgguaguuggaugaauaaaauuaugagcuacucuuccgauuuucgacaaaucuucugucaggcaugccugagagaagaacccgacucagagaacccuugucuuauuagcaggcugauguugugggaugcuaagcucuauaaaggcgcccggaagauccugcacgaauuaaucuucaguagcuuuuucauggagauggaauacaaaaagcuguuugcuauggaguucgucaaguauuacaaacagcuccagaaggaauauauuuccgacgaucaugaccguagcauaucgaucaccgcccuuucuguucaaauguuuacagugccaacucuggcacgccacuugauugaggagcagaauguaaucuccgugauaaccgaaacacuacuggagguccuccccgaauaccuggauagaaacaauaaauucaacuuucagggguacucacaggacaaacuuggaaggguguaugccguuauuugcgaucugaaauacaucuugaucaguaagccuaccauuuggacggagcggcuccgaaugcaauuccuggaaggcuuucgcagcuucuuaaagauccugacuuguaugcaggguauggaggagauuagaagacagguggggcagcacauagaagucgacccagacugggaggcugcgaucgcaauucaaaugcagcucaagaauauccuccugauguuucaggaauggugcgccugugaugaggaacuuuugcugguggcuuauaaggagugccauaaagccguaaugcgguguuccacaucuuucaucagcucaaguaagaccguugugcaguccugcggacacagccucgagacuaaaucuuaccgcgucucagaagaccuggugaguauucaucuuccccugagcagaacauuggcaggccuccacgucaggcugucccguuuaggcgccgugucucggcugcacgaguuuguuucguucgaagauuuccaaguggagguccuaguagaguauccgcuccgaugucuggugcuuguugcucagguggucgccgaaauguggagaaggaacggguugagccugauaucccagguguuuuacuaucaagacguaaagugccgcgaggaaauguacgauaaggacaucauuaugcuccagaucggagcaucacugauggauccuaauaaauucuuacugcuuguguugcagcgguacgagcucgcggaggcuuuuaacaagaccauuaguacgaaagaccaggaucugaucaagcaauauaacacccuaauagaggagaugcugcagguucucaucuacauugucggugaaagauaugugcccggcguggggaaugucacaaaagaggaaguuacuaugagggagaucauucaucugcuuugcaucgaaccaaugccucacucugccauagcaaagaacuugcccgagaaugagaacaaugaaaccggacuggagaacgugauuaauaagguggccacauucaaaaagccaggcguaagcggucauggggucuacgaauuaaaagacgagucccucaaggauuuuaacauguauuucuaccacuauucaaaaacucagcauagcaaggcugaacacaugcagaaaaagcgccgaaagcaagagaauaaagacgaggcccugcccccuccaccgcccccugaauuuuguccagcauucucuaaggugaucaaccuucugaauugcgauauuaugauguacaucuugcggaccguuuuugagcgugcuauagacacagacuccaaccucuggaccgaaggcaugcugcagauggccuuccacauccuagcgcugggacuccuggaggagaaacagcagcuucaaaaggcccccgaagaggaagugacuuuugauuucuaccauaaagcuaguagauugggcagcucugcaaugaauauucagaugcuguuagagaagcucaaggggaucccucagcuggaaggacaaaaagacaugauuacguggauccuucagauguuugauacagucaagaggcugcgcgagaaauccugucuaauaguggccaccacuucagguagugagagcauuaagaacgacgaaaucacccacgauaaagagaaggcugaacggaagagaaaagccgaggcagcgaggcuccaucgacagaagaucauggcccagaugucggcucugcagaaaaauuucauugaaacacacaaguugauguaugacaacaccuccgagaugccaggcaaagaggauucuaucauggaagaggaaagcacucccgccguuucagacuacagucgcauugcacuggggccgaagcggggaccuuccgugacagagaaggaaguauuaacgugcauacucugucaggaggagcaggaagucaaaaucgagaacaaugcuauggugcugucugccugcgugcaaaagagcaccgcacuuacucaacauagaggcaaaccaauugaacuguccggugaggccuuggauccccucuucauggacccugaucuggcuuaugggacauacaccggcucauguggacacgucaugcacgcgguuugcuggcagaaguauuuugaggccgugcagcuaagcagucagcaaaggauccauguagaccuguucgaucuugaaucuggcgaguaccucuguccccugugcaaauccuuguguaacacagugauuccaaucauaccucugcagccccagaagaucaauagcgaaaacgcagacgcuuuagcccagcuccugacucuugcccguuggauucaaaccguccuggcucgcaucucgggguauaauauucggcacgcaaaaggagagaacccaaucccgauauuuuucaaucaggguaugggcgacucaacguuggaauuucauucuauucucaguuucgggguggaguccagcaucaaguacucuaacagcaucaaggagaugguuauucuguuugccaccacaauauacagaaucggacuaaaagugccucccgaugaaagggacccacgaguccccaugcugacuuggucaaccugcgcguucacaauucaggcuaucgagaaucuucucggcgaugaagguaagccucuguuuggggccuugcaaaaccggcagcacaauggcuuaaaagcacugaugcaguucgccguggcucagcgcauuacuugcccacaaguucucauccagaagcaccuggugagacuucugagcgucguauugcccaacauaaaaagugaggacaccccuugucuacugagcaucgaucucuuucaugugcugguuggagcagugcuugccuucccgucuuuauauugggacgauccagucgaccugcagcccuccucagugaguagcuccuacaaucaccucuauuuguuccaucugauuacgauggcgcacaugcuccagauccugcuuacaguagauaccggccugccuuuggcucaagugcaggaagacucugaggaggcccauucggcaagcucauuuuucgccgaaauuucccaguacacaagugggucuaucggaugcgauauaccaggcugguaucuaugggucagccugaagaacgguauuacacccuaccucaggugugcugccuuauuuuuccacuaucugcuugggguuaccccuccggaggaacugcacacuaauuccgcagagggagaauacucagcucucugcucuuacuugagccugcccaccaaccucuuucugcuuuuccaggaguauugggacacagugcggccacuacugcaacgauggugugccgacccugcguuguuaaacugccugaagcagaaaaauacgguggucagauacccccgcaagaggaacagucucaucgagcugccagaugacuauuccugucuucugaaucaggccagccauuuucguugcccucggucugcagaugacgaaagaaaacaccccgugcucuguuuguucugcggcgcuauccuguguucacaaaacauuugcugccaggagaucguuaauggugaagagguaggcgccuguauauuucaugcucuacacugcggggcaggaguguguauuuuccugaagaucagggagugccgcgucgugcucguugaaggcaaagcccgagggugugccuacccagcuccguaucuugaugaguacggagaaaccgacccuggccugaagagagguaaccccuuacacuugucccgggagagguaucgcaagcugcaucucguguggcagcagcacugcauuaucgaagagauagcgcguagucaagagacuaaucagaugcuguuuggguucaacuggcagcuucuguga

SEQ ID NO: 64495 - RNA, 5667 nt, Artificial Sequence
  derived and/or modified sequence opt3 from UBR3__Homo_sapiens__NP_742067
auggccgcugcagccgcggcugccgugggcgggcagcaacccagccagccugagcugccagcaccgggacucgcccuugacaaggcugcaaccgccgcucaccugaaagccgcguuguccagacccgauaacagggcaggugccgaagaguuacaggcucugcuagaacggguccucucugccgagcgcccucuggcagcugccgcgggcggggaagacgccgcagcugccggaggcggugggggaccaggcgcugccgaggaggaagcacuugaguggugcaagugucuguuggccggcgggggagguuacgaugaauucugcgcugcgguucgagcauaugaccccgccgcucucuguggccugguguggacagccaauuuuguagcauaccguugcagaacuugugggaucucaccuugcaugagucugugugccgagugcuuccaucagggagaucacacgggccaugacuuuaacauguucaggagccaagcugguggggccugugauugcggagacuccaaugugaugcgggagucuggcuuuuguaaacgccaccagauuaagucgucaagcaacauaccaugcguccccaaagaucucuuaaugaugagugaauucgugcugccuagauuuaucuucugccuuauucaguauuugagggagggcuacaaugaaccagcagcggacgggccguccgagaaggaucugaacaagguucuacagcuccuggaaccccaaaucucuuuucuugaggaccugaccaaaaugggaggugcuaugcggagcguguugacacagguccucacuaaucagcagaacuauaaggaucugaccuccggcuuaggggagaaugccugugugaaaaagucacaugaaaaauaccugauugcacucaagaguagcggacuuacauauccugaggacaagcugguauacggcguucaagaaccaucugccgguaccuccucauuggcugugcagggguucaucggcgccacuggaacacuaggccaggucgacagcagugaugaggacgaucaagacgggucucagggacuggguaaacgcaagcgagugaaacucuccagcggcaccaaggaucagucgauaauggacgugcugaaacacaagucuuuucuugaagagcuguuguucuggacgaucaaauacgaguuuccccagaagauggucacuuuccuccugaacauguuaccugaucaagaauauaagguugcauucaccaaaacauuugugcagcacuacgcuuucauuaugaagacucugaaaaagucccaugagucagacaccaugaguaauagaaucguacacauuagcgugcagcuauuuuccaacgaagagcucgccaggcaggucacagaagagugccaacugcuugauaucauggugaccguuuugcuguauaugauggagucuugucucauaaaaagcgaacugcaggacgaggaaaauucacuucauguggucgugaacugcggggaggcgcuguugaagaauaacacguacuggccacucguaagugauuucauuaacauccugucccaccagagcguugccaagcgguuuuuagaggaccacggacugcuagugacuuggaugaauuucgucucuuuuuuccagggcaugaaccucaauaaacgugaacugaacgagcauguggaauuugagucacaaacauauuacgcugcauucgccgcugaacuugaggccugugcacagcccaugugggguuugcugagucacugcaagguccgcgagacccaggaauauacuagaaaugugguuagguacugucucgaggcgcugcaggacugguuugaugccauuaacuucguggacgaaccggcuccuaaucaaguaacauuucauuuaccccugcaccgguacuaugccauguuccuuagcaaagcagucaagugccaggaguuggaucucgacuccgugcugccagaucaggaaaugcuaaugaaacugaugauccauccucuccaaauccaggcuucucuggccgagauucacucgaacauguggguucgaaaugggcuucagauaaagggccaggcaaugaccuacgugcaaagccacuucuguaacuccaugaucgaccccgauauuuauuugcugcaggucugcgccucacgcuuagacccagauuacuuuaucaguucuguguucgagagauuuaagguaguggaccuccugacgauggcuagccagcaucagaauaccguucuugaugcggaacacgagagguccaugcuggaaggagccuugacauuccucgucauacugcuaucacugcggcuccaucugggcaugagcgacgaugagauucuucgcgcagaaaugguggcucaauuguguaugaacgacagaacucacucuucccuguuagaccucauccccgagaauccuaacccaaaaagugggaucauuccgggaagcuauucuuuugaguccgugcugucagccgucgccgauuucaaggcucccguuuuugaaccugguggcaguaugcagcaggggauguacaccccaaaagcagaggugugggaccaggaauucgaucccgugaugguaauccuuaggacagucuaucgucgggacgugcaaagcgccauggaucgauacacugcguuucugaagcagucgggaaaauucccuggcaauccauggcccccguacaagaagagaaccucccuacacccuucuuauaaaggucucaugaggcuguugcauugcaagacacugcacauuguuuuauuuacccuccuguacaaaauacuuauggaccaucagaaccugagcgagcacguguugugcaugguccucuaucugaucgagcuagggcuggaaaacucagcugaggaagagagugaugaagaggccuccgugggcggaccagagcgcugucaugacucuugguuccccggcagcaaucuuguuuccaacaugcggcacuuuauuaauuacgugagaguaagggucccugaaacugcacccgaggugaagcgcgauucaccagccagcacgaguucugacaaccucgggucccugcaaaauagcggaacagcucagguguucucguuggucgcagaacgacggaaaaaguuccaggagaucaucaaccguucaucuagugaagccaaucagguugugagaccuaaaaccuccagcaaguggucugcgcccggcagcgcuccacaacugacuaccgccauuuuagagauaaaggaguccauccucucacugcuuauuaaacugcaccauaaguugagugguaaacagaacagcuauuacccgccuuggcucgaugacaucgaaauucugauccagcccgagauaccaaaguauucucacggggauggaaucacagcaguagaaaggauucuacugaaagccgcuucccagucacgcaugaauaagcggaucauugaggaaaucugcagaaaggugacccccccugucccacccaaaaaggugacugccgcagagaaaaagacacuugacaaagaggaaaggcgacaaaaggcucgcgagcggcagcagaagcuccuggccgaauuugcgaguagacagaaaagcuucauggagacggccauggacguugauuccccugagaacgacauaccgauggaaauuaccacugcagagccacaagugucugaagcugucuacgauugugugaucugcggccagucgggucccagcucagaggacaggccuacaggcuugguuguguuacugcaggccuccaguguccucgggcagugucgugauaauguagaaccaaagaaacugcccauuucugaggaggaacaaaucuacccuugggacaccugcgcugcagugcaugauguucgccuuagccuguugcagcgguauuuuaaggacuccucaugucuacuggccgugucuauaggaugggagggcggggucuacgugcagacaugcggacacacucuccauaucgauugucacaaaagcuauauggaaagucugagaaacgaccaaguacuucagggcuucuccguggauaagggugaguuuaccugcccguuauguaggcaguucgccaauagcguccugcccugcuacccagggucuaacguugaaaauaacccuuggcagcgacccucaaacaaguccauucaagaccucaucaaagagguggaggaauugcagggacggccaggcgcuuuuccuagugagacgaaucugagcaaggaaauggagucggugaugaaagacauuaagaacaccacacagaaaaaguaucgcgauuacucuaaaacucccgguuccccagacaaugauuuccucuuuauguauagcgucgcgagaaccaaccuggaacuugagcugauccacaggggcgggaauuugugcucaggaggcgcaaguacagccgggaagcggucuugucuaaaccagcuguuccaugugcucgcuuuacacaugcgacuguacuccauagacagcgaguacaauccguggagaaagcuuacucaacuggaagagaugaacccucagcucggauaugaagagcagcagcccgagguuccaauuuuguaccaugauguaaccucacugcuccugauccaaauccuuaugaugccccagccucuacgcaaagaccacuuuacgugcauugugaagguccuguucacauuguuauauacccaggcccuggcagcccucagugugaaauguagcgaagaggauagguccgcuuggaagcacgcgggcgcccugaaaaagucuacuugcgacgcagaaaagagcuacgagguucuucuguccuucgugaucucagaacucuuuaaagguaaguuguaucaugaggaggggacacaagaaugugcuauggucaauccaauugccuggucucccgagaguauggaaaaaugccugcaggauuucugucuaccuuuucugcguauaaccucgcuccuucagcaccaucuguucggagaggacuuaccgagcugccaggaagaggaggaauuuuccguguuggcaucuugucugggccuccugccaacuuucuaccaaaccgagcaccccuuuaucucagccagcugccuugauuggccuguacccgcuuucgacauuaucacacagugguguuuugaaauuaaguccuucacggagcggcaugccgaacaggguaaagcgcugcucauccaggagaguaaguggaaguugccacaccuguuacaacuaccugagaacuauaauaccauauuucaguacuaccacagaaaaacuugcucugucugcacaaaggugcccaaagauccagcaguuugucuggugugcggcaccuucgucugucucaaggggcuuugcuguaaacagcagagcuauugcgaaugugugcugcauucacaaaacugcggagccggcacagggaucuuuuugcugauuaaugcuuccguuaucauuaucauaaggggacaccgcuucugucucuggggcaguguguaccuggacgcccauggugaggaagaccgagaucuuagacgggggaagccucucuauauuugcaaggagagguacaaaguccuggagcagcaguggaucagccacacuuucgaccacaucaacaagcgcuggggaccgcauuauaauggcuuguga

SEQ ID NO: 64496 - RNA, 15705 nt, Artificial Sequence
  derived and/or modified sequence opt3 from UBR4__Homo_sapiens__XP_011539410
auggccaccagcggcggggaagaagcugccgccgcggcucccgccccuggaaccccagcaacuggugccgauacgaccccgggcugggaaguggcugucagaccccugcucuccgcaucuuacucagccuucgaaaugaaggaacuuccucagcugguugcuagcgugaucgaaagcgaauccgagauuuugcaccacgaaaaacaauaugagccauuuuacucuucguucguagccuuaucaacccacuauauaacuaccgugugcagccugauccccaggaaccagcuacagagcgucgcggcagccuguaaggugcucauugaauuuucccugcuucggcuggagaauccugaugaggcuugcgccguuucucagaaacauuugauccuccugauuaaggggcuguguacaggaugcagccgccucgaccgaaccgaaaucauaacuuucacagcaaugaugaaauccgcuaaguuaccacaaaccgugaagacgcugucagaugucgaggaccagaaagaacuugccagucccgugagcccugaguugcgucagaaggaaguacagaugaacuuucugaaucaacuaacuucuguuuucaacccaagaaccguggcgucccagccgaucucaacacagacucucgucgagggcgagaaugaugaacagagcaguaccgaccaagccucugcaauuaaaacaaagaacguguuuaucgcucagaauguggccucccugcaggagcuuggugggagcgaaaaacuguugagggucugucucaaccugcccuacuucuuacgguauauuaaucgcuuucaagaugcuguucuggccaacucguucuuuaucaugccugcaaccguggccgacgcuacggcgguaagaaauggauuccacucucucgugauagaugucacuauggcacuugacacacuguccuugccagugcuagagccccugaacccuucaaggcuccaggauguuaccgugcugagucuuagcugccuguacgccggcgucuccguggcuacuuguauggccauuuugcauguaggcucugcacagcagguucggacagggagcaccucaaguaaggaagacgauuaugaguccgacgccgcuacgaucgugcaaaagugccucgagauuuacgacaugaucggacaggccaucaguucuucacgccgagcugguggcgaacacuaccagaauuuucagcuguuaggggcguggugucugcuaaacagucucuuccugauucuuaauuugagcccaaccgcucuggccgauaaaggaaaggagaaagacccccucgcagcccugagagucagggauauacuuucccggacaaaggaaggcguggguucuccgaaacuggggccuggaaagggccaccaaggcuucggggucuugucggugauccucgcuaaccaugccauuaaacuguuaacuagccuguuucaggaccuacagguugaggcacuccacaagggaugggaaaccgauggucccccagcugcccuguccaucauggcgcagucaacaaguauacaacguauucagcgccuuaucgacucugugccuuugaugaaccugcuccugacuuuacugagcaccuccuauagaaaggccugcguacuucagaggcagcggaaaggcucaaugagcucugaugcuuccgcaaguacagacagcaauaccuacuaugaggaugacuucucuuccacugaggaagauucaagucaagacgacgauagcgagcccaucuuggggcagugguuugaagagacgauuucgccauccaaggagaaagccgcucccccuccaccgcccccuccacccccucucgaaucuagcccacgagucaagucacccaguaaacaggccccgggagagaagggcaacauccuggcaucccgcaaggacccugaacuauuccugggucucgcgucuaauauucugaacuuuauaacaagcuccaugcuuaauucaagaaacaauuucaucaggaacuacuugagcgugagucugucugagcaucacauggccaccuuagcuuccauuaucaaagaaguugauaaggacgggcucaaaggcagcucggaugaggaguuugccgcagcucuguaucacuucaaucauucacuugugacuucugaccugcaaaguccaaacuugcagaauacccuccugcagcagcuaggagucgcccccuuuuccgaaggcccuuggccccuguacauccacccacaaagccucucugugcugagccggcuuuugcugauuuggcagcauaaggcauccgcccagggggauccugacguacccgaguguuuaaaagugugggaucgcuuccucucaacaaugaagcagaacgcucugcaaggaguugucccaagugaaaccgaggaccuuaauguggaacaucugcaaaugcuacuccugauauuucacaacuucacugagacagguagaagggcgaucuugagccuguuugugcagauuauccaggaguuaucugucaauauggaugcccaaaugcguuucguuccgcucauucuggcacggcuucuguugaucuucgacuaucuccugcaccaguacuccaaggcuccuguguaccuauuugaacaggugcaacacaaccugcuuucacccccauucggcugggccagugggagccaggauuccaacucuagacgagccacgacaccccucuaucauggauuuaaagagguagaagagaauuggucgaagcacuucagcucagacgcugucccucauccaagguuuuacugcgugcugucccccgaagcaagugaggacgauuugaaccgccuggacucuguugccugcgauguguuauucagcaaacucgucaaguaugacgagcuguacgcggcucuuacugcccuguuggcagccggcucccagcucgauacagugcggagaaaagaaaauaagaacguuaccgcucuggaggcaugugcccuacaguauuacuuucugauacuuuggaggauccucgguauucugccuccgucaaagacauauaucaaucaauugucuaugaacagcccagaaaugagugagugcgacauuuuacacacucugcgcugguccagccgacuccggaucucuucauacgugaauuggauaaaagaucaccugauuaagcaggggaugaaagcggagcaugcuuccagucuucuggaauuggccagcaccacgaaguguucgucuguaaaauacgacgucgagaucguggaagaguauuucgcacgucagauuuccagcuuuugcucaaucgauuguaccacaauacuacagcugcacgaaauccccagucuccaaucuauuuacacucuggacgccgcuaucuccaaggugcaggucagccuugaugagcauuucucaaaaauggccgcagagaccgacccucacaagaguagcgaaauuacaaagaacuuacugccagcuacucuccaguugaucgauaccuaugccuccuuuacgagagcguaccugcuccagaauuucaacgaggaaggcacaaccgagaaacccucuaaggaaaaacugcaaggauuugccgcaguucuugcuauaggcagcuccaggugcaaggccaauacucuggggccuacauuggugcagaaccuaccgucaucuguacagaccgugugugagaguuggaauaacauuaauacuaacgaguuccccaacaucggaucguggcgcaaugcuuucgcaaacgacaccaucccaagcgaauccuauauuucugccguccaggccgcucaucuggguacacucugcucacagagcuuaccucuggcggcaucccuuaaacacacgcugcucaguuuggugcggcugaccggcgaccucaucguuuggucugaugagaugaaucccccacaggugauuagaacucugcuuccucuacuguuggaaagcucaacagaguccgucgccgaaauaaguagcaacucuuuagagaggauccuggggcccgcugaguccgacgaauuucucgcccgaguguacgagaagcugauuaccggauguuauaauauccuugcaaaccacgccgauccaaauucaggccuggacgaaagcauucucgaggagugcuugcaguaccuggaaaagcaacuagagucgucucaggcucgcaaagcgauggaagaguucuuuagugauuccggugaacugguucagaucaugauggccacagcaaacgagaaucucagcgcuaaguucuguaaccgggugcuuaaauuuuucacuaagcuguuucaguuaaccgagaaaucaccgaauccuuccuugcugcaucucugcgggucucuggcccaacuugcaugcgucgaacccguaagacugcaggccuggcucacgaggaugacaaccagcccacccaaggacagugaucaguuggacgugauacaggagaaccgucaacuguuacagcuacugacuaccuacaucguucgcgaaaauucccaggugggcgagggagucugugcugugcuccuuggcacacugacuccuauggccaccgaaauguuggcgaacggggauggaacaggcuucccagagcugaugguagugauggcaacgcucgccagcgcuggucagggggccggacaucugcagcuucauaaugcugcagucgacuggcucucucggugcaagaaauaucugucacagaagaacguuguggagaaauugaacgccaaugugaugcacggcaagcaugucaugauucuggaauguaccugccacaucaugaguuacuuagcugaugugacuaacgcccuaucccagagcaauggucaaggccccucucaccugucgguugacggggaggaaagagcaauugagguagacucagauuggguggaagaacucgcggucgaggaagaggacagccaggccgaagauuccgacgaggauagucuuuguaacaaacugugcacauuuaccaucacucagaaggaguucaugaaucagcauugguaucacugucauacaugcaagaugguggacggaguuggcguguguaccgucugcgcuaaagugugucacaaggaucacgaaauaucuuacgccaaauaugggagcuuuuucugcgacugcggagcaaaggaggauggcuccuguuuggcucugguaaaaaggacgccuucaagugguaugucuagcacuaugaaggaauccgccuuccaaucagagccgcgaauuagcgaaucucucguccggcaugcauccaccaguagcccagccgacaaagcuaaggugacaaucucggaugggaagguugcggacgaggagaaacccaagaaauccucucugugccgcaccguggaaggauguagagaggaacuucagaaccaggccaauuuuucauucgcaccuuuaguccuggauaugcucaacuuuuugauggacgcuauccagacuaauuuccaacaggccagcgccgugggcaguuccucuagggcacagcaggcucugagcgagcuacacacaguugaaaaggccguggagaugaccgaccaacugaugguccccacacucgguucacaggagggcgcguuugaaaacgugcggaugaauuacuccggggaucagggacagacuauucgacaacuuauaagugcucauguacugagacgcguggccaugugcguuuugagcucuccacacggcaggcgucagcaucuggcagucucacacgagaaagggaagaucaccgugcuccagcuguccgccuuacuuaagcaagcugacagcucuaaacggaagcugacgcucacaagacuagcaagugccccugugcccuucaccguccugucguugacuggaaacccauguaaagaagauuaucuggcgguaugcggccucaaggacugucacgugcuuaccuuuuccagcucagguucuguuagcgaucaucugguguugcacccucagcuggcuacagggaauuucauuaucaaagccgucuggcucccgggaucccagacugaguuagcaauugugaccgccgacuuuguuaagaucuacgaucugugcguggacgcucuuagucccacguucuacuuucugcuaccaucaucuaagauaagggaugucacauuccucuuuaacgaagagggcaaaaauaucauugugaucaugagcuccgccgguuauauuuacacccagcugauggaggaagcaaguagcgcucaacagggcccuuucuauguaacuaacguguuggagaucaaucaugaagaccugaagcaggauuccaacucucagguugccgggggaggcgucucaguguacuauagccacgugcuccaaaugcuuuucuuuucguacugucaggggaaauccuucgcggccacaauaagucgcaccacucuggaggucuuacagcuguuucccauuaacaucaagucuuucguugugugcagcucaaauggaggcuccaaaacaucuccagcauugugucaguggagugagguaaugaaccacccuggucucgugugcugcguccaacagaccacgggggugccccugguugugauggucaagccggacacuuuucuaauccaggaaauuaagacccuuccagcuaaagccaagauccaagauaugguagcaauacgacauacagcuuguaaugagcagcagagaaccacaaugauucugcucugcgaagacggaagccugcggaucuauauggccaacguggagaauacuuccuacugguugcagccuucacugcaacccagcucuguuauuaguaucaugaaaccagugaggaagcgcaaaaccgccacgauaacaacucguaccuccagccaggucacauuccccauugacuuuuucgaacacaaccagcagcucaccgauguggaguuuggcggcaaugaccuucugcaagucuacaacgcgcagcagaucaagcauagauuaaauucaacugggauguauguggcuaacaccaagccuggagguuucacaaucgagauuucuaauaacaauuccacgaugguuaugacuggcaugcggauccagauugggacccaagcaauagaaagggccccgucguacaucgagauuuuuggacgcacaaugcagcugaacuugagccgaaguagaugguucgauuuucccuucacccgggaagaggcucuccaggccgacaaaaagcugaaucuauucaucggcgcaucuguggauccagccgguguaacuaugaucgacgcugugaaaauuuaugggaagacaaaagaacaauuuggauggccugaugagcccccugaggaguucccauccgcgagcgucucaaacauaugucccaguaaccuuaaucaguccaacggcaccggcgacagcgauucugccgcaccuacgacuacaucagggaccguucuggagagcuccgaaaccgagucucucacuaagcuggacagguugguggucaguucguuagaagcucuggagagcugcuuugccgugggaccaaucauugagaaagaacgcaauaagaacgcagcccaggagcucgcuacacuucugcuaucccugcccgccccggcgucaguacagcaacagucuaagagccucuuggcaagucugcacaccuccagaucagccuaccauucucacaaagaucaggcacuucugagcaaggccgugcagugucucaauacauccaguaaagaagguaaggacuuagacccugagguuuuccaaaggcuggugaucacugcacggagcauugcuaucaugcguccaaacaauuugguccacuuuacggagucuaaacugccccagauggaaaccgauugcuucuuuccucgcugugccugcuggucacucggcauaguggggauccuuauuggagcuccacuggagacacccuccccggaaggcauggacgaggguaaggaaccucagaagcagcuagagggggauuguugcagcuucaucacucaacuggucaaccauuuuuggaaacuccacgccaguaagcccaaaaaugcauucuuggcgccagccugucugccuggacuuacccauauugaggcuacagugaacgcccugguugacaucauacacggcuauuguaccugcgaauuagauugcauuaauacugcaucuaagaucuacaugcagaugcuccugugccccgacccagcuguauccuuuucguguaaacaggccuugauucgagugcugagacccaggaacaagcggcgccacgucacgcucccuagcucaccaagauccaauaccccgaugggcgauaaggacgaugacgaugacgaugacgcagacgagaaaaugcagucuagugggauccccaacggaggucauauaaggcaagaaagccaggagcagucagaaguggaucacggcgacuucgagaugguuuccgagagcauggugcuugaaacagccgagaaugucaacaacgggaauccuucuccacuggaagcgcuacuggcuggagccgagggcuuucccccuaugcucgauaucccacccgacgcagaugacgaaacuaugguggaguuggccauugcucugaguuuacaacaggaucagcaggguuccagcucaucugcccuugggcugcaaucgcucggacugagcggccaggcaccuuccaguucuucauuggacgcuggcacccugagcgauacaaccgccuccgcgcucguaacucuuagugcuccggccucugacgaugaggggagcacagcagccacggacggauccacccugcggacuucaccagcugaccaugguggcagcguggggucugaauccggaggcagugcaguugauucagucgccggugagcacagcgugucggggcgauccucugcguauggagacgccacagcugaaggccaucccgcaggcccugggagugugagcucauccaccggagccaucucuaccacaacuggucaccaggagggcgaugggagcgagggagaaggcgagggugaaacggagggggacguccacaccaguaacagacuacauaugguucgccugauguuacucgaaaggcuguugcagacacuuccccaacugcggaaugugggcggaguacgugcuauuccauacaugcaagugauccucaugcugacuaccgauuuggacggcgaggaugagaaggacaaaggggcccuggauaaccuacucucccagcuuauagcagaacugggaauggacaagaaagaugucagcaagaagaaugagagaucugcuuuaaacgaagugcaccugguugugaugaggcuccugucagucuucaugucccgcacaaaaagcgguaguaagucuucaauuugcgaguccagcucguugaucucuagugccaccgcggccgcacuucuguccagcggcgcuguggacuacugucuccauguacugaaaucacuauuggaauauuggaagucucagcaaaaugaugaggagccuguugccacuagccagcugcucaaaccccacacgacauccaguccaccggacaugucaccuuucuuucuucggcaguacgugaaggggcaugcagccgacgucuucgaggcuuauacccaacuguuaacugagauggugcugcgacuccccuaccagaucaaaaagauuaccgauacaaacagcagaaucccacccccuguguuugaccacuccugguucuauuuucugucugaauacuugaugauacagcagacuccauucgucaggcgccaaguucggaaacuucugcucuuuauuugcggaaguaaagagaaguauagacagcugcgugaucuacacaccuuagacagccaugugaggggcaucaaaaagcuguuggaagaacaggguauuuuccuccgggccuccguagugacagcgucaucugggucggcucugcaguacgauacgcuuaucagccugauggagcaccucaaagcaugugccgaaauagcugcccaacgcaccaucaauuggcagaaguuuugcauuaaggacgauuccguccuguacuucuugcuucaggugaguuuucugguugacgagggcgugucucccguccuacuccagcuguuaagcugugcacugugcggaucaaaaguguuggccgcucucgcggccuccagcggcucuaguuccgcaucaaguucuucggccccuguagcugcauccagugggcaagccacuacacagagcaagucaucuaccaaaaaguccaaaaaggaagagaaggagaaagaaaaggauggagagacuagcgguagucaggaagaccagcuguguacagcucuuguuaaccaacugaauaaauucgccgauaaggagacccucauccaguuuuugcgaugcuuccugcuugaaucaaacuccagcucugugagauggcaggcgcauugccugacguuacacauuuauaggaauaguagcaaaucccaacaggagcuacuccuggaccugauguggucuaucuggccggaguugccagcauacggccggaaggccgcucaguucgucgaucuccugggguauuuuucacuuaagacaccccagacagagaagaaacugaaagaguacagccaaaaggccguggaaauuuuacgcacucagaaccacauccucaccaaucauccuaacuccaacauauauaauacacugucgggauugguugaguucgacggcuacuaucuugaaucugacccaugucuggugugcaacaaucccgaggucccuuuuuguuacauuaaacuaaguagcaucaagguggauacuagauacaccacaacccagcagguagugaaacucaucgguucacacacuauuuccaaggucacgguuaagauaggggaccugaaaaggacaaagauggugcgaaccaucaaccuguauuacaauaaccggacuguccaagcaauuguggaguugaaaaauaagcccgcucguuggcauaaagccaagaagguacagcucaccccaggccagacagaagugaaaaucgaucugccgcuuccuauuguugcgucuaaccugaugaucgaguucgccgacuuuuaugaaaauuaccaggcuagcacggagaccuuacaaugccccagauguuccgcaagugugccagccaacccuggagucugcggcaauuguggggaaaacguguaucagugccacaagugucgcucaauaaauuacgaugagaaagaccccuuccucugcaacgcuuguggauuuugcaaguaugcaagguucgauuuuaugcuguacgccaaaccauguugcgcuguugacccuaucgagaaugaagaggaucggaagaaggccgucagcaacauuaacacucuauuggacaaagcagauagaguguaccaucagcugaugggccaccgcccccaacuugaaaaucuccugugcaaggugaacgaggccgcgccggagaaaccacaggacgacucugguacagcugggggaaucuccaguaccagcgccucaguaaauagguauauucugcaguuggcacaggaauacuguggcgauugcaagaacucuuucgacgagcuuuccaaaaucauacaaaaggucuuugccucgcgaaaggaacuccuggaguaugauuuacagcagcgggaagcugccacuaaaagcaguagaacauccgugcagccuaccuucacagcaucucaauacagggcucugucaguucuagguuguggccacacuagcuccaccaagugcuaugggugugccucugcggugacggagcauugcauuacccuccugcgcgcauuggccacaaaucccgcucugcgucacauccuugucagccagggacucauccgggagcuguuugacuacaacuuaagaaggggcgccgcugcaaugcgcgaagaggugcgacagcugauguguuugcucacucgggauaauccagaagccacccagcaaaugaacgaccugauuauagggaaaguuaguacagcgcuuaagggacauugggccaaucccgaucuggcuucaucccuacaguaugagaugcuccuguugacugacagcaucucuaaagaagauaguugcugggagcugagacuuaggugugcacucucccuguucuuaauggccgugaacauuaagaccccuguagucguggagaauaucacgcugaugugcuugcgcauucuccagaagcugaucaaaccgccagcucccacaagcaagaaaaacaaggacgugccuguugaagcccuuaccacugucaaacccuacuguaaugagauacacgcacaagcccagcuguggcuaaagagagauccaaaggcuucauacgacgcguggaagaagugccucccuauccggggcauugaugguaacgggaaagcccccucgaagucugaacugaggcacuuguaucugacagagaaauacguguggcguuggaagcaguuccuuagccgacgcggaaaaagaaccuccccauuagaccugaagcucggccauaauaacuggcugcggcagguacuauuuacuccugcaacccaagcugccaggcaggcagccugcacaaucguggaggcuuuggcgacgauuccgagucgcaagcagcagguccuggaccuccuuaccucauaucuggaugagcucucuaucgccggugagugugcagcugaauaccuggccuuauaucaaaaauugauuacuagcgcccacuggaagguguaccuggcugcaagaggcguucuucccuauguggggaaccugauaacaaaagagaucgcccggcuccuggcucuagaagaggcgacccuuuccacugaccugcagcagggauacgcccucaagaguuugacaggccuguuaagcucuuucgucgagguggaauccauuaaaaggcauuuuaagucacgacugguugggaccgugcucaauggauaccuuugccugcguaaguugguaguccagagaacgaaacugaucgaugagacacaagacaugcuccuagaaaugcuggaggauaugaccacuggcaccgaaagcgagacaaaggcauucauggccguguguaucgagacugcuaaacgcuauaaccuugacgauuaccggaccccaguuuuuauuuucgaaaggcugugcucgauaaucuauccugaggaaaaugaggugacagaauuuuucgucacgcucgagaaggacccccagcaggaggacuuuuugcaggguagaaugccagggaacccuuacuccucuaaugaacccggaauuggcccgcugaugcgcgacaucaaaaacaagauuugucaagauugcgacuuaguggcacugcucgaggaugacaguggcauggaacuucugguaaauaacaagaucauaucauuggaccugccaguggccgaggucuauaaaaagguuugguguacuaccaaugaaggggagccuaugcggaucguguacaggaugcgaggacuccuaggugaugcuacagaggaguucauugagagccuggacuccaccacugaugaagaggaggacgaagaggaaguguauaaaauggccggcgucauggcacagugcgggggauuagaguguaugcugaacagacucgcgggcauccgggauuuuaagcaggguaggcaccuuuugacagugcugcugaaacucuucucuuacugcguuaagguaaaagugaaucgccaacagcuugucaagcuggaaaugaacaccuugaaugugaugcuggggacgcucaaccuagcccugguugcugagcaggagagcaaggacaguggaggcgccgcaguggcugaacaggucuuaucaauuauggagaucauacuugaugaauccaaugccgagccccugagcgaagacaaaggcaaccucuugcugacuggggauaaggaccaacuggugaugcuccuugaucagauuaacucuaccuuuguacguuccaauccaagugugcugcagggauugcuaagaaucauucccuaccugagcuucggugaggucgagaaaaugcagauccucguugaacgauucaagccuuauuguaacuuugacaaauacgacgaggaucauucaggcgacgauaagguguucuuagacugcuuuugcaagauagcggccgggaucaaaaauaacucuaauggacaccaacugaaggaucuuauucugcagaaaggcaucacacagaacgcucucgacuauaugaagaaacacauucccuccgcaaagaauuuggaugccgacaucuggaagaaauuccugagcaggccagcucugccuuuuauacuccggcuacugcgcggucuugcaauucagcauccggggacccaagucuugaucggaacugauucgauccccaaccugcacaagcucgaacaggugaguucugacgagggcauuggcacauuagccgaaaaucugcuugaggcccugagagagcauccagauguuaacaaaaagaucgacgcugcaaggcgggaaacccgcgccgagaaaaagagaauggcgauggcuaugcgacagaaggcccucgggacauugggaaugacuaccaaugaaaaaggucaagugguaacgaagacagcacugcuaaaacagauggaggagcugauagaagaaccuggccucaccuguugcauuuguagggaaggguacaaguuccagcccacuaaaguguuaggaaucuauaccuuuacaaagcgggucgcccuggaggaaauggagaacaaaccacguaagcagcaaggcuacucaacugugucccacuucaauauuguucauuaugauugccaccuugcugccguccgccuggcaagagguagggaggaaugggagagcgcugccuugcagaacgcgaauacgaaguguaacgggcuccugccuguguggggaccccacgugccggaaucugcauuugcaaccugccuugcucggcauaacacauaccugcaggaguguaccggccagagagaaccuacuuaccaacucaauauccacgacauaaaauugcuguucuuacgcuuugccauggagcagagcuucuccgcugacacaggcgggggaggucgagagaguaacauccaucugauuccauauaucauucacaccguacucuacguccuaaauacuacaagggcaaccucacgggaagagaagaaccugcagggcuuccuugaacagcccaaagagaaguggguggaaagcgccuuugagguugaugggccuuauuacuucacgguguuggcgcugcacauccucccacccgagcaauggagagccacucgugucgaaauucugcgcaggcuucuggugaccucccaggcucgggcaguugccccuggaggcgcuacaagacucaccgacaaagccgugaaggauuauucugcauaccgaaguucauugcuguuuugggccuuagucgaccuaaucuacaauauguucaagaaagugccaacuagcaacacagagggugggugguccugcucucuggcugaauauauaaggcauaaugauaugcccaucuacgaggcggccgacaaggcacucaaaaccuuucaggaggaguucaugccgguagagacguuuucggaguuccuggauguggcuggacuuuugagcgagauuacagacccugaauccuuucugaaggaucuccugaacaguguucccuga

SEQ ID NO: 64497 - RNA, 8397 nt, Artificial Sequence
  derived and/or modified sequence opt3 from UBR5__Homo_sapiens__NP_001269802
augaccagcauccacuucgugguccauccccugccuggcaccgaggaccagcucaacgauagacuuagggaaguuuccgagaagcugaauaaauacaaccuaaauucucacccaccguuaaacgugcuggaacaagcaacuauuaagcagugcguaguggggcccaaucaugcugcauuuuugcucgaggacggacgggucugucgcaucgguuucucagugcagccugaucgacuggaacuuggcaaaccagacaacaaugaugggagcaagcugaacagcaauuccggagccggccguacgucuagacccgguaggaccucggacucaccuugguuuuugagcgggagugagacacucggacggcuggcgggcaacacucugggcucccgcuggucuagcgggguuggagguuccggcgggggaucaaguggcagaagcucugcuggugcaagggauucccggcgccagacccgagugaucagaacagggagggaccggggaucaggccucuuaggcagccaaccacagcccgucauuccugcaagugugaucccagaggaacugauuucucaggcccagguaguucuucaagggaaaucccguagcgugaucauacgcgaguugcagagaaccaaucuggaugucaaccuggcugugaauaaccuccugucgagggacgaugaagacggagaugacggugacgauacugcaucugaguccuaucuuccgggcgaggaccugaugucauugcucgaugccgacauccacagugcucaucccagcgugauuaucgaugccgacgcgauguucuccgaagauauuucuuacuuuggguauccuagcuuccggcgaucaagucugucccgcuuaggaagcucuagaguccugcuccuuccacuggagagggacucagaauugcuacgggagcgcgaaaguguucugagacucagggagcgucgguggcuggauggcgccagcuuugacaaugagcgagguuccacaucuaaggaaggggagcccaaccuugauaagaaaaacaccccugugcagucgccaguaagccugggcgaagacuugcagugguggcccgacaaggauggaacgaaauucaucugcauaggcgcccucuacuccgagcuguuagcugugucaaguaagggggaacuguaucaauggaaauggucugagagcgagccguacagaaaugcccagaacccuucccuacaccaccccagggcaacuuuucucggacugaccaaugaaaagauuguccuuuugucagcuaacagcauccgcgccacaguggcgacugagaauaacaagguugccaccuggguggacgaaacacugucuuccgucgcaaguaaacucgagcauaccgcucagacguauagcgaacugcaaggugagcggauugugucucuucacuguugcgcccuguacacuugugcucaguuggaaaauucccucuacugguggggcguaguuccauucucacagagaaagaaaaugcuggaaaaggccagggccaagaacaagaaaccuaagaguagcgccgggaucucguccaugcccaauaucacagugggaacccaggucugcuuacgcaacaauccacuguaucaugcuggcgcgguggcauuuucuauuagcgccgguauacccaaggucggggugcuaauggagucaguuuggaacaugaaugauaguugucgauuccaacuccgguccccugaaucucugaaaaacauggagaaggcuagcaaaacuacagaggccaagccagaauccaaacaggagccggugaagaccgaaaugggacccccuccaucacccgcaagcacgugcagugacgccucuuccaucgcuagcucggccucaaugccuuacaagcguagaaggucuaccccagcacccaaagaggaagagaagguaaaugaggaacaguggagucuucgcgaggucguguuuguugaagaugugaaaaacgucccggugggaaagguauugaaaguggacggcgcguauguugcugucaaguucccugggacauccagcaacacuaauugucagaacucuagcggaccagaugccgaccccuccucacugcuccaagauugccggcuguuaagaauugacgagcuacagguggugaagaccgguggcacaccuaaaguccccgauuguuuccagaggacuccaaagaaacuuugcaucccugaaaagaccgagauauuggcaguuaauguggacaguaaaggggugcacgccguacucaagacaggaaacuggguccgauacugcauuuuugaucuggcuaccggcaaggccgagcaggaaaauaacuuccccacuagcucuaucgcauuucuaggucaaaaugagcgcaacguggcuaucuucacggccgggcaggaauccccaauuauccugcgggacggcaauggaacaauuuauccgauggcgaaagacuguaugggcgggauaagagauccugacuggcucgaucugcccccaaucucaagucuuggaaugggcguucacagcuugauuaaccugcccgccaauuccaccaucaagaaaaaggcugcagugaucauuauggccgucgagaaacagacuuuaaugcagcauauacucaggugcgacuacgaggcuugucgucaauaucugaugaaccuugagcaggccgugguucuggagcagaauuugcaaaugcuccagaccuuuaucucucaccgcugcgaugguaaccggaauauucugcaugcaugugugucgguaugcuucccuacaagcaacaaggaaaccaaagaggaagaggaggcggaaagaucagagaggaacacuuuugccgaacgacuauccgcugucgaggccaucgcaaaugcuauuaguguggugucuagcaacgggccaggaaaucgggccggcuccucaucuagccgcagucugagacucagggaaaugaugcggcgaucccugagagcagccggucuuggccgccacgaggcuggggcgaguucuucagaccaucaggaucccgucuccccuccgaucgccccacccaguuggguuccugacccacccgcaauggauccugacggagauauagacuucaucuuggcuccggccgugggcagccugacaacggccgcuaccgggacuggacagggccccucgacaucuaccauuccagguccuuccacagagcccagcguaguggaaucaaaggauaggaaggcaaacgcccacuuuaucuuaaaacuccugugugacagugucgugcuucaaccauaccugcgugagcuacucucugcgaaggacgcucgggggaugacuccuuucauguccgccguuagcggcagggcauaccccgccgcuauuaccauccuggaaacggcacagaaaauagccaaggcggagauuucaaguagcgaaaaagaggaggauguguuuaugggcauggucugcccauccgguaccaauccggacgauucuccuuuguaugugcuguguugcaacgacacauguagcuucacuuggaccggcgcugaacacaucaaucaggauauuuuugagugcaggacaugcggguuacucgaaucccuguguugcuguacugagugcgcccgcguuugucauaagggacacgacugcaaacuuaaacgaaccucacccacggcauacugugauugcugggaaaaguguaaaugcaagacacugaucgccggccagaaaucugcuagauuggaccuccuguaucggcuacugaccgccacuaaccuugugacacucccaaauaguagaggggaacaucuguugcuguucuuaguccaaaccguagcacgccagacuguggagcacugucaguaccgucccccuagaauacgggaagauaggaaccgcaagaccgcuucgccagaggacagcgauaugcccgaccacgaccucgaaccuccgcgauucgcccagcuggcgcuugagagaguucugcaagauuggaaugccuugaaguccaugaucauguuuggaucucaggagaacaaagacccacucucagcaagcucccggauuggccaucugcuacccgaggaacagguguaucugaaucaacagagugguacaaucaggcuugauugcuucacgcacugccucauugucaaguguaccgcugacauccuguuguuagauacucugcucgggacacuggugaaagaacuucagaacaaguacaccccuggacgcagagaggaagccauagcuguaacaaugagguuucugcggucuguggcacgugucuucguuauuuugagcguggagauggccucauccaaaaagaagaauaacuuuaucccccagccaaucggcaaaugcaagcgcguguuccaagcccuacugccuuaugcugucgaggaacucuguaacguggcggagagucugauuguucccguacgaauggguaucgcaagaccaacugccccuuuuacccuugcuagcacgucuauugacgccaugcagggcuccgaagaguuauucucaguggaaccgcugcccccaaggccuagcucggaucagucuaguuccagcucacagucccaaucuagcuacauaauccggaauccccagcagcgcagaauuagucagucccaaccagucagggggcgggacgaggagcaggaugacaucgugagcgcagauguugaagagguggaagucguggagggaguagccggcgaagaggaccaucacgaugagcaggaggagcauggggaagagaacgcugaggcggaaggacagcacgacgagcacgacgaagauggcucugacauggagcucgauuugcuggccgcagcugaaacagagucagacagugaguccaaucauagcaaccaagauaaugccucuggucgaagaucggucgugaccgcagccacugcugggucagaagccggagcgagcuccguuccugcauuuuucagugaggacgauucucagagcaacgacuccucagauagugacucuagcuccucacagagcgaugacauugaacaagagaccuuuaugcucgaugaaccccuggagcgcacaacuaauucuucccacgccaacggcgcugcccaggcuccgaggaguaugcagugggcagugcggaauacccagcaucaacgugccgcuagcacagccccaucguccacgucuaccccugcagcgucaagcgccggccuuaucuacauagaccccaguaaccugagaagguccgggacuaucucuacaagcgcugccgcagcugccgcagccuuggaggcuucaaaugcguccaguuaucuaaccagcgccucuucacuggcacgcgcuuacuccauugucauccggcagauuagcgaccucaugggauuaaucccaaaauauaaccaccugguguacucucagauacccgccgccguuaaacuuacuuaucaggaugcagugaaucugcaaaacuacgucgaagagaagcucauuccuacauggaauuggauggugaguaucauggacucgaccgaagcucaguugcgauaugguuccgcccuggcgagcgcuggcgauccggggcaucccaaccacccacuccacgccucacaaaauucugcaagaagggagcgcaugacggcccgggaagaggcuagccugagaacucuugagggacguaggcgggcaacccuacuguccgcccgccagggcaugaugagugcgcgaggugacuucuugaacuacgcuuuaucacugaugagaucucauaacgaugaacacagcgacguacucccugugcuggauguuugcucccuuaagcaugucgccuacguguuucaagcacugaucuauuggauuaaagccaugaaucagcagacaacccucgacacuccccaauuggagaggaagcggacacgcgaacugcuagagcuggggauagauaacgaggacagugaacacgagaaugaugacgacaccaaccagagcgcuacacucaaugauaaggacgaugacucccuuccugccgaaacuggacagaaccacccauucuucagaaggucugauucaaugaccuuucugggcuguauacccccuaauccauucgaggugcccuuagcagaagcuauuccguuggccgaccagccucaucugcuccaaccaaacgcgcgaaaagaggaucuguuuggccggcccagccaggggcuuuacucguccagugccucuagcggaaagugccugauggaggucacgguagaccguaauugucucgaaguguugccuacaaaaaugucauaugcagcuaaccugaagaauguuaugaacaugcagaauagacagaaaaaggagggugaggagcagccaguguuacccgaagagaccgaguccucuaagccgggcccuagugcccacgaucuagcagcucagcugaaaagcucccuccuugccgaaaucgggcugacugagucagaaggacccccauugaccagcuuccgcccucagugcucuuuuaugggcauggucauuagucaugacaugcugcucgguagguggcggcugucccuugaacucuucgggagaguguuuauggaagauguuggagccgagcccggcagcauccugacagaguugggcggguucgaagugaaggagucaaaauuucgcagggaaauggagaagcugcgaaaccagcaaucucgggacuuaucccuagaggucgauagagacagggaccugcucauacagcagacuaugcgccagcuuaauaaccacuucggacgucggugugcgaccacgccaauggcugugcauagaguaaaagugacauuuaaggaugaacccggugagggcucggggguugcaaggagcuucuacaccgccaucgcucaagccuuccugaguaacgaaaaguugccuaaucuggagugcauucagaacgcaaauaaaggaacucacacaucucucaugcagcgccugcgaaaccggggcgaaagagacagggagcgcgagagagaacgggagaugaggcguuccagcggucuucgagccgggucacgcagagaucgggacagggauuuucgcagacaauuaaguaucgacacccggccauucaggccggcuuccgaaggaaaucccagcgaugacccugagccacugcccgcgcaccgacaggcccucggcgaacguuuguauccuagaguccaggcaaugcagccagcuuuugccucuaagauuacuggcaugcugcuagagcugucacccgcacaacuccuucuguugcuggccagcgaggauucccuccgcgcucggguggacgaagccauggagcugaucauagcgcaugggagggaaaacggagcagauucuauuuuagaccuuggucugguggacaguucggagaaaguccaggaaaauagaaagcgccacggcagcucccggucaguuguggauauggaccucgaugacacagaugacggggaugacaacgccccucuauucuaccagccgggaaaaaggggcuuuuauaccccacgacccgguaagaauacggaggcuagacugaacuguuuccggaauaucgggaggaucuugggacugugccuccuucagaacgagcugugcccuauuacuuugaaucgccauguaaucaaggugcugcucggccguaaagucaacuggcacgauuuugccuucuuugaccccgugauguacgaaucuuuaagacaacugauacuugcaagccagaguuccgaugcugacgccguuuucucagcuauggaucuggccuuugcaauugaccuauguaaggaggaaggcgggggacagguggagcucaucccaaauggugucaacauuccuguaacaccccagaacguguacgaguauguucgaaaauacgcggaacacaggaugcugguggucgccgagcaaccauugcaugcuaugcggaagggccugcucgacgugcuuccgaaaaauucucuggaagauuuaacagccgaggacuuccgccuguuggucaacgggugcggagaagugaauguucagaugcucaucagcuuuaccuccuucaacgaugagaguggcgagaaugcagaaaagcugcuacaguucaagagaugguuuuggagcauaguggagaaaaugucuaugacagaaaggcaagaccuuguauauuucuggacuucauccccuagccugcccgcuagugaggaagguuuucagccaaugcccucuauuaccauccggccuccagaugaccagcaccuccccacggccaacacauguaucucccgccuguacgugccuuuguauucgagcaagcagauucugaaacaaaagcuccuucuggcaaucaaaacuaagaauuucggguuugucuga

SEQ ID NO: 64498 - RNA, 1278 nt, Artificial Sequence
  derived and/or modified sequence opt3 from UBR7__Homo_sapiens__NP_786924
auggccggcgcugagggggcagccggaagacagagcgaacuggagcccguggucucccucguugacgugcuugaagaggaugaggaacuggagaacgaagcgugcgcuguauuggguggcucugacucagagaaguguaguuacagccaaggguccgugaaaaggcaggccuuauaugcaugcucuaccuguacaccugaaggagaggagccagccggcaucugccuggcuuguucguacgaaugccacgguucacauaagcuauucgagcucuauacuaaacggaauuuucgcugugauugcgggaacagcaaguucaaaaaucuggaauguaaacuucugccggacaaggcaaaggucaacaguggaaauaaguacaacgauaacuuuuucggcuuguauugcauuuguaaacgacccuacccugacccagaggaugaaauacccgacgagaugauccagugcgugguuugcgaggauugguuucacggccgucaucucggggccauuccuccagaauccggagacuuccaggagauggugugucaggcuugcaugaagagauguucuuuucugugggccuaugcggcacaacuggccgucacgaaaaucagcaccgaagaugacggucucgugaggaauauugauggcaucggggaccaggagguaauaaagcccgaaaauggagagcaccaggacuccacauuaaaggaggauguuccugaacaaggcaaagacgaugugcgggaggucaagguggaacagaacucagagccaugcgcugguaguagcucugaauccgaccugcagacuguguucaaaaaugagucacuuaacgccgagagcaagaguggguguaaauugcaggaacugaaggcaaaacaacuaaucaagaaggauaccgcuacauacuggccgcucaauuggcgcucuaaacugugcaccugucaggacugcaugaagauguacggagaucuugacguccuguuuuugacugaugaguaugacacaguucucgccuacgaaaacaaaggcaagauugcgcaggccaccgauagauccgacccccugauggacacguuaagcucgaugaauagggugcaacagguagagcugaucugugaguauaacgaucucaaaacugaacuuaaggacuaccugaagcgguucgcagaugagggcaccguggucaaacgcgaagacauucagcaguuuuucgaggaauuucaaucuaagaaacgaagaaggguggaugggaugcaguauuacugcuccuga

SEQ ID NO: 64499 - RNA, 705 nt, Artificial Sequence
  derived and/or modified sequence opt3 from UBTD2__Homo_sapiens__NP_689490
augggcgggugcgugggagcccagcacgacagcuccgguucucugaacgaaaauucagaaggcaccggggucgcucucggaagaaaccaaccccuuaagaaagagaagccuaaauggaagagugauuacccaaugacagacggccagcugaggagcaaacgggaugaguucugggacacugcaccggccuuugagggucgcaaggaaaucugggaugcguugaaggcugccgcacaugccuucgaguccaaugaccacgaguuagcucaggcaauuauagauggggccaacaucacgcugccccauggagcucuaaccgaauguuaugacgagcucggcaaucgauaccagcugccuguuuauugccuugccccacccauuaacaugaucgaagagaaaucugauauugagacacuggacaucccugaaccacccccuaauucgggcuacgagugucaauugcgucucagacugucaacugggaaggaucugaaacucgugguaaggagcaccgacacaguguuucacaugaagcggcgcuuacaugcggcagaaggagucgagccagguagucagagaugguucuuuuccggcaggccgcugaccgauaaaaugaaguucgaggaacuuaagauacccaaagacuaugugguucaggugaucgucucucagccugugcaaaacccaacucccguagagaauuga

SEQ ID NO: 64500 - RNA, 2184 nt, Artificial Sequence
  derived and/or modified sequence opt3 from UBTF__Homo_sapiens__NP_001070151
augaacggcgaggccgacugccccaccgaucuggaaauggcugcaccuaaggggcaggacagauggagccaagaggauaugcucacacuucuggaauguaugaaaaauaacuugccauccaaugacucuucaaaguucaaaacuacggagagucacauggauugggaaaagguggccuuuaaagacuucagcggagauaugugcaaguuaaagugggucgagaucuccaacgagguuaggaaauuucggacccugacagaacuaauucucgacgcgcaggagcaugugaagaauccguacaaagguaagaaacugaagaagcaccccgauuucccuaaaaagccacuuacucccuauuuucgcuucuuuauggaaaaacgagcuaaguacgccaaacugcauccugagaugucuaacuuggaccucaccaagauacugucgaaaaaguauaaggagcugccagaaaagaagaaaaugaaguacauccaggauuuccagcgugagaaacaagaauuugagagaaaucucgcaagguuccgggaagaccaccccgauuuaauucagaacgccaagaagucagacaucccugagaaaccaaagacaccgcagcagcugugguauacccaugagaaaaagguauaccuuaaagugcgccccgacgaaauuaugagagauuauauccaaaagcacccugaguugaauauaagcgaagagggcaucacuaagaguacacugaccaaagcugaaaggcagcuaaaggacaaauuugaugggcggccaacgaagcccccuccaaacuccuacucucucuacugugcagagcugauggccaauaugaaagacguccccagcacugagcgcauggugcuuugcucccagcaguggaagcuguugucacaaaaggaaaaagaugcuuaucacaagaaaugugaccagaagaaaaaggauuacgagguugaacuccugcgauucuuagagagucugccggaagaggagcagcaaagagugcucggagaagagaaaaugcuuaacauuaauaagaagcaggccaccagcccugcgucuaaaaagcccgcacaggaaggcgguaaagggggauccgagaagccaaaaaggccugucucagccauguuuaucuucagcgaggaaaagcggcgucagcugcaagaggaacgccccgaguugagugaaucugagcuaacaagacugcucgcuaggauguggaacgaccuguccgagaagaaaaaggccaaauauaaggcacgggaagcugcccuuaaagcgcagagcgagcgaaagccaggcggcgaacgcgaggaaagagggaagcugcccgagucgccuaaaagggccgaggaaauuuggcagcagucugugaucggagauuacuuggcacgguucaagaaugaccgcguaaaagcucucaaggccauggagaugacuuggaacaacauggagaaaaaggaaaagcugauguggauuaaaaaggcugccgaagaucagaaaagauaugagagggaguuauccgaaaugcgugcaccaccggccgcuaccaauucaaguaagaaaaugaaguuucaaggugagcccaaaaagccuccaaugaacggcuaccagaaguucagccaggaacugcuauccaauggggagcucaaccaucugccccuuaaagagcggaugguugaaauaggaucucgauggcaaagaaucagccagucacagaaggagcacuauaaaaaguuggcggaggaacagcaaaaacaguacaaggugcaucuggaccucugggucaagagucuguccccucaggacagggcagccuacaaagaauauauuagcaauaagcgcaaaucuaugacaaaacuucggggcccaaaccccaaaucaaguagaaccacgcugcaaagcaaguccgagucugaggaagaugacgaggaagaugaggacgaugaagacgaggaugaggaagaggaagacgaugagaauggugacucgagcgaagaugggggagacuccucagagaguucuagcgaggaugaauccgaggacggcgacgaaaacgaggaggaugacgaagaugaggacgaugacgaagaugacgaugaggacgaagauaaugagucagagggcagcagcuccaguucuucuuccucaggggacaguagcgauucggacuccaacuga

SEQ ID NO: 64501 - RNA, 894 nt, Artificial Sequence
  derived and/or modified sequence opt3 from UBXN1__Homo_sapiens__NP_001273006
auggccgagcugaccgcucucgaaagccuuaucgagaugggcuuccccagagggagggcagaaaaggcccuggcguugacaggaaaccaggguauugaggcugccauggacugguuaauggaacacgaggaugacccugauguggacgagccacuggaaacuccgcuaggccauauacucgggcgggagcccacguccucugaacaaggaggccuggaggguucagggagugcagccggagagggcaaaccugcucuuagcgaagaggaacgccaggagcagaccaagcgaaugcuggaauuggucgcacagaaacaacgugagagagaggaaagggaggaacgggaggcccucgaacgcgagagacagaggcggcgccagggccaggagcuguccgcugcccgacaaagacugcaggaagaugagaugaggcgggcggcagaagaacgucgcagagaaaaggccgaggagcucgcugccaggcagcggguucgagagaaaaucgagcgcgacaaggcagaaagagcuaagaaauacgggggaucuguggguucgcagccacccccuguagccccagagcccggcccugugccaucaagcccgagucaagagcccccuacaaagagggaauaugaucagugccggauucagguccgcuuaccagacgggacuucccugacccaaacauuuagagcgagggagcagcuugccgcagugcguuuguacguugaacugcaccggggagaggaacuaggcggugggcaggaucccgugcagcuccugucuggauucccuagacgagcuuuuagcgaggccgacauggagaggccacuucaagaacugggcuugguccccuccgcugugcucaucguagccaaaaaguguccgucauga

SEQ ID NO: 64502 - RNA, 780 nt, Artificial Sequence
  derived and/or modified sequence opt3 from UBXN2A__Homo_sapiens__NP_859064
augaaggacguggauaaccugaaaagcaucaaggaggaaugggucugcgagaccggcuccgacaaucagccccucgggaacaaucaacagucuaacugugaauacuucguugauucacuuuuugaggaagcccagaaagugaguagcaagugcguauccccugcugagcagaaaaagcaaguggacgucaauauuaagcuguggaaaaacggauucacagugaaugaugacuuuagaucuuauucggauggugcaucacagcaguucuugaacagcauaaagaaaggcgaguuaccaagugaacugcaggggaucuuugacaaggaggaaguugaugugaaagucgaggacaagaagaaugagauuugucuauccacuaaaccgguguuccaacccuuuucuggacagggccacaggcucgguagcgccacgccuaagaucguauccaaagcgaagaacauugaaguugagaauaaaaacaaucugucagcugugccacuuaacaaucuggaacccaucaccaacauacagaucugguuggccaacgggaagcggauuguccagaaauucaauaucacacaucgcgugagucacauuaaggauuuuaucgagaaguaccaaggaagccagcgaucuccuccauucucccucgcaacugcccugcccgugcugcgucucuuagacgaaacccugacacuugaggaggcugauuugcagaacgcagucauaauucaaagacugcagaaaaccgccucauuuagggaacuaagcgagcauuga

SEQ ID NO: 64503 - RNA, 996 nt, Artificial Sequence
  derived and/or modified sequence opt3 from UBXN2B__Homo_sapiens__NP_001071087
auggccgagggcgggggacccgaaccuggugagcaggaaagaaggagcuccggcccacggccgcccucugcucgcgaccugcaacucgcacuugccgagcuguacgaagaugaggugaagugcaaaucaaguaagagcaaccgaccuaaagcgaccgucuucaaguccccacguacacccccucagagauuuuauucuucggagcacgaauacucaggguugaauaucguuaggccaagcacuggaaaaauugugaacgaguuauucaaggaagcucgggagcauggcgccguaccccugaaugaggcaacgcgcgccaguggugacgauaaguccaaaucuuuuaccgggggaggcuauagacuaggcagcuccuucuguaagaggucagaauacauauauggggagaaccagcuccaggacgugcaaauccugcuuaaacuguggaguaauggauuuagcuuggaugacggugaacuccggccuuacaacgagccaacaaaugcucaguuccuggaaucugucaagcgcggcgagauuccgcuggagcuccagcgauuagugcacgggggacagguuaaccuggauauggaagaccaucaagaucaggaguauaucaaacccagacuuagguuuaaggcauucuccggcgaaggucagaaguuggggucacugacuccugagauugugagcaccccaaguucucccgaagaggaggacaaauccauccuaaaugccgucgugcucauagaugacagcguaccuacaaccaagauccagauucggcuggcugauggaucgcgucuuauccaacgcuuuaacucuacucacaggauucuggacguuagaaauuucaucgugcagucccggccagaauuugccgcguuggacuucauacucgucacaucauuucccaacaaagagcugaccgaugaaaguuuaacgcugcucgaggcagacauucuuaauacugugcuguugcagcaacuaaaguga

SEQ ID NO: 64504 - RNA, 1527 nt, Artificial Sequence
  derived and/or modified sequence opt3 from UBXN4__Homo_sapiens__NP_055422
augcugugguuccagggcgccauccccgcugcaauugccaccgcgaagagaagcggggcuguguuugucguuuucguggccggagacgaugagcaauccacacagauggcagccucuugggaagacgauaaaguaacugaggcuucaaguaacagcuuuguggcaauaaagaucgacacgaaauccgaagccugccuccaguucucucagauuuacccugucguguguguuccaucgucauuuuucaucggugauagcggcauuccgcuugaggugaucgcugggagugucuccgccgacgaacuggugaccaggauacacaagguacggcaaaugcauuuguuaaaaucugagacaagcguugcgaauggaucccagucagagaguagcgugucuacucccuccgcaucauuugaaccuaacaauaccugcgagaacagccagagucgcaaugccgaacugugugagaucccacccacaucugauaccaaguccgacacugcuacaggcggugagagcgccgggcacgcaaccucgucucaggaaccuuccggaugcucagaucaacgaccagcugaggaccuaaacauucgugucgaaagacucacgaagaaacuggaggaaaggcgggaggagaagcgcaaagaagaggaacagagagagaucaagaaagaaauugagaggcggaagacuggcaaggagaugcuugauuauaaacgcaagcaggaagaggaacugaccaaacgaauguuggaggaaagaaauagggagaaggccgaggaccgggcggcccgugaacgcaucaaacagcaaauagcacucgauagagcugagagggccgcucgguucgccaagacaaaagaagagguggaggcagccaaggcugcggcacugcuggccaagcaggcugaaauggaggugaaacgagaaaguuacgcccgcgagagaagcacugucgcaaggauucaguuucggcuccccgacggcuccucuuucaccaaccaauuuccuagcgacgccccauuagaagaggcucgccaguucgccgcacagacaguugggaauaccuauggaaacuuuucacuggcgacgauguucccgagaagggaguucacuaaggaagauuacaaaaagaaacuuuuggaccuggagcuagcucccagugccuccgugguacuccugccugcaggucguccaacagccagcaucgugcauucuucaaguggcgauauuuggacccuucuggggacugucuuguaucccuuucucgcuaucuggcggcugaucagcaauuucuuauuuuccaacccuccacccacacagaccucugugcgaguuacgucgagcgaaccgccuaaucccgccuccucaaguaagucugagaagagagaaccagugaggaaacgcguccuggagaagcggggagacgauuucaaaaaggagggcaaaauuuacagacucaggacccaagacgauggugaagacgagaacaauacauggaacgggaacagcacucagcagauguga

SEQ ID NO: 64505 - RNA, 672 nt, Artificial Sequence
  derived and/or modified sequence opt3 from UCHL1__Homo_sapiens__NP_004172
augcagcugaagcccauggagaucaacccugaaaugcucaauaaagugcuuagcagacugggcgucgccgggcaauggagguucguugacguguugggauuagaggaagagucccuggguucuguaccagcuccggcaugcgcccuacuccugcuuuuuccccugaccgcgcagcacgaaaacuuccggaagaaacagauugaggaguugaagggccaggaagugucaccuaaagucuacuuuaugaagcaaacaauagggaauaguuguggaacuaucggccucauucaugcuguggccaacaaucaggauaagcuggguuucgaggacgggagcguucugaaacaguuucucuccgaaacggagaagaugucuccagaggaucgcgcaaaaugcuucgaaaagaacgaggccauccaggcugcacacgacgccguggcucaagaaggacagugucgagucgaugacaaagugaauuuucauuucauuuuauuuaacaauguagauggccaccuguaugagcuugacggccguaugcccuucccuguuaaccauggggccucgucagaagauaccuugcugaaggacgcggcaaaggugugcagagaguuuacagagagggaacagggagagguccgguucagcgccguggcucuauguaaagccgcauga

SEQ ID NO: 64506 - RNA, 693 nt, Artificial Sequence
  derived and/or modified sequence opt3 from UCHL3__Homo_sapiens__NP_005993
auggagggccagagauggcugccccucgaagccaacccugaggugaccaaucaauuccuuaagcagcugggguugcacccaaacuggcaguuugucgacguuuacggaauggauccggaauuacugagcauggugcccaggccuguaugcgcugugcuacuccuguucccaaucacagagaaauaugaagucuuucggacugaggaggaagagaagauuaaaucccagggucaagacgugacgucuucaguuuacuucaugaagcagaccauaaguaaugcauguggcacaaucgggcuuauucaugccaucgcgaacaauaaagauaagaugcacuuugaaagcggauccacucugaagaaauucuuggaggagucugugucgaugucacccgaggaacgcgcucgauaucucgaaaacuacgacgccauucgugucacccaugagacaagcgcacacgaaggccagaccgaggccccuaguaucgaugagaagguggaccugcauuuuauagcucugguacacguugauggucaccucuaugaauuagacgggagaaaaccauuccccaucaaucauggagagacuuccgaugaaacacugcuugaggacgcaauugaagugugcaagaaauuuauggagagggauccugacgaguugcgguucaacgccaucgcucugucugccgcguga

SEQ ID NO: 64507 - RNA, 987 nt, Artificial Sequence
  derived and/or modified sequence opt3 from UCHL5__Homo_sapiens__NP_001186190
augaccggcaacgccggggaguggugccugauggaaagcgaccccggaguguucacagagcucaucaaggguuuuggcuguagaggggcucaggucgaagagauuuggucccuugaaccugagaauuucgagaaacugaagccaguucacggauugauauuuuuauucaaauggcaaccgggcgaagaacccgcagguucugugguacaggauucaaggcuggacacuaucuuuuucgccaaacaggugauuaacaaugcgugcgcuacgcaggccaucgucagugugcuacucaacuguacccaucaagauguucaccugggggaaacacuuagcgaguuuaaggaguucucccagucuuuugacgcagccaugaagggacuggcuuugucaaauucggaugugauucggcagguccauaacagcuucgcacgccagcaaauguuugaguucgacacuaagaccagugccaaagaggaagaugcuuuucacuucguguccuacguaccuguuaauggccgacucuaugagcuggacggccugcgugaagggccaaucgaucucggagccugcaaccaggacgauuggauaucugcggugagacccgucaucgagaagaggauucagaaauacagcgagggugaaauccgguucaauuuaauggcaauuguguccgaccgcaagaugaucuaugagcagaaaauagccgaacugcaaagacagcuugcugaggaaccuauggauacagaccagggcaacucaauguugagugccauucaaagcgagguggcaaagaaucagaugcugaucgaggaagagguccagaagcuaaaaagguacaagauugaaaacauccggcgcaaacauaauuaucucccauuuaucauggagcugcuuaagacccuggcugaacaccagcaauugauuccccucguugagaaagccaaggagaaacagaacgcgaagaaggcccaggaaacuaaauga

SEQ ID NO: 64508 - RNA, 606 nt, Artificial Sequence
  derived and/or modified sequence opt3 from UCK1__Homo_sapiens__NP_001129426
auggccagcgcuggcggggaggacugcgaaucccccgcaccugaggccgauagaccacaccagaggccguuccugaucggagugucugguggcaccgcgucagggaagaguacagucugugagaaaauuauggaacuccuuggacaaaacgaaguugagcagcggcagcgcaaggugguaauacugagccaggaccgauuuuacaaaguguugacugcugagcaaaaggccaaagcauuaaagggccaguauaauuucgaucaucccgacgccuuugauaacgaccugaugcaccguacgcuaaagaauaucgucgaagguaaaaccguggagguuccuacauacgauuucgugacucauuccagacucccagaaaccacagucguguaucccgcugacguaguucuguuugaggggauucuuguguucuacucucaggagaucagggauauguuucaucugcgguuguucgucgacaccgauucggacgugcgccucucaagaagggauaaggaagugugccggugugaccacccugcacgcagcggacaguauggcugccaccaaccagaccgagccgcucaccccggccauagugagugguga

SEQ ID NO: 64509 - RNA, 786 nt, Artificial Sequence
  derived and/or modified sequence opt3 from UCK2__Homo_sapiens__NP_036606
auggccggcgacagcgagcagacccugcaaaaccaccagcagcccaaugggggagaaccuuuccucaucgguguguccggcgggacagcuucuggaaagucaagugucugcgcaaaaauuguucagcuucugggccaaaacgagguggauuacagacagaagcagguagugauauugagccaggacuccuuuuauagggucuuaacuucugaacaaaaagccaaggcgcugaaaggucaguucaauuuugaucauccagacgcuuucgauaacgagcuaauccucaagacgcugaaggaaauuaccgaggggaaaacagugcagaucccgguuuacgacuuugugucgcacucacggaaggaggaaacugucaccguguaucccgccgauguaguucuuuucgagggcauucuggcauuuuacagccaggaagugcgcgacuuguuccaaaugaaacucuuugucgauacagacgccgauacccgacugagucguagagugcugagggacaucuccgagcggggacgcgaucucgagcagauauuaucucaguauaucacuuucgugaagccugcuuuugaagaguucugucugccaaccaaaaaguacgcagacgucauuauccccagaggcgccgacaaucuuguugcuauuaacuugaucgugcaacauauacaggauauucugaaugggggaccuagcaagaggcagacaaacgguugccuaaauggcuauacgccaucccggaaacgccaggccucagaaaguagcucucgaccccacuga

SEQ ID NO: 64510 - RNA, 1602 nt, Artificial Sequence
  derived and/or modified sequence opt3 from UCKL1__Homo_sapiens__NP_001180308
augagcucucccccugccuacccaggcaucagaauuuccgggugcagggcucugggagcagaggguucaaguaacgccgaaagccucgaccggcuucugccgcccgugggcaccgggcgcuccccucgaaagcguacaacuucucaguguaaaucggagccacccuuguuaagaacgucaaagaggaccauauauacagcgggacggccuccaugguacaaugaacacggcacucaaagcaaagaggcuuucgccaucggucuagggggaggcagugcauccggcaagaccacagucgcccgcaugauuaucgaagcucuggauguucccugggugguacuccugucuauggacagcuuuuauaaagugcuuaccgagcagcagcaggagcaagcagcccauaacaauuucaacuuugaucacccugacgcuuucgauuuugaccugauuaucuccacuuugaagaagcucaaacaggggaagucagucaaagugccaauauacgauuucacaacccauaguagaaagaaagacuggaagacgcuguauggagccaauguuaucauuuuugaagguaucauggcguucgcagauaagacucugcucgaguuacuggacaugaaaauuuuuguggauaccgacagcgauaucaggcuuguccggcgcuugcgaagagacauaucugaaaggggccgggacauugagggggugaucaagcaguacaacaaauucguaaagccguccuuugaucaguauauucaacccacaaugcgucuggccgacaucguugugccucgcggaucaggcaauacugucgcuaucgaucuaauugugcagcacgugcauagccagcucgaggaaagagagcugagugucagggccgcacuugcuucugcccaccagugccacccacugccccggaccuuguccguucucaaaagcacaccucaagugcgagguaugcauaccauaauccgcgacaaggaaacgucgagagaugaguucaucuuuuacucuaaaaggcugaugcgguuacugauugaacacgcgcucuccuuccuuccauuccaggacuguguagugcagacuccccaagggcaggauuacgccggaaagugcuaugcaggcaagcagauaacaggcgucucaauucugcgcgcuggggagaccauggagccggccuugagagcuguguguaaagacguuaggaucggaacuauccuaauucagacaaaccaacugaccggugaaccugagcuccauuaccugcgucuucccaaggauaucagugacgaucacgugauucugauggacugcacggucagcaccggcgccgcagccaugauggcugugcggguauugcucgaccacgauguuccagaagacaaaauauuucuguuaucccugcuaauggcggagaugggggugcauucugucgcauaugccuucccucgagugagaaucauuacaacugcugucgauaagagggugaaugaccucuuucgcaucauccccggaauuggcaacuucggugaucgguacuuugggaccgacgccguuccagauggcagcgacgaagaggagguggcauauacaggauga

SEQ ID NO: 64511 - RNA, 417 nt, Artificial Sequence
  derived and/or modified sequence opt3 from UCMA__Homo_sapiens__NP_660357
augaccuggagacaggccgugcugcucagcugcuucuccgcugucguucuucugucuauguugagggagggcacaucagugaguguagggacuaugcaaauggcaggagaagaggccagcgaagacgcgaagcagaaaaucuuuaugcaggaguccgaugcuucuaacuucuuaaagcggcgcgguaaacgaucgcccaagucacgugacgaagugaaugucgagaacagacagaaacugaggguggaugagcuacggcgcgaauacuaugaggaacaaagaaaugaguuugagaacuucguugaggaacagaaugacgaacaggaggaaaggagccgggaggccguggagcaguggcgccaauggcacuacgauggccuccauccuaguuaucuguacaaccgacaccauacguga

SEQ ID NO: 64512 - RNA, 339 nt, Artificial Sequence
  derived and/or modified sequence opt3 from UCN2__Homo_sapiens__NP_149976
augaccagaugcgcccugcuccuucugaugguguugauguuaggcaggguccugguugugcccguaacaccuaucccaacuuuccagcuacggccgcaaaacagcccccagacgaccccucgcccagcugcauccgagucucccucagccgcgccuacauggccaugggcugcccagagucacuguagccccacucgacauccugggucccguauugugcucucucuggacgucccaauaggacuucugcagaucuugcucgaacaagcaagagccagggcugcacgggagcaggccaccacaaaugcucgcauucuggccagagugggucacugcuga

SEQ ID NO: 64513 - RNA, 486 nt, Artificial Sequence
  derived and/or modified sequence opt3 from UCN3__Homo_sapiens__NP_444277
augcugaugcccgugcacuuccuccuucuguuguuacugcuacucggcgggccuagaaccggacugccacauaaguuuuacaaagccaagccgaucuucagcugccuuaacacagcucuguccgaggcagaaaaaggucagugggaggacgccucuuugcucucaaagaggaguuuucacuaucugcggagccgcgaugcguccucuggcgaagaggaagaggggaaagagaagaagacuuuccccauuucgggagcucgaggcggugcccgugggacgagauacagguaugucucacaagcacagccucggggaaaaccacgccaggacaccgccaagagcccccauagaacaaaauuuacucugagucucgauguuccuaccaauauaaugaacuuacuguucaauaucgcuaaggccaaaaaccuuagggcacaggcugccgcgaaugcacacuugauggcccaaauuggccggaagaaguga

SEQ ID NO: 64514 - RNA, 375 nt, Artificial Sequence
  derived and/or modified sequence opt3 from UCN__Homo_sapiens__NP_003344
augagacaggccggcagggcugcacugcucgccgcgcuucuguuguuagugcaacugugccccgggagcucccagcggucuccugaggcugccggaguccaggacccaucacuacgcuggaguccgggugcacgaaaccagggcgggggagcccgugcucuccugcuucuguuggcagaaagauuccccaggcgggccggcccuggucgccucgggcugggaaccgcuggcgagagaccaaggcgggauaaucccagccuguccaucgaccucacauuucacuuacugcgcacucuuuuggaacuggcccgaacgcaaucucagagagagagggcggaacagaaccggauuauauucgauucgguuggcaaguga

SEQ ID NO: 64515 - RNA, 924 nt, Artificial Sequence
  derived and/or modified sequence opt3 from UCP1__Homo_sapiens__NP_068605
augggcgggcugaccgccagcgacgugcaccccacacucggaguccagcuuuucuccgcugguaucgcagccugccuggcggauguuauuacuuuuccuuuggacacggcuaaggugagauuacaaguacagggcgaguguccaaccucuucagugauaagguacaaagggguccugggaacaaucacugccgugguuaagaccgaaggccggaugaaacuauauaguggucucccggcagggcugcagcgccagauuagcuccgccucucuucgaaucggacuguacgauacagugcaagaguucuugaccgcuggcaaggaaacugcacccucgcucggcucaaaaauucuggccgggcugacaaccggaggugucgcuguguuuaucggccagccuacggagguaguuaaggugcgucuccaggcccagagccauuuacacgggauaaagccaagauauacuggaaccuacaacgcguauaggaucauugcaacaacugaaggccugaccggucuuuggaaagggacaacccccaauuugaugcggagugucaucauuaacugcacggagcuggugacuuacgaccuaaugaaggaggccuucgugaaaaauaacauccucgcugaugacgucccuugucaucugguuuccgcccuuauagcaggauuuugcgcuacagccaugucuagcccaguggauguagugaagacccgcuucauuaauucacccccuggccaauauaaauccgucccaaacugugcgaugaagguguuuacuaaugaaggcccgacagccuucuuuaaggggcugguucccaguuucuugagacucggaagcuggaacgugaucauguuugucugcuucgagcagcugaaaagggaauuaucuaagucccggcagaccauggacugugcaacguga

SEQ ID NO: 64516 - RNA, 930 nt, Artificial Sequence
  derived and/or modified sequence opt3 from UCP2__Homo_sapiens__NP_003346
auggugggcuucaaggccaccgacguucccccuacagcuacugucaaauuucugggggcaggaacggccgcgugcaucgcugaucucauuaccuucccacuugacacagccaaggugagacugcagauacaaggugagagccagggcccgguaagggcaacugccuccgcucaguaccgcggggugaugggaaccaucuugacaaugguccggaccgaaggcccccgaucuuuauauaacggucugguggcagggcuacagcgucaaaugucauuugccaguguuagaauuggacucuacgauagcgugaaacaguucuauacuaagggcuccgagcacgcuucuaucggcucgaggcugcuugccgggucaacaaccggagcgcuggcagucgccguggcucagccuacggacguaguuaaagugcgguuucaggcccaagcacgcgcugguggcgggagaagguaccagagcacugucaaugccuauaagaccauugcgcgggaagagggauuccgcggcuuguggaaggguacaaguccaaacguggcccgaaaugcaaucgugaacugugcugaacucgucacuuacgaucugauaaaagacgcccugcucaaggcuaauuuaaugaccgaugaccugcccugccauuuuacauccgccuucggggcaggauuuuguaccacgguuaucgccucuccuguggauguagugaaaacuagauauaugaacagcgcucuuggccaguacuccucagcgggccacugcgcauugacaaugcugcagaaggaggggccaagggccuucuacaaaggauuuaugcccaguuuccuacggcucgguagcuggaaugucgugauguuuguuaccuaugagcaacugaagcgugcucuuauggccgcauguacuucucgcgaagccccuuucuga

SEQ ID NO: 64517 - RNA, 939 nt, Artificial Sequence
  derived and/or modified sequence opt3 from UCP3__Homo_sapiens__NP_003347
auggugggccugaagcccagcgacgucccuccaaccauggccguuaaauuccucggggcuggaacagcagccugcuuugcggaucuugugacuuucccgcuggacacggcuaagguaagauugcagauccaaggugagaaccaggccgugcagaccgcaagguuaguccaguaccggggcgugcuggggacaauucuaacuaugguucgcaccgaaggacccuguuccccuuauaauggccucguggccggucugcaacgacagaugucuuuugcuucaauacguaucgggcuuuacgauagugucaaacagguguauacaccaaagggagcagacaacagcucccugaccacuagaauuuuggccggcugcacaaccggcgcuauggccguaacgugugcgcagcccacugauguugugaaagucagguuccaagcaucuauccaccucgggccuucgcggucagaccgcaaguacagcggaaccauggaugccuauagaacaauugcuagggaggaaggugugcggggccuguggaaggggacucugccaaauaucaugcgcaacgccauagugaauugcgcagaggucguuaccuacgacauccucaaagaaaaguuacuggauuaucaucuuuugacagacaacuuucccugucacuucgugagugcuuuuggagccggcuucugcgcgaccguaguggccuccccugucgaugugguuaaaacgcgauacaugaacucuccaccgggucaguacuuuagcccccuggacuguaugauuaagaugguggcacaggaggggccuacugcuuucuauaaaggauuuacaccauccuuccuaagacucggcucauggaaugucgugauguuuguaaccuacgagcagcugaagagggcccuuaugaagguucaaaugcugcgggaaagucccuucuga

SEQ ID NO: 64518 - RNA, 1416 nt, Artificial Sequence
  derived and/or modified sequence opt3 from UEVLD__Homo_sapiens__NP_001035787
auggaguucgacugcgaaggccugagaaggcuccuugggaaguacaaauuucgggaucugaccguggaggaauugcgcaacgucaauguuuucuuuccccacuucaaguauagcauggacacauacguguuuaaagauuccucucagaaggacuuacugaacuucacuggaacgaucccuguaauguaucaagguaauaccuacaacauuccaauacgauuuuggauccuagauucacauccguucgcucccccuauuuguuuucucaaaccaacagccaauaugggcauccugguggggaagcacgucgacgcacagggacguauuuaucuucccuaccugcagaacuggagucauccuaagagcgugaucguuggcuugauaaaagagaugaucgccaaguuccaggaggaacucccaauguauucccugucuucgucagaugaggcgagacaaguggaccugcucgcuuacauugccaaaaucacugaaggugucagcgauaccaauaguaaguccugggcaaaccacgagaauaaaacagugaacaagauuaccguaguugggggaggcgaauuaggcaucgccugcacucuggcuauaucugcaaaggggauugccgacaggcuuguguugcuggaucuaagcgagggaacaaaaggugcuaccauggaccucgagaucuuuaaucugcccaacgucgaaauuuccaaggaucuuucagccagugcgcauagcaaaguggugaucuucacggucaauucucugggcuccucacagagcuacuuggacguugugcagaguaacguagacauguuucgggcacucgugccugcccuggggcacuauucucagcacuccgucuuacugguggcuagccaaccaguugagaucaugacuuacgugaccuggaagcucucgacauucccggccaaucgcgucauuggaauaggcuguaaccuugauucucagagacugcaguauaucauuacuaacguguugaaagcacagaccuccgguaaggaaguauggguuaucggggagcaaggagaagacaaagugcuaacauggucaggccaggaggaggucgugagucauaccagccagguccaacuguccaauagggcuauggaacuccugcgggugaagggccagcgcucuuggagcguugggcuuucaguggccgauaugguagacaguauagucaacaauaagaaaaaggugcacuccguuagcgcgcuggccaaaggauacuaugauauuaacucugagguguucuugucacuccccugcauccuggguacgaauggcgucagugaagugaucaagacuacauuaaaagaggacaccguaacugaaaagcugcagagcuccgcaucuucgauucauagccuacagcaacagcucaagcuguga

SEQ ID NO: 64519 - RNA, 801 nt, Artificial Sequence
  derived and/or modified sequence opt3 from UFD1L__Homo_sapiens__NP_001030324
auguucagcuuuaacauguucgaccaccccaucccuagaguguuucagaauagguucuccacccaauaccggugcuuuucugucucaaugcuggccggcccaaacgaucgcagugacguugagaaagggggaaagauuauaaugccgcccagcgcucucgaucagcuuucccgacugaauaucacauauccuauguuguucaaguuaacuaacaaaaauucugaccguaugacgcauuguggugugcuggaauuuguagcagaugagggcauuugcuaccuaccacacuggaugaugcagaaccuccugcuugaagaagggggacuggugcaggucgagucggugaauuugcaaguugccaccuauucaaaguuccagccccagagcccugacuuucucgauaucacaaacccaaaagcggugcuggagaaugcucugagaaacuucgccugucucacuaccggcgacgucauugcaaucaauuacaacgagaagauauaugaauuaagggugauggagacaaagcccgauaaagccguaaguaucauugaaugcgacaugaauguugauuuugacgcuccucuggguuacaaggagccagagcgccaggugcaacaugaagaguccaccgaaggggaggcagaucacucuggauaugccggcgaacuuggcuuccgggcuuuuagcggguccggaaacagauuggacgguaaaaagaaaggcgucgagccgucacccaguccuaucaagccaggggacauuaagaggggaauccccaauuacgaguucaaacugggcuga

SEQ ID NO: 64520 - RNA, 2385 nt, Artificial Sequence
  derived and/or modified sequence opt3 from UFL1__Homo_sapiens__NP_056138
auggccgacgcuugggaggaaaucagaaggcuggcagccgauuuccagcgggcgcaauuugcugaggccacccagcgccucagcgaacgaaacugcauugagauagugaauaagcugaucgcacagaaacagcuggaagucguucacacauuggacggcaaggaguacauuacucccgcccaaaucuccaaagagaugcgugaugaauuacaugugagagggggaaggguaaacauuguggaccugcagcaggucaucaauguggaucuaauacacaucgagaaccggauuggugacaucauuaagucugaaaaacauguucagcucgugcugggccaacuuaucgaugagaauuaucuggaccgcuuggcugaggaagucaacgauaagcuccaggagucaggacaggugacgauaagugaacuguguaagaccuacgaccugccuggaaauuuccucacacaggcauuaacucaaagacugggcaggauuaucagcggucacauugaucuugacaaccgcgggguaaucuuuaccgaggccuucguugcucggcauaaagcccgaaucagaggauuguuuuccgcgauuacaaggccaaccgcagugaauagccugauaucgaaguauggcuuccaggaacagcuacucuacucaguccuggaggagcuugugaacagcggccggcugcgugggacuguggucggaggucgccaagauaaagccguuuuugugccggacaucuauaguagaacacaguccaccuggguagacucuuucuuuaggcagaauggcuacuuggaguucgaugcucucagccggcuggggauucccgacgccguguccuauaucaagaaacgauacaagacgacucaguuacuguuucucaaggcagcuugcgucggacaaggccuuguggaucagguugaagccucaguggaagaggcgauaaguagcgguaccugggucgacauugccccucuguugccaacaucucuauccguggaagaugcagcuauccugcuccagcagguaaugcgcgccuucucaaaacaagcuagcacuguuguguuuagugacaccgucguggucucugagaaguucaucaacgauuguacagagcuguucagagaacuuaugcaccagaaagccgagaaggaaaugaaaaauaaccccgugcaccugauuaccgaggaagacuugaagcagaucuccacgcucgagagcguuucgacuucuaaaaaggauaagaaagacgagaggcggcgcaaggcaacagaaggguccggaucaaugagaggcggcgggggagguaaugccagggaguacaaaauuaagaaagugaagaagaaaggccguaaggaugacgacagugaugacgaaagccaguccucucauaccgggaaaaagaaaccugagaucagcuuuauguuccaagaugagauagaagacuuucugcggaagcacauucaggaugcuccagaggaguucaucucagaauuagcggaauaucugaucaagccccuaaacaaaacuuaccucgagguaguccgaaguguguuuauguccagcacaaccucugcaucaggaacgggcagaaagaggaccauuaaagaccugcaggaggaaguuaguaaccuuuauaauaacauacgcuuguucgagaaggguaugaaauuuuucgccgaugacacacaggcugcccugacuaagcaucuccuuaagagcgugugcaccgauaucacaaaucuuauuuuuaacuuccuggcauccgacuugaugauggccgucgaugacccugcugccaucacuucugaaauucggaaaaagauccucucgaaacugagcgaggaaaccaagguggcauuaacaaaacugcacaauucccuaaacgagaagucaauagaggauuuuaucaguugucucgacucugcggcugaagccugcgacauuaugguaaaaagaggggauaagaagagggagcgccaaauccuguuccagcaccgacaggcacuugccgaacaauugaaagugaccgaggacccagcucugauucuccaucugacuagcguuuuacuguuucaguucuccacgcacucaaugcuucaugccccgggccggugugucccccagaucauagcauucuugaauagcaagauuccugaagaucagcacgcucuccuggugaaauaccaagggcuaguggucaagcagcugguuucucaguccaaaaagacaggccagggggacuauccacucaacaaugagcuggauaaggagcaagaagacguggccaguaccacucguaaagagcuucaggaauugucuucuuccaucaaggaucugguguuaaaaucaagaaagaguagcguaaccgaggaguga

SEQ ID NO: 64521 - RNA, 312 nt, Artificial Sequence
  derived and/or modified sequence opt3 from UFM1__Homo_sapiens__NP_001273633
augaucagagccuuccccaccacaacuccuaggagccugcaccucuuuacguccucuaccuuccuugcucgggcacugccaggcgccuuuccgacaggggcgugcgaggaacgcuugucagugcccgagaguacuccuuucaccgcugucuuaaaguuugccgcagaagaguucaaaguuccagccgcuacaagcgcaauuauaaccaacgacggaaucgguauuaaucccgcccagacugcuggcaacguguuucugaagcauggguccgaacuacgaaucauuccucgugauagaguaggaucuuguuga

SEQ ID NO: 64522 - RNA, 1185 nt, Artificial Sequence
  derived and/or modified sequence opt3 from UGCG__Homo_sapiens__NP_003349
auggcccugcucgaccuugcucuggagggcauggcaguguucggguuugucuuguucuuaguucuguggcuaaugcacuuuauggccaucauuuacaccagacuccaucugaacaagaaagcgacagauaagcagcccuauagcaaacuuccuggagugucccuguugaagccacucaaagguguagacccgaaucugauaaacaaucuggaaacuuucuuugagcucgauuaccccaaguaugaaguguuacugugcguccaagaccacgaugacccugcuaucgauguguguaagaaacuuuugggcaaguacccaaacguugacgccaggcuguucauugggggcaaaaaggugggaaucaaucccaaaauuaacaaucuaaugccugguuaugaggucgcaaaguacgaucucaucuggauaugcgacucugggauccgggugauuccagauacgcugaccgacaugguaaaccagaugacagaaaagguuggacuugugcauggccugcccuaugucgccgaucgccagggcuuugcugcaacuuuggaacagguguacuucgggaccucacacccucgauacuauaucagugccaaugugacaggauuuaaaugugucaccgguaugagcugccucaugcguaaggacguucuggaccaagcuggcggguuaauugccuucgcgcaguacaucgcagaggauuauuuuauggccaaagcuauagccgacagaggauggagguucgcaauguccacucagguggcuaugcagaacucuggcucguacucaauuagccaauuucagagucggaugauccgcuggacaaagcugagaauuaauaugcucccagccaccaucaucugugagccgauuuccgagugcuucguagcgucucuuauaaucgguugggccgcacaucacguguucaggugggauauuauggucuuuuucaugugucacugccuggcuugguuuaucuucgacuauauacaguugcgcggggugcagggaggcacgcuauguuuuagcaaacuggauuacgccguugcuugguucauucgggaauccaugacuaucuauaucuuucucucagcccugugggaccccaccauuaguuggcgaacaggcagauacaggcuucggugcgggggaacugcagaggagauccuggauguguga

SEQ ID NO: 64523 - RNA, 1284 nt, Artificial Sequence
  derived and/or modified sequence opt3 from UGDH__Homo_sapiens__NP_001171629
auguucgagaucaagaaaauuugcuguauaggcgccggguacgugggagguccuaccugcagcgucaucgcucacaugugucccgaaauuagaguuacagugguagacgugaacgaguccaggaucaaugcauggaacucuccaacucugccgauuuaugaacccggccucaaggaggucguggaaucaugccgggggaaaaauuuguuuuucaguacgaacaucgaugacgccauaaaggaggcggaucugguuuuuaucagcguguuguccaauccugaguucuuagcugaaggaaccgccauuaaagaccugaagaacccagaucgcguccuaaucggcggugacgagacacccgaagggcagcgagcagugcaagcccucugugcuguauacgagcauuggguuccucgugagaagauucugacuaccaauacauggucuucggaacuuucaaaacuggcagccaacgcuuuucuugcccagagaaucagcaguauaaauuccauuucugcgcucugcgaggcaaccggagccgauguggaagaggucgcuacugccaucggcauggaccagaggauuggcaacaaguuccugaaagcaagcgugggguuuggagguuccuguuuccagaaggaugugcugaaucucgucuauuuaugcgaagcucugaaccuuccagagguugcccgguacuggcaacaggugaucgacaugaaugauuaucagcgcagaagguuugcgucacggaucauugacaguuuguucaacacaguaaccgauaaaaagauagccauccugggcuuugcauucaagaaagacacgggggacacucgcgagucuagcuccauuuacaucucaaaguaucuaauggaugaaggagcucaccuccauauauacgaccccaaagugccucgagagcagauugucguggaucugagccacccaggcguuagugaagacgaucaagugucuagacuugucaccaucuccaaggacccguacgaggccugugauggugcucaugccgugguaaucugcacagaaugggacauguuuaaagagcuggauuaugagaggauucacaagaaaauguugaagcccgcauucaucuucgacgggcggcguguucucgauggacugcacaaugaauuacagacuauuggcuuucagauagagaccaucggcaagaaagugagcucgaagcgcauuccuuacgccccaucuggggaaauccccaaauucucccugcaggacccuccaaacaagaaacccaaggucuga

SEQ ID NO: 64524 - RNA, 4668 nt, Artificial Sequence
  derived and/or modified sequence opt3 from UGGT1__Homo_sapiens__NP_064505
augggcugcaagggggacgccagcggagcuugugcagccggugcgcugcccgugaccggcgucugcuacaaaauggggguucucgugguacuuacagugcugugguuguucuccucugucaaggcugauucaaaagccaucacuacgaguuuaaccacaaagugguuuagcacuccucugcuacucgaggcauccgaguuccuggccgaagacucucaggaaaaauuuuggaacuucguggaggcuucgcaaaauauuggaucaagcgaucacgacggcaccgauuauaguuacuaucaugcaauacuugaagccgcuuuucaguuccuguccccauugcagcagaaccucuuuaaguucugucugucucugagaagcuacuccgccacaauccaagcguuucagcagauugcagccgacgagccgcccccugaggguugcaauucauucuuuaguguucacgggaagaaaaccugugaaagcgauacucucgaggcuuuacugcuuacagccucugaaaggccaaagcccuugcuguucaaaggagaccaucgguauccuuccucaaacccagagagccccguggucaucuuuuacagugagauuggcucugaagaguucuccaauuuccaccgccagcuaaucagcaagucgaacgcaggcaaaauaaauuauguguuucgacauuacaucuucaacccucguaaggaaccaguauaccucucuggguauggaguugagcuggcuauuaaguccaccgaauacaaagccaaggaugacacgcaagugaaagguacugaggucaauaccacagugaucggcgagaacgauccgauugacgaagugcagggguuucuuuucggaaagcugagagauuugcaccccgaccucgagggccagcugaaagaauuaaggaagcaccuggucgagucaacuaaugaaauggcgccucucaaaguuuggcagcuucaagaccugaguuuucagaccgccgcacggaucuuggcuagcccaguggagcuagcccugguagugaugaaggaucucucccagaacuuccccacaaaggcucgcgccauaaccaaaacggcagucucuagcgagcugagaacugaaguggaggaaaaucaaaaguauuuuaaagguacacuugggcugcagccuggagacucagccuuguucauuaacggccuccauauggaucuggacacccaggauaucuuuaguuuauucgacguucugaggaaugaggcucgggugauggaaggccuacaccgccucgggauugagggacugucccuucauaacgucuugaagcugaacauccagccaagcgaggcggauuacgcaguggacauccgaucucccgccauuucauggguaaauaaccucgaaguugauaguagauauaauagcuggccguccucucugcaagagcuucugaggccuacuuuucccggugugauacggcagauccguaaaaacuugcacaauauggucuucauuguggacccagcucacgaaacaaccgccgagcucaugaacacggcagagauguuucugucgaaucauaucccuuuacgcauaggcuucauuuucgucgugaacgauagcgaagacguugacgggaugcaggaugccggaguggcuguacugagagccuacaauuaugucgcacaggagguggacgauuaccacgcguuucaaacccuaacacauaucuacaacaagguuaggacuggcgaaaaggugaaagucgagcacgugguauccgugcucgaaaagaaauaucccuacguugaggucaauucaauccuggguauugacagugcuuaugaucggaaccgaaaggaggcccgcggguacuaugaacagaccggcgugggaccacuucccguggucuuguucaauggcaugccuuuugagagagaacagcuggacccagaugagcucgaaacaaucacuaugcauaaaauucuggagaccacaaccuucuuucagagggcaguuuacuuaggggagcugccgcacgaccaagaugugguggaauauauaaugaaccagcccaauguagucccucggaucaacucucgcauucuuacugccgagagagacuacuuggaucucacggcuagcaacaauuucuuuguggacgauuacgccagguucacaauccuggacucccagggaaagaccgcagcuguugccaacucaaugaauuaucuaacuaagaaagguaugagcucuaaggaaaucuacgacgauuccuuuauucguccagugaccuucuggauagucggcgacuuugauagucccagcgggcggcagcugcucuaugacgcgaucaaacaccaaaagucuuccaacaaugugcgaauuucaaugaucaacaauccugccaaagagauuaguuacgaaaacacacagaucagcagagcuauaugggcagcccugcagacccaaacuucgaaugcugccaagaacuucaucacaaagauggcaaaagagggagcggccgaggcucuugccgcaggcgcugauauugccgaauuuuccguuggugggauggacuucucuuuguucaaggagguguuugaaagcucaaaaauggauuucauccugagucaugcaguauauugcagggacgucuuaaagcucaaaaagggccagcgcgccgugauuuccaauggacggaucauaggcccacuggaggauucugagcuuuuuaaccaggacgauuuccaccuguuggaaaauauuauccucaaaacgagcgggcagaagauuaagucccauauccaacagcugagaguggaggaagacgucgcuucagaucuaguuaugaaaguggacgcgcugcucagcgcccagcccaagggagacccgaggauagaguaccaguuuuucgaagaucgccacagugcaaucaaacugcgaccuaaggagggugagaccuauuuugacguaguggcugucguggauccaguuacucgggaagcccaacgucuugcccccuugcuguuagugcucgcucagcugauuaacaugaaucuuagagucuucaugaacugucagucuaaacuguccgacaugccucuaaagagcuuuuacagguacgugcucgagcccgaaaucucguucacaucagauaacucuuuugcaaagggcccaauugccaaauuccuggacaugccucagagucccuuguucacccugaauuuaaacacaccagaguccuggaugguugaaagcgugcgcacuccguaugaucucgacaauaucuaccuggaggaggucgauucuguaguggcggcugaauaugagcuugaauaccuguugcucgaggggcacugcuaugacauaaccacgggacaaccuccccggggccugcaguuuacccuagguacaagcgccaacccaguuauuguggauacuaucgucauggcaaaucugggguacuuccagcuuaaggccaaccccggcgcuuggauccucagacugaggaaaggacgauccgaagacauuuaucgcaucuacucacaugacggcaccgauaguccuccagacgcagaugaggugguaauuguguugaauaacuuuaagagcaaaauaaucaaggucaagguucagaaaaaggccgacauggugaaugaggaucuguuaucugacgggacauccgaaaacgagucaggauucugggauaguuuuaaauggggcuucacuggucaaaagaccgaagaggugaaacaggacaaggaugacauuaucaauauuuuuagcgucgcguccgggcaccucuacgagcgguuccugagaaucaugaugcuuucugugcugaagaacacgaaaacacccguuaaguuuugguucuugaaaaauuaucucucgccuaccuuuaaggaguucauaccguacauggcuaacgaauauaauuuucaguacgaacugguacaauauaaauggccaagguggcuacaucagcagacugagaagcagcguaucauuuggggauacaaaauccuguuccuugauguccucuucccccuggugguggacaaguuuuuguucguugaugccgaccaaauugugcgcacagacuuaaaggaacugcgggauuuuaaccucgacggcgcaccuuaugguuacaccccauucugugauagcagaagggagauggacggcuaccgauuuuggaaaucaggguauugggccucccaccuggcuggacggaaguaccauaucagugcccuuuaugucguggaucugaaaaaguuccgcaaaauagcagcuggcgacagauugagggggcaguaccagggacuaucucaggaucccaacagccuguccaaucucgaccaagaucugccuaacaauaugauucaccagguaccgaucaagucacuuccccaggagugguuauggugcgaaacuuggugugacgaugccucuaagaaacgggcgaagaccaucgaccugugcaacaauccaaugacaaaagagccuaagcucgaagccgcaguccgaauugugcccgaguggcaggauuaugaccaagaaauaaaacaguugcagaucagauuucaaaaggagaaggagacgggcgcucuguacaaagaaaagaccaaagagccaagccgcgaagguccucagaagagggaggaacucuga

SEQ ID NO: 64525 - RNA, 4551 nt, Artificial Sequence
  derived and/or modified sequence opt3 from UGGT2__Homo_sapiens__NP_064506
auggcccccgcuaaggcaaccaacguggucagacugcuccuuggcagcacagcccugugguugucccaguuagggucuggaacuguugcggcuucaaaaagugugacggcccaccuggcagccaaguggccugagaccccacuacuccuggaagcuagcgaguucauggcagaagaguccaaugaaaaauuuuggcaauuccuugagacaguacaggagcuggccaucuacaagcagacugaaucugacuauucguacuauaacuugauucucaaaaaggcuggucaguuucuggauaaucugcauauaaaccucuuaaaguucgccuuuucaaucagggcguacagcccggcaauucaaauguuccagcagaucgccgcugacgagcccccuccagauggcugcaaugccuuuguggucauucacaaaaagcauaccuguaaaaucaacgaaauaaagaaacugcuuaagaaggcagcuagucggacacgccccuauuuguucaaaggggaccacaaguuuccuaccaauaaagagaaccugccagugguuauccuauacgccgagaugggaacucgaacauucuccgcguuucauaaggugcucucugaaaaagcccagaaugaggaaauucuguauguccuucgucacuacauccaaaagcccagcuccagaaaaauguaccugucaggcuaugguguggaguuggcaauuaagaguaccgaauacaaggcucucgaugacacgcagguaaaaacuguuaccaacacaacuguggaggaugagaccgaaacaaaugagguccagggguuccuguuuggaaaguuaaaagaaaucuauagcgaccugagggauaaccucaccgccuuccagaaguaccuuauagagucuaauaaacaaaugaugccucugaaggugugggaauugcaggaccuauccuuccaggcugccucacaaauuaugagcgcaccaguguaugauaguaucaagcugaugaaagacauuucucagaacuuuccgaucaaggcccggucccucacgcgcaucgcugucaaucagcacaugagagaggagauuaaagaaaaccagaaggaucugcaaguuagguucaaaauacagcccggcgacgcgcggcuuuuuaucaacggccugcgcguggacauggauguauacgacgcauucagcauuuuggauaugcucaagcuggaggggaagaugaugaauggauuacgaaaccuggguaucaauggcgaagacaugucgaaauuucuaaagcucaacucucauauaugggaguauacuuacgugcuggauauuagacacuccucaaucauguggaucaaugaccuugaaaacgaugacuuguacauuacauggccuaccaguugccagaaacugcucaagccagucuuccccgggagcgugccuuccaucaggcggaauuuucauaaccugguucuuuucauugauccagcccaggaguauacucuggacuuuauaaaauuggcugauguguucuacucucacgaggucccccuccguaucggauuuguguucauucugaauacagacgacgaaguagauggcgccaacgacgccgguguugcauuauggcgcgcuuuuaauuauaucgccgaggaguucgauaucagcgaagcauucauuucaauagugcacauguaccaaaaggucaagaaagaccagaacauccugaccguggauaaugucaagagugugcuacagaacacguuuccgcaugcgaauauuugggacauccucgggauucacuccaaauaugaugaggaaagaaaggcuggagccagcuucuacaaaaugaccggccugggcccucuuccccaggcauuguauaacggggagccauuuaagcaugaagagaugaacaucaaagaacugaagauggccguucuccaaaggaugauggacgcuucuguguaccugcagcgggagguauucuuaggaacacugaaugaucgaacuaacgccauagacuuucuuauggaucgcaauaacgucgugccuagaaucaauaccuugauucucaggacaaaccagcaguaccugaaucuaaucucaacuuccguuaccgcagacguggaggauuucagcacauuuuucuuucuggacucccaagacaagucugcugucauugccaaaaacauguauuaccucacccaggaugacgaaucgaucauaagcgcggugacucuguggauuaucgccgauuucgacaagcccuccggucggaaacuuuuguuuaaugcucugaagcacaugaaaacgucaguacauagucgcuuaggcauuaucuauaacccaacaucuaagauaaaugaggaaaacaccgcaaucagcagagggauucucgccgcuuuccugacucagaagaauauguuucuuagguccuuccugggacaauuggccaaagaggaaaucgcaaccgcgauuuacucaggcgauaagaucaaaacauuccucauagaggguauggacaagaacgccuuugagaaaaaguauaauaccguggggguuaacauuuuccguacucaccagcuguuuugucaggauguccuaaagcugcggcccggcgaaaugggaaucgugagcaacggccgauuccucgggccucuggacgaggauuuuuacgcugaagacuucuaucuuuuggagaaaaucacauuuucuaaucugggagaaaagauuaaagguaucguggagaacaugggcauuaaugccaacaauauguccgauuucauaaugaaggucgacgcauuaaugaguagcguuccaaaaagagcuucuagguacgaugugacguuucuccgcgagaaccacuccgugaucaagaccaauccgcaggaaaacgacauguucuuuaauguaauugccaucgucgacccccugacucgggaggcacaaaagauggcccagcuucuggugguucuagggaaaauuaucaacaugaagauaaaacucuucaugaauugcagaggaaggcugucagaagcuccuuuggagaguuucuaccgcuuugugcuggagccagaauuaaugagcggcgcgaacgaugucucgucccucggucccguggccaaguuccuggacaucccugagucuccacuucugauuuugaauaugaucacacccgaaggguggcucguugagaccgugcauagcaacugugaucuggacaauauucaccuaaaagauacagaaaagacuguaaccgcagaguaugagcuggaauaccuucuccuggagggccagugcuuugacaaagucacggaacagccgccucgaggauugcaauucacccugggcacaaagaacaagccagcugugguggauacuaucgucauggcccaucacggguauuuucaguuaaaagccaaccccggagcuuggauacuccggcugcaccaggguaagucagaggacauuuaccagaucguuggccaugaagggaccgauagucaagcagaccuugaggauaucauugugguacugaauaguuucaaaucuaagauauugaaagugaaggucaagaaagagacagacaagaucaaagaagacauucucacugaugaggacgaaaagaccaaaggacugugggauagcaucaaguccuuuacggugucacuacacaaggagaacaaaaaggaaaaagacguucugaauauuuucagcguggccaguggccaucuuuaugagcguuuucucagaaucaugaugcugucugucuugaggaacacaaagaccccugugaaauucugguuacugaagaauuaccucucccccacuuuuaaggagguuauaccacacauggcgaaagaauaugguuuccgcuacgagcuggugcaguaccgguggccuagauggcuuaggcagcaaacagaacgacagcgcaucauuuggggguauaagauccuguuuuuggauguccuauucccccuggcuguagacaaaauuaucuucguggaugccgaccagauaguucggcaugaucucaaggagcugagagacuuugaucuugacggcgcaccauacggauauaccccguucugugauagcaggcgugagauggacggcuaccgcuuuuggaaaacuggguauugggccucgcacuuacugcggagaaaguaccacauuucagcucucuauguggucgacuugaagaaauucaggcgaaucggagcaggcgaucggcugcgcucucaguaccaagcccucagucaggacccuaacucccugagcaaucuugaucaggaccugcccaacaauaugaucuaccagguggcgauuaagucuuugccacaagauuggcuauggugcgaaaccuggugugacgaugagagcaaacagagagcuaagacaaucgaccugugcaacaaucccaaaacgaaggaauccaaacucaaggccgcagccaggauaguaccugaguggguggaauaugaugcugagauucggcaguuacuggaccaucuugagaacaagaaacaggauaccauccugacucacgacgaacucuga

SEQ ID NO: 64526 - RNA, 1527 nt, Artificial Sequence
  derived and/or modified sequence opt3 from UGP2__Homo_sapiens__NP_006750
augagcagauucgugcaggaccuguccaaggccaugucucaagauggcgcuucacaguuucaggaggucaucaggcaggaacucgagcuuaguguuaaaaaggaacuggagaaaauuuugaccacagcaagcucccacgaguucgagcauacuaagaaagacuuagauggguuucggaagcuguuccaccgcuuucuacaagagaagggacccucuguggacugggguaaaauacagcgaccuccagaagauucgauccagccguacgagaagauuaaagcccguggccuccccgacaacaucucaagcguacugaauaaacuuguggucgugaaacugaacgggggauugggcacgaguauggguugcaaggggccuaagucccucauuggaguuagaaaugaaaacaccuuccuggaucugacagugcagcaaaucgagcaucucaauaaaacuuauaacaccgacgucccauuagugcugaugaacucuuuuaauacagaugaggacaccaagaaaauacuucagaaguacaaucacuguaggguaaaaaucuauacuuucaaccagagccgguacccccgcauuaauaaggaauccuugcugccuguugcgaaagaugugucauauaguggcgagaacacagaggcuugguacccacccggccauggggacaucuaugccagcuuuuacaauucuggacuacucgauaccuucauuggugaaggcaaggaauacaucuuugucuccaacauagacaaucugggggcaacgguggaccuuuauauucugaaccacuugaugaacccuccaaauggaaagagaugcgaguucgugauggaggucacuaacaaaaccagggccgauguuaagggcgguacacucacucaguacgaagggaaacugcgguuaguggagaucgcucaaguaccgaaggcacacguggacgaauuuaaaucagucagcaaguucaagauuuucaauaccaacaaucuguggaucagucucgccgcugugaaacgccuucaggagcagaacgccaucgauauggaaauuauaguuaaugcgaagacacuggacggaggcuugaacgugauccaacuagagaccgcagucggcgccgcuauuaaaucuuuugaaaauucccuggggaucaacgugccccgaagcagauuccucccuguaaagacgacuucggaucugcuucugguuaugucuaauuuguauucccucaacgccggaucacugacaaugagugaaaagagggaguuuccaaccgugcccuuagucaagcuggguagcuccuucacuaaggugcaggacuaccuacggcguuuugaaucuauaccugauaugcucgagcuggaccaucuuacagucagcggcgaugugaccuucgggaaaaauguuucauugaagggaacggugauuaucaucgcaaaccacggcgaccgcauugauaucccacccggugcuguacuggaaaauaaaauugucagugggaaccucagaauacuggaccauuga

SEQ ID NO: 64527 - RNA, 1593 nt, Artificial Sequence
  derived and/or modified sequence opt3 from UGT1A10__Homo_sapiens__NP_061948
auggccagagcuggcuggaccagccccgugccucugugcgucugucuccuucugacaugcggguucgcagaggccggaaaguuguuaguugugccaauggacgguucccacugguuuacuaugcagucuguaguggaaaaacugauccuaaggggccaugaggucgugguugugaugccggaagucucauggcaacucgagcggagucugaacuguacggugaagaccuacagcacauccuauacucuugaagaucagaaucgcgaguucaugguauuugcgcacgcucaguggaaagcccaggcacaaucuauuuucucgcuguugaugucaagcaguuccggguuucucgaccuguucuuuucucauugccgaagccuguucaacgaucguaagcucguugaguacuuaaaagaauccucauuugacgccguguuccuggaucccuuugacaccuguggacuuauagucgcuaaguauuucaguuugccuagcgugguguuuacaagaggcaucuucugccaccaucuggaggaaggugcacaguguccagcuccccuaucuuacgucccuaaugaucuccugggguucuccgacgccaugaccuuuaaggagaggguuuggaaccacauugugcaccuugaggaucaucuguucugccaguauuuguuucggaaugcccucgaaaucgcgucagagauucugcagacuccaguaacagcauacgacuuauauagccacaccaguaucuggcugcuccgcacggauuucgugcuugacuaccccaaaccugucaugccaaacaugauauuuaucggaggcauuaauugucaucaaggcaagccgcugcccauggaguucgaagccuacaucaacgcuucuggggaacacggaauugugguuuuuaguuuggguagcauggugucggagaucccugagaaaaaggccauggcaauagcugaugcccuaggcaaaauuccacagacuguccuguggagauauaccgggacaaggcccucuaaucucgcgaacaauacuauccuggugaaguggcuuccucagaacgaccuguugggacacccaaugacccgggccuucauuacacaugcaggcucccacgguguauacgaaucaaucugcaaugggguucccauggugaugaugccgcucuuuggagaccagauggauaacgcuaagcgcauggagaccaaaggcgccggcgucacgcugaauguguuagaaaugacuuccgaggaccuggaaaacgcucuaaaggccgucaucaacgauaaaagcuauaaggagaauauuaugcgacucuccucucugcauaaagacagaccuguggagccccuugauuuggcaguuuucuggguggaauuuguaaugaggcacaagggggccccacaucugcggccugcugcgcacgaccucacaugguaccaauaucacagccuggaugucauaggauuccuucuggcagugguuuugaccguggccuuuaucacuuucaaauguugcgcuuacgguuaucguaagugccucggcaagaaagggcgcgucaagaaagcccauaagucaaaaacacacuga

SEQ ID NO: 64528 - RNA, 1602 nt, Artificial Sequence
  derived and/or modified sequence opt3 from UGT1A1__Homo_sapiens__NP_000454
auggccguagagagccagggcgggagaccccugguccucggacuucuguugugcguuuuagguccugugguaucccacgcuggcaagauccugcuaauuccaguggacgggucucauuggcucucaaugcugggagcaauacaacagcuucagcagaggggccacgaaaucgucgugcuggccccggaugcgaguuuguacauucgggacggugcuuucuauacccucaaaacauaccccguuccuuuucaacgcgaggaugugaaggagagcuucgucucccuggggcauaacguguuugaaaaugacucuuuccugcagcgaguaaucaaaacuuauaagaaaauuaagaaggauucggccaugcucuuaucaggauguagccacuuacuucauaacaaagaauugauggcaagucuggccgaguccucuuuugacguuaugcuaacggauccauuccuccccugcagcccuaucguggcucaguaccugucccuuccaaccgucuuuuuccugcacgcauugcccuguucacucgaguuugaagccacacagugcccuaauccauucaguuaugugccgcguccccugagcucucacuccgaccauaugacuuuucugcaaagagugaagaacaugcugauagcuuucucacagaauuuucucugugaugucguuuacagcccuuaugccacccuugcgagugaguuccugcagagggaagugacaguacaggacuugcuaucuuccgcaagcguguggcuguuccggucggauuuugucaaagacuacccacgccccaucaugccuaacaugguguucguuggcggcauuaauugccuccaccaaaacccacugucucaggaguuugaggccuacaucaaugcuuccggggaacauggaauuguggucuucucacuugguaguauggugagcgagauccccgaaaagaaagccauggcaauagcugaugcccugggcaagauuccgcagaccguauuguggagauauacugggacaaggccuuccaaccucgcgaauaacaccauccugguuaagugguuaccccaaaaugaccugcuaggacacccaaugacgcgggccuuuauuacucacgcaggcucucaugguguguacgagagcaucuguaacggggucccuauggugaugaugccccucuucggagaccagauggauaaugcuaaacgcauggaaaccaagggcgccggcgucacacugaacgugcuugagaugacuucagaggacuuggaaaacgcucugaaagccguuaucaaugauaagaguuauaaagagaacauuaugcgacucuccagccugcacaaggacagaccaguggaaccccuugaucuggcaguauuuugggucgaguucgugaugaggcauaaaggggccccucacuugcggccagcugcgcaugaccucaccugguaccaguaucacucucuggauguuauaggauuuuuacuggcagugguccuaacaguggccuucaucaccuuuaagugcugugcuuacgguuaucguaagugccucggcaaaaaggggcgcgugaaaaaggcccacaaaucaaagacgcauuga

SEQ ID NO: 64529 - RNA, 1605 nt, Artificial Sequence
  derived and/or modified sequence opt3 from UGT1A3__Homo_sapiens__NP_061966
auggccaccggccuccaggugccccugccuuggcuugcuacagggcuguuguuacugcuaagcguccaaccaugggcagaguccggaaagguucucgugguaccgaucgacgguucucacuggcugucaaugagagaagugcuuagggagcugcaugcccggggccaccaggcggucguguugacucccgaaguuaacaugcauauuaaagaggaaaauuucuuuacgcucaccacauacgcuauaaguuggacucaggaugaguucgaccgccacgugcuggggcauacccagcuguauuuugagacagaacacuuccucaagaaauuuuuccgaagcauggccauguuaaacaauaugucccuggucuaccaccguucuugcguggagcuuuugcauaacgaagcacugaucagacaccuaaaugccaccucguuugauguaguucucacugacccugugaaccugugugcugcaguccuugccaaguaucugucaauuccaacaguguucuuuuugaggaauauccccugcgaucucgacuucaaaggaacccaauguccuaacccaagcaguuacauuccccggcuguuaacgacuaauuccgaucauaugaccuuuaugcagcgcgugaagaacaugcuguauccucucgcucuuucuuacaucugccacgccuucagcgcgccauaugcaucccuggccucagaguuguuucagagagaggucaguguuguggacauacuaagccacgcuucuguauggcuguucaggggcgauuucgugauggacuacccgcggcccaucaugccuaauauggucuuuauuggugggaucaacugugccaaucgcaagccacucucccaggaguucgaagcauacauuaacgcuucaggagaacauggcaucgugguuuuuagccugggcaguauggugucugagauacccgagaaaaaggccauggcgauugccgaugcacuugggaaaaucccucaaacaguccuguggcgauauacuggaaccagaccauccaauuuggcuaacaacacaauucucgugaaguggcugccccagaaugacuuacugggucacccgaugaccagggccuucaucacgcaugcuggcagccacgggguauacgaaucgaucugcaacggaguuccuauggugaugaugccccuauuuggcgaucagauggacaaugccaaacggauggagacuaagggugcaggggucacacucaacgugcuggaaaugaccucugaggaccuugaaaaugccuugaaggcugucauuaacgauaaauccuauaaggagaauauaaugcgucugucaagucuccauaaagaccgcccaguggaaccucuggaucuugcgguuuucuggguggaguuuguaaugagacacaagggagcaccccaccugaggccagccgcucaugacuugacuugguaccaguaucacagccucgaugucaucggcuuccuguuagccgugguucugacaguggcauuuauuaccuucaaauguugcgccuacggcuaucggaagugucuagggaaaaagggacgagucaagaaagcucauaaguccaaaacgcacuga

SEQ ID NO: 64530 - RNA, 1605 nt, Artificial Sequence
  derived and/or modified sequence opt3 from UGT1A4__Homo_sapiens__NP_009051
auggccagaggcuuacaggugccccucccuaggcuugcuaccgggcuguuguuacugcuaagcguccaaccaugggcagaguccggaaagguucucgugguaccgacagacgguucucccuggcugucaaugcgggaagcccuucgcgagcugcacgcgcgaggccaucaggcuguggucuugacuccugaagugaacaugcacaucaaagaggaaaaguucuuuacgcucaccgccuacgcaguuccauggacacagaaagaguucgaucgugugacucugggguauacccagggauuuuucgagacagaacaucugcucaagagauacaguaggagcauggccauuaugaauaacgucuccuuagcucugcaccggugcuguguggagcuuuugcauaaugaagcacugauacgccaccuaaacgccaccucuuuugacguaguucucacugaucccgugaaucugugcggcgcuguccuugccaaauaucugucgaucccugcgguguucuuuuggagauacauuccaugugacuuggauuucaaggguacacaaugccccaacccuucaagcuauaucccaaagcuccugaccacgaauagugaccacaugacuuuucugcagagggugaaaaacaugcuguacccgcucgcacuuuccuauauuugucauaccuucucugcccccuacgcuagccuggccuccgaguuguuucagcgggaggucucaguuguggaucuaguaaguuacgcaagcguguggcuguuccgcggggacuuugucauggauuauccucgaccaaucaugcccaauaugguguucauaggaggcaucaacugcgcuaauggcaagccucucucucaggaguucgaagccuacauuaacgcguccggggaacacggaaucguuguguuuucacuggguagcauggucagugagauuccagagaaaaaggccauggcaaucgcugacgcccuuggcaaaauaccccaaacagugcuguggagauauacugggaccaggccgucuaauuuggcuaacaauacaauucucguaaaguggcugccucagaacgauuuacugggacaucccaugacccgggccuucaucacgcacgcaggcucccacgguguuuacgaaagcauuuguaacggggugccaauggucaugaugccucuauuuggagaccagauggauaaugccaagcguauggagacuaaaggcgcuggcgugacacucaacguccuggaaaugaccucggaggaccuugaaaaugcguugaaggcagugaucaacgacaaaucuuauaaggagaauaucaugcgccuguccucacuccauaaagauagacccguugaaccacuggaccuugccguguucuggguagaguuugucaugaggcacaagggggcuccccaucugcggccugccgcacacgauuugacuugguaccaguaucauagucucgacgugauuggauuccuguuagccguugugcugacagucgcuuuuauaaccuucaaaugcugugccuacgguuaccgaaagugccuaggcaagaaagggcgcgugaagaaagcacacaagagcaaaacgcacuga

SEQ ID NO: 64531 - RNA, 1605 nt, Artificial Sequence
  derived and/or modified sequence opt3 from UGT1A5__Homo_sapiens__NP_061951
auggccaccggccugcaagugccccucccucaacuugcuacagggcuguuguuacugcuaagcguccagccaugggcagaauccggaaagguucucgugguaccgacugacgguucucacuggcugucaaugagagaagcccuuagggaucugcaugcgcggggccaccagguggucguguugacgcucgagguuaacauguacaucaaagaagagaauuucuuuacccugacaacuuaugcuauuaguuggacccaggacgaguucgaucgccugcucuuagggcauacacagagcuuuuucgaaaccgagcaucugcuuaugaaguuuucccgacguauggccauaaugaacaauaugucuuugaucauucacagaucgugcguggaacugcuacacaacgaggcacucaucaggcaucugcacgccacuucauucgacgucgugcuuacagaucccuuucaccugugugcugcaguauuggccaaauaccucagcauuccugcuguuuucuuucugcggaauaucccaugcgacuuagauuucaagggaacccagugucccaacccuaguuccuauauaccacgccugcucacgacuaauucugaccauaugaccuuucuucagagagugaaaaacaugcuguaccccuuggcccuaagcuaucugugccacgcggucuccgcaccuuacgccucacucgcuagugaacuguuccagagggaggugagcguggucgaucuuguuucucacgccuccguguggcuguuucggggcgacuucguaauggauuauccacgcccgaucaugcccaauaugguguucauuggugggaucaacugugcaaauggaaagccuuugucacaagaguuugaggcuuacauuaacgccagcggcgaacauggcaucgucguguucagucucgggucuaugguuuccgaaauaccagagaagaaagcgauggccauugcagacgcucugggaaagaucccccagacaguguuauggcgauacacugguaccagaccuagcaaucuggccaacaauacaauucuagucaaauggcucccacagaacgaucugcuuggccaccccaugaccagggcuuuuaucacgcaugccgggucgcacggaguguaugaaucuaucugcaacggcguaccgaugguuaugaugccuuuguucggugaccagauggacaaugcaaagcggauggagacuaaaggggccggagugacacugaacguccucgagaugaccuccgaagaucuggagaaugcucuuaaggcggugauuaacgacaagucauacaaagaaaauauaaugcgucugaguagcuugcauaaggaucgccccgucgagccacucgaccuggcaguguuuuggguugaguucgugaugagacacaaaggcgccccucacuuaaggcccgcugcccaugaucugacuugguaucaauaccacucccuagacguaaucggcuuucuccuggcagucgugcuuacaguugccuucauuaccuuuaaguguugcgcuuauggguaccggaaauguuugggaaagaaaggucgagugaagaaggcccauaaaucuaagacgcacuga

SEQ ID NO: 64532 - RNA, 1599 nt, Artificial Sequence
  derived and/or modified sequence opt3 from UGT1A6__Homo_sapiens__NP_001063
auggccugccugcucagaucuuuccagaggaucuccgcuggcguguuuuuccuugcacugugggggauggucguuggagacaaguuguuagugguaccccaagaugguucucacuggcugucaaugaaagacauuguggagguccuaagugaucggggccaugaaauagugguuguggucccugaggugaaccuccugcuuaaggaaagcaaauacuauacccgcaagaucuacccaguaccguaugaccaggaggaacugaaaaaucgauaccaguccuuugggaacaaucacuucgccgagcguagcuuuuugacagcgccccagacugaguauagaaacaauaugauuguuaucggacucuacuucauuaacugucaaucgcugcugcaggauagggacacgcucaauuucuucaaggaaucaaaguuugaugcuuuauucaccgacccugcccugccaugcggcgugauccuugcagaguauuugggucugcccagcgucuaccuauuucggggguucccuuguagucucgaacauacauuuucccgcucuccagaucccgugagcuacauaccuagaugcuauacuaaauucuccgaccacaugaccuucucacagaggguggccaacuuucuggucaaucuucuggagccauacuuguucuauugucucuuuaguaaguacgaggaacuggcuagcgcaguuuuaaaacgggauguggacaucauuacacuguaucagaagguaucuguguggcuccuucgcuacgauuucguccuggaguauccgcgacccgugaugccuaacaugguuuuuaucggaggcauuaauugcaaaaagagaaaggacuugucccaagaauuugaggccuacaucaacgcuucaggcgaacaugggauaguggucuuuagccuaggaaguauggugucugagauuccagagaaaaaggccauggcgaucgcagacgcccuggguaaaauuccccagaccguacucuggagguacacuggcacacggccuuccaaucuggcuaacaauaccauccuuguuaaguggcugccacagaacgauuugcucgggcaccccaugacgcgugccuucaucacucacgcaggaagccauggcguguaugaaucgauuuguaacggugucccgauggugaugaugccucuguuuggggaccagauggauaaugcuaaacgcauggagaccaagggagccggcgucacauuaaacgugcuggaaaugacuucugaggaccuagaaaaugcgcucaaagccguuauaaacgauaaguccuacaaggagaauaucaugagacugucaagucuucacaaagacaggcccguggagccauuggaucuggcaguauucugggucgaauuugugaugcggcauaagggcgcuccucaccuccgacccgccgcucacgaccugaccugguaucaauaccauagccuugauguuauuggguuccuguuggccgugguccucacaguggcauuuaucaccuucaaaugcugugccuauggauaccgcaagugccuggguaaaaagggcagaguaaagaaagcucacaaguccaaaacgcauuga

SEQ ID NO: 64533 - RNA, 1593 nt, Artificial Sequence
  derived and/or modified sequence opt3 from UGT1A7__Homo_sapiens__NP_061950
auggccagagcuggcuggaccgggcugcucccccuuuacgugugccuguuguuaacauguggauucgcaaaggccgguaaacugcuagucguuccuauggacggcagccacugguuuacuaugcaguccgugguagagaagcucauccugagggggcaugaaguggucgugguuaugccagaggugucuuggcaacuuggacggucacugaacugcacggucaaaaccuauaguacaagcuacacuuuggaagaucaggaccgcgaguucaugguguuugcggaugcucgauggaccgccccgcuccguuccgcauucucucugcugacaucgucaagcaauggcauuuuugaccucuucuuuaguaacuguagauccuuauucaaugauaggaagcugguagaauaucuuaaagagucuugcuuugacgccguuuucuuggaucccuuugacgcuuguggucugauaguggcaaaguacuucagccuaccuuccgucguguuugcccgggggaucuucugccacuaucucgaggaaggagcucaguguccagcgccccugucauacgugccucgccuucuguugggcuucagugaugccaugaccuuuaaggagagagucuggaaccauauuaugcaccucgaggaacaucuguucugcccauauuucuucaaaaauguuuuagagaucgcaagcgaaauucugcagacucccgugacagccuacgaccucuacucucacaccuccaucuggcuucugaggacggauuuuguauuggaguauccuaagccagugaugccgaacaugauauucaucggcgggauuaauugucaccaaggaaaacccgucccuauggaauuugaggcuuacaucaacgccucaggugaacauggcauugugguuuucagccuagggaguauggugucugagaucccagagaagaaagcaauggcuauagccgacgcgcugggaaagauuccccagacuguccucuggcgguauaccggcacacgcccuuccaaucuggccaacaauacuauccuugugaaguggcugccacagaacgauuugcucggucaccccaugacccgagcauuuauuacacaugcugggagccacggaguauacgaaucgaucugcaauggcguuccgauggugaugaugccucuguucggcgaccagauggacaacgccaaaagaauggagaccaagggggcuggagucacguuaaaugugcuggaaaugacuucugaggaucuagaaaacgcccucaaagcagucaucaacgacaaguccuauaaagagaauauuaugaggcugucaagucuucacaaggaucggcccguggagccauuggaccuggccguguuuuggguugaauuuguaaugcgucauaaaggugcuccucaccuccgccccgcggcacaugaucugacaugguaccaauaucacagccuugacgucauaggcuuucuguuggccgugguucucaccguggcuuucaucacuuucaaguguugcgccuacggguacagaaagugccugggcaaaaagggaagggucaaaaaggcacauaaauccaagacacacuga

SEQ ID NO: 64534 - RNA, 1593 nt, Artificial Sequence
  derived and/or modified sequence opt3 from UGT1A8__Homo_sapiens__NP_061949
auggccagaaccggcuggacaagccccaucccucugugcgugucccuccuucugacuuguggguucgcugaagcaggaaaguuguuagucguuccaauggacgguucucacugguuuacgaugcagucagugguagaaaaacugauucuaaggggccaugagguggucgugguuaugccggaagugaguuggcaacucggaaagagccugaacugcaccgucaaaacauacuccacuucuuauacccuugaggaucuggaccgggaguucauggauuuugccgacgcgcaguggaaggcucaggugcgcucguuguucucacucuuucugagcaguuccaauggguucuuuaaccuguucuuuucucacugucgaagccucuucaaugaucguaaauuaguagaauaccugaaggaguccucauuugacgccguuuuccuugaucccuuugacgcaugcggcuugauaguggccaaguauuucagucugccuagcgucguguucgcuagagguaucgcaugucauuaccuagaagagggggcccagugcccagcuccccucucuuaugugccuaggauucugcuuggauuuuccgaugccaugacauucaaagaacggguccgcaaccacaucaugcaucuggaggagcacuuguuuugucaauacuucucaaagaaugcgcucgaaauugcaagcgagauccugcagaccccaguuacugccuaugacuuauacagucacacaucuauauggcugcucagaaccgauuuugugcuugacuaccccaaaccuguaaugccaaacaugaucuucauuggcggcaucaauugccaucaggggaagccgcugcccauggaauuugaggcuuauauuaacgccuccggagaacacgguaucguggucuucagcuugggcucgauggugucugagauaccugagaaaaaggcaauggcuauugccgaugcgcuagggaagaucccacagacgguucuguggagguacacuggaacccggcccuccaaucucgccaacaauacaauucuggugaaauggcuuccucaaaacgaccuguugggccauccaaugacucgcgcauuuaucacccacgcugguucacacggggucuaugaaaguaucuguaauggagugcccaugguaaugaugccucucuucggcgaccagauggauaacgccaagcgaauggagacaaaaggcgcugggguuacccugaauguguuagaaaugacgagcgaggaccuggaaaacgcccuaaaggcagucauuaacgauaaauccuacaaggagaauauaaugagacucucuagccugcauaaagacaggccgguggagccccuugauuuggccgucuuuuggguggaguucguuaugcggcacaagggagcuccacaucugcguccugcggcacacgaccucacuugguaucaguaccauucacuggaugugaucgguuuucuucuggccguagucuugacaguggcuuucauuaccuucaagugcugugccuauggcuaccgcaaaugccucgggaagaaaggaagaguuaagaaagcacacaagaguaagacucacuga

SEQ ID NO: 64535 - RNA, 1593 nt, Artificial Sequence
  derived and/or modified sequence opt3 from UGT1A9__Homo_sapiens__NP_066307
auggccugcaccggcuggacaagcccccugccucucugugugugccuucuguugacuuguggguucgcugaggcaggaaaguuacuggucguuccaauggacgguucccacugguuuacgaugagaucugugguagaaaaacuaauccucaggggccaugagguggucgugguuaugccggaagugucauggcagcuggggcggagucuuaacugcaccgucaagacauacagcacuuccuauacccuggaggauuuggaccgcgaguucaaagccuuugcgcacgcucaauggaaggcccaggugcgaucuauuuacucgcuccugaugggaucauauaaugauauauucgaccuguuuuucagcaacugucguagucucuuuaaagauaagaaguuaguagaauaccugaaagaguccucuuucgacgcaguuuuucuugaucccuucgacaauugcggcuugaucguggccaaguauuuuagccugccuuccgucguguucgcuagagguauucuaugucauuaccucgaagagggggcacagugcccagcuccccugucauaugugccuaggauccuucugggauuuagugaugccaugacauucaaagaacggguccgcaaccacauuaugcauuuggaggagcaccuccugugucacagauucuuuaagaaugccuuagaaaucgcgagcgagauacugcagaccccaguuacugaauacgaccucuacucucauacauccaucuggcuucugaggaccgauuucguguuggacuaucccaaaccuguaaugccaaacaugauuuuuaucggcggcauuaauugccaccaagggaagccgcuacccauggaguucgaagcauacaucaacgccucaggagagcaugguauaguggucuuuagccugggcaguauggugucugagauuccugaaaagaaagcuauggccaucgcagaugcucucgggaagauuccacagacgguucuguggcgguauacuggaacccgccccuccaaucuugccaacaauacaauccuggugaaaugguugccucagaacgaccuccugggccacccaaugacucgagcguucaucacccacgccgguagccauggggucuacgagucgauuuguaauggagugcccaugguaaugaugccguuauuuggcgaccagauggauaacgcaaagagaauggaaacaaaaggcgcugggguuacccugaaugugcuagagaugacgucugaagaccucgagaacgcccugaaggcugucauaaacgauaaauccuauaaggagaauaucaugaggcuuucaaguuugcacaaggaccggccuguggaaccccuggaucucgccgucuucuggguggaguuuguuaugcgucauaaaggagcaccacaucugcgcccugccgcucacgaccuuacuugguaccaauaucacagccuggaugugauugguuucuugcucgcgguaguccugacaguggcauuuaucaccuucaagugcugcgccuacggcuacagaaaauguuuagggaagaaaggaaggguuaagaaggcucacaaauccaagacucauuga

SEQ ID NO: 64536 - RNA, 2082 nt, Artificial Sequence
  derived and/or modified sequence opt3 from UGT2A1__Homo_sapiens__NP_001239203
augcugaacaaucuccuucuguucagcuugcagaucuccuuaauuggcaccacauuagggggaaacgugcuaauauggcccauggaggguucucacuggcucaaugucaagaucauuaucgacgaacugauuaaaaaggagcauaacguuacugugcuuguagccucaggcgcucuguuuaucacgccuaccaguaauccaagccugacauucgaaauauacaaagugccguuugggaaggagagaaucgaaggagucauuaaagauuucgugcucacuuggcuggagaacaggcccuccccuucuaccaucuggcgguuuuaucaagagauggcaaagguuauuaaggacuuccacauggugucgcaggaaaucugcgauggcguccugaaaaaucagcagcucauggccaagcugaaaaagucaaaauuugaggugcugguaagcgacccaguuuuccccuguggugauauaguggcgcuuaaguuggggauuccuuuuauguacagucugcgcuucuccccagcuucuacagucgaaaagcauugcggaaaagugcccuauccuccaagcuacgugccggccguccuauccgagcucaccgaccaaaugucauuuacugaucgaauccguaacuucauuaguuaucacuugcaggacuacauguuugagacacuuuggaaaagcugggauucuuauuacuccaaggcacuggacggcucacauugguugaauaucaagaucauucucgaagaacugauacagagaaaccacaauguuaccguguuagccagcagugcuacgcuguucaucaacucuaaucccgauuccccuguaaacuucgaagugauuccagucagcuacaaaaagucgaauaucgacucucucauagagcacaugauuaugcuuuggaucgaucauaggcccacuccucugaccaucugggcauuuuauaaagaauugggcaagcuacuggacacauucuuucagauuaacauccaacucugugacggggugcugaagaacccaaaacuuauggcccggcugcagaagggagguuucgauguuuugguggcugaccccgucacuauuugcggcgaucucguggcccugaaauuagggauaccguuuauguacacccugcgcuucuccccugcgucaacaguagagagacacuguggaaagauccccgcaccaguuaguuaugugccugccgcucuaagcgagcucaccgaccagaugacguuuggcgaaaggauuaaaaauacuaucuccuacucucugcaggauuauaucuuccaaagcuacuggggugaguggaacucauauuacaguaagauucuugggcggcccacaaccuugugcgaaacuaugggaaaggccgagauauggcugauccgcacauacugggacuuugaguucccacgacccuaucucccuaauuuugaguucgucggcggccugcauuguaaaccagcaaagccgcuucccaaagugcuguggagauacaaggggaaaaagccugcuaccuugggaaacaauacgcagcucuuugauuggauuccacagaacgaccuguuaggucaccccaagaccaaagccuucaucacacacggcgggacuaauggaauuuaugaggcgaucuaccauggcgucccuaugguggguguuccaauguucgccgaucaacccgacaacauagcacacaugaaggcuaaaggggccgcuguggaaguaaaucugaacaccaugacauccgucgaucuacucagcgcccugaggacugugaucaaugagccgucuuauaaggaaaacgcaaugcggcuuucacguauucaucacgaccagccuguuaaaccauuggaccgcgccguguuuuggaucgaguucgucaugagacauaagggcgcuaagcaccugaggguggcggcacacgaucucaccugguuucaguaccauagucuggacguaauuggauucuuacuggugugcguuacaaccgccaucuuucuugucauacaguguugcuuguucagcugucaaaaauuuggcaagauugggaaaaagaaaaagcgggaauga

SEQ ID NO: 64537 - RNA, 1611 nt, Artificial Sequence
  derived and/or modified sequence opt3 from UGT2A2__Homo_sapiens__NP_001099147
auggugagcaucagagacuucaccaugcccaagaaauuuguccagaugcugguuuucaaccucacacuuacugaggugguacuguccggaaauguguugauuuggccuacggaugggucucacugguuaaacauaaagaucauucuggaggaacuaauccaaaggaaucauaacgucaccgugcucgccucaagugcuacacuguuuauuaauagcaacccagacuccccgguuaauuucgaagugauccccgucucuuacaaaaagucgaacauagauucacuuaucgagcacaugauuaugcuguggaucgaccaucggccuacuccauugaccauuugggcauuuuauaaagaacucggaaagcugcuggauacauucuuucagaucaauauacagcucugcgacgguguguuaaagaaccccaaacugauggcccgccuucagaagggcggguucgauguauugguugcggacccugugaccauuuguggagaucuggucgcucuaaaacucggcaucccauuuauguacacucugcgauucagccccgccaguacaguggagcgucacugcgguaagauuccugcaccaguguccuaugucccggccgcucuuucugagcugaccgaccaaaugacguuuggggaaagaaucaaaaauacuaucagcuacuccuugcaggauuauauuuuccagucauacuggggagaguggaacaguuauuacagcaagauacucggcaggcccaccacacugugugaaacuaugggcaaggcagagaucugguuaauucggaccuacugggacuuugaguucccucgcccauaucugcccaauuucgaauuuguugggggacuccauugcaaaccugccaagccacuucccaaagagauggaagaguucauccagucuuccgguaagaacggcgugguaguguuuucacuggggagcauggucaaaaauuugacagaagagaaggcuaaccuaauagccagugcgcuggcacaaauuccgcagaaagugcucuggagauacaagggaaagaaaccugccacccugggcaacaauacgcagcuuuucgauuggaucccccagaacgaccuguugggucacccaaagacuaaggcuuuuaucacacacgggggaaccaauggcauuuaugaggccaucuaccauggcguuccuaugguggggguccccauguucgcagaccaaccagauaacauugcucacaugaaagccaaaggagcggccguggaaguaaaucucaacacuaugacaucuguugaccuguuauccgcacugaggaccgugauaaaugagcccagcuauaaggaaaacgcuaugcggcuaucgcgcauccaucacgaucagccugucaagccacucgaccgagccguguuuuggauugaguucgucaugagacacaaaggugcuaagcaucugaggguggccgcacacgaucuuacgugguuucaguaccauucuuuggacguuaucggcuuccugcucguguguguaaccacagccaucuuucuggucauucaaugcugucuuuucuccugccagaaauuugggaagauaggcaaaaagaagaaacgggaauga

SEQ ID NO: 64538 - RNA, 1584 nt, Artificial Sequence
  derived and/or modified sequence opt3 from UGT2A3__Homo_sapiens__NP_079019
augagaagcgacaaguccgcccugguguuccuccuucugcaguuguuuugcgucggcuguggguucugcggaaaaguuuuaguguggcccugugauaugucucacuggcugaacguaaaggugauccuagaggaacucauugucaggggucaugaggugaccguucugacacacucaaaaccuagucuuauagacuaccggaagccaagcgcucugaaauuugaagugguccauaugccgcaagaucgcacugaggaaaaugagaucuucguggacuuggcacucaacguacugcccggccuguccacguggcagucuguuauuaagcucaaugauuucuucguggagauccgagggaccuuaaagaugaugugcgaaucguuuauuuauaaccagacacugaugaaaaaguugcaggagacuaauuacgacgucaugcuuaucgauccugugauaccauguggagaccugauggccgaacuacucgcggugcccuucguccugacccuucguaucucaguuggcgguaacauggagagaagcugcgggaaacugccugcuccauugaguuaugugcccguaccuaugacaggacucaccgauaggaugacuuuucuggagcgggugaaaaauuccauguuaucuguccuguuccacuuuuggauucaagacuacgauuaucauuucugggaagaguuuuacagcaaagcccucggccgcccaacaacccuuugugaaacggugggcaaggcagagaucuggcugauuagaacuuauugggacuucgaauuuccgcagcccuaccagccuaacuuugaguucguugggggauugcacugcaagccagccaaagcucuacccaaggagauggaaaauuuugugcaguccucaggugaggauggcaucgucguguucagucuggggagccucuuucaaaacguaaccgaagagaaagcaaauauaauugccucugcucuggcccagaucccucagaagguucuuuggagguacaaaggaaagaaaccauccacacugggcgcgaacacucgguuguaugacuggauuccccagaaugaccuccugggucacccgaagaccaaggcauucaucacacaugggggaaugaacggcaucuacgaagccauuuaucacggcgugccuauggucggggugcccauauuuggagaucaauuagacaauaucgcucauaugaaagccaagggugcagcugucgagauuaacuucaaaaccaugacgucagaggaucugcuacgcgcccuccgaacugugaucacagacagcaguuacaaggaaaacgcgaugagacugucuaggauacaccacgaucagccaguuaaaccucuugaccgggccguguuuuggauugaguucguaaugcgucauaagggcgcaaagcacuugcgcuccgcugcccaugaucugaccugguuucagcacuauagcaucgacgucaucggguuccuccuggcuuguguggccacugcaauuuuucuuuucacaaaaugcuuccuguuuucgugucaaaaguucaauaaaaccagaaagaucgaaaagagggaguga

SEQ ID NO: 64539 - RNA, 1587 nt, Artificial Sequence
  derived and/or modified sequence opt3 from UGT2B10__Homo_sapiens__NP_001066
auggcccugaaguggaccacagugcuccuuauccagcugagcuucuacuuuuccucuggcucaugcgggaaagucuugguuugggcugcagaguauaguuuauggaugaacaugaagacuauucugaaagagcuagugcaaagaggacacgagguaacggugcucgccagcuccgcgucuauacuguucgaccccaaugauucgucaacccuuaagcuggaagucuacccuacaagccugacuaaaaccgaguuugaaaacaucauuaugcagcucgugaagaggcugagugagauccagaaggacacauucuggcugccauuuucccaggagcaagaaauucucugggcuaucaaugauauaauccggaacuucuguaaagacguugugucuaauaagaaauuaaugaagaaacugcaggagagccgcuuugauauugucuucgccgacgcauaucuuccgugcggugaauugcuggccgagcuauuuaacauccccuucguguacucccauucauuuaguccuggcuauagcuucgagcgacacucugggggauuuauuuucccacccuccuacguaccuguugugaugucaaagcucagcgaucagaugaccuucauggaacgugucaagaauaugcuguaugugcuuuacuuugacuucugguuucagaucuucaacaugaaaaagugggaucaauuuuacagugaggugcugggcagaccaacuacauugucugaaaccaugaggaaagcugacauauggcucaugcgaaauuccuggaacuucaaguuuccccauccuuuccugccaaaugucgauuuuguugguggguuacacuguaaaccggcaaagccccugccuaaagagauggaagaguucgugcagagcucgggagagaacggcguaguggucuuuucucucggcuccauggugucaaauaugacggaagaacgcgccaacguuauugcuacugcccuugcgaagaucccacagaaggugcuguggagauucgacgggaauaaacccgaugcauugggacuaaacaccaggcuguauaaguggauuccucagaacgaccuccugggucauccaaaaacacgggccuuuaucacucacggcggggcuaauggaaucuacgaagccauuuaucacggcauacccauggucgguaucccgcuuuucuucgaccaaccugauaacauugcacauaugaaggcuaaaggggccgcggugcgcguagacuuuaauaccaugaguagcacagaucuguugaacgcccucaagaccguuaucaaugaccccuccuacaaggagaacauaaugaaacugucucggauucagcacgaucagccagugaagccuuuagacagagcagucuucuggaucgaauuugugaugaggcauaaaggagcuaagcacuugcgggucgccgcucacaaucuaacgugguuccaauaucauagccucgaugugaucggcuuucugcuugccugcguugcaacuguguuguucauuaucacaaaauguugccuguuuuguuucuggaaguuugcccguaagggcaaaaaggggaaacgcgacuga

SEQ ID NO: 64540 - RNA, 1590 nt, Artificial Sequence
  derived and/or modified sequence opt3 from UGT2B11__Homo_sapiens__NP_001064
augacccugaaguggacaagcgugcuccuucugauccacuuguccugcuacuucucuucaggcaguugugggaaagucuuaguuugggccgcugaguauagccauuggaugaacaugaagacuauucugaaagagcuagugcagagaggacacgaaguaacggugcucgcauccucugccucgauacuguuugaccccaaugaugcgucaacccuuaaguucgaagucuacccuacaagccugacuaaaaccgaguuugaaaacaucauuaugcaacaggugaagagguggagugacauccggaaggauuccuucugguuguauuuuucucaggagcaggagauucucugggaacuguacgacaucuuccgcaauuuuugcaaagauguugugagcaacaagaaagucaugaagaaacugcaagagucccgauucgacauaguguuugcugaugccguauucccauguggugaacucuuagcagcccugcuuaauauccguuuuguuuauucauugagauucacaccgggcuacaccauugagaggcauagugggggacugaucuuucccccuagcuauauuccaaucgugaugucuaagcuauccgaccagaugacuuucauggagcgggucaagaacaugauauacgugcucuacuucgauuuuugguuccagaugucagacaugaaaaagugggaucaguuuuauagcgaagugcugggccgccccacaacccuuuucgagacgauggguaaagcugacauuuggcugaugagaaauaguuggucuuuucaauucccucacccauuuuugcccaacgucgauuucguugggggauuucauugcaagccugcaaaaccacucccgaaggaaauggaggaguucgugcaguccagcggcgaaaauggcguaguggucuuuucgcuggggucugugaucuccaacaugacugccgagagggcuaauguuauugccaccgcguuagcaaaaaucccccagaaggugcuguggcgguucgacggaaacaagccugacgcccucggucuuaauacacgccuguacaaauggaucccacagaacgauuugcuaggccaccccaagacucgagcuuuuauuacccacgggggagccaauggcauauaugaagcaaucuaccaugguauuccuauggucgggaucccacuguucuucgaccaacccgauaacauagcucacaugaaagccaagggagcggccgugagacucgacuuuaacacaaugucaaguaccgaucugcuuaaugcacugaaaacgguaauuaacgacccguuguauaaggagaauaucaugaagcucagcaggauccagcaugaucagccuguuaaaccccuggaccgggcuguguucuggauugaauuugucaugccacacaagggcgccaaacacuuacguguggcugcccaugaucugacuugguuccaauaccacucccuagacgucaucggcuuucuccuggcauguguggccacaguuauuuucauaaucaccaaguuuugccuuuucuguuuuuggaaauucgcucgcaaggggaagaaaggaaagagagauuga

SEQ ID NO: 64541 - RNA, 1593 nt, Artificial Sequence
  derived and/or modified sequence opt3 from UGT2B15__Homo_sapiens__NP_001067
augagccugaaguggaccuccguguuccuccuuauccagcugucuugcuacuuuucaaguggaagcugugggaaagucuugguuuggcccacagaguauucccacuggauuaacaugaagacuauauuagaagaacuggugcaaagaggacaugaaguaacggugcuaaccucuucggccucaacacucgucaaugcuagcaaaaguuccgcaaucaagcuggagguguacccuacuucucuuaccaaaaacuaucuggaagacagcuugcucaagauucuggauagguggaucuacgguguuuccaagaauacauucuggucauauuuuagucagcugcaggagcucugcugggaguacuaugacuacagcaacaaauuauguaaggaugccgugcugaauaaaaaguugaugaugaaacuucaggaaucuaaguucgacgucauucuggcggaugcucuaaacccaugcggcgagcuccuggccgaacuuuuuaauaucccguuccuguacuccuugcgguuuucagugggguauaccuucgagaagaacggaggcgguuuucucuuucccccuagcuacguaccaguugugaugagugagcugucugaccaaaugauauucauggaacgcaucaaaaauaugauucacauguuauauuucgauuuuugguuccagaucuacgaccugaagaaaugggaucaguucuauuccgagguccucgggcgacccacuacacuuuuugaaaccaugggaaaggcagagauguggcugauucguacguacugggacuucgaauuuccuagaccauucuugcccaacguggauuuugugggcggccuacauuguaaaccugccaagccacugccgaaagagauggaggaguucguccagagcucgggggagaauggaaucguuguguuuucucucgguuccaugauaucaaacaugagugaagagagcgcuaauaugauugcauccgcccuggcucaaaucccccagaagguacuuuggagguucgacggcaagaaaccuaacacucuggggucuaauacccgguuguauaaguggcucccacagaacgaucuguuaggacaccccaaaacaaaggccuuuauuacucauggcgguaccaacgggaucuacgaagcgaucuaccacggcauuccuauggugggaauaccacuguucgcagaccagcacgacaauaucgcccauaugaaagcuaagggcgccgcacuaagcgucgauauucgcacaaugucaaguagagaccuccugaacgcucuuaaguccgugaucaaugaucccguuuauaaagagaacgugaugaaguugagcaggauacaccaugaccaaccgaugaaaccucuggaucgggccgucuuuuggauugaguucgugaugcgccacaagggggcgaaacaccuccgaguagccgcacauaaucugaccuggauccaguaccacucucuugacguuaucgcuuuucuguuggccugcguggcuacggucauuuucaucauuacuaaguucugucucuuuugcuucagaaagcuggccaaaaagggcaaaaagaaaaagagggauuga

SEQ ID NO: 64542 - RNA, 1008 nt, Artificial Sequence
  derived and/or modified sequence opt3 from UGT2B28__Homo_sapiens__NP_001193933
auggcccugaaguggaccagcgugcuccuucugauccacuugggcugcuacuucuccucugggucauguggaaaagucuuaguuuggacaggugaguauagucauuggaugaacaugaagacuauucugaaagagcuagugcagagaggccacgaaguaacggugcucgcuagcuccgcaucuauacuguuugaccccaaugaugccuucacccuuaagcuggaagucuacccuacaucguugacuaaaaccgaguuugaaaacaucauuaugcaacaggugaagagguggucagacauccagaaggauagcuucuggcucuauuuuagucaggagcaagagauucugugggaauuucaugacaucuuucggaauuucugcaaagauguuguguccaacaagaaagucaugaagaaacugcaggagucucgcuuugacauaaucuucgcggaugcuuucuucccauguggggaacucuuagccgcacugcuuaauauuccguuuguguacagcuugugcuucacacccggauauaccaucgagcgacacuccggcggucugauuuucccuccaucauacauccccguaguuaugaguaagcuaagcgaccagaugacuuuuauggagcgugugaagaacaugauauauguccucuacuucgauuuuugguuccagaugugugacaugaaaaagugggaucaauuuuacucugaagugcuggggagaccuacaacccuuuucgagacgaugggaaaagccgacauuuggcugaugaggaacuccuggucauuucaguucccacaucccuuuuugccuaauaucgauuucgugggcggccuccacugcaagccagcuaaaccgcugcccaaggaaauggaggaauuuguccagagcaguggggagaauggaguugugguauucucuuuagguuccgugauuagcaacaugacugcagagcgggccaaugucaucgcuaccgcccuggcgaaaaucccucagaagauuuga

SEQ ID NO: 64543 - RNA, 1110 nt, Artificial Sequence
  derived and/or modified sequence opt3 from UGT2B4__Homo_sapiens__NP_001284544
augagcaugaaguggaccuccgcccugcuccuuauccagcugucuugcuacuucucaaguggcagcugugggaaaguguuggucuggcccacagaguuuucccacuggaugaacauuaagacuauauuagacgaacugguucaaagaggacaugaggugacgguacuagcuucuucggcaucaaucagcuucgauccuaauaguccauccacccucaaauuugaaguguauccggucucucugacaaagacugaguucgaagacauuaucaaacagcuugugaagaggugggccgagcugcccaaggauaccuuuuggagcuacuucucccagguucaggagauuauguggacauuuaacgacaucuugcggaaauucugcaaggauauagugucaaauaaaaagcucaugaaaaagcugcaagaaagucgcuuugacgucgugcuggcggaugcuguauucccuuuuggugagcucuuagccgaacugcuuaagaucccauucguuuauagcuugcgauuuucucccggcuacgcaauugagaaacacuccgggggacugcuauucccuccaucauaugugcccgucgugaugagcgagcucagugaccagaugaccuucaucgaacgugugaagaacaugauuuacguccuguauuuugaguucugguuucagaucuucgauaugaaaaagugggaccaguuuuacucugaaguucuuggcagaccuacuacacuguccgagaccauggccaaagcugauauaugguugauuaggaauuacugggacuuccaauuuccacauccgcuccugcccaacguggaguucguagguggguuacacuguaagccugcaaaaccacugcccaaggagauggaggaauuugugcagagcucgggagagaauggcgucgugguuuucucucucggcuccauggugucaaacacgagugaagaacgggccaaugucaucgcuagcgcccuugcgaagauuccucagaaagugcuguggcgcuuugaugggaacaagccagacacuuugggacuaaauaccagacuguauaaauggaucccccagaacgaccuccuggauaucaagaggaugcuuuga

SEQ ID NO: 64544 - RNA, 1590 nt, Artificial Sequence
  derived and/or modified sequence opt3 from UGT2B7__Homo_sapiens__NP_001065
augagcgugaaguggaccuccgucauccugcucauucagcuuucuuucugcuuuucaaguggcaacugugggaaaguucuggugugggcagcugaguacagccacuggaugaauauaaagacaaucuuggacgaauuaauucaaagaggacaugagguaacugugcuggcauccucugccucgauccuauucgaucccaacaauucaagcgcgcucaaaauugaaaucuauccuacgagucugaccaagacagagcuugaaaacuuuauaaugcagcagaucaaaaggugguccgaccugccaaaggauacuuucugguuguacuuuucucagguccaagagauuaugagcaucuucggugacauuacccggaaguuuugcaaagaugugguuuccaauaagaaauucaugaagaaagugcaggagucacgcuuugacgucaucuucgcugaugccauauuuccguguagugaacuccuggcagagcuguucaacauucccuuuguguauagccucucuuucuccccuggcuacacauucgaaaagcacucagggggauuuaucuucccacccagcuauguaccuguugugaugagugaguuaaccgaccagaugacuuuuauggagcgagucaagaauaugauuuacgugcuguauuucgauuuuugguucgaaaucuuugacaugaaaaagugggaucaguucuacucugaggugcuuggccguccaacaaccuuguccgaaacgauggguaaagccgacgucuggcugaucagaaacagcuggaauuuucaauuccccuacccucuacucccaaacguugauuuuguagggggacugcauugcaagccggcuaaaccccuuccuaaggagauggaagacuucgugcagucgucuggcgagaauggcguggucguguuuucccuggggucaaugguuaguaacaugacugaggaaagggcaaaugugauugccagcgcuuuggcccagauaccacagaaaguccucuggcgguucgacggaaacaagcccgauacccuggguuuaaauacacgccuguauaaguggaucccucaaaacgaccuccuuggccacccaaaaacuagagcguucauuacccaugggggagcaaacggcaucuacgaggccauauaucacgguauucccaugguggggaucccgcuguuugcugaucagccugacaauaucgcccacaugaaggcaaggggagcugccguacggguugauuucaacacaauguccucuaccgacuugcuaaaugcgcugaaacgcgugauuaacgaucccagcuacaaggaaaaugucaugaaacucucacgaauccagcaugaccaaccagugaagccucuggauagagccgucuuuuggauugaguucgugaugaggcacaagggcgcaaaacaucuucggguugcugcccacgaccugacgugguuucaguaucacaguuuggaugugauaggcuuccuccugguaugugucgcuacugugaucuuuauuguuacaaagugcuguuuauucugcuuuuggaaauucgcccguaaggccaaaaaggggaagaacgacuga

SEQ ID NO: 64545 - RNA, 1470 nt, Artificial Sequence
  derived and/or modified sequence opt3 from UGT3A2__Homo_sapiens__NP_001161788
auggccggccagagagugcugcuccuugucggguuccuguugcccggaguuuuacugagcgaggcugcaaagauccuaaccauuuccacaguggacuuuaaaaaggaagagaaaucuuaccaaguaauaucauggcucgccccugaagaucaccagagggaguucaagaaaaguuuugacuucuuucuggaagagacucuugguggccgggggaaguucgagaaccuguugaaugugcucgaauaucuggcgcugcagugcagccauuuucucaaccgcaaggauaucauggacuccuuaaagaaugagaacuucgauauggucauuguggaaacguuugacuacuguccauuccugaucgcugagaaacuuggaaaaccguuuguugccauuuugucuaccucguucggcucacuggaguuuggucuacccaucccucucagcuaugugccagucuuccgaagucugcuuacagaucacauggacuucugggggcgugugaagaauuuucugauguucuuuuccuucugcagaaggcagcaacauaugcagucuacuuuugauaacaccauaaaagaacacuucacagagggaagccggcccguauugucccaucuccuguuaaaggcagaacugugguuuaucaauucagacuucgccuuugauuucgcucgcccucuccuuccaaacaccguuuacgugggcggccugauggagaagcccauuaaaccugucccacaggacuuggaaaauuuuaucgcaaaguucggggauaguggauuugugcuagugacucuggguagcauggucaacacaugucagaauccggagauuuucaaagagaugaacaaugccuucgcucaccucccccaaggcguuaucuggaagugccaguguucucacuggccuaaagacgugcaucuggccgcgaacguaaagauaguggacuggcuuccacaguccgaucuguuggcacaccccucaauuagacucuuugucacccaugggggacagaauagcaucauggaagccauucaacacggcgugccuaugguugguaucccacuguucggggaccagcccgagaacauggugagggucgaagcuaaaaaguuuggagugaguauccaguuaaagaaacugaaggccgagacgcuagcacucaaaaugaagcaaauuauggaagauaaacgguauaagucugcugccguagcggccuccguuauacugcgcagccacccgcuuucgccuacucagcgauuggugggcuggaucgaccauguccugcagaccggcggggcaacacaccucaagcccuacguguuccagcaaccauggcaugagcaguaucugcuugaugucuuuguguuccuguugggacucacucuggguaccuuauggcugugcggcaaacuacucgggauggcuguuugguggcugagaggagccaggaaggugaaagagacauga

SEQ ID NO: 64546 - RNA, 1626 nt, Artificial Sequence
  derived and/or modified sequence opt3 from UGT8__Homo_sapiens__NP_001121646
augaaaagcuacacccccuauuucauccugcucugguccgccgugggcauugcuaaggcagccaagauaaucauugucccuccaaucauguuugagucucacauguacauuuucaaaacacuugcgucagcucugcaugaaagagggcaccauacuguguuuuuguuaagugagggaagggacaucgccccgagcaaccacuauucccugcagcgguaccccgguauauucaauucuacgaccucggaugcauuucuacaaucaaagaugcgcaacaucuucagcggccgacucacagccauugaacuguuugacauccuugaucauuauacuaaaaauugcgaccugaugguugggaaccacgcuuugauucagggacucaagaaggagaaauucgaucugcugcucguagacccuaaugauauguguggcuuugugaucgcacacuuacugggugucaaguacgccguguucaguaccgggcuuugguauccagcugaaguuggagcccccgcgccuuuggcauacgugccagaguuuaacucccugcuaacagaccguaugaaucuccugcagagaaugaaaaacaccggcgucuaccuuauaucuaggcugggcgugagcuucuugguacuccccaaguaugagcggauuaugcagaaauacaaucuguuaccugaaaaguccauguaugaucugguucaugggucaagucucuggaugcuuugcacugacguggcccuggaguuuccacgcccgacauugcccaacgucguguacgugggagguauccuaaccaagccugcuagcccacugcccgaagaucuccaaagaugggucaauggcgccaacgagcacggguucguucuggugucuuucggagcaggcguaaaauaucuuuccgaggacauugcuaauaagcuggccggugcguuggggaggcucccucagaaagugaucuggcgguuuucaggaccaaagcccaaaaaccugggcaauaacacgaaguuaaucgaauggcugccgcagaacgaucuacucggccauagcaaaauuaaggccuuccugagucacgggggacuuaauucuauauuugagacuauguaccacggugucccugugguuggcauccccuuguucggggaccauuaugacaccaugacacgcgugcaggcaaagggaaugggcauucugcucgaauggaaaacugucaccgagaaggaacuguacgaggcucuugugaaaguaaucaacaauccauccuaccgacaaagagcccagaagcugagcgagauacacaaagaucagccuggucaucccguuaacaggacaauuuauuggaucgacuacaucauucggcacaauggggcucaucacuugcgugccgcagugcaccagaucucguuuugucaauauuuccuccuggauauugccuuugucuuacugcuaggcgcugcgcuccuguacuuccuuuugucuugggugaccaaguuuauauaucgcaagaucaaaucccuguggucaagaaacaagcauaguacggucaauggacacuaccauaacggcauucucaaugggaaauauaagaggaacggacacaucaaacacgaaaagaaggugaaauga

SEQ ID NO: 64547 - RNA, 1038 nt, Artificial Sequence
  derived and/or modified sequence opt3 from UHMK1__Homo_sapiens__NP_001171692
auguuccugaccagacccaaggugugcgucgaccucaacaggcggguuacacuuuacggcguguuuacuauccacuucagcccuaauguaccaucccgcugucuguuguuagagcugcuagaugugucugucucagaacuccugcuuuauaguagccaucaggggugcuccauguggaugauucaacacugugcccgagacgugcuggaggcuuuggcauuucuccaucacgaaggauacguucaugccgaucugaaaccgcguaacauacuguggucugcggagaaugaaugcuucaagcucaucgacuuugguuuaucguucaaagagggcaaccaggaugugaaguauauucagacggacggguacagagcucccgaggccgaacugcagaauugucuugcacaagccggauugcagucagauaccgagugcacaagcgcugucgaccuguggagucuaggcaucauucuccuggaaauguuuuccgguaugaaacuuaagcacacugugaggucucaggaguggaaggcaaacagcuccgccaucauagaucacaucuucgcuucaaaagccguaguuaaugcggcaauuccugccuaucaucugcgggacuugaucaagaguaugcuccacgaugacccaagccgcaggauucccgcugagauggcccuguguucuccauuuuucuccaucccuuuugcaccccauauagaagauuuagugaugcugccuaccccaguccucagacuucugaacguguuggacgacgauuaccuagagaaugaagaggaauaugaggacguggucgaggauguuaaagaagagugccagaaguacgggccggugguaucacugcucgugcccaaagaaaacccuggacggggccaagucuucguggaguacgcuaaugccggcgacagcaaggcggcccagaagcugcuuacagggcgcauguuugauggaaaauucguuguggcaaccuucuauccacugagugcuuacaagcgagguuauuuguaccagacucuccuguga

SEQ ID NO: 64548 - RNA, 4323 nt, Artificial Sequence
  derived and/or modified sequence opt3 from UHRF1BP1__Homo_sapiens__NP_060224
auggccggcaucauuaagaaacagauacugaagcaccucagcagauucaccaaaaaccuuucccccgacaagaucaaucugucuacauugaaaggggagggacaauuaacuaaccuggaacuagaugaggaagugcuccagaauguccuggagcuuccuacguggcuggcuauuaccaggguuuacugcaaccgggcaucaauccgcauucaguggacaaaguugaagacucauccaaucugucucugccuggacaaaguggaaguagagaugaagaccugugaggauccgcgacccccuaauggucagaguccaauagcccuggcgagcggccaauccgaauauggguuugcugagaaaguggucgaaggaauguucaucauugugaacucuaucacaauuaagauccacucgaaagccuuucaugcaucauucgagcucuggcaguuacagggcuacagcguuaaucccaacuggcagcaaagugaccugcgucuuaccagaauaacugauccuugcaggggugagguguugacauuuaaggaaauuaccuggcagacgcugcggaucgaggccgacgcuacugauaauggggaccaggauccagucaccacaccccuacgccucauuacuaaccagggaagaauccaaaucgcacugaagaggcggaccaaagacuguaaugugauuuccucuaagcugauguuccuguuggaugaccuccuguggguauuaacagauagccagcugaaagccaugaugaaguaugcugaaucccucucagaggccauggagaaaagugcgcaccagcgcaagagccuugcaccugagccaguucaaauaaccccgcccgccccuucugcucagcaguccugggcccaggcauuuggcggcucacaagggaacagcaauaguucuuccagccgacugucgcaguacuucgagaaauuugacgugaaggaaucuuccuaucauuugcuaaucucaagacuggaccuccacauuugcgaugacagucagagcagggagccaggagucuccgcuaaccggcugauggguggcgccaugcagcuuacguuccguaagauggcguuugauuacuaucccuuccacugggccggggacucuuguaaacauugggugcgccacugcgaagcaauggagacuagaggacaaugggcucagaagcuggugauggaauuucagagcaaaauggagaaguggcaugaggaaacaggcuugaaaccuccauggcaccucggugucgauucacuguucaggcggaaggccgacaguuuauccagcccccgaaagaauccgcuggagcgcucuccuucacaggggagacaacccgcuuuccagccuccugccuggaacaggcuacggaguagcuguaugguugugcgcguagaugaccucgauauccaccagguguccaccgcaggacagcccucuaaaaagccaucgacucugcuuagcugcuccagaaaauugcauaaccugcccacacaagucucagccauacacauugaauuuaccgaguacuacuucccugacaaucaggaacucccagugccgugucccaaccuguauauccagcuuaauggccugacguuuaccauggauccuguuaguuugcucuggggcaaccuguucugcuuagaccuguacaggucucuagagcaauuuaaggcuaucuauaaacucgaggacagcucccagaaggaugaacaucuggacauucgucuugaugcguucugguugaaggugucauuuccacuggagaaacgggaacgagcagagcuccacagaccccaggcccuggucuucagcgcuucugggaugaucgccacaaauacuaggcaugcaccucacugcuccuguagugacuuacagagccuguuucgcggauucgccgcugccgaguuuuuccacucuaacuacgaucauuuuccaaaggugcccgguggcuucucccuuuugcacaugcucuuucugcaucacgcauuucaaauggacucaugccuaccgcagccuaauacccugccaccccagcggccuaaagcgaguugggaucucuggagcguacacuucacacagauuucgcuggacuuugaagggacugagaacuucaagggacauacccuuaauuuuguugcucccuucccauuguccauaugggccugucugccuuuaagauggcaacaggcacaggccaggaaacuccugcuugcuucugaaggccgccugaagcccagcgccucauuugguaguccagugcaguccgaggcauuggcuccggauucuaugagccacccucgauccaagacagaacaugaccucaaaucacugagcgggcuaaccgaggucauggagauccugaaggaaggcaguucuggaauggauaacaaaggcccccucacugagcuggaagacguggccgauguccacaugcuugugcauuccccagcgcacguucgggugcguuuggaccacuaucaauaccuggccuuacucagacugaaggagguacuucagaggcugcaggaacaacuaacgaaagacacagagagcaugaccgggucgccccuccagaaucagacugcuugcauuggaguccuguucccuucagcagagguggccuugcugaugcauccagcucccggugccguugaugcagacucugcgggcagugauuccaccagcuuaguggacucugaacucagcccuuccgaggaucgcgaacugaagucagacgccaguagcgaucaggggccggcuucuccagagaaaguccuugaagaguccucaaucgagaaccaagacgugagucaggaacggccccacagcaauggagagcugcaggauuccggcccuuuggcccagcaacucgcagguaaggggcaugaagcuguagagucucugcaggccaagaaacuaucgagaacacaggcaagcucauccccagccgcucugaagcccccugcgggcagggagaccgccgugaacggacagggcgaacuuaucccgcucaaaaauauugagggggaacugaguucugcaauacacaugacuaaggacgcuacaaaagaggccuugcaugccacgauggaucugaccaaggaagcuguuagcuuaacuaaggacgcauuuucccucggacgagaucgcaugacaucaaccaugcacaaaaugcugucucuucccccagccaaggagccuauggcgaaaacagacgagggugucgcugcccccgugagcggcggggcagcccggcugagauucuuuaguaugaagaggacugugucccaacagagcuucgacggagucucuuuggauucauccggcccagaagaccguaucaguguugauagcgacgguucggauucuuuugugaugcuccuggaguccgaaagcgggccugagucagugcccccaggcagucuaucuaacguauccgacaacgcuggaguccagggcagcccgcuggugaauaacuaugggcagggaucaccagcagccaauaguagcguuucccccucuggcgaagaucuuauuuuccacccagugagcguccucgugcugaaaguuaacgagguguccuucgguaucgagguacgcggggaagacuugaccgucgcguuacaagcugaggaacugacgcuccagcagcugggaaccgugggccuuuggcaauuucugcauggucagugucccggcacaugcuuccaggagucaucuacuuugaagaccgggcacauucggccugccgugggacuaagauuugaagucggcccaggggcagccguucauaguccccuggcuucgcagaauggauuccuccaccuucuuuuacacggcugugaucuggagcucuugacaagcgugcuguccggucucgggccuuuucuggaggacgaagagaucccgguaguggucccaaugcaaauagaacuucugaacucuucaaucacuuugaaggaugacauucccccuaucuaccccaccagcccaggaccuauucccaucacgcuagccauggagcaugugguucugaaaagguccgacgauggcguguuccacauaggugcagcugcccaggacaagccaagugcggagguccucaaaucugaaaagcgacagccuccgaaagaacagguguuuuuaguucccacaggcgaaguguucgagcaacaggucaaggaacugccaauucuucagaaggagcugaucgagaccaaacaggcccucgcaaaugcuaaccaagauaaggaaaaauugcugcaggagauucggaaguacaauccuuucuucgaacucuga

SEQ ID NO: 64549 - RNA, 2382 nt, Artificial Sequence
  derived and/or modified sequence opt3 from UHRF1__Homo_sapiens__NP_001276980
auguggauccaggugagaaccauggacggcaggcaaacacacacugucgauagccugucccggcucacgaagguugaggaacuucgccgaaaaauucaggagcuguuccauguggaacccggguugcagcguuuauuuuacagaggaaagcagauggaggacggucacacccuguucgauuaugaaguaaggcuaaacgacacaauacaacuccuggugcggcagucucuuguccugccucauucaacuaaagagcgcgauagugaguugagcgacaccgauuccggcugcugucucgggcagucugaaucggacaagucaagcacacacggagaggccgcugcagaaaccgauaguagaccagccgacgaggauaugugggacgagacugaacugggccuguacaaagugaaugaguauguugaugcgagggacacaaacaugggugcuugguuugaagcccaggugguccgggugacccgcaaggcaccgucccgagacgagcccugcucuagcacguccagaccugcccucgaagaggauguaaucuaccauguuaaguaugacgauuacccagagaauggggugguccaaaugaacucaagggacgugcgggcucgugcacgcacuauuaucaaauggcaggauuuagaagugggacaggucguuaugcugaauuauaaccccgacaauccuaaggagagaggcuucugguacgaugccgaaauuaguaggaaacgggagacccgaacagcucgcgaacuuuacgccaacgugguauugggcgacgauagccugaaugacuguagaaucauauuuguggaugaggucuucaagaucgagaggccaggggaaggaucucccaugguggacaacccuaugcggcgcaaauccgguccaucaugcaagcacuguaaggacgauguuaauagacuaugcagggugugugcgugccaccucuguggcgggcgucaggacccggauaaacaacugaugugcgacgagugugauauggcauuucauauuuauugccuugaucccccucugagcagugucccaucugaagacgagugguacugccccgaaugucggaacgacgccuccgaggugguauuggcuggagagcgacucagagaaagcaagaaaaaggccaaaauggcaucggcuacuucuuccucacagagggauuggggcaaggguauggccugcguugggcgcaccaaagaguguacaaucgugccuaguaaucacuauggaccaauucccggcaucccggucggcaccauguggcgguucagagugcaggucagcgaauccggggugcauaggccucacguugcgggaauacacggucgcucuaacgacggcgccuacagccugguguuagcagggggauaugaggaugacguagaucauggcaacuuuuucacguacacugguucagggggccgagaccugaguggaaauaagcggacagcugagcaauccugcgaccagaagcucaccaacacuaaucgugcccuugcucugaacuguuuugcccccauuaaugaucaggaaggcgcagaggccaaagacuggagaagcgggaagccagucagggugguucgcaacgugaaaggagguaaaaauucuaaguaugcuccugcggaaggcaaccgguacgaugggaucuacaaggucgugaaguauuggcccgagaaaggaaagucaggcuucuugguauggagauaccuacugaggcgagacgaugacgaaccaggucccuggacaaaagaggggaaggaucgcauuaaaaagcucggccugaccaugcaguauccugagggauaccuugaagcacuggccaaucgggagagagaaaaggagaacaguaaaagggaagaggaggaacaacaggagggcggguuugcuagcccacguacgggaaaggguaaauggaagcgcaaauccgccggcgggggaccgucucgggcaggcucgcccagaaggaccagcaagaagacaaaaguggaaccuuauuccuugacugcccagcagucaagucucauccgagaggacaagucuaaugcuaaacuguggaacgaaguuuuagccagccugaaggaucggccagcauccgguucacccuuccaacuauuccucagcaaagucgaggagaccuuucagugcaucuguugccaggaacugguguuccgcccuauuacaacugugugucagcacaaugucugcaaggacugucuugauagaucuuuuagggcgcaaguuuucuccugcccagcuugccgguacgacuuggggcgaaguuaugccaugcaagugaaccagccccugcagaccgugcucaaucagcuguuuccgggcuacggaaacggcagauga

SEQ ID NO: 64550 - RNA, 2409 nt, Artificial Sequence
  derived and/or modified sequence opt3 from UHRF2__Homo_sapiens__NP_690856
auguggauccaggugagaaccauugacggcagcaagacaugcacuauagaggaugucuccaggaaagccacgaucgaagaacugcgggaacgcguuugggcucucuucgacgugcgacccgagugucaacgucuguuuuacagagggaagcagcuugaaaacggauauaccuuguucgauuacgacguagguuuaaaugauauuauccagcugcuagugaggccugacccagaucaccucccgggcacaucuacucagauugaggcaaaacccugcucaaacaguccuccaaaggucaaaaaggcgccccggguggggccuagcaaucaaccauccaccucugcccgcgcuagacugaucgaccccggauuuggcauauauaagguuaacgagcuuguggaugccagggacgucggucugggggcaugguucgaagcccauauccacucggugacacgggcuucagauggacagagccgcggcaaaaccccuuugaagaauggcaguuccuguaaacgaacuaacgggaauauuaagcauaaaucuaaggagaacacaaauaagcucgacagcguaccauccaccucaaacagugauugcguugcagccgacgaagacgugaucuaccacauucaguaugaugaguacccggagagcggaacgcuggaaaugaaugucaaagaccugagacccagggcucggacuauccucaaguggaacgaguuaaaugugggugauguggucaugguuaacuauaauguggaaucuccuggccagcguggguuuugguucgacgccgagauaaccacacugaaaacuauuucccgcaccaagaaagaacuuagaguaaagaucuuuuugggaggcucagaggguacacugaacgauuguaaaauuaucagcguggacgagaucuucaagauugaaaggccaggggcgcauccccuaaguuuugcagauggaaaguuccuccggcgaaacgacccugagugcgaucuguguggcggcgacccagagaaaaagugccacucuuguuccugccgcgucugugggggaaaacacgagcccaauaugcaacuucugugcgaugaaugcaacguggccuaccauauauacuguuugaauccgccucucgacaagguucccgaggaggaauauugguacugcccaagcuguaaaaccgacucgucugagguggucaaggcuggugaaagacugaagauguccaaaaagaaagccaagaugccuucagcaaguacggagagcaggcgggauuggggccgcgggauggcuugcgugggaagaacuagggaauguacaaucguacccuccaaccacuauggcccaauucccgguaucccuguugggucuaccuggcguuuucgggugcaggucagcgaggccggcgugcaucgaccacacgucggaggcauacacgggagaucaaaugacggagcguacaguuuagugcuggccgguggcuucgcagaugagguugaccgcggggaugaauuuacuuauacaggauccggcgguaaaaaccucgcugggaauaagaggauuggcgccccgagcgcugaccagacccuuacgaacaugaaucgggcccuggcauugaacugcgaugcuccccuagacgauaagaucggagccgagucuagaaauuggagggcgggcaaaccugugcgcguaauccgaucauucaaggggcggaaaauuaguaaguacgcaccagaagagggaaaccguuaugacgguaucuacaaagucgugaaguacuggcccgagauuagcuccucucauggcuuccugguuuggagauaucuccugaggcgcgaugacguggaaccugccccauggaccucggaggggauagaacggagcagaaggcuuugucugcgauugcaguaccccgcuggauauccguccgauaaggagggcaaaaagccuaaaggucaaucaaagaaacagccaagugggacaacuaagcgccccaucucugacgacgauugcccuagcgccuccaaagucuacaaggcaucagacagcgccgaagcuauugaggccuuucagcucacaccccaacagcagcaccugauccgggaggauugucagaaucaaaaguuaugggacgaagugcugucucaucuaguagagggcccaaacuuccucaaaaagcuggaacaguccuuuaugugcguguguugccaggagcuuguuuaucagccugucaccacugaaugcuuccacaauguguguaaagauugcuugcaaagaaguuuuaaggcacagguguucagcugucccgcgugcaggcaugaccugggacagaacuacaucaugauuccaaacgagauacuccagacccugcuugaucuguuuuucccgggcuauucuaaagggcguuga

SEQ ID NO: 64551 - RNA, 2160 nt, Artificial Sequence
  derived and/or modified sequence opt3 from UIMC1__Homo_sapiens__NP_057374
augcccagaaggaagaaaaaggugaaagaggucagcgaaucccggaaccuggagaagaaagacguugaaaccacaucuucagugaguguaaagcgcaagcgacgucucgaggaugccuucaucgugauuagcgacuccgauggcgaagaaccuaaagaggaaaaugggcuucagaagacuaaaacgaagcaaucuaacagagcuaaaugccuggcaaagaggaagauagcccagaugaccgaggaagaacaguuugcguuggcuuuaaaaaugucggagcaggaagcccgggaggucaauucacaagaagaggaagaggaggaacugcuacgcaaggcaaucgccgagagccucaacaguuguagaccauccgacgcuucugcaacaaggagccggccgcuggccacuggacccuccucacagagucaccaggagaaaaccacagauagcggucuuaccgagggcauuuggcagcuggugccuccaucuuuguucaaggggucccauaucucacaaggaaaugaagcugaggagcgcgaagaacccugggaccacacugagaaaacagaggaggagccuguuagcggcaguucugguuccugggaucagagcucgcagccaguguuugagaacgucaaugugaagucuuucgaccgaugcaccgggcauuccgccgaacacacgcaguguggaaaaccccaagagucaacuggcagaggcagugcguuucucaaggcaguacaggggagcggagauaccuccaggcauugccugccuacacuggccgacgcuaagggucuccaggauacuggcgggaccguuaacuacuucuggggcauuccauuuuguccggacggaguggaucccaaucaauauacaaaagucaucuuaugccagcuggaaguguaccagaagucucuuaaaauggcccagcggcaauugcugaacaagaaagguuucggggagccugugcuaccacgucccccuagccucauacagaaugaguguggacagggcgaacaggcaucagagaagaacgaaugcaucagugaggacaugggcgacgaagauaaggaggagcgccaagaauccagagcuagcgacuggcacucuaaaaccaaggauuuucaggagucaaguauuaaaagccugaaggaaaaacuucuguuggaggaggaaccaacgacuucccacgggcagucuucgcagggaaucgucgaggaaacaagcgaggaagguaauuccguucccgccucacaaaguguggcggcccucaccucuaagaggagccugguauuaaugccggaguccucagcagaagagauuacuguguguccugagacacagcugucuagcuccgaaaccuucgaccucgagcgggaagucagucccggcagccgagauauccuugacggggugcgcauaauuauggcugauaaggagguuggaaacaaagaggacgccgaaaaggagguggcuaucucuacguuuuccucaaguaaucaggucagcugcccacugugugaucagugcuucccucccaccaaaauugaaagacaugccauguauugcaacggcuugauggaggaagacacagugcuaacuaggcggcaaaaggaggcaaaaaccaagucggauuccgguacagccgcucagacuucucuggacaucgacaagaacgagaaauguuaccucugcaagagccugguaccauuucgcgaauaucagugucacguugauucaugccuucaacuggcgaaagcagaccagggggauggccccgagggaaguggcagagccuguuccaccguggaagggaaguggcagcagagguugaaaaauccuaaggagaaaggacauucugaaggucgucuccugagcuucuuagagcaauccgagcacaagacaucagacgcugauaucaagagcagugaaaccggcgccuuccgggucccaucuccggggauggaggaagcaggaugcucccgagagaugcagagcucguuuacuagaagggaccugaacgaaucacccgugaaaucuuucgucaguauuuccgaggccacggauugucuaguggacuuuaagaaacagguuacagugcagccuggcagccgcacccggacuaaggcugguagagggaggcgccgaaaauucuga

SEQ ID NO: 64552 - RNA, 735 nt, Artificial Sequence
  derived and/or modified sequence opt3 from ULBP1__Homo_sapiens__NP_079494
auggccgcugcagccagccccgcguuccugcucugccuuccucuguugcacuuacuguccggcuggucuagagcuggguggguggacacccauugucuaugcuacgauuuuaucauuacaccaaagucaaggccggagccccaguggugugaaguccaaggacucguugacgagcggccuuuccugcacuaugauugcgugaaccauaaagccaaggcauuugccagucuugguaaaaagguaaaugugacuaaaacgugggaggaacagaccgaaacacugcgcgacgucguggauuucuugaagggccagcuccuggacauacagguugagaaccugaucccaauugagccccucacuuuacaagcucgaaugagcugugaacacgaggcacaugggcacggacguggcuccuggcaguuucuguucaauggucagaaguuucuuuuguucgauucuaacaauagaaaauggaccgcccugcacccuggggcuaagaaaaugacagaaaagugggagaaaaacagggacgugaccauguuuuuccagaagaucucgcuaggagauugcaagauguggcucgaggaauuucugauguacugggagcaaaugcuugacccaacuaaacccccuucacuggccccaggcacaacccagccgaaggcgauggcaacgacuuugagccccuggagucuccugauuaucuucuuauguuuuauacuggccggccgguga

SEQ ID NO: 64553 - RNA, 741 nt, Artificial Sequence
  derived and/or modified sequence opt3 from ULBP2__Homo_sapiens__NP_079493
auggccgcugcagccgcgaccaagauccugcucugccuuccccuguuguuacugcuaagcggcugguccagagcugggagggccgacccucacucucucuguuacgauauuacagugauaccaaaauuccggccgggaccccgcuggugcgcaguccagggucaaguugacgagaagacuuuucugcauuaugauuguggcaacaaaacggugaccccuguaucaccacuugggaagaaacugaaugugacaacugccuggaaggcucagaaccccgucuugcgagaagugguugacauccucaccgagcagcugcgugauauucagcuggaaaauuacacaccuaaggagccacucaccuuacaagcaagaaugaguugcgaacagaaagccgagggacacagcuccggcucuuggcaguucucguuugacggucagaucuuccugcuuuuugauucagagaagaggauguggacuacagugcaucccggggcucggaaaaugaaggaaaaaugggagaacgacaaggucguggccaugagcuuccacuauuuuaguaugggagauuguauuggcugguuggaagacuuccugaugggcauggauuccacccuagagccuucugcgggggcaccacucgccaugagcuccggaacgacucaacugcgcgcuaccgccacaacucuuauccugugcuguuugcucauaauccugccgugcuuuauuuuacccgguaucuga

SEQ ID NO: 64554 - RNA, 735 nt, Artificial Sequence
  derived and/or modified sequence opt3 from ULBP3__Homo_sapiens__NP_078794
auggccgcugcagccagccccgcgauccugccuagacucgcuauucuuccauaccuguuguucgacugguccggcaccgggagggccgaugcacacucuuuaugguauaacuuuacaauaauccaucugccgcggcacggacagcaauggugcgaggugcagucacaggucgaccagaagaauuuccuaaguuacgauugugguagcgacaaaguucucuccaugggccaucuggaggaacaacuuuaugccacugaugcuugggggaagcagcuggaaauguugcgcgaggugggacagcgacuccgucuggaacuggcagacacggagcucgaggauuuuacccccucuggcccuuuaacacugcagguaagaaugucgugcgaaugugaggccgacgguuacauuagggggucauggcaauucagcuuugauggacggaaauuccuuuuguuugacaguaacaaucgcaaguggacugugguccacgcuggcgccagaaggaugaaagaaaagugggagaaggauuccggccugaccacauucuuuaaaauggugucuaugcgggacugcaagagcuggcuacgcgauuuccucaugcaucgaaagaaaagacuggagccaaccgcgcccccuacuauggcaccagggcuugcccagcccaaagcuaucgccacaacccuguccccuuggucauuuuugauuauccucuguuucauacugccaggaaucuga

SEQ ID NO: 64555 - RNA, 3153 nt, Artificial Sequence
  derived and/or modified sequence opt3 from ULK1__Homo_sapiens__NP_003556
auggagcccggcagagggggaaccgaaacaguggguaaguucgaguuuagcaggaaagaccugaucggccacggggccuucgcugucguuuuuaagggacggcaucgcgaaaaacacgaucucgagguggcaguaaagugcauuaacaaaaagaaucuugccaagucccagacucuguugggcaaagaaauaaagaucuuaaaagagcugaagcaugagaacauuguggcgcuauacgacuuccaagaaauggcuaauucugucuaucucgugauggaguacuguaacgguggggaucuggccgacuaucuucacgcaaugcgaacgcugucagaagauaccauccguuuguuucuccagcagauugccggagcuaugagacugcugcauaguaaaggcaucauacacagggaccucaagccucagaauaucuuacugagcaacccagcaggccggcgcgccaauccgaacuccauuagaguuaagaucgcugauuucggguuugccagguaccuucaaucuaauaugauggcggcaacauugugcggaucgcccauguauauggccccugaggugauuaugucacagcacuacgacgguaaagcugaucuguggagcaucggcacuauagucuaucagugucuaaccgggaaggccccauuccaggcaaguucuccccaagaccuccggcuguuuuacgagaaaaacaagacacuugugccuaccauuccacgcgaaacuuccgcuccccugcgacaguugcuccuggccuuacugcagagaaaucauaaagauaggauggacuucgaugaguuuuuccaccauccuuuucucgacgcgagcccauccguacggaagucaccgcccguuccugugccaaguuaccccagcucuggauccggcucaagcaguucuuccagcucgacaucucaccuugccuccccuccaucacugggugaaaugcagcaauugcagaaaacccuagcaagucccgcugacacggccggguuccugcacagcucccgugauucuggaggcagcaaggacucaaguugcgauacugacgauuucgucauggugccggcucaguuuccuggcgaccucguggccgaggcacccuccgccaagccaccucccgauagccugauguguucugggucaagucuugucgcuagcgcgggacuggaaucccauggucgcaccccaucucccucgccuccaugcagcuccucaccgagucccucuggcagagcagggccuuucagcuccucaagguguggagccagcguuccaauccccgugccuacacaaguacagaacuaucagcggauugagcgaaauuugcagucuccaacucaauuucagacaccccgcuccagugcuaucagaaggagcggcucuaccuccccgcucgguuucgcccgggcaucaccuaguccacccgcccacgcugagcaugggggcgugcuggcccgcaaaaugagcuuaggaggcgggagaccuuacacccccucgccacaggucggaacgaucccugaaaggcccgguugguccggcacuccaucuccgcagggggcagagaugcguggaggccggagcccucgacccgguucaagugcgccagaacacucccccagaacaucugggcugggcugcaggcuacauagcgcuccuaaccucuccgaccugcacgugguucgcccaaaacuucccaagccuccgaccgauccauugggagccguguuuucacccccucaagcaagcccaccccagccuagucacggccugcagucuugucggaaucucagaggguccccgaagcugcccgacuuccuucagaggaacccacugccucccauuuugggaagcccaacuaaagccgucccuucguuugauuuccccaagacaccaucaucucaaaaccuccuggcuuuacuggcccgccagggugugguaaugaccccgccucgaaaucggacgcuacccgaccucagugagguuggcccauuucaugggcagccccugggaccuggccuucguccaggugaagaccccaaggggccuuucggcagauccuuuagcaccucuagguugacagaucugcuccugaaagcagcuuucggaacucaggccccggacccaggcagcaccgaguccuuacaagagaagcccauggaaauagcgccuucagccggguuuggaggcagucugcaccccggugcucgcgcagggggaacaagcucuccauccccuguggucuucacugugggcucacccccaagugguagcaccccuccgcagggcccccggacaagaauguucuccgccgggccaaccggaucugcuucgagcucagccaggcaucuugucccuggccccugcuccgaggcaccagcgccugaauugcccgccccggggcacggauguaguuuugcugauccaaucgccgcaaaccucgagggcgcugugacuuucgaagccccugaccugcccgaggagacgcuaauggaacaggagcacacagaaauucugcgaggucuccgcuuuacccugcuuuucguucaacauguguuggagaucgcagcccugaaagggucugcuagcgaggcggccggaggcccagaauaucaguuacaggaguccguagucgcagaucagauaucacuccugucucgggaaugggguuuugcugagcaacuugugcuguacuugaagguugccgaacuccugagcaguggccuacaguccgccauugaccagaucagagcugggaaacugugccucagcucuacugugaagcaggucgugaggcgucugaaugagcuuuauaaggcaucaguaguguccugccaaggauugagucugcgcuuacagcgguucuuucucgauaaacagagacugcuugacaggauccacagcauuaccgccgagcgacugaucuucucgcaugcgguucagaugguccaaucugcugcccuagaugaaauguuucagcaccgggagggcugugugccccgcuaccauaaggcacuccuguugcuggaaggguuacagcacaugcucuccgaccaagccgauauugagaacgugacaaaaugcaagcuguguauagaaagaaggcuuagcgcucuguugaccggaaucugcgcauga

SEQ ID NO: 64556 - RNA, 3111 nt, Artificial Sequence
  derived and/or modified sequence opt3 from ULK2__Homo_sapiens__NP_001136082
auggagguggucggcgacuucgaauacagcaagagagaucugguugggcacggagccuuugcugugguauucaggggucggcaucgccagaaaaccgacugggagguggcaaucaaguccauuaacaaaaagaaucucucuaaaucacaaauacuucugggcaaggaaaucaagauuuugaaagaguuacagcacgaaaacaucgucgcccuguaugaugugcaggagcuacccaauaguguuuuucucgugauggaguacugcaacgggggagaccuggcggauuaucuucaggcuaagggcacacugagcgaagacacuauucgagucuucuugcaucaaaucgccgcagccaugcguauacuccacuccaaagguaucauucauagagaucugaagccucagaauauccugcucucuuacgcuaacaggcggaaaucgucagugagcgggauucgcaucaagauagcagacuuuggauucgccagauauuuacacaguaauaugauggcugccacgcuguguggcuccccaauguacauggcgccggagguaauuaugucucagcacuaugaugcaaaggccgaccuuuggagcaucggcaccguuauuuaccagugcuugguggggaaacccccuuuucaagcuaacuccccacaggaucugaggauguucuacgaaaagaaucggucacuaaugcccaguaucccucgcgagacaagcccauaucucgccaaccugcuucugggauugcuccagcgaaaucagaaagacagaauggauuuugaggcauucuuuucucaucccuuccuggaacaagguccugucaagaaauccuguccagugccggugcccauguacucaggcagcgucagugggucuuccugcggaagcucgccuucuuguagguuugcuuccccacccucauuaccugacaugcagcacauccaggaggaaaaccugaguagcccaccccucggcccgccuaauuaucuucaaguuuccaaggacucugccagcacuucaaguaaaaacuccagcugcgauaccgacgauuucgugcugguaccccauaauauuucuucagaccacaguugugauaugccaguggguacagcggggcggcgugccagcaacgaguucuuggucugcggaggccagugucagccuaccgugaguccccacucugaaacugcaccaauacccguuccuacacagauccgcaacuaccaaagaauugagcagaaucuaaccucgacggcuagcuccggcacuaacgugcaugggucaccaaggagugccgucgugcggcgaucuaauaccagcccgaugggauuucugcgccccgguuccugcucaccuguaccagcugacacagcccagacuguuggcagaaggcucagcaccgggucuucccggcccuauaguccuagcccacuggugggaacaauccccgagcaguucucucaauguugcugcggccacccgcagggucaugauucccgcucaagaaacaguagcgggucgccugucccacaggcacagucuccccaaucccuucugagcggcgccagguugcagucagcuccuacccucacggacauauaccagaauaagcagaagcugcguaaacaacacagugaucccguguguccaucccauacuggagcgggcuauucuuacagcccucagcccucccggccagggucauuaggaacaagcccgaccaagcaccuggguaguucuccucgauccagcgacugguuuuucaaaacuccccuaccaacaauuaucggcucgcccaccaagacgaccgcaccuuuuaaaaucccaaagacacaggccucaucuaaccuccuggcucuugucacuagacacgggcccgccgaggaacaaaguaaggauggaaaugaaccuagggagugcgcacauuguuugcuggugcagggcuccgaacgccagcgggccgagcagcaaagcaaagcuguuuucgguagaucugugagcaccgggaagcucuccgaccagcagggcaaaacaccgauuugcaggcaccagggaucaacugacagucugaacaccgagcgcccaauggauaucgcccccgcaggcgcgugugggggaguacuugcuccuccagccgguacagcagccagcucuaaggcuguccuguuuaccgugggcucacccccucauuccgccgcagcuccgacuugcacgcacauguucuugcgaacacggaccacuuccguugggcccagcaauuccggaggcucucucugugccaugucgggucgugugugcgucgggagcccaccuggccccggauuuggcucauccccaccuggggcggaagccgcucccagucugagauacgugccauauggagcaucuccgccuagcuuagagggccugauuaccuucgaagcccccgagcuaccagaagagacacucauggagagggaacacaccgacacucugcgccaucuuaacguaauguugauguuuacagagugugugcuggaucucacggcuaugcggggugggaaucccgaacugugcaccuccgccguuucauuauaccaaauacaggagucugucgugguggaccagaucagccagcugaguaaagauuggggaagagucgagcaacuuguuuuguauaugaaggcagcgcagcuccuggccgcuucccuacaccuggccaaggcacagauuaaaagcggcaagcucucuccuucaacugcugugaaacaagugguaaagaaccugaaugaaagguacaaauucuguaucacaaugugcaagaaacuuaccgagaaguugaaccgauuuuucuccgacaagcagcgcuucaucgaugaaauuaauagugucacagccgagaaacugauauauaacugcgcaguggaaaugguucagagcgccgcuuuagacgagauguuucagcaaacugaggauaucguguaccgguaucauaaggcggcccuccugcuugaaggucugucgagaauuuugcaggacccagcagauaucgagaacguccacaaauacaaguguucuauugaaaggcgucucuccgcucugugccauagcaccgccacgguguga

SEQ ID NO: 64557 - RNA, 1419 nt, Artificial Sequence
  derived and/or modified sequence opt3 from ULK3__Homo_sapiens__NP_001092906
auggccggccccggguggggaccuccaagacuggacgguuucauccucaccgagaggcuuggcagcgggacauacgcuacuguguauaaggcauacgccaaaaaggauacgcgggaagucguugcgauuaaaugcguggcuaagaaaucccugaacaaggccucuguagagaauuuguuaaccgaaauagagauccugaagggcauucgccacccgcauaucgugcagcuaaaagacuuucaaugggauucagacaacauuuaucucaucauggaguucugugcaggaggugaucugagucgauuuauacacacacguagaauccuucccgaaaaggucgccaggguguucaugcagcagcuggcuagcgcauugcaguuucuccaugagcggaauauuucccaccuggaccugaaaccucaaaacauccucuuaucuucgcuggaaaagccacaucuuaaauuggccgauuucggguuugcucagcacaugucacccugggacgagaagcacguucugcgcggaagcccucuauacauggccccagaaauggugugccagagacaguaugaugcgagggucgaccucuggaguaugggcgugauucuguacgaggcacuuuucggccaacccccuuuugccucccggucuuucagcgagcuggaagagaagauccgcuccaaucgaguaauagaauugccacucagaccgcuguuaucaagggauugucgggaccugcuccagcgucuucuggagcgcgaucccaguagaaggauuagcuuucaggacuucuuugcucauccuuggguugacuuggaacacaugccaucuggggagucccuaggacgggccacugcacuggugguccaggcugugaaaaaggaucaagagggugacucagccgcggcccucagccuguauugcaaagcacuugauuucuucgugcccgcucugcauuacgaagucgacgcccagcgaaaggaggcuaucaaagccaagguuggccaguacgugagucgcgcagaagaguugaaagccauuguaucuuccagcaaccaagcucuccugagacaggggaccucggcgagggauuuacugcgggaaauggcacgcgacaagccuagacuacucgccgcucuggagguggccucugcagccauggcuaaggaggaagccgcaggaggcgagcaggaugcgcuugacuuguaucagcacucccugggugaacuccugcuucuguuggcugccgagccacccgggaggcgucgggaacuccugcacacagagguccaaaauuuaauggcacgagccgaguaccugaaagaacaggugaagaugagagagucaaggugggaagcugauacccuagacaaagagggacucagugagagcguucgcuccucuuguacucugcaguga

SEQ ID NO: 64558 - RNA, 3828 nt, Artificial Sequence
  derived and/or modified sequence opt3 from ULK4__Homo_sapiens__NP_060356
auggagaacuucauccuguacgaagagauuggcagagggagcaagaccguggucuauaaaggaaggcggaaggguacaauaaauuuuguugccauccucugcacugacaaauguaagcgccccgaaauuacgaacugggugcgacuuacccgugagaucaaacacaagaauauuguaacauuccaugaaugguacgagacuuccaaccaccugugguugguggucgaguuaugcaccggcgggucucugaagacagugaucgcucaggaugaaaaucuaccugaggacguugugagagaauuuggaauagaucucaucucaggccugcaucaccuucauaaacuggguauuuuguucugugacaucaguccaaggaagauucuccuggaggggccgggaacccugaaauuuagcaacuucugccucgcaaaggucgagggcgaaaauuuagaggaauuuuucgcccugguggcggcugaggaaggcgggggagauaacggugagaauguacuuaaaaaguccaugaagucucggguuaaaggcucgcccguguauacugccccugaggucgugcgcggggcagacuuuucaaucagcagugauuuguggucccugggaugucuacucuacgaaauguucucuggcaagccacccuuuuucagcgaguccauaucagaacugacagagaaaauucuuugcgaagacccucugccacccaucccuaaggauaguagcagaccaaaagccucuuccgacuuuauuaacuugcucgauggucuguuacaaagggacccgcagaagcggcugaccuggacgcgccuccuucagcacucauucuggaaaaaggcuuucgcaggggccgaucaggagagcaguguggaggaccugucuuugucccgaaauacuauggaauguagcggaccccaagacucgaaggagcuacugcagaacucucaguccagacaggcuaaaggccacaagucaggccaaccucucgggcauaguuuuaggcuggaaaauccaaccgaguuccggcccaaaagcacacuugaaggacagcugaacgaguccauguuuuugcucucuagccguccuacuccacgcaccucaacagccgucgagguuagucccggugaagauaugacccacugcuccccgcagaagacgagcccucugacuaaaaucacaucuggccauuuaucacagcaagaccuggagagucagaugagagaacuaaucuauaccgauagcgaccucgugguaacucccauuauagauaauccaaagaucaugaagcagccucccgugaaauucgacgcgaagauucugcaccuuccaacauacuccgucgauaaauugcuguuucucaaggaccaagauuggaacgacuuccugcaacagguguguucucagaucgauucgaccgagaaaagcaugggggcauccagggccaagcugaaccuguugugcuaucucuguguuguggcuggacaccaagaggucgccacgcggcuguuacauucaccccuguuucagcuacucauacagcaucugcgaauugcaccuaauugggacauccgcgcuaagguggcccacguaaucggccuuuuggcgagucacaccgccgaacugcaggagaacacaccaguuguggaagcaauuguccuccugacugaguuaaucagagaaaauuucaggaacucuaaacugaagcaaugccuuuugccgacccucggugagcugauuuaccuaguggcuacacaggaggaaaagaagaaaaauccccgggagugcugggccgucccucuggcugccuacacugugcucaugcgcugucugagagaaggggaggaaaggguugugaaccauauggcagccaagauaaucgagaauguaugcaccacauuuagcgcucagucccagggcuucauuaccggagagaucggcccaauccuuugguauuuguuucgucacucaacugcggacagccugcggauuacggcagucucugccuuaugucgaauaacaagacacucccccaccgcuuuccaaaacgugaucgaaaagguugggcucaauagugugauuaacagccuggccucugcaaucugcaaaguccagcaguacaugcuuacucuguuugccgcuauguuguccugugguauucaucuccagaggcugauccaagagaagggauucgugucaaccauaauccgccuacuggauaguccuagcacaugcauucgggccaaagcauuccucguacugcuuuauaucuugauuuacaauagagaaaugcuguuacucucgugucaggcgaggcuggugauguauaucgagcgcgacucccgaaagaccacuccaggcaaagaacagcaaucugggaacgaguaccuuagcaagugccuggaucuacucauaugucacauuguucaggagcugccccggaucuugggagacauucuuaauucauuagcuaacgucaguggccguaaacauccguccacaguccaggugaagcagcucaagcugugccuuccucugaugccagugguuuugcaccucgugacgucucaaguguuuagaccccagguagucaccgaagaguuccuguuuagcuaugguacuauccuaucccacauaaaaucaguggauagcggggaaacaaauaucgacggcgccauuggacugaccgcaagugaggaguucaucaagauuacacuuucugccuuugaagcuaucauacaguacccuauucuccugaaagauuacagguccacuguuguggacuauaucuugcccccacuggucagcuuagugcagucgcaaaacguugaguggcgccucuucucacugcggcuucugucugaaaccacgaguuugcucgugaaccaggaguuuggcgaugggaaggaaaaagccuccguagacagcgauucuaaucugcuagcacugaucagagacguccuucucccucaguacgagcauauucuguuggagcccgauccagugccggcuuaugccuuaaagcugcucguggcgaugaccgaacacaacccuacauucacuaggcuggucgaggaaagcaaacuuaucccccugauuuuugagguuaccuuggaacaucaggaguccauacuaggaaauacaaugcaaucagugaucgcccugcucaguaaccugguagcuuguaaagacagcaauauggagcuuuuauacgaacagggucuggugucucacauuugcaaccucuugacugagaccgcaacgcugugccucgacgucgauaauaagaacaauaacgaaauggccgcuccacugcuuuucucccuguuggacauccuacauucaaugcugacauauaccaguggcauugugcgacucgccuuacaggcacagaaaagcggguccggagaggauccccaggcggccgaagaccugcuucugcucaaucgcccuuugacugaucugaucucucuccugauaccacuucuacccaacgaggacccugagaucuuugauguuucgagcaagugucugucaauuuuggugcaguuauacggcggugaaaauccggacucccugaguccagagaacgucgaaaucuucgcucaccuccugacaucuaaagaggaucccaaggagcagaaacuucugcuccggauuuugagaaggaugaucaccagcaaugaaaagcaccuggagucccuaaagaacgccgggucacugcuccgugcacuugaacgccuggcuccuggcucuggcagcuuugccgacagugcaguggccccauuagcuuuggagauacugcaagcgguuggacauuga

SEQ ID NO: 64559 - RNA, 1923 nt, Artificial Sequence
  derived and/or modified sequence opt3 from UMOD__Homo_sapiens__NP_001008390
augggccagcccagccugaccuggaugcucaugguggucguugccuccugguucaucacaacugcugcaacggacaccucugaggccagauggugcucagaaugucacaguaacgcgacaugcacugaggaugaagcugugaccacauguaccugccaagagggguuuacuggagacggucuuacauguguagaucuggacgaaugcgccauuccuggcgcacauaauuguagcgccaacuccucuugcgugaauaccccagggucguucucaugugucugcccggagggauuuagguugagccccggcuuagguuguacggauguggacgagugcgcugaaccugggcugagucacugccaugcacuagccacuuguguuaacguggucggauccuaccucugcguguguccagcuggcuaucggggcgauggguggcacugcgaguguucucccggaagcugcgguccuggccuggacuguguaccagaaggggaugcccuuguuugcgcggaccccugucaggcacaucgcacccuggaugaguacuggcgauccacagaguauggagaaggcuacgccugcgacacugauuugcgugguugguauagauucguggggcagggaggcgcuaggauggccgagaccugugucccugugcuccggugcaauacagcagcuccaauguggcugaacggcacccacccgucaagugacgaagggauagugagccgcaaggccugcgcgcacuggucuggacauuguugccugugggacgccuccguccagguuaaagcaugugcugguggcuacuauguguacaaucucacggcucccccugagugccacuuagccuacuguacugauccaucaagcguagaagggacaugcgaggaguguaguaucgacgaagauugcaagucuaacaauggaagauggcauugucaaugcaaacaggacuuuaacauuaccgauaucucccugcuugagcacagguuggaauguggcgccaaugacaugaaggugagccuggguaaaugccagcuaaagucgcucggguucgauaaggucuuuauguaucugucugacucccggugcucaggcuucaacgaucgcgacaaucgagauugggugaguguugugacucccgcaagagacggaccuuguggcacaguccuuaccaggaacgagacgcacgccaccuacagcaauacacuguauuuggcugacgaaauuaucauacgggaucucaacaucaaaauuaacuuugcgugcuccuacccacuggacaugaaggugucuuuaaaaacugcacugcagcccaugguaagcgcccucaauauccguguugggggaaccgguauguucacagugcgcauggcucuuuuucaaacuccgucauauacccagccuuaccagggcaguuccgucacacugagcaccgaggccuucuuguauguggggacuaugcuagauggaggcgaccugucuagauuugcacuccugaugacgaacuguuacgccacacccucaaguaaugcuaccgauccacuuaaguacuucauuauccaggacaggugcccucauacucgggauagcaccauacaagucguggagaacggugaauccucucaggggcgauucucgguucagauguuucgcuucgccggcaauuaugaccugguguacuugcacugugagguauaucucugcgauacaaugaacgaaaaauguaagccaaccugcagcggaacuagauuuagguccggcucagucauugaccaaagucgggugcugaauuuagggcccaucacacgcaagggaguucaggcaacggugucuagagcguucagcucccugggucuacucaaagucuggcugccccuuuugcugucagcuacccucacucugacauuucaguga

SEQ ID NO: 64560 - RNA, 3957 nt, Artificial Sequence
  derived and/or modified sequence opt3 from UMODL1__Homo_sapiens__NP_001004416
augcugagaaccagcggccucgcccuucuggcuuugguguccgcagucgggcccucucaggccucaggauucacagagaaggguuuaagucugcuaggcuaccaacucugcagccacaggguuacucauacggugcagaaaguagaagcggugcagaccuccuauacaucuuacgucucgugugggggauggaucccuuggcggcgcugcccaaagaugguguaucgaacucaguaccugguuguggaggucccggaaucacguaacgugaccgacuguugcgagggcuaugaacaacuuggucuguacuguguauugccccucaaucagagcgggcaguuuacaaguagaccuggagcuugcccagccgagggccccgagccuuccaccucuccauguagccuggauauugacugccccggccuggaaaaauguugcccuugguccgggggaagguauuguauggcaccagccccgcaggcucccgagcgggauccuguugguucaugguacaacgugacuauacucgucaagauggacuucaaagaauuacaacagguggauccacgccugcuuaaucacaugagauugcugcauagucuagugacaagcgcacuccagcccauggccucuaccguccaccaucugcacuccgcuccuggcaacgccucaacgacuguuagcaggcuucuguuggggcucccacggccccugccgguggcggacguaaguaccuuacugggagauaucgcaaagcgcguguacgaggucauuucugugcagguucaagacgugaaugagugcuuuuaugaagaacucaacgccugcuccggccgagaacuuugugcuaaucuggaggguagcuacuggugcgucugucaccaggaagccccugcaacaucgcccagaaaguugaaccuagagugggaggauugcccaccugugucugacuauguaguucugaaugugacuuccgauucauuccaggucaguuggaggcucaacagcacccaaaaucauacauuucacgugcgggucuaccgugggauggaacugcuucgcuccgcuagaacccagucucaggcccuggcgguggccggauuggaggcaggcguucucuauagggugaaaacgagcuaccagggcuguggggcugacguaucaacuacacugaccaucaagacuaacgcccaagucuucgaagugacaauuaaaaucguuaaucauaacuuaaccgagaagcugcuaaaucggaguuccguggaauaucaggauuuuagccgacagcuccugcacgaggucgagucuucauuucccccagugguaagugaccuuuaccgcagcggaaaauugagaaugcagauagugucccugcaagcugguucuguugucgugaggcucaagcugacggugcaggaccccggcuucccuauggggaucucgacccuugccccaauucugcagccguugcucgcaagcacagucuuccagaucgaucggcaaggaacucgcguucaggacugggaugaaugcguggacuccgccgagcacgauuguucacccgcugcguggugcauuaaccuggaaggcaguuacaccugucagugcagaacaacuagggacgcaaccccuucucgugccggucgggcuugugagggggauuuagugagcccaacaggcggaggccuguccgccgcaaccgggguaacuguccccggacuagguacgggcacagccgcucucgggcuggaaaacuuuacccuuucaccuagcccaggauauccccagggcacuccggccgcaggucaagcguggaccccugagccaucuccccgaagagggggcuccaaugugguuggauacgacaggaacaauacaggcaaggggguggagcaggaauugcagggaaacaguaucauggagccucccagcuggccaucuccuaccgaagaucccacuggucauuuccuguggcacgcuacacgcuccacgcgggagacccuccugaauccaacuugguuaagaaacgaggacucaggcccgagugggagcgucgaucugccucuuacaucgaccuugacagcccucaaaacucccgcaugcgugccaguuuccauaggaaggauuauggugucuaauguaaccagcacgggcuuucaucuggccugggaagcugaccuagccauggacucaaccuuccaacugacacucacuagcauguggucccccgcagucgugcuggagaccuggaacacaucugugacucuuagcgguuuggaaccugggguccugcacuuaguugagaucauggcuaaggccugcggcaaagaaggagcgcgcgcccaucucaaggugcgaaccgcugcacggaaacugauuggcaagguacguaucaaaaaugugagauauuccgagucauucaggaacgccagcagucaggaguaccgcgauuuucuugaacuguucuuucggauggucagagggucuuugccagcuacgaugugucagcacauggacgccggaggcgugaggauggagguuguguccgucacaaaugguagcaucgugguugaguuccaccuccugauuauagcagauguggacguccaggagguaucggcggccuuucuaaccgcuuuccaaacugugccccugcucgaaguuauccgaggggauacauuuauucaggacuaugaugagugcgagcgcaaggaagacgauugugugccuggaaccucaugccggaacacucugggcucuuucaccuguaguugcgaggguggcgccccggacuuuccagucgaauacuccgagagacccugugaaggggauagcccuggaaaugagacaugggcaacgucuccagagaggccccuuaccacugcuggcacaaaggccgcauucgugcaggggaccagcccuacaccgcagggauugccccaacgucugaacuuaacuggcgccguacgcgugcucugcgaaaucgagaaagucguuguggcuauacagaagcgguuucugcagcaggaauccauuccagagucaagucuuuaucugagccauccuucuuguaaugugucccacucaaacgguacccauguccuacucgaggcgggguggagugaaugcggaacgcugaugcaaagcaacaugacaaauaccgugguuagaacuaccuugaggaacgaccugucccaggagggcaucauccaccacuuaaaaauucucucucccaucuacugugccuuccagaaugaucugcuuacaucgagcgguuuuacucuggaauggggcguauacaccauuauagaggacuugcauggggcaggaaacuucgugacagaaaugcaacucuucaucggcgacucaccaauuccucagaauuauuccgucagugcuucugaugacgugcgaaucgagguugggcuguaccggcagaagaguaaccuaaaagugguccugacggagugcugggccacccccuccucaaaugcccgcgauccaaucacuuuuucuuucauuaacaauagcugcccggugccuaacacauauaccaauguaauagaaaacggaaauaguaacaaggcucaguuuaaacuuagaaucuucuccuuuauuaaugacagcaucgucuaccuccacuguaagcugagggugugcauggagucucccggcgcaacuuguaagauuaacugcaacaauuuccgguugcugcaaaacucagaaacauccgccacccaucagaugaguugggguccauuaauccgaagcgagggggaacccccucacgcggaggcuggacucggcgccgguuauguugugcugauagucguggcaaucuuuguucuuguggccggcacggcuacucuguugauugucagauaccagcgcaugaaugggagguauaacuucaaaauccagucgaauaacuuuucuuaccaaguguucuacgaguga

SEQ ID NO: 64561 - RNA, 1443 nt, Artificial Sequence
  derived and/or modified sequence opt3 from UMPS__Homo_sapiens__NP_000364
auggccguggcuagagcagcccugggcccccucgucaccgggcuuuacgacguucaggcguucaaguuuggagauuucgugcugaaaagcgguuuguccucuccuaucuauauugacuuaaggggcauaguaucacggccacgccugcuaagucaaguggcugauauccucuuucagacagcccagaacgcagggauuagcuucgacacugucugcggagugccguacacggcccugccccuugcuaccguuaucuguuccacaaaucagauuccuaugcugauccgacguaaggagacuaaagauuauggcaccaagagauugguggaagguacaauaaacccaggggagaccugccucaucauugaagacgucgugacuucuggaucgucaguacuggagacaguugaagugcugcaaaaagagggccucaaggucaccgaugcaaucguguuacuggacagggagcagggcgggaaggauaaacuucaggcccacgguauucgguugcauagcguguguacgcugaguaagaugcuagaaauccucgagcagcagaaaaaggucgacgcugaaacuguuggucgcgugaaaagauuuauacaagagaauguauucguggccgcgaaccacaauggcucuccccuguccauuaaggaggcaccuaaggaacuuagcuuuggggccagggcugagcugccacggauccaucccgucgccuccaaauugcuccgccugaugcagaagaaagaaaccaacuuaugccugucagcagaugugagucucgcucgagagcuucugcaguuggccgacgcgcuaggaccuagcauuuguaugcugaagacacacguugauauccucaaugacuucacucuggacgugaugaaagaacuuaucacccuggccaagugccaugaguuuuugauuuucgaggauagaaaauuugcagacauaggcaacacagucaagaagcaauacgaaggugggaucuucaaaauugcuucuugggccgaucucgugaaugcucacguaguuccaggauccggcguggucaagggccugcaggaggugggguuaccgcugcacaggggaugucuacucaucgccgaaaugucaagcaccgguagucuggcaacgggcgacuauacucgggccgcuguccguauggcggaggaacauucugaguuugugguuggguucauauccggaagccgcgugucgaugaaacccgaguuccuucacuugacaccuggcguacagcuggaagcaggaggggauaaccucggccaacaguacaauucuccacaggaggucauuggaaagagaggcuccgacaucaucauuguggggaggggaaucauuucagccgcugaucggcuggaagccgcagagauguaucgaaaagccgcuugggaagccuaccuuagucgccuggguguuuga

SEQ ID NO: 64562 - RNA, 723 nt, Artificial Sequence
  derived and/or modified sequence opt3 from UNC119__Homo_sapiens__NP_005139
augaaggugaaaaagggcgggggaggugccggcaccgcuacagagagcgcacccgggccuuccggacagucugucgccccaaucccgcagcccccugcggaaucagagaguggcagcgaauccgagccagacgcuggucccgggccuagaccaggaccccugcagaggaaacagccuauuggcccagaagauguucucggccuucagcggauaacuggggacuaccugugcucuccggaggagaacaucuauaagauugauuucgugcgcuuuaaaauccgagacauggauucgggaacgguauuguucgaaauuaagaagcccccugugucagagcguuuaccaaucaauagaagggaccuggaucccaacgccggucgguuuguccgcuaccaauucaccccugcauuucuaagacucaggcaagugggcgccacaguugaguucacugugggggacaaaccagucaauaacuuucggaugauagaacgccacuauuuccgaaaucagcugcuuaagagcuuugauuuccauuuuggauucuguauccccaguuccaaaaauaccugcgagcacauuuacgacuuuccgccucugucugaagaguugaucagcgaaaugauuagacaucccuaugagacacaguccgauucauucuacuucguggacgauaggcucguaaugcacaacaaggcugacuauaguuacagcggcaccccauga

SEQ ID NO: 64563 - RNA, 5112 nt, Artificial Sequence
  derived and/or modified sequence opt3 from UNC13A__Homo_sapiens__NP_001073890
augagccugcucugcgugggcgucaagaaagccaaguucgacggggcucaggagaaauuuaacaccuacguuacacuuaaggugcaaaauguaaaauccacuacgaucgcagugagaggcucucagcccucaugggaacaggauuucauguuugagauuaacagacuggacuuggguuuaaccgucgaaguguggaauaagggccugauaugggauacaaugguugggacuguguggaucccucuacggaccauucgccagaguaacgaggaaggaccaggcgaguggcucacacuggacagccaagucaucauggccgauuccgagauuugugguaccaaggacccgacuuuccaccgaauccuucuggauacacguuuugaauugccccucgacauaccugaggaagaggcgagauauugggcuaaaaagcuggagcagcugaaugccaugagggaucaggacgaauacucuuuccaggaugagcaagacaaaccacuccccgugccuucgaaccagugcuguaauuggaacuauuuuggguggggagaacagcauaaugaugacccagacucagcaguagaugaccgggauagcgacuaccgcagugagaccuccaacucuauaccaccuccauauuacacgacuagccagccgaaugccuccguucaccaauauucagugagacccccuccauuaggcaguagggaaagcuacucugauuccaugcauucauacgaggaguucagcgaaccccaggcucugaguccuaccggaucuucccgguaugcaagcucgggggagcuuucucagggauccucacaauugagugaagacuuugauccagacgagcacagccugcaggguuccgauauggaagacgagcgcgaucgagacucuuaccauagcugccacucaagugucuccuaucacaaggacagccccagaugggaucaggacgaggaagaacuggaagaggaucucgaagacuuccuggaggaggaggaacuuccggaagaugaggaggaacuggaggaagaggaagaggaggugccugacgauuugggcucuuacgcccagagggaagacguggcugucgccgagcccaaagauuuuaagcggauuucacugcccccugcggcacccgggaaggaagacaaagccccaguugcucccacagaggccccugauauggcaaagguggcuccaaaaccggccacucccgacaagguaccugcggccgaacaaaucccagaggcagagcccccuaaagaugaagagaguuuccguccacgcgaagacgaggaaggacaggagggccaggacagcauguccagagcuaaggccaacuggcucagggcuuuuaauaaagugcggaugcaguuacaagaggcccgaggugaaggggagaugucuaagucgcugugguucaagggaggccccggcgggggacucauuaucauagauagcaugccggacauucgcaaaagaaagccuaucccacuugucuccgaucuggcaaugucauuggugcagaguaggaaagccgguauuaccucugcucuagcgagcuccacacugaacaaugaggaacucaagaaccauguuuauaaaaagacccugcaggcacuuaucuaccccaucucauguacgacuccucacaacuucgagguguggacagccaccacucccacauauugcuacgaaugugagggccuguugugggggauugcucggcagggaaugcgcugcaccgaauguggcgucaagugccaugagaaaugucaagaccuccugaaugccgauugcuuacagagagcagccgaaaagagcucuaaacacggugcugaggacaggacgcagaacauaaucauggugcugaaggaucguaugaaaauucgggagcgaaauaagccagaaaucuuugagcuaauacaggaaauuuucgccguaaccaagacagcacacacucaacagaugaaagcgguuaagcaguccgugcucgacgggaccaguaaauggagcgcuaagaucucuaucacagucgugugcgcccaaggccugcaggcaaaagauaagacuggauccucagacccuuacgucaccgugcagguuggcaagaccaagaagagaaccaaaacuauuuaugggaaccuuaaucccgugugggaggaaaacuuucauuucgagugucacaauaguagcgauaggaucaagguacgcgucugggacgaggaugacgacauuaaaucgcgggugaagcagagauuuaaaagggaauccgaugacuucuugggacaaacgauaaucgagguucgcacacugucuggugaaauggaugugugguacaaccucgacaagcgaaccgauaagagcgccgucucaggcgcuauucggcugcauaucaguguggagaucaaaggggaagagaagguagccccauaucacgugcaguacacuugccuucaugagaaucuguuucacuucguuaccgacguccagaacaauggaguggugaaaauuccggaugcaaagggcgacgaugcuuggaaagucuauuacgacgaaacagcccaggagauaguugaugaauuugcgaugcguuaugguguggaguccaucuaccaagccaugacccacuucgcuuguuugucuagcaaguacaugugcccuggggugcccgcaguaauguccacucuccuggccaacauuaaugcuuauuacgcccauacaacggcaucaaccaacgucagcgcgagugacagauuugccgcuucuaauuucggcaaggagagguuugugaaauuacuggaccagcuacacaacucccuccgcaucgaucugagcauguaucggaacaauuucccagccucgucacccgaaagacuucaggacuugaagucuacuguugaucugcucacaaguauuaccuucuuuaggaugaaagugcaggagcugcaauccccuccacgagcaagccaggucgugaaggacuguguuaaggcuugcuuaaacucuacauacgaauauaucuucaauaacugucaugagcuguacagccgcgaauaucagacugaucccgccaaaaagggagaggugcuuccugaggaacaaggcccguccaucaaaaauuuggacuuuuggucaaagcucaucacccugauuguaaguaucauugaggaagauaaaaacagcuacacgccaugccuaaaucaguucccccaggagcugaacgucgggaagaucucugcagaagugauguggaaucucuuugcccaggacaugaaauacgcuauggaggagcacgauaagcaccggcuguguaaguccgcggacuauaugaaccuucauuucaaagugaagugguuguacaaugaauaugucaccgagcugccugccuuuaaagauagaguuccagaauaccccgcaugguucgagccuuuugugauacaaugguuagacgaaaacgaggagguaucaagggauuuccuccacggagcucuggaacgugacaagaaagacgguuuucagcagacaagugagcaugcccuuuucagcugcuccguggucgauguguuuucucagcugaaucaaucguucgaaauuaucaagaaauuggaguguccggacccccagauuguuggccacuauaugcgccgguucgccaagacuaucagcaacgugcuccugcaguacgcugauauaaucucaaaggacuuugcauccuauugcaguaaagagaaggaaaaagucccaugcauucuaaugaauaacacccagcaacugagagugcagcucgagaagauguucgaagccaugggagggaaagagcuggaugcggaggcuucugacauccuuaaggaguugcagguuaagcugaacaauguguuagaugagcucagcagggucuuugccacauccuuccagccucauauugaagaguguguaaaacaaaugggcgacauccugucacaggugaaggguacugggaacguucccgcaucugccugcagcaguguggcucaggaugcagacaauguccuucaaccaauaauggaucugcuagacuccaaccucacccuguuugccaaaauuugugaaaagacgguguugaaacgaguacugaaggaguuauggaagcucgugaugaauacaauggagaaaacaaucguccugccuccccuuacugaucagacaaugaucggcaaccuguugcggaagcacggaaaaggccucgaaaaggggcgcguuaaacugccaagccacucugacggaacccagaugauuuucaaugcggcuaaggagcuaggccagcugucaaaacuuaaagaccauauggugagagaagaggccaagucccucacuccgaaacaaugcgcaguggucgaacuggccuuggauaccaucaagcaguacuuucacgcugguggggugggacugaaaaagacauucuuagagaagaguccugaccuccagagccugagguacgcccuuucgcuguauacgcaggcaaccgauuugcucauuaaaacuuuuguucaaacacagucugcucagggccuggguguagaagaccccgugggcgaggucuccgugcauguugagcuauucacccacccagggacaggagaacauaaggugacugucaaagugguagccgcgaacgaucugaaguggcagaccagcggcauauuucggcccuucaucgaggucaauauuaucgggccucaacuuucagacaaaaagcgaaaauucgccacgaagaguaagaacaauucuugggcaccaaaauacaacgaauccuuucaguucacacucagcgcugaugccggacccgaguguuaugagcuacaggugugcguuaaggacuacuguuuugcuagagaagaucgcaccgugggcuuggcagucuuacaacugagggagcucgcccagcgugguucagccgcuugcuggcugccucuugggcggaggauucacauggacgauacuggacugaccguguugaggauccuaagucagcgcagcaaugacgaaguugcgaaagaguucgugaagcugaaauccgacacacgaucugcagaagagggcggugccgcuccggccccauga

SEQ ID NO: 64564 - RNA, 4776 nt, Artificial Sequence
  derived and/or modified sequence opt3 from UNC13B__Homo_sapiens__NP_006368
augagccugcucugcgugagagucaagagggccaaauuccagggcucccccgacaaguuuaacaccuacguuacacuuaaagugcaaaauguaaagucuacuacgguggcuguccgcggggaucagccuucaugggagcaggacuucauguuugaaaucagucggcuggauuugggauuaagcguggagguuuggaacaaaggucugauuugggacaccauggugggcacagucuggauagcacuaaagacuauccgacaguccgaugaagaggggccaggagaauggucuacccucgaggccgagacacugaugaaggacgaugaaauuuguggcacccguaauccgacuccccacaaaauccuucuggacacaagauucgaguugccuuuugauauuccagaagaggaggcgagguauuggaccuacaagugggaacaaaucaacgcucucggugccgacaaugaguauucgucacaggaagagagccagcggaaaccccugccuacggcagccgcucagugcaguuucgaagauccagacuccgcaguggaugaccgcgacucugauuacagaagcgagacuuccaacucauuucccccuccauaucauaccgccagucaaccgaaugcuagcguacaccaguuccccguuccugugaggucuccacagcagcugcucuuacaaggguccucacgggacagcuguaacgauaguaugcagucuuacgaccuggauuaucccgagcgccgagccauauccccuacaagcucgucuagauacggauccucaugcaaugucagucagggcagcucccaacuuucugaauuggaccaguaccaugagcaggaugacgaucacagggaaacugacagcauccauucaugucacaguucccacagccugucucgggauggccaggcgggguuuggagagcaagaaaagccacuagaggugaccggucaggcagagaaagaagccgcuugcgagcccaaggaaaugaaggaggacgccacaacccauccgccucccgaccucgugcugcagaaagaucacuuccuuggcccacaggaaucauuuccugaggagaacgcaaguagccccuucacgcaagcucgugcccauuggauucgcgcggucacuaagguuagacugcaguugcaggaaaucccagacgauggggaccccucccucccucaguggcugccagagggaccggccggcgguuuauaugggauugauucuaugcccgaccugaggcggaaaaagccucucccacuugugucggaucugagcuugguacaaucccgaaaagcaggaaucacaucagcuauggccacccgcacuucccuaaaggacgaagaacugaaaucucacguguacaagaagacacuccaggcucugauauaucccauuagcuguaccacgccucacaauuuugaggucuggaccgccacaacuccaaccuacugcuaugaaugugagggccuucuguggggcaucgcaagacaggggaugaggugcuccgaauguggagugaaaugccaugagaagugccaggauuugcucaacgccgacugucugcaacgggcugcggaaaaaucaugcaagcacggugcagaggaucgcacacagaauauuaucauggccaugaaagacagaaugaagaucagggagcguaacaagcccgaaauuuucgagguuauacgggauguguucacugucaauaaagcugcccaugugcagcaaaugaagaccguaaaacagagcguuuuagacggcacaucuaagugguccgcaaaaaucaccauuacuguggucugugcccaggggcugcaggcuaaggacaagacgggaaguagcgauccguacgugacaguccaagugucuaaaaccaagaaacgaacuaagaccaucuuuggcaaccuaaacccuguuugggaagagaaauuccacuuugaaugccauaauuccucagacagaauaaaggugaggguaugggaugaggacgaugacauuaagagucgcgucaaacagcggcucaagagagagagcgaugacuuccugggucagacaaucaucgaagugaggacccuuucgggggagauggauguuugguauaacuuggaaaaacgcacugacaaguccgccgugucuggcgcaauucgacugcagaucagcgucgagauuaaaggagaagagaagguggcgccauaccacguacaauacacaugucuccacgagaaucuguuucauuaucuuacggauauacagggcucagggggagugcggauccccgaagcucguggugacgaugccuggaaaguuuacuucgacgagaccgcacaggaaauugucgacgaguuugccaugagauauggcaucgagaguaucuaccaggcuaugacucacuucgccugccuguccucuaaguauauguguccuggggugcccgcagugaugagcacauugcucgcuaacauuaaugccuacuaugcgcauaccacagccuccacuaacgucucagcuagcgauagguuugcagccaguaauuucggaaaggaacgcuuuguuaaacuguuagaccaacugcacaacucucuacggauagaucucuccaccuacagaaauaacuucccagcuggcagcccugagaggcugcaggaccuuaagucgacgguggauuugcugaccucaaucacauuuuuccgaaugaaagugcaggaacuccaaucucccccacgcgccagucagguagucaaggacugcgugaaagcaugucugaauaguacuuacgaguauauuuucaacaauugccacgauuuauacagccggcaguaucagcugaagcaagaacuuccgccugaggagcagggucccucuaucagaaacuuggacuuuuggccaaagcucauuacccugaucguuagcauaaucgaagaggauaaaaauuccuacacacccgugcuaaaccaguucccucaggaacugaacgucgggaaggugucagcggagguuauguggcaucucuuugcccaagacaugaaauaugcucuggaggagcacgagaaggaucaucuuuguaaaagugccgacuacaugaauuugcacuucaaggugaaguggcugcauaacgaauauguaagggacuuaccaguccuccagggccaggugcccgaguacccugcaugguuugaacaguucgugcugcaauggcuugaugagaaugaagacgucagccuggaguuuuugcguggagcucucgagcgcgauaaaaaggacggcuuccagcagacuucugaacacgcccuguuuuccugcucaguuguggauguauucacccagcuaaaccaaaguuuugagauuauccggaaacuggaaugcccggacccaagcauucucgcacacuacaugagaagguucgccaagacgaucgggaaagugcugaugcaguaugcugauauacuuuccaaggacuuucccgcguacuguacaaaggagaaauugccuugcauucugaugaauaacguccagcaauuacgagugcagcucgagaagauguucgaagccaugggagguaaagagcuggaucuugaagcagcugacucucugaaggagcuacagguuaaacucaauaccgugcuggaugaauugucgauggucuucggcaacagcuuucaggugcggaucgacgaguguguucgccaaauggccgauauucugggacaggugagagggacuggcaaugccucaccagacgcuagggcauccgccgcgcaggacgcugauagugucuuacggccccucauggacuuccuggaugguaaccuuacacuguuugccaccguaugcgagaagacuguguugaaacgaguucucaaggaacuguggagaguggucaugaauaccauggagcgcaugaucgugcuaccuccgcugacagaccagacggggacccaacuuauauucacugcagccaaggaacucucucaucugagcaaauugaaggaucacaugguaagggaggaaacacguaaccugacccccaaacagugugcuguguuagaccucgcacuggauacaaucaagcaguauuuucaugccggcggaaauggccuuaaaaagacuuuccuggagaaguccccagacuugcagucacuccgguacgcgcugucucuauauacccaaacgacagauacccugauuaaaacuuuugucagaagccagaccacacaggggaguggaguugacgauccugugggcgagguguccauccaagucgaccuuuucacucaccccgguaccggggaacauaaggugacaguuaaaguaguggcugccaacgaucucaaguggcagacggcaggaauguuuaggccauucgucgaggugaccaugguuggcccucaccagagcgacaaaaagcgcaaguuuacuacaaaaucuaagucaaauaacugggcccccaaauacaacgaaaccuuccacuuccuguuggguaaugaggaaggcccagaguccuaugaguuacagauuugcgugaaggacuacuguuuugcucgagaagauagaguccuggggcucgccgugaugccgcugcgggacguaacugcaaaaggaaguugcgcuuguuggugcccucuuggcaggaagauccauauggaugagacagggcugaccauauugcgcauucuaagccaacguucgaacgacgaagucgccagagaguucgugaagcugaaaucugagucccggagcacggaagagggaucauga

SEQ ID NO: 64565 - RNA, 6645 nt, Artificial Sequence
  derived and/or modified sequence opt3 from UNC13C__Homo_sapiens__NP_001074003
augguggccaacuucuuuaagagccugauccucccauacauucacaaacuuugcaagggcauguucaccaaaaagcuggggaauacaaacaaaaauaaggaauauagacaacaaaagaaagaccaggauuuuccuacugcuggacagacgaaguccccaaaauucucuuacaccuuuaagucaacagucaaaaagauagcaaaguguaguagcacucauaacuuguccaccgaagaggacgaagccucuaaagaguucucguuaucaccgacauuuagcuauaggguugcgaucgcuaauggucugcagaagaacgccaaagugaccaauagugauaacgaagacuuacuccaagagcuguccucuauugagagcuccuacucagaaagucuuaaugagcugcggagcucuacugaaaaccaggcacaguccacacacaccaugcccguacgccgaaaucguaagucaagcaguucuuuggccccuuccgagggcagcucggauggggagagaacgcuccauggacugaaacugggcgcucucaggaaguuacggaaauggaagaagucucaggaaugcguguccucagacagugagcugagcacuaugaaaaaguccugggguauccgcucuaaaagccuugauagaaccgucaggaacccaaagacaaaugcauuggaacccggguucucaaguuccggauguauuagccaaacucacgacgugauggagaugaucuuuaaagaacugcagggcauaucucagaucgagaccgagcuaucagaacuccggggccauguuaacgcccugaagcacaguauugaugagaucagcuccucuguggaagucgugcagucggagauugaacaacuucgcacaggguucguacagagccgaagagagaccagggacauccacgauuauauaaagcaucugggacacauggguuccaaggcuucauugcgguuucucaauguuacggaggaacguuucgaguacguggaaagugucguguaucagauucugaucgacaagaugggcuuuucugaugccccuaacgcgauuaaaaucgaguucgcacaacgcaucgggcaucagagagacugcccaaacgccaagcccaggccuauuuuaguguacuucgaaacuccacagcagcgggacagcguccugaaaaaguccuacaagcucaaaggaacaggcauagguaucucaaccgauauucuuacucacgacauccgagagcgcaaggagaaagggauaccgagcucucaaacauaugaauccauggcuauuaagcugaguacccccgagccuaaaaucaagaagaauaacuggcagagcccagaugacucugaugaagacuuggaguccgaucuaaauagaaacucauacgccguucugaguaaaagcgagcuccugacgaagggaucgaccuccaaacccucuagcaagucacacagugcaagguccaaaaauaagacagcuaacucuagccggaucuccaauaaaucagacuaugauaagauuagcagucagcuuccugaaucugacauccuggagaagcagacuaccacacauuacgccgaugcgacuccauuguggcacucccaaagcgacuuuuucaccgccaaacucucgcgcucagaaucugacuuuaguaagcugugucaguccuauagcgaggauuucucugaaaaccaguuuuucacaagaaccaauggcagcuccuuacugucaaguagcgacagggagcuauggcagcguaaacaagagggcacugcaacgcucuacgauucucccaaggaccagcaucugaacgggggagugcaggguauucagggccaaacagaaaccgagaauacugaaaccguagauuccgggaugucaaacggaauggugugcgcuaguggcgaccggagccacuauuccgauucucagcuuucguugcaugaggaccugagcccguggaaagaauggaaucagggugccgaucucgggcuggacucauccacacaagagggcuuugauuacgagaccaacagucuuuucgaccagcagcuggaugucuacaauaaggacuuggaauaucucggaaagugucacucugaccugcaggaugacagcgaguccuacgauuuaacucaagacgauaacucaucuccuugccccggccuggacaacgaaccacaggggcagugggugggacaguaugauagcuaccaaggugcuaauaguaacgagcuauaucagaaucagaaccagcucuccaugauguaccgaagccaaucugaacugcagucagacgauuccgaggacgccccucccaaaaguuggcacagcagacuuucgauagauuugucugacaagacauuuuccuucccaaaauuuggcagcacgcugcagagggcaaagucagcccucgagguuguguggaauaaaaguacccaaucucuguccggguaugaagauagcggaucaaguuuaaugggccgcuuccggacucugagccaguccacagcuaacgagucuagcaccacacuugacuccgacgucuacacugaacccuacuauuacaaggcggaggaugaggaagacuauaccgagccuguggcagauaaugaaacggacuacguagagguuauggaacagguguuggccaagcucgagaacagaaccucaaucacagagacugaugaacagaugcaggcuuaugaccaucugucuuacgagaccccauaugaaacaccgcaggaugaggguuacgacgggcccgccgaugacauggucagugaagagggccuagagccucugaaugaaacuucggcagagauggaaauuagggaggaugaaaaccagaauaucccagagcagcccguggagaucaccaaaccuaagcgcauucgacccagcuuuaaagaagccgcucuccgggccuacaagaaacaaauggcagagcuggaagagaagauacuugcgggagacuccucuucagucgacgagaaggcucguaucgugagcggcaacgauuuggacgccuccaaauucagugcacugcagguuugugggggagccgguggcggguuauauggaauugauucuaugcccgaccucagaaggaagaaaacgcugccgaucgugcgcgauguagcuaugacacuugccgcacggaaaagcggccugucauuggcuauggucauuagaaccucccucaauaacgaagaacugaaaaugcacguguucaagaaaacucuacaggcccugaucuacccuaugaguagcacaauaccacauaauuuugaaguuuggaccgcgacuacccccacauauugcuacgagugugaaggucuccugugggggaucgccaggcagggcaugaagugccuugagugcggagugaagugucacgagaaaugccaagacuugcugaacgcugauuguuuacagcgagcagccgaaaagucuuccaaacacggcgcugaggacaagacgcagaccauuaucacugccaugaaagaacgcaugaagauucgggagaagaacagaccugaagucuucgaggugauccaggagauguuucaaauaucaaaagaagauuucguacaguuuacaaaggcagcgaaacagagcgugcucgacgggaccucgaaguggucugccaaaauuacaaucacuguugucagugcucaaggacugcaggccaaggauaagaccggcuccagcgaccccuaugugacggugcaggucgguaaaaauaagaggcguacaaaaaccauuuucgggaaccuuaauccaguuugggaugagaaguuuuacuucgaaugccauaacucaacugaccgcaucaaagugcgggugugggacgaggaugacgauauaaaguccagaguaaagcagcacuuuaaaaaggaaucugacgauuuccugggacaaaccaucgucgaggugaggacacuaagcggcgagauggacguuugguauaaucucgaaaaacgaacugauaagagugcaguguccggugcuauucggcugaaaaucaacgucgagauuaagggcgaagagaagguggccccuuaccauauccaguacaccuguuugcacgagaaucuguuucauuauuuaacagaaguuaaaagcaacgggggagugaagauacccgagguaaaaggcgacgaagcauggaaggucuucuuugaugacgccucucaggagauuguggaugaguucgcuaugcgcuacgggaucgagucaaucuaucaggcgaugacgcacuucaguugccucuccagcaaauacauguguccaggagugccggccgucaugucuacccugcuugcaaauauuaacgcuuuuuaugcccacacuacaguuucgaccaauauccaagugucagccagcgacagauucgcugcaacuaacuuuggcagggagaaguucauuaaacuguuggaucagcuccauaauucccugcggauagaccuaaguaaguaccgagaaaacuuuccugccucuaauacagagagacugcaggaccuuaagagcaccguagaucuccugacguccaucacuuucuuucgcaugaaaguguuggaacugcagucacccccaaaggcgaguauggucgugaaagacugcguuagggcuuguuuagauucuaccuauaaguacauuuucgacaacugccacgagcucuacagccaacugacagaucccuccaaaaagcaggacaucccucgugaagaucaggguccaaccacuaagaaccuugacuuuuggccccaacugauuacauugauggugaccaucauagaugaggacaaaacagccuauacuccuguccucaaucaguucccgcaggagcugaacauggggaagaucucagcagaaauuauguggacccuauuugcccuggauaugaaauacgcucuugaggaacaugagaaucagcggcucuguaagagcacggacuauaugaaccugcacuucaaagugaagugguucuacaaugaauauguuagagaguugccagcauuuaaggacgccgugcccgaguacucuuuaugguucgaaccuuuugucaugcaauggcuggaugagaacgaagacguauccauggaguuccuccauggagcgcugggcagggauaaaaaggacgguuuucagcagacaagugagcacgcucuuuucagcugcucggugguugauguguuugcccagcugaaucaauccuucgaaaucauuaaaaaguuggagugcccaaaccccgaagcacuaucucaccugaugcgccgauuugccaaaaccaucaauaagguccuccugcaguaugcugccauagugucaagcgacuucaguucccauugugauaaggagaacguaccuugcauucuuaugaauaacauccagcaguuaagagugcaacuggagaagauguuugagucuaugggcgggaaggagcucgacagcgaagcaucaacuaucuugaaagagcugcaggucaagcucuccggaguucuggaugaacuuagugugaccuacggcgagagcuuccaggugauuauagaagaguguaucaaacagaugucuuuugagcugaaucaaaugcgggcuaacgggaauacaacuucaaacaaaaauuccgccgcgauggacgccgaaauugucuugaggagccuaauggauuuccuggacaaaacccucucuuuaagugcaaagaucugcgagaagacggugcugaaacgcguucuuaaggaacuguggaaacucguauugaacaagauugagaaacagaucgugcugccgccccucacagaucagaccggaccacaaaugauauucaucgcugccaaggaccugggccagcuuucgaagcuaaaagaacacaugauucgugaggacgcuagaggucugacuccucggcagugugcaaucauggaggucguguuggccacaauuaagcaguacuuucaugccgggggaaacggccugaaaaagaauuuccuagaaaaaucccccgaucuccaaagccugagguaugcucuuucacuguacacccagacuacagacgcgcucaucaagaaguuuauagauacccagacgucucagagccgcuccaguaaagacgcaguuggucaaauuucagugcacgucgauaucacugccaccccaggcacaggggaccacaaggugaccguaaaagucaucgcuauuaacgauuugaauuggcagacaacugccauguuccgaccuuuuguggagguuugcauccugggacccaaccuaggcgacaagaaaagaaagcaggggaccaagacgaaaucuaauacauggagcccaaaguauaacgaaacuuuccaguuuauacugggaaaagagaaucggccgggcgcauacgagcuccaucuuuccgugaaggauuauuguuucgccagggaagaccgcauuaucgguaugaccgucauucaacugcagaacaucgcugagaaagggaguuacggagcgugguauccuuuauugaagaauauaagcauggaugaaacaggccugaccauucucagaauccugucccagaggacuucugacgacguggccaaagaguuuguucggcuuaagucagaaacccguagcacagaggagucggcauga

SEQ ID NO: 64566 - RNA, 3273 nt, Artificial Sequence
  derived and/or modified sequence opt3 from UNC13D__Homo_sapiens__NP_954712
auggccacccugcucagccacccccagcaaagaccuccauuccuuaggcaggcuaucaagauucggcgccgacgugugagagaccugcaggauccgcccccucagauggcaccagagauacaacccccuucccaucacuuuucuccagaacagagggccuuguuauacgaggacgcgcuguauacaguccuacaucggcucggccaccccgaaccuaaccauguuacugaggcuucagaacugcuucgcuaccugcaggaggccuuccacguggagccagaagaacaccagcaaacguugcagagaguaagggaacucgagaaaccgaucuuuugccugaaggcaaccgugaaacaggccaaggggauucugggaaaagaugucagugguuucagcgaccccuauugucucuuaggcaucgagcagggggugggaguuccuggcgguuccccagggucucggcaucgccaaaaggcugugguccgacacacaauucccgaagaggaaacucauagaacccaggugaucacacagacccugaauccuguaugggaugagacuuuuauacuugaguucgaggacaucacaaacgcaucguuucacuuggauaugugggaccuggauaccguugagucagugaggcaaaagcuaggagaacucacggaccugcacggccuucggcguauuuucaaagaggcccgcaaggauaaaggccaggacgauuuucuggggaaugucguguugagacuccaggaccugaggugccgggaagaccagugguacccauuagagccccgaacugaaaccuauccggaucgcggacaaugucaucugcaguuccagcucauccacaagagaagggcuacaagcgccagucggucccagccuucuuacacugugcaucuucaccuguugcaacagcuagucagccaugagguuacccagcacgaggcggguuccacaucaugggacggcagucugagcccccaggcagccaccgugcucuuucugcacgcuacgcaaaaagaucuuucugacuuccaucaguccauggcccaguggcuggcauauucacgcuuguaccagagccucgaauuuccaaguucuugccuguuacacccuauuacuuccaucgaguaccaauggauacaggggagacugaaggcugaacagcaagaggaacuagccgcgagcuucucgucucuccugacauauggacuuuccuugauuaggcguuuccggucaguauuuccccugagugugagcgauuccccagcccgacuccagucucugcuuagaguccuggugcagauguguaagaugaaagcauucggcgaguugugccccaacaccgcuccucucccacagcugguuacugaggccuuacaaacagguaccacggaaugguuucaucugaagcagcagcaccaccagccgauggugcaagggauccccgaggcuggaaaagcccuacucggccugguccaggacgugauuggcgaucuucaucagugucagaggaccugggacaagaucuuccacaauacauugaaaauccaucuguuuagcauggcauuccgcgaacuccaauggcugguagccaagcggguucaggaucacacuaccguggucggggacguggucucaccugagaugggagagaguuuauuucagcuguacauuucccuuaaagaauugugccaacucagaaugagcagcucagagagggauggugugcuggcucuagacaacuuccaucgcugguuucagccagcgauacccaguuggcugcagaagacauauaaugaagcacucgcccgaguucagcgggcugugcaaauggacgagcugguaccucuuggcgaauugacuaagcacagcaccuccgccgucgaucugucuacauguuucgcacagaucucgcacaccgcccgucaguuagacuggccagaucccgaggaggcuuuuaugauuacugugaaauucguugaagacacgugcagacucgcccugguguacuguagccuuaucaaggcaagggcgcgcgagcuguccucagggcagaaagaucaaggacaggcugccaacauguugugcgucgugguaaaugacauggaacagcuccggcuggugauaggcaagcuaccggcacagcuggccugggaggcucucgaacaaagaguuggugccguccuggagcaggggcagcuucagaacacauugcaugcacaacugcagagugcuuuagccggccucggacacgagauuaggaccggcgugcgaacucuggcggaacagcuugagguggggaucgccaaacauauccaaaagcuggucggaguucgcgaaucugugcuaccugaggaugcuauucucccacugaugaaguuuuuggaaguggagcugugcuauaugaauaccaacuuaguacaggagaauuucagcucccuccugacacuucuguggacccacacuuugacaguccucguggaagcagccgcuucacagcggucuucuucccuggccaguaacagacuaaaaaucgcacugcagaaucuugagauuuguuuccaugcggaagguugcggccugcccccuaaggcccuccacacggcuaccuuucaagccuugcagagggaccuggaguuacaggcagcuagcucucgugagcucauacgcaaauacuucuguucccggauccagcaacaggccgaaacuacaucagaggaacugggggcaguuaccgugaaggccaguuauagagcuagcgagcagaaacuuagggucgaacuguugucggcguccucucuccugccccuagauagcaacggaucaagugacccauuugugcagcugacacuugagccucgacacgaguuccccgaacucgccgcacgggagacucaaaagcauaagaaagaucugcacccauuguuugacgaaaccuucgaguuuuuaguuccggcugaaccuugccgcaaggccggcgccugucugcuccugacggugcuugauuacgacacccugggugcugacgauuuggagggggaggcauuccuaccccugagagaaguaccaggccucuccggaucugaggaacccggcgaggucccucagacaaggcugccacuuacuuaccccgccccuaacggggacccgauuuuacagcugcucgaaggacggaaaggugaucgagaggcgcaaguguuugugagauugcgcaggcaucgugcuaagcaggccagccagcacgcacugcggccagcccccuga

SEQ ID NO: 64567 - RNA, 2790 nt, Artificial Sequence
  derived and/or modified sequence opt3 from UNC45A__Homo_sapiens__NP_001034764
augaccgccagcuccguggagcagcugagaaaggaaggcaacgaacucuucaaaugcggggacuacggaggugcucuugcagccuauacacaagcgcugggcuuggaugcuacuccccaggaccaggccgucuuacacaggaaucgggcagccugucaucugaagcuagaagauuacgacaaagcugagacggaagcaucuaaggccaucgagaaagaugggggagacguuaaggcucucuaucgccgaucacaggcccuggagaaacuuggccgucuggaucaagcgguguuggaccuccagagaugcguaagucuggaaccuaaaaacaagguguuucaggaggcacugaggaauauuggugggcagauacaagaaaaaguccgguacaugagcuccaccgaugccaagguggagcagauguuccagauccucuuagacccagaggaaaaaggaacagagaagaagcagaaggcuucucaaaaccugguugugcuugcccgcgaagaugcaggcgcugagaagauuuuuagaucgaauggcguccaguugcugcagaggcuacucgacaugggggaaacugaucugaugcuugccgcgcugcggaccuuggugggaaucuguucagagcaccaaagccgcacaguagccacccucaguauucuggguacucgaagaguuguguccaucuuaggcgucgagucucaggcagugagccuggcugccugccaucuccuucaggugauguucgacgcucugaaagaaggggucaagaaaggauuuaggggcaaggagggugccauaaucguugacccggcacgggaauugaaagugcuaauuuccaaccugcucgaucugcuuacagagguaggggugucaggacagggccgugacaaugcccugaccuugcucaucaaggcugucccccgcaagagucugaaagauccuaacaauagcuuaacgcugugggugauugaccaaggccuaaagaaaauccucgaaguugggggaucucugcaggauccacccggugagcuugcggugacugcaaacuccagaaugucagccagcauauugcugaguaaacucuucgacgaucugaagugugacgcugagagggaaaauuuucaccggcuuugcgagaacuauauuaagucuugguucgaaggccaggggcuggccggaaaguugcgagcaauccagaccgucuccugucuccugcaaggcccuugcgaugccgguaaucgcgcuuuagagcugagcggggugauggaaucgguaauugcccuaugugcaucugagcaggaggaagaacagcucguugcgguggaagcucugauccaugccgcaggcaaagccaagagagcuuccuuuaucacagccaacggagucucacuuuugaaagaccuguacaagugcagugagaaagauagcauuaggauacgggcacucgugggccuguguaaguuaggguccgcuggagguacugacuucucuaugaagcaguuugccgagggcagcacccugaaacuugcgaagcaaugccgcaaaugguugugcaaugaccagaucgaugccgggacaagaaggugggcugucgaaggacucgcauaucugaccuucgacgccgaugugaaggaggaauuuguugaggacgcugccgcacuaaaagcgcuguuccagcucucacgucuggaggagcggagugugcuuuucgccguagcuuccgccuuggucaacuguacgaacagcuacgauuacgaggaaccagaccccaagaugguggagcuggcaaaguaugcuaaacagcacguuccugaacaacacccaaaggauaaaccgucuuuugugcgagccagagucaagaaauuacucgcagccggcgugguaucagcuauggugugcaugguuaagacugagagucccguccugacaagcuccuguagggaacuucugucucgcguguucuuggcgcucguggaggaggucgaagaccgggguaccguuguggcccagggaggcgggagagcacugauuccucuagcucuggagggcacugauguggggcagacaaaagccgcccaagcucucgcaaagcugaccaucacgucgaauccagaaaugaccuuucccggagagaggauauacgaaguaguccgcccucuugugagcuugcugcauuuaaacugcuccggucuccagaauuucgaggcccugauggcgcuuacaaaccuggcuggcauuucagagcgacuacggcagaagauccucaaagaaaaggccguuccaaugaucgagggguauauguuugaggagcacgagaugauucguagagcagccacugaauguaugugcaaucuggcuaugaguaaagaggugcaggacuuguucgaagcacaaggaaacgauaggcugaaguuacucguccuguacucuggcgaggacgaugaacuucugcagcgcgccgcggcugguggguuggccaugcucaccagcaugcggcccacacuguguuccagaaucccucaggugacuacccauuggcuagagauucugcaggcacuucuccugucaagcaaucaagaguugcagcacaggggcgccguugugguacugaacauggucgaggcuucucgagaaauagccuccacauuaauggaaagugagaugauggaaauccucagcgugcuggcaaaaggagaccacucuccggugacccgcgcugccgcggccugccuugacaaggcagucgaguauggccugauucagcccaaucaggauggggaguga

SEQ ID NO: 64568 - RNA, 2790 nt, Artificial Sequence
  derived and/or modified sequence opt3 from UNC45B__Homo_sapiens__NP_001253981
auggccgagguggaagcuguccagcugaaggaggaaggcaacagacacuuccaacuccaggacuacaaagcagccaccaauagcuauucccaggcgcuuaagcugacaaaagauaaggcuuuguuagccacucuguacaggaaccgggcagccugcgggcuaaaaacggagucuuauguucaggcugcaucagacgccagucgcgcuaucgauauuaauagcuccgacauaaaggcccucuaccgacguugucaagcgcuggaacaucuuggaaagcuggaucaggcauuuaaagacgugcagagaugcgccaccuuggagcccaggaaccagaauuuccaagagaugcuccggcgccugaacacaucuauccaggaaaagcugagaguacaguuuucgacugauucaagggugcagaaaauguucgagauucucuuagacgaaaauagcgaggcugauaagcgggagaaagccgcaaacaaucugaucguccuuggucgcgaagaggcuggcgccgaaaagauuuuucaaaacaaugggguggcguugcugcuacagcuccuggacaccaagaaaccugagcuuguucuggccgcagugcgaacauugaguggaauguguuccggccaccaggcuagagccaccgucauccuccaugcugugaggauagaucggaucugcucucugauggccguagaaaacgaggagaugagcuuagcaguuuguaaucugcuccaagccauuaucgacucccuuucaggugaagauaagcgugagcaccgcgggaaagaagaggcucugguguuggacacuaagaaagaccuaaagcagauuacaagucaucugcucgauaugcuggucagcaaaaaggugucuggacagggcagagaccaggcgcuuaaccuguugaauaagaacgugccaaggaaagaucucgcaauccacgacaacucccggaccauauaugucguugauaauggccugcgaaagauuuuaaaagugguagggcaagugccggaccugcccucaugccuaccucucacggauaacacucgcaugcuggccagcauccuuauuaauaaguuguacgacgaucugagaugugacccagaaagggaucacuuccggaaaaucugcgaggaguauaucaccggaaaguuugacccccaggacauggauaagaaccucaaugcuauucagacagucagugguauacugcagggcccuuucgaccuugggaaccaacuguugggacucaaaggcgugauggaaaugaugguugcccugugugguucugagcgcgaaacugaucaguuaguggcagucgaggcccugauccaugcuuccaccaagcuaagcagagccacauuuauuaucaccaauggggugucgcuccugaaacagauauacaagacgacuaaaaacgaaaagauuaagaucaggacacuuguaggauugugcaaacugggcucugcaggcgggaccgacuacggacuccgucaguucgcggaggguuccacugagaagcuggcuaaacaaugucggaagugguuaugcaauaugucaaucgauacacgaaccagaaggugggccguugaaggccuggcauaucuuacguuggacgccgaugugaaagacgauuuuguccaggacgugccagcucuccaggccauguucgagcuggcaaagaccagugauaagacaauucuauacagcgucgcuacuacccuggugaacugcacaaauuccuaugacguuaaagaagugauccccgagcucguacagcuggccaaguuuucuaaacaacacgucccugaggaacauccaaaggauaaaaaggacuucauugacaugcgcgugaaacggcuuuugaaggcggggguuauaagcgcccuggcuuguauggugaaggcagauucagccaucuuaacugaccagaccaaagagcuccuggcuagagucuuccuugcccugugcgauaacccgaaggacaggggaacaauuguggcacagggcggugggaaagcguugaucccccucgcccuggaaggcaccgauguaggaaaggugaaagcugcccacgcacuagcuaagaucgccgcaguuaguaauccugacauugccuuuccaggcgagcgcgucuacgaaguggugcgaccccugguccggcuccuggauacucaacgugacgggcuucagaacuaugaggcuuugcugggauuaacgaaucucuccgguagaagcgauaagcugaggcagaaaauauucaaggagcgcgcgcuuccugacaucgaaaacuacauguuugagaaccacgaucagcugcggcaagccgcaacagaauguaugugcaauaugguucuacauaaagaggugcaggaaagauuccucgcugacggcaacgauaggcugaaguuggugguacuguuauguggggaggacgacgauaaaguccagaaugccgccgcuggagcacucgccaugcugaccgcggcucacaagaaacuuugccugaagaugacucaggugaccacacaaugguuggagauucuccagcgacugugucuacaugaccagcugucuguucagcaccgcggccuugugaucgccuauaaccuccuggcagccgaugcugaauuggcaaagaaacuggucgagucagaauuacucgagauucugaccgugguugguaagcaagaaccagacgagaaaaaggccgaggugguacagacugcgcgggaaugccuuaucaaguguauggauuacggguuuauaaaacccgucaguuga

SEQ ID NO: 64569 - RNA, 2529 nt, Artificial Sequence
  derived and/or modified sequence opt3 from UNC5A__Homo_sapiens__NP_588610
auggccgugagacccggccuguggccugcucuccuugggaucguccuggcagccugguugaggggaagcggugcgcagcaauccgcuaccguugccaacccagugccgggcgcaaaucccgacuuacugccucacuuccuaguagagccagaagauguguacauugucaagaacaaacccgugcuccugguuugcaaggccgugccugcuacacagauauuuuucaaauguaauggggaguggguccgccagguggaccauguaaucgaacggucuacugauggaucaaguggccuuccaacgauggagguucgaauuaacgugagccgucagcaagucgaaaagguguuuggucuggaggaguauuggugccaguguguggcaugguccucuucggggaccacaaaaucacagaaggccuacaucagaauugcuuauuugaggaagaauuucgaacaggagccccucgccaaagaagucagccuggagcaaggaaucguucugccuugccggccaccggagggcauacccccugcggaaguggaguggcuccgcaacgaagacuuaguagauccaagucuggaccccaauguguacaucacuagagagcacucccuugucgugaggcaggcacgguuggccgauaccgcuaacuauacauguguugccaagaauauuguggcacgccgaagaucugcuagcgccgcggucaucguguacguagacggcuccuggucaccuuggaguaaauggagcgccugcgggcuggauuguacccauuggaggucucgggaaugcuccgacccagcaccccguaacggaggugaggagugucagggcacugaucuagacacacgcaauugcaccucagaucucuguguucacacggcuagcgggccggaagacguggcccuguaugucggacuuauugcuguggccgucugccugguguugcuccuguuaguucugauccucguguacugcagaaagaaagagggccuugacagugauguagcagacucuuccauacugacuagcgguuuucagccugucucgauuaagcccucuaaggccgauaacccacauuugcuaaccauccaaccugaccuguccacaacuaccacaaccuaccaggggucacucugucccaggcaggauggaccaagucccaaauuccaacugacgaauggccaccuucugagcccuuugggcgggggacggcacacucuccaucacuccucuccaacaagcgaagcugaggaauuugugucacgacugaguacccagaacuauuuccgcuccuuaccgagagguacuagcaauaugacauacggcaccuuuaacuuccuagggggaaggcugaugauucccaacacgggcaucucucuccugaucccuccagacgcgauuccccgggguaagauauaugagaucuaccuuaccuugcauaaaccugaggauguucgccugccacucgcagggugccagacacugcuuucacccauugugaguuguggcccgccuggaguccuguugacuagaccagugauccucgccauggaccacugcggcgaacccagcccugauuccuggucucugagguuaaagaaacagucgugugaggggagcugggaagacguacugcaccuaggagaggaagcucccucccaucucuauuacugccaacuggaggccucagcauguuauguguuuaccgagcagcuuggucguuucgccuugguuggcgaagcucugagugucgccgcagcgaagcggcucaaacuguuacuguuugcuccaguggccugcacaucucuugaguacaauauacgaguguacuguuugcacgauacucaugacgcacucaaggaagucguucagcuggagaagcagcuagggggacaacugauucaggagccuagagugcuccacuucaaagacagcuaucauaaccugaggcuuuccauccacgaugugcccagcucauuguggaagucuaaacuguuaguauccuaccaggaaaucccauucuaucacauuuggaauggcacccagcgcuaccuccauugcacauuuacccuggagcgggucaguccgagcacuucugaccuugccuguaagcuguggguguggcaaguugaaggugaugggcaguccuucucaaucaacuuuaauauuacgaaagacacaagauucgcugaguugcucgcccuggaaagugaggcaggcgugccugcucuagucggacccagcgccuuuaagauaccauuccugaucaggcagaagauuaucucgucccucgaucccccuugccgccgaggcgcggacuggcggacccuggcccagaaacuucacuuggauucucaucugagcuuuuucgcuucaaagccaagucccacugcaaugaucuuaaaccucugggaggcccgucacuuuccuaaugggaaccugucccaacuugcugccgcaguggcgggacugggucagccggacgccggccuauucaccguuucugaagcugagugcuga

SEQ ID NO: 64570 - RNA, 2805 nt, Artificial Sequence
  derived and/or modified sequence opt3 from UNC5B__Homo_sapiens__NP_001231818
augggcgccagaagcggggcuaggggagcacugcuccuugcccuguuguuaugcugggacccccggcugucccaggcggguaccgauucuggcucagaggugcuaccugacaguuucccaagcgcuccggccgaaccccucccuuacuuucugcaagagccacaggaugcauauaucgucaagaacaaacccguugaacuucgcugucgagccuucccugcuacacagauuuacuuuaagugcaauggggagugggugucccagaacgaccacguaacucaagaaggacuggaugaggcaacgggcuugcgugugagagagguccagauagaagugucuaggcagcagguugaggaacucuucggucuggaggacuauuggugucaaugcguggccuggucgucagcugggaccacaaaaagccggcgcgccuacgucagaaucgcguaucugaggaagaauuuugaucaggagccacucggaaaagaagugcccuuagaccaugagguacugcuucagugucggccuccagaaggcguuccgguggcagaggucgaaugguugaagaacgaggaugugauugaccccacucaggauaccaauuuccugcuaacaaucgaccacaaccucauuauccgccaagcccgacugagugauaccgcuaauuacacuugcguggccaagaacauagucgcaaaaagaagguccacaaccgcuacgguuaucguguauguaaauggcggguggucuagcugggccgagugguccccuuguucaaaccggugcggacgugguuggcagaagcgcacuagaaccuguacaaauccagcgccccuuaacggcggggccuuuugcgaaggacaggcauuccagaaaacugcuuguaccacaauuugcccuguggacggcgccuggaccgaguggaguaaguggagcgcuugcucuacggaaugugcccauuggaggucccgggagugcauggcaccacccccgcaaaauggugggcgagacuguucaggaacucuguuggauagcaaaaacugcacagacggccucuguaugcagaugcuggaagccaguggcgaugcugcguuauacgcagggcuggucguggccaucuuuguuguggucgcuauucucauggccgugggaguaguuguguaccgcagaaauugcagggacuucgauaccgacaucacugauucuuccgcagcccuuacagguggcuuucacccugucaacuucaagaccgcucggcccagcaacccacagcuguugcauccuucggugcccccagaccuaacggccucugcagggauauaucgcggacccgucuacgcgcugcaagauuccaccgacaagauuccuaugacaaauucaccacuccuggauccgcuucccagucugaaagugaagguuuauagcuccucuacuaccggcagcgguccuggguuggcugacggcgccgaccuccugggaguguuaccacccggcacauacccuucagauuuugcaagagacacucacuuccugcaccuaaggagugccucccucgggagccagcagcugcuuggauugccacgugaucccgguucuucaguaaguggcaccuucgggugucugggaggccggcucagcaucccggguacaggggucucccugcuugugccuaacggcgcuauuccacagggaaaauuuuaugagauguaccuguugaucaauaaggccgagucuacccucccccugucggaaggcacucaaacgguuuuaagcccuuccgugacaugcgggcccaccggacugcuacucugucgaccagucauccugacuaugccucauugcgcagaggugucagcuagagacuggauuuuccagcuuaaaacccaggcccaccagggucauugggaagagguagugacauuggaugaagagacccugaacacucccuguuauugccaacucgagccaagggcgugccacauacuguuagaccagcugggcacauacguuuuuacgggggaaaguuacucucgcagcgccgucaagcggcuucaguuggcuguguucgcaccggcccucuguaccucccuggaguauucacuaagaguguacugccuggaagauacuccugucgcucucaaagagguucuggagcuugaaaggacauugggaggcuaucugguggaggaacccaagccauuaauguuuaaggacagcuaccacaaucuccgccugucucuucaugaucugccccacgcccauuggcgauccaaauugcucgcaaaguaucaggagaucccuuucuaccacauuuggagugguagccaaaaagcgcugcauuguaccuuuacacuagaacggcacucucuggccuccacugagcugaccugcaagaucugugugcgucagguagagggggaaggccagauauuccaacuccacacgacccuugcugagacaccagccggaucauuggacacucugugcagugcacccggcagcaccgucacaacucaguuagggccuuaugcuuuuaaaauuccgcucucgaucagacagaagaucuguaacucccuggaugccccaaauucuaggggaaacgacuggcgcaugcuugcacagaagcugagcauggaucgguaccuaaauuacuucgccaccaaggcuucacccacgggcgugauucucgaccugugggaagcguugcaacaggacgauggugaccugaacaguuuagccuccgcacucgaggaaauggggaaaucugagaugcugguugcuguggccacagauggagacugcuga

SEQ ID NO: 64571 - RNA, 2796 nt, Artificial Sequence
  derived and/or modified sequence opt3 from UNC5C__Homo_sapiens__NP_003719
augagaaagggccugagggccaccgcugcacggugcgggcucggacuugguuaccuguugcagauguuagugcugcccgcccuagcgcuccugagcgcuuccggcacagggucugccgcacaagacgaugacuucuuucacgagcuuccugaaacuuucccaucagauccgcccgagccucugccacauuucuugaucgaacccgaggaagccuauauugucaaaaacaagccuguuaaucucuacuguaaagcuaguccagcaacgcagauauauuucaagugcaacagcgagugggugcaccagaaagaccauaucguagaugagcgcguggacgaaaccuccggacugauuguccgagaggugucuaucgaaauuucgcgucagcaaguugaggagcuguuuggccccgaagauuacuggugucagugcguggccuggucaagcgcugguacaacuaagaguagaaaggccuaugucaggaucgcguaccuccggaaaaccuucgagcaggaaccuuuagggaaggaggugucccuggaacaggagguacuuuugcaaugucgcccaccggagggaauacccguugcagaaguggaguggcugaaaaaugaagacaucauugauccugucgaggacagaaacuuuuauaucacaauugaucacaaucuaaucauaaagcaggccaggcucucugacaccgcuaacuacacuugcguggccaaaaauauuguggcaaagcggaaguccacaaccgcuacggucaucguuuacgugaacggcggcugguccacuuggaccgaauggucaguauguaauagucgcugcgggcgaggauaucagaaaagaacaaggacuuguaccaacccagcuccccugaaugguggcgcguucugcgaggggcagagcgugcaaaagauugccuguacaacccuuugcccugucgauggacgguggacgccauggucuaaaugguccacuugcggcacagaguguacccauuggcgucgcagagaaugcacugcacccgcuccgaagaacggugggaaagacugugacggacugguguugcagucaaagaauugcacagauggccucuguaugcagaccgccccugacagcgaugacguugcucuguacgugggcaucgucaucgccgugauuguaugcuuagcaauaaguguuguggucgcccuguuuguguauaggaaaaaccaccgggauuucgagucugacaucauugauuccagcgcucucaaugggggauuucaacccgucaacaucaaggcggcacgacaggaccuucuggccgugccaccugauuugacgucggcugccgcaauguaccgcggucccguuuaugcccuacacgacgugucugauaagauaccaaugaccaacucccccauucuggacccucucccaaaucugaaaaucaagguauacaacacaucaggcgcugucacuccgcaggacgaucuuagugaauuuaccagcaaacugagcccccagaugacacaaucuuugcucgagaaugaagcccugagcuuaaagaaccagucacuggcaagacagacugacccuaguuguaccgcguuuggguccuucaauagccuaggaggccaucucaucgugccaaacucugguguuucacugcuuauucccgcuggggccaucccucagggcaggguguaugagauguacgucacagugcaccggaaagagaccaugcgcccacccauggaugacagucaaacuuugcugacgccgguagugagcugcggaccuccaggcgcacuccugacaagacccguuguccuuaccaugcaucacugugccgauccuaauacugaagacuggaagauucuguugaagaaccaggcugcccaggggcagugggaggaugugguggucguuggagaagagaauuucaccacacccugcuacauacaacucgacgcagaggcuugucacauccugaccgaaaacuuauccacuuaugcccuggugggucauucuacaacgaaagcggccgcuaagaggcuaaaacucgcaauuuuuggcccacugugcugcucgagccuugaguacuccauccguguguauuguuuggaugacacccaggaugcccugaaggaaauccuccaccuggagcggcagaugggagggcaguuacuggaagaaccuaaagcccuucauuucaagggcucaacucacaauuugcgacucaguauucaugacauagcccacucucuguggaaaagcaagcuacuggcaaaguaccaagagauccccuuuuaucacguaugguccgguucacagagaaaccuccauugcacauucacccuggaaagguuuagccuuaauacagucgaguugguguguaaacugugcguucgccagguggaaggggagggccaaauuuuccaguuaaacuguacugucucugaggagccaaccggaaucgaucucccgcugcuugacccugcgaauacgauuaccacagugacuggccccuccgccuuuaguaucccacugcccauacggcagaaguugugcagcucucucgacgcuccucagaccagagggcacgauuggaggaugcuggcccauaaacuaaaccuggaccgcuaccucaacuauuucgcaacaaaguccucaccaacuggaguuauccuggaucuuugggaggcucaaaauuuucccgacgguaacuugaguaugcuggccgcaguguuagaagagaugggccgacacgaaaccguagucagccucgccgcugaggggcaguacuga

SEQ ID NO: 64572 - RNA, 2862 nt, Artificial Sequence
  derived and/or modified sequence opt3 from UNC5D__Homo_sapiens__NP_543148
augggcagagccgcugcaaccgccgggggagguggcggggcgaggcgguggcugcccuggcucggacuuugcuucugggcugccggcacagcagccgcucgcgguacugacaacggggaggcacugccugaaagcaucccauccgccccgggaacguugccccacuuuauugaggaaccugaugacgcuuacauaaucaagucuaauccaauugccuuacgauguaaagcgcgucccgcaaugcagaucuucuuuaagugcaacggcgagugggugcaucaaaaugaacacgucucagaggagacccuggaugaaaguagcggccuaaaaguuagagagguguucauuaacguaacaaggcaacagguggaagacuuucaugggccugaggauuauuggugucagugcgucgccuggucccaccucggaacuucuaagucgcggaaagccucagugcgcaucgcuuaccugagaaagaauuucgagcaggacccacaggguagggaaguucccauagagggcaugaucgugcuucauugucggccuccagaaggggucccggcagcugagguggaauggcugaagaacgaggagcccauugauagcgaacaggacgagaauaucgauacccgcgccgaccacaacuugauuauccgacaggcgagacucagugauuccggaaauuauacaugcauggccgcaaacauaguagcuaaaaggcggucucugagcgccaccguuguggucuacgugaauggcgguugguccucauggacugaauggagugcuuguaacgugcguugcgggcgcggauggcaaaagagaagcaggacauguaccaauccugccccacugaacggcggcgcauuuugcgaggggaugucuguccagaaaauuacguguacuucccucugccccguugacggaucaugggaaguguggagcgaguggaguguaugcucuccugagugugaacacuuacggauccgagagugcaccgccccacccccgcgcaaugguggcaaguucugugaagggcugucccaggagagcgaaaacugcacagauggacuuuguauuuuggacaaaaagccucugcaugagaucaagccccagucgaucgagaacgcuucugacauugcgcuauauuccggccucggugcagccguggucgcuguggccguucuggugauaggggucacucuuuacagaaggucacaaagugauuauggcguggacguaaucgauagcuccgcacugaccggaggcuuucagacauucaauuuuaaaaccguucggcaggggaacucuuugcuccugaauagcgccaugcaaccagacuuaacggugucacgcacuuacaguggaccuauuugccugcaggauccccucgacaaggaacuuaugacagaguccagccuguucaacccauugucugauaucaaagucaaggugcagucaaguuuuauggucagccuagguguguccgaaagagcugaguaccacggcaaaaaucauucuaggaccuucccccacgggaacaaucacucguucagcacuaugcauccucguaacaagaugccauauauacagaaucuguccucacucccgacacggaccgagcugcgaacgaccggaguuuuuggccaccuuggugggagacuggugaugcccaacacaggcguaaguuugcucauuccucauggagccaucccagaagaaaauucuugggaaaucuacaugagcauuaaccaaggcgagcccucccugcagucagacgggagcgaagucuuacugucuccugaggugacuuguggaccacccgauaugaucguuaccacaccguucgcacuaacuauuccucacugcgcggacguguccagugagcauuggaauauacaccucaaaaagaggacccagcaggguaagugggaagaggucaugagcguggaagaugagucuacauccuguuauugccugcuugacccauuugcuugucacguauugcuggacucauucggcaccuacgcccucacuggggaacccaucacggauugcgcagugaaacaacugaagguugccgucuuuggaugcaugaguuguaacagccuugacuauaaucugcgcguguacugcguggauaacacaccuugugcuuuccaggaggucguuucggacgagcggcaucagggcggucaguugcucgaggagcccaaacuguuacacuuuaaggggaacaccuucucccugcaaauuucugugcuagauaucccaccuuuucucuggagaaucaaacccuucacugccugccaggaagugccauuuagcaggguaugguguucaaaucgccagccgcugcauugcgcauucagucuugagcgauauaccccuacaaccacucaguuguccuguaagauuugcauacggcaacugaagggccacgaacagauccuccagguccaaacaucuauucuggagagcgagcgugaaacgaucaccuuuuucgcucaggaggacuccacuuuccccgcccagacaggaccaaaagcguuuaagauucccuacucaaucagacagaggauaugugccaccuucgauacaccuaacgcuaaaggcaaggacuggcaaauguuagcacagaaaaauagcaucaaccgcaaucugaguuacuuugccacucagucuuccccaagcgcugugauucuuaacuugugggaagcccggcaccagcaugauggggaccucgauucgcuggcaugcgcgcuagaggagaucggaagaacccacacgaagcugucaaauauuucugaaagucaacucgacgaggccgauuucaacuauuccaggcagaauggccuguga

SEQ ID NO: 64573 - RNA, 7377 nt, Artificial Sequence
  derived and/or modified sequence opt3 from UNC79__Homo_sapiens__NP_065869
augaucagcacccuggccacauuccccccuuuucuccacaaggacauuauagaguaccuuuccacuucuuuccugccaauggcuaucuugggcucaaguagaagggaaggggugccggcacaugucaacuuaagcgccuccucuaugcugaugauugcgaugcaguauacgucgaaucccguuuaccacugccaacuacucgagugucugaugaaauauaagcaggaaguguggaaagaucuucuguacguaaucgcuuauggaccuucacaggugaagccacccgccguccagauguuguuucauuacuggccuaaccucaaaccacccggugcaauuagcgaguaucggggccugcaauacaccgccuggaauccuauccacugccagcauauagaaugucacaacgcuaucaauaagccagcagugaagaugugcauugacccgagucuguccguugcccucggggauaaacccccuccauuauaccugugugaggagugcucugaacgcaucgcuggagaccacagcgaguggcuuauugauguguugcugccccaggccgaaaucuccgcgauaugucagaagaaaaacugcucaagucauguccgacgugcagugguaacauguuucagcgccggcugcugugguagacacgggaauaggccuguucgguauugcaagcgcugccauucuaaccaccacuccaaugaggugggagcugccgcagagacucaucuauaccaaaccucaccacccccgauuaacacaagagaauguggcgcugaggaacucgucugcgccguggaggcggugaucagccugcuuaaagaagccgaguuucacgcagagcagagggaacaugagcugaaucggcgccgacaguugggccucaguucuucccaccauagccuggacaacgcugauuucgacaauaaggaugacgauaagcacgaccagagauuacugucgcaauuugggauuugguuccucgucucucuuuguaccccuuccgaaaacacucccacagagucacuggccagguugguugcuaugguguuucagugguuccacaguaccgccuauaugauggaugacgaaguaggaagccuaguggagaaacugaagccacaguuugucacgaaauggcucaagacugugugcgacguucgguucgaugugauggucaugugucugcuuccuaaacccauggaguuugcacguguggguggcuacugggacaaguccugcucuaccguaacacaacugaaagaaggguugaaucgcauccucugucugaucccauauaacguuauuaaccagagcgugugggagugcauaaugcccgaaugguuagaggccaucagaacugaagucccugauaaucagcugaaggaguucagggaggugcuaucaaagauguucgacauugaacucuguccacugccguuuaguauggaggaaauguucggauuuaucuccugccgguucaccggcuaccccagcucuguccaggagcaagcucuuuuguggcugcaugugcucucagagcuggauauaaugguuccucuucagcuguugauuaguauguuuagcgacggugugaacuccguaaaagaacucgcgaaucagcgaaagucucgcgucucggagcuggcagggaacuuagccagcagaaggguguccguugcuucagauccaggacggcgcgugcagcacaauaugcugagucccuuccauucuccuuuucaaagcccauucagauccccccuaaggucaccguuucguagcccuuucaaaaacuuuggccacccaggcgggcggacaaucgacuucgauugugaagacgaugagaugaaucucaacugcuuuauccugauguucgaccuuuugcugaagcagauggaacuccaggacgauggaauuaccaugggucuggagcacucuuuauccaaagacaucauuaguauaaucaauaacgucuuccaggcccccuggggcgggagccauacgugccaaaaggaugagaaggcaauugaauguaaucugugccagucuuccauccuuuguuaucaguuggccugcgagcuccuggaacgacuagcuccuaaagaggaaucaagacugguggagcccacugacagucucgaggauagccugcuuucguccaggccagaauuuaucauuggaccugagggcgaagaggaagagaaccccgccucuaagcacggugagaauccagggaacuguacagaaccgguagagcaugcagcggugaaaaaugacaccgaacgcaaguucugcuaccagcaauugccuguuacucugcgguuaauauacacaaucuuucaggagauggcuaaauucgaggaacccgauauucucuuuaacaugcugaacugucuuaagauccugugcuugcacggcgagugucucuauauugccagaaaggaccauccacaguuccuggcauacauccaagaucacaugcuaauagccagccuguggagggucgugaaaucagaauuuagucagcucuccucucuggcugugccccuuuugcugcacgccuuaagccucccucauggagcagacaucuucuggaccauuaucaauggcaacuuuaauuccaaggauuggaaaaugcgcuucgaggcugucgaaaagguugccgugauuugccgauuucuggacauccacucagugacgaaaaaccaucuucugaaguauagccuagcgcacgccuucuguugcuuucucaccgcuguagaggaugucaauccagcaguggccacacgggcugggcuguugcuggacacuauaaagcgucccgccuuacagggacucugccugugucuugacuuccaguucgauaccguugugaaagacagaccuacaauucugaguaaguugcuccugcuacauuuucugaaacaagauaucccggcacuuucuugggaguucuuugucaacagguucgaaacucucucccuggaggcgcaguugcaccuggacugcaauaaggaauuuccauuccccaccacaauuaccgccgugcgcacuaacguugcuaauuuaagcgaugccgcacucuggaaaaucaagcgggcuagauuugccaggaaccgacagaaaucggugcgcucacugcgggacucuguaaaggguccugucgagaguaagagagcacuuucccugccagaaacguugacaagcaaaauaaggcagcaaucucccgagaaugauaacaccaucaaggaccuccugccugaggaugccggcauugaccaccagacugugcaucagcuaaucaccgugcugaugaaauucauggcuaaggaugaaagcuccgcggagucagacauuaguagcgccaaagcauuuaauacagucaagcgucaccuuuacguucuccugggguaugaucagcaagaaggauguuucaugaucgcuccgcagaagaugcgcuugucuaccugcuuuaacgccuucauagccggcauugcucaggugauggacuacaauaucaacuuagguaaacaucugcucccccugguagugcaaguccuuaaguauuguuccugcccacagcugcggcacuacuuccagcagccucccagauguucauuguggagucuaaaaccacacaucaggcaaauguggcugaaggcacuccuggugauucuuuacaaauauccuuaccgagacugcgauaucagcaagauuuuacugcaucucauacacaucacuguuaacacauugaaugcccaguaucauuccuguaagccccacgcgacggcugggccacuguacucugacaacucgaauauuagccgguauucagagaaagaaaagggcgagaucgagcucgccgaauaccgcgagaccggagcacugcaggauucccuucugcauugcgugagagaagagaguauuccgaaaaagaaauugaggucuuuuaagcagaagagccuagacaucggcaacgccgauucccugcucuucacuuuagacgagcaccggcgaaaaucauguauagauagaugcgacaucgaaaagccucccacacaagcugcauauauugcccagcgcccaaaugaucccgggaggucucgucagaacagcgcgacccggccugacaauagugagaucccagaaaaccccgcuauggagggauuuccugaugccagaaggccggucauuccagaagugcgccugaauugcauggagacauucgagguuaaaguggacucccccgucaagccugcacccaaagaagaccuugaucugaucgaccucagcucugauucaacuuccgguccagagaagcacaguauauugagcaccucggacucugauucccugguauuugaaccucuccccccacugcgaauuguggagagcgacgaagaggaggaaacgaugaaccagggcgaugacgggccuucaggaaaaaaugccgcuaguucuccguccguucccagccauccaucagugcuuagucuaagcaccgccccucugguccaaguguccguagaggauuguucuaaggacuucagcuccaaggauucaggcaacaaucagucugcagguaacacagacagugcuuugaucacuuuagaagaucccauggacgccgaggggucgagcaaaccagaagagcugccugaguuuuccugcggcucuccccucacccugaagcagaaaagagaccuucugcagaagucauucgcgcucccggaaaugagcuuggaugaccacccagauccuggaacagagggcgaaaaacccggggagcugaugccauccaguggagccaagacugugcuacugaagguccccgaggacgcagaaaauccuaccgagucugaaaaaccggauacgagcgcugagucagacacagaacaaaaccccgagcggaagguugaggaagauggcgccgaggaauccgaguuuaaaauccagauugugccaaggcagcgcaagcaacguaaaauagcugugagugcaauccagagagaauaccucgacauuagcuucaacauccuugauaagcugggugagcagaaggacccugaucccucuaccaaaggguuauccacuuuggagaugccucgggaaucaagcucggccccaacacuggacgccggaguccccgagaccucuagucauuccagcauuucaacucaguacaggcaaaugaagcgcggcucccucggugugcugaccaugucucagcuuaugaaacgacagcuggaacaccagagcagugcuccucacaauaucuccaacugggauacagagcaaauacagccaggcaagagacaguguaauguucccacgugccucaacccggacuuggaagggcagccucugcggaugaggggagcgaccaaaagcucuuuacuaucagcaccaaguaucguauccauguuugugcccgccccugaggaguucacugacgaacaaccaacagucaugaccgauaagugucaugacugcggcgcuauucuggaggaauaugaugaggagacacucgggcuugccaucgugguucugagcacuuuuauucacuugucucccgaccuggcagccccgcuccugcuugauaucaugcagucggugggacgccucgcuucaagcaccacguucuccaaucaggcggaaaguaugauggucccuggcaacgccgcagguguggcuaagcaauuccugagauguauauuucaucaguuggcccccaaugggauuuucccacagcuguuucagucuacaaucaaagacggaaccuucuuaaggacucuagcaagcucccugauggauuuuaacgagcucucaaguaucgccgcucuuucucaacuguuggaaggccugaauaacaagaaaaaucucccugccgguggcgcgaugauucggugccuggagaacaucgcaaccuucauggaagcccuucccauggacagcccauccucauuauggacaacuauaagcaaucaguuucagaccuucuuugcuaagcugcccuguguacucccuuugaaaugcucucuggauuccagucuacguauuaugaucugucugcucaagauuccaagcacaaacgccacgcgcucgcuucuggagccguucuccaaguugcugucuuuugucauccagaaugcuguguucacccucgcauaccugguugaguuaugcgggcuuugcuaucgagccuuuacuaaagaaagagacaaguucuaccugucaaggagcgugguccucgagcuacugcaagcuuugaaacugaagaguccccucccugauacaaaccuucuguugcuggugcaguucauaugugccgacgcaggaaccaaacucgcggaauccacuauuuuaucuaagcagaugaucgccagcguuccaggcugcgggacagcugccauggagugugugcggcaguauaucaaugaaguccuggacuuuauggcagauaugcacacccuuacgaaacugaagucacauaugaagacuugcucccaaccccuacacgaggacaccuucggaggccaccucaaagugggucuggcucagauugccgcaauggauaucagucgcgggaaccauagagacaacaaggccguaauuagguacuugccuuggcuguaucacccacccagcgcuaugcagcagggaccuaaagaguuuauagaaugugugucucauauccggcuccuuucauggcuguuacugggcuccuugacacacaaugcgguuugcccgaacgccagcucuccaugucuccccauuccucuggaugcagguagucacgucgcugaccaucuaaucgugauccuuauuggcuuccccgagcaaucgaagaccuccgugcugcacaugugcagccucuuucaugccuucauauuugcccagcuguggacugucuacugugaacagucagcaguagcuacaaauuugcaaaaccagaaugaguucucuuuuaccgccauccugacagcgcucgaauucuggagccgagugacuccauccauucuucagcugauggcucacaacaaaguuaugguggagauggucugcuuacaugugaucagucugauggaggccuugcaggaauguaauucaaccauuuuuguuaagcucaucccuauguggcugcccaugauacaaucuaacaucaagcaccuaagcgcagggcuucagcugagacuccaggccauucagaaucacgugaaccaucacucccugcgcacguugccaggaaguggccaaagcuccgcuggguuagcagcccugaggaaauggcuccagugcacacaguucaagauggcgcaggucgagauccaaucuucagaagcugccagccaguuuuacccgcuuuga

SEQ ID NO: 64574 - RNA, 1248 nt, Artificial Sequence
  derived and/or modified sequence opt3 from UNC93A__Homo_sapiens__NP_001137419
auggacagaucacugaggaacgugcucgucguuuccuucggcuuucuucuguuguucaccgccuacgggggauuacagucucugcaaucaagucuauauagcgaggaaggucucggcgugacagcucuguccacucuuuacgggggaaugcuguugucuucgauguuucugcccccucuccugaucgagcggcucggcugcaaggguacgauuauauuaucaauguguggguauguagcauucagcgugggaaacuuuuucgccaguugguacacccugaucccaacauccauucuuuugggccugggcgcggcuccgcuauggucugcccagugcacuuaucucaccaucacagggaauacccacgcagaaaaagccggaaagcgcgguaaagauauggucaaucaguacuuuggcauuuucuuucugaucuuccagagcuccgggguguggggaaaccuuauaucaagucugguuuuuggccaaacucccagccaggguucugggguguuggcuguccucaugaucgcagccuuccugcagccuauucgagacgugcagcgugaguccgaaggagagaagaaaucaguaccauuuuggagcacauuacugaguaccuucaagcucuauagagauaagaggcuuugucuguugauccuacugccccucuacucuggccugcaacagggcuuccuuuccagcgaguacacgcggucguauguuacuugcacccuggggauucaguuugugggauacgucaugaucuguuucucugcuacagacgccuugugcuccgugcucuaugguaaagugucacaguacacuggccgcgcgguccuguauguuuuaggggcagugacccauguaaguuguaugauagcccugcuacucuggagaccuagggcugaucaccuggccguguuuuucgucuuuagcggacuuuggggcguggcagacgcuguuuggcaaacacagaauaacgccuuguacggugugcuguucgaaaaguccaaagaggcggccuuugcaaauuaucggcucugggaagcucugggguucgucauugccuuuggcuacucuauguuccuuugcgugcauguaaagcuguacaucuugcucggaguucugagcuuaaccaugguggcuuauggccuggucgaguguguggagagcaaaaacccaauucgcccccacgccccugggcaggucaaucaagcagaagaugaggaaauccagacgaagauguga

SEQ ID NO: 64575 - RNA, 1794 nt, Artificial Sequence
  derived and/or modified sequence opt3 from UNC93B1__Homo_sapiens__NP_112192
auggaggccgaacccccucuguacccaauggcuggcgcagccgggccgcagggagacgaggaucuccuuggugugcccgacggcccugaagcgccacuggaugaguuggucggggcuuaucccaacuacaaugaagaggaggaagagagaagguauuaccggcgcaagcgauuaggaguucugaaaaacgugcuagccgcaagcgccggcgguaugcucaccuaugggguauaccugggacuucugcaaaugcaguugauccuccacuaugacgaaacauaccgugaggugaaguacggcaauaugggccugccugauauugacuccaaaaugcugauggggauaaacgucacuccaaucgcugcacucuuauauacgcccgugcugauuagauucuuuggaaccaaguggaugauguuccuugccguugguaucuacgcuuuguuugugucuacaaauuauugggagagguacuauacucuggucccuucagccguggcgcuaggcauggcaauuguaccacucugggccaguauggggaacuacaucacccggauggcucagaaauaucaugaauacagccacuacaaggagcaggauggacaaggcaugaagcagcgcccgcccagagguucccaugccccuuaucugcuuguuuuccaggcaauauuuuacucuuucuuucaccugucguucgcuugcgcccaguugccaaugaucuauuuucucaaucauuaccuguaugacuuaaaccacacacuguacaaugugcaaucaugugggaccaacagccacgggauucucaguggcuucaauaaaacuguccuuaggacacugccccgguccggcaacuugaucgugguggaaucuguccuaauggcgguugccuuucuggcaaugcuccuggugcuugggcugugcggagcugccuaucgcccuaccgaggaaauugauuugcgaagcguagguuggggcaauaucuuccagcucccauuuaagcaugugagagacuacaggcugcggcacuuaguccccuucuucauauacuccggguuugaggugcuguucgcuuguacgggaauugcccuaggcuaugguguuugcucaguggggcucgagcgucuggcauaccuuuuggucgccuauagucugggcgcuagcgcggcaucucuccugggacuucugggcuuguggcucccgcgcccugugccccugguagccggggcuggaguucauuuacugcuaacuuuuauccucuucuuuugggccccagugccuagaguccugcagcacuccuggauucuuuacguggcagccgcuuuguggggugucggcucagcccugaacaaaaccgggcucagcacacuguuaggaauccuguaugaagauaaggagaggcaggacuucaucuuuacuauuuaccacugguggcaagcaguggcgauauucaccguuuaucuuggcaguucuuugcauaugaaagcuaagcucgccgugcugcuaguaacacuggucgcagccgcuguguccuaccuccggauggaacagaagcugcgacgcgguguugcccccagacagccaaggaucccccggccucaacacaaagugcgcggguacagauaucuugaggaagauaauagcgacgagucggacgcagagggcgaacauggagauggcgcugaggaagaggccccaccggcggggcccaggccuggaccagaacccgccgguuugggccgucggccuuguccauacgagcaggcucagggaggagacggccccgaggaacaguga

SEQ ID NO: 64576 - RNA, 915 nt, Artificial Sequence
  derived and/or modified sequence opt3 from UNG__Homo_sapiens__NP_003353
augggcguguucugccuggggcccuggggacucgguagaaaacuuaggaccccuggcaaagggccacugcaguuguuaagccggcuguguggagaccaccuacaagccaucccggcuaagaaagcacccgccggccaggaggaaccugguacaccacccuccucuccucucucagcggagcagcuggaucgcauucagcgaaacaaggcugccgcacuucugcguuuggccgcuagaaaugucccaguuggguuuggagaaaguuggaaaaagcaucucagcggcgaguucggcaagcccuacuuuauaaaacugaugggguucguggcagaagagaggaagcacuauacuguauacccuccaccgcaucaaguguuuacguggacccagaugugcgacaucaaagaugucaaggugguuauucugggacaggaccccuaucacgguccuaaccaggcccauggccucuguuucuccgugcaacggccagugcccccuccacccucuuuagagaauaucuacaaagaacugucgacagauauugaggacuuuguccacccggggcacggagaucuuucaggcugggcuaagcaggguguauugcugcuaaacgccguucucacugugcgcgcgcaucaggcaaauagccacaaggaaagagggugggagcaguucaccgacgccgucgugaguuggcugaaccaaaauuccaacggacuuguguuucuguuguggggcucuuaugcucagaaaaagggcagcgccaucgauaggaaacggcaucacguccuccagacagcacacccuucaccccuguccguuuaccgcggguucuuuggaugccgacauuucaguaagaccaaugaguuacugcaaaagagcgguaagaaaccaauagacuggaaggaacucuga

SEQ ID NO: 64577 - RNA, 1155 nt, Artificial Sequence
  derived and/or modified sequence opt3 from UPB1__Homo_sapiens__NP_057411
auggccggcgcugaguggaaaagccuggaagagugccucgaaaaacaccuuccccugccugacuugcaggaggugaagagagucuuauacgggaaagaacugaggaagcuagaucucccacgggaggcauucgaggccgcgucccgcgaagacuuugagcugcaaggauaugcuuucgaagccgcagaggagcagcuucgacguccgagaaucguucaugugggucugguacagaacaggauucccuugccugccaaugcuccaguggcagaacaggucucugcccuccaccggcgcauaaaagcuaucguggagguugccgcgauguguggcgugaacauuaucugcuuucaagaagcauggaccaugcccuucgccuuuuguacaagagagaagcugccuuggacugaguucgcugaaucagccgaggaugggccaacgaccagguuuugccagaagcuggcaaagaaucaugacauggucgugguaagucccauucucgaacgggauagcgagcacggagacguuuuauggaacacagcuguggucaucuccaauucuggcgccgugcuggguaagacucgcaaaaaccauauaccucgagugggggauuucaaugaaucgaccuacuauauggagggaaaccuuggccacccagucuuucagacacaguucggcagaaucgcgguuaauauuuguuacgggaggcaccauccguugaacuggcugauguauucaaucaauggagccgaaauuaucuuuaaccccagcgcaaccauaggugcucuaagugagucccucuggccuauugaggcccggaaugcugccaucgcaaaccacugcuucacuugugccauuaaucgugugggcacagaacauuuuccaaacgaguucaccucuggggacggaaagaaagcucaccaagauuucggcuacuuuuaugguagcuccuacguagcggcacccgacucaagucgcacgccugggcugagcagaucuagggauggacuucugguggccaaguuggaccucaaccugugccagcaggucaaugauguguggaacuucaagaugacuggccgguacgaaauguaugcucgagaguuagccgaagcaguuaaauccaauuacucaccaaccaucgugaaggaguga

SEQ ID NO: 64578 - RNA, 3357 nt, Artificial Sequence
  derived and/or modified sequence opt3 from UPF1__Homo_sapiens__NP_002902
augagcguggaggccuacggccccuccucucagacccugacauuccucgacacugaagaggcugaacuucugggggcagauacgcaaggaucagaguuugaguucaccgacuuuacauugccuagucagacucagaccccaccggguggccccgggggaccuggcggugggggagccggcggcccagggggagcgggugcuggcgccgcagccgggcaguuagaugcucaagucggacccgagggcauccugcagaacggugcaguugacgauagcguggccaagacaucccagcuacucgcugagcugaauuucgaagaggacgaagaggauaccuauuacacuaaagaccuuccuauucacgccugcucuuauugugggauacaugauccagcgugcguaguguacuguaacacaucgaagaaaugguuuugcaauggaagaggcaacaccucaggcagccacaucgucaaucaucuggugagggcaaaguguaaagagguuacguugcacaaggacgggccccucggagaaacugugcuggagugcuauaacugugguugccggaaugucuuccugcucggcuuuauuccugccaaggcugauagugugguaguuuuacugugucgccagccaugcgccucccaaucuagccuuaaagacaucaacugggauuccucacaguggcagccguugauucaggaccgauguuuccugaguuggcuagugaagauccccagcgaacaagagcagcuccgugcaagacagauaaccgcucaacagaucaauaaacuggaagaacuuuggaaggagaacccuucugccacacuggaagacuuggagaaaccaggggucgaugaagaaccccagcaugugcuccugagguacgaagacgcguaucaguaccaaaauauuuuuggaccuuuagugaagcuggaggccgauuacgacaagaaacucaaggagucccagacucaggauaacaucaccguccggugggaccuuggccugaauaaaaagcgcauugcauauuucacauugccaaaaaccgauucagacaugagacuaaugcagggugaugaaaucugccugagguacaagggggaccucgcuccccuguggaaaggcauaggacacguuauuaaggugccggauaacuauggcgacgagaucgccauugaacuucggagcaguguaggggcuccuguggaggucacgcacaauuuucaaguggacuucguuuggaagucuacuuccuuugaucgcaugcagagcgcccugaaaacauucgcaguggacgaaaccucggucucuggauacaucuaucauaaguugcucggucacgagguggaggauguaaucauuaaaugccagcugcccaagcgauucacugcccagggcuuaccagaccugaaccauucccaaguuuacgcugugaaaacaguccuacagagaccucucucacugauacaggggcccccaggaaccggcaagacggugaccagugcgacaaucgucuaucaccuugcaaggcaggguaacgggcccguguugguuugugccccuagcaauauugcuguggaucaacugacugaaaagauccaccagaccggccucaaaguaguccggcugugcgccaagucccgugaggcaauagacucuccagugagcuuucuugcccugcauaaccagauucgcaauauggauucaaugccggaauugcaaaaacuccagcagcugaaggacgagacaggagaguuaaguuccgcugaugaaaaacgguacagggcccugaagcggacugcagagcgagaacuacucaugaacgcggacguuaucuguugcaccugugugggcgcuggggauccccgccuggccaagaugcaguucagaagcauccuuauugacgagucuacacaagcaaccgaaccugagugcauggucccagugguauugggagccaaacagcugauccucgugggugaucacugucagcugggccccguugucaugugcaagaaagcugccaaggcaggguuaucacagagucuguuugagaggcuugugguguugggaauuagaccuauacgccuccaaguccaguacagaaugcauccagcucugagcgccuuccccuccaauaucuuuuaugaaggcucucuacagaacgguguuacugcggccgacagggugaaaaagggguucgacuuucaguggccgcaaccugauaagccaauguucuuuuacgugacgcagggccaggaggaaauugcuucgagcggaacauccuaucugaaucguaccgaggcagccaacguagagaaaaucacuaccaagcuccugaaagcuggcgccaagcccgaccaaaucgggauuauaacaccuuacgagggacagcggucauaucuuguccaguacaugcaguucaguggcucuuugcacaccaaacuguaucaagagguggaaaucgcaagcguugaugcguuucagggucgagagaaggacuucauuaucuuauccugugugagagccaaugaacaucaggggauuggauuucucaacgaucccaggcgccugaaugucgcucuuacucgggccagauacggcgugaucauaguugguaacccaaaagcacugucaaagcagccuuuguggaaucaccuccugaacuacuauaaggagcaaaaagugcuaguagaaggcccccugaauaaccucagggagagccugaugcaguucucuaagccacgcaaacuugucaacacaaucaauccgggggcucgauucaugacgaccgccauguacgacgcacgggaggccauuaucccuggauccguguaugaucguaguagccagggcagacccucuuccauguacuuucagacucacgaccaaauugggaugaucucagcuggaccaagucauguggcggccaugaacauacccauuccuuucaauuuggucaugccacccaugccuccgccaggcuauuuuggucaggcaaacgggcccgcugccggaaggggcacaccuaaggguaaaaccggccgcgggggacggcagaagaauagauucggccugccagggcccagccagacaaacuuaccuaauucgcaagccucccaggauguugcuucucagccguuuagccaaggagcacucacucagggcuacaucucaaugagucagcccucccagaugucucaaccaggucugagccagccugaacuuucccaggacucauaucugggggaugaguucaagagccagauugacguggcccuaagucaagauucuaccuaccagggagaaagggcguaccagcacggcgguguaacgggccucucccaguauuga

SEQ ID NO: 64579 - RNA, 3819 nt, Artificial Sequence
  derived and/or modified sequence opt3 from UPF2__Homo_sapiens__NP_542166
augcccgccgagagaaagaaaccugcuagcauggaagagaaggacucccugccaaacaauaaagaaaaggauugcucugagaggcggaccgugucaaguaaagaacgcccgaaggacgauaucaagcucacagcuaaaaaggaggucagcaaagcccccgaggacaagaaaaagcgacuugaagaugacaagcguaaaaaggaggauaaagaaagaaagaaaaaggacgaggagaaaguuaaggcggaagaggaauccaagaaaaaggaggaagaggagaaaaagaaacaccaggaagaggaaaggaagaagcaagaggaacaggcuaaacggcagcaggaggaggaagccgcagcccaaaugaaggagaaagaagagucuauucagcugcaucaggaagcaugggagcgccaccauuugagaaaggaguuaaggucgaaaaaccagaaugcaccugauucacggccagaagagaacuucuuuagccgccuggacaguucccuaaagaagaauacugccuucgugaaaaagcucaaaacgauaaccgaacaacagcgagauucucugagccacgacuuuaacggccuuaaucuguccaaguacaucgcugaggccguagcgucaauuguggaggcaaaauugaagaucagugaugucaacugugccgugcaucucugcagccuguuccaccagagauaugcugacuuugcccccucucugcuccagguuuggaagaaacacuucgaagcaaggaaggaggagaaaacaccuaauauuacuaaguuacggaccgaccugcguuuuaucgcugagcuuacaauaguggggaucuucaccgauaaagaaggauugucccugauuuacgagcaacuaaagaacaucauuaaugccgaccgcgagucacauacucacgucagcgugguaaucaguuuuuguagacauugcggugaugacauagcgggccucguuccaaggaaagugaagucugccgcagaaaaguucaaccuguccuuucccccuagcgagauuaucucgccagaaaaacagcagccguuccaaaaucuucugaaggaguauuuuacaucuuugaccaaacaccucaagcgggaucaccgagaacugcagaacacggagcgccagaauagaaggauuuuacauuccaaaggggagcugucagaagaccggcacaagcaguacgaggaguucgcuaugaguuaucaaaagcuccuugccaacagccagucccuggcugauuugcuagacgagaacaugcccgaucugccucaggacaaaccaacucccgaagaacauggaccuggcaucgauaucuucaccccagguaagcccggggaguacgaccucgaaggaggcauuugggaggacgaagaugcccgcaauuuuuaugagaaccugauagaccuuaaagcauucgucccggccauccuguuuaaggauaaugagaaaucuugucagaacaaggaaagcaauaaggacgauacaaaagaggcuaaggaaucaaaagagaacaaggaagugaguuccccugacgauuuggagcucgagcuggaaaauuuagagauuaacgacgauacucuggaacuagagggcggggacgaagcggaggaucucaccaaaaagcugcuugacgagcaagaacaggaggaugaagaggcaagcacaggaucucacuugaagcugaucguggacgccuuccuccagcagcugcccaauugcgucaacagagaccuuauagauaaagcugccauggacuuuuguaugaauaugaacaccaaggcaaauaggaaaaagcugguucgugccuuguucauugugccacggcaacgacucgaucuguuaccuuuuuacgcuagacugguagccacgcuacaucccugcaugucagacguggcagaagaucucuguaguaugcugaggggugacuuccgcuuucacguccggaaaaaggaucagaucaacaucgagacuaaaaauaagacagugagauucauuggcgagcuuaccaaguuuaaaauguucacuaagaacgacacauugcacugccugaaaaugcuccugagcgauuuuucccaucaccauaucgaaauggcguguaccuuacuggagacgugcgggagguuccuuuuccgcucuccagaaucgcacuugcgaaccagcguucuccuggagcagaugaugcggaagaaacaggcuaugcaccuagacgcccguuacgugacaauggucgagaacgcauauuacuauugcaaucccccuccagccgaaaagacugugaagaaaaagagaccgccccugcaagaguacguaaggaaacuccuguauaaggaucuuuccaaaguuaccacagaaaagguguugcgccagaugcggaagcugccuuggcaggaccaagaggucaaagauuacgugauuuguugcaugauaaacaucuggaaugucaaguauaacucaauucauuguguggcuaauuuacucgccggacugguucuuuaccaggaagacgugggcauccacguagucgacggugugcuggaggauaucagauuggggauggagguuaaccagccaaaauuuaaucagaggcgaauuaguucugcaaaguuccucggagaacuguacaacuaucgcaugguggagagcgcugucauauuucggacucuauacuccuucaccucauuuggcgugaaucccgacggcagcccuucuucccuggauccacccgaacaucucuucagaaucaggcugguaugcacaauucuugacaccugugggcaauauuuugaucguggaaguagcaaacgcaaguuggacugcuuccugguguacuuucagcgguauguuugguggaagaaaucuuuagaggucuggacuaaggaucacccguucccuaucgacauugauuacaugaucuccgacacgcucgaacugcuuagaccaaaaauaaagcuguguaacucacuagaggagaguauccgacaggugcaggaucucgaaagggaguuucugauuaaauugggucuggugaaugacaaggacagcaaggauucgaugacagaaggcgagaacuuagaagaggacgaggaagaggaagaagggggagccgagaccgaggaacaauccggcaaugaaucugaggucaacgaacccgaggaggaagaggguagcgauaaugacgaugacgaaggggaggaagaggaggaagagaacacugauuaucucaccgacucaaacaaagaaaaugagacagaugaagagaacaccgagguuaugaucaagggcggaggccugaaacaugugccuugcguggaagacgaggauuucauucaggcgcuugacaagaugaugcuggaaaauuugcagcagcggaguggggaguccguaaaaguccaccaacucgauguggccaucccccugcaccuaaagucucagcugcgcaaaggaccaccucuugguggcggggagggagaagcugagagcgcagacacuaugcccuuuguuaugcucacaagaaagggcaacaagcagcaauucaaaauacugaaugugccaauguccucacaguuggccgcuaaccauuggaaucagcagcaagccgaacaggaggaaaggaugcggaugaagaaacugacguuagacauuaacgagcgacaggagcaggaagauuaccaagagaugcuccagagccuggcacagagaccggcgccugccaauaccaaccgcgaaaggcguccccgguaccagcacccaaagggugcucccaaugccgaccuuaucuucaaaacugggggcagaaggcgcuga

SEQ ID NO: 64580 - RNA, 1431 nt, Artificial Sequence
  derived and/or modified sequence opt3 from UPF3A__Homo_sapiens__NP_075387
augagaagcgagaaggaaggcgccgggggacugagggcugcaguggccgcgcggggucccuccggccgcgagaaacucucugcucuugaaguccaguuccaccgagacucacaacagcaggaggccgaaaccccuccaacaaguagcuccgggugcggaggcggugcagggaagccgcgugaggagaaaagaacugcccugucuaagguugugaucaggcgguugcccccuggauuaacgaaagaacagcuggaggaacaacuacgcccacuccccgcucaugauuacuuugaguucuuugcagccgaccugucgcuuuauccucaccuguacucaagagcuuauauuaacuucaggaauccagaugacauauugcucuuucgggaucgcuucgacggcuacaucuuucuggauagcaagggccuggaguaucccgccguaguggaguucgcgccuuuucagaagauugccaaaaagaaacuccgaaagaaagacgcaaagaccgggaguaucgaggaugacccagaauacaagaaauucuuagagacauauugugucgaagaggagaagacuuccgcuaacccggaaacccugcuuggagagauggaagccaaaacaagagaguugauugcaaggcggaccacuccccugcuagaauacaucaagaaucguaaacucgagaagcagcgcauaagagaggagaaaagggaggaacggcgacgcagagagcuggaaaagaagaggcuucgggaggaggaaaaacgcagaaggcgugaggaagaacggugcaagaaaaaggagacagauaaacagaagaagaucgcugaaaaagaggugcgaauuaagcuguugaaaaagccugaaaaaggugaggaaccaaccacggagaagcccaaggagagaggcgaagagaucgacacugggggaggcaaacaagaaucuugugccccuggugcgguugugaaggccaggccaauggaggggagccucgaagaaccccaggagaccucccauucaggaagugauaaagaacaccgcgacgucgagcggagccaggaacaggagucugaagcacaaagauaccauguggacgauggcaggcgccaccgagcucaccaugagccggagcggcugucccguagaucagaagacgagcagagguggggcaaggggccuggacaggaucgcgguaaaaagggcagccaagacaguggggcccccggagaagcuauggagcgguuaggcagagcccagaggugcgaugacucuccagcaccucgaaaggagcgccuggccaacaaagaucggcccgcucuccagcuuuaugacccaggugcgagauuuagggcacgugaaugugggggcaaucgccggauuugcaaggccgagggauccggcacagggcccgagaaaagagaagaagcugaguga

SEQ ID NO: 64581 - RNA, 1413 nt, Artificial Sequence
  derived and/or modified sequence opt3 from UPF3B__Homo_sapiens__NP_075386
augaaggaggaaaaagagcacagacccaaggagaaaagggugacccugcucacgccugccggcgcuacugggagcggagguggcacguccggggacucuucaaagggagaggauaaacaggaccggaacaaggaaaagaaagaggcacuuaguaaggucguuauccgccgacugccaccgaccuugacaaaagagcaauuacaggaacaucugcagcccaugccugagcacgauuacuucgaauuuuucagcaaugacacuucccuauauccacauauguacgcccgugcguauauuaacuuuaagaaucaggaggauauaauccucuucagagacagguuugauggcuacguguuccuggacaacaaaggucaagaguaucccgcuauuguagaauuugccccuuuccagaaggcagccaagaaaaagaccaaaaagcgggauacaaaaguggggaccaucgacgaugacccagaguaccgcaaguuucuugaaucuuaugcuacugauaaugagaaaaugacaucgacccccgaaacgcuguuggaggagauugaagcaaagaacagagagcucaucgccaagaaaacuaccccucugcugucauuccucaagaauaaacagaggaugcgggaagagaagcgcgaagaacgaagaaggcgggagauagaacguaaacgccagagagaggaagagaggcggaaguggaaggaagaggagaaacgaaagcgcaaagacaucgaaaagcugaaaaagauugacagaaucccagagagggauaaguuaaaagacgaaccgaagauuaaacuuuugaagaaacccgagaagggagaugagaaggaacuggacaaacgggagaaggcuaaaaagcuagauaaagaaaaccucagcgacgagcgcgccaguggccaauccugcacacugccuaagagaucugauagcgaacuuaaagacgagaagccaaagaggcccgaggaugaauccggccgugacuaccgggagcgagaaagagaguacgaaagggaucaggagcgcauccugcgggagagagaaagguugaaacgccaggaggaggaacgacggcgucagaaggaaagauaugagaaagagaagacuuuuaaaaggaaggaagaggaaaugaagaaagagaaggacacccuccgcgacaaagggaagaaagcggagucaacagaaaguauaggaagcucugagaagaccgaaaagaaagaggaagucgugaagcgggauagaauuaggaauaaagaccgaccugcaaugcaacuguaccagccaggugcccgcucccggaacagauuaugucccccggaugacucaacaaagagcggcgauagugcugccgagaggaaacaggagucugggaucucccaccguaaggaaggaggcgaggaauga

SEQ ID NO: 64582 - RNA, 822 nt, Artificial Sequence
  derived and/or modified sequence opt3 from UPK1A__Homo_sapiens__NP_001268372
auggccagcgcugcagccgcggaggcugaaaagggcucccccguggucguugggcugcucgugguaggaaacaucauuauacuucugucugguuugucauuauucgccgagaccaucugggugacagcagaccaguacagagucuauccucugaugggcgugagugggaaagaugacguuuuugccggagcuuggauugcaaucuucugcggcuuuagcuucuuuaugguggccuccuucggugucggggcugcccuauguaggcggcgcucuauggugcucacuuaccugguacuuaugcugauuguuuauaucuuugaaugcgcgucguguauaacgucauacacccaccgagauuauauggugagcaauccaaguuugaucacaaagcaaaugcucacuuucuacuccgcagacaccgaucagggacaggagcugacacgucugugggacagagucaugauugaacaggagugcuguggcaccucuggcccgauggauugggugaacuuuacuagcgccuucagggcugccacacccgagguggucuuuccuuggccaccccucugcugucggcgcaccgggaauuucaucccuuuaaacgaagagggaugcagacugggucauauggacuaucuuuuuacgaaagcaggcguucaauggcacaauuuguccucacugcagaggcuaccacccggguucaagggauucagucaucucagcuuucagucuuccugggauuaccgggcugccucaaacacuagcgcgaccccuaguacagccacucgcggcgugucucgaggucuggggcuuccauccuga

SEQ ID NO: 64583 - RNA, 783 nt, Artificial Sequence
  derived and/or modified sequence opt3 from UPK1B__Homo_sapiens__NP_008883
auggccaaggacaacagcaccgugagaugcuuccagggccugcucaucuuugggaaugucauuauaggauguugcgguaucgcucuuacagcagaguguauuuucuuuguuuccgaucaacacucucuguaccccuuguuagaagccacugacaacgaugacaucuauggcgcggcuuggauugggaucuucgugggaauaugccuguuuugucuaucaguacucggcaucguggguauuaugaaaaguagcaggaagauccugcuugccuacuucauucugauguuuaucgucuaugcauucgagguggccuccugcauaacggcugcaacccagcaggacuuuuucacaccuaauuuguuucucaaacagaugcuggaacgguaccaaaacaauucuccaccgaacaaugaugaucaguggaagaacaaugggguuacuaaaaccugggaccgccugaugcuccaggauaacuguugcggagugaauggccccucggacuggcagaaguauacaucagccuuccgaaccgagaacaaugaugcugacuacccuuggccacgucaauguugcgucaugaacaauuuaaaggaaccccugaaccuugaggccuguaaauugggcgugccuggguuuuaucauaaccagggaugcuacgagcugauuagcgguccaaugaauagacacgcguggggcguagcaugguucggguucgccauccuaugcuggacuuuuuggguucuccugggaacaauguucuacuggaguaggauugaauauuga

SEQ ID NO: 64584 - RNA, 555 nt, Artificial Sequence
  derived and/or modified sequence opt3 from UPK2__Homo_sapiens__NP_006751
auggcuccccugcucccuaucagaacccuuccacugauuuugauauuacuggcccuacucagcccgggcgcagccgacuucaacaucuccucucugucagggcuucugagucccgcguugacagagagccuccugguggcucugccuccaugccaccucacuggagguaaugccacguuaauggucaggcgggcaaacgauuccaagguugugaccucuucguuuguagugcccccuugucgcggccgacgugaacuggucucagugguugacagcggggccggauucacagugacuagacuuagugcuuaccaggucaccaauuuggugccaggcacaaaauuuuauauuuccuaccugguaaagaaagguaccgcaacugagucuagcagggaaauccccauguccacacuaccucggcgcaacauggagucaauugggcucggaauggccagaaccggcggcaugguugugaucacgguccugcuuaguguggcuauguuccuguuggugcucggguuuauaaucgcccuggcguuaggaagcaggaaguga

SEQ ID NO: 64585 - RNA, 501 nt, Artificial Sequence
  derived and/or modified sequence opt3 from UPK3A__Homo_sapiens__NP_001161046
augcccccucugugggcccuccuugcucugggcugcuugagauucgggagcgcagugaacuuacagccacaacuggccuccgucaccuuugcgacaaauaacccgacucuaacgaccguugcucucgagaagccccuguguauguucgacucuaaagaagcccuuacaggaacucacgagguguaccuguauguauugguggauucagucaccccuuacaguacaaucgacaccuggccagguaggcggagcggcgggaugauugugauaacuuccauccucggaucucugcccuuuuuccugcucguuggcuuugccggugcaauugcuuuaucgcugguggauauggggucaagcgacggagaaacaacccaugauagucagaucacgcaggaggcagucccuaagucccuuggcgccucugaaagcuccuauacuucagugaaucgcggcccacccuuggaccgagcugagguauacaguagcaaacugcaggauuga

SEQ ID NO: 64586 - RNA, 933 nt, Artificial Sequence
  derived and/or modified sequence opt3 from UPP1__Homo_sapiens__NP_001274355
auggccgcuaccggcgcaaacgccgagaaggcggaaagccacaaugacugccccgugagacugcucaacccuaauaucgcuaaaaugaaggaggauauucuuuaccauuucaaccugacaacuuccaggcacaauuuuccagccuuguucggggacgucaaauuuguuugugugggagguucuccgucacggaugaaggcauucauacgcugcguaggcgccgaauuagggcuggauugucccggacgagacuauccuaacaucugcgcuggcacggaucguuacgcaauguauaaaguggguccaguccuaagugugagccaugggaugggcauucccuccaucucuauuaugcuccacgagcugaucaaacuucuguacuaugccagauguucgaauguuaccauaaucaggauuggaacaucaggcgggaucggauuggaaccugguacuguggucauuaccgagcaggcuguggacacaugcuuuaaggccgaguucgaacaaaucguacucggcaagcggguuauacgcaagaccgaucugaacaaaaagcuggugcaggagcucuuacuguguagcgcggaacuuagugaguuuacuacagucguggggaauaccaugugcacguuggacuucuacgagggacagggcagacuggauggugcacuauguuccuauacugaaaaagacaagcaggccuaccucgaggcugccuacgcagcuggggugaggaacauugaaauggagucuagcgucuuugccgcgaugugcuccgccuguggacugcaagcagcuguugugugcguaacccuucugaaucgguuggaaggcgaucagaucucaaguccacgcaacgugcucagcgaguaucagcagcgaccccaaagacuggucucuuacuucauuaagaaaaaguuauccaaagccuga

SEQ ID NO: 64587 - RNA, 1125 nt, Artificial Sequence
  derived and/or modified sequence opt3 from UPP2__Homo_sapiens__NP_001128570
augcuggcccccggcugcgagcucgacccugaucaggaaguggucagaaccaggccagaggacguuccggcuagccccuccacaucuacuaugaucgugucaguacuucggccuccaagucacgcaagcuguacggccugcgggaccgugacauuccauauugucgaacgcauggcguccgugauacccgcuucuaaccgaucgaugcguucagauagaaauacuuacguuggaaagagguuugugcacgucaaaaacccuuaucuggacuugauggaugaggacaucuuauaccaucuggaucuagguaccaagacacacaaucucccagccauguucggcgacgugaaauuuguauguguugggggaagccccaaccggaugaaggcauucgcccuguuuaugcauaaagaacuuggcuucgaggaggcugaagaggauauuaaggacaucugcgcagguaccgaucgcuauuguauguacaagacugggccugugcuggccauuagucacggaaugggcaucccauccauaucuaucauguugcacgaacucauuaaacugcugcaucacgcuagaugcugugacgucacaaucauuaggaucggcaccagcgggggaauagguauugccccgggcacgguggugaucacugauauugcggucgacuccuuuuucaagccccgguuugagcaaguuauccucgacaauaucgugacccgcucaacagaguuagauaaagaacugagugaggaacuuuucaacugcagcaaggagauuccuaauuuuccaacuuugguagggcauaccauguguacauaugacuucuacgaaggacagggccgacuggauggugcacuaugcucuuuuuccagagagaaaaagcucgacuaucugaagagggccuucaaagcuggggugcggaacauagagauggaaucaaccgucuucgccgcaauguguggacuuugcggccugaaggcugccgugguuugcgugacguugcucgaucgucuggacugugaucagaucaauuuaccccacgacguccugguggaguaccagcaacgcccucagcuccuuauuagcaacuuuaucagaaggcggcugggcuugugcgauuga

SEQ ID NO: 64588 - RNA, 930 nt, Artificial Sequence
  derived and/or modified sequence opt3 from UPRT__Homo_sapiens__NP_659489
auggccaccgagcugcagugccccgacagcaugccuugucacaaccaacaggucaauuccgcuucuacaccaucaccggaacagcucagacccggcgaucuuauccuggaccaugcagggggaaacagggccagucgggcgaaggugauuuuguuaacugguuacgcucacagcucccugccugccgagcuagauucuggcgcaugcgggggaucgucacucaauagcgaaggcaacagugguuccggggacucuagcuccuaugaugccccagcuggaaauucauuccuggaggacugugaacuuagucgccagauaggcgcacaacugaaauugcuccccaugaacgaucagauccgagagcugcagacgauuauccgugacaagaccgccagcagaggcgauuuuauguucucugcugacaggcugauucggcucguuguggaggaaggguuaaaucagcugccuuacaaagagugcaugguaacaacuccaaccggauauaaguacgaaggugugaaauuugagaagggcaacuguggggucuccaucaugcgcucaggagaggccauggaacaaggccuuagagauugcuguaggagcauacggaucgguaagauuuugauccagagugacgaggaaacacagcgcgcgaaaguguauuacgcaaaguuucccccugauauuuaucgaagaaaaguucugcuaauguacccaauccucucuaccgggaauacugugauagaggccgucaaggugcugauugaacauggaguacagccguccguuaucauucuucugagcuuguucucgacaccccacggcgcuaaaucuaucauccaagaguucccugagauuaccauacucacgacugaagugcauccagucgcccccacccacuuuggccagaaguacuucgggacagacuga

SEQ ID NO: 64589 - RNA, 696 nt, Artificial Sequence
  derived and/or modified sequence opt3 from UQCC1__Homo_sapiens__NP_001171906
auggcccugcucgugagaguccuuaggaaccagaccagcaucucccaauggguucccgugugcucucggcugauuccuguaucaccaacacagggccagggggaccgcgcuuugagucgaacuagccagaagauaaaaaucgcagccuuacguauguacacguccuguguggagaagaccgauuucgaagaguuuuuccugagaugccaaaugccggacacauuuaauucuugguuccuaauuacucuccugcacgucuggaugugucuugugaggaugaaacaggaaggacggucggguaaguauaugugccgcaucauuguucauuuuaugugggaggaugugcagcagagaggcagggucaugggggugaaccccuacauccugaaaaagaauaugauauugaugaccaaccacuucuaugcggcuauccucggauacgacgaaggcauucugucagaugaccauggucuggccgcagcccucuggcggacauuuuucaaucgcaagugugaggauccucgacacuuagagcugcuuguagaauauguuagaaaacaaauccaguacuuggacagcaugaacggggaggaucugcuacucaccggagaagugaguuggaggccacuggucgagaagaauccccaguccauucuuaaaccucauucuccaacuuauaacgacgagggccuguga

SEQ ID NO: 64590 - RNA, 381 nt, Artificial Sequence
  derived and/or modified sequence opt3 from UQCC2__Homo_sapiens__NP_115716
auggccgcuagcagauacaggcgguuccugaagcucugcgaggaauggcccguggacgagaccaaacgcggccgagaucuuggggcauaucugcgucagagagucgcccaagcguuuagggaaggagagaacacacagguugcugaaccugaggccugugaccagauguacgaguccuuggcacgguuacacucuaauuauuacaagcauaaauauccacgcccgagagauacuucauucaguggucugagccuagaagaguacaagcucauccuguccacggacacccuugaggaacugaaagagauugauaagggcauguggaagaaauugcaggaaaaguuugcccccaaagggccugaggaagaccacaaggcuuga

SEQ ID NO: 64591 - RNA, 336 nt, Artificial Sequence
  derived and/or modified sequence opt3 from UQCRB__Homo_sapiens__NP_006285
auggccggcaagcaggcugugagcgcauccgggaaauggcuggacggaaucagaaagugguacuauaacgccgcggguuucaauaaacucggccuuaugagggaugacaccauuuacgaggaugaagacgucaaggaggcuauacggcgccugcccgaaaacuuguauaaugaucgaauguuucguaucaaaagagccuuagaccugaaccuaaagcaccaaauucucccuaaggagcaguggacaaaauacgaagaggagaauuucuaucuggaaccauaccuuaaggagguuaucagggaacggaaagagcgcgaggaaugggcaaagaaauga

SEQ ID NO: 64592 - RNA, 1443 nt, Artificial Sequence
  derived and/or modified sequence opt3 from UQCRC1__Homo_sapiens__NP_003356
auggccgcuagcguggucugcagagcagccaccgcgggcgcucagguucugcucagggcccggcgcucccccgcacuucugcgaacuccugccuugcguucuacagcuacguucgcacaagccuuacaguuugugccagagacccagguaucacugcuagacaacgggcucagaguggcuagugaacagagcucccaaccgacauguacugucggaguguggaucgauguugguucuagguucgagaccgaaaagaauaacggcgccggguacuuucuggagcaccuugcguucaaaggaacaaagaaucggcccggcucggcacuggaaaaagagguggagucaaugggugcccauuugaacgcuuauagcacccgcgaacacacugccuacuauauuaaggcacucaguaaagaccugccuaaggcugucgagcugcucggggauauagugcagaauugcuccuuagaagacucucagaucgagaaggagagagauguaauucugagggaaaugcaggagaacgacgccagcaugcgggauguuguguuuaauuaccuucaugcgacagccuuccaaggaaccccauuggcacaggcugucgaaggccccuccgagaacgugcgcaaacugucacgagccgaccuaacggaauaucucaguacucacuacaaggcuccuagaauggugcuggccgcagccggcggggucgagcaucagcagcuucuggauuuggcucaaaaacaccucggagguaucccauggaccuaugcggaggacgcaguucccacacugacuccuuguagguuuaccggcagcgaaauucggcaccgugaugacgccuuaccauucgcucauguggccaucgcaguagaggggccgggaugggccucucccgauaauguggcucugcaggucgccaacgcaauaaucggccacuacgacugcacauacggugggggagugcaucucuccucaccucuugcgagcggcgcuguugccaauaagcugugucagaguuuucaaaccuucucuauuugcuaugcagaaacgggcuugcuaggggcccacuuugugugugaccgcaugaaaaucgaugacaugauguucguccugcagggacaguggaugagacucugcacuuccgcuacagagagcgaaguggccagggguaagaacauucugcggaaugcacuuguaucgcaccuggauggcaccacuccaguuugugaggacaucgggcgaucuuugcucacauacggacgcagaauaccccuggcugagugggaauccaggauugccgagguggaugcgucagucgugcgggaaaucugcaguaaguauauuuacgaccaguguccugccgucgcuggcuaugguccaaucgagcaauuacccgauuacaaccgcaucagaagcgggauguuuuggcugagguucuga

SEQ ID NO: 64593 - RNA, 1362 nt, Artificial Sequence
  derived and/or modified sequence opt3 from UQCRC2__Homo_sapiens__NP_003357
augaagcugcucaccagagccggcagcuucuccagguuuuacucucuuaaaguggcucccaaggucaaagcaacagccgcgccugcuggggccccaccgcagccccaagaccuggaguucacuaaguugccuaacggauuaguuaucgcaucacuggaaaauuauaguccagugagccggauuggucuauuuauaaaagccggcucccgcuacgaggauuucucuaaccucgggacgacccaucugcuucgacugacaucgucauugacuaccaagggagcuagcaguuuuaagaucacacguggcauugaagcaguaggugggaaacucuccgugaccgccacuagagagaauauggcuuauacagucgaaugccugaggggagacguggauauccugauggaguuccucuuaaacguuaccacggcccccgaguuucggcgcugggaaguggcggaccugcagccucagcuuaagauugauaaagcagucgccuuccagaauccacaaacucacgugaucgagaacuugcacgcugccgcauacagaaaugcucuggccaacccccuauauuguccugacuacaggauaggcaagguaaccucugaggaacuccauuauuuuguucagaaucacuucacaagcgcgcggauggcccugaucggccuuggggugucccauccaguccugaaacagguggcagagcaguuuuugaacaugcgcggaggucucggccugucaggggcuaaggccaauuaccgaggaggcgaaauuagagagcaaaacggugauaguuuagugcacgcugccuucgucgcagaaagcgccguugcugggucugcggaggcaaaugccuuuuccgugcugcagcacguacucggagcuggcccgcaugugaagaggggcucaaacacuaccagccaccuucaucaggccgucgcaaaagccacacagcaacccuucgacgugagugcuuucaaugccucuuacuccgauagcgggcuguuuggaaucuauaccauuucgcaggcaacggcggcuggugacguuaucaaggccgcauacaaccaggugaaaacuauagcccaaggcaacuugucuaauacagauguccaggcugccaagaacaaacuaaaggcaggguaucugauguccguggaaucaagugagugcuuccucgaggaaguaggaagccaggcucugguugccggcuccuacaugccuccaucuaccgugcuucagcaaauugacagcgucgcgaaugccgauaucauuaacgcugccaaaaaguuugugucaggucagaagaguauggcagcuuccgggaaucugggccacacucccuucgucgacgaguuguga

SEQ ID NO: 64594 - RNA, 825 nt, Artificial Sequence
  derived and/or modified sequence opt3 from UQCRFS1__Homo_sapiens__NP_005994
augcugagcguggccuccagaucuggccccuucgcuccuguccucucagcaaccaguaggggaguugccggggcgcuucggccacuggugcaggcuacaguaccggccacucccgagcaaccuguguuggacuuaaagcgcccauuucugagccgagaaucccuaucuggucaggcaguccguagaccccucguggccucgguuggccugaacgugccugcuucagucugcuacagccacacggauaucaaagugccagacuucagugaguauaggcggcuugaaguacuggauuccaccaagucuagccgcgaguccucagaagcaagaaaaggguuuaguuacuugguuacaggagugacuaccgucggcguggccuaugcugccaagaaugcggugacacaguucgucagcucuauguccgcaucagccgacguucucgcucuggccaaaauugagauaaagcugagcgauauccccgaggguaagaacauggcauuuaaauggagggggaagccucucuucgugcggcaucgcacccagaaagaaauugagcaagaagcugccguagaguuaagucagcugcgagacccacagcacgaucuugacagagugaagaaaccggagugggucaucuugauuggaguguguacucaucugggcugcguucccaucgcgaaugccggcgauuuugggggauacuauuguccuugccacgguucucauuacgacgcauccggcaggauacggcuagggccagcuccccucaaccuggaagugccuacauaugaguucaccagcgaugacauggucaucgugggauga

SEQ ID NO: 64595 - RNA, 249 nt, Artificial Sequence
  derived and/or modified sequence opt3 from UQCRQ__Homo_sapiens__NP_055217
augggcagagaguucgggaaccugaccaggaugcggcacgugaucagcuacucccucucucccuuugaacagcgcgccuauccucaugucuucacaaaggguauuccaaauguucuucgacguauaagagagucauuuuucagggugguaccgcaauuuguggucuucuaccugaucuauacuuggggaacggaagaguuugaacggaguaaacgcaagaaccccgcugcauacgagaaugacaaauga

SEQ ID NO: 64596 - RNA, 4464 nt, Artificial Sequence
  derived and/or modified sequence opt3 from URB2__Homo_sapiens__XP_005273417
auggccgcuguguacagcggcaucucccugaagcucaaaucuaagaccacaucaugggaggacaaacuuaagcuggcacacuucgccuggauuagucaucagugcuuuuugcccaacaaagaacaagucuuacuggauugggcgagacagagccuaguugcuuucuauaagaagaaacucgagcugaaggaagacauaguggagaggcuuuggaucuacauugauaauauccugcacucccggaaauugcagaaccuccugaagaaugggaaaacuauuaaccugcagaucucucucguaaagauaaucaaugaacgcguggccgaguuuucguuaucaggaagccaacgaaacauuugugcaguccugcguugcugucaggguauccuuaguacgccugccuuggcugugauuuauaccgcaaagcaggagcugaugguugcccuacucucccagcugugcuggucugcuuguagacaaccagaaggcgccguggucgcgcagcuuuucgaggugauccaucuggcauuggggcacuaccuccugauauuacagcagcaaguaaauccgaggcgggccuuuggagacguuacagcucaucugcuccagcccugccuugugcugcgccacuugcuaagcggcgguacuuggacccaggccgggcaaggacagcugagacagguccucuccagggauauucggucacagaucgaagcaauguuccgcggcggcauuuuucaaccugagcugcuuaguagcuauaaagaggggcuguuggaccagcagcagggagaugugaagacaggugcuaugaaaaaccuccuggccccaauggacaccguguuaaaucgacuggucgaugcgggcuacugugccgcaucucuacacacuuccguuguggcuaacucaguagcccuccuguauaaacuuuucuuggacagcuacuuuaaagaagggaaucaacugcucugcuuccaggugcugcccagacuuuuuggaugucugaagaucagucauuugcaggaggaacagucuaaagcucucuccacaagcgauuggaccacggagcuguuagucguggaacaacugcuaaacucgguugccaauaacaauaucuacaacauugcagccgacaggauacggcacgaggaggcucaguuccguuuuuaucgccauguggcggaacuccugaucaaccacgcacaggccccuauuccagcuugguucagaugccuuaagacuuugaucucucugaaucaccucauacuggagcccgauuuagacgaccugcuugccuccgcauggauugaugccgaagucaccgaguucaggacaaagaaagcucaggaagccuugauccggacuguguuucaaaccuacgcaaagcuccgacagguaccucgccuguucgaggagguucuaggcgugaucuguagaccagcggcugaagcccugaggcagccgguccucgcaucaggucccaguacagugcugagcgccugccuuuuggagcugccuccaucccaaauuuuagacaccuggucucucguccuggaaaaauuucagagccuugugcugcccuauuugcagucagaugcugacauggcccucaagagucugucccuaagccugcuccugcauugcaucauguucaacaugcggucucuugauucaaguacgccuuugccaauuguucgcagaacucaguguaugauggagaggaugaugcgugaacuggugcaacccuuacucgcacugcuuccggacacaccugggcccgagccagagcuguggcuacagaaaguaagcgauuccguccuccuguugucuuacaccugggcucagguggacgccauguuuucgcugaauugcagccaguaucacuccaugucaggaccuuuaauaggcguugcgcucgaaaucaguaaccugcccucucuucugccaggcgugaagacucaacauuggaagaaaauugagaaguucacagcccaguuuagcuccuuggggaccuacugucucgaacagcuguaucuacagaaaaugaagcggacgcugaugcaaaccucauuccgaagcgagggagcuauccagucucuuagaugcgaugcagccuuuaucauugguuccggcaggaaaagucucaaucagcgcacaacugcuagcugggacgggcaagucggaauggugucuggccugaccuaccccguagcccacuggcauuugauaguguccaaccugacaaucuuaauuucauaccucuguccugaugacguugguuaucuggcaaguguccuucugcggacuuugccaauggggaaggcgcaggaggugagcaucgacgaagaggccuacauuacccucgaaaagaucucgaaggcuuuccugcacuccccgcuauuucccgagaugcagucucugcacagcgccuuccuuacaugcgugaccacuucauguaguuccauacucugcucuggcgcacagagagauagcggacuggucucccaacaguugccuugguuauuugaaaaggaccauaugguugugggccacugggagaauagguucgcuaaagccgggccagagggaaucgaaccccgcggugagauugcacagaaccugcucucacuggugaagucugauuucccuauccagcuugaaggcgagcaacuggaaaguauuuuggggcuacuggagguaaucucugcccuccagcuggacucccuuuuaccacccuaucauguccacuacuuucuggugcucuugagcauggcuguuacgaaacugggauguucgugcucaucuagucucgcgcugaaguuccuuacaaccuguuaucagcuguugggcuaccuacagaaggguaaauccgcccgaagcguguuuaagauaauguaugggucugauauuuucgaggucgugcugacuagccucuuucgggcauccucacguuucuuaaucgaaauggacgauccggcuuggcuggaguuucuucaaguuauuggcaccuuccuggaggaacucaugcagauguugauccagaugaaacugagucucgugcugaauuuuagaaagauaacagccuuccuuagcagcuccaaaccuuacaccgaagccgcuucaaguaagcagcuagagaaccaaaauccacagggaaggcagcuguuguuaguaagccugacucgccucugccacguccugggccccuuucuuaaagagcaaaagcuggggcaggaagccccugcagcgcucuccgaguugcugcaacagguggugcuacagacaggagcuguccugcagcucugcucuguucccggugcccggggcuggagacuuccaucggugcugaucagcucaguauccacguuauuggaagcagaccuggggcagcauuguagggauggaggcgccgacauuagucaggguucugaucgaacccuccugagccacguggcucuuuaccaaggggucuauucccagauccugcucgaguugccugcacuggccggccaugaccagucauuccaggcggcuuuacaauuucuaacucuguucuuccucgcccccgagcuucacccaaagaaagauucuguguuuacaagcauguuccauaguguucgccgggugcuggcagacccggaaauuccuguccaggugacccaggacaucgagccccacuugggagcccuguuuacacaaaugcucgaaguuggcacuaccgaggaucugagacuugugaugcagugcauacuccaggggcuggacgucuccaacauguggaaggcugauguacaguugcugaauagggaagccagccaagagcagccagugucuuuaacgguugugggacccguccuagacgugcuggcagcucuccuucgucagggcgaggaagccauugguaacccucaccauguaucacuggcguucuccaucuugcugaccgugccacucgaucaccugaaaccccuugaguacgggagugucuuuccucgcuuacauaauguucuguucagcauccuccagugucacccgaaggugauguugaaagccauuccaucguuucugaacucuuucaaccggcuaguguuuuccgucaugagagaaggaaggcaaaaggacaagggcagcaucgaugaccugcccacagugcucaaaugcgcacgacuuguugagcggauguauucacauauugcugcccgcgcugaagaguucgcaguauuuaguccuuucaugguggcccaguacguccuggaggugcagaagguuacuuuguauccagccgugaaaucucugcuccaggaagguauauaccugaucuuagaucuuuguauugagcccgacguccaauuccugagagcuucccuccagccuggcaugagggauaucuuuaaggaacuauauaaugacuaccugaaauaccacaaggcgaagcacgagggggaaaaacgguauaccgcauga

SEQ ID NO: 64597 - RNA, 2796 nt, Artificial Sequence
  derived and/or modified sequence opt3 from URGCP__Homo_sapiens__NP_001071131
auggccagccccggcaucgagguggaacugcucgggaagggacacuccgaccuuggugaggucgcuccugaaauuaaagcaucugagagaaggaccgccguugcgauagcugaucuggaauggcgggagauggagggcgacgauugcgaguuccgcuacggggacggaacaaacgaagcccaggauaaugacuuuccaacuguggaacgaucacguuugcaagagauguuaagucugcuaggccucgagacguaucagguacagaagcugagccuucaggauucccugcaaaucucuuucgacucgaugaaaaacugggcaccccaggugccgaaggauuugccuuggaauuuucucagaaaacugcaggcccugaacgcugacgcaaggaauaccacaaugguccucgauguguuaccagacgcccggcccguugaaaaggagucacagauggaagaggaaauuaucuacugggauccugcugacgaccuggccgcggauauuuauagcuucagugagcuuccaacucccgacaccccugugaacccauuggaucugcuaugugcacuccugcuuuccucugacagcuuucugcaacaggagaucgccuugaagauggcucucugccaguucgcccugccguuaguccugcccgauuccgaaaaucauuaccacacauuucuccuuugggcaaugcgcgguauagugagaaccugguggucacagccuccaagggggaugggaaguuuccgggaggacagcguaguucugucucgcgcucccgccuuugcguucgugcgaauggaugucuccucaaacagcaaaagucaauugcuaaaugccgugcugucuccuggccauagacagugggacuguuuuuggcacagggaucucaaccugggcacuaaugcacgggaaaucuccgacgggcuuguggagauuagcugguucuuuccaucgggacgugaagaucuggacaucuuccccgagccggucgcuuucuugaaccuccgcggugacauuggcucucauuggcugcaguuuaaguuacugacagagaucuccucagccguuuucauacuaaccgauaauauuaguaaaaaggaauauaaacuccuguacagcaugaaggaguccacgacuaaguauuacuuuauccuuucuccuuacagagggaaaaggaacaccaauuugcgguuccugaacaagcucauucccgugcugaaaaucgaccacagccacguacuugugaaggucucaaguacagauuccgacagcuuugugaaacgaauccgcgcuauuguuggaaacgugcugagagccccaugcaggcgggucucuguggaagauauggcacaugccgcucgcaaguugggccucaaaguagacgaggauugugaagagugccaaaaggcgaaggacagaauggagaggauaacucguaaaaucaaggauucagacgcauaucggcgagaugaacugagauuacagggugacccuuggaggaaagccgcucagguugagaaggaguucugucagcugcaaugggccguggaucccccagaaaaacaccgcgcagagcuacggagaaggcuccuggaacuucgcaugcagcagaaugggcaugaccccaguagcggaguccaggaguuuauuuccggcaucucuucgccuagcuuguccgaaaagcaauacuuccugcgauggauggaguggggccucgcccggguggcucagccacgucugagacagccgcccgaaaccuuacugacacuuaggccuaagcacgggggaaccacggacgucggugagccauuguggcccgagccucucggcguggaacacuuucugcgcgagauggggcaguucuaugaagccgagucaugccuaguugaagcaggacggcugccagcgggccaaagaagguuugcucauuuccccggucucgccagugagcugcuuuugacugggcugccguuagagcucauagauggcucuacacugagcaugccugugcgauggguaaccggacuucugaaagaauugcacguccgccucgagcggagauccaggcuggugguucuaucaacugugggcgucccagggacaggaaagagcacccugcucaacacgauguuuggucugcguuucgcaaccggcaaaucuugugggccccgcggagccuucaugcagcuuauuacaguggcugaaggcuuuucccaggacuuggguugcgaucauauccugguaaucgacagugggggcuuaauuggaggcgcccucacuagcgcaggggaucgguucgagcuggaggcuucucuugccacccugcuaaugggacucuccaaugugacaguuaucucacuggcggaaacuaaggacauuccugccgcuauauugcacgcauuucugagauuagagaaaaccggucauaugcccaacuaccaguucgucuaucaaaaucuccacgaugugagugugccaggcccuaggccccgagacaagcggcagcugcuugauccaccgggggaccugagccgcgccgcugcccagauggaaaagcaaggagauggcuuuagagcauuggcgggucucgccuucugugacccugagaaacagcacaucuggcauauucccgggcuguggcacggcgcuccacccauggccgcagucucgcuagcuuacuccgaagccaucuuugagcugaagaggugccuucucgagaacauccggaauggacugucuaaccagaauaaaaacauucagcaauugauagaacugguucgaagauuauga

SEQ ID NO: 64598 - RNA, 1428 nt, Artificial Sequence
  derived and/or modified sequence opt3 from URI1__Homo_sapiens__NP_001239570
augaccacauggagcucccugcagggcucucacgugucaaagagagcccucgcuuacgcacuugucguuacuaacugccaagagaggauccagcauuggaaaaagguggacaaugauuauaacgcccugcgggaacgcuugaguacguuacccgacaaacugagcuacaauauuaugguaccuuucgggccauuugcguucaugccgggaaagcuagugcacaccaacgaggucacagugcuccugggugauaauugguuugcuaaauguuccgccaagcaggcaguuggccuuguggaacaucgaaaggagcacguccguaaaacuauagacgaucugaagaaagugaugaagaacuucgaaucuagaguagaguuuaccgaggacuugcagaaaaugucggaugccgcuggggacaucguugauauuagggaagagaucaagugcgacuucgaauuuaaggcaaaacaucggauugcccacaagccccacucaaaaccuaagacaagcgauaucuucgaggcugacauagccaaugaugugaaaaguaaggaccuccuggcggacaaagagcugugggcacgccucgaagaguuagaaagacaagaggaacugcuuggagaguuggauuccaagccagacaccgucaucgccaacggcgaggauacuacaucuagcgaagaggaaaaggaggacaggaauaccaacgugaaugcuaugcaucaggugacggauucccacacucccugucauaaagacgucgccucaagugaaccuuuuagcggucagguuaacucucagcugaauugcuccgugaacgggucaagcaguuaucacucugaugacgaugacgaugacgacgaugacgaugacgaugacaauauugaugacgaugacggagauaacgaccacgaggcacuaggcguaggcgauaacuccaucccaaccauuuacuucagccauacaguggagcccaagcggguccgcaucaauacugggaaaaacaccacacucaaguuuucggagaaaaaggaggaagcuaagcgaaaaagaaagaauaguaccggauccggucacucagcccaagagcugccuacgauaaggacuccagcggacauuuaucgggccuucguggacguugugaacggcgaauacgucccgcguaaaaguauccuuaagagccgcuccagagaaaauucuguguguagcgauacaucagagaguuccgcagcugaauuugacgauaggcgagggguacugcggagcauuucuugcgaggaagccaccuguucagacacuucugagagcaucuuggaggaggaaccccaggaaaaccagaaaaagcuccugccuuuauccguuacaccagaggugcugcgccucgucggauauucuagaaaucuugcuccccugaacgugaucuuguga

SEQ ID NO: 64599 - RNA, 441 nt, Artificial Sequence
  derived and/or modified sequence opt3 from URM1__Homo_sapiens__NP_001129419
auggccgcuccccugagcguggaggucgaguucggcgggggagcagagcuccuuuuugacgguaucaagaaacacagaguuacccugccuggccaggaggaaccaugggauauuaggaacuuguuaauauggaucaagaaaaaucugcuaaaggaacggccggaacucuucauucaaggggacuccgugcgccccggaauccugguacuuauuaacgaugccgacugggagcuguuggugucuacacucggcgauaucccuccacccgcgccugcucuggccgcaucagucgguaaacgaugggccaguccacaggcucauauagaauggcuggggaaucccccuccacacagcuccccgacucuccguuuacuggagucucccacgccuggagaagagggcaugggcucgugggggcauggaucaaccccacccagcuga

SEQ ID NO: 64600 - RNA, 2211 nt, Artificial Sequence
  derived and/or modified sequence opt3 from UROC1__Homo_sapiens__NP_001159446
augagcucccugcaggcccucugcucuggccuuccccugagaccuuugccagagaacagggggcggcaagcuggagugccgcacgcacccguccgcaccccuucauuaaguccaguugaaaagcagcuggcccuacgaaaugcgcuccguuacuucccucccgacgugcaggagcugcuugcuccagaauuugcccaggagcugcaauuguauggucauaucuacauguauagauucugucccgauauugaaaugagggcauacccuauagagcaguauccaugccagacaaaaguagccgcugcaaucaugcacaugauuaugaacaaucucgacccggccguggcucaguuuccccaagagcuggucacuuacggcgggaacggacagguguucagcaauugggcccaguuuuggcugacgauguucuaucucuccaagaugaccgaggagcagacauuaguuauguacucuggccauccucugggucuuuuuccaucgucacggagcgcgccccgcuuggugaucacuaacgggauggucauuccuaauuacaguuccagaaccgaauaugagaaacuguucgcacuaggagugacaauguacggccaaaugaccgccggcucuuauuguuacaucgggccacagggaauaguacacgguacuguucucacagugcugaacgcugccaggcgguaucuuggcaucgaggaucuggcagggaaggucuuugugaccagcggauugggcgguauguccggggcucaggccaaagcggccgugauugucggaugcaucggcguuauugcagaaguggacaaggcugcccucgagaagcgccaucgacaaggcuggcugauggaaguaacggauucauuagacagauguauccagaggcugcgggugcuccagcuugggcugcagcaagcucuuggaugggccggucuacccgcagcccugggccucugcguccugaguuguuucgugaaucuugcuccgcugggggagggacguugcuuggcgccuagcggcuuuucucgcccccuccugggugcaccaguuuuacugcuauguccuuccagagaagccaggaaaaagaaagaggugcucucacugggguaccacggcaacgucguggcucuuugggagcgguugguacacgaacuggauacuaccggagagugccucguugaccugggcagcgaucagacaaguugucauaaucccuucaacgggggauauuacccagugcagcuuucuuuuacugaagcccagucccugauggcaagcaaucccgccgucuucaaggacuuggugcaagagucgcuccgacgccaggucucugcuauaaacagacuggccgaagagaaauucuuuuucugggauuacgguaaugcauuuuuacuggaggcgcagagggcuggcgccgacguggaaaagaagggggcaggacggaccgaguuccgcuauccuuccuacguucagcacauuaugggcgauaucuuuucacaagguuucgggccauuuagaugggugugcacaaguggcgacccgcaggaccuagccguaaccgaugaacucgcuacgagcguccuggaggaagccauugcagacggagugaaaguuuccgugaaguugcaguauauggauaacaucagguggauccgugaggcugcccggcaucgauuggucgugggcucucaggcgaggauucuguacagcgaccaaaaagggagaguagccauagcuguggcaaucaaccaggccauugcuugccgccggaucaaggcccccguuguccucucaagagaucaccacgacgugaguggaacugauuccccuuucagggagacaagcaauauauaugacgguucugcauuuugugcggauauggccgugcagaacuucgucggcgacgcuugccgcggggccaccuggguugcacugcauaauggaggcggugugggguggggcgaagugauuaacggaggcuuuggguuaguacuggauggaacuccagaggcugaaggccgagcccggcuuauguugucaugggacgucaguaaugguguggcacguagauguuggagcgggaaccaaaaagccuacgagaucaucugccagacaaugcaggaaaauuccacccucguugugacgcugccccacaaggucgaagacgagagggugcuacagcaagcucugcagcucuga

SEQ ID NO: 64601 - RNA, 1041 nt, Artificial Sequence
  derived and/or modified sequence opt3 from UROD__Homo_sapiens__XP_011540382
auggaggccaacggccuggggccccagggauucccugaacucaagaaugacaccuuucuuagagcugcauggggugaggaaacagauuacacuccaguguggugcaugaggcaagccggccgguaucugccggaguuccgcgaaacgcgagcggcucaggacuuuuucagcaccugucguucccccgaggccugcugugaguugacauuacaggcacuggggauggaagucacuaugguuccuggaaaaggcccaucuuuucccgagccucuaagagaggaacaggaucucgagaggcugcgggacccagaagugguagccucagagcuugguuacguguuccaagcuaucacccugacacgccagagauuggcagggagggucccccucauuggauuugccggcgcuccuuggacccugaugacuuauaugguggaaggcgggggaaguagcacaauggcccaggcgaagcgguggcuguaccagcgcccacaagcaucccaccagcucuuacgaauacugaccgaugcccuuguuccguauuuggugggucaggucguggcuggcgcccaggcacugcaacuauucgagucucaugcugggcaccucggaccccagcuguuuaacaaauucgcccuuccuuacaucagagacguagcgaagcagguuaaagccaggcugcgggaagcaggcuuggcuccagugcccaugauuaucuuugccaaggauggucauuucgcucucgaggagcuggcccaagcaggguaugaagucgugggauuagacuggacgguggccccuaagaaagcucgugagugcgucggcaagacuguuacccugcagggcaaucucgauccaugugcgcuuuacgcaucggaagaggaaauugggcagcuggugaaacagauguuggacgauuuuggaccccaccgcuacaucgccaaccuaggucauggccuguauccggacauggauccugagcacguaggggcuuucguggacgccguccacaagcauucaagacuccugaggcaaaauuga

SEQ ID NO: 64602 - RNA, 798 nt, Artificial Sequence
  derived and/or modified sequence opt3 from UROS__Homo_sapiens__NP_000366
augaaggugcugcuccuuaaagacgccaaggaggaugacugcggccaggaucccuacaucagagaacugggguuguauggauuagaggcuacccugauuccuguccucagcuucgaauuucuaucccugccaucuuucucagagaaacuuagucacccggaagacuacgguggccugauauuuacaagccccagggcaguugaggccgcggaguugugucucgaacaaaacaauaagacugaggugugggaacggucccugaaagagaaguggaacgcuaagucuguauauguggucgggaaugccacggcaucgcuggugucaaaaaucggacucgauaccgagggcgaaacaugcgguaacgccgagaaguuagcugaauacauuuguagccgcgagaguuccgcacugccucuuuuguucccaugcgggaaucugaaacgagaaauccuacccaaggcccucaaagacaagggaauugcuauggagucuaucacuguuuaucagaccguggcccauccuggcauacagggcaaccugaauagcuacuauucccagcaaggggucccagcgucaaucacauuuuucagucccagcggacuuaccuacucucugaagcacauucaggaguuguccggugauaacaucgaccagauuaaauuugcagccaucggcccuacuacagcucgugcccucgcagcucaggggcugccagugucauguaccgccgaaagcccgacgccccaagcguuagccacuggaauaagaaaggcacugcagccucauggcugcuguuga

SEQ ID NO: 64603 - RNA, 744 nt, Artificial Sequence
  derived and/or modified sequence opt3 from USB1__Homo_sapiens__NP_001182231
augagcgccgcuccccuggugggcuacuccucuucagggagugaggacgaaagcgaggauggaaugagaaccaggccuggugacggcucccaccggcgcgggcagucuccacucccgcgacaacguuuccccgucccugauucgguucuuaacauguuuccaggaacagaagagggccccgaagacgauucaacuaagcauggugggagagugaggacguucccucacgagcggggaaauugggcaacccauguauaugugccauacgaggccaaagaagaguuucuggacuuguuagauguccugcuaccccacgcgcagacauaugugccucgccucguuagaaugaagguguuccaucugagccuuagucaguccgucgugcugaggcaccacuggaucuugccauuuguacaggcucucaaagcccggaugacuucuuuccaucgcaccuuuauuggccuggaaguuacaagcggccacgcacaauuccuggaccucguguccgaggucgaucgagugauggaggaauuuaacuuaaccacuuucuaccaggacccgucauuucaucugagucuugccuggugcgugggggaugcuagauugcagcuggagggacagugucuacaagaacuccaggcaauagucgacgguuucgaggaugccgaaguucugcuuagggugcacacagagcagguacggugcaagagcggcaauaaauuuuucucuaugccccugaaguga

SEQ ID NO: 64604 - RNA, 780 nt, Artificial Sequence
  derived and/or modified sequence opt3 from USE1__Homo_sapiens__NP_060937
auggccgcuagcagacuggagcucaaccuugugaggcuguugucccggugcgaagcaauggccgcggagaagcgcgaccccgaugaauggcgauuagagaaauacgucggcgcucuggaagacaugcuacaggcccucaagguucacgcaucuaaaccugccucagaggugaucaaugaguauaguuggaagguagauuuccugaaagggaugcuucaagcugaaaagcugaccagcuccucugagaaggcauuggccaaccaguuucucgcuccaggacgugugccgacaacugccagagaaaggguccccgcgacgaaaaccgugcaucugcagucgcgggcacgcuacacaucagagaugagaagcgagcugcucgguacugacagugccgaaccugagauggauguuaggaagcggaccggcguggcugggucccagccagucucugaaaaacaaagcgccgcagaguuagaccuggugcuucagcgccaccagaauuugcaggaaaagcuggcugaggagaugcuaggacucgcccgaucccugaaaacaaacacccuugcggcccaaucaguaauuaagaaggauaaucagacucugagucauagcuugaaaauggcagaccagaaccucgaaaagcugaaaacagagucugaaagauuagagcagcacacccaaaaguccguuaauuggcugcucugggcuaugcuuauaaucguguguuucauuuuuaucucaaugauucuguucaucaggauaaugcccaaauugaaguga

SEQ ID NO: 64605 - RNA, 933 nt, Artificial Sequence
  derived and/or modified sequence opt3 from USF1__Homo_sapiens__NP_001263302
augaagggccagcagaaaaccgccgagacagaagaggggacugugcaaauccaggaaggagcugucgcaacgggugaggaccccaccagcguugccauugcguccauacagucugcugccacauucccugauccaaacgugaaguacguauuuagaacugaaaauggcgggcaagugauguauagggucauccaggugucagagggacagcuggacggccagaccgaggguacaggggcaauuaguggauacccggccacccaaagcaugacucaggcuguuauccagggcgcauucacauccgaugacgccguggauaccgaaggcacggcugccgagacucacuauaccuacuuucccucuacagcggucggggacggagccgguggcacuaccucggggucaacagcagcugugguaaccacgcagggaagcgaagcccuccuuggccaagcaacuccuccagguacagggcaguucuuuguuaugaugaguccccaggaggugcugcaaggaggcucccagcggucuauugcuccucgcacccauccauauagccccaaauccgaggccccucgaacuacacgugaugaaaagagaagggcgcagcacaacgaggucgaacggcgcagaagggacaaaaucaauaacuggauagugcaguugucaaagaucauuccagauugcaguauggagagcaccaagucuggccaauccaaagggggaaucuuaucaaaggccugugacuacauucaggaacugcggcagagcaaucaucgccuaagugaggagcuccagggucuggaucaacuucagcuggacaacgauguguugcgacagcaggucgaagaccucaaaaauaagaaccugcugcucagagcacaauuaaggcaccauggccuggagguugugaucaaaaaugacucuaacuga

SEQ ID NO: 64606 - RNA, 1041 nt, Artificial Sequence
  derived and/or modified sequence opt3 from USF2__Homo_sapiens__NP_003358
auggacaugcuggaucccggccucgacccugccgcuagcgcaaccgccgcggcugccgcaucccacgauaaggggccagaggccgaagagggaguggaacuucaggaggguggcgacgggccgggagcugaggaacaaacagcagucgccaucacuucuguucagcaggcugccuucggcgaucauaacauucaguaccaauuuagaacggagaccaaugguggacaggugacauauaggguagugcaggucacugacgggcagcuggauggccaaggcgacaccgcgggggcagugucaguugugaguacagccgcuuucgccggaggucagcaggcagucacccaggugggcguagauggggcugcccaacggcccggaccugcggccgcaagcguuccacccggcccugcugccccauuucccuuggcugugauacagaacccuuucuccaauggugggucuccagccgcagaagccgucucgggagaggcucgcuuugcguacuucccggcaucaagcgugggcgacacuacagccgugaguguccagaccacggaucaauccuuacaggcuggcgggcaguuuuauguuaugaugacuccccaggacgugcugcaaaccggaacacagcgaacuaucgccccucguacccacccauacucucccaaaauugaugguacaagaaccccuagggacgaacggcgcagagcacagcauaacgagguagagaggcggcgccgagacaagaucaauaacuggauugugcagcuaagcaaaaucauaccagauugcaaugccgacaacuccaagacgggcgcuucaaaagggggaauccucaguaaggccugugauuauauuagagaacugaggcaaacuaaucagcggaugcaggagacauucaaggaagcagagcgucuucagauggacaacgaacuguugcgccaacagaucgaggagcucaaaaaugaaaacgcgcugcugagagcucagcuccagcaacacaauuuagagauggucggcgaagguaccaggcaguga

SEQ ID NO: 64607 - RNA, 1602 nt, Artificial Sequence
  derived and/or modified sequence opt3 from USH1C__Homo_sapiens__NP_001284693
auggacagaaagguggccagggaguuccggcacaaagucgauuuucugaucgaaaacgacgcugagaaggauuaccucuaugacguucuucgcauguaccaucagaccauggauguggcaguacuggugggcgacuugaaauuagucauuaaugaacccagccgacugccucuauucgaugccauacguccacucaucccgcugaagcaccaaguggaguaugaccagcuuacacccagaaggucccggaaacugaaggaaguucgcuuggauagacuccauccugaggggcugggacugucugugagggguggccucgaguuugggugcggauuauucauuucacaccugaucaagggcggucaggcggacagugucgggcuucaggugggagaugaaauuguacggaucaacggcuacagcauauccucuuguacucaugaggaaguuaucaauuugauucgcacgaaaaagaccgugucgaucaaaguccgacacauuggccugaucccagugaagucaagccccgacgagccucuaacauggcaauauguggaucaguuugucagugaguccgggggaguuagagguucucucggcagcccagggaacagggaaaauaaagagaagaagguguucauaucccugguaggaucacggggccuugguugcaguauuagcucugggcccauccagaaaccuggaauuuuuaucucccacgugaagccaggcucacugagcgcugaagucggcuuggagaucggggaccagauuguggaaguuaacggaguggacuucaguaaucucgaucauaaagagggucgugagcuguuuaugacugaccgcgaaagauuagccgaggcaaggcaacgggaacugcagcgacaggagcuccuuaugcagaagcgccuggccauggaaucuaacaaaauauugcaagagcagcaggagauggaaagacaaaggcggaaggagaucgcucagaaagcagccgaagagaaugaacgcuacagaaaggagauggagcagauugucgaagaggaagagaaguucaaaaagcagugggaggaagauuggggcuccaaagagcaacuacugcucccgaagaccaucacagcugaagugcaccccguaccucugaggaaaccaaaguaugaccaggggguugagcccgaacuugagccugccgaugaccuggauggaggcaccgaggaacagggugagcaggacuuucguaaguacgaagagggguucgauccauacagcauguuuacucccgaacaaauaaugggcaaagacgugcgguugcuccgaauuaagaaagagggaucgcuggauuuagcgcuggagggcggggucgacucuccgaucggaaagguggucguguccgcaguuuaugaaagaggugccgcugagaggcauggcgggaucgugaaaggagacgaaauuauggccaucaacggcaagauuguaacagauuacacccuagcagaggcugaagccgcgcuccagaaggccuggaaucaggguggggacuggauagaucuggucguggcaguuuguccucccaaagaguaugacgaugagcuuacguucuucuga

SEQ ID NO: 64608 - RNA, 1386 nt, Artificial Sequence
  derived and/or modified sequence opt3 from USH1G__Homo_sapiens__NP_775748
augaacgaccaguaccacagagccgcuagggauggcuaucuggagcuccuuaaggaagcaacccggaaagagcugaaugcccccgacgaagaugggaugacaccuacuuugugggcggcuuaccauggaaacuuagagagccugcgccuaaucgugucccgagguggcgacccagauaagugcgacauuugggggaauacgccgcuccaccuggccgcaucuaacggacaucuucacugucugucauucuuggucaguuuuggcgccaauauauggugccucgauaacgacuaucauacaccccuggauauggcugcaaugaaaggucacauggaauguguucguuaccuggacagcaucgccgcuaagcaauccucucucaauccuaaauuaguggggaagcugaaggauaaagccuucagagaggcggagaggcggauucgcgaaugcgcaaaacuucagagaaggcaccaugagcggauggaacgccgauauagaagggaguuggccgagcggucggacacccugucauuuagcagucuaacuuccucuacccucagccgucgccugcagcaccuugcucugggaucccauuugccauacucacaggccacacuccacggcaccgcaagaggcaaaacuaagaugcagaaaaagcuggaaaggcggaagcaagggggagaggguacauucaaaguaagugaagauggccgaaagagcgcucgcucuuuauccgggcugcagcucggaucagacgugauguuugucagacagggcaccuaugccaaccccaaagagugggguagggcgccucuucgggacauguuccugagcgaugaagacagugugucucgcgccacguuggcagcugagccagcccacuccgagguuagcacugauucggggcaugacucucuauuuaccagacccggacugggcacaaugguguucaggcguaauuaccucuccucaggccugcacgggcuuggacgggaagaugguggccuggacggggucggagcuccucgaggcagauugcaaaguagcccaucccucgaugacgauucucuggguagcgccaacucauuacaggacaggaguuguggggaggaacugccgugggaugagcuagaccucggccuggacgaagaucuugagcccgagacuuccccuuuggaaaccuuucuggcaagccuccauauggaggacuucgccgcucugcuucgccaggaaaagaucgaucuggaggcguugaugcucugcucugaccuggauuuacggucaauuagugugccacugggacccagaaagaagauccuaggcgcaguaaggcgccgacggcaggccauggaacguccuccagcucucgaggacacagagcuguga

SEQ ID NO: 64609 - RNA, 4641 nt, Artificial Sequence
  derived and/or modified sequence opt3 from USH2A__Homo_sapiens__NP_009054
augaacugccccgugcugagccucggcuccggguuccuuuuucaggucaucgagaugcugauuuucgccuacuuugcuucuauaucauugaccgaaaguagaggauuauucccuaggcuggagaauguuggugcauuuaagaaagugagcaucguaccaacacaagccguguguggccuaccggaccgguccacuuucugccacucuucggcggcugccgaaucaauucaguuuuguacgcagcgcuucugcauccaggauugucccuaucgaagcagucauccuaccuacacagcacucuuuuccgccgggcugucuagcugcauuacuccagacaagaacgaucuucaccccaaugcucauuccaacucagcaaguuucaucuuuggaaaucacaaaagcuguuucucuuccccuccaucacccaagcugauggccagcuuuaccuuggcugucuggcucaaaccugagcaacagggcgugaugugcguuauagaaaagacaguggacggucagaucgucuucaagcugaccauuagugagaaagagacuauguucuauuaccguacagugaacgggcugcagccaccgaucaagguaaugacccucggaagaauuuuaguuaaaaaguggauccaucugucugugcaaguccaccagacgaaaauauccuuuuucauuaauggcguggaaaaggaucacacucccuuuaacgccaggacccuuagcggcucgaucacagacuucgcgucugggacugugcagauuggacaguccuugaauggucuggagcaauuugucggccggaugcaggauuuccgccuauaucagguugcacucaccaacagagaaauccuggagguguuuucaggggaccuucugagguugcaugcccaaagucacugucggugcccuggaagccauccacgcguacacccccucgcucagcgauacuguaucccuaaugaugccggcgacacagcagauaacagaguguccaggcugaauccagaggcucaccccuuaucuuucgucaacgacaaugauguggguaccagcuggguuucaaacguguuuacgaacauuacucagcugaaucagggggucacaauaaguguggaccucgaaaacggacaauaucagguauucuacaucauuauccaguuuuucuccccgcagccuaccgagauacggauucaacguaagaaagaaaauagccuugacugggaggauuggcaguacuuugcccgcaacugcggcgcguucggcaugaagaauaacggggaccuggaaaaacccgauucuguuaauugcuugcagcuaucaaacuucacuccauauaguagaggaaaugugacauuuagcauccugaccccuggucccaacuacaggccaggcuauaauaacuucuacaauacgcccucccuccaggaguuugucaaggccacccaaauccgguuccauuuucacgggcaguauuacacaacugagaccgcagugaaccugcgacaucgcuauuacgcugucgacgaaauuacaaucucuggaagaugucagugccacggccaugccgauaauugugacacuaccucgcagccuuacaggugccuuuguagccaagaguccuucacagaaggucugcacugcgaucgguguuugccacucuauaacgacaaaccguuucgccagggggaucagguguacgcuuucaacugcaagcccugucaaugcaauucacacaguaaaucuugucauuauaacauuagcguugacccuuuuccauucgagcacuuuagaggcggaggcggggugugcgaugacugcgaacauaauaccacuggaaggaacugugagcugugcaaggacuacuucuuucgucagguaggugccgaucccuccgcaauagacgucuguaagccuugcgauugugacacggugggcacacggaaugggucaaucuuaugcgaucagauuggaggccaguguaacugcaaacgacacguuagcgguagacaauguaaucagugccagaacggguucuauaaucugcaggagcuagacccagauggcuguucucccugcaacugcaauaccuccggaacuguggacggcgauaucaccugucaccaaaacagugggcagugcaaguguaaagccaaugucaucggacucaggugcgaccauuguaacuucgguuuuaaguuccugcgcagcuuuaaugaugugggcugcgaaccgugucagugcaaccuucacgggucuguaaacaaauucuguaauccucauuccggacagugcgaguguaagaaggaagcuaaaggcuugcaaugcgacacaugccgggagaacuuuuacggucuggaugugaccaauuguaaggcgugcgacugugacacugcagggucacucccaggcacaguuugcaacgccaaaacgggacaguguauuugcaagcccaaugucgaaggcagacaguguaacaaaugccuggaggggaauuucuaucuuaggcaaaacaauaguuuucuguguuugccuugcaacugugauaagaccggaacuauaaauggcagccuccugugcaacaagucgacaggucagugccccuguaaauuaggggugaccggacugcgcugcaaucagugugagccacaccgauacaaccuaacaaucgacaauuuccagcauugccaaaugugugaaugcgauucccucggcacucugccugguaccauuugugaccccaucucuggccagugccuuugugugccaaaccggcaggggcguagaugcaaccagugucaaccgggauuuuacauuagcccuggcaaugcuacggggugcuugcccugcucaugucacaccacaggagccgucaaccacaucugcaauagucugacuggccaguguguuugccaggaugcauccauagccggucagaggugugaccaaugcaaggaucauuauuucggguuugacccacagaccggacgcugucagcccugcaacugucaccucucuggcgcucugaaugagacaugccauuuagugacuggucaguguuucugcaaacaauucgugaccggcagcaagugugaugccugcguaccuuccgcaucacaccuggacgucaacaaucuuuuggggugcagcaaaacgccauuucagcagcccccuccgcggggacaagugcagaguucuuccgcgaucaaccucagcuggucgccacccgauucaccuaaugcucauuggcugacauacucucuacugagagacggcuucgaaauuuauaccacugaggaucaguacccauauaguauccaguacuuucucgacacagaccugcuucccuauaccaaguacuccuacuauauugagacuaccaacguucacgggagcacaaggucuguggccgucacguacaagaccaaaccuggagugccggaaggcaauuugacucugagcuauaucauacccauugguuccgauucaguuacauuaaccuggacaacucucaguaaccaaagcgggccaaucgagaaguacauucugucuugugcaccucuugccggaggccagcccugcguguccuaugaaggucacgagaccucagcuacgaucuggaaucugguaccauucgccaaauacgacuuuaguguccaggcauguacaagcggcgggugcuugcauucccucccuauaaccgugacuaccgcucaggcgcccccacaacgacugucuccgccuaagaugcagaaaaucucgagcacagaacuacacguggaguggucacccccagccgagcugaacggaauuaucauucgcuaugaacucuacaugcggagacugagguccacuaaggagaccacaagugaagagucucgugucuuccagagcuccggcuggcuuucaccccauucuuuuguugaaagcgccaaugagaacgcuuugaaaccuccacagacgaugaccacuaucacagggcuggagcccuacaccaaguaugaguuccgcguguuagcaguaaauauggccggaaguguguccagcgcuugggucucugaacggacuggcgaaucagccccuguguuuaugauaccgccauccguuuucccccucaguagcuacucgcugaacauuucuugggagaagccugcagauaacgugacaagagguaaagucgugggguaugacaucaauaugcuuuccgaacaaagcccccagcagucaaucccaauggcguuuagucaacugcuacacaccgccaagucucaggagcucuccuacacgguugagggacugaaaccuuauaggauuuacgaguucacuaucaccuuguguaacagcgugggcugcgucacaucagcuaguggcgccgggcagacccuggcagcugcccccgcacaguuacgaccaccucucguaaagggaauuaauagcacuacaauacaccugaaaugguuuccgcccgaagaacuuaacgguccauccccuaucuaucaacuggagcggcgcgagucuagcuugcccgcccucaugaccacaaugaugaagggcauuagauucaucgggaauggauacuguaaguucccauccucaacucauccugugaacaccgauuuuacgggcaaaugcguuuga

SEQ ID NO: 64610 - RNA, 2922 nt, Artificial Sequence
  derived and/or modified sequence opt3 from USO1__Homo_sapiens__NP_001276978
augaacuuccugagaggcgugaugggagggcagagcgccgguccccaacacaccgaggcugaaacaauccagaagcucugcgacagggucgcauccucuacucuucuggaugaccggcgcaaugccguucgagcguugaaaucauuaaguaagaaauaccgucuggaggugggcauucaggcuauggaacaucuaauacacguacuccagacggauagaagcgacuccgagaucauuggguaugcccuggauacccuuuacaacaucauuucuaaugaagaggaggaagagguggacgaugucgaagaggagaacucgacaaggcaaucagaagaccugggaagccaguuuacugagaucuucauaaagcagcaggaaaaugugaccuugcuccugagucugcucgaggaauuugauuuccauguucgguggccuggcgugaaauuacugacaucccuuuugaagcaacuggguccacagguccagcagaucauucuagugucuccgauggggguaagccgccucauggaccugcuugcagauuccagagagguuaucaggaacgacggagugcuguugcuccaagcccugacccggucaaauggcgcuauucagaagaucgucgcauuugagaacgccuucgaacgcuuacuggauauaauuagugaggaaggcaauagcgacgggggaaucgugguggaggacugucucauucuucugcagaacuugcugaaaaauaacaauucuaaccaaaauuucuuuaaggaagguuccuauauccagcgaaugaaacccugguuugaggucggcgaugagaacucaggguggagcgcucagaagguuacuaaccuacaccucaugcugcagcuugugagaguacuggugaguccuacaaauccacccggagccaccucuuccugccaaaaagcgauguuccaguguggcuugcuccagcagcugugcacgaucuuaauggcaacuggugucccugccgacauucugaccgaaacaauaaacacugugagcgagguuaucagggggugucaagugaaucaggauuacuuugcuucggucaacgccccaucuaaucccccucggccagcaauugugguacuacucauguccaugguuaacgaacgucagccguucgugcugcgcugcgcuguccuuuauuguuuucagugcuucuuguacaagaaucaaaagggacagggcgagaucgugucaacccugcuccccaguacaauagacgccaccggcaacagcgucuccgcggggcagcugcuuuguggaggucuguucucuacggauagcuugucaaauuggugcgccgcaguggcucucgcccaugcucugcaggaaaacgccacucaaaaagagcaguuacugagaguucagcuagcaacaaguauuggcaauccuccagugucccuccugcaacaguguaccaacauccuuagccagggggacaagaucgauaggcggggaucuaaaauucagacucgaguaggcuugcugaugcuccugugcacaugguuaucaaauugccccaucgccgucacccacuuucugcacaacagugcuaaugugccuuuccuuacgggucaaauugcggagaacuugggggaagaggaacagcucguucagggccugugugcacuacugcucggaauaagcaucuauuuuaacgacaauucccuggagucuuacaugaaggagaaacuuaagcaguugauugaaaaacgcaucggcaaggagaacuucaucgaaaagcugggguuuauuucgaaacaugaguuauacagcagagccucccaaaagccacagcccaauuucccgucaccugaauauaugauauuugaucacgaguucaccaaacucgugaaggagcuggaaggagucaucacaaaagcuauuuacaagaguucugaggaagacaagaaagaggaagaggugaagaaaacucuugagcagcaugauaacaucguaacccacuauaagaauaugauuagggaacaggaccugcaauuggaggaacuccggcaacaggugagcacacugaaaugccagaacgagcagcuacagacugccguuacccagcaagucucccagauccagcagcacaaggaccaauacaaucugcucaagauacagcuggguaaagauaaccagcaucagggcucauauagcgaaggggcacaaaugaauggaauccagcccgaggagauuggccgccuuagagaagagaucgaagaguugaagaggaaccaggagcuguuacagucucaacucacagaaaaagacuccaugauugagaauaugaagaguagccagaccucugguacuaacgaacaguccucagccaucgugagugcucgugauagcgagcaaguggccgaacugaaacaggagcuugcaacgcugaagucgcagcuaaauucccagucugucgagauaacaaagcuccaaaccgaaaaacaggagcuguugcagaagacugaagcguuugcuaaaagcguugaggugcagggggaaaccgagacaauuaucgccaccaagacuacagacguggagggccggcugucagcauuacuccaagaaacgaaagagcugaagaacgaaauuaaagcccuuagugaggaacgaaccgcuaucaaggagcagcuggauuccucuaauagcacuauagccaucuugcagacagagaaggacaaacucgaacuggagauuaccgauuccaagaaagaacaggacgaucuacugguacuucucgcagaccaagaucagaagauccugucauugaaaaacaagcugaaggacuuaggacacccagucgaggaggaagaugagcucgaaagcggcgaccaggaggacgaagaugacgagagugaggauccugggaaagaccuggaucauauuuga

SEQ ID NO: 64611 - RNA, 2397 nt, Artificial Sequence
  derived and/or modified sequence opt3 from USP10__Homo_sapiens__NP_005144
auggcccugcacagcccccaguacaucuucggcgacuuuuccccugaugaguucaaccaauuuuucgugaccccaagaucuucagucgaacucccgcccuauagugggacaguucuuugcggaacucaggcuguggacaagcugccugauggucaggaguaccagaggauugaauuuggcguagacgaggugauagaaccaagcgauacguugccccggaccccuuccuauucuaucucgucaacauuaaauccacaagcacccgaguucauucugggguguacugccagcaaaaucaccccugacggaauuacaaaggaggcgaguuacggcuccaucgauugccaguauccagguucugcucuagcccucgacgggagcuccaacgucgaagcagaggugcuggaaaaugauggaguuucaggcggccuugggcagcgcgagcgaaagaagaaaaagaagcguccgcccggauacuauaguuaccugaaagacgguggcgaugacagcauaucuaccgaggccuuggugaacgggcaugcuaauuccgcagucccuaacucagugagcgccgaagaugcugaguuuaugggagacaugccacccaguguaacuccuagaacauguaauucuccacagaacuccaccgacagcguuucggauaucgugcccgacucuccguucccuggcgcccucgguuccgauacgaggacugcggggcaacccgaaggaggcccaggcgcagacuuugggcagucaugcuucccugccgaggcuggacgggauacccugagucgcacagccggugcacagcccugugucggcacugacaccacagaaaaucuggggguggcuaacggacagauucucgagagcuccggcgaggguaccgccacgaaugggguggaauuacacacuacagagucuaucgaucuggacccaaccaagcccgaaagcgcgucaccuccagccgauggcacuggaagugcauccggcacacuuccggucagccaacccaaaucuugggcuucauuguuucaugacaguaagccuagcuccucuucgccaguugccuacguggagaccaaauauagcccucccgcuauuuccccacugguaucagaaaaacagguggaggucaaggaggggcuagugcccguuagugaagauccgguggccaucaaaauagcagagcuccuggaaaacgucacgcuuauucacaagccugugucucugcagccaagaggauugaucaauaaagguaacuggugcuacauuaaugccacccuccaagcucugguagcgugucccccuauguaucauuuaaugaaguucaucccccuguacagcaaaguucagaggccaugcacauccacuccuaugaucgacucauuugugcggcucaugaacgaguucaccaacaugcccgucccaccgaagccucgccaggcacuuggcgacaaaauugugcgagauauaagacccggggccgcuuucgaaccaacauauaucuacaggcuguugacugucaauaagagcucucuauccgagaagggacggcaggaggacgccgaagaguaucugggcuuuauucucaacggucugcacgaagagaugcuuaaucugaaaaaguugcucagucccagcaacgagaaacugaccaucucuaaugggccuaagaaccacuccgugaaugaagaggaacaagaggaacagggcgagggaucagaggaugaaugggagcagguuggcccacguaacaaaacaagugugacccgccaggcagacuucguacaaacucccauaacggggauuuuuggaggucauaucagaagcgucguguaccagcagucguccaaggaaucugccacauuacagccuuucuuuacccugcaacuagauauccagagcgacaagauuaggacuguucaggaugcucucgagucacugguggcccgggaaaguguccagggcuacaccacaaaaaccaagcaagagguggagaucucccgacgcguaacucuugaaaaauugccgccagugcugguucuccaccugaagagauucgucuaugagaaaacagggggaugucagaaacuuauuaagaauauagaauaccccguggaccuggagaucucuaaggaauugcucagcccuggcgugaagaacaaaaauuuuaagugccauaggacguaucggcuguucgcagucguuuaccaccacgguaacuccgcgaccgggggccauuauacuacagauguguuucagauuggauuaaauggcuggcugcgcaucgacgaucaaaccgugaaaguaaucaaccaguaccaggucgugaagccaacagcugagagaacugccuaucuacucuacuacaggcguguugaccugcuuuga

SEQ ID NO: 64612 - RNA, 2892 nt, Artificial Sequence
  derived and/or modified sequence opt3 from USP11__Homo_sapiens__NP_004642
auggccguggcucccagacuguucggcgggcucugcuuuagguuccgggaccagaacccugaggucgcaguugaaggacgccuuccaaucagccacuccuguguggguugccgacgugagagaaccgccauggcgacaguagcugccaauccggcagccgcugcagccgcuguggccgcggcagccgcugucacugaagauagggagccccaacaugaggagcugccuggcuuggacucucaguggcggcagauugagaacggggaaucaggacgcgagagaccauuaagggccggcgaaaguugguuucugguggagaagcacugguacaaacagugggaggcauauguucaagguggggaucaggacagcuccacguuccccggauguauaaauaacgcuacccuauuucaggaugaaaucaauuggcggcucaaggagggccugguggaaggcgaggacuacguccuucugccugccgcggccuggcauuauuuggugucuugguacgggcucgaacacggacagccacccauugagcgcaaaguaaucgagcugccuaacauucaaaagguugaaguguauccagucgagcugcucuuagugcgacauaaugaucuggguaaaucgcacacagugcaguucucacacacugacagcaucggccuugucuugagaaccgcaagggaacgguuucugguugagccgcaggaagauacacgucuaugggcuaagaacagugaggggucccucgaccgccuguacgauacccauauaacugugcuugacgccgcucuggagacaggacaguugaucauuauggaaaccagaaagaaagauggcacguggcccucugcccaacuccacguaaugaauaacaauaugagcgaggaagacgaggacuucaagggucagccugggaucugcggacugacuaacuuaggcaauaccuguuuuaugaacuccgcacugcagugccucucaaaugugccacaacuuacagaauauuuccugaacaacuguuacuuggaggagcuaaauuuuaggaacccccugggcaugaaaggggaaauugccgaggcuuacgcggaucucgucaagcaggcauggaguggacaucaccggagcaucgugccucacguuuucaaaaauaaggugggucauuuugccucucaguuccugggcuaucagcaacacgacucccaggaacuucugucauucuugcucgaugggcugcaugaggacuuaaaccgagucaagaaaaaggaguacguggaacugugcgaugcugccggacgcccagaccaggagguagcacaggaagccuggcaaaaucacaaaagaaggaacgauagcguuauaguggacacuuuucauggccuauucaagaguacccucgucugucccgauugcgguaaugugucugucacauuugacccguucuguuaucuguccgugccucuucccauuagccacaaacggguuuuggagguguuuuucaucccaauggauccucgcagaaagcccgaacagcacaggcugguagucccaaagaaggggaagauuucggaccucugcguggcucugucuaaacauaccggcaucucccccgagcguaugaugguugccgacguguuuucacaccgguucuacaaacuuuaucagcuggaggaaccuuugaguagcauccucgaucgagacgauauuuuugucuacgagguguccggaagaauagaagcaaucgagggcucuagggaagacauuguagugccaguuuaucugcgcgagcggacgccggcgagagauuacaacaauagcuacuauggguuaaugcuguucggacauccccuacucgucucagugccuagggaccgcuuuacuugggagggucuguacaacgugcuuauguaucgauugagucgguacgucacaaaaccaaauuccgaugacgaagaugacggcgaugagaaggaagacgaugaggaagacaaagacgauguucccgggccuagcaccggaggcucucugcgugacccagagcccgagcaggcugguccgucaaguggggugacuaacagaugcccuuuccuccuggauaauuguuuaggcacaagccaauggccacccaggcgccggagaaagcagcuguuuacccuucagacggugaacuccaauggaaccucugacaggacaacuucgccugaagagguacacgcccagcccuauaucgcaauagauugggaaccagagaugaagaaacgauacuaugacgaggucgaagccgagggcuacgugaagcacgauugcguuggguacgugaugaaaaaggcuccuguccgcuugcaagaauguauugaacucuucaccacaguggaaacucuggagaaagagaaccccugguauugcccaagcuguaagcagcaucagcuagccaccaagaaacuggaccucuggaugcugccggaaauccuuaucauucacuugaagcgguucuccuacacaaaauuuucaagagagaagcuggauaccuuaguugaauuuccuaucagggaccucgauuucagugaguucgugauucaaccccagaacgaaucuaauccagagcuguauaaauacgaccuuauagcaguaagcaaccauuauggagguaugcgugauggccacuacacuacguuugcuugcaauaaggacuccgggcaguggcauuauuucgacgauaacucagucagccccgugaaugagaaccagaucgaaucuaaggccgcguacgugcuguuuuaccaacgccaggacgucgcccggagauugcucuccccugcuggaaguagcggcgcaccagccucucccgcuuguuccucaccuccgaguagcgaguucauggauguuaauuga

SEQ ID NO: 64613 - RNA, 1113 nt, Artificial Sequence
  derived and/or modified sequence opt3 from USP12__Homo_sapiens__NP_872294
auggagauccugaugaccgugagcaaguucgccuccauuugcacaaugggcgcuaacgcaucugcccucgaaaaagagauagggcccgaacaguuuccugucaaugagcacuacuucggacuuguuaacuuugguaauacuuguuauugcaacucagugcugcaagcguuguacuucuguagaccauuuagggaaaagguauuagcuuauaaaagucagccgcggaagaaagagagccugcuaacgugccucgccgaccuguuccauuccaucgcaacccagaagaagaaagugggcgucauucccccuaagaaauuuaucacacgccuucgaaaggagaaugaacuguucgauaacuacaugcagcaagacgcccacgaguuuuugaauuaucuccugaacacuauugcugauauccugcaggaggaacguaaacaggagaagcagaaugggagacucccaaacggaaauauagacaacgaaaauaacaauucuacccccgauccuacaugggugcaugagaucuuccaaggcaccuuaacuaacgaaacaaggugucugaccugcgagacgauuucgucaaaggacgaagauuuucuugacuugagcguugauguggagcagaacaccaguaucacucacugucugcgggguuucuccaauacagagacucuaugcucugaauacaaauauuacugugaggaaugccgcagcaagcaggaggcacauaaaagaaugaaggucaaaaagcucccaaugauucuggcccuucaccugaaaagguuuaaguacauggaccaguugcaccgguauaccaagcucuccuaccgcgugguauucccccuggaauuacgacuguucaacacaucaggggaugcuaccaauccugacagaauguaugaucucguugccguggucgugcauuguggaaguggcccaaacaggggccacuacaucgcgauagugaaaagccaugacuuuuggcuucuguucgacgaugacauugucgagaagaucgaugcacaagccauugaggaauuuuauggguugacgucugacaucuccaaaaauucagagagcggauacauccuauucuaucagagucgggauuga

SEQ ID NO: 64614 - RNA, 2592 nt, Artificial Sequence
  derived and/or modified sequence opt3 from USP13__Homo_sapiens__NP_003931
augcagagaaggggcgcccuguucgggaugcccggagguagcggcgggcggaagauggcugcaggagacaucggcgagcuccuugugccucacaugccaaccauucgcgucccgcgauccggugaucguguuuacaaaaacgaaugcgccuuuucuuaugacucacccaauagugaagggggacuguacguguguaugaacacauucuuggcguuuggcagagaacauguagagaggcacuuccggaagacuggccaaagcguguauaugcauuuaaaacgccacgucagagaaaaggugcgcggggcuuccggaggugcccugccuaaacggcgcaauucuaagauauuucuagaucucgacacggaugacgaucugaacucggacgauuacgaguaugaggacgaagcaaaacuuguuaucuucccagaucauuacgagauugcccugcccaauaucgaagaguugccugcucucgugaccauugcaugcgacgccguccugucaagcaaaaguccauaucgaaagcaggaucccgacacaugggagaacgaacugccuguguccaaauacgcuaauaaccucacucaguuagacaauggcguaagaaucccaccgucuggguggaagugugccaggugcgaucugcgggagaaccuuugguugaaucugaccgacggaagcguucuauguggcaaaugguuuuucgauuccucaggugggaacggacacgcgcucgaacacuaccgugacaugggcuauccccuggcagugaaacuuggcacaauaaccccugauggggccgacgucuacaguuuucaggaggaggagccagugcuggauccccauuuggcuaagcaccucgcccauuucggaaucgacaugcugcacaugcacgguacugagaauggcuuacaagauaacgacauuaagcugcgcgugagcgaaugggaggucauccaggaaucugggacaaagcucaaaccuauguauggaccaggcuacaccggucuuaagaaucuggggaacuccugcuauuugucaagcguuaugcaggcaauuuuuaguauccccgaguuccagagagcuuacgugggcaaccuaccgaggauauuugauuauucuccucuggaccccacgcaagacuucaauacucagaugaccaaacucggacauggccugcuuuccgggcaguacagcaagccaccuguaaaaucggaacugauugaacaggugaugaaggaggagcacaagccccaacagaacggaaucucuccacggauguucaaagccuuugucuccaagucacaucccgaguucaguagcaaucgacagcaagaugcgcaggaauuuuucuugcaccucgugaaccugguugagcgcaauagaauugguuccgaaaacccuucugacguguuuagguucuuagucgaggagcggauccaguguugccagacacgcaaagugagauacacugaaaggguagauuaucugaugcaacuaccaguugccauggaggcagcuaccaauaaggacgaacucaucgccuacgagcugacacgucgggaggcugaagccaaccgaagaccgcuucccgaguuggugagggcaaaaauuccuuuuagcgccugucugcaggcuuucucagaaccagagaaugucgaugacuuuuggaguuccgcgcuccaggcaaagagcgccggcgugaagaccucucgcuucgcuucauuucccgaauaucuggucgugcagauaaagaaguucacguuugggcuugauuggguuccuaaaaaguucgacgugaguaucgauaugccagaccuguuggauauuaaccaucuccgggccagaggacugcaacccggcgaggaggaauuaccggacaucagcccuccaauaguaauucccgaugacuccaaagacaggcugaugaaucagcuaaucgauccuucugacaucgaugagucgagcgucaugcagcucgcagaaauggguuucccccuggaggccugccgcaaggcuguguacuuuacugggaacaugggcgccgaaguugcauucaauuggauuaucgugcacauggaggagccagacuuugcggaaccucuuacaaugcccggauauggcggggcugccuccgcaggagccucagucuucggugcuaguggcuuggauaaccagccaccggaggaaauuguggccauaaucaccucuaugggguuucaacgaaaucaggcaauucaggcucugcgggccacuaacaacaaucucgagcgugcgcuggacuggaucuucagccacccugaauuugaggaggauuccgacuucguaaucgaaauggagaacaaugccaacgcuaauauuauaucagaagcaaagcccgagggaccaagagugaaagauggcagcgguacauacgaguuauuugccuucaucucucauauggggaccuccacgaugaguggccacuauauuugucauaucaagaaagaaggaagguggguuauuuacaacgaccacaaggucugcgcuagcgagaggcccccuaaagaucugggcuacauguauuuuuaccggagaaucccaucuuga

SEQ ID NO: 64615 - RNA, 1380 nt, Artificial Sequence
  derived and/or modified sequence opt3 from USP14__Homo_sapiens__NP_001032411
augccccuguacagcgugaccgucaaguggggcaaagagaaguucgaagggguugagcucaacacagacgaaccuccaaugguguuuaaagcccagcuuuucgcucugacuggaguacaaccggcaagacagaaggugauggucaaagguggcacguugaaggaugacgauugggggaauaucaagauuaaaaacauggaguuacccugcggacugaccaaucuaggcaacacauguuauaugaaugccacugugcagugcauaagguccguuccugaacucaaggacgcgcugaaacgguacgcuggugcccuucgcgcaucuggggagauggccucagcucaguauaucaccgcagcccugcgagauuuguuugacaguauggauaagacaagcuccucuauuccacccaucauucuccugcaauuccugcacauggcuuuuccucaguucgccgagaaaggagaacagggccaguaccuccaacaggacgcgaacgaguguuggauccagaugaugcguguguuacagcaaaagcuggaagcaauagaggaugacucggucaaggagaccgauucaagcagugccuccgcugccacuccaucuaaaaagaaaagccuuaucgaccaguuuuucggcguggaauuugagacaaccaugaagugcacggaauccgaggaagaggagguaacuaaagggaaggaaaaucaguugcaacugucauguuucauuaaccaggagguuaaauaucuauuuaccggacucaagcugagacuucaggaagagaucacaaagcagagucccacucugcaaaggaaugcauuguacauuaaaagcucuaagaucucccggcucccugcuuaucugaccauacagauggugcgcuucuuuuacaaagaaaaggagucagucaacgccaaaguguuaaaggaugugaaguucccacugaugcucgacauguacgagcuuugcacaccggaacugcaggagaaaauggucagcuucagaaguaaguuuaaagacuuggaagauaagaaaguuaaucagcaacccaacaccucugacaagaaguccagcccucagaaagaggugaaguaugaaccauucucguuugcggaugacauugguucuaauaacuguggcuacuaugaucuacaggccguacugacgcaucaggggagguccucaaguagcggacacuacguguccugggucaaacggaagcaagacgaguggaucaaauucgaugacgauaaggugucuauuguuacucccgaggacauccuccgccugagcggcgguggggauuggcauaucgcauaugugcuucuguacggaccucgaagagucgaaauuauggaggaagagucagagcaguga

SEQ ID NO: 64616 - RNA, 2946 nt, Artificial Sequence
  derived and/or modified sequence opt3 from USP15__Homo_sapiens__NP_001239007
auggccgagggcggggcugcagaccuggauacccagagaagcgacaucgccacacuccuuaagacuucccugaggaaaggagauacgugguacuugguggacucucggugguucaagcaauggaaaaaguaugucgguuuugauucaugggacaaauaccagaugggcgaucagaacguuuaucccgggccuauugacaauaguggauuacugaaggauggcgacgcgcagagccuaaaggaacaccucauagaugagcuggacuacauccuucugccaaccgaagguuggaacaaauugguguccugguauacacucauggaggggcaagaaccgauugcucgcaagguaguggagcagggaauguucgucaaacauugcaagguggagguuuaccugacugaacugaaacucugugagaauggcaacaugaauaacguggucacccgacguuuuucuaaggccgauacaaucgacaccauugaaaaggagaucagaaaaauauucucgauccccgacgagaaggaaacuagguuauggaauaaauauaugucaaacacauuugagccucugaauaagccagauagcaccauucaggacgcaggccuuuaccaggggcaaguguugguaaucgaacagaaaaacgaggauggaacguggccccgggguccuaguacuccaaagucccccggcgccucuaauuucagcacccugccuaaaauuuccccaucaagucuaagcaacaauuacaacaauaugaacaaccgcaauguuaagaacucuaauuauugccucccguccuacacagcuuauaagaacuacgacuauucagaacccgggagaaauaacgagcagccuggacuguguggccuuagcaaucuggguaacacuugcuuuaugaauagugcaauccaguguuugucuaacaccccaccccucacagaguacuuccugaaugauaaauaucaagaagaguuaaacuuugacaauccucuggggaugaggggagaaauagccaaguccuacgcugagcucauuaaacagauguggagcggcaaguucucguacgugaccccacgggccuuuaaaacgcaggucggccgcuucgcgccccaauuuucuggguaucagcagcaggauugccaagaacuucuggcauucuugcuagacggacugcacgaggaucucaaccgaaucagaaagaagccguacauucagcugaaagacgccgaugguaggccugacaaggugguggcugaggaagccugggagaaucaucuuaaacggaacgacuccaucaucgucgauauuuuccacggccuguuuaagucaacuuugguuugucccgaaugcgcaaaaauaagugugacauucgacccauuuuguuaucucacccugccuuuacccaugaagaaggagcguacucuggaaguauaccuagugcgcauggauccacucacaaaacccaugcaguauaaggucgugguuccuaaaaucgggaacauucuggaccuuugcaccgcuuugagcgcccuguccggaaucccagcggauaagaugauagugacggacauuuacaaucauagauuccacaggaucuuugccauggaugagaaccucucuagcaucauggagcgggacgauauuuaugucuucgaaaucaauauuaaccgaaccgaggacacagaacacgugauaaucccgguaugucugcgcgagaaauuuagacauucaaguuacacucaccauaccggcuccagccuuuucggucagcccuuucugauggcaguuccuaggaauaacacagaggauaaguuguacaaucuccuguuacugcggaugugccgcuaugugaagauuucuacugaaaccgaggaaacagaggggucacuacacugcuguaaagaccaaaacaucaauggcaacggaccaaauggcauccacgaagaggggagucccagcgagauggaaaccgaugagccugacgacgaauccucucaggaucaggagcucccaucggaaaacgagaauagccaguccgaggacucagucggaggugauaacgacagugaaaauggccugugcacugaggauacguguaaggggcaacuuacaggacauaaaaagagauuguucaccuuucaguucaacaaccugggcaauacugacauuaacuacauaaaagaugacaccaggcacauccguuuugaugaccggcagcuccgacuggaugaaagaucuuucuuagcucuggacugggaucccgaccuuaagaaaagguauuucgacgagaaugccgcugaagauuuugagaagcaugagagcguggaauacaagccgccuaaaaagccauucgucaaauugaaggacugcauugagcucuuuacaaccaaagaaaagcugggugccgaggaucccugguauuguccuaacugcaaggagcaccagcaagcaacuaaaaagcuagaccuguggucccuucccccagugcugguugugcaucuuaaacgcuucucauacagccgguauaugagagauaaguuggacacacugguagauuuuccuaucaaugacuuagauaugucugaguuccucauuaaccccaaugccgggccauguagguacaaccugaucgcugucuccaaucacuacggcggaaugggcgggggacacuauacggcguuugccaaaaacaaggacgaugguaagugguacuauuucgacgacaguagcgugucuaccgcauccgaagaucagauaguuucaaaagcugccuacgugcucuuuuaucagcgccaagacacuuucaguggcacaggguuuuucccgcuggaucgagaaaccaagggagcaagcgccgcuacaggcaucccuuuggagucggacgaagauuccaaugacaacgauaaugacauugagaacgagaauugcaugcauacuaacuga

SEQ ID NO: 64617 - RNA, 1593 nt, Artificial Sequence
  derived and/or modified sequence opt3 from USP17L2__Homo_sapiens__NP_958804
auggaggacgauagccuguaccucggaggggaauggcaguucaaccacuuuuccaaacuuaccucuucaagacccgacgccgcuuucgcagagauccaaaggacaagucugccugaaaagagcccauuguccucugaggcccggguggauuuaugcgacgaucuggcgccggucgcucgccagcuagcaccccgaaagaaacucccucugucgucacguagaccagccgccguuggagcuggucuucagaauaugggcaacacuuguuaugaaaaugcaagccugcagugcuugacguacacacccccucucgccaacuauaugcugaguagggagcauucccaaaccugucagcggccaaagugcuguaugcugugcacuaugcaggcucacauuaccugggcccuccauucucccgggcacgugauacagccuagccaagcguuagcagccggauuucaucgcggcaaacaggaggacgcucacgaguuccugauguuuacaguagaugccaugaagaaggcaugucuuccaggucacaaacagguggaccaucacuccaaggauaccacuuugauccaucagauuuucgggggaugcuggagaucacaaaucaaaugucugcacugccacggcauuagugacacauuugauccguaccuagacaucgcucucgauauacaggccgcgcagagcgucaagcaagcccuggagcagcuugugaaacccgaagaacugaauggcgagaacgcauaucauuguggguugugccuccagagggcuccugccucuaagacccugacguuacacacuuccgcuaagguucugauccucgugcuuaaacgguucucagacgucaccggaaauaagcuggccaaaaacgugcaguacccagaaugcuuggacaugcaacccuauaugagccagcagaauacagguccucuaguauacguucuguacgcagugcucguccaugccggcuggaguugucacgaugggcauuauuuuucuuacgugaaggcucaggagggacaaugguauaaaauggacgaugcgaaggugacugcaugcuccauuaccagcguccugucgcagcaggccuacguucuuuucuauauccagaaaucugaaugggagcgccacuccgaaucagugagucgaggcagagagccaagggcucugggugccgaggacacagaucggcgugcaacccaaggggaauugaagcgcgaccaccccugucuccaggccccggagcuggaugaaagauuaguagagagggcuacgcaggaaagcacucuggaccauuggaaguuuccucaggagcaaaacaaaacaaagcccgaguucaaugugcggaaagucgaaggaacccuaccaccuaacgugcucguuauucaccaguccaaguacaaaugcggcaugaagaaucaucaccccgagcagcaaucuagccugcuuaacuugucaaguacuacacgaaccgaucaggaauccgugaauacgggcacccuggccagccuccaggggcgcacaagaaggucuaagggcaaaaacaagcacucaaaacgggcacugcuugucugucaguga

SEQ ID NO: 64618 - RNA, 1593 nt, Artificial Sequence
  derived and/or modified sequence opt3 from USP17L30__Homo_sapiens__NP_001243796
auggaggacgauagccuguaccucagaggagaauggcaguucaaccacuuuuccaaacuuaccucuucaaggcccgacgccgcuuucgcagagauccaacggacaagucugccugaaaagagcccauuguccugcgagacucgcguggauuuaugugacgaucuggccccggucgcgcgacagcuagcuccccgugaaaagcucccucugucuucgagaaggccagccgcaguuggggccggacuucagaauauggguaacacgugcuaugugaaugcuucacugcaguguuugaccuacacacccccucucgcaaacuauaugcugagccgggagcauagucaaacuugccaccgccauaaaggcuguaugcugugcaccaugcaggcccacauuacaagagcucuccauaauccagggcacguaauacagcccucccaggccuuagcggcaggauuucacaggggcaagcaagaggacgcccaugaguuccugauguuuaccguggaugcuaugaaaaaggccugucuuccuggucacaagcaggucgaccaucacucuaaagauacuacauugauccaccagauuuucgggggauacuggcggagccagaucaagugccugcauugucacggcauuuccgacaccuuugauccauaucuagacaucgcacucgauauacaagcugcccagucagugcagcaagcgcuggagcagcuuguuaaaccggaagaacugaacggcgagaaugccuaccauugcgggguguguuugcagcgcgcacccgcuaguaagacgcucacucugcacaccagcgccaaagucuuaauccuggugcucaagcgauucucugacguaacaggaaacaagauugcuaaaaauguucaguauccugaaugccuugacaugcaaccauacaugucccagcccaacacugguccucugguguacgucuuguaugccgugcuagugcaugcaggcuggucaugccacaaugggcacuacuuuagcuaugucaaggcccaggagggacagugguacaaaauggaugacgcugaaguuaccgcgaguucuaucacauccgugcugagccaacaggcauauguacucuucuacauucagaagucggagugggaaagacauucugaguccgugucaaggggccgggagccacgugcccugggugcugaagauaccgaccgcagagccacgcagggggagcuuaaaagggaucaccccugucugcaagcaccggaauuggacgagcaucucgucgaacgggccacucaggagaguacacuggaucacuggaaguuuuuacaggagcagaacaaaaccaagccugaguucaaugugcgaaagguugaaggaacucugcccccagacgugcuagucauccaccaaagcaaauauaagugcggcaugaaaaaccaucacccugaacagcaguccucucuccugaaucuuagcucaaguacacccacccaucaagaguccaugaacacgggcaccuuggcuagccugcgcgggagagccaggcggucuaagggcaaaaacaagcacucaaagcgcgcacuccuggugugucaguga

SEQ ID NO: 64619 - RNA, 1119 nt, Artificial Sequence
  derived and/or modified sequence opt3 from USP18__Homo_sapiens__NP_059110
augagcaaggccuucggccugcucagacagaucugccaauccauucuugcugagucuucacagagucccgcagaccuggaagagaaaaaggaagaggauagcaacaugaaaagggaacagccucgggagcgcccacgagccugggacuacccgcacggguuggugggauuacauaauauaggucagaccuguugccugaacucccuaauccaagucuuuguuaugaauguggauuucacacguauucucaagagaaucacuguacccaggggcgcggacgagcagcggcgcucugugccuuuucagaugcugcuucuguuggagaaaaugcaggauucgagacaaaaggcugucaggccacucgaacuggccuauugucugcagaagugcaacgugccccucuucguucagcacgacgcagcccaguuauaccugaaacuuuggaauuugauuaaggaucaaaucacggacgugcaucuggucgaacggcuacaggcucucuauaccauacgcgugaaagauucacugaucuguguagacugcgcaauggagagcagucgaaacuccucuaugcuuacacugccuuugagccucuuugauguugacuccaagccacugaaaacuuuagaggaugcccugcacuguuucuuucagcccagagaacucucaaguaagagcaagugcuucugugagaauugcgggaaaaagaccaggggaaaacaagugcuuaagcugacacauuugccucagacccuaacuauucaccugaugcgguuuucuauccguaacucccagacacgcaaaauuugucacucacucuacuucccacagagccuggacuuuagucaaauccuuccgaugaagagagaaucuugcgacgcugaggaacaguccggcggucaguaugagcuguucgccgucauagcgcauguggggauggcagauagcggacacuacugcguguauauuaggaaugccgucgacggcaaaugguuuuguuucaacgauucgaauaucugcuugguuucuugggaggacauucaguguaccuacggcaaccccaauuaccauuggcaagaaacggcuuaucuccugguguacaugaagauggagugcuga

SEQ ID NO: 64620 - RNA, 2745 nt, Artificial Sequence
  derived and/or modified sequence opt3 from USP20__Homo_sapiens__XP_005251722
augggcgacagcagagaucugugcccccaccucgacuccaucggggaggugaccaaggaagaucuucuguugaaaucuaagggaacaugucagucaugcggugucacuggcccuaacuuaugggccugucugcaaguugcuugcccauacgugggguguggagagaguuucgcagaccauagcacgauucacgcccaggcgaaaaagcauaaucuaaccguaaaccucacaacuuuuaggcuguggugcuaugcuugugaaaaagagguguuccuugaacagcggcuggccgcaccguugcucggcuccucuucgaaguuuucagagcaggauagcccucccccaagucacccccugaaggccgucccuauagcuguggcagacgagggugaauccgagucugaagaugacgaucugaaaccacgcgggcucaccggaaugaagaauuuaggcaacagcugcuacaugaaugccgcucugcaagcccuuuccaacugucccccuuugacacaguucuuucuggagugcggcgggcuaguucgaaccgacaaaaagccagcgcucuguaaaucauaucagaagcuggugagugaggucuggcauaagaaacguccgagcuacgugguacccacuucucuuucccacggaaucaagcugguuaauccuauguucagagguuaugcacagcaagauacacaggaauuuuugaggugccucauggaccagcugcacgaggaauuaaaagagccaguggucgccaccguggcucugacggaagcccgggauucagacagcagugacacugaugagaagcgcgagggcgacagaucucccuccgaagaugaguuccucagcugcgacucgucuuccgauaggggagaaggggacggccagggucgcgggggaggcucaagucaagcagagaccgaacuucugauuccugaugaggcuggccgggccaucagcgagaaagaacgaaugaaggacagaaaauuuuccugggggcagcagaggacaaacucugagcaaguggaugaagacgcggaugucgacacugccauggcagcuuuggacgaucagccagccgaggcucagcccccgagcccucggucaaguucccccugucguaccccagaaccugacaaugaugcccaucuacgcuccucuucaagacccugcaguccaguucaccaucacgagggacacgcaaagcugagcuccucucccccuagggccucgccagugcggauggcuccgagcuacguacucaagaaagcacaggugcuguccgcggguucacgacgcagaaaggagcaaagguaucggagugucauuucugacaucuucgauggcagcauacuuucccuggugcaguguuugacaugcgaccgcguuucaaccacgguggaaacuuuucaggaucucagccugcccaucccugggaaagaggacuuagccaagcugcauucugcuauuuaccagaacgucccagccaaacccggagcauguggcgauuccuacgccgcucaagguuggcuagccuucaucguggaauauauuagaagguuuguaguuaguugcacaccuagcugguucugggggccaguggucacccucgaggacugucuggcagcguucuuugcugccgaugagcuuaagggcgacaauauguacucuugcgaacguuguaagaaauugcggaacggagugaaguauugcaaaguccugcgacuccccgagauccuguguauacaccuuaagagauucaggcaugaagugauguacuccuuuaaaauuaauucacacguuaguuucccgcuggagggcuuggaucuccgcccuuuucuggcaaaggaaugcacuagccagaucacaaccuaugacuuacugucggugauuugccaucacgggacggccggauccggucacuacaucgcuuauugucagaacguaaucaauggccagugguacgaguucgacgaucaauacgucaccgaggugcaugaaacaguugugcagaacgccgagggguauguccuauuuuaccggaagucuagcgaagaggcaaugagagaaaggcaacaggugguaucacucgcugccaugcgcgagccaagucugcuucgauucuaugugucccgggagugguugaacaaauuuaauacuuucgcggaacccggaccuauuaccaaccaaacauuucugugcucucacggcgguauacccccacauaaguaccacuauaucgacgaucucguugucauucugccucagaaugugugggagcacuuauacaaccguuucgggggcggacccgccgugaaucaucuguaugucuguagcaucugccagguugaaauagaggcucuugcaaaaagaaggcgcauugaaaucgacacuuuuaucaaguugaacaaagccuuccaagcugaggaguccccaggcgugauuuacuguaucucaaugcagugguuccgggaaugggaggccuuugugaaggggaaggauaaugaaccgccuggacccauugacaacagcagaauagcacagguaaaagguaguggccacguccagcucaagcaaggggcggauuacggacagaucucugaggagaccuggacauaucugaauagccuauacggcggugggccagaaauugccaucaggcagagcguggcucagccccugggcccugagaaccuccauggagaacagaaaaucgaggccgaaacccgagcaguuuga

SEQ ID NO: 64621 - RNA, 1578 nt, Artificial Sequence
  derived and/or modified sequence opt3 from USP22__Homo_sapiens__NP_056091
auggugagcagacccgagccugaaggcgaggccauggacgcugaacuggcagucgccccaccggggugcucccaccucggaucuuucaagguugauaacuggaaacagaaucuuagggcgaucuaccaauguuuuguguggucagguaccgcugaggcccggaagcgcaaagcaaagaguugcauuugucauguaugcggcgugcaccugaaccgauugcauagcuguuuauauugcgucuucuuuggguguuucacuaaaaagcacauacaugaacacgccaaggcuaaacgucacaaucuggcaaucgaccuaauguacggaggcauuuauugcuuucucugucaggauuacaucuaugacaaggauauggagauuaucgccaaagaggaacagagaaaggcuuggaaaaugcagggugugggggagaaguucuccacaugggaacccacgaagagggagcuggagcuucugaaacauaacccuaagcggcgcaaaauaaccucuaauugcacaaucggauugagaggccucauuaaccugggcaauacuuguuuuaugaacugcaucguucaagcccugacccacacaccacucuuaagggacuucuuucugucggaucggcaucgcugcgaaaugcagucacccagcaguugucuugugugcgagauguccucuuuguuccaggaauuuuacagcgggcaccgauccccucacauuccauauaagcugcuacaucucgucuggacccacgcgagacaucuggcaggauacgagcagcaagacgcccacgaguuccuuaucgcugcccuggauguguugcauaggcacuguaaaggugacgauaauggcaagaaagcaaacaaucccaaccacugcaauuguauaauugaccagaucuuuacugggggacuccagucagauguaacaugccagguuugucauggcgugaguaccacgauugacccuuucugggacaucagccuggauuuaccagguucuuccacuccguucuggccccugucaccugggagcgaaggaaacgucgugaauggcgagagucacgugucuggcaccacaacucucaccgacugccuucggcguuuuacacgcccagaacaucugggguccagcgcuaagaucaaguguucgggaugccacucuuaccaagaguccaccaaacaguugacgaugaagaaacuacccauugucgccuguuuccaccugaagagauuugaacauucagcgaaacucaggcggaagauaacuacauauguuaguuucccucuggagcuugauaugaccccauuuauggccagcuccaaggaaucucgaaugaacggucaguaccaacagcccacugacagccugaacaaugauaacaaauauucauuguucgcagugguaaaucaccagggcacacucgagagugggcauuacaccuccuuuauccgccagcacaaggaccaaugguucaaaugcgaugacgcuauuaucacgaaggccagcauaaaagaugugcuggacucugagggauauuuacuguuuuaccauaagcaguuccuagaauaugaguga

SEQ ID NO: 64622 - RNA, 3378 nt, Artificial Sequence
  derived and/or modified sequence opt3 from USP25__Homo_sapiens__NP_001269970
augaccguggagcagaacguccugcaacagagcgccgcucagaagcaccagcaaacauuccucaaucagcuuagagaaaucacuggcauuaacgacacgcagauacugcagcaagcauugaaagauuccaaugggaacuuagagcuggccguugcguuucuaaccgcuaagaaugccaaaacaccccagcaggaagagacuaccuacuaucagacagcacucccuggaaacgacagguacaucucuguggguucacaagccgauaccaauguaauugaccugacuggcgaugacaaggaugaccuucagcgggcuaucgcacugaguuuggccgaaagcaaccgcgcuuuccgagagacagggauuaccgaugaggaacaggccaucucccgugugcucgaggcgucuauagcagaaaauaaagccugccugaagagaacgccaacugaggucuggagggacucgcggaacccguaugaucgcaagagacaagacaaagcucccgugggacugaagaauguuggcaacaccuguugguuuucagccgugauccagagccucuucaauuuacuggaguuuaggcggcuugucuugaacuacaaaccuccaaguaaugcacaggaucugccccgcaaccagaaggaacaucgaaaccuaccuuucaugagagagcucagguaucuguuugcccuucugguggguacaaaacggaaguacguagacccaucccgugcuguugaaauuuugaaggacgcguucaaaucuaaugauagccaacagcaggacguguccgaguuuacucacaagcuccuggauugguuagaagacgccuuccagaugaaagcagaggaggaaaccgaugaggaaaagcccaaaaacccuauggucgagcuguuuuaugggcgcuuccucgcugugggagugcuugaaggcaagaaauuugagaauacagagauguucggccaauacccacugcaggucaacggguucaaggacuugcaugaaugccuagaggccgcuaugaucgaaggagagauugaaucacugcacagugagaauagcgguaagucuggccaggagcauugguuuaccgaacucccgcccguucugacguucgagcuuuccagauuugaauuuaaccaggcccuggggaggccugagaaaauccacaauaaguuggaguucccacaagugcucuaccuggaucgguauaugcaccgaaaccgcgaaauaacuagaauuaaaagggaggaaaucaagcgguuaaaagacuaccugacaguacuacagcagcgccucgagagauaucugucauacggaagcggccccaagagguucccucuuguggaugucuugcaguaugcacuggaauuugccaguucuaagccaguguguaccucccccguugacgauauugacgcuagcucgccgccuucugguuccauccccucacaaacucucccaaguacaaccgagcagcagggggcgcugagcuccgagcuuccuucuacgagccccucaaguguggcagccaucuccagccguucugucauucauaaaccauucacccaaucacggauacccccugaccugccaaugcacccggcuccccgacauaucacagaagaggaauugagugugcucgagagcugccugcacagauggaggacugaaauugagaaugauacccgcgacuuacaggaguccaucucucggauacacagaacaauugaacugauguacucggauaagagcaugauccagguaccuuauaggcuacaugccguucucgugcacgagggacaggcaaacgccggccauuacugggcuuacaucuuugaccaccgcgaaucccgauggaugaaauauaaugauauugccgucacuaagucaaguugggaggaacuggugcgggacucuuucggcggguaccguaacgcaagcgcguauugucuuauguacaucaaugauaaagcucaauuuuugauucaggaggaguucaacaaggaaaccggacagccacuggucgguauagagacacuucccccugaccugagagauuuuguggaagaggacaaucagagguucgagaaggaauuagaggaaugggaugcccaacuggcacagaaagcccuucaggagaaguugcucgcuucccagaaacugcgcgaaucagagaccagcguuacuacggcccaagcagcuggcgacccagaguaucuagaacagcccucucgguccgauuucaguaagcaucugaaagaggaaacaauccagauuaucaccaaggccagccacgagcacgaagacaagucuccggagacugugcuccaauccaaaccugagaacaccacaucacagccacugaguaaccagagaguagucgaaguggcgaucccccauguugggaaguuuaugauugagagcaaagaaggaggcuacgacgaugagauaaugaugaccccuaauaugcaggguaucauuauggccaucgggaagucgagguccguguaugaccgaugcggccccgaagcuggauucuuuaaagcaauuaagcucgaguacgcccgcuuggucaaacuggcucaagaggauacuccaccugaaacagacuaccgguuacaccaugugguaguguauuucauccagaaccaggcccccaagaagauaaucgagaaaacgcuccuggaacaguuuggcgauagaaaucuuucuuucgacgagaggugucacaacauuaugaagguugcacaagcgaaacuggagaugaucaagccagaagaggucaauuuggaagaguacgaagaguggcaccaggauuaucguaaauuucgcgagaccacuauguaccucauuaucgggcuggaaaacuuccagcgggagagcuauauagacucacuacuguuucucauuugcgccuaccagaauaacaaggaacugcuuaguaagggauuguauagaggucaugaugaggaacugaucucccacuacaggcgagaguguuuacucaaacugaaugagcaagcugccgaacuuuucgagucuggcgaagaccgggaggugaacaaugggcugauuaucaugaacgaauuuauagugccguuccuaccucuccuguuggucgaugagauggaggaaaaggacauccuggcaguugaggauaugcgcaauagauggugcagcuacuuaggacaggaaauggagccccaucuccaggagaaacugacagacuuucuuccaaagcuguuggacuguuccauggaaauuaaaucauuccacgagcccccuaagcucccaagcuauaguacccaugaacugugcgagagguucgcucggaucaugcuaucucugucccgaacacccgccgauggcagauga

SEQ ID NO: 64623 - RNA, 2742 nt, Artificial Sequence
  derived and/or modified sequence opt3 from USP26__Homo_sapiens__NP_114113
auggccgcucuguuccucagaggcuuugugcagaucgggaacugcaagaccggaauuagcaaauccaaggaggcauucauagaagccgucgagaggaaaaagaaagaccggcuuguucuguacuuuaagucugguaaguauucaacauuccgcuugagugauaauauccaaaacgugguauuaaaaagcuaccgaggcaaucagaaccaucugcaccuaacucuccagaauaacaaugggcuguuuauugaaggacuuuccucuacggacgcggagcagcugaagaucuucuuggaucgugugcaccaaaacgaaguccagcccccugugagaccaggcaaaggugggucgguuuuuaguagcaccacacagaaggagauuaauaaaacuucauuccauaagguggacgagaaguccucuagcaaauccuuugaaaucgcuaagggaucaggcaccggcguccuccagaggaugccgcugcugacaaguaaacucaccuuaacuuguggggagcugagcgaaaaccaacacaagaaacggaagcgcaugcuuucuuccucaagcgagaugaaugaggaguucuugaaagaaaacaauaguguggaauauaagaagucuaaagccgauugcuccagauguguaagcuacaacagggagaagcagcugaaacuaaaggaacucgaggagaauaaaaagcuggaaugcgagucgucuuguauaaugaacgcaacaggaaaccccuaucuugacgauaucggucuguugcaggcccucaccgaaaagaugguucugguguuuuuacugcagcaaggcuacuccgacggguauacgaaaugggauaagcucaaacuuuucuuugagcuguucccugaaaagauuugccauggauugccaaaucuaggcaacacuuguuacaugaaugcuguccugcagucacuccugaguauccccagcuucgcagacgaucuucugaaccaguccuuuccuugggguaaaauuccauugaaugcccucaccaugugccuggcucgguuacuguucuuuaaggacacauacaacaucgagauaaaggagaugcuacuccugaaucuuaaaaaggccauuucugcggcagccgaaaucuuccacgggaacgcucaaaaugaugcccacgaguuuuuggcacauugucuggaccagcucaaagacaacauggaaaagcugaauacuauuuggaaacccaagagcgaguucggagaagauaacuuuccuaaacagguguucgcugacgauccagacaccucaggcuuuaguugcccggugaucacaaauuucgagcuugagcuguugcacuccaucgccuguaaggcgugcggccaggucauucucaagaccgaacugaacaauuauuuaagcauaaaccugccccaacgcaucaaagcccauccuucuucaauucagaguacguuugaucuauucuuuggggcagaggaacucgaguacaagugcgcuaaaugugagcacaagacuagcguuggagugcacuccuucucucgacugccaagaauccuuauaguacauuugaaaagguauucgcugaacgaguucugcgcccucaagaagaaugaccaggaagugauuaucagcaaauaccugaaggucuccucacacuguaacgaagguacacggcccccuuuaccacugagugaggauggcgaaaucaccgacuuucagcuuuugaaagugauucguaagaugacuucugggaauaucagcguuuccuggcccgcuacaaaagagucaaaggauauucucgccccgcauauaggaagcgacaaggagucugaacagaaaaagggccagaccguguucaaaggugcaucccgcagacagcagcaaaaguaucuggggaaaaacaguaagccuaaugagcuagaaagcgucuacucuggcgauagggccuuuaucgagaaggaaccccuggcucaccucaugacguaucuggaggacaccucccuuugccaguuccauaaagcgggaggcaagccagcaucaaguccugggacacccuugagcaaaguggacuuucagacuguaccagagaaccccaagcggaaaaaguacguuaagaccucgaaauucguggccuuugaucgaauuaucaauccuacaaaggaccuguacgaagauaaaaacauccgcauuccagagagauuccagaaggucuccgaacaaacucagcagugugacggaaugaggauaugcgagcaagcuccgcagcaggccuuaccccagucuuuuccuaaaccagguacccaaggccacacaaagaaucuccugcggcccaccaaacuuaaccugcaaaagagcaaucgcaacucauugcucgcacuggggaguaauaagaacccuagaaauaaagauauccuagacaagauuaaauccaaggccaaagaaacuaagaggaacgaugacaagggagaucacacguaucgucugaucucuguggucagccaucucggcaaaacacugaaguccggucacuacauuugugacgcuuaugauuucgagaaacagaucugguuuaccuacgacgauaugcgggugcuugggauacaggaggcccaaaugcaggaagaccgaagaugcacuggcuauaucuucuuuuacaugcauaacgagauuuucgaagagauguugaagagggaggaaaaugcacagcugaacucaaaagagguugaagagaccuuacagaaggaauga

SEQ ID NO: 64624 - RNA, 3234 nt, Artificial Sequence
  derived and/or modified sequence opt3 from USP28__Homo_sapiens__NP_065937
augaccgccgagcugcagcaagacgaugcugcaggcgccgcggacgggcacggaagcuccugccagaugcuccuuaaccagcugagagaaaucacagguauucaggaucccucuuucuugcaugaggcuuuaaaggccucaaauggcgacauaacucaagcagugagucugcuaacggaugaaagggucaaagagccuagccaggacaccguugccacagaaccauccgagguggaggggucugcugcaaacaaggaaguacucgccaaagugaucgaucugacucacgacaauaaggaugaccuucaggcugccauugcgcugucguugcucgagucaccgaaaauccaggcagauggacgggaccugaaccgcaugcaugaagccaccagcgcugagacaaagcgaaguaagcguaaaagaugugaggucuggggcgaaaaucccaacccuaaugauuggaggcggguggacgguuggccaguugggcugaagaacgugggaaauaccugcugguuuuccgccgucauucaaucucucuuccaguuacccgaguuucgcagacuggugcuuagcuacuccuugccucagaacguacuggaaaauuguaggucacacacugagaaacggaacaucauguucaugcaggaacuacaauaucucuuugcacugaugaugggcaguaaucgcaaguucguugacccaagcgcugcccuugaucuguugaaaggcgcguuucgaucuuccgaggagcagcagcaagacgugucagaguucacacauaagcuccuggauugguuagaggacgccuuucagcuggcagucaacgugaauagccccagaaacaagagugaaaacccuauggugcaacucuucuacgggaccuuucuuacggagggagucagggaagguaaaccauucugcaauaacgagacuuuuggccaguauccgcugcagguuaauggguaccggaacuuggaugagugucuagaaggagcuaugguggagggcgacguagaacugcuccccucugaucacuccgugaaguauggucaggagcguugguucaccaaacugccuccaguccuuacauucgaacugagccgcuuugaguucaaucagucguuggggcagcccgagaagauacacaacaaacucgaauuuccucaaaucauuuacauggacagauauauguacaggucuaaggagcugauccggaauaaacgagaaugcauucgcaaguuaaaggaggagaucaaaauacugcagcagaagcuagaaagauacgugaaauauggauccggcccagccagguucccccucccggauaugcugaaguacguuauugaguuugcuucaacuaaaccugccagugaaagcugucccccagaguccgacacccauaugacacuuccuuugucuagcgugcacugcucagucagugaucagaccuccaaggaaagcacgucuacugagucaaguagccaagacguggaguccacauucucuucgcccgaagacagccugccaaaguccaaaccccucaccucaagucggucuagcauggagaugccuucccagccagcaccgcgcacuguaacagaugaagagaucaacuuuguuaagaccugucugcagagauggaggucagaaauugagcaggacauccaagaucuuaaaacgugcaucgccagcaccacacagacuauugagcagauguauugugacccccuguugcgucaagugccuuaccggcuccaugcuguccuggugcacgaaggccaggcgaaugcagggcacuauugggccuacauauauaaccagccacgacagucuugguuaaaguacaaugauaucuccgucaccgagaguagcugggaagagguggaaagagacucuuacggaggucugaggaacguuuccgcuuauugccuaauguacauuaaugauaaacuccccuauuucaacgccgaggcagccccuacagagucagaccaaaugagugaaguggaggcucugagcguagaacuuaagcauuacauccaggaggauaauuggcgcuuugagcaggaagucgaggaaugggaggaagaacagucgugcaagauaccacaaauggaguccucuacuaacagcucaagucaggacuauuccaccucucaggaacccagcguggccuccucacacggcguucgguguuugagcagugagcaugcagugauugucaaagaacagacagcgcaagcuaucgccaacaccgcaagagccuacgagaagucugggguggaagcugcccuguccgagguaaugcucagcccggcaaugcagggagugauccuggcuauugccaaagcgaggcagacuuucgaucgcgacggcucggaggccgguuuaaucaaggcuuuucacgaagaguauucacgacuguaccaacuugcaaaagaaacgccuacaucucauagugauccacgguugcagcacguucucgucuacuucuuucagaaugaggcccccaagcgugugguggaaagaacccugcuagagcaguucgcugacaagaaccuguccuaugacgagaggagcauuucuauaaugaaagucgcccaagcaaagcucaaagaaaucgggccugaugacaugaauauggaggaauacaagaaauggcacgaggauuauagccuguuccgcaagguuuccguguaccuuuugacuggccuggaguuauaucagaaaggaaaguaccaggaagcgcucucauaucugguguacgccuaccagaguaacgcugcccuucugaugaagggcccccggagagggguaaaagagagcgucauugcauuguauaggcgaaagugccuccuggaacuaaaugcuaaagccgcaucucuguuugagaccaacgacgaucauuccgugacagaaggaaucaauguuaugaacgagcucaucauuccauguauacaccugaucauuaauaacgacaucucaaaggaugaccuugaugccauugaggugaugcgcaaucauuggugcaguuacuugggucaagacaucgcugaaaaccugcaguuaugucucggcgaguuccugccucggcuucuggaucccagcgcggaaauaaucguccuaaaagagccaccgaccauuagaccuaauucccccuaugaccucugcucuagguuugccgcagugauggaaucgauccaggggguuagcacugugacaguaaaguga

SEQ ID NO: 64625 - RNA, 1089 nt, Artificial Sequence
  derived and/or modified sequence opt3 from USP2__Homo_sapiens__NP_001230688
augcuggugcccggcagcaccagaccuuacuccaagaaaaggcagaacucuaagucagcccaagggcucgcuggacuucggaaucuggguaacacaugcuucaugaauaguaucuugcaguguuuaagcaacacucgcgagcugcgagacuauugccuacagcgucucuacaugagagaucugcaccauggcuccaaugcacacacggcccuugucgaagaguuugcgaaacugauucagaccauauggacaucuucgccaaacgacguugugucaccgagcgaauuuaagacucaaauccagagguaugcuccccgguucguaggguacaaucagcaggaugcccaagaguucuugcgcuuucuccuggacggacugcauaacgaagugaauagagucacccucaggccuaaaaguaacccagagaauuuagaucaucugcccgacgaugagaagggccggcagauguggcgcaaguaucuugaacgagaggacuccagaauuggugauuuguucguggggcagcugaaaucuagccuaacauguaccgacugcggauacuguuccacuguuuuugauccuuucugggaccucucacugccaaucgcaaagaggggcuaucccgaagugacacuuauggauugcaugcggcuguuuaccaaagaggacgucuuggacggcgaugagaagccuacguguugccguugucgcgggagaaaaaggugcauuaagaaguucaguauccagcgguuuccaaaaauacucgugcugcacuuaaagcgauucagcgaaucucgcaucagaacuuccaaacugaccacauuuguaaacuucccgcucagggaccuugaucugcgggaguucgccucagaaaauacuaaccacgcuguuuacaauuuguacgcagugagcaaccacaguggaaccacaauggguggccauuauaccgccuacugucgcucucccgggacgggagaguggcacacuuuuaacgacuccagcgucacaccuaugucgucuucccaagugagaaccucagaugcuuaucuacuguucuacgaacucgccaguccacccagcaggauguga

SEQ ID NO: 64626 - RNA, 4815 nt, Artificial Sequence
  derived and/or modified sequence opt3 from USP32__Homo_sapiens__NP_115971
augggcgccaaggagagcagaaucggguuccuguccuacgaagaggcucucaggcgggugaccgacgucgaacuuaaacgccugaaggaugcauuuaaacgaacaugcggauugucuuauuacaugggucagcacuguuucauucgugagguuuuaggcgacggggugcccccuaagguagccgaagugauauauugcucauuuggaggcacuagcaaaggucugcauuucaacaaucuaaucgucgggcucgugcugcuuacgagaggaaaggaugaggagaaggcgaaauacauuuuuagccuguucuccucugaaucgggcaacuauguuaucagggaggaaauggagcggauguugcacguggucgacggcaaggugccagauacccuccgcaaauguuuuucagagggggaaaagguaaauuacgagaaauucagaaacuggcuguuucugaauaaggacgcuuucacauuuaguagguggcucuuaaguggagguguuuaugugacucugaccgaugacuccgauacaccgaccuucuaccaaacucuugccggcgucacacauuuggaagagucugacauuaucgaucuggaaaagcgguacuggcuacucaaagcacagagccgcaccgggcgauuugaccuggagacguucggaccccuuguguccccuccaauaagacccucacugagugagggcuuguucaacgccuuugaugaaaauagggacaaccacaucgacuucaaggagauuagcugcggucucucugcuuguugccgggggccucuggcagaacgucagaaauuuuguuucaagguguuugaugucgaccgcgauggaguuuuauccagaguggagcugagggacaugguaguggcccuccuugaagucuggaaagauaaucggacugacgauaucccagagcugcauauggacuugucagauauuguggagggcauccuaaacgcucacgacaccacaaagaugggccaccugacucucgaagauuaucagauauggagcguuaaaaaugugcuggccaacgaguuccuuaaucuguuguuucaagucugccauauugugcucgggcugcgacccgcgaccccugaagaggaaggacagaucauucgcgguugguuagagagagagaguagguacggccugcaggcagggcacaacugguucaucaucucuaugcagugguggcaacaguggaaggaauauguaaaguacgacgccaauccaguugugauugagccguccagcguccuaaacggaggcaaauauucguuugguacagcugcccaucccauggaacagguggaggaccggauagggucuucccucucauacgucaacaccacggaggaaaaguucagugauaauaucagcacugcauccgaggcuucugaaacagccggcagcggauuucuguauucagcgaccccuggcgccgacguguguuucgcacgccagcacaacaccagugauaauaacaaucaaugccuuuugggggcuaacggaaauauucugcuccaccugaacccacagaaacccggugccaucgacaaucagccucuuguuacacaagagccagugaaggcuaccucccugacguuggaaggcgggagacucaaaaggacuccccagcugauacauggacgugauuacgagaugguaccggagccugucuggcgggccuuauaccacugguauggcgcaaaccuggcccuaccccgaccagugauuaagaauagcaagacagacaucccugaacucgagcuguuucccagauaccuuuuguuccugaggcagcagccagcuacucgcacccaacagucuaacaucuggguuaauauggguaacgugcccucaccuaaugcgccacucaaacggguccuggcauauacaggguguuucaguagaaugcagacuauuaaggaaauccaugaguacuuaagccagaggcugcgcauuaaagaagaggauaugcgacuuugguuguauaacuccgagaacuaccucacccugcuagacgaugaagaccacaagcuggaguaucucaaaauacaagaugaacagcaucuggugaucgagguacggaauaaggacaugucuuggccggaagagaugucguuuauugccaacagcuccaagaucgaucgucacaaagugcccacagagaagggcgcuaccggacuuucaaauuugggcaacacuugcuucaugaauaguucuauccagugcguuagcaacacgcagccucugacacaauacuuuauuuccgggagacacuuauacgaacucaauaggaccaacccaauaggaaugaaaggucauauggccaaguguuauggcgaccugguccaggagcuuuggucagggacucagaaaaauguggcaccccugaaguugcgcuggaccaucgccaaguacgcuccucgguucaacggauuucagcaacaggacagccaggaacuccuggccuuccuacuggauggccuccacgaggaccugaauagagugcaugagaaaccauaugucgaacuuaaggauucugacgguaggcccgauugggagguugcagcggaggcuugggacaaccacuugcgacgcaaucgguccauugugguggaucuguuucacgggcaauuaagaagucagguaaaaugcaagacauguggccauaucagcgucagguucgacccguuuaacuuccucucucugccucuuccaauggauuccuacaugcaccuggaaauuaccgugaucaaacuagacggaacuacacccguucguuauggccuccgccugaauauggaugaaaaguacacgggguugaaaaagcagcugucagacuuaugcggacucaacagugagcagauacugcuugccgaggugcauggcagcaacaucaagaauuuuccucaagauaaccagaaaguccggcugucgguguccgguuucuugugugcauuugaaauucccguuccagugucuccuaucagcgccucaagucccacccagacugacuucuccucuagcccauccacaaaugagauguucacccucacaacuaacggggaccugccgagaccuauuuuuauccccaauggaaugccaaacaccguaguccccugcggcacggaaaagaauuucaccaacgguauggugaauggccacaugccuucacuaccagauagccccuuuacaggguauauaauugcugugcauaggaaaaugaugcgaacugagcuguacuuccuuaguucucagaagaaccggccuucccucuuuggaaugccgcugaucgucccauguaccguucacacacgcaaaaaggacuuguacgaugccguguggauucaaguaagcagacuggcaucgcccuuaccuccacaggaagcuagcaaucacgcccaggacugcgaugacucuaugggcuaucaguaccccuucacucucagggugguccaaaaggaugggaacaguugugcguggugcccuugguaucgguuuugucgaggaugcaaaaucgacugcggcgaggauagagccuucauagguaaugcuuacaucgcaguggacugggauccgaccgcccugcaucuucgcuaucagacgucccaggagaggguuguggacgaacacgagagcgucgaacaaucucgucgggcucaggccgagcccauuaaccuggacagcuguuugagagcauuuacauccgaagaggagcucggggaaaaugagauguacuauugcucaaaguguaaaacccauugccuggcgacuaagaaacuagaucuguggaggcuuccaccuauccucauuauccaccugaagcgcuuccaguuugugaacggacgauggauaaagagucagaaaauuguuaaguuccccagagaaucauucgacccaucugccuuuuuggugccucgggaucccgcuuuaugucaacauaaaccacugacaccgcagggcgacgagcucuccgagccuaggauccuggcccgcgaagucaagaaaguagaugcacagucaagugcuggugaggaagacgugcuucugagcaagucccccucuucguugagcgccaacaucauuucauccccaaagggcagucccucuagcucccguaaaucagggaccucuugcccuagcaguaaaaauuccagcccaaacucuucacccagaacucuaggacgguccaagggcaggcugcgccucccucagaucgggaguaagaauaaacugagcucgucuaaggagaaccuugaugcauccaaagaaaauggagccggccaaauuugugaguuagcugacgcgcugagccgaggucacguucucgggggaucacagccggaguuggugaccccacaggaucacgaagucgcccuggcaaacggcuuccucuacgagcaugaggcuugcgguaauggcuacaguaacgggcagcugggaaaucacucugaagaagacuccacagaugaccaaagagaggauacgcggauaaagcccaucuauaaccuuuacgccauuagcugucauucaggcauccugggagggggccacuaugugaccuacgccaagaauccuaacugcaaaugguauuguuacaaugacaguagcugcaaggaguugcaccccgacgaaauugauacugacuccgcuuauauccuauuuuacgagcagcaggguauagauuacgcacaguuccugccaaaaacagacgggaagaaaauggccgauaccucuagcauggacgaagauuuugaguccgacuauaagaaguacugcguacuccaauga

SEQ ID NO: 64627 - RNA, 1803 nt, Artificial Sequence
  derived and/or modified sequence opt3 from USP33__Homo_sapiens__XP_011539358
augaccggcagcaacucccacaucacaauucugacucucaaggugcuuccccauuucgagucucuggggaaacaggaaaagauaccuaauaaaaugucagccuuuagaaaccacugcccacauuuggacagugucggagagaucacgaaggaagauuuaauucagaaaagccuggguaccugucaagacugcaagguucagggcccgaaucuaugggcuugucucgagaacaggugcuccuacgugggguguggagaaucucagguagaucacucgacaauccauucacaagagacuaagcacuaucugaccgugaaucuuacaacccugcgggucuggugcuacgcauguagcaaagagguguucuuggaccgcaagcucggcacucagcccagucugccucacguucgacagccacaucagauucaagaaaacuccgugcaggauuuuaaaauccccucuaauacaacccugaagacgccucucgucgccguguucgacgauuuagacauagaggcggaugaagaggacgagcugcgugcuagaggucuuacuggguugaaaaacaucggaaauaccugcuauaugaacgccgcacugcaggcccuaagcaauuguccaccccucacacaguuuuuccuggauugcggcggccuugcuaggacugacaagaagccugcaauuuguaaauccuaccugaaguugaugaccgaacucuggcacaaaucacggccagggaguguaguuccgacaacccuguuucaaggaaucaagacggugaaccccacuuuccgcgguuauagccagcaggaugcccaagaguuuuuaagaugccugauggaccuccuucaugaagaacugaaagaacaggucauggagguggaggaagacccucagacaauuaccacugaggaaacaauggaggaagauaagucucaguccgacguggauuuccaaucaugcgagagcuguaguaauucugacagggcugagaacgaaaauggcucccggugcuuuagcgaggauaacaacgaaaccacgauguugauccaggacgaugagaauaacucggaaaugucuaaagacuggcagaaggagaagauguguaauaaaauaaacaaggucaauuccgagggggaguucgauaaagaccgcgauucaauuagugagaccguugaccuaaacaaucaggaaacagugaagguacaaauccacagccgagccuccgaguacauuacugacgugcacucuaacgaucugagcaccccacagauccuccccucaaaugagggagucaacccuagacugagugcguccccacccaaaagcggcaaucuuuggccgggucuggcaccuccccauaagaaggcccagucugcuucaccaaaaaggaagaaacagcacaagaaauaucggagugugaucagcgacauuuuugaugggacaauaaucuccucuguucaaugcuugacuugugaccgugugucggucacccucgaaacauuccaggaucugagcuuaccuauucccggaaaggaggaccuggccaagcuacauuccucaagucacccaaccucuaucgugaaagcaggcagcugcggcgaagccuacgcuccccagggguggauagcguucuuuauggaguacguaaagcgcuucguuguguccugugucccuucaugguuuuggggaccaguggucacucuccaggauugccuggccgcauucuuugcuagagacgaacuuaaaggugauaacauguauagcugugagaagugcaaaaagaaugccacggcuuguuga

SEQ ID NO: 64628 - RNA, 3372 nt, Artificial Sequence
  derived and/or modified sequence opt3 from USP36__Homo_sapiens__XP_005257599
augcccaucguggacaagcugaaagaggcccucaagccuggcagaaaagauagcgcugacgauggggaacuuggaaagcuguuggcauccucugccaaaaaggucuuacugcagaagauugaguucgaaccagcgucaaaaaguuuuagcuaccaacuagaggcucucaaguccaaauauguucugcuuaacccgaagaccgaaggugccucuaggcacaaaucgggcgacgaucccccugcacggcgccaggggucagagcauacauacgagagcugcggagacggcgugccagcuccccagaagguacuguucccuacugaacgauugagucuccguugggagagaguguuuagggucggugcugggcugcacaaucugggaaacacguguuuccucaaugcaaccauacagugcuuaacauauacuccaccccuggccaacuaccuuuuguccaaggaacaugcucggucuugucaccaaggcagcuuuugcaugcugugugugaugcagaaucauaucguucaggccuucgcgaacuccggcaaugcaauuaaaccugugucauuuauccgcgaucuaaagaaaauugccagacacuucagguuugggaaccaggaggacgcucacgaguuccuccgguauaccaucgaugccaugcaaaaggcaugccugaauggaugugcuaaacuugaccgccagacacaggccaccacucugguccaucagauauuugguggcuacuugcgaaguagagugaagugcagcguauguaaaucuguuuccgauacauaugacccauaccucgauguggcgcuggaaaucaggcaagccgcaaacauuguccgggcuuuagagcuguucgugaaggccgacgugcucucaggggaaaaugcuuacaugugcgccaaguguaaaaagaaagucccggcaagcaagcguuuuaccauccaccgcacgaguaacguucuuacucugucuuugaaaagauucgccaauuucuccggaggcaagauuaccaaggacguggguuaucccgaguuucuaaacaucaggccuuacaugagccagaauaacggggauccaguaauguauggacuguacgcugugcucguccauucgggcuauucuugccacgcgggccacuacuauugcuacgugaaagcauccaacgggcagugguaccaaaugaaugacucacugguucauaguagcaacgugaaggucgugcuuaaucagcaggccuauguacuguucuacuugcggauacccggauccaaaaagucuccugaaggucucauuagccgaacaggcucaaguucccugccagggcgccccagcguuaucccggaucacucuaaaaagaacauuggaaauggcaucaucucaaguccuuuaacugguaagagacaggacagcgggaccaugaaaaagccccauacaaccgaggagauuggcgugccaauauccaggaacggaucuacgcugggccuaaaaucgcaaaauggguguaucccucccaagcucccaagcggaucccccucaccuaaacugagucagacuccaacacacaugccgaccauucuugaugaccccgguaagaaggucaaaaagccugcuccaccccagcauuuuucuccucggacugcccagggcuugccagggacaagcaacuccaauucaagccgcucuggaucccaaagacagggcaguugggauagcagggacgugguccugucuaccucccccaaacuccuggcaacggccaccgcuaacggucacgggcuuaagggcaaugaugaaucagccggacuggaccgucggggcaguagcucguccucuccggagcacagcgcaucaagugauuccacaaaagcgccucagacuccacgaucuggggcugcccauuugugcgacagccaggaaaccaacuguuccacagcaggacacucaaagacucccccuagcggugccgacaguaaaaccgugaagcucaagucucccguucuguccaauacaaccacugagccagcuagcacgaugucgccucccccagccaaaaaguuagcacugucagcuaaaaaggccucuacacuauggagagcgaccggcaacgaucucaggccgccucccccaagucccuccagcgaccugacucauccuaugaaaaccucucacccagugguagccagcacauggcccguccaccgcgcucgggcaguguccccugccccgcaaucaaguagcagacuucagccacccuucucuccucauccaaccuugcuguccucaacucccaagccuccggggacaagugaacccaggagcugcuccucuaucucgacggcucucccacagguuaaugaggaucuggugagcuuaccucaccagcugcccgaggccucagaaccaccucaaucccccagugagaagcgcaaaaagaccuuugucggagaaccacagcgacuuggcucugagacucgguugccgcagcauauacgugaagcaacagcggccccucacgguaaaagaaagaggaaaaagaagaaacgccccgaggacaccgcugccagcgcacuccaagaggggcagacacagcggcagccaggcucccccauguauagaagggaaggacaagcucagcugccugccgugcgacgccaggaggauggcacucagccacaaguaaacgggcaacaggugggauguguuaccgacggccaucacgcaucaucucggaagagaaggcguaaaggugccgaagggcuaggagaggagggcggucugcaccaggauccccuccgccauagcugcaguccuaugggcgacggggauccggaagcuauggaggaauccccacggaagaaaaagaagaaaaagagaaaacaggagacgcagagggcggucgaagaggacggacaccugaaguguccccgaagcgccaaaccucaggaugcaguggugcccgagucuucauccugcgcuccaagugccaacggcugguguccuggggaccggaugggacuuagccaagcacccccagucucguggaauggcgaacgcgagucugauguugugcaggaauugcugaaguacuccagcgacaaagccuaugguagaaagguguuaaccugggacgggaagaugucagccguaagucaggaugccauugaggacucuaggcaggcgcggacagaaacugucguggaugacugggaugaggaguucgaccgaggaaaagaaaagaaaaucaagaaauuuaagagagagaagcgcaggaacuucaaugcuuuucaaaaacuccagacccgucggaacuucugguccguuacacauccugccaaggcagccagccugucauacagaagguga

SEQ ID NO: 64629 - RNA, 2940 nt, Artificial Sequence
  derived and/or modified sequence opt3 from USP37__Homo_sapiens__XP_005246779
augagcccccugaagauccacggcccuauuagaauaagguccaugcagaccgggaucacaaaauggaaggagggaucuuucgaaauuguggagaaagaaaacaaggucucacucguugugcauuacaauacugguggcaucccacggauuuuucaacuuagucacaacaucaaaaauguagugcugcgcccgagcggggccaagcagucccgauugauguuaacgcugcaggacaacucuuuccuaucgauagauaagguccccucaaaagacgcugaggaaaugcgucucuuucuggaugcagugcaucagaauagacuuccugccgcgaugaagccaagccaaggaaguggcuccuucggugcuauccuggggucuaggaccagccagaaagagacaucccggcaguugucauauagugacaaccaggccagcgcaaagcgcggaucucucgagacuaaagaugacauucccuuuagaaagguucugggcaauccuggcaggggguccaucaagaccguggccggaucagguauugcucggacaaucccaagccugaccaguacuucuacaccccuccgcuccggcuuacuggaaaaccgaaccgagaaaagaaagaggaugauaagcacggggucggaacuuaaugaggauuacccuaaagagaacgacucuuccucaaauaacaaggcaaugacugauccaagucggaaauauuugaccagcucccgugaaaagcaacugucucuaaaacagagcgaggaaaaucgcacaucaggacuccugccgcuucagaguuccagcuucuacggcucuagagccgguucaaaggagcacaguagcgggggaacuaaccuggacaggaccaaugucuccucucagacacccucggcuaagcggagcuugggcuuucucccucaaccagugccccuguccguuaaaaaguuacgaugcaaccaggauuauaccggcuggaacaaaccucgcguaccacugucaagucaucagcaacagcagcuccagggguucucuaaucuuggaaacacguguuacaugaaugccauucugcagagcuuguuuucccuacagucauucgcgaacgaccugcucaagcaggguauccccuggaaaaagauuccgcugaaugcacuuaucagaagguuugcccaccuguuggugaagaaagauaucugcaacagcgaaacuaagaaagaccuccugaagaaagucaagaaugcuauuucugccacagcagagcgguucuccggcuauaugcagaacgacgcucacgaguuuuuaagucaaugucuggaucagcuaaaggaagacauggagaaacucaauaagaccuggaaaacugaaccugugagcggggaggaaaacucucccgauauauccgccacacgcgcguauaccugcccagugaucacgaaucuggaguucgagguccagcauucaauuaucuguaaggccugcggagaaauaauuccuaaaagagagcaguucaacgaccuuaguaucgauuugcccaggcguaagaagccacugcccccucggagcauccaagacucgcucgaucuguuuuuccgagcagaggagcuugaauacuccugugagaaaugcggcgguaagugugcucugguuagacacaaauuuaauagguugccacgcgugcucauucugcauuuaaagcgguacucuuucaacguagcccugagccuaaauaacaaaaucgggcaacaggugauuauaccgagauaccucacccugucaagucacugcacagagaacacuaagcccccuuuuacccuuggcugguccgcucacauggccaucucuaggccauugaaagcaagccagauggucaauuccuguauuacaucacccagcacuccuaguaagaaguucaccuuuaaaucuaaguccagccuggcccucugccuggacucggauucagaagacgaguuaaaacgcucuguggcucugagucaacgacuuugcgaaauguugggaaacgagcagcagcaagaggaucucgaaaaggacuccaaacuguguccaaucgagcccgacaagagcgaacuagaaaauucuggcuucgaucggaugagcgaagaggagcugcucgcggcaguucuggaaaucuccaagcgugacgccucaccgagucuuagccaugaggaugacgauaaaccuacaucuuccccagacaccggguuugcugaagaugacauucaggagaugcccgaaaacccugauacuauggagacggagaagcccaaaacaauaaccgaauuggacccagccucauucacugagaucaccaaggauugcgacgaaaauaaagagaacaagacaccugaaggaagucagggugagguggauuggcugcagcaauaugacauggagagagaaagggaggaacaggaguuacagcaggcacucgcccaaagccugcaggagcaggaggcuugggaacagaaggaagacgaugaccuuaaacgcgccaccgagcuguccuugcaagaauuuaauaacucuuucgucgaugcacucggcucggacgaggauagcgggaaugaggacguguuugauauggaauacacugaggcggaagcugaggaacugaagcggaacgccgagacaggaaaucuaccccacucauauagacugauuuccguaguuagucauaucggcucuacgagcuccucaggucacuacauuucugacguguaugauaucaaaaagcaggcaugguucaccuacaacgaccucgaggucagcaaaauacaggaagccgcugugcaaagugauagggaccgauccggguacaucuucuuuuauaugcauaaggagauuuucgaugaacugcuugagacugaaaagaauagccagucuuugucaacagaggucggcaaaaccacacgccaggcccuguga

SEQ ID NO: 64630 - RNA, 1431 nt, Artificial Sequence
  derived and/or modified sequence opt3 from USP3__Homo_sapiens__NP_001243631
auggagugcccccaccugagcuccucuguguguaucgccccugacucagcuaaguucccaaacggcaguccgagcuccuggugcuguucugucugcagaucgaauaaaucacccuggguuugucuuaccugcagcagugugcauuguggguccuacaggugcgaugacuuuguagugaacgauacaaagcucggacugguccagaaagugcgggaacacuugcaaaauuuagagaacucugcauucacugccgaccgccauaagaaacgaaagcugcuagaaaauagcacgcucaacuccaagcugcuuaaaguuaaugguucaaccacagcgauuugugcuacuggccugcguaacuuggggaauaccugcuuuaugaacgccauacuccagagucugagcaauaucgagcaguucuguugcuauuuuaaggaacugccugcaguggagcucagaaacggaaaaacagccggcaggcggaccuaccacacucgcucucagggugauaauaacgucuccuuaguggaggaauuuagaaagacacugugcgcucuuuggcaagggucacagaccgcauuuagcccagagaguuuguucuauguaguuuggaaaauuaugcccaauuuuaggggauaccagcagcaagacgcccaugaguucaugcgguaucugcuagaucaccuccaccuggaacuucagggcggcuuuaacggggugucucgcuccgcuauccugcaggagaacagcacguugucggccucuaauaaguguugcauuaacggagcguccacugucgugaccgcaaucuucgguggcauacuccagaaugaagugaacugucugaucugcgggacagagucacgaaaguuugacccuuucuuagaucugagucucgacauuccaagccaauucagauccaaaaggucuaagaaucaggaaaacggacccgucuguagccuucgggauugccugcguucauuuacugacuuggaggaacuagaugagaccgagcuguacaugugucauaaaugcaagaaaaagcagaaaaguacaaagaaguucuggauccaaaaacucccuaagguucugugucuucaccugaaacgcuuucauuggaccgccuauuugagaaauaagguggacacguacguagaguucccacucaggggccuggacaugaaaugcuacuuacuggaaccggaaaacuccggucccgagagcugucuauaugaucucgcugccguggucgugcaccacgggucuggaguuggcucaggccauuacacugcauaugcuacacacgaagggcggugguuucauuucaaugacaguaccgugacucugacagaugaggagaccgucgugaaggccaaggcguacauucuuuucuauguagaacaccaggccaaagcaggaagcgacaaguuguga

SEQ ID NO: 64631 - RNA, 3744 nt, Artificial Sequence
  derived and/or modified sequence opt3 from USP40__Homo_sapiens__NP_060688
augagccuguuccucagaguggucuuuuccuucaccauguuuggagaccuuuucgaggaagaguacucuacaguuucaaacaaucaguaugggaaggggaaaaagcugaaaacuaaggccuuggaacccccugcuccaagggaguuuacgaacuuaagugguauccggaaucaaggcgggaccugcuaccugaacagccuacuccagacacugcacuucacuccggaauuucgcgaggcacuuuucucccugggacccgaggaauugggccucuuugaggauaaagacaagccugaugccaaggugcgaauuauaccacugcagcugcagcgucucuucgcgcaauuacugcuuuuggaccaggaagcugccucuaccgcagaucugacagacucguuugguuggaccucaaaugaggagaugagacagcaugauguacaggaacuaaacaggauccucuucagcgcccuggagacgagucuuguggggacauccggacacgaccugauuuaucgguuguaccauggcaccaucgucaaucaaauuguguguaaagaaugcaagaacguuucugagcgccaggaagauuuucucgaccugacgguggcugucaaaaaugugagcggcuuagaggaugcacuguggaacauguauguagaggaagagguuuucgacugugauaaucucuaccacugcgggacuugugacagacuugugaaggccgcuaaauccgccaagcugaggaaguugcccccuuuccuaaccgucucacugcuccgguuuaacuucgacuuugugaaaugcgaacgcuauaaggagacaaguuguuacacuuucccacugcgaaucaaucuuaaacccuuuugcgaacagagcgagcuggaugacuuggaguacauauaugaucucuucucugugaucauucauaagggagguuguuacggcgggcacuaucacgucuacaucaaagacguugaucaucugggaaacuggcaguuucaagaagagaaguccaaaccugacgugaauuuaaaggaucugcagucagaagaggaaauugaccacccacuaaugauccucaaggcgauacugcuugaggagaacaacuugauuccgguagaucagcugggccaaaaacuccugaagaaaaucgguauuagcuggaauaagaaauauagaaagcagcaugggccccuuaggaaguuccugcaguugcacagucagaucuuucuccugucuuccgacgaaagcaccgugcgguuacugaaaaacucgucucuacaagcagaguccgauuuccagcguaaugaccagcagaucuuuaagaugcucccuccagaaucacccggacugaacaauaguauuagcugcccucacugguucgacauaaacgauuccaaaguccaaccaauccgcgagaaggacauugagcagcaguuucagggcaaagaaucugccuacaugcuuuucuauagaaagagccaauugcagaggcccccggaggcucgggccaauccucgauacggcgugcccugucaucugcucaacgaaauggaugcagcuaauaucgagcugcagacaaagcgcgccgaaugcgacucagcgaacaauaccuucgaguuacaucugcaccuugggccacaguaccacuuuuucaacggagccuugcauccuguugugagucaaacggaguccgucugggaucucacuuuugacaaaagaaagacacugggugaucuaaggcagagcauauuccagcugcucgaauuuugggagggcgacauggugcugucuguagcaaaacuuguucccgcuggguugcacauuuaucaaucacugggaggcgaugaauuaacccucugcgagacugaaaucgccgacggugaggauaucuucguguggaauggggucgaggugggcggaguccacauucagacaggcaucgacugugaaccacugcuucugaacguguugcaucucgauaccaguagcgacggggagaagugcugucagguuauugaauccccgcacguguuuccugcuaaugccgagguaggaacgguccugaccgcacuagccauaccagcuggugugaucuucauuaacucugcgggcugccccgggggagaaggcuggacagcaauccccaaagaggacaugcggaagacuuuucgcgagcagggucugagaaacgggucgagcauccucauucaagauucccaugacgauaauucacugcuuaccaaggaagagaaauggguuacaaguaugaacgaaauagacugguugcacgugaagaaucugugucaguuagagucugaggaaaaacaggucaagaucagcgccacugugaacaccaugguauucgauauuaggaucaaagcuauuaaggagcucaaacugaugaaggaacuugccgacaauuccugccugcguccuaucgaucggaacggcaagcuacucuguccagugcccgacucauacacacugaaagaggcagaauugaagaugggaagcucucugggcuuaugccucgggaaagccccuuccaguagccagcuguuucuuuucuuugcuaugggaucugauguucaaccagguaccgagauggagauagucguggaagagacuaucuccgugcgagacugucugaaguugaugcucaaaaagucaggccugcagggggaugccuggcaccuaagaaagauggacuggugcuaugaagcaggagagccccugugugaagaggaugcgacgcuuaaagagcuccugauuugcaguggcgacacauugcuguuaaucgaaggucagcucccgccucugggguuccuuaaggucccaauuuggugguaccagcugcaaggccccagcggacauugggagucgcaccaggaccagaccaauugcacuuccucuuggggcaggguuuggcgcgcuaccagcucacaaggggccaguggaaacgaaccugcacagguguccuugcucuaucugggcgauaucgagauaucugaagacgccacacuagcugagcugaaaagccaggccaugacccuucccccauuccucgaguuuggugugccuucccccgcacaucugcgggcuuggacuguagaaagaaagaggccagggcgcuuguuacgaacagaucggcagccgcugcgugaguacaaacucggaagaaggauugaaaucugucuggagccucuucaaaagggcgagaaucuggguccccaggacgucuugcuacgcacucaggugcggauuccaggcgaaagaaccuaugcccccgcgcuggaucucguuuggaacgccgcucagggaggaacugcaggcucacugaggcaacgaguggccgacuucuaccgccuuccugucgagaagaucgaaauagcuaaauacuuuccagagaaguucgaaugguuacccaucagcaguuggaaucagcagauuacaaaacggaagaaaaagaagaaacaggauuaucugcaaggggccccuuacuaucucaaggacggagauaccaucggcgugaaaaacuugcugauugacgaugacgacgauuuuucuacaaucagagacgauacugguaaggagaaacagaagcagagggcacucgggcgucgcaaaucccaggaggcgcugcacgaacaaagcucguacauacuuucaucugccgagaccccggcucggccaagagcccccgaaacgagucuguccauucauguuggcagcuucagguga

SEQ ID NO: 64632 - RNA, 3951 nt, Artificial Sequence
  derived and/or modified sequence opt3 from USP42__Homo_sapiens__NP_115548
augaccaucguggacaaggccagcgaguccucugaucccucagcuuaccagaaccaaccuggcaguagcgaagcagucuccccaggggacauggaugccggaucugcgucguggggugcuguuucaagccugaaugacgugaguaaccacacacucucccuuggcccgguacccggggccguggucuauucuagcuccucagugccugauaaaaguaagccaagcccccagaaagaccaggcacugggagauggcauugccccuccacagaagguuuuguuccccucugagaaaauaugcuuaaaguggcaacagacucauagagugggugcugggcugcagaaucuaggaaacacguguuuugcaaaugccgcucuccagugccugaccuacacaccuccacuugccaacuauaugcugucccacgaacauucaaagacuugucacgcggagggcuucugcaugauguguaccaugcaagcacauaucacacaggccuugagcaauccgggcgacgucauuaaacccauguuugugaucaacgaaaugaggcggauugcucgccacuuccgauuugggaaucaggaggaugcccacgaguuccuccaguacaccguagacgcaaugcaaaaggcuugccugaacggaaguaauaaacuggaucgucauacucaggccacaacccucguuugucagaucuuugguggcuauuuaagaucuagggugaagugccugaacuguaaaggggucuccgacacguucgauccuuaccuugacauaacuuuggaaaucaaggcggcccaaagcgugaauaaggcacuggagcaguuugugaaaccagaacagcuagacggagagaacucguauaagugcucuaaauguaagaaaaugguccccgcuuccaagcgguucaccauucaccgcucaaguaauguucucacacugagccuuaaaagauuugccaacuucacuggcgguaagaucgcuaaggaugugaaauacccugaguaccuggacauuaggccauauaugucccagcccaacggggaaccgaucguauacguguuguaugccguccucgugcauaccggauuuaauugccacgcaggccacuacuucugcuauauaaaggccucuaacggccugugguaccaaaugaaugauagcauuguuucaacaagugacauccgguccguguuaagccagcaggcuuauguccuguucuacauucgcucucaugaugugaaaaacgggggagagcucacccacccuacgcauucacccggucagaguagcccacgaccuguaaucucccaaagaguugugacuaauaagcaggcggcacccggcuuuaucgggccacagcuucccucucacaugauuaaaaacccuccacaucugaauggaacaggcccguugaaggacacccccucgagcuccaugucaaguccuaacgguaauucuagcgucaacagggccuccccagugaaugcuucagccagcguccagaacuggucugugaaucgguccaguguuauacccgaacacccuaagaaacaaaagaucacuauuagcauccacaacaaacuaccagugcgucagugucagucucagcccaaucugcauuccaacucacucgagaacccgacaaagccuguaccaaguagcaccauaaccaauucggcaguccaauccacgucuaacgccagcacaaugucagugaguuccaaaguuacuaagcccauuccucgcucugaaagcugcucccagcccgugaugaaugggaagucaaaacugaacagcaguguccuugugccauacggcgcugagucuuccgaggauagcgacgaagagucgaagggacugggcaaagaaaaugggaucggaaccaucguaucaucucacaguccuggucaggaugccgaggacgaagaggcaacaccccaugaguugcaagaaccaaugacucucaacggcgcuaauuccgcggauagcgacucugacccgaaggagaacgggcuggccccugauggagcaagcugucagggccagcccgccuuacacuccgaaaauccauucgcuaaagccaacggucugcccgggaagcuaaugccugcaccacuccugucacuucccgaggacaagauuuuggaaaccuuuagacugaguaauaaacucaagggcagcacagaugagaugucugcuccuggagccgagaggggcccgccagaagaccgggaugcggagccccagccuggguccccagccgcugaaucacuggaggagcccgacgcagccgcuggacuuaguagcaccaaaaaggccccuccgccccgagauccagguacuccugcaacgaaagaaggcgcgugggaggccauggcuguggcccccgaagaaccaccucccuccgcaggggaagacaucguuggagauacagcuccaccggaccugugcgauccuggcucuuugaccggugacgccucgccccucagccaagaugcaaaggggaugauugccgagggcccacgcgacucagcucuggcggaggcccccgaaggauuauccccugcaccacccgcuagaagugaggaaccuugugagcagccgcugcuaguccacccaucuggcgaccaugccagggaugcccaggaccccagccagucccucggggcuccugaagcagccgagcggcccccagcgccugugcuggauauggcucccgccggacacccagagggcgacgcagaaccuucaccgggugagcgcguggaagaugccgcugcacccaaagccccagggccuucucccgcgaaggagaagauaggaagccuuagaaaagucgacaggggccauuaucguagucggcgagaaagauccagcucuggugagccagcuagggagucacgcuccaagacugaaggccaccggcauagaaggcgccgaaccugcccucgggagcgugauagacaagacaggcacgcccccgaacaccauccggggcacggagaucgcuugaguccaggcgagcggagaagccuggggagguguucgcaucaccauucucgacaccgcuccggaguugagcucgacugggugcggcaccauuacacagaaggcgagagagguugggggagggaaaaauucuauccugaucguccccgcugggaccggugcagauacuaucacgauagguacgcacuguaugccgcucgagacuggaagccauuucauggaggccgggagcacgaacgcgccgguuuacacgagagaccccauaaagaccacaacaggggccggcgagggugugagccugcaagagaacgcgagaggcaucguccgagcucaccccgggcuggagccccacacgcgcuggccccucaucccgauagauucagucacgacaggaccgcacuuguggcuggcgauaauugcaacuugucugaccgcuuucacgaacaugagaaugggaagucccgaaagagacggcacgauagcguagaaaacucagacagucaugucgagaaaaaggccaggcgcagcgagcagaaagauccucucgaggagccaaaggcuaaaaagcacaagaaauccaagaaaaagaaaaagucuaaggacaaacaccgugauagagacagccggcaucagcaggauuccgaccugucagcagccuguucugacgccgaucuacacaggcauaagaaaaagaaaaagaaaaagaagcgccacagucgaaaaucggaagacuucgugaaggauagcgagcugcaucuccccagaguuacuucccuggaaacaguggcucaauuucggagggcgcagggaggcuucccucuuucuggugggccacccuuggagggagucggcccguuucgcgagaaaacgaagcaccugagaauggaaucaagggacgaucggugccguuuauucgaguacggucagggcgacuga

SEQ ID NO: 64633 - RNA, 3357 nt, Artificial Sequence
  derived and/or modified sequence opt3 from USP43__Homo_sapiens__NP_001254505
auggaccugggccccggggaugccgcuggagguggcccucucgcaccaagaccgaggcggcgccgaagccuucguagacuguucuccagguuuuuguuagcccuggggucucggucacgccccggagacaguccuccaagaccccagccuggccacugcgauggugacggggagggaggcuucgcgugugcuccaggccccgugccugccgcaccagggagcccgggagaagagaggcccccugguccacaaccccagcuacagcucccugccggcgauggggcucggccacccggagcacagggccugaagaaccaugguaauaccugcuuuaugaacgccgucguucaaugucuuuccaauacagaccuguuggcugaauuucucgcccuggggcgcuaccgagcggcaccgggacgcgccgaggugacugaacagcuggcugcccucguaagggcauuauggacgcgggaguauaccccucagcugucugcugaguuuaaaaacgccgugucgaaguacggcucacaguuccaaggcaauagccagcacgaugcgcuugaauuuuugcuguggcuacucgaccguguccaugaggaucuggaagggaguucccgcggacccgugucugagaaacuuccaccugaggccacaaagacuagcgaaaacugccugucccccucagcacaguugccacucggucagaguuucguucaaagccacuuucaggcucaguauagaucuucccugaccuguccccauugcuuaaaacaaucaaauacauucgacccuuuucugugugugagccucccaaucccgcuuaggcagacccgguuccugagugucacuuugguguuucccucuaagucccagcgauuccuacgcguaggccuggccguuccuauucucagcacaguggcugcccugagaaagauggucgcagaggaagggggagugccagccgaugaggugauacuugucgaacuguaccccucgggcuuccagaggucuuucuucgacgaggaggauuugaacaccaucgcugaaggugacaauguuuaugcguuucaagugccuccaucccccucacaggggacgcucagugcacacccgcugggcuuaagcgccuccccucggcuggcugcccgcgagggacagagauucucucuaagccuccacucagaaaguaaaguacugauuuuguuuugcaaccuugugggcuccgggcagcaagcaagcagguucggaccacccuuucugauccgugaggaccgggccgucucuugggcucagcuccagcagucaauucugaguaaggugcgacaucuuaugaaaagcgaagccccuguucaaaaucuggguuccuuguucucuaucagaguggucggccucucgguggcauguagcuaccugucccccaaggauucaaggccauuaugccacugggcgguagaccgcguucugcaucuacggagaccugggggacccccacacgugaaacucgcugucgagugggauaguucugugaaggagaggcuguuuggcagccuucaggaagagagagcccaggacgcagauuccgucuggcagcaacagcaggcccaccaacagcauucauguacuuuggacgaaugcuuccaguuuuauaccaaggaggaacagcuggcucaagaugacgccuggaaaugcccgcacugucaggugcuccagcaggguaugguuaagcugagcuuauggacacugccugauauacuuaucauucauuugaaacgauucugccaagugggggagcggcguaacaagcucucuacucugguaaaauuuccccuauccggccugaauauggcaccacacgucgcucagagaaguaccagccccgaggccggacucggcccuuggccaucuuggaagcagcccgacugucugccuacauccuacccgcuugauuucuuguacgaccuguaugcggugugcaaccaucacgggaauuuacaggccuacuguaggaacucacucgacggacaaugguauaguuacgaugacagcaccguugaaccacugcgcgaggaugaagugaacacgcggggugcuuauauccuuuucuaccagaaaagaaauucgauucccccuugguccgcaucuagcucaaugaggggcaguacuuccucuagccuguccgaccacugguugcuccgacuggggucacaugccggaagcacacgcggcagucuacugucuugguccagcgcuccaugccccucgcucccucaggucccggauucacccaucuuuaccaacucucuguguaaucaagagaagggugggcuugagccacggagauuggugaggggcguaaagggacguaguauauccaugaaagccccuacuacaagccgcgcaaagcagggccccuucaaaaccaugccacugcgguggucuuuugggagcaaggaaaaaccucccggagcguccguggaguuaguugaauaucucgagucaagaaggcgaccacggaguacgagccagucuauugucucccugcuuaccggcacagccggugaagacgagaagucagcuaguccgcgcagcaacguggcccugccugcaaauuccgaggaugggggcagagcuaucgaaaggggacccgccggugugccaugccccucugcacagccuaaccacugucuagccccaggcaauucggacgggcccaacacugcucggaagcucaaagagaaugcgggacaagauauuaagcugccucgaaaauucgacuugccgcugaccgucaugccaagcguugaacaugagaagcccgccagaccugaaggccagaaagcaaugaacuggaaggagucauuucagaugggguccaagaguucucccccaagcccuuacaugggauucuccggcaauucaaaagauucucgcagggguacaagcgaguuagaccguccccuccaggggacucugacccuucugcggaguguguuuagaaagaaagaaaacaggcgcaaugagcgagcugaaguguccccacaaguaccuccggucagcuuggugucuggaggccucucacccgccauggauggucaggccccaggcuccccucccgcucugagaaucccagaggggcuagcacggggacugggcaguaggcuugaacgcgacguuuggagcgccccuucgucucuccgucugcccagaaaggcgucccgggcuccgagggggagcgccuugggaaugucacagcgcacagugccaggcgagcaggcaaguuacgguaccuuccaacgagucaaauaucacacucugucuuuagggagaaagaagacgcucccugaguccagcuuuuga

SEQ ID NO: 64634 - RNA, 2139 nt, Artificial Sequence
  derived and/or modified sequence opt3 from USP44__Homo_sapiens__NP_001265322
augcuggccauggacacuugcaagcacgugggccagcuccaacuugcucaggaucauagcucccugaacccccagaaauggcacugugucgacugcaauacaacugagucuaucugggcauguuugucaugcagucauguugccugugggagauacauugaagaacacgcguuaaagcauuuccaggaaagcucccacccuguggcucuggagguaaacgaaauguauguguuuugcuaccuaugugaugacuauguccucaaugauaacacgaccggagaccugaaacuucugaggcggacauugucugccauaaagucgcaaaauuaccacugcacuacccgcucaggucgauuccuccguagcaugggcacaggggaugacaguuauuuucugcaugauggagcacagucccugcuccagucugaggaccaguuauacaccgcccuguggcacagaaggcggauccuuaugggcaaaauuuuccgcacuugguuugagcaaagcccaaucgguagaaagaagcaggaggagccguuccaggaaaagauugugguuaagagggaggugaaaaagcggcgccaggaguuggaauaucaagucaaagcugagcuggaauccaugcccccucgaaagucacuaagacuccaggggcuggcacagaguacaaucauagagaucgugagcguacaaguuccagcccagacccccgcuucuccugccaaggauaaagugcuuuccacgucagaaaacgagauuagccagaaggucagugacucuuccgugaaaaggcggccaaucgugacucccggagucaccggccugcguaauuugggcaacacauguuacaugaauagcguucuccaggugcugucgcauuuacugauuuuucgccaaugcuuccucaaacuugaucugaaccagugguuggcgaugacugcaucugagaaaaccagauccuguaagcacccuccaguaacagacaccguggucuaccagaugaaugaaugccaggagaaagacacgggguuugugugcucaaggcaaaguagccuauccucuggacugagcgguggcgccucaaaggggcggaagauggaacucauccagccgaaagagcccaccagucaguauauaucccugugucacgaacuucauacacuguuccagguuauguggagcggaaagugggcuuuggugucuccuuuugccaugcuccacucagucuggcgacugauuccagcauuccgcggcuacgcucaacaggaugcccaggaguuuuuaugcgagcugcuagacaaaauccagagagaacucgagaccacugguacaagucugcccgcgcuuauuccuaccagccaaaggaaguugaucaaacaggugcugaacguaguuaauaacaucuuccaugggcagcuccugucccaagugacgugucuugccugcgauaauaagucuaacaccauugaaccauucugggaccugucguuggaguuucccgaacgguaucaguguagcggaaaggauauagcaucccagccgugccucgucacagagaugcuggcuaaauucacugagaccgaagccuuagagggcaagaucuacgugugugaccagugcaacucaaaacgcagaagguuuaguucuaagccugucgugcugacagaagcucaaaaacagcuaaugauuugucaccucccccagguucugcgucuucauuugaagcgguuccgauggagcggcagaaauaacagggagaagaucggggugcacguaggauuugaggaaauacugaauauggagccauauugcugucgcgaaacucucaaaucccugcggccugagugcuucauuuacgauuuaucagccgucgugaugcaccaugguaagggcuuugggagcggacacuauaccgcauacugcuacaacucugaaggcgguuucuggguucauuguaaugacuccaaacugaguaugugcacaauggaugagguguguaaggcccaggcuuauauccucuuuuacacccaaagagucacugagaacgggcacagcaaauugcuucccccagaacugcuacugggcucucagcaccccaaugaggacgcggauacguccucaaacgaaauccucaguuga

SEQ ID NO: 64635 - RNA, 1080 nt, Artificial Sequence
  derived and/or modified sequence opt3 from USP46__Homo_sapiens__NP_001127695
augaacugcuuccagggcaccaaugccagcgcucuggagaaggacaucgggcccgaacaauuuccuauuaacgagcacuacuucggacucgugaauuuugguaacacauguuauugcaauuccguccuucaggcacuguacuucuguagaccauuuagggaaaacguuuuggccuauaaagcgcagcagaagaaaaaggagaauuuacugacuugccuagcugaucucuuccauucuauagccacgcagaaaaagaaggugggcguaaucccgcccaaaaaguuuauuucacggcugcgcaaagaaaacgaccuuuucgauaauuacaugcaacaggacgcacacgaguuucugaacuauuugcucaauaccaucgccgauauucugcaggaggaaaagaaacaagagaagcagaacgggaagcugaaaaauggaaacaugaaugaaccugcugagaacaacaagccagagcucacaugggugcaugaaaucuuccagggcacuuuaaccaaugagacacgaugucugaacugcgaaaccgucaguagcaaagacgaggauuuucuugacuuguccguggauguugaacagaauacuucuauaacacacugucugcgugacuucucgaacaccgagacgcuaugcucagagcaaaaguacuauugugaaacuugcuguagcaaacaggaggcacagaagagaaugagggugaaaaagcuccccaugauccuggcccuucaucugaagcgguuuaaauacauggaacaauugcaccgcuacaccaagcucaguuauagagucguguucccucuggaguuaaggcuguucaauacauccucugaugcuguaaaccucgaccggauguacgaucuuguugccguggucgugcacugcgguagcgggccaaaucgcggacauuauauuacuaucgugaaaucccacggcuuuuggcuguuguucgacgacgauauugucgaaaagaucgacgcgcaggcaauagaggaguuuuacggccuaaccucagauauuaguaaaaacagcgaaucuggguauauccuguucuaccagucccgagaguga

SEQ ID NO: 64636 - RNA, 3105 nt, Artificial Sequence
  derived and/or modified sequence opt3 from USP48__Homo_sapiens__XP_011540564
auggcccccagacugcagcucgagaaggcugcauggaggugggccgaaaccgugcggccugaggaagucagccaagagcacaucgaaacagcguaccgcauuuggcuugagccaugcauacgaggcguuugucguagaaacugcaaagggaauccgaacugucuggugggaaucggugagcauauuugguugggcgaaaucgacgaaaauuccuuccacaacauugaugaccccaauugcgaaaggcggaagaaaaacucuuuuguaggguuaacuaaucugggagcuacguguuaugugaacaccuuccuacaggucugguuucucaaucuggagcuucgccaggcccuguacuugugcccuucaacauguagugauuauaugcucggcgacgguauccaggaggaaaaggauuacgagccacaaacuauaugcgaacaucugcaguaucuguucgcacucuuacagaacagcaauagaagguacaucgaccccuccggguuugugaaagcccugggacuugauaccggccagcaacaggacgcucaggaguucucuaaguuguuuaugucgcugcuagaagauacacucucaaagcagaaaaacccugacguucggaauauugugcaacagcaguucuguggcgaguaugcauacgucaccgugugcaaccaaugugggcgcgagagcaagcugcuuaguaaauuuuacgaacuggaguugaauauccagggacacaagcagcucacugauugcauuuccgaguuccugaaagaggaaaaguuagagggugacaaccgauauuuuugcgagaacugucagucuaagcaaaaugccacaagaaaaaucaggcugcucagccuuccaugcacccugaacuugcagcuaaugcgguucguauuugaucgucagacgggccauaagaaaaagcugaauacuuacauaggguucuccgaaauucucgacauggagcccuauguugaacacaaaggaggcucauacguguaugagcugagugcuguccuuauccaccgcggugugagcgccuacucugggcauuauauugcgcacgugaaggacccucaguccggagaaugguacaaauucaacgaugaggacaucgagaagauggaaggcaagaaacugcaauugggcaucgaggaagaucucgagccaucaaagagccagaccagaaaaccgaagugugggaaaggaacacauugcaguaggaaugcauacaugcuggucuaucgguuacagacucaggagaagcccaacaccacaguucaagugccugccuuucugcaggaauugguagaccgagauaauucuaaguucgaggaaugguguauugagauggcugaaaugcgcaaacaguccguggacaaggguaaagccaagcacgaggaggucaaagaacucuaccagagacugccagcaggcgcugagcccuaugaauuugugagccuugagugguugcaaaaguggcuggaugaaucgaccccuacgaagccaauagacaaccacgccugccucuguucucaugauaaacugcaccccgacaagaucuccauuaugaaaaggaucucagaguacgcggccgauauauucuauagucgguacgggggaggcccgcgccuuacuguuaaggcacugugcaaagaguguguggucgaaagaugcaggauuuugcgucucaagaaucagcugaacgaggacuauaagacagugaauaacuuacugaaagcugccguaaaggguagcgacggguuuuggguuggcaaauccucucuacggagcuggcgacagcucgcucuggaacaacuugaugagcaggacggagaugccgaacagucaaauggcaagaugaacgggaguaccuugaauaaagacgaguccaaggaggaaagaaaagaggaagaggagcugaacuucaacgaagauauccucuguccucauggagagcugugcaucagcgaaaaugagaggcgcuuagugucuaaggaagcauggucaaagcugcagcaauacuuucccaaagccccagaguucccuaguuacaaggagugcuguagccagugcaaaauucuugaacgggagggugaagagaacgaagcucuacacaagaugaucgcgaaugagcagaaaacuucccuccccaaccuguuucaggacaagaauagaccaugucuaucuaacuggcccgaggauacagacguccuguauauugugucgcaauucuuugucgaagaguggaggaaguucgugcgcaaaccuacccgaugcagcccaguuuccucagugggcaauagugcacuccuguguccgcaugggggacuuauguuuacguucgccucuaugaccaaggaagauagcaaauugauagcucugaucuggcccuccgaguggcagaugauucagaaguuauucguagucgaccacgugaucaaaaucacacggauugaaguuggcgaugugaacccuucagagacucaguacauaagcgagccaaagcucugccccgaaugucgugagggucugcuuugccaacagcagagagaccugagggaauauacccaagccacaaucuacguccacaaggugguagauaauaaaaaggugaugaaagacucugcaccugaguugaacguuuccaguagcgagacugaagaggacaaggaagaggccaaaccagauggggaaaaggaccccgauuuuaaucagucuaacggcggaaccaagcgccagaaaauuucccaucagaauuauaucgcuuaccaaaagcaggucauucggagaucaaugaggcaccgaaaagugcgcggcgagaaggcccuccuggugagugcaaaccagacacuaaaagagcugaagauccagauaaugcaugcguucagcgucgcuccguuugaccaaaaucucucgaucgaugggaaaauucuguccgacgauugugccacccuuggaacuuuggguguuaucccugaaucugugauucuguuaaaggcagacgagccaaucgccgauuaugcugccauggacgaugugaugcagguaugcaugcccgaagagggcuucaaggggacgggacuccugggccacuga

SEQ ID NO: 64637 - RNA, 2067 nt, Artificial Sequence
  derived and/or modified sequence opt3 from USP49__Homo_sapiens__NP_001273483
auggacagaugcaagcacgugggcaggcugcggcucgcccaggaucauagcauccuuaacccccaaaaaugguguugccuggagugugcuaccacagaauccgucugggcaugcuugaaguguucucacguugccugcgggcgcuacauugaggaccaugcguuaaaacacuucgaagagacuggacauccucuggcuauggaagugcgagaucuauauguauuuuguuaccucugcaaggacuaugugcugaaugauaacccagagggugaccuuaaacuguugcguucaagucuccuggccgucagaggccagaagcaggauacgccggugaggcgggggcgcacccugagaagcauggcauccggagaggacguugugcucccccagagggccccucaaggccagccacagauguuaacagcucugugguaccggcgccagcgacuuuuggcaagaacucugaggcuaugguucgaaaagucuucgcggggucaagccaaacucgagcagcgucgccaggaagaggcucuggagagaaagaaagaagaggccaggcggcgacgcagagaagucaagaggcggcuucuggaggaauuggcgucaacacccccucgcaaaagcgcaagacuccuguuacacaccccaagggaugccgggcccgcugccagucguccugcagcucugccaaccucccggcgagugccggccgcgacucucaaacuuagaaggcagcccgccauggcaccuggaguaacaggccugcgcaauuugggcaacaccuguuauaugaacucuauacuacaaguucugagccaccuccagaaguuucgggagugcuuccugaaucuugacccauccaagacggagcaucuguuucccaaggcuacuaaugggaaaacccaguugucaggaaagccuacaaacaguagcgccacugaacucucucugagaaaugauagggcugaggccugugaacgcgaggguuucugcuggaacggccgagcauccaucucacggagcuuagaacugauucaaaauaaagagccaaguucuaagcacaucucccuaugccgugagcuccauacccuguuuagagugauguggagcgggaaaugggcccuugucucgcccuucgcuauguugcacucuguguggucccugauuccggcguuuaggggauacgaccagcaggaugcacaggaguuccucugugagcugcuucacaaggugcaacaggaacuggagucagaaggcacaacccgccggaucuugauaccuuuuagucagagaaagcucacgaaacagguccugaagguugugaacacuaucuuccauggucaauuacugagccagguaacaugcauuuccuguaauuauaaaucuaacaccaucgagcccuuuugggaccuaagccucgaguucccagaaagguaccacugcauugagaagggguucgugccucugaaucagacugaaugucuuuugacagagaugcuggccaaauuuaccgagacggaagcucucgagggacgaaucuacgccugcgaccaguguaacucaaagcgccggaagaguaaccccaaaccacuggucuuauccgaagcaagaaagcaacugaugauauauaggcuuccccagguguugcgucuccaucugaaacgcuuccgguggagcggcagaaaucacagggagaagauuggcguucauguggucuuugaucaggugcuaaccauggaaccuuacugcugucgagacaugcugucuucacucgauaaagagacauucgccuaugaccugagugcuguaguuaugcaccacgggaagggauuugguagcggccauuacacugccuauugcuacaacaccgaagggggauucugggugcacuguaaugauuccaaacuuaacgucugcucuguggaagaggucugcaagacacaggcauauaucuuguuuuacacucaacggaccgugcagggcaaugcgcgcauuucggaaacacaucugcaggcucaaguucagagcuccaacaaugacgaggguagaccacagaccuucucauga

SEQ ID NO: 64638 - RNA, 942 nt, Artificial Sequence
  derived and/or modified sequence opt3 from USP4__Homo_sapiens__NP_001238806
auggccgagggcgggggaugcagagaaaggcccgacgcugagacccaaaagagcgaacuggguccucucaugcggacaacucuucagcgcggcgcacagugguaccugaucgauucccgaugguucaaacaguggaagaaauaugugggguuugacucuugggauauguacaacgucggagagcacaauuuguucccaggcccgauugacaacucagguuuauuuagugaucccgaaagccagacgcugaaggagcaucuaauagacgagcucgauuauguucuggugccuaccgaagccuggaauaaacuucugaacugguacggguguguagagggacaacagccaaucgugcguaaggucguggaacacggcuuguucguuaagcauugcaaaguggaggucuaucuccuggagcugaagcucugugaaaauuccgaccccacaaacguguuaucuugccacuuuucgaaagcggauacuauugcuaccaucgagaaggaaaugagaaaacuguucaauauuccugccgagagggaaacacggcuuuggaacaaguacaugucaaauaccuaugagcaguugagcaagcuggacaacacuguacaggaugcaggccuauaccaagggcagguucucgugaucgagccacagaaugaagacggaacauggccccgccagacccugcaaaguaaagucuccuuuuuccuuccuagacuggaguguaacggugccauauuggcucauugcaauuuuugucucccaggcucuagcaacuccccggcaucagccaguaggguggcucccagccaccuggccaauuucuuuuucuuugaaauggagucucacuccgugacgaaguuagaaugcgggggagcggucucagcauacagccggguucaggugaugcugcucccucagccacccgaguggcuuggcuga

SEQ ID NO: 64639 - RNA, 2577 nt, Artificial Sequence
  derived and/or modified sequence opt3 from USP5__Homo_sapiens__NP_001092006
auggccgagcugagcgaagaggcucuccuuuccgugcugcccaccaucagagucccuaaggcaggcgacaggguucacaaagaugaaugcgccuucucuuuugacacaccagagucagaagggggauuguacauuuguaugaacacuuucuuagguuuuggcaagcaguauguggagcggcauuucaauaaaacggggcaacgcguauaccugcaccuacgacguaccagaaggccgaaggaggaagaucccgcgacaggaacuggcgacccuccacggaaaaagcccacccgccucgcuauagguguggaagggggauuugaucugagugaagagaaguucgagcuugacgaagaugucaaaaucgugauucugccugacuauuuggagaucgccagagauggccucggcgggcugccagacauuguuagggaucgggugacaagcgcagucgaagcccugcucuccgcugacucugcaucgcgcaagcaggaggugcaggccugggauggagaaguacgacagguuucaaaacaugcuuuuagcuuaaagcaacuggacaaccccgccagaaucccuccaugcgguuggaaauguaguaagugcgacaugagggagaaucuuugguugaaccugaccgauggcuccauacuaugugggcggcguuacuucgacggaucuggcgguaauaaccacgcgguggagcauuaucgcgaaacuggguacccgcucgcagucaagcugggaacaaucacccccgauggcgccgacguguauagcuacgaugaggacgauauggugcuugacccuucccuggcugaacacuugucacacuuuggcauugauaugcucaaaaugcagaagacggacaaaacuaugaccgagcuggaaaucgauaugaaucagagaauuggggagugggaguuaauccaggaaaguggagucccacugaagccccucuucgguccuggcuacacagggauaaggaaccuuggaaauagcugcuaucugaacucuguugugcaaguauuguuuuccauuccagacuuccagcggaaauacguggacaagcuagagaaaaucuuucagaaugcccccacugauccgacccaggacuucucaacacaagucgcaaagcugggccauggucuccugagcggggaauauaguaagccugugcccgagucuggcgauggagaacgaguuccagagcagaaagaggugcaggacggcauugcuccucgcauguucaaggcccuuaucgggaaaggacaccccgaauuuuccaccaacagacaacaggaugcgcaggaguucuuucugcauuugaucaauauggucgaaaggaacugucggagcucggagaauccaaacgagguguuccgcuuucucguagaagagaagauuaaaugccuggccacggaaaagguuaaguacacucagagaguggacuauauaaugcaauuacccgucccuauggaugcagcucugaacaaagaggaacuacucgaguacgaggaaaagaaaaggcaggccgaggaagagaagauggcucugccagaacuugugcgugcccaggucccguucucuuccuguuuggaggcauauggugcccccgaacagguggacgauuuuuggucaacagcucugcaagcgaaaaguguugcagugaagaccacucgguucgccagcuuuccugacuaccucguaauccagauuaagaaauucacauuuggccuggauugggucccaaagaaacuugacguguccaucgagaugcccgaggaacuggauauaucucaguugcgagggaccggacuccagccuggcgaggaggagcugccagacauugcucccccguuaguuacgccugacgagccaaaggguagccugggguucuacggcaaugaagaugaggacucauuuugcaguccccacuucuccagcccuaccucucccaugcuagaugaaucagugaucauccaacucgucgagaugggauucccaauggacgccuguagaaaagcaguguauuacacaggcaacaguggggccgaggcugccaugaauuggguaaugagccacauggaugacccugauuuugcaaacccccugauucuuccaggauccucugguccgggcucgacuagcgcggcugccgacccucccccagaagauugcgugaccacaaucguuuccaugggguucucaagggaccaggcauugaaggcccugcgcgcuacuaauaacagucucgagcgggccgucgauuggauauuuucucauauugacgaucuggacgcagaagcugccauggacaucagcgagggaagauccgcggccgauucaauuagcgaaucugugcccgugggcccuaaggucagggacgguccagggaaauaucaguuauucgcuuuuaucucccacaugggcaccaguacaaugugcggacauuacguuugucacaucaagaaagagggccgcugggugauuuauaaugaucagaaggugugcgcaagcgagaaacccccuaaggaccugggguacauauauuucuaccaacgaguagccucuuga

SEQ ID NO: 64640 - RNA, 4221 nt, Artificial Sequence
  derived and/or modified sequence opt3 from USP6__Homo_sapiens__NP_001291213
auggacaugguggagaacgccgauagccugcaggcucaagaaagaaaggacauccucaugaaauacgauaagggccacagggcagggcuucccgaggacaaaggaccugaaccagucgguauuaauuccucuauagaucgguucggcauccugcaugagaccgaauugccgcccguuacagcccgcgaggcgaagaaaauucgacgugagaugacuagaacgucaaaguggauggaaauguuaggggagugggaaaccuauaagcacaguagcaaacugaucgacaggguguacaagggcauuccuaugaacauccggggcccaguaugguccgugcuacucaauauacaggagaucaaacugaagaaccccggucgcuaucagauuaugaaagagagagggaagaggucuucggaacauauccaccauauugaucuugacguccggacaacucugcgcaaucacguguuuuuccgagauagauacggagcuaagcagagggaguuguuuuauauccuccuggccuacucagaauauaacccugagguuggcuacugccgggaccugagccacauaaccgcacucuucuuacuguaccuuccagaagaggaugccuuuugggcuuuggugcaacugcuagcaagugagcgucauucccuccccggcuuccacucuccuaaugggggaacaguccagggucugcaggaccagcaagaacaugugguaccaaaaagccagccgaagaccauguggcaccaggauaaagagggccuuugugggcagugcgccucccugggauguuugcuccgcaaccugauugacggcaucucauuaggucugacucucagacuuugggacguuuaucugguggaaggggagcaagucuugaugcccauuacaaguaucgcucuaaaggugcagcagaaaaggcugaugaagaccagccggugcggacucugggcccgacugcgcaaucaauuuuucgauacgugggcgaugaacgacgauacugugcuuaaacaccugagagcaucuaccaagaaguugacaaggaaacagggcgaccucccuccacccgccaagcgggaacagggcucccuggcuccucgcccaguccccgccucaagagggggaaaaacuuuauguaaggguuacaggcaggcaccgccuggacccccagcucaauuucagcguccuaucugcagcgccagucccccaugggcgucucgguucuccacccccuguccugggggagccguucgagaggauacauauccagugggcacccaggguguaccgagccuggcacuagcucaagggggcccccagggaucguggagauuucucgaguggaaaucuaugccuaggcugccaacggaccuugauauuggcgggcccugguucccucauuacgacuuugaaugguccugcugggugcgcgccauaucacaggaggaucaguuggcuacuuguuggcaggccgaacacugcggagagguccauaauaaggacaugaguuggccagaagagaugagcuucacagcaaacuccucuaagaucgaucggcaaaaagugcccaccgagaagggugccacuggccugagcaaucucgggaacacauguuucaugaacucaaguauucagugcguuuccaauacccagccgcugacgcaguauuuuaucagcggaagacaccuuuacgaacugaacaggaccaauccuauaggcaugaaaggucauauggcuaagugcuauggggacuuggugcaagagcucuggucuggcacacagaaaucagucgcgccacugaaguuacgccgaacuauugcaaaguacgcccccaaauucgacggauuucagcaacaggauagucaggaacugcuagcuuuccuccuggacggccuucacgaggauuugaaccgggugcacgagaagccuuacguagaacugaaagacagcgaugggcgucccgacugggagguugccgcagaagccugggauaaucaucucagaaggaaccgcuccaucaucguggaccuguuucacggacaguuacggucucaagucaaguguaaaaccugcggucauauuucggugagauucgauccauuuaauuuccugagccuuccuuugcccauggacuccuauauggaucucgagaucacagucauuaagcuggacggcacuaccccagugagguacgggcuacgacugaacauggaugaaaaguauacaggacucaaaaagcagcugcgcgaccuuuguggcuugaacucagagcagauacuguuagcugagguucacgacaguaauaucaaaaauuuuccgcaggauaaccaaaaggugcagcucucuguaagcgguuuccugugcgccuuugaaauuccuguccccuccucaccaaucagcgcaucuucccccacccagaucgacuucaguagcucuccuuccacuaaugggauguuuacgcuuacaaccaacggcgaucugccaaaacccauuuucauaccuaauggaaugccgaacacugugguuccauguggcaccgagaagaauuucacaaacgggauggugaacggacacaugcccucauugccugacaguccauuuaccggcuacaucauugcgguccaucggaaaaugaugagaacugaacucuauuuccugagcccccaggagaauaggccuucgcuauuugguaugccgcugaucgugcccugcacaguacacacgcguaagaaggaucucuacgacgcuguguggauucaaguuuccuggcuggcccgcccacuuccuccccaggaagcaucuauccaugcccaggaucgggacaacuguaugggguaucaauacccauucaccuugagagucgugcagaaagauggaaauagcugcgcuugguguccucaguacagguuuugccgaggcuguaagauagacugcggugaggaucgggccuucaucggcaacgcauauauugcuguggacuggcaccccacugcccugcauuuacgcuaccagacaucacaagagagagucguugauaaacacgaaaguguggagcaguccaggcgggcgcaggccgaaccaaucaaucucgacucuugccugcgagcuuuuaccagcgaggaagaacuuggggaguccgaaauguauuacuguucaaagugcaaaacacacugucuggcaacuaagaagcuagaccucuggagacugccgccuuucuugauuauccaucugaaacgcuuucaguucgugaacgaucaauggauaaagagccagaaaauuguaagguuuuuacgugagaguuucgaccccucugccuuucucgucccacgggaucccgcucugugccagcacaagccucuuaccccacagggagacgaacuguccaaacccagaaucuuggccagggaggugaagaagguugaugcacaaagcucggcgggcaaagaggacaugcuccugucaaagucuccuaguucccuaagcgccaauauuucuagcuccccgaaagggucaccaaguagcucucgcaaguccggaacgucaugucccaguagcaaaaacuccucuccuaauucgagcccccgaacccugggcagaucaaagggucggcuuaggcucccacagaucggguccaagaacaaaccuaguucuagcaagaaaaaucuggaugcuuccaaggaaaacggagccggccagauaugcgaguuggcagacgcucugucacgcggucauaugcguggcgggucucagcccgaauuagugacaccacaagaucacgaggucgcccucgcaaauggauuccuguaugaacaugaggccuguggcaacgggugcggagacggcuacagcaauggucagcuugggaaccacagugaggaagauuccacugacgaccagagagaggauacccacaucaaaccuauuuauaaccuguacgcuaucagcugucauucuggaauuuugucaggcggucacuacaucacauaugcgaagaauccgaacugcaaaugguacuguuauaaugacuccaguugcgaggagcuccaucccgaugaaauagacacugauagcgccuacauucuguucuaugagcaacagggcaucgacuacgcacaguuucuaccaaagaucgaugggaagaaaauggcugacaccucgucuacggaugaggacuccgaaagcgauuaugagaaguacucaaugcugcaguga

SEQ ID NO: 64641 - RNA, 2538 nt, Artificial Sequence
  derived and/or modified sequence opt3 from USP6NL__Homo_sapiens__NP_001073960
augagaaccgaggccguggucaacagccagggccaaacagacuaccugacuaaggauuccgaccaggauguugcucucaaacuugcacaggaaagggccgagaucguggcgaaguaugaccgggggcgcgaaggagcugagauugaacccugggaggaugccgacuaccugguauauaaagugacggaucgauucggguuuuugcacgaggaagaguuaccugaccauaaugucgcaguggaacgucagaagcaccuggagauagagagaaccacaaaauggcuaaagaugcucaagggcugggaaaaauacaagaacacugagaaauuccauaggcggaucuauaaggggauuccacugcaacuucgcggagaaguuugggcccuguugcucgagaucccgaaaaugaaggaagagaccagagaucuguacucuaagcugaaacacagggcucggggcugcucacccgacauucgccagaucgaucucgacgugaaucgaacauuuagagaucauauaauguucagggaccgguauggugucaagcagcagaguuuauuucacgugcuggcagccuacagcaucuacaacaccgagguaggguauugucaaggaaugucccagauuacugcucuuuugcugauguacaugaaugaagaggacgccuucugggcgcuaguuaaacucuuuucuggcccuaagcacgcaaugcauggcuucuuugugcagggguucccaaaacugcuucguuuucaggaacaccaugagaagauccugaacaaauucuugucgaagcucaagcaacaccuggauucacaggaaauuuauacauccuuuuacaccaugaaaugguucuuccagugcuuuuuagaccgcacgcccuucacucugaaucucagaaucugggauauauauauuuuugagggagagaggguccuuaccgccaugaguuacacaauccugaaguugcacaaaaagcaucuaaugaaacuguccauggaagaacucguggaguucuuucaagagacucuggcuaaggacuucuuuuucgaagaugacuuugugauugagcagcuucagaucucuaugaccgagcugaagcgggccaaauuggaucucccugaaccagguaaggaggacgaauaucccaaaaagccucugggccaguuaccaccggagcugcaaagcugggguguccaccaucuauccaacggacagcgaucaguuggccgccccaguccucucgcaagcgguagaagggagucuggggcuccacaccggcgccaugaacacagcccccacccucagucaagaacaggaaccccagagagggcccagcccccgcgucggaaaagcguggaagaggaaaguaagaagcugaaagaugaggcggacuuccaacgaaaacuuccuucuggcccccaggauuccagcagacaguacaaucaugccgcagcuaaccaaaauucgaacgccacgucuaauaucaggaaggaguuuguaccaaaguggaacaaaccuuccgacgugucagcuacugaacgcacagccaaguacaccauggagggcaaggggcgggcagcccaccccgcuuuggcggucacugugccaggacccgcagaaguuagagugaguaaugucaggccuaaaaugaaggcccuggacgcugaggaugguaaacgcggcagcacagccucccaguaugacaacgugccagggccggaacucgauucuggagcaagcguagaggaggcccuggaacgagcuuacucacagaguccccggcaugcccuuuauccuccaagcccccguaagcacgcagagccuuccucuucaccaaguaaaguuagcaacaaguucaccuuuaaagugcagcccccgucccacgcgagauacccuucucagcuggacggcgaagcuagggguuuggcccauccacccucguauagcaauccucccgucuaccacgggaacuccccaaagcauuucccuacggcaaauucaaguuucgccucuccccaauuuagcccaggcacccagcucaacccgucccgccggccucacggaucaacacugagcgugucugcuucccccgagaagaguuauagcagaccaucucccuuaguccugccuuccucaaggauugaagugcuaccaguugauacuggcgccgggggauacagugguaauagcggcucgcccaaaaacgggaagcucauaaucccuccgguggacuaccugccagauaaucgaaccugguccgagguaucuuauacauaccgccccgagacucagggacaaagcuggacccgggacgcaucaagaggcaaccuuccuaaauauagugcuuuccaguuggccccauuucaggaucauggucugcccgcggucuccguggacucuccuguuagguacaaggccagcccggcugcagaagaugccucccccucaggguauccauacagcggcccucccccuccagcuuaucacuaccguaaucgcgacggacucaguauucaggagucugugcuguuauga

SEQ ID NO: 64642 - RNA, 3261 nt, Artificial Sequence
  derived and/or modified sequence opt3 from USP7__Homo_sapiens__NP_001273386
auggccggcaaccacagacuggggcucgaggcuggagacaccgaugaucccccuaggaucacacagaauccagugauuaacgguaaugucgcacuuagcgacggccauaacacugccgaagaggacauggaagaugacacguccuggcggucugaggcgaccuuccaauuuacaguugaacgcuucucacgacugagugagagcguguuguccccgcccugcuuuguacguaauuuaccuuggaagauaauggugaugccaagauucuaccccgauaggccucaccagaaaucugucggguuuuuccugcaguguaacgcugagucggacucaacuagcuggaguugccaugcccaggcagugcuaaagaucauuaauuaucgggaugacgaaaaauccuuuucucgcagaaucagccaccucuucuuucauaaggagaacgauuggggauucuccaauuuuauggccuggucagaaguuaccgacccagagaaaggcuucauugaugacgacaaggugacauuugaggucuucgugcaagcugaugcaccccacgguguagccugggacaguaagaaacacaccggguacguuggacugaagaaccagggcgcuacuuguuauaugaauagccuucugcagacauuguucuuuaccaaccagcucaggaaagccguguacaugaugccuacggaaggcgaugacucuuccaagucagucccacuggcgcugcaacggguguucuaugagcuccagcauagcgauaaaccgguggggacuaagaaguuaaccaaaaguuuuggaugggaaacacuggacucuuucaugcagcacgauguccaggagcuuugccgcguuuugcuggacaauguggaaaacaagaugaaagguacuuguguagagggcaccauccccaagcuauuucgagggaaaaugguguccuacauacaaugcaaggaggucgauuauagaagcgacaggcgggaagauuacuacgacauccagcucucgauuaaaggaaagaagaauaucuucgagucuuuuguggacuauguugcagugggccagcuggauggugacaacaaauacgaugccggggaacauggacuucaagaggcugaaaagggcgucaaauuccugacauugccuccagugcuccaucugcaguuaaugcguuuuauguaugacccccagaccgaucagaacauuaagaucaaugaccgcuucgaguuuccugagcaacugccacucgaugaauuucuucagaaaacggaccccaaggauccggccaacuacauacugcacgcaguauugguucacuccggcgacaaucacgggggacauuauguggucuaccuaaacccuaagggugauggcaaaugguguaaguuugacgaugacguggucucaagaugcacuaaagaggaagcuauugagcacaauuaugggggacaugacgaugaccugagugugaggcacuguacaaacgccuacaugcucguuuacauccgggaaagcaagcuguccgaggugcuucaggcgguaaccgaucacgacauuccccagcaacuggucgagcgauugcaggaagagaaacgcaucgaagcccagaagagaaaggagaggcaggaggcacaucucuauaugcaagugcagaucguugcugaagaucaguucugcggccaccaggguaaugacauguacgaugaggaaaaagugaaguauacugucuucaaagugcugaagaacucuagcuuagccgaguuuguacaaucacugagucagacaaugggguucccacaggaccaaauucggcuauggccuaugcaggcucgcuccaauggcaccaaaagacccgccaugcucgauaacgaagcagacggaaauaagacgaugauagagcugagcgauaacgagaauccauggaccaucuuucuugaaacaguggaccccgaguuggccgcuucuggcgcgacucugccuaaguucgauaaagaccaugacguuaugcucuuucugaagauguacgauccaaaaaccaggucacuuaacuauugugggcacauuuacacaccgaucaguugcaagauacgugaccuguugcccgucaugugcgaucgggcaggauucauucaggacacuagccucauccuguaugaagaggugaaaccuaauuuaaccgaacgaauccaggauuacgacgugucccuggauaaggcccuagacgagcucauggauggugacauuaucgucuuucaaaaagaugacccagagaacgacaacucugaacugcccacagcuaaggaguacuucagagaucuuuaucacaggguugacgugauuuucugugauaagaccauaccuaaugacccaggcuucgugguaacuuugucgaaccgcaugaauuacuuucaggucgccaaaacgguggcacagcggcugaacacagaucccaugcuccugcaguucuuuaagagccaaggguauagagacggaccgggcaauccuuuaaggcauaacuacgaagguacccugcgcgaucuuuugcaguucuucaaaccacgacagcccaagaaacucuauuaccagcaacugaagaugaagaucacugacuuugagaaucggcguuccuucaaaugcauuuggcuaaacucacaguuuagagaagaggagaucacccuguauccugauaagcacggguguguuagggaccuccuggaagagugcaaaaaggccguggaacuuggcgagaaagcuaguggaaaguugcgccuguuagagaucgucucuuacaagauuauaggcgugcaucaggaagaugagcuccuggaaugucuuagccccgccacaucccggaccuucagaaucgaggaaauuccacuggaccaaguugauaucgacaaagagaaugagauguuggugacuguagcacacuuucauaaggaagucuucgggacauuugguauuccuuuccuccugaggauccaccagggagagcacuuucgagaagugaugaaacgcauacagucacuacuggacauccaggagaaggaguucgaaaaauuuaaguucgcgauugugaugaugggccggcaucaauacaucaacgaggaugaauaugaggucaaucucaaggacuucgaaccccagccagggaacaugagccacccgagaccuuggcugggacuugaucauuuuaauaaagcucccaagaggucucguuacacguauuuggagaaagccauuaagauccacaacuga

SEQ ID NO: 64643 - RNA, 3357 nt, Artificial Sequence
  derived and/or modified sequence opt3 from USP8__Homo_sapiens__NP_001122082
augcccgccguggcuagcgucccuaaggagcuguaccucuccucuucacuuaaagaccugaacaagaaaaccgaaguuaagccagagaaaaucaguacaaagagcuaugugcacuccgcauugaagauuuucaaaacugccgaagagugcagauuagauagggacgaggaacgggcguacguacuguauaugaaguacgugacggucuauaaucuaaucaaaaagcgcccggauuuuaaacagcaacaggacuacuuccauucuauacucggccccgggaacauuaagaaggcuguggaggaagccgagcgacugucggaaucacuuaaacugcguuaugaggaggcagaaguuagaaagaaauuggaggaaaaggauaggcaggaggaagcccagcggcuccaacagaaacgccaggagaccggaagagaggacgguggcacacuggcuaaggggagccuggaaaaugugcucgauaguaaagacaagacucagaaguccaacggagagaaaaaugaaaagugugagaccaaagaaaagggcgcaaucacagccaaagaguuauacaccaugaugacugauaagaacauuucucugaucauaauggacgcuaggcggaugcaagauuaccaggacagcugcauccuucacuccuugucagucccugaggaagccauuaguccaggugugacagcgagcuggaucgaggcacaucugcccgaugacucuaaggacaccuggaaaaagcgcgggaauguagaauauguugugcuacucgauugguuuuccucagccaaagaccugcagauuggaacgacucuucgaagccugaaggaugcuuuguucaaaugggagaguaagaccguccucagaaacgaaccucugguguuagagggcggcuacgagaauuggcugcucuguuauccacaguacacaacuaacgccaaggugacucccccuccaaggcggcaaaaugaagaggucucuaucucccuugacuuuacauauccgagccuggaagagucgauacccucuaaaccugcagcucagaccccacccgccuccauugagguugaugaaaacaucgaguugauuucagggcagaaugaacguaugggaccucuaaacaucaguacgccaguggagcccguagcggccagcaaguccgacgugucuccgaucauucaaccuguccccagcaucaaaaaugugccacagauagaucgcacuaagaaaccugcaguuaagcugcccgaggaacacagaauuaagucagagaguacaaaccaugaacagcaguccccacaaagcgguaaagugauccccgacaggucuaccaagccugucguguucucaccaacucucaugcugacagaugaggaaaaagcucggauacacgccgagaccgcacuucugauggaaaagaacaaacaggagaaggaguugcgagaacgccagcaggaggaacaaaaagagaagcucagaaaggaggaacaggagcagaaagccaagaaaaagcaggaagcagaggaaaaugagauuacggagaaacaacagaaggccaaggaagagauggagaaaaaggaaagugaacaggcuaaaaaggaggacaaagagaccagcgcgaagaggggcaaggaaaucacagggguaaaacggcaguccaagucugagcacgaaacuucggaugcuaaaaagagcguugaggaccgcggaaaaagaugcccgacccccgaaauccaaaagaaguccacaggcgacgugccucauacuucagucaccggugauagugggucuggaaaaccauuuaagauuaaaggccagcccgagagcggcauccugaggacagggaccuuccgugaggacacugaugacacggaacggaacaaggcccagcgagagccuuuaacaagagcuagguccgaagagaugggacgcauugugccaggucugcccucaggcugggccaaauuucuagauccgauaaccgggacuuuccgguacuaucacagcccuaccaauacaguccauauguacccacccgaaauggcaccuucuuccgcucccccaaguaccccucccacucacaaggccaaaccacaaaucccggccgagagagacagggagccuagcaagcucaagcgcucuuacuccucacccgauauuacacaggcaauccaggaagaggaaaaacgaaagccaacggugacccccacuguuaaccgggagaauaaaccuacauguuauccaaaggcggagaucagucgucugagcgcuucgcagauuagaaaccuuaaucccguguuuggaggcuccgguccugccuugaccgggcugaggaaccucggcaauacaugcuacaugaacucuauacugcaaugucuuugcaaugcaccgcaccuggccgacuauuucaaccgcaauuguuaccaggaugacaucaaccggagcaauuugcucggacauaaaggcgaaguagcugaggaauuugggauuaucaugaaggcccuguggacuggacaguauagauacauuucaccaaaggauuucaaaaucaccauagguaagaucaacgaccaguucgcaggcuauagucaacaggauucccaggaguuacugcuauuucucauggacgggcugcacgaagaccuuaacaaagcugauaauaggaagcgauacaaagaggagaacaaugaccauuuggaugacuucaaggccgcggaacacgccuggcagaagcauaaacaacugaacgagucuauuaucgucgcucucuuucagggacaguucaagagcacggugcaaugccugaccugucacaaaaagucccgcacauuugaagcauucauguacuuaucacugccccuugccagcaccaguaaaugcaccuugcaggauugccuccggcuguuuucuaaggaggaaaagcuaacagacaauaacagauucuauuguucccacugcagggcucgucgcgauagccugaaaaagauugagaucuggaaacucccuccaguucugcuugugcauuugaagcgguuuucguacgacggcagauggaaacagaagcugcagacuucagucgauuuccccuuagagaaucucgaccugucucaauaugugauagguccuaagaacaaucuuaaaaaguacaaccuguuuaguguauccaaucacuaugggggcuuggauggaggccauuacaccgccuauuguaaaaacgcagcgaggcagcgaugguucaaguuugacgaucacgaagugagcgacauuucuguuagcuccgucaaaucaagugccgcuuacauccucuucuacacgagccuggggccgcgggugacagacguggccaccuga

SEQ ID NO: 64644 - RNA, 7713 nt, Artificial Sequence
  derived and/or modified sequence opt3 from USP9X__Homo_sapiens__NP_001034679
augacagccacaacucggggcucccccgucgggggcaacgacaaucagggucaggcuccugauggccagucccagccaccgcugcagcaaaaccagacgucuucacccgacaguagcaaugagaacuccccugcaaccccacccgaugaacaggggcagggagacgccccuccacaacucgaggaugaagaacccgcguucccucacacagaccuugcuaagcuggaugacaugaucaauaggccacggugggugguuccgguguugcccaaaggcgaauuagagguacugcuagaggccgcaauugaucucucuaagaaaggucuggacgugaagucggaagccugccagcgcuuuuuccgagaugggcuuacuauaucauuuaccaaaauccugacagacgaggcugucagcggauggaaguucgaaauucaucguuguaucauuaacaauacccaccgguugguggagcucugcguugcaaagcugagucaggauugguuuccucugcucgaguuacuggccauggcucuuaacccacauuguaaauuccacaucuacaauggcacuaggcccugcgaauccgugucuagcuccguccaguugccugaggacgaacuguuugcccggucaccagacccccgcaguccgaagggcuggcuaguggaucuccugaacaaauucgggacacuuaauggauuucaaauacugcaugacagauucaucaacgguagcgcguugaauguacagauuaucgcagcccucauuaagccuuuuggccaguguuaugaguuccugaccuuacacacgguuaaaaaguacuuucugcccaucauagaaauggugccacaauuccucgagaaccuuacugaugaggaacugaagaaagaggcuaagaaugaagccaaaaacgacgcauugucuaugauuaucaagucccucaagaaccuggcuucaagggucccugggcaggaggaaaccgugaagaaucucgagauuuuccggcugaaaaugauccuucgccuguugcagaucagcaguuuuaacggaaagaugaaugcccucaacgaggugaauaaggucauuucuuccguuagcuauuacacacaccgacauggcaaccccgaagaggaagaguggcugacugcggaaagaauggccgaguggauacagcaaaauaacaucuuaucgauugugcugagggauucucuacaccagccacaguauguagagaaacucgaaaagauccugcgguucgugauaaaagagaaggcacuuaccuugcaggaccuggauaauauuugggcugcccaagcugguaaacaugaagccaucgucaagaacgugcacgaccuccuggcaaaacuugccugggauuuuucccccgagcagcuggaccacuuguucgauugcuuuaaggcuucauggacaaaugcgaguaagaaacagcgugagaagcuccuggaauuaauccgcagacuggcagaggacgacaaagaugggguuauggcccauaaggugcuaaaccuccuguggaaucuugcucacagcgacgaugucccuguggacauuauggauuuggcccuguccgcacauaucaagauucucgacuacucuuguagccaggauagggacacccagaaaauacaguggaucgaucgguucauugaggaacugcgaacgaacgacaaguggguaaucccagccuuaaaacagauccgcgaaauuugcucacuguuuggagaggcuccgcagaaucuuagucaaacucagagaagcccccacguuuucuauaggcaugauuugauaaaccagcuccaacacaaccacgcccuggugacccuugucgcagagaaucuggcgaccuacauggaaagcaugcggcucuacgcucgcgaccaugaggauuaugacccucagacugugagacugggcucuagguacucacacguccaggaagugcaggagcgucuuaacuuuuugcgguuccuguuaaaggacggccaacucuggcugugugccccacaggcaaaacagaucuggaagugccuugccgaaaaugcuguuuaucugugugaucgagaggccugcuuuaagugguacaguaaauugaugggggacgagcccgaucucgacccugauauuaacaaggacuucuuugaaagcaaugugcugcagcuagauccaucccugcucacagagaacggaaugaaaugcuucgaaagauucuuuaaggcaguaaauuguagggaggguaaacuggucgcuaagcgccgggccuauaugauggacgaucuugaauugaucggccuggacuacuuauggagagugguuauucaaucuaacgaugacaucgcgucgagggccauagaucuccugaaagagaucuauaccaaucuugggccccgccugcaagugaaccaggucgugauucaugaggacuucauccagagcugcuuugaccgacuaaaggcuuccuacgauacgcucuguguacuggacggagauaaggacucagugaauugcgcacggcaagaagccguucguauggucagaguguugaccgugcugagggaguacauuaacgaaugugauagugacuaucacgaggagcgcacaaucuuaccgaugucucgggcuuucagaggcaaacaccucagcuuugucguuagguucccuaaucagggucgacagguggaugaccuggaaguguggucccauacuaacgauaccauagggucaguacgccggugcauucuuaauagaaucaaggccaacgucgcacacacaaaaauugagcuguuugugggcggagaauugaucgacccagcggaugacaggaagcucauaggccaacugaaccuaaaagacaagagccugaucacugccaaacuuacccagauuucuuccaauaugcccaguagcccugauucuuccucagacaguagcacagggucgcccggaaaccaugguaaucacuacuccgauggcccaaacccugagguugaaucuugucuccccggggugaucaugagccugcauccacguuauauuucauucuuguggcaggucgcugaccugggaaguuccuuaaauaugccgccucuccgcgauggcgcccgggugcugaugaaacuuaugcccccagacucuaccacuaucgagaagcugagagcaauaugcuuggaucacgcuaaacucggugagagcucccugucacccagccuagacagucuguuuuucgggccuucugccucccagguucuuuaccucacggaagugguauaugcacuguugaugccagccggcgcucccuuagcggaugacagcucggauuuucaauuccacuuucugaagucaggaggccucccucugguccuuucuaugcugacaaggaacaauuucuugccgaacgccgacauggagacccgaagaggggcauaccuaaaugcucugaaaauugccaagcuccugcuuacugccaucggauauggucaugugcgcgcuguggcagaagccugucagccaggcgucgaggggguuaaccccaugacccagaucaaucaggugacacacgaucaagcgguaguguuacagagugcucugcaguccauuccuaacccaagcucugaaugcaugcucagaaaugucagcgugagguuggcccagcaaaucuccgacgaggcaucacgguacaugcccgacauuuguguuauacgagccauccagaagauuaucugggcuaguggaugcggcagccugcagcucguguucucuccuaacgaggaaauuaccaaaaucuacgagaagacuaaugcagguaacgaaccggaucuggaggacgaacaggucugcugugaggcccuugaggugaugacacugugcuuugcguugauacccacggcucuagaugcccuguccaaagaaaaggcauggcaaaccuucaucauugaccucuuacugcauugucacucaaaaacuguuagacagguggcccaggagcaauuuuuccuuaugugcacacgcuguugcauggggcauaggccacugcucuuuuucaucaccuugcuguuuacaguccucggcaguacugcucgugaacgggccaagcacagcggagauuauuucacccugcuuagacaccuacugaacuacgcauauaauuccaacauuaauguaccuaacgcugagguguuguuaaauaacgagaucgacuggcugaagaggauacgcgaugacguuaaacgaacgggcgaaaccgggauugaggaaacaauccucgagggacaucugggcgugacuaaggaacuucuggccuuucagaccucugagaaaaaguuccacaucgguugugagaaagggggagcgaaucucauuaaggaauugauagaugacuuuaucuuccccgccucgaacgucuaccugcaguauaugagaaauggcgagcuaccagcagaacaggcuauuccugugugcgguucacccccaacaaucaacgccggcuucgagcugcucguagcucuugcagugggguguguccggaaucugaaacaaauuguugauucauuaacugaaauguacuauaucggaaccgccauaacgacaugcgaggccuugaccgagugggaauaccugccgccugugggccccaggccacccaagggguuugugggacucaagaacgcuggcgcgacuuguuacaugaacuccgucauccagcagcuguauaugauuccuaguauccgcaacgguauucuugcaaucgaggggacaggaucugacguggaugacgacaugagcggcgaugaaaaacaggacaaugaguccaacguugauccacgugacgauguauucgguuacccccaacaguuugaagacaagccugcccugucaaaaaccgaggauagaaaggaguauaauauaggcgugcuccggcauuugcaggucauuuucgggcaccuggcugccucuagguuacaguacuaugugccgcgcggauuuuggaaacaauuccgacuauggggcgaaccaguuaaccugagagagcagcacgacgcacucgaauuuuucaacagccuuguggauagucuggacgaggccuugaaggcucuggggcaucccgcgaugcucuccaagguccugggaggcagcuuugccgaucagaaaaucugccaagguugcccucaccgguacgagugugaagagucuuucacuacccuuaauguggacaucaggaaccaucagaaucuccuggacucauuggaacaguauguaaagggggaucuguuagagggagcaaacgcuuaccacugcgaaaaauguaauaagaaagucgacacagugaagcgccuacugauuaagaaacuacccccaguucuugccauccagcugaagagauuugauuacgacugggagagggagugcgcaauaaaauucaacgauuauuuugaguucccucgggaguuggacauggaacccuacacgguggccggcgucgcuaagcuggagggugauaaugugaacccagaaucccaacucauucagcagagugagcagagcgagucggaaaccgccggcucuacuaaauaucgucugguuggggugcuuguccauuccggacaagcgagcggcgggcacuacuauucauacaucauucagcgcaauggaggcgacggugagcgaaacagaugguauaaguucgaugacggggaugugacagaauguaagauggacgaugacgaggaaaugaaaaaucagugcuuuggaggcgaguacaugggcgagguauucgaccacaugaugaagaggaugaguuaccggcgccagaaaagaugguggaacgcauauaucuuauuuuacgaaaggauggauaccauagaccaagaugacgagcugauucgguauaucucugaacucgccaucacaacucgaccucaucagauuaucaugccguccgcuauugagagaagcgugcgcaagcagaauguucaguucaugcacaacaggaugcaauacucaauggaguauuuucaguucaugaaaaaguugcugaccuguaauggggucuaccuaaaucccccaccuggacaggaucaucugcuccccgaagccgaggaaauaacgaugaucaguauucaacuugcugcacgguuucuguucacaaccgguuuucacacuaagaaaguggugcguggcagcgccuccgacugguaugaugcuuugugcauccugcucagacacucuaagaacgucagguucugguuugcccauaauguacuguucaacgugagcaaucgcuuuuccgaguacuuacuugaauguccaucagcagagguuagaggggcguucgccaaacugaucguguucauugcucacuuuucucuccaggacggaccuugccccaguccguucgccucgccaggcccuagcucccaggcauacgauaaccuaucucugucagaccauuugcugcgagcuguccucaaucuucugagaagggaggugagcgaacacggucgccauuugcagcaauauuuuaaccuguucguuauguacgccaaucucgggguggcagagaagacccaguuacugaaacuuuccguccccgccacauuuaugcuggugagucuagaugaaggaccaggacccccuauaaaguaucaguacgcugagcucggcaaacuguauucuguagugagccaguugauccgguguugcaacguuucauccagaaugcaaaguagcauuaaugggaacccgccccugccaaauccuuucggagaccccaaccucucucagccuaucaugccaauucagcagaaugucgcggacauccuuuuugugcguacuuccuacgugaagaagauaaucgaagauugcucaaacagcgaggagaccgucaaacuguuaagguucuguugcugggaaaauccccaauuuucgucuacaguucugagugaguugcucuggcaaguggccuauuccuacacguacgaacugcggccuuaucuagaccuucugcuccagauucuguugaucgaggauagcuggcaaacccaccgcauucacaacgcacugaaggguaucccagacgaucgagacggccucuucgauacuauacagagaagcaaaaaccauuaccagaagagggcuuaucaguguauuaaaugcaugguagcccuauuuuccaauugucccguggccuaccaaauccugcaggggaacggagacuuaaagcggaaguggacaugggcagucgaauggcugggcgaugaguuggagcgcagaccguauaccgguaauccucaguacacuuauaacaauuggucuccacccgugcagagcaacgaaacaaguaauggguacuuccucgagaggucccacagcgcucgaaugacccuggccaaagcgugcgaacuauguccugaggagguuaagaaagcuacgucugugcaacagauugaaauggaggaaucaaaggagccagacgaucaggacgcccccgaugaacaugagaguccgccucccgaggacgcaccacuuuacccucacucccccggaagccaguaucaacagaacaaucacguccauggccagccauacacuggccccgccgcucaccauaugaacaauccucaacggaccgggcagcgugcacaggaaaacuaugagggaucugaagagguaucgccaccgcagacaaaagaccaauga

SEQ ID NO: 64645 - RNA, 7668 nt, Artificial Sequence
  derived and/or modified sequence opt3 from USP9Y__Homo_sapiens__XP_011529771
augacagccaucacacacggcagccccguagggggaaaugauucccagggucaaguccuggauggccagucucagcaucucuuccagcaaaaucagacuucaaguccugacagcuccaacgaaaauucuguugcuacgccaccgcccgaggaacaggggcagggagaugcuccuccacaacacgaagacgaggaacccgccuuuccucacacagagcuugcgaaccuggaugacaugauuaauaggccaagguggguggugcccguguugccuaagggcgaguuagaaguccugcuggaggcugccauagaucucucggugaaaggucuggacguuaagucagaagcaugccagcgguucuuucgcgaugggcuuacaaucagcuucacuaaaauucugauggacgaggccgugaguggauggaaguuugagauccaccgauguauuaucaacaauacccaucguuuggucgaacucugcguggcuaaacugucccaggauugguucccacugcucgaguuacuggcaauggcccuuaacccgcacuguaaguuucacauauacaauggcacaagacccugcgaauugaucucuagcaacgcucagcugccugaggacgaauuguucgccagguccucagauccacggagucccaagggcuggcucguggaccugauuaauaaauuugggacccuuaacggauuccaaauccugcaugaccgcuuuuucaaugguagcgcguugaacauucagaucauagcagcccucauuaagccuuuuggccaguguuaugaguuccugucucaacacacucuaaagaaguacuucaucccaguuauugagaucgugccccaucugcucgaaaaucuuacagaugaggaacugaaaaaggaggcuaagaacgaagccaaaaacgacgcauuguccaugaucauuaagucacugaaaaauuuagcuagcagaauaagugggcaggaugagaccaucaagaaccucgagauuuuuaggcugaaaaugauccuucggcuguugcagauaucuuccuucaauggaaagaugaacgcccucaaugaaauuaacaaagucaucagcucggugucuuauuacacgcaccgccacuccaauccggaggaagaggaauggcugacugcggagcgaauggccgaguggauccagcaaaacaauauuuuaucaaucgugcugcaggacagucuacaucagccucaguaugucgaaaagcucgagaagauucugagauuuguuauaaaagaaaaggcacuuaccuugcaagaucuggacaacaucugggcugcccaggcuggcaaacacgaggccauugugaagaauguacaugaucuccuggcaaaacuugccugggacuucagccccggucagcuggaucacuuguuugacugcuucaaggcuuccuggacaaacgcgucuaagaaacagagggagaagcuccuggaauuaauccggcgucuggcagaggaugacaaagacggggugauggcccauaagguccuaaaucuccuguggaaccuugcucaaagcgaugacgugccaguugauaucauggacuuggcccugucagcacacauuaaaauacucgauuacaguuguucccaggaccgcgaugcccagaagauccaguggauugaccacuuuaucgaggagcugagaacuaaugauaagugggugauuccugcuuuaaaacaaaucagggaaauaugcagccuguucggagaggccucucagaaccuuucacagacccaacggaguccccauaucuuuuaucgacacgacuugauuaaccagcuccagcagaaucaugcacuggucacccugguggcggagaaccuggcuaccuacaugaauagcauccgccucuacgccggcgaucacgaagacuaugauccacaaacgguaagacugggcuccagguacucucacguucaggaggugcaggaacggcuuaacuucuugcgcuuucuguuaaaggacgggcagcucuggcugugugcaccccaagccaaacagauuuggaagugccuugcugagaaugccgucuaucugugugacagagaagcaugcuucaaaugguacucgaaguugaugggagaugagccugaccucgauccagacaucaacaaggacuuuuucgagagcaaugugcugcagcuagacccgucccugcucacugaaaacgguaugaaaugcuucgagagguuuuucaaggcugucaauugucgugaacggaaacugauagccaagcgaagaucauauaugauggaugaccuugaguugauuggccuggauuacuuauggagggugguuauccagaguucugacgaaauugcgaaccgcgccaucgaucuccugaaagagauauauacaaaucuugggccccggcugaaggcuaaccaagugguaauccaugaggacuuuauucagagcugcuucgauagacuaaaagcauccuacgacacccucugugucuuugacggagauaaaaauucaaucaacugcgccaggcaggaagcuauucgcauggugcgaguucugacugugaucaaggaguacauaaaugaaugugacagcgauuaucacaaagagcggaugauuuugccuaugucucgugccuucagaggcaagcaucuguccuuaaucgucagguuuccaaaccaaggucgccagguggacgagcucgauaucuggagucacacaaacgacaccauugggagcguacggagaugcaucgugaauaggauuaaagcaaacguugcgcauaagaaaauagaacuguucgucggcggagagcuuaucgauucugaagacgaucgaaagcugauuggccaguugaaucucaaggacaaaucccugaucacggccaagcuaacccagauuaacuuuaauaugcccucaaguccugauagcucguccgacucuagcacagcuucaccagggaaccaccgcaaucacuacaacgacggacccaaucuggagguggaaaguugucuuccgggugugaucauguccguccauccucgguauauaucuuuccucuggcaaguugccgaucugggcagcaacuugaauaugccaccccugagagacggggcaaggguguuaaugaaacucaugccucccgaucguacugcuguggagaagcugcgcgccguaugccuugaccacgcaaaacugggagagggcaaguuguccccaccucucgauucacuguuuuucggucccagcgccagucagguccuauaccugaccgaagugguuuaugcacuucucaugccagcgggggugccgcugacagacggaucuuccgauuuucagguccauuuccuaaagagcggaggcuuaccucuggugcucucgaugcugauccggaacaauuuccuucccaacacugacauggagaccagaagaggggccuaccugaaugcauugaaaauugcuaagcuacugcucacagccaucggauauggucacguucgagccguggcugaagcaugucagccaguagucgauggcaccgaccccauuacucaaaucaaccaggugacgcaugaucaggccgugguccugcagucagcgcuucaaucuauaccuaacccaaguuccgagugcguuuuacggaaugaaagcauucugcucgcucaggagaucucuaacgaggccagccgcuacaugcccgacaucugugugauuagagcaauacagaaaaucauuugggccuccgcuugcggggcauugggacugguauuuucaccuaaugaagagaucacaaagauuuaccagaugaccacuaacggcaguaauaaacucgaaguggaggaugaacaagucugcugugaggcccuggaggugaugacccuuugcuucgcgcuguugccgacagcucuagacgcccugagcaaggaaaaggcauggcagaccuuuaucauagaccucuuacugcacuguccaucuaaaacuguuaggcagcuugcccaagagcaguucuuucugaugugcacacgguguugcaugggucaccgaccccucuuguucuuuaucacgcuacucuucaccauucugggguccacugcuagagaaaagggcaaauauucaggagauuacuuuacacuucuacgccaucuguugaacuaugccuacaauggcaacaucaauauuccuaacgcagagguguuacuggucagugagaucgacuggcucaagaggauacgugauaaugugaaaaacaccggggaaacaggaguugaggaaccaauucuggagggccaccuuggugugacuaaggaacugcucgcuuuccagaccagcgagaaaaaguaucauuuugggugugagaagggaggcgccaauuugaucaaagaacugaucgacgauuucauuuuccccgcguccaaggucuaccuacaguaucugcggucuggugagcucccugccgaacaagcaaucccgguaugcucgagccccgugacgauaaacgcuggcuuugagcuucugguugccuuagcuauugggugugugagaaauuugaaacagaucgucgacugccugaccgaaauguacuacaugggaacagcaauuacuaccugugaggcccucacagagugggaauaucugccaccugugggccccaggccaccuaagggguucguaggacuuaaaaacgccggcgcuacuugcuacaugaacucagugauccagcagcuguauaugauacccuccauucgcaacaguauccucgcgaucgaggguaccgggucugauuugcacgacgauauguuuggagacgaaaagcaagauagcgaguccaacgucgacccacgagaugacguuuucggcuacccgcaccaguuugaagacaagccugcacugucaaaaacggaggauagaaaggaguauaauauugguguguuacggcaucuacaggugaucuucggccaccuggccgcuucucagcuccaauacuauguccccaggggguuuuggaaacaguuccgccuuuggggagaaccagugaaccugcgugagcagcaugacgccuuggaauuuuucaauagccugguugauagucucgacgaggcacugaaggcccuuggccaccccgcuauucucuccaaaguacuagggggcagcuuugcggaucaaaagauaugccagggcuguccucauagauacgagugcgaagagucuuucacaaccuugaacguggacauccggaaucaccagaaccuguuagauucacuagaacaguacauuaagggugaccugcucgagggggccaaugcauaucacugugaaaaaugcgauaagaaagucgacacugugaagaggcuucugaucaaaaaguugccacgcguucuggcuauccaacucaagcgauuugauuacgacugggagagagagugugccauuaaauucaacgacuauuucgaauuuccccgggagcuggauaugggaccuuacacaguggcaggcgucgccaaucuugaaagggacaacguaaauuccgagaacgaauuaauagagcagaaggagcagagugauaaugaaaccgcugguggcacuaaauaucgccugguggggguccucgugcauagcggacaggccucgggcgggcacuacuauucuuacaucauucaaagaaacggaaaggacgaucagaccgaccauugguacaaauucgaugacggcgauguuacagagugcaagauggacgaugacgaagagaugaagaaucaguguuuugguggggaauauaugggagagguguucgaucacaugaugaaaaggauguccuaccggcgucagaagcgcugguggaacgcguauaucuuguuuuacgagcaaauggacaugauugacgaagaugacgagaugauccgauauauaagcgaacugacgaucgcaagaccgcaccagauuaucaugucaccagccauugagaggaguguccggaaacagaacgugaaguucaugcauaaucgccuacaguacucucuggaguauuuucaauucguuaaaaagcuccuuaccugcaacggcguguaccugaaucccgcuccuggccaggauuacuugcugcccgaagccgaggaaaucacuaugauauccauucagcucgcugcaagauuucuguucacaaccggguuucacaccaaaaagaucgucaggggaccagccagcgacugguaugaugcuuuaugugugcuucugcggcauucaaagaacguacgauucugguuuacucacaauguacucuucaacguuaguaauagauucagcgaguaccuacuggaaugcccuuccgccgagguccgcggugcauuugcgaaauugauuguguucaucgcccauuuuucucugcaagacggcagcugucccuccccauucgcuucaccugggccgucuagucaggccugcgauaaccucucgcuuagcgaccaccuguugagggcaacccugaaucucuuacggcgugagguguccgaacacggacaucaucugcagcaguauuuuaaccuuuucgucauguacgcuaaucugggcguagccgagaagacgcaacuacucaaacugaacgugcccgcaacauuuauguugguuucucuggaugaagguccagggccucccauaaaguaucaguacgccgagcucggaaaacuuuauucaguggucagccagcugaucagaugcuguaauguguccaguaccaugcagucuagcauuaacggcaauccaccuuuacccaacccguucggcgaccugaacuugucacaaccaaucaugccuauucagcagaauguucucgauauccuguuugugaggacuuccuacgucaagaagauaauugaagacugcaguaacagcgaggacaccaucaaacuacuucgcuucuguucuugggagaauccccaguuuuccucaacagugcugagcgaacuccuguggcaaguagcuuacucguauacuuacgaguugcggccauaucuggaucuccuuuuccagauccuguuaauugaagacucuuggcagacccaucgaauccacaacgcgcugaaggggauacccgaugacagagauggauuguuugacacaauucaaaggaguaaaaaucacuaccagaagcgcgccuaucagugcaucaaauguaugguggcacucuucuccagcugcccuguugcuuaccagauucugcaagguaacggcgaucuaaagcggaaguggacgugggccgucgaguggcuuggggacgaacuggagagacguccguauaccggaaauccccaguacucauacaacaauugguccccaccugugcagucuaacgagacugccaauggcuauuuccucgaaaggagccauagugcacggaugacacuggcuaaagccugugaguugugccccgaagaggagccugaugaccaggaugcgccagacgaacacgagcccuccccuagcgaagaugcuccauuauacccccauucuccggccucacaauaucagcagaacaaucacgugcauggucagccuuacaccgggccagcagcccaccaccugaacaauccccaaaagacuggacagcgcacacaggagaacuaugaaggcaacgaggaggucaguuccccucaaaugaaagaccaguga

SEQ ID NO: 64646 - RNA, 3279 nt, Artificial Sequence
  derived and/or modified sequence opt3 from USPL1__Homo_sapiens__NP_005791
augauggacagccccaagaucggcaacgggcugccugugauuggaccagguaccgauauaggcaucuccucucuccacauggucggguaccuuggcaaaaauuucgacucagccaagguuccgagugaugaguauugccccgcuuguagagaaaaaggaaagcugaaagcauugaagacauacaggauuagcuuucaggaguccaucuucuuaugcgaagaccugcaauguauuuauccucuagguucuaagucgcucaacaaucugaucucaccagaucuugaggaaugccauacuccccacaaaccucagaagcggaaaagccuggagaguuccuacaaggacucuuugcuccuggccaacagcaaaaagacgcgcaauuauauagcgaucgaugggggaaaggugcugaacuccaaacauaauggcgagguauacgacgaaaccucaaguaaccucccagauagcucuggccagcagaaucccauucgaacagcugacuccuuagagcguaacgaaauccuggaggccgauacuguggacauggcaaccacaaaggauccugccaccgucgacgugucagggacuggaagaccaagcccgcaaaaugaggguuguacaaguaaacuugaaaugcccuuggagucuaagugcaccuccuuuccucaggcucuguguguucaguggaaaaacgcauaugcccuaugcuggcucgacuguauucugagcgcucuugugcacucggaggaacugaagaauacggucacuggcuugugcucuaaagaagaguccaucuucuggaggcuccugaccaaguacaaccaggccaauacauuacuguacacuucacaacucaguggggugaaggauggagacuguaaaaagcugaccagcgagauauuugcggaaauugagacaugccuuaacgaaguacgggaugagaucuucauuuccuugcagccacagcuacgcugcacccugggcgacauggaaucucccguuuuugcauucccucuccugcuuaaacuggagacgcauaucgagaaguuguuucucuauagcuucucaugggauuuugaauguagucagugcggucaccaauaccagaacagacacaugaaaucccuggugacuuucacaaaugucaucccagaguggcaucccuuaaacgccgcucacuuugggccguguaauaacugcaauagcaagucucagauuaggaagauggugcuggaaaaagugucaccuauauucaugcuacauuucgucgagggacucccccaaaacgaccugcagcacuaugccuuucacuucgaaggcugucuuuaccagaucaccaguguuauucaguaucgggcaaauaaccauuuuaucacuuggauauuggaugcugacggcagcuggcuggagugcgaugaccucaaggggccauguuccgagcgccacaaaaaguucgaagugccugccucugagauucauaucguaaucugggaacgaaaaauuucgcaagugacagauaaggaggcggccugccugccccuuaagaaaaccaaugaccagcacgcacugagcaacgagaagccagucuccuugacgucauguagugugggagacgcugccucugcugaaaccgccagcguuacacaucccaaagauaucuccguggcaccuagaacucucucacaggacaccgccgucacacacggugaucaccuguuaagcggcccaaaggggcugguggacaauauucuaccgcucacucuggaggaaaccauacagaaaacagcuucuguaucccaacuuaacagugaggcguuuuugcuggaaaauaagcccguugcagagaacaccggaauccucaagacuaauacgcuguuaagccaggagucucugauggccuccucagugagugcuccuugcaacgaaaaacuuauucaggaucaguucgucgacaucagcuuuccaucgcaaguggucaacacaaauaugcaguccgugcaguugaacaccgaggauacuguuaauaccaagucugugaacaauacagacgccaccggccucauccaggguguaaaaagcgucgaaauugagaaggaugcacaacugaaacaguuccuaacucccaagacagaacagcugaaaccugagagggugacgucacaaguuaguaaccucaagaagaaagagaccacugccgacucccagacaaccacaucuaagagccugcagaaucagucccuuaaagaaaaccaaaagaaaccauuuguggggucaugggucaagggcuugauaagccggggagcuaguuucaugccccugugugugucugcccauaaucguaacacuaucaccgauuuacagccguccguaaagggcgugaauaacuuugggggauucaaaacgaaggguauuaaucagaaagcaagccacguuucgaagaaagcgcgcaagucagcuucuaagccuccacccaucaguaaaccucccgccggcccaccuuccagcaacgggaccgcagcccauccccacgcucacgccgcaucugagguccucgaaaagagcggauccacaucaugcggcgcucagcugaaucauaguagcuacgguaacgggauuucuuccgccaaccacgaggaccuuguggaaggccaaauccauaaacugagauugaagcucaggaaaaagcugaaggcggagaaaaagaaacuagccgcucugaugucaaguccacagagccggacugugcgauccgagaaucucgaacaggucccgcaggauggaucuccuaacgacugcgagucgauagaagaccugcuuaaugaguugcccuauccaaucgauauugcaagcgagucagccuguaccacaguucccggcgugucccuguacaguucucaaacucacgaagagaucuuagcugaacuccugagcccuaccccaguguccacggagcuuucagaaaacggggagggagacuuucgcuaccuggguaugggcgauucucauauucccccuccgguaccaagcgaguucaaugacgucagucagaacacacaccuaagacaggaucacaauuauugcucccccaccaagaaaaacccuugugaagugcaaccagacagccucacuaauaacgccugcguuaggacacugaauuuggagucucccaugaagaccgauaucuucgacgaauuuuucucauccagugcacugaacgcguuagccaaugauacucucgaccugccucauuuugaugaguaccuuuucgaaaacuauuga

SEQ ID NO: 64647 - RNA, 1221 nt, Artificial Sequence
  derived and/or modified sequence opt3 from UST__Homo_sapiens__NP_005706
augaagaaaaagcagcaacaccccggcgggggagccgacccuuggccacauggugcuccgaugggcggggcacccccuggacugggcagcuggaaaagaagggugccacuccuucccuuccugcgguuuuccuugcgcgauuacgguuucugcauggccaccuuacuggucuuuugucuagggucucuccuguaucagcuuucaggaggcccuccacgauuccuguuggaccuccgucaguaccugggcaacaguacauaucuggaugaccacgggcccccuccaagcaagguucucccguuucccucccaggugguauacaauagagugggaaaaugcgguucuaggacugucguguuacugcuucggaucuugucggagaagcauggcuucaaccugguuacgucagauauucacaauaagacccgccuaaccaaaaacgaacaaauggagcucauaaagaauaucagcacugcggaacagccuuaucuguuuaccagacaugugcacuuccuuaacuuuaguagguucgggggagaccagccagucuacauuaauaucauucgggaucccgugaaccgcuuucuguccaauuauuucuuucgaagauucggcgacuggaggggugagcagaaccacaugauccggacaccuucuaugcgucaagaagaacgcuacuuggauauaaaugaguguauccucgaaaacuacccagagugcagcaaucccagacuguucuauauuaucccguacuuuugugggcagcauccuaggugccgggaacccggagagugggcuuuagagcgagccaaacugaacguaaaugaaaacuuccuccuuguuggcauucuggaggaauuggaggacgugcuacugcuccuggaacgcuuucuuccacacuauuucaagggcguccuguccaucuacaaagauccugagcauagaaaguuggggaacaugaccgugacugugaagaaaacaguccccucaccagaggcaguucagauacucuaucagaggaugcgguacgaauaugaguuuuaccacuacgugaaggaacaauuccaccuguuaaaacgcaaguuuggacugaaaagucauguaagcaagcccccucuaagaccacacuucuuuauuccgacaccccucgagacggaggagccuaucgacgaugaggaacaggacgacgagaaauggcuggaagauauuuauaagagguga

SEQ ID NO: 64648 - RNA, 1026 nt, Artificial Sequence
  derived and/or modified sequence opt3 from UTF1__Homo_sapiens__NP_003568
augcugcucagacccaggcggccuccaccgcuugcucccccugccccacccagcccugcauccccagaccccgagccucgcaccccaggcgaugccccggggacacccccucgacguccagcgucucccucagcucugggagaauuggguuuaccugugaguccaggcagcgcccagagaacucccugguccgcaagggagacggaacugcuacucgggacccugcuucaaccggccgucuggcgggcucuguugcucgaccgcagacaggcacugccuacauacaggcggguuucugccgcucuggcccagcagcaagugcgccgaacucccgcgcagugcagaaggcgguauaaguuccucaaagauaaguuucgugaggcacacggacagccaccuggccccuucgacgaacagauccgcaaauuaaugggucugcuuggggauaacggaagaaagaggccacggcgacgcucgcccggcucaggcagaccucaaagggcccggcgcccaguaccgaaugcucaugcccccgcaccuagcgagccagacgcuacccccuugccuacagccagagauagggacgcggauccaaccuggacucugcguuuuagucccuccccgccuaaaucugccgacgcaagcccagcucccggguccccucccgccccagcuccuacagcccuagcaaccuguauucccgaggaucgggccccagugcgaggaccggguucaccucccccacccccugcuagagaagacccagauagucccccuggcaggccggaggacugcgcgccacccccugcagccccacccagccucaacacggcucugcuucagacucuggggcacuugggagacauagccaauauccucggcccucugcgcgaucaguuacugacccucaaccagcaugucgaacaacuucggggugcauucgaccagacagugucucuggccguuggguuuauuuugggauccgcugccgcagagagaggcgugcuaagggauccgugucaguga

SEQ ID NO: 64649 - RNA, 2160 nt, Artificial Sequence
  derived and/or modified sequence opt3 from UTP14A__Homo_sapiens__NP_001159693
augaccgccaacagacuggcugagagccuccuugcacugucccagcaagaagaguuggccgacuuacccaaggauuaccugcuaucugaaucagaggacgaaggcgauaaugacggggagaggaaacaccagaagcuccuggaggcgaucaguagccuugauggaaagaaccggcgcaagcuggcugaacgauccgaggccucuuugaaagugucggaguucaaugucucaagcgaggguaguggcgagaagcucguucuggcagaccugcucgaaccugugaagacauccucuagcuuagccacugugaaaaagcagcugucccguguaaaaucaaagaaaacggucgagcuuccauugaacaaggaagagauugaaagagcuaggaccccgcuggagcaggagauauuuaaucuacuccauaagaacaaacaacccgugacagauccucugcuuacuccaguugaaaaggcaagucugcgggccaugagcuuggaggaagcuaaaaugcgcagagccgagcuccagagggcgcgggcacugcagucuuauuacgaagccaaggcucgccgagagaaaaagaucaaauccaagaaguaucacaaaguggucaagaaagggaaggccaaaaaggcauuaaaggaguucgaacagcugagaaaagugaaucccgcugccgcgcucgaggaacuugagaagauugaaaaagccaggaugauggagcggaugucacugaagcaucaaaacagcggaaaaugggcaaagaguaaggcuaucauggccaaauacgacuuggaggcucgucaggccaugcaggaacagcuaucuaagaauaaagagcugacccaaaagcuccagguagcauccgaaagcgaggaggaagagggcgguacagaagauguugaggaacugcuugugccugacgucgugaacgaggugcagaugaaugccgaugggccaaaccccuggaugcugcgcucgugcaccucugacacuaaagaggcugcgacacaagaagauccugagcaguugccagaacucgaggcacacggagucuccgaaucagagggcgaggaaagaccgguugccgaggaagagauucuguuaagggaauuugaggagcggcgaagucugcgcaagagaagcgaacuaucccaggacgcugagcccgccggcucucaggaaaccaaggacagcgggucacaagaggugcucagugagcugaggguacuuucccagaaauugaaggaaaaucaucagagccggaaacagaaggcaucuucagagggaacgaucccucaagugcagcgcgaagaaccagcccccgaagaggaggaaccucugcuccugcagagaccagagaggguccagacucuugaggaacuggaagaguuggguaaagaggaauguuuccaaaacaaggagcucccccguccggugcuggaaggccagcagagugagcggaccccuaauaaccgacccgaugcuccaaaagaaaagaagaaaaaggagcagaugauagacuuacaaaaccugcuaacaacucagagcccuuccguuaaaucucucgccgugcccaccaucgaggaacuggaggaugaagaggagagaaaucacaggcagaugauuaaggaagcauuugcgggggacgaugucauccgcgacuuccuuaaagagaagcgggaagcuguggaggccucgaagccaaaagauguagacuugacacugcccggauggggcgaauggggugggguuggacucaagccuagcgccaaaaagagaaggcgcuuucugauuaaagcaccagagggcccgccccgaaaggauaagaacuuaccuaaugugaucauaaacgagaaacggaauauucacgcugccgcacaucaaguccgugugcugccauaucccuucacccaccauuggcaguuugaaagaacgauccagacuccuauuggcuccacauggaacacccagagggcuuuccaaaaacuuacuacaccaaaagucgugaccaagcccgggcacaucaucaauccgauuaaagccgaggacguuggauaccgcucaaguucucggagcgauuuguccgugauacagagaaacccuaagaggaucacgacccgacacaagaaacagcucaagaaaugcucaguagacuga

SEQ ID NO: 64650 - RNA, 2301 nt, Artificial Sequence
  derived and/or modified sequence opt3 from UTP14C__Homo_sapiens__NP_067677
augaacgugaaucaggucgccgagaaccuggcucucagccaccaagaagaacuuguugaccugcccaagaauuacccuuuguccgaaaacgaggaugaaggcgacucugauggggagagaaaacaucagaaguuacuggaggcaaucauuucacuagacggaaagaauaggcggaagcucgccgaacgcagugaggcgagccugaaaguguccgaguucucuguaucgucagaggguagcggcgagaaacuugggcuggcugauuugcucgaaccagugaagaccaguuccucucuggccacagucaaaaagcagcugaaccgagugaaaagcaagaaaguuguggagcucccguuaaauaaggaaaagauagagcagauccaccgugaagucgcauuuuccaaaacuucacaagugcugaguaagugggaccccauuauccuuaaaaaccagcaggccgagcaguugguauucccucugggaaaggagcaaccagcuauugcacccaucgaacaugcccuaagcggcuggaaagcuagaacgccucucgagcaggaaauauuuaaucugcuucacaagaacaaacagccaguuaccgauccccuguugacaccuauggagaaggccucucuccaggcgaugucccuggaagaggcaaagaugcauagggccgaguuacaacgggcucgcgcccugcagucauauuacgaagcaaaagcuagaaaggagaaaaagaucaaaagcaagaaguaucacaaaguggucaagaaagguaaggccaaaaaggcgcucaaggaguucgagcagcuucaaaaagugaauccaacuguggcccuggaagagauggagaagauugaaaacgcaaggaugauggagcggaugaguuugaaacaccaaaauucugggaagugggcuaaauccaaggccaucauggcuaaguacgaccuagaagcccgccaggcaaugcaggagcagcuggccaaaaacaaggagcucacccagaaacugcaggucgcuagcgaaucggaggaagaggaaggaggcacagagguugaggaacuucuggugccgcauguagcgaaugaggugcagaugaacgucgauggccccaacccuuggauguuucgaucuugcaccuccgacacuaaggaagcagccacacaagaggauccagaacaggugcccgaguuggcugcccacgagguuucagcaagugaagccgaggaaagaccuguggcugaggaagagauucuccugagggaguucgaagaacggcagagcuuacguaaacgcuccgaacugaaucaggacgccgagccagcaucuagccaagagaccaaggauucaaguucccaggaaguccuaagcgagcucagagcgcugucucagaaacuuaaggaaaagcaucagucaaggaaacaaaaggcuaguagcgaggggacggugccccagguacagcgggaggaaccggccccugaggaagcagagcccuugcugcuccaacgauccgaacgcguucagacucuggaggaacuugaggagcugggaaaagaagacuguuuucagaacaaggaguugccaagaccugugcucgaaggucagcaaucugagaggacccccaauaaccggccagacgcccccaaagaaaagaaggagaaagagcagcugaucaauuuacagaacuuccugacaacucagucgccuagcguccgcucccuagcugugccaaccauaauugaggaacucgaagaugaggaggaaagagaccaaaggcagaugaucaaggaggccuuugcaggcgaugacgucauucgugauuuccugaaagaaaagcgggaggcuguggaagccucaaaaccgaaggacguugaucuuacauugcccggguggggagaguggggcgguguggggcugaagccuagugcgaaaaagcgaagacaguuucucaucaaagccccagagggacccccuaggaaggacaaaaaucugccaaacguaaucauuucugaaaagcgcaauauacacgcugcagcccaccagguccaaguguuacccuauccguucacccaucaccggcaguuugagagaacgauccagacuccuauuggcagcacauggaacacccaaagggcuuuccagaagcugacuacaccaaaaguugugaccaagcccggccauaucauaaaaccuauuaaggccgaagaugucggguaccaguccucaagccgcucugaccuucccgugauccagcgaaauccaaaacggaucacgacccgucacaacaaggaggaaaaauuguga

SEQ ID NO: 64651 - RNA, 8358 nt, Artificial Sequence
  derived and/or modified sequence opt3 from UTP20__Homo_sapiens__NP_055318
augaagaccaaacccgugagccacaagacagagaacacuuacagauuccugacguuugccgaaaggcucggcaaugucaacaucgacauuauacaucggaucgaucgcaccgcuuccuaugaggaagagguugaaacauacuucuuugaggggcuucugaaauggcgagaguugaauuuaacugaacacuucggaaaguuuuauaaagaggugauugacaagugccagucuuucaaccaacugguauaccaucagaaugaaaucgugcagucacuaaagacccaccuccaggucaaaaacaguuuugcauaucaaccucugcuugaucuggugguucaguuggcccgugaccuccagauggauuucuacccacauuuuccggaguucuuucugacaauuaccagcauccuggagacucaggacacagaacucuuagagugggcguucaccucccugucuuaucuuuacaaguacuuguggagacugauggugaaagauaugucgucaauauauagcauguacaguacgcuacucgcucacaagaaacugcacaucaggaauuuugccgcagaauccuucacuuuccuuaugcggaaggucucugacaagaacgcccuguuuaauuugauguuccucgaucuggacaaacaucccgagaagguggaagguguaggccaauuacuguuugagauguguaaagggguucgcaacauguuccacagcugcaccggacaggcugugaagcucauucuuagaaaacugggcccugucacagagacugaaacccaguugccauggaugcuaaucggugagacacugaagaauauggugaaauccaccgugucauauauuaguaaggaacauuuugggacguucuuugagugucuccaggaaagccugcuugaucugcacacuaaggucacaaaaaccaacugcugugagucuuccgagcaaaucaagagguugcucgaaacuuaccugauauuaguuaaacacggaucaggcacaaagauucccaccccugcagacgugugcaaaguacugagccagacgcuacagguggccagucucucuaccuccuguugggagacacugcuugaugucaucagcgcuuugauucugggcgaaaaugugucgcucccagagacucugaucaaggaaaccaucgagaagauuuucgagucucgguuugaaaaacgccuuauauucuccuuuucagagguuauguucgccaugaagcaauuugaacagcuguucuugcccaguuuccucagcuauaucgugaacugcuuucugauugacgacgcggucgugaaagaugaggcauuagccauccuggcuaagcuaauacucaauaaagccgcaccuccaacagcuggguccauggccauugagaaguacccgcugguauucucuccccagaugguuggauuuuauaucaagcagaaaaagacucgaagcaaagguagaaacgaacaauucccugugcuugaccauuugcugucaaucauuaagcucccacccaacaaagauaccacauaccugagucaguccugggcggccuuagucgugcugccucacaucaggccacuugagaaggaaaaggucauucccuuggugaccggcuuuauagaggcacucuucaugacuguugacaaagggagcuuuggaaagggcaaucuguucgugcuaugucaggcuguaaacacgcugcucucucuggaagagucaagugagcuuuugcaucuggucccgguggaacggguuaaaaauuuagugcucacauuuccucuggagcccagcguccuucuguugaccgaucucuacuaucagcgucuggcccuaugcgguuguaaggggccacugucccaagaagcucucauggagcuguucccuaaacuucaggccaacaucucuacuggagugucgaagauucgcuugcugaccaucagaaucuuaaaucacuuugacguacagcuccccgaaagcauggaggaugacggccuguccgagaggcagucaguguucgcaauucuucggcaagccgaacugguuccagcuacagucaacgauuaccgagagaaacuacuccaucugcgcaaguugagacacgacguggugcagaccgcgguccccgauggcccucugcaggaaguuccauuaagguaucuccuggggaugcuuuacauaaauuuuagugcacugugggacccggugaucgaguugauuucuagccacgcccaugaaauggagaacaagcaguucuggaaaguguauuacgagcaccucgaaaaggcugccacucaugcagagaaagaacugcaaaaugacaugacagaugagaaguccguaggagacgagucaugggaacagacgcaggagggugaugucggcgcccuauaucacgaacaacuggcucuuaaaaccgacugccaggagcggcucgaucacacuaacuuccgcuuucuguuguggagagcccugacaaaguuccccgaaaggguggagccucguagccgggaguuaucuccacucuuucugcgauucaucaauaacgaauacuaccccgcagaccuucagguugcgccuacccaggaucugagaaggaaggggaaaggaaugguggcugaggaaauugaggaagagccagccgcaggcgacgaugaggaauuggaggaagaggccgucccccaagacgaauccagucagaagaaaaagacacgccgggcugccgcaaaacagcucaucgcucaucugcagguguuuagcaaguucucuaauccgagagcccuauaucuggaguccaagcuuuacgagcucuaucugcaauuguuacugcaccaggaucagaugguucagaaaauaacucucgacugcaucaugaccuacaagcauccucacgugcugccauauagggaaaaccuucaacgccuguuggaggaucgaucauuuaaagaagagauuguacauuucaguaucagcgaggacaaugcggucgugaagacggcccaccgggcugaccuauuucccauucugaugcguauccucuacgguagaaugaaaaacaagaccgggucgaagacacagggcaaauccgcaucuggaacuaggauggccauagugcugcgcuuccuugcuggcacccagccugaagagauucaaaucuuuuuagaucugcucuucgaacccguccggcacuucaagaacggggagugucauagcgccguuauucaggcaguggaagacuuggaucugucaaaaguacucccacugggaagacagcacgguauccuuaauagucuggagauaguguugaagaacaucucccaucuaauuucugcguaucugccuaaaauccuccagauuuuacugugcaugacagccacugucagccacauccuugaccaaagggagaagauacagcugcgauuuauuaauccccucaaaaacuugcgccggcugggcaucaagauggugaccgauaucuuccucgacugggaauccuaccaguuuagaacggaggaaauugaugcuguuuuccauggggccguguggccacagaucucaaggcugggaagcgagagucaauacucuccgacaccucuucuaaagcugauuuccauauggagccguaaugcacgcuauuuucccuuguuagcuaaacagaagccaggccaccccgaaugugacauccugaccaacgucuucgccauucucucggcaaaaaaucugucagaugccacugcuucuaucgugauggacauuguugaugaccuucugaaccucccugauuuugagccaacagagaccguguugaaucugcuagucacugguugcguauaccccgggaucgcggaaaacauaggcgagaguaucaccauuggaggccggcugauccucccucacgugccggccauucuucaguaucuguccaagacaacgaucagcgcagaaaaaguuaagaagaaaaagaauagagcucaggugucuaaagaguuagggauauugagcaagauuuccaaauucaugaaggacaaggaacaaucaaguguccugaucacccuccugcuuccauuucugcauaggggaaacaucgccgaggacacugagguggauauucucguaacagugcagaauuugcugaaacacugugucgaccccaccagcuucuuaaagccuauagccaaacuauuuucuguuaucaagaacaaacugucccgaaagcuccuuugcacaguguucgaaacucugucagauuuugagagugguuugaaguacauuaccgacguggucaaacugaaugcuuucgaucagcggcaucucgacgauaucaacuucgacgugcgcuuugaaacguuccagacaauuaccagcuauaucaaggagaugcaaauaguugauguaaacuaccugaucccagugaugcacaauuguuuuuauaaccuugagcucggcgacaugucccugucugauaaugcaucgaugugcuugaugagcauuaucaaaaagcuggccgcguuaaacgucacugaaaaagacuacagagagauuauccacaggucacuacuggaaaagcuccggaaggggcuuaaaucccagaccgagaguauacagcaagacuacacaacuauucugucuuguuugauccagaccuuccccaaucagcuggaauuuaaggaucucgugcagcugacacauuaucacgacccugagauggauuucuuugagaacaugaaacauauccaaauucaccgaagagcucgcgcccuuaagaaauuagcaaagcagcugauggaaggaaaaguugugcucagcuccaagucauugcagaauuacaucaugccguaugccaugacgcccauauucgacgagaagaugcugaaacaugaaaacauuaccacugcugcaacagagaucauuggcgccaucugcaagcaccuaucuuggagcgcguacauguauuaccugaaacacuuuauacauguccuccagaccggucaaauuaaucagaagcuuggggugagucuguugguaaucguccuggaagcuuuccacuuugaucauaaaacucucgaggagcagaugggcaagaucgaaaacgaggaaaaugccauugaggcaaucgaacugccagagccugaggccauggaauuagagaggguggacgaagaggagaaggaauauacauguaaaucccuuagcgauaacggacagcccggcaccccagacccugcugauucugggggaacgucagccaaggaguccgaaugcauuacuaaacccguuaguuuccugccacaaaauaaggaggaaauagagcguaccaucaaaaacauucagggcacaaucaccggugacauccucccgcggcuacacaagugccuggcaagcacuacaaagagagaggaagagcacaaauuggugaagucgaaagucgugaaugaugaagagguugugagggucccucuggcuuuugccauggugaagcucaugcagucucuuccccaagaaguaauggaggcgaaccugccauccauuuugcugaaagugugugcccucuuaaagaaccgcgcacaggagauacgagacaucgcuagaagcacccuggccaagauuaucgaagaucuugggguucauuuccugcuauacguccucaaagagcugcagacaacuuuggugcggggauaccaggugcacguccugaccuucacgguacauaugcuccuucaaggccugacaaauaaguuacaggugggugaccuggacucaugcuuggauauuaugaucgaaauauuuaaccacgagcucuucggcgcuguugcagaagagaaagaggugaagcagauccugaguaaagucauggaagccaggcgcucuaaguccuaugacagcuacgagauucuagggaaauuugugggaaaggaucagguuaccaagcuuauccugccccucaaagaaauucugcaaaauacuaccucauugaagcuggcccguaaagugcaugagacacucagacggaucacugucggccuuauagugaaccaggagaugaccgcugaaaguauucuguuacugagcuauggguugaucuccgagaaucucccucugcuaacggaaaaggagaaaaacccaguagcgcccgcaccugacccgaggcuuccaccccagucuugucugcuccugccucccacaccagugcgcggaggccagaaggccguugucagccgaaagaccaauaugcacauuuucaucgaauccgguuugagauuacugcaccucucacuuaaaacuucuaagauaaaaaguucgggggagugcgugcuggagaugcuagauccuuuugugagccugcucaucgacuguuugggauccauggaugucaagguuauuacaggcgcucugcaaugccuuaucugggugcugcgguucccccucccaucuauugaaaccaaagccgagcaguuaacuaagcaucuguuuuugcugcucaaggacuacgcaaaacuuggugccgcuaggggccagaacuuccaccugguagugaauuguuuuaagugcgucacaauccuagugaaaaagguuaaaucauaucagauaaccgaaaagcaacugcaggugcucuuggcguacgccgaggaagauauuuaugacacgagccgccaggcaacugcuuucgggcugcuuaaggccauccuguccagaaaauuacucgucccugagaucgaugagguaaugaggaaggugaguaaacuggcaguuucugcccaaagcgaaccggcucgggugcagugucgucaggucuuuuugaaguacauucuggacuacccccucggagauaaacuucgcccaaaccuggaguucaugcuagcccagcugaauuaugaacaugagaccggccgagaaucaacacucgagaugaucgcguacuuguuugacaccuucccucaagggcuguuacacgagaacugcggaauguucuuuauaccccuuugucugaugacaauuaaugacgauuccgcaacuugcaagaaaauggccaguaugaccaucaagagccuccugggcaagauuucuuuggaaaaaaaggacuggcuguucgauauggugacgacaugguuuggugcuaaaaagagacucaacaggcagcuugccgcucugaucugcgggcuauucgucgaguccgaaggaguggacuuugagaaacggcugggcacuguuuuaccagugauagagaaggaaaucgauccugagaauuucaaggacauuauggaagagaccgaagagaaagcagccgaucgccuccuguuuucauucuugacacuuaucaccaagcugauuaaagaguguaacaucauucaguuuacuaagcccgcugaaacccucagcaaaaucuggucgcacguacauucucaccugagacauccgcacaauugggugugguugacagccgcacagauauucggucugcuauuugcgaguugccaaccagaggaacucauucagaaguggaacacgaagaaaacuaagaaacaucuuccugagcccgucgccaucaaguuccuggcuuccgacuuagaucagaaaaugaagagcaucucacuggccuccugucaccagcuccacucuaaguuucuggaccaaagcuugggcgaacagguugugaaaaaccuucuguucgcagcuaagguccucuaucugcuagaguuguacugcgaggauaaacagaguaagauuaaagaagaccuggaggaacaagaggcccucgaagacgggguggcaugugccgaugagaaggcugaguccgacggagaagagaaggaagagguaaaagaggaacuuggcaggccagcgacccuguuauggcugauacagaagcucagccggaucgccaaacuggaggcagcuuauucuccccgaaauccuuugaagagaacaugcauuuucaaauuucuuggggccguggccauggaucugggaaucgacaagguuaaaccguaccuccccaugauuaucgcaccacuguuccgcgaacuaaacucaaccuauagugagcaggauccuuuacugaagaauuugucccaggaaauaaucgagcuccugaagaaacuugugggccuggagagcuuuucucucgcuuucgccucgguccaaaagcaggcgaacgaaaaaagggcucugcggaagaaacguaaggccuuggaguuugugacuaaucccgacauugcagccaagaaaaagaugaaaaagcauaaaaacaagucagaagcuaagaaaagaaagaucgaguuccuuaggccugguuacaaagcaaagcgccagaaaagccacucccugaaggaucuagccauggucgaauga

SEQ ID NO: 64652 - RNA, 10302 nt, Artificial Sequence
  derived and/or modified sequence opt3 from UTRN__Homo_sapiens__NP_009055
auggccaaguacggcgagcacgaagcuagccccgacaacgggcagaaugaguucuccgauaucauuaagucuaggucagacgaacauaacgaugugcagaagaagaccuuuacuaaguggauaaaugcaagguucaguaagagcggaaagccuccaaucaacgacauguuuacugaucugaaggacggucggaaacuacuugaucuguuggagggcuuaacggggaccucccugccgaaggaacgcggaucuacacgaguccacgccuugaauaacguuaaucgugugcuccagguacugcaucagaacaauguggagcuugucaacauuggcgguacugacaucguggaugggaaucacaaacugaccuugggacuccuguggucgauuauccugcauuggcagguuaaggacgugaugaaagaugucaugucagaccuccaacagacaaacagcgagaagauauuacugaguugggugagacagaccacuaggcccuauucccagguaaauguucuuaacuucacaaccucuuggacggauggcuuggcguuuaaugcugugcugcaccggcacaagccugaccuguucagcugggacaaagucgugaagauguccccaaucgaacgccucgagcaugccuuuucaaaagcacaaacuuaccugggcauugaaaaacuucuggaucccgaggacguggccguccaguugccugauaaaaagaguaucauuauguaucucaccagccuguucgagguuuuaccacaacaggugacaaucgacgcuauaagagaaguagagacucugcccaggaaauacaagaaggaaugcgaggaagaggcaauuaacauccaaucuaccgccccugaggaagaacacgaauccccacgggcugagacaccgucaaccgugacggaagucgauauggaccucgauagcuaucagauugcccuugaggaggugcugacuugguugcuaagugcggaagacacauuucaggagcaagaugacaucucugaugacguugaagaggugaaagaccaguucgcaacccaugaagccuuuaugauggagcugacugcucaccaguccagcgucgggucggugcuccaggccggaaaccaacugaucacacaggguacccuuucugaugaggaagaguucgaaauucaggagcagaugacgcuguugaaugcacgcugggaggcucuccgaguagaauccauggacagacaaucaaggcugcacgauguuuuaauggagcugcagaagaaacagcuacagcaacucagugccuggcugacccuuacagaggaacggauacagaagauggaaacuugucccuuggacgaugacgugaaaagccugcagaagcuccuggaggagcauaagucccuucagucugaucuggaagcggagcaagucaaagugaacagcuugacccacauggucgugaucguugacgaaaauucaggcgagagugccacagcaauucucgaagaucagcugcagaaguuaggggagcguuggacugcugugugccgcuggaccgaggaaagauggaacaggcugcaagagaucaauauacuauggcaggaacuccuggaggaacagugucuuuugaaagccuggcugacagagaaggaggaagcucucaacaaaguacagaccuccaauuuuaaggaccaaaaggagcugagcgucucugugcggcgauuagccauucugaaagaagauauggagaugaagcgccagacucuugaccaguugucagagaucggacaggauguuggccaacuccuggacaacaguaaagcaagcaagaaaaucaauuccgacucugaagaauuaacgcagagaugggauucgcuggugcagaggcucgaagacagcuccaaccaggucacacaagccguggcuaagcuggguaugucacagauuccucagaaggaucuuuuggagaccguacgggugcgcgaacaagcgaucacuaaaaagaguaaacaggagcugccacccccuccacccccgaagaaaagacagauucauguugacauagaggcaaagaaaaaguucgaugccaucucugcugaauuacucaauuggauucugaaguggaaaaccgccauccagacaaccgagaucaaggaauacaugaaaaugcaagacacuagcgagaugaagaagaaacuuaaggcacuggaaaaagagcagagggagcguauuccucgggccgaugaauugaaccagacagggcagauacucgucgagcaaaugggaaaggaaggccugcccacggaggaaaucaaaaaugugcuagagaagguguccucagaguggaaaaacgucagccagcaccuggaagaccucgagcgaaagauucagcugcaggaagauaucaaugcuuauuucaagcaacuugacgaguuggagaaaguuauuaagaccaaagaagagugggugaagcauacuucuaucuccgaaaguagcagacagucucugccauccuuaaaagauucaugccagagggagcucacaaaccugcuuggccugcacccuaagauagaaauggcccgcgcaaguuguagcgcgcuaaugucgcagcccuccgcuccagacuuugugcaacggggguucgauucuuuucucggaagauaccaggccguacaggaggcagucgaggacaggcaacagcaccuggaaaacgaguugaagggucagcccggccaugccuaccuggaaaccuuaaaaacacucaaggacgugcugaaugauagcgagaacaaagcucagguuucacuuaaugugcugaacgacuuggccaaggucgaaaaagcacuccaagagaagaaaacucuggaugagauccuagaaaaucagaagccugcucugcacaaacuugccgaggaaaccaaagcgcucgagaagaacgugcauccagacguugaaaaacuguauaagcaggaguucgaugacgugcaggggaaauggaauaaguugaagguacuggucaguaaagauuuacaccuccuggaggaaauugcccuuacgcugcgcgcuuuugaggcagacuccaccgugaucgaaaaguggauggauggagugaaagacuucuugaugaagcaacaggccgcucagggcgaugacgccggucuccagcgacaacuggaccagugcucugcauuugucaacgagauugagacaaucgaaagcucccucaagaauaugaaggagauagaaacuaaccugcggucagggccgguugcgggcauuaagaccugggugcagacacgucuuggagauuaccaaacucagcucgagaaacugagcaaggaaaucgccacccagaaaaguagauugucugagucccaggagaaggcugccaaucuaaagaaggaccuggcagaaaugcaagaguggaugacgcaggcugaagaggaauaucucgagagggauuucgaguacaagagccccgaggaacuggaaucggccguagaggaaaugaaacgcgcaaaggaggacgugcuucagaaagagguccgggugaagauucugaaagauaacaucaaguugcuagccgcuaagguuccuucaggcgggcaggaacugacaucugagcucaaugugguccuggaaaacuaucaacuuuuauguaauagaauaaggggaaaaugccacacccuggaggagguguggaguuguuggaucgaacucuugcauuaccuggaccucgagacuacauggcugaacacccuugaggaacgaaugaaguccacugaaguucugccagagaaaaccgaugcggugaacgaggccuuggaaagccuagagucuguccugcgccaccccgcagacaaucggacacagauuagagaacucggucagacguuaaucgauggcgggauucuggacgauaucauaagcgagaaacuugaggcuuuuaacuccagguaugaggaccugucacaucucgccgagaguaaacagauuagcuuggaaaagcaacugcagguacuccgugagaccgaucagaugcuacaggugcuucaagaaucucuaggagagcuggacaaacaguugacuacauacuuaaccgaccgcaucgaugccuuccagguuccucaagaagcucagaagauccaggcagagauuuccgcccacgagcugacacucgaggaacugcggagaaauaugaggucacagccacuuacaagucccgaaagccgaaccgcgcggggcgguucccaaauggacgugcugcagcgcaagcucagagaggucucuacgaaauuucaguuguuccagaagccggcuaacuuugagcaaaggaugcuggauugcaaacgggugcuagacgggguaaaggccgaacugcaugugcucgaugucaaagacguugauccugacgugauccagacacaccuugauaaguguaugaagcuguacaaaaccuuaucggaggugaaguuggaagucgagacugugauuaaaaccggccgacacauaguucagaagcagcaaacagacaauccaaaaggaauggaugaacagcugacuagccucaagguacuguauaacgaccuuggcgcacaggugaccgaggggaagcaagaucuggagagagccucacagcucgcucgcaaaaugaagaaagaagcagccuccuugagugaguggcugucugcgacagaaacggaguuaguccaaaagagcaccuccgaaggacuacugggugaccucgacacugagaucucaugggcuaaaaaugugcuuaaggaucuggagaagaggaaagccgacuugaacacaauuaccgaaucuagcgcagcccugcagaaucucaucgagggcagugaacccauucuggaggaacgucuuugcguucucaacgcuggguggucccgggugagaacuuggacagaggauuggugcaauacccugaugaaccaucaaaaucaguuggagaucuucgacggaaacgucgcccacauaagcacguggcuguaccaggcagaggcuuuacuagaugagaucgaaaagaaaccuacuucuaagcaggaggagauugugaaaaggcugguaucagaacucgacgaugccaaucuucaagucgagaacgugcgcgaccaggcgcugaucuugaugaacgcccgaggcuccaguagcagagaacugguugagcccaagcucgcagaacugaaucggaacuucgagaaagugucgcagcauauuaagucugcuaaacuuuuaaucgcccaggagccacuguaucaaugucucgucaccacagaaaccuuugagacuggugugccuuucuccgauuuggaaaaacuggagaaugacauagaaaacaugcuaaaguuuguugagaaacaccuggagagcucagaugaagacgagaagauggacgaagagagugcucagauugaagaggugcuccagagaggggaagaaaugcuucaucaacccauggaggauaauaaaaaggaaaagauccgccugcaguugcugcuccugcacacacguuacaacaaaaucaaggcaauuccaauacagcagagaaaaaugggccaauuagccucuggaauccgguccagccuucugccgaccgacuaucucgucgagauuaauaagauccuacugugcauggaugacguggaguugucacugaacguaccugaacucaauacagccauuuacgaggauuucaguuuucaggaagacagccuuaaaaacaucaaggaucagcuggacaaguugggcgagcagauagcugugauccacgaaaaacaacccgauguuauucuggaggcguccgggccagaggcaauccagauuagggacacucucacccaguuaaaugccaagugggaucgcaucaaccgaauguauucugacagaaaaggauguuucgaucgggcuauggaagaguggaggcaguuucauugcgaccugaaugaccuuacgcaauggauaacagaagccgaggaacugcuagucgauaccugugcacccggcgguagccucgaccuggagaaggcccgcauucaccagcaggaguuggaaguggggaucuccucacaucagccuucuuucgcugcgcugaacagaacuggagauggcaucgugcaaaaacucagucaggccgacgguucguuucuuaaggagaagcuggcaggcuuaaaucagaggugggaugcuauugucgccgaaguaaaagaccggcaaccacgucugaagggggagagcaaacaggugaugaaguaccgccaccaguuggaugaaaucauaugcuggcucaccaaagcagagcacgccaugcagaagcgauccacaacugagcugggagaaaaccuacaagagcuuagagaccugacccaggaaauggagguucaugcugagaaacucaaguggcugaauaggacggaauuggagaugcugucugauaagucacucagccuucccgaacgggacaaaauuuccgagagucugcgcacagugaacaugaccuggaacaagaucuguagagaagucccuacuacauuaaaagagugcauucaggagccgucuagcgugucacagaccaggaucgccgcgcacccaaauguucaaaaggugguccugguguccagugcaagcgauauacccguacagucucaucggacuuccgaaauuucaaucccugccgacuuggacaaaacaaucaccgagcucgcugauuggcuggugcuaauugaccagaugcuuaagagcaacaucguuacggucggcgauguggaagagauuaauaagacugugucgcgaaugaaaauaaccaaggccgaccuggaacagagacacccacaacucgauuacgucuucacacuggcucagaacuugaaaaauaaggcaucuaguuccgacaugcgcaccgccaucacagagaaauuagagaggguuaagaaccagugggaugggacucaacauggaguggaacugcggcagcagcagcucgaggacaugauuaucgauagccuucaaugggacgaucaccgugaagagaccgaggaacugaugagaaaguaugaggcuaggcuauacauccugcagcaggcccgccgggacccccucacgaaacagauuucagauaaucaaauauugcugcaggaacuuggcccuggugacgggaucguaauggcauuugacaacgugcugcagaagcucuuagaggaauauggauccgaugacacacgaaaugucaaagagacuaccgaguaccugaagacaucuuggauuaacuugaaacagagcaucgcggauagacaaaaugcccuggaagcugaguggaggaccgugcaggccagucgccgggaccucgaaaacuuccuuaaguggauucaggaggcagaaacuaccguuaaugugcuggucgaugcuucccacagagagaacgcccuacaggacagcauccuggcacgugagcucaagcaacagaugcaggauauacaagccgaaaucgacgcucauaaugauauuuuuaaaucuaucgacggcaacaggcagaagaugguaaaagcguuggguaacucagaggaagccacaaugcugcagcaccggcuugaugacaugaaucagcgcuggaacgaucugaaggcaaaaagugcuuccauucgagcccauuuagaggccagcgcagaaaaguggaauagacuccugaugucuuuggaggagcugaucaaguggcucaacaugaaagacgaggagcuuaagaaacaaaugccgauaggcggggacgugcccgcucugcagcuacaguaugaucacuguaaggcccugaggcgggaacucaaagagaaggaauacucgguuuugaaugcgguggaccaggcucgcgucuuccuggccgaucaaccaauugaggcaccugaggaacccagaaggaacuuacagucaaaaacggagcuuacuccagaggagcgagcccagaagaucgcuaaggcaaugcggaaacagagcuccgaggugaaggaaaaaugggagagucugaaugccgucaccucuaacuggcaaaaacagguggacaaagcgcucgaaaagcugcgugauuugcagggagcuauggacgaucuggacgccgauaugaaggaggcagaaagcguuagaaauggcuggaaaccugugggggaccuccuuauugauucccugcaagaccacaucgagaagauaauggccuuccgcgaggaaaucgcucccauuaacuuuaaaguaaagacagugaaugaccuaucaagucagcugucuccauuagaucuccauccgagccugaaaauguccaggcaguuggacgaucuuaacaugcgguggaagcugcuccaggucucaguugacgauagacugaagcaauugcaggaggcccaccgcgacuucggaccuagcucucagcauuuucuguccaccagugugcagcuacccuggcaaaggagcaucucgcacaauaaagucccauauuacauuaaccaucagacucagacaaccugcugggaucaccccaagaugacggaacucuuccagucccuugcagaccugaauaacgugcgauuuucugcuuaccggacugccaucaaaauaagaagguuacaaaaggcgcugugucucgaucuguuggagcuuucaacaaccaacgaaauuuucaaacagcacaagcugaaucagaacgaccaacuccugagcguaccugaugugaucaauugccuaaccacuacauaugacggcuuggagcagaugcauaaggaucugguuaacgugccacucugcgucgacaugugucuuaauuggcuguuaaacguguacgacaccggucgcacagggaaaauccguguccagagucugaagauuggacucaugucccugucuaaaggcuugcuugaggaaaaguaucgguaccuguuuaaagagguggccggucccacugaaaugugcgaucagagacaacucggccugcuauuacacgacgcaauccagauaccuaggcagcugggggagguugcugccuucggaggcagcaauauugaaccgucaguacgcuccuguuuucagcaaaacaauaacaagccagagaucagugugaaagaguucauugauuggaugcauuuggaaccccagagcauggucuggcucccugugcugcaccgaguugcagcugccgagacggccaagcaccaggcgaagugcaauaucuguaaagaaugccccauagugggguuucgguauagaucucuuaagcauuucaacuacgacgucugucagucaugcuucuuuuccggaaggaccgcuaaaggccacaagcugcauuauccaaugguggaguacuguaucccuacaacuagcggugaggauguacgcgacuucaccaaagugcucaagaauaaguuuagaucuaaaaaguacuucgcaaaacacccccggcugggguauuugccaguucaaacaguccuugaaggagauaaccuggagaccccuauuacucuaaucaguauguggccggaacauuacgaccccucgcaguccccacagcucuuucacgaugacacgcacagcaggauugagcaguaugccacccgucuggcucaaauggaacgaacaaauggcucauucuuaacugauucuagcuccaccacaggcaguguggaggacgagcaugcccugauccagcaguacugccaaacccuagggggagaaucaccugugucucagccccagagcccagcacagauucucaaguccgucgagcgcgaagagagaggugaacuggagcggaucauagccgaucuugaggaagaacagaggaaccugcagguugaauaugagcagcucaaagaccagcacuugcgcagaggccugccuguggggagucccccggaaagcauuaucuccccacaucacacuucugaggacucagagcuuaucgcugaagcgaagcuguuacggcaacauaagggaaggcuagaggcccgaaugcagauucucgaagaucacaacaaacagcuggagagccagcugcaccguuugagacaacuccuggagcagccugaaucggacucccgcauaaauggcguaagucccugggcaucuccacagcauagcgcucuuucauacucccuggaucccgacgccucugguccucaauuucaccaggcagccggggaggauuuacucgcuccgccccaugacacaaguacggaucugaccgaagugauggagcagauccacagcacuuucccauccuguugcccuaacguccccucacggccucaggccauguga

SEQ ID NO: 64653 - RNA, 360 nt, Artificial Sequence
  derived and/or modified sequence opt3 from UTS2B__Homo_sapiens__NP_937795
augaacaagauccugagcuccaccgugugcuucggccuccuuacacuguugucugucuuaucauuucugcagaguguucacgggagacccuaccuaacucaaggaaaugagauuuucccugacaaaaaguauacgaacagggaagaacuccugcuugcccuguugaauaaaaacuuugauuuccagcggccauuuaauaccgaccucgcucugccgaacaagcuggaggagcucaaucaguuagaaaaacugaaggagcagcuuguggaggaaaaggauagcgagacauccuacgcaguagacgguuuguucucuucgcaucccucaaaacgcgccuguuuuuggaaguauugcguguga

SEQ ID NO: 64654 - RNA, 420 nt, Artificial Sequence
  derived and/or modified sequence opt3 from UTS2__Homo_sapiens__XP_011538839
auggagaccaacguguuccaccugaugcucugcgucacaagcgccagaacucauaaguccacgucucuuuguuuuggccacuucaauucauaccccagucugccuuugauccaugacuuacugcuagaaauuagcuuucagcucuccgcuccacacgaggaugcaaggcugaccccggaggaacuugaacgggccucucuguugcaaauacuccccgagaugcugggggcggagcgcggagacauccugcgaaaagcugauucgucaacaaacauuuucaauccucgugguaaccucagaaaguuucaggacuucagcggccaggauccaaauaucuuacugagucaucuuuuggccaggauuuggaaacccuauaagaaacgggaaacuccugacugcuuuuggaaguacuguguuuga

SEQ ID NO: 64655 - RNA, 1170 nt, Artificial Sequence
  derived and/or modified sequence opt3 from UTS2R__Homo_sapiens__NP_061822
auggcccugacccccgagagcccuuccucuuucccaggccucgcugcaacagggucaagugugccggaacccccuggagguccaaacgccacucuuaauagcuccugggcgucucccacggagccuucgucacuggaagacuuggucgcuaccggcacaaucgggacuuuacugagcgccaugggaguugugggcguaguggguaacgcauacacccuagucgugacaugcagaagucucagggccguugcuuccauguauguguacgucgugaaucuggcacuugccgaucuguuguaucuccugucuauuccauuuauaguagcuaccuacguuacuaaggaguggcacuucggggacgugggaugucggguccuguuuggccucgauuucuuaacaaugcaugccagcaucuuuacccugacggugauguccucagaacgcuaugcggcagugcuucgacccuuggacacuguccagcguccuaaaggcuacagaaagcugcuagcccucgggaccuggcugcuugcucuguugcucacacugccaguuauguuagccaugaggcuggugcggcgcggaccgaaaagucucugccuucccgcaugggguccuagagcucacagggccuaucugacuuugcuauucgcgaccagcauugccggcccagggcugcucaucggacugcuuuacgcacggcuggcucgcgccuaccgaagaucucaaagggcuuccuuuaagcgggcccgucgccccggcgcaagagccuugaggcucguacuggguauuguguuacuguucugggcuuguuuucuaccuuucuggcucuggcagcugcuugcgcaguaucaucaggcaccauuggcuccccggacagcccgaaucgucaacuaccugaccacgugccucacuuauggaaauucaugugccaacccguuucuguacacacuucugacccgcaauuauagagaucacuugagggggcgggugcgcggcccuggcagcgggggagguagaggccccguuccaagucuccaaccuagggcacguuuccagcggugcucugggcgaucccugagcucguguucuccccagccaacugacuccuuagugcuggcccccgcugccccugcaagaccagcgccggagggacccagggcuccugccuga

SEQ ID NO: 64656 - RNA, 4179 nt, Artificial Sequence
  derived and/or modified sequence opt3 from UTY__Homo_sapiens__NP_001245181
augaaaagcugcgccgugucccugaccacagcugcagucgccuucggcgacgaggcgaaaaagauggcugaagggaaagccucuagagagucagaagaggaaaguguuagccucacuguggaggagagggaagcacuuggagguauggauucccggcuguuuggcuucguacgcuugcacgaggacggggcccgaacgaagaccuuacugggaaaagcugugcguuguuacgaaucucuaauccucaaggcagagggcaaggucgagucggacuuuuucugccagcugggucauuuuaaccuucuguuggaagauuauucaaaagcccucagcgcuuaccaaagauauuacagucugcaggccgauuauuggaagaaugcggcauuccuguacgggcucggauuaguguauuuuuacuacaacgccuuccacugggcuauuaaagccuuucaggacguucuguauguggaucccuccuucuguagggcaaaggagauacaucuucgguugggccugauguuuaaagucaauacagacuacaagucuagccuaaagcacuuccagcucgcucugaucgauugcaacccuuguacucuuuccaaugccgaaauucaauuucauaucgcgcaccuguaugagacccagcgcaaauaccacucagccaaggaagcauaugagcaguugcuccagacagagaaccugccagcucaagugaaagccaccguauuacagcagcugggcuggaugcaucacaauauggaccucguuggggauaaggcuacuaaagaaaguuacgccauucaguaucuucaaaagagccuggaggcagacccgaacucuggacaguccugguacuucuuggguagaugcuacucaagcaucggcaaagugcaggaugccuucauaaguuauaggcaaucuaucgacaaguccgaagcuagcgcggacacaugguguucgauugggguccuauaccagcagcagaaucaacccauggaugcacugcaggccuauaucugcgcugugcagcucgaccauggacacgccgcagccuggauggaucugggcacccuuuacgagucuuguaaccagccucaagacgcuauuaagugcuaucugaaugccgcacgguccaaacgcuguucaaacacgaguacuuuggcggcucgaaucaaguuucuccaggcccagcugugcaauuuaccacagagcucccugcaaaacaaaaccaagcuacuccccucuauagaagaggcauggagccugccuauuccagccgagcuuacaucaagacagggugcuaugaauacugcccagcagaacgggagugauaacuggaauggaggccaauccuugagccaccaucccgugcagcaggucuacucucugugccucaccccucaaaaacugcagcaccuugaacagcugagggcaaaccgggacaauuugaacccagcucagaagcaucaacucgagcagcuggaaucacaguucguuuuaaugcagcaaaugcgucacaaggagguggcccagguacgcacaaccggcauccauaauggggcgauuacggauaguagccugccgacuaacuccgugucuaauagacagccccacggagcccuaacaagggucucgagcgugucccagccugguguucggccagcuuguguggaaaaacuccugucaaguggcgcauuuucugccgggugcauccccuguggaaccagcaagauccuuggcuccacugacacaauuuugcuggguucaaacugcauagcugggagcgagucuaauggcaacgucccuuaucuccaacagaauacccacacgcugccacauaaccacaccgauuuaaauuccaguacagaggaacccuggcgaaaacagcugagcaacucugcccaaggacuucauaagucccagucaaguuguuugagcggcccgaaugaggaacagccucucuucucgacuggguccgcacaguaccaccaagcgaccucuacaggaaucaaaaaggccaacgagcaccugacucuacccagcaacucagugccacagggugacgcugauagucaucuguccugccacaccgccacaucuggcgggcagcagggaauuauguuuaccaaggagagcaaaccuuccaagaaucgcucacucguacccgaaacuagcagacauacgggcgacacaaguaacgguugugcagacguuaaagggcugucuaaucacgugcaucaacuuaucgcugaugccgucuccagcccaaaccacggcgacucgcccaauuugcugauagcagauaacccucaguuaucagcccuccugauuggaaaggcuaauggcaacguggggaccggaacuugcgacaaagucaauaacauccacccagcggugcauaccaagacagaucacucuguugccaguuccccgagcucugcaaucagcaccgcuacucccuccccuaagucaacagagcagaggaguauuaauagcgugacgucucuuaacuccccacauucaggucugcacaccguaaauggcgaaggguugggaaaaagucagagcuccacuaaggucgaccucccccuggccucucaucggucgacaagccaaauccuaccuucaauguccgugaguauuuguccaucuagcaccgagguucugaaagccugccgcaaccccggcaagaauggucucuccaacucauguauacugcuugauaaaugcccgccuccaagacccccuacaucucccuacccaccuuugcccaaggacaaacugaacccaccgacuccuagcaucuauuuagaaaauaagagggaugcuuucuuucccccacuccaccaguucugcaccaaccccaagaauccugugacggucauucgugggcuggcaggcgcccuuaaacuggaccuaggacucuuuaguaccaagacacugguggaggcgaacaaugagcacaugguagaagugcggacucaguugcugcagccagcugaugagaacugggaccccaccggcacaaagaagaucuggcgaugugaauccaauagaagccauacuaccaucgccaaauacgcacaauaucaggccucuucauuccaggaguccuuaagggaagagaacgagaagcgcacgcaacacaaggaucauagugacaaugaaagcacaucgucugagaacuccgggcggagaaggaaaggaccuuuuaagaccauuaaauucggcacuaauauagaccucagcgauaacaagaaauggaagcugcagcuucacgaacugacaaaguugccggcuuuugcacgcguugucucagccgguaaucuccugacccacguggggcauacuauccuaggaaugaacaccgugcagcuguacaugaaagucccaggcagucgaacacccggucaccaggagaauaacaacuucugcucuguuaauauuaacaucggcccuggggacugugaaugguucguggugccagaggauuauuggggaguacuuaaugacuuuugcgagaagaacaaucucaacuuccugauguccagcugguggcccaauuuggaagaucuguacgaggcgaacgucccuguguaucgguuuauucaacguccgggcgacuuaguuuggaucaaugcugggacggugcauuggguccaggccgugggaugguguaacaauauagcauggaacguuggcccccucaccgccugccaguacaaacuggcuguggaaagauacgaguggaauaaacuuaagucaguaaagaguccagucccuauggugcaccugagcuggaacauggccaggaauaucaagguguccgaucccaaauuguucgagaugauuaaguauugucuccugaaaauccuaaagcaguaccaaacucugcgcgaagcacuugucgcugccgguaaagagguuauuuggcaugggcggacaaacgacgaaccagcgcacuauugcucuaucugugagguggaaguauuuaaucuccuguucgugaccaacgagagcaacacacagaagacuuacauaguccacugccaugauugugccagaaaaaccuccaagucauuggagaauuuugugguuuuagaacaguauaagauggaggaccugauucagguguacgaucaauucacgcucgcacugucucuuaguucgagcuccuga

SEQ ID NO: 64657 - RNA, 2100 nt, Artificial Sequence
  derived and/or modified sequence opt3 from UVRAG__Homo_sapiens__NP_003360
augagcgccuccgcuucugugggcgggcccgucccucagccaccgcccggaccugcagccgcgcugccacccgguucagcugccagagcacuccacguugagcuuccuagucaacagaggcggcugcgccauuugcgaaacaucgccgcucguaauauugugaacagaaauggccaccaguuacuggacaccuacuucacacuacaucucugcagcacugaaaagauauauaaagaguuuuacagguccgaaguaaucaagaacucucugaauccaacguggcggucgcuugauuucgggauuaugcccgaccgccuggauaccucagugagcuguuuugucgugaaaaucuggggaggcaaggagaacauuuaucaguugcucaucgaauggaaaguuugccuggacggucugaaguaccucgggcaacagauacacgcaagaaaucagaacgagaucauuuucggauuaaaugauggcuauuacggcgccccuuuugagcauaagggguauaguaacgcucagaaaacaauccugcuucaaguggaccagaauugugucaggaacuccuacgauguguucucuuugcugcggcuacaccgcgcccagugcgcgauuaagcagacucaaguaaccguucagaaaaucggaaaggaaauagaggaaaaacuccgacugacaagcaccuccaaugagcuuaagaagaaaucagagugucugcaguugaagauucucgugcugcaaaacgaauuagagagacagaaaaaggcacuggguagggaagucgcccuccuucacaaacagcagaucgcucugcaagacaagggcagugccuuuagcgcagagcauuugaaacuacagcugcagaaggaaucucucaaugagcugcggaaggagugcacugcuaaacgugaacuuuuccugaagacaaacgcccaguugaccauucgcuguagacaacuccuguccgaguuaucauacaucuauccaaucgaucugaacgaacacaaagacuacuuugugugcggggugaagcuaccgaauagcgaggauuuccaggcgaaagacgauggaaguauugccgucgcacucggcuauacggcucaucugguuucuaugauauccuuuuuccuucaggugcccuugagguacccuaucauucacaaggguagccggucgacuaucaaggacaacauaaaugacaaacugaccgaaaaggagcgagaguuuccacucuaucccaaagggggagaaaagcugcaguucgauuacggcguauaucuucugaacaaaaauauugcccaauugcgcuaccagcacggccucgggacaccugaccugagacagacuuuaccaaaccugaagaauuucauggagcauggacuaauggugaggugugaucggcaccauaccucuuccgcuauccccgucccgaagcgccagucaaguaucuuugguggcgccgacgugggguucagcggaggcauuccuucccccgauaaaggucacagaaagagggcaucuagcgaaaacgagcgucuccaauacaaaacaccaccucccucauauaauagugcccuggcucagccaguuaccacggugcccuccaugggggaaacugagcggaagaucacaagccuuucuucaaguuuggacaccagccuggauuuuuccaaagagaacaagaagaaaggcgaagaccucgucggaucucugaauggcgggcaugcgaacgugcacccuucgcaggagcaaggagaagcauuaagcggucaccgagccacuguaaauggcacacugcuuccauccgagcaggcugggucagccaguguucaguugccgggagaguuccaucccgugucugaagcagagcucugcuguaccgucgaacaggccgaggaaauuauaggccuggaggcuacggguuuugccagcggggaucaacuagaggcauucaacugcaucccuguggacuccgcggucgcuguggaaugcgaugagcagguucugggcgaauuugaggaguucucaagaaggauuuacgcccucaaugaaaacgugagcucuuuucgccggccaagaagguccagugacaaguga

SEQ ID NO: 64658 - RNA, 2457 nt, Artificial Sequence
  derived and/or modified sequence opt3 from UVSSA__Homo_sapiens__XP_011511824
augcagggccacgcccaucccccugagaaggaaaccccagcuagaaggcggcgcccgcccccuugcacacaaccacgagagcccagccgugcauccgcccugagagggcucuguagggcgccucgggaauggggaccacaccaugcucccccuaaaccacgcuucccgaagagaggucuucaggugaggcccucugccgcagaccuggccuugccuugcguccggggcuguggguuacgccgacaggauggaagaaggcugugcuuuucauuccggccaggccccgcucgugcacaggguuaccuacucuguguuuggcgcagagacauggaucaaaaacugaguaagcugguggaggaacugacuacgagcggggagccuagguugaacccagagaaaaugaaggaacucaagaaaaucugcaaguccucugaggaacagcugucgcgggccuaucgacugcucauugcucaguuaacccaggagcacgccgagauacgccugucagcguuucaaaucguagaagaacuuuucgugagaagccaucaguuuaggauguuggucgugaguaauuuccaggaauuucuggagcuaacacucggaacugaccccgcacagccgcugccucccccacgggaagccgcucaacgccuuagacaggccaccacaagggcaguugagggcuggaacgagaaauucggcgaggcuuacaagaaacuggccuugggguaucacuuucuccgucacaauaagaagguggauuuccaggacaccaacgcgcggucccuggccgagcgaaaaagagaagaggaaaagcaaaaacauuuagauaagauuuaccaggagagggcaucucaggcugagcgcgaaaugcaggagaugagcggagaaaucgaguccugucugacugaagucgagucaugcuuucggcuccuugugccuuucgacuuugaucccaauccagagacagaaagucuggguauggccagcggcaugucugacgcuuugagauccucaugugccgggcaaguaggacccugcaggagcggcaccccugauccacgcgacggugagcagccguguugcagucgagaucuacccgcaucugccgggcacccucgggcuggaggcggcgcgcagccaucccagacggcaacuggggaccccagcgacgaagaugaggacucggaucuggaggaguucguucguucucauggacucgguucccacaaauauacccuggacguggaacuuugcucagaaggccugaagguccaagagaacgaagauaauuuggcccucauucacgcugccagagacacacugaaauuaaucaggaacaaguuccugccugcaguguguaguuggauacagcgcuuuacucggguggggacccauggaggcugccuaaagagagccaucgaucucaaagcugagcuggagcuugucuugaggaaguacaaagaacuggacauugagccagaagguggggagcgacgccggacagaagcccucggcgaugcagaggaggacgaagaugacgaggacuucguugaagugcccgagaaggaaggauaugagccgcacaucccugaucaucugagaccagaguacggccuugaagcggcucccgagaaagacaccguagugaggugucugcguacgcgcacucggauggaugaagaggucagcgacccuacauccgccgcagcccaguugagacagcucagggaucaccuucccccaccuucuagcgcuucacccagucgagccuuaccagagccgcaagaagcacagaagcuggcugccgagcgggcgcgcgccccugugguucccuacgggguggaccuacauuauuggggacaggaacucccaaccgcugguaagauugucaaauccgauagccagcacagauuuuggaagcccucugagguggaagaggagguaguuaaugcagacaucucagaaaugcugaggagucggcacauaacuuucgccggcaaauuugagccugugcaacauuggugccgagcuccaagacccgaugggcgccuuugugaaaggcaggaccguuugaagugcccuuuccacggaaaaauugucccgcgggaugacgagggcagaccacuggaucccgaagacagggcccgcgagcagcgaagacaacuccagaagcaggagcggccugaauggcaggacccagagcugaugagggauguggaagcagcgacaggucaagacuuagggagcucccgcuacucuggcaagggacguggcaaaaagagacgguaucccucgcugaccaaccuuaaagcccaggcugauacggccagggcacgcaucgggcgaaaggucuuugcuaaagccgcagugagacggguuguggccgcuaugaauaggauggaccagaagaagcaugagaaauucagcaaccaguuuaauuacgcguugaacuga

SEQ ID NO: 64659 - RNA, 1278 nt, Artificial Sequence
  derived and/or modified sequence opt3 from UXS1__Homo_sapiens__NP_001240804
auggugagcaaggcccugcucagacuugucuccgcuguuaacaggcggcgcaugaaacuguuguuaggcaucgcacugcuagccuacguggcgucuguaugggggaauuucgugaacaugucauuucuccugaaucgaaguauucaggagaacggagaacuuaagauagagagcaaaaucgaagagauggucgaaccccugcgugagaagauuagagacuuggagaaauccuucacccaaaaguauccuccagugaaguuucucucugaaaaagauaggaagcggauccugauuacagguggcgcuggguucguuggaucgcaccugacugacaaacucaugauggauggccaugaggugacggucguggacaacuuuuucaccggucgcaagagaaauguagaacacuggaucgggcaugagaauuuugaguuaauaaaccacgauguuguggaaccgcuguacaucgaggucgaccagauuuaucaucuugccucacccgcaagcccuccaaauuacauguauaaccccaucaaaacauugaagacuaauaccauuggaacacugaacaugcuaggccucgccaagagggugggcgcucggcugcuucuggcaaguaccuccgaaguguacggggauccugagguccacccacagucugaagacuauuggggacacguuaaucccaucgguccucgcgccugcuacgaugagggcaaacgaguggcugagacuauguguuacgccuauaugaagcaggaagggguagaggugagagucgcgaggauauucaacacauuuggaccacggaugcauaugaaugacggccgugugguuagcaacuucauuuugcaagcacuccagggugaaccgcugaccguguacggguccggaucacagacgcgcgccuuucaguaugucagugauuuagugaacggccugguagcucucaugaauagcaacguuucuucccccgugaaucuuggcaacccugaggaacacacuauccuggaguucgcccaauugauuaaaaaucuagucgggucaggaagcgagauccaguuucugagugaagcacaggacgauccacagaagagaaaacccgacaucaagaaagcuaagcucaugcuggguugggagccuguggucccacuugaagagggccugaacaaggccauucauuacuucaggaaagaauuggaguaucaagcgaauaaccaguacauacccaagccgaaaccugcccggaucaagaaagggcgaacccgccacucuuga

SEQ ID NO: 64660 - RNA, 474 nt, Artificial Sequence
  derived and/or modified sequence opt3 from UXT__Homo_sapiens__NP_004173
auggccacacccccuaagagaagggcuguggaggcaaccggcgaaaaaguccugcgguacgagacuuucaucagcgacguucuccagcgcgaucuucgaaaggugcuggaccaccgugauaaaguauaugaacaauuggccaaguacuuacagcugagaaacgugauugagaggcuacaggaagcgaaacauuccgagcucuauaugcaggucgaccuggggugcaacuuuuucguggauacgguugugccagacaccucucggauauacgucgcucuuggauauggcuuuuuccuggaguugacacucgccgaagcacugaaguuuaucgaucgcaagucaagucugcucacugaguuaagcaauucccugaccaaagacucuaugaauauuaaggcccacauccauaugcuuuuggaaggucugagagagcuacaagggcuccagaacuucccggagaaaccccaccauuga

SEQ ID NO: 64661 - RNA, 2349 nt, Artificial Sequence
  derived and/or modified sequence opt3 from VAC14__Homo_sapiens__NP_060522
augaaccccgagaaggacuucgccccucugaccccaaauaucgugagagcucucaacgauaaacuuuacgaaaagaggaaagucgcagcccuggagauugaaaaguugguucgggaguuuguggcgcagaauaacacaguacaaauaaaacacgugauccagacuuuaagccaggaguucgcucugucccagcauccgcacucucgcaagggcgggcuaauuggacucgccgcaugcucaaucgcccuggguaaggacaguggccuuuaucugaaagaguugauugagcccguccucacguguuuuaaugaugcugacagccgacugcguuacuaugcaugcgaagcccuguacaacaucgugaagguugcuagaggggccgugcucccucauuucaaugucuuauuugauggacuguccaaacuugcggcagacccagaucccaacgugaagucuggcucggaguugcuggacaggcuacucaaagauauaguaaccgaaucaaauaaguucgaccugguuagcuuuaucccucuucugcgggagcgcauuuauaguaacaaucaauacgccagacaguucaucauuuccuggaucuuggugcucgagucugucccagauauaaaccuguuagacuaucugcccgaaauucucgauggucuuuuucagauccugggggacaauggaaaggagauuaggaaaaugugugaagugguguugggcgaguuccuaaaggaaaucaaaaagaacccuagcuccgucaaauuugcugagauggccaauauccugguuauucacugccagacaacugacgaucucauacaacugaccgcaauguguuggaugcgggaguucauccagcuugcuggccgcgugaugcugccauacucaagugggauuuugacagccguacucccgugccuggcguacgacgaucgaaagaaaagcaucaaggaaguggccaacgucuguaaccagucuuuaaugaagcuggugacccccgaggacgaugaacuagacgagcucagaccuggacagaggcaagcagaaccaacucccgaugacgcucugccuaaacaggaggguacagccuccggcgggccagauggaucaugcgacagcaguuuuucuuccggcauaagcguuuucaccgcugccucgacggagcgggcacccgugacucuucauuuggaugguauuguccaggugcugaauugucaccucucugacaccgccaucgggaugaugacacguaucgcuguacugaaguggcuuuaucaccuguacauuaaaacuccgcgcaagauguucagacauaccgacuccuuguuuccuauccuccugcaaacauuaucagaugaaagugacgagguuauucugaaagaucuagaagugcucgcggagauagcaagcucccccgccggacagaccgacgauccaggcccucuggacggccccgaucuucaggcuucucacagcgaauugcaggucccaacgcccgggagggccggacugcucaacacuucagguacaaagggccuggagugcaguccuuccaccccaacuaugaauagcuauuucuacaaguuuaugaucaacuuacugaaacgguucucuucagagcgaaaacuuuuggaagugcgcgggccguuuauuaucagacaacucugucugcuacugaaugcagagaacaucuuccauaguauggccgacauucuccugagggaagaggaucuuaaguuugcuagcacaaugguccacgccuugaauaccauacuguuaacguccaccgaacucuuccagcugcggaaccagcuuaaggaccugaaaacauuggaaucucagaaucucuuuugcugccuguaucgcucguggugucacaaccccgugacuaccguuagccuaugcuuccugacacaaaauuacagacaugcauaugaucucauccagaaguuuggagaccuggaggugacuguagauuuccuugcggaagucgacaaguuggugcagcugauugaguguccuaucuuuaccuacuuaaggcuccagcugcuugacguuaaaaacaauccauaccugauuaaggcucuauauggccuccugauguugcugccccaauccucagccuuccaguuacucagucaccgucugcagugcgugccuaacccagaacuucugcagacagaggauucuuugaaagcagcccccaagagccaaaaagcugacuccccgucaaucgauuacgccgagcuccugcagcauuucgaaaagguccagaauaagcaccuagaggugcggcaucaacgaagcgguagaggggaccaccuggauaggcgcguagugcuuuga

SEQ ID NO: 64662 - RNA, 351 nt, Artificial Sequence
  derived and/or modified sequence opt3 from VAMP1__Homo_sapiens__NP_001284367
augagcgcccccgcucagccuccagcagagggcaccgaagggacagccccgggaggugggcccccuggcccacccccuaacaugacuuccaauagaaggcugcaacagacgcaggcucagguggaggaagucguugacaucauucgggugaacguagauaaggugcucgagcgcgaccaaaaacuuucugaacuggaugaccgagcggaugccuugcaggcaggagccucacaguucgagaguagcgcugcaaaguuaaaacguaaguacugguggaaaaauugcaagaugaugauaaugcugggcgccaucugugcuauuaucgucgugguuauugugagaagggguuga

SEQ ID NO: 64663 - RNA, 351 nt, Artificial Sequence
  derived and/or modified sequence opt3 from VAMP2__Homo_sapiens__NP_055047
augagcgccaccgcugcaacagcgcccccugccgcuccagccggcgaagggggaccgcccgcaccuccacccaaccugacuuccaauagaaggcuccagcaaacgcaggcccagguggacgaggucguugauaucaugcgggugaacguagacaaggugcuugagcgcgaucagaaacugucugaauuggacgaucgagcugacgcauuacaagccggugcuucacaguucgagaccagugccgcgaagcugaaacguaaguacugguggaaaaaucuaaagaugaugauuauacucggcgucaucugcgcaauuauccugauuaucauaaucguguauuuuagcacauga

SEQ ID NO: 64664 - RNA, 423 nt, Artificial Sequence
  derived and/or modified sequence opt3 from VAMP4__Homo_sapiens__NP_001172056
augcccccuaaguucaaaagacaccugaacgacgaugacgugaccggcagcgucaaguccgagaggcggaaucuccuugaagaugacucugaugaggaagaggacuuuuuccuggggccaucaggaccgcgcuuugguccccgaaacgauaaaaucaagcauguucagaaucaaguggacgaaguaauugaugugaugcaggagaacauaacaaaagucaucgagcguggcgaaagauuggacgaguuacaggauaagagugaaagccuguccgacaaugccacugcuuucucuaacaggucgaagcagcuacggcgccaaaugugguggagagggugcaaaauuaaggcaaucauggcccucguggcggcuauucugcuucugguuaucauaaucuugauugugaugaaauacaggacguga

SEQ ID NO: 64665 - RNA, 540 nt, Artificial Sequence
  derived and/or modified sequence opt3 from VAMP7__Homo_sapiens__NP_001138621
auggccauccuguucgcuguggucgcaagaggcaccacaauucucgccaagcacgcguggugcgggggaaacuuucuugaggacuucgaaaggagccgggcuuuuaauuuccugaacgagaucaaaaagcgcuuucagacuacguacgguucccgagcccaaaccgcauugcccuaugccaugaacucugaguucucaaguguuuuagcugcacagcugaaacaucacagcgaaaauaagggccuagauaaagugauggaaacacaggcccagguagacgagcucaaggggauaauggugcguaauauugaucuggucgcucaaagaggagagaggcuugaacuguugaucgacaagacugagaaccucguggauuccucuguuaccuuuaaaacaaccucgcggaaucuggcccgcgcgauguguaugaagaaccugaaacucacuauuaucauaaucauugugucaaucgucuucauuuacaucauagugagcccuuuaugcggcgguuuuacauggccaaguuguguaaagaaauga

SEQ ID NO: 64666 - RNA, 303 nt, Artificial Sequence
  derived and/or modified sequence opt3 from VAMP8__Homo_sapiens__NP_003752
auggaggaagccagcgagggcgggggaaacgacagagugaggaaucugcaguccgaagucgaggguguuaagaacaucaugacccaaaauguggaacggauucucgcucgcggcgagaaccuugagcaucugcgaaauaaaacagaagauuuggaggcaacuucugaacacuucaagacgaccucacagaaaguagcccguaaguuuugguggaaaaacgugaagaugauagucuuaaucugcgugauuguuuucaucauuauccuguuuauagugcuauucgcgacaggggcuuuuaguuga

SEQ ID NO: 64667 - RNA, 1566 nt, Artificial Sequence
  derived and/or modified sequence opt3 from VANGL2__Homo_sapiens__NP_065068
auggacaccgagagccaguacuccggcuauucuuacaagucagggcacaguagaagcuccaggaaacaucgggaucgccgagaccgucacagaucuaagucgagggauggaggucggggcgacaaaucagugacaauccaagcccccggggaaccucugcucgauaacgagagcacucgcggagacgaaagagaugacaauuggggcgagacgaccacagucguuacugguaccagugaacauuccauuucucacgaugaccuuacaaggauagcuaaggauauggaggacagcgugccacuggauugcucccggcauuuggggguagcagccggagcgaccuuagcucugcuaucauuccucacuccgcuggccuuucuucuguugcccccucuccuguggcgcgaggaacuggagccauguggcacagcaugcgaaggccucuucaucaguguggccuuuaaauuacugauucuuuugcuggggagcugggcucuauucuuucgaagacccaaggcaucucucccuagggucuucgugcugcgggcccuucugaugguuuugguguuucuccuggucguguccuauugguuauucuacggaguacguauccuggacgcucgcgagagaucauaucaggguguugugcaguuugccgucagccucguggacgcgcuucuguucgugcacuacuuggcagucguucuacuggagcucaggcagcugcaaccacaguuuacccuuaaggugguacggaguacggauggcgccucucgauucuauaacguggggcaccuguccauucagcgcgucgcuguguggaucuuggaaaaauacuaccaugacuuucccguuuauaauccugcccuccugaacuuaccaaagagcgugcuggcuaaaaaggucucgggauucaaaguguacucucuaggcgaggaaaauuccacuaacaauucaaccggucagaguagagcaguaauagccgcggccgcaaggcggcgcgauaacagccacaaugaguauuacuaugaagaggcugagcaugaaagaaggguucguaagcggcgagccagacucguggucgcuguggaggaagccuucacacacaucaagaggcugcaagaggaagaacagaaaaacccgcgcgaggucauggacccccgggaagcagcccaggcuauuuuugcguccauggcaagagccaugcagaaguaccuuaggacuaccaaacaacagccuuaucacacaauggagucuaucuugcagcaucuggaguucuguauuacccacgauaugacgccaaaggcuuuucucgagcgcuaccuggccgcagggcccacuauccaauaccauaaagaacgauggcuugccaagcaguggacacuggugagcgaggagccuguuaccaauggauugaaagacggcauaguguuccuccugaagcggcaggauuuuucauuaguagucaguacuaagaaagugccauucuuuaagcuguccgaagaguucguugaccccaaaagccacaaguuugugaugcgucuacagucugaaacaucagucuga

SEQ ID NO: 64668 - RNA, 885 nt, Artificial Sequence
  derived and/or modified sequence opt3 from VAPA__Homo_sapiens__NP_003565
auggccagcgcuuccggcgcaauggccaagcacgagcagauccuggugcucgaucccccuaccgaccuuaaauucaaggggccauuuacagacgucguuacuacgaaccugaaauugagaaauccgucugauaggaaggugugcuucaaaguaaagaccacagcgccccggcgcuacugugugcgaccuaacucaggaauuauagacccagguaguacugucaccgugagcguuauguuacaacccuuugauuaugacccuaaugaaaaguccaaacauaaguucauggugcagacaaucuuugcuccacccaacaccucugauauggaggccgucuggaaagaagcaaagccugacgagcugauggauucgaaacuacguugcguguucgaaaugccaaaugagaacgacaagcucggcauuacuccgcccgggaaugccccuacaguaaccucaaugagcaguaucaacaauacgguugcuacuccagcauccuaccacaccaaggaugaccccagaggacugucugugcuuaaacaggagaagcagaaaaacgauauggaaccuagcaaggccgucccacugaaugcuuccaaacaagacggccccaugccgaagccucauucagugaguuugaacgacacagagacuaggaaacucauggaagaguguaagcggcugcagggugagaugaugaagcugagcgaagagaaucgccaccucagagaugaaggguuaaggcugcggaaaguggcccauucugacaagcccggauccaccucaacagcgagcuuucgcgauaacgucaccaguccacuuccuucuuugcugguugugauugcagccaucuucauaggcuuuuuccuaggcaaauuuauccucuga

SEQ ID NO: 64669 - RNA, 300 nt, Artificial Sequence
  derived and/or modified sequence opt3 from VAPB__Homo_sapiens__NP_001182606
auggccaagguggagcagguccugagccucgaaccccaacacgagcuuaaauucagaggcccuuuuaccgacguugugacaacuaaccugaaguuggggaauccaacggauaggaacguaugcuucaaagugaagaccacagcuccgcggcgcuacuguguccgacccaauuccggaaucauugacgccggugcaucuauaaacgugucaggccguagauggacugcggaugaagaggacagugcugaacagcagccucauuuuagcaucuccccaaauugggaggggaggcggcccuga

SEQ ID NO: 64670 - RNA, 2772 nt, Artificial Sequence
  derived and/or modified sequence opt3 from VARS2__Homo_sapiens__NP_001161205
augugcaucccaccuccaaacgugaccggcagccugcacauugggcaugcccucacagucgcuauacaggacgcacuuguuagauggcacaggaugcggggagaucaagugcuguggguaccggguuccgaccaugccggcaucgcgacucaggcuguggucgagaagcaguuguggaaagaacgcggggugcgacgucacgaguuaucuagagaagccuuccugagggagguuuggcaguggaaggaagcaaaaggaggcgagauuugugagcaacuacgggcccucggugcuucacuggauugggaccgcgaaugcuuuacgauggauguggggaguagcgucgcagugaccgaggccuucguaagacuuuacaaggcuggacuguuguauaggaaucaucagcucguuaacugguccugugcccugcggucugcgaucucggacauugaaguggagaaucgcccccugccuggccacacacagcuccgauuaccaggcugccccacuccugucucauuugggcugcuuuucagcguggcauuuccaguggauggagagcccgacgccgaagucguuguggguaccacaagaccugagaccuugccaggcgauguagcuguggccguccacccggacgauaguagguacacucaucugcacgggcggcagcuacgucauccccucaugggacaaccucugccacuuaucacagacuaugcagugcagccccacguuggcaccggugcugugaaagucacgccugcccacuccccagcggaugccgaaaugggggcacgccauggacugucucccuugaacgugauagcugaggacggcacuaugaccagccucuguggcgacuggcugcagggguuacacagauucguagccagggaaaagaucauguccguucugucagaguggggacucuuucggggucuucagaaucauccgauggugcugccuauuugcagucgaagcggcgaugucaucgaguacuugcuaaagaaccaaugguucgugcgcugucaggaaaugggggcuagagccgcaaaagccgucgagucuggagcucuggaacucucccccucauuucaccagaagaauuggcaacauugguucagccacauuggcgacuggugcgugaguaggcagcugugguggggucaccagaucccagcguaucuuguuguggaggaucaugcacagggggaagaggacuguuggguagucggccggucugaggccgaagcucgcgagguggccgcagaacugacaggaagaccuggcgccgaguugacucucgaaagggaucccgacguucuggauaccugguuuuccagcgcuuuauucccauuuucggcccugggguggccccaagagacaccugaccuagcacguuucuacccacucucucugcuugagaccggauccgauuugcuccuguucugggugggucggauggucaugcugggcacgcagcuuacugggcagcugccguuuucaaaaguguugcuccaccccaugguacgagacagacagggaaggaagaugaguaaaagccugggcaacguguuagauccucgcgacauaauuuccgguguugaaaugcaaguccugcaggagaagcuacggucugggaaucucgacccagcggaacuggcuaucguggccgcagcccagaagaaagauuucccccauggcauuccugagugcggaacagacgcucuuagauuuaccuuguguagccacggcgugcaggccggggaucugcaccucucagucagugagguucaauccugcaggcauuucugcaacaagaucuggaaugcacugcgcuuuaucuuaaacgcucugggagaaaaauucgugccacagcccgccgaggaacuuagcccgucuucaccuauggacgcguggauuuugagucgacucgcccuggcugcacaggagugugaacgggguuuucuaacucgugagcugagccucgugacacacgcccugcaucacuucuggcuucauaauuugugcgauguauaucuggaggcugucaagccaguguuauggcacucccccagaccucucgggcccccacagguucuguuuucuugugccgaccuuggccugagguugcucgcaccucugaugcccuuccuagcggaggaacuguggcaacgccucccaccgcggccuggaugucccccagcccccucgauaagcguggcuccuuacccauccgccugcucacuggaacacuggagacagcccgagcuugaaaggcgauuuagucgcguccaggaggugguucaaguguugcgggcacugagagcuaccuaccaguuaacgaaagccaggccucguguacuccugcagucuagcgagccgggcgaucagggucuuuucgaagcauuucuggagccacuagggacccucggcuauugcggagccgucggccuguugcccccuggggcugcggccccauccggaugggcacaagcuccccugucagacacagcccagguguacauggaauuacagggccucguggauccucagauccaacugccgcuucuggccgcucgccgguauaaguugcagaaacagcucgacagccugacugcaagaacccccucugagggugaagccgggacacagaggcaacagaagcuauccagucugcagcuugagcucagcaagcuggauaaagcggcuucucauuugcgacaacugauggacgagcccccugcccccggauccccagaauuauga

SEQ ID NO: 64671 - RNA, 3795 nt, Artificial Sequence
  derived and/or modified sequence opt3 from VARS__Homo_sapiens__NP_006286
augagcacccuguacgugagcccccacccugacgccuucccaucucucagagcucuuaucgcagccagguauggcgaggcgggggaaggaccggguuggggcggggcucauccccggauuugccugcagccuccacccacaucacgcacuccuuuuccacccccucgauugccagccuuagagcaaggaccgggcggucugugggucuggggagcaacggccguugcucagcuacucuggcccgcagggcugggcggcccugggggaagucgugccgcugugcuuguacagcagugggugagcuacgccgauaccgaacugauaccagcggcauguggugccacauugcccgcucucggccugagauccucugcccaagacccucaggcaguccugggggcucucggaagggccuuaucgccacuggaggaauggcuucgguugcacacuuaucuggcgggcgaggcccccacccuagcagaucucgcugccgugacagcucugcuucugccguuccgcuacguuuuggacccucccgccagaaggaucuggaacaaugugacccggugguuugucacuugcgugcgccagccagaguuccgagcaguacucggugaaguugugcuguauucaggggccagaccuuuaagccaucagcccggaccagaggcucccgcgcugccuaagacagcagcccaacucaaaaaggaagcuaaaaagagggagaaacuugagaaguuucagcagaagcagaaaauucaacagcagcaaccaccgcccggcgaaaagaaaccuaagccagagaaacgggaaaagcgugaucccggcgucaucaccuacgaccugccuacgccacccggggagaagaaagaugugaguggaccgaugccugacuccuauucuccacgcuacguggaagccgcaugguaccccuggugggagcagcaggguuucuuuaagccugaguauggcagacccaacgucagcgccgcuaauccacgagggguuuucaugauguguauuccucccccaaacgugacuggauccuugcaccuaggccaugcccugaccaaugcaauccaggauucacucacacgguggcaccgaaugcgcggugaaacuacccuguggaacccggggugcgaccacgcgggcauagcuacacaaguaguggucgagaaaaagcuguggagagaacagggacuuaguaggcaucaguugggccgggaggccuuucuccaggaaguguggaaauggaaggaggagaaaggggaucgcaucuaccaccaacugaagaaguuaggaagcucucuggacugggauagagcauguuucaccauggacccuaaacuauccgccgcuguuacggaagccuuugugaggcuccaugaggaagguauuaucuaucguucaacucggcuggucaauuggagcugcacacuuaacagugcaauuucugacaucgagguggauaagaaagaauugaccggccgaacucugcucuccguacccggguacaaggagaaaguugaguucggagugcuggucagcuuugcuuauaaggugcagggcucggacucugaugaagaggucgugguugccacaaccagaauagaaacgaugcuuggugacguggcgguagccguccacccaaaggauaccagguaccagcaccugaaagggaagaaugugauucaucccuucuugucccgcucacucccuaucguuuucgacgaguuuguggauauggacuucggcacaggagcugucaaaauuacuccagcacacgaucagaacgacuaugaggugggccaacggcaugggcuggaagccaucaguaucauggauagcagaggagcuuuaauuaauguacccccuccguuucugggucuaccaagguucgaggcccgcaaggcagugcucguugcgcugaaagaacgaggccuuuuucgggggauagaggacaaccccauggucgugccuuuguguaaucguuccaaggacguggucgaaccacugcucagaccccagugguacguuaggugcggagagauggcccaggcugccucugcagcugugacccgcggcgaucugcggaucuuaccugaggcccaccagagaacauggcaugcauggauggacaacauuagggaaugguguaucagccgacaacugugguggggucaccgcauaccggccuacuucgugacuguaucagaucccgcugucccaccuggggaggaccccgauggccgguauugggugaguggaagaaaugaagcggaggccagggaaaaggcagcuaaagaguuuggcguuuccccagacaagauuagccuucagcaggaugaggacguguuggauaccugguucucuucagggcucuuuccucugaguauccuaggauggcccaaccaaagcgaagaccuguccgucuucuacccaggcacacuccuggagaccggucacgauaucuuguuuuucuggguggcccguaugguuaugcuugggcugaaauuaacuggacgccucccguuucgggaaguguaucugcaugccauuguaagagacgcucacggcaggaagaugucuaaaucgcuugguaacgucaucgauccucuggacgugauuuacggcauauccuugcaggggcuccauaaucagcugcuaaacuccaaucuggaccccucagagguggaaaaggcaaaggagggacagaaagccgauuucccagcgggcauccccgagugcgggacggacgcucuccgauucggacugugugccuauaugagucaaggccgggauauuaaccuugacgucaaucgcaucuuggguuacagacacuuuugcaacaagcuguggaaugcaacaaaauucgccuuaagggggcucggaaagggcuuuguuccuucuccaaccagccagcccgguggccacgaaucccugguggaucgguggauccgaucaagacuuacugaggcuguacgccugagcaaccagggguuccaggcauaugacuuuccugccgugaccacagcgcaauacucuuucuggcuauacgaacucugcgaugucuaucuggaguguuugaaaccggugcugaauggaguugaccagguggcugccgagugcgcaaggcagaccuuauacacuugucucgaugucggccugcgucuucuguccccauuuaugcccuucgugacagaagaguuguuucagcggcucccuagaaggaugccccaagccccaccuagucugugcguuacgcccuauccagaaccuagcgaguguucuuggaaggacccggaagcugaggccgcacuagagcuggcucuuuccauuacccgcgccgugcgaucacucagagcggauuacaaccugacucggauaaggcccgacugcuucuuggaagucgccgaugaggcaacaggggcucuggccagugcuguaagcggauaugugcaggcauuagccucggccggcguuguggcuguccucgcgcugggugcaccagccccucaggggugugcuguggcccuugcauccgaccgcugcucuauccaucugcaauugcagggacucguagaccccgcccgugaacugggcaaacuacaggcuaagagaguggaggcgcagcggcaagcccagaggcugcgcgaaaggagagcagcuagcgguuacccagucaagguuccucuugaggugcaggaggccgaugaagcaaaacuccagcaaaccgaggccgaacugcggaagguggacgaggcuauugccuuguuucagaaaauguuauga

SEQ ID NO: 64672 - RNA, 1098 nt, Artificial Sequence
  derived and/or modified sequence opt3 from VASH1__Homo_sapiens__NP_055724
augcccggcgggaagaaaguggccggagguggcagcuccggggcuaccccuacaucugcagccgcgacugcuccaucaggagucagaaggcuggagacgagugaaggcaccagcgcccagcgggacgaggaaccggaggaagagggugaggaagaucuccgcgacgggggaguucccuucuuugugaaccgaggcggccuuccuguagaugaggcaacaugggaacguauguggaagcacguggccaaaauccauccagacggggagaaggucgcucaaagaauuaggggagcaacugaucugcccaaaauaccuaucccauccgugcccaccuuccagccuucuacaccaguuccggagcgguuggaagccgugcagcgcuacauuagagaguuacaguauaaucacaccgguacucaauuuuucgaaaucaagaagucgaggccccugacaggccuaauggaccucgcuaaagagaugaccaaggaagcccugccuauuaaaugccuugaggcggucauccuggggauauacuugacgaacucaaugccaacucucgagcgguuucccaucagcuucaagaccuauuuuaguggaaauuacuuccgccauauugugcugggcguaaacuuugcaggucgauauggggcccugggaauguccagaagggaagaucucauguacaaaccuccagcuuuccggacauuaucugagcugguucuugacuuugaagccgcauauggccguuguuggcacguguugaagaaggucaaacugggccagagcgugucccaugauccccacucaguggagcagaucgaauggaagcacaguguccuagacguugagcgccucgggagagaugacuucaggaaagagcuggaacggcaugcucgagauaugcgccuuaagauuggaaaagguacuggcccgccuagccccaccaaggacaggaaaaaggacgugucuuccccacagagagcccaaucaagcccucaccggcgcaauaguagaucugagaggcgucccuccggggauaagaaaacaagcgaaccaaaggcgaugcccgaccugaacggauaccagauccggguauga

SEQ ID NO: 64673 - RNA, 873 nt, Artificial Sequence
  derived and/or modified sequence opt3 from VASH2__Homo_sapiens__NP_001129946
auguggaugcacguggccaagguccaucccaaaggcggggagaugguuggagcuaucagaaacgcagccuuccuggcgaagccuagcauuccacaggugccgaauuacaggcucuccaugaccauacccgacuggcuucaagcuauccagaacuauaugaaaacacugcaguacaaucacacugguacgcaguuuuucgaaauucggaagaugcgcccuuugucuggcuuaauggagaccgccaaagaaaugacacgagagucacugccaaucaagugccuagaagcaguaauucucgggaucuaucugacuaacggacaacccaguauagagcguuuuccuaucagcuucaagaccuacuuuuccggcaauuauuuccaucacgugguccuugguauuuacuguaacgggagauauggaucucugggcaugucgaggcgggccgaguugauggauaaaccacucacauuucgcacccugucagaccugaucuucgauuuugaagacagcuacaagaaauaccuccauacugugaagaaaguuaagauuggcuuauaugugccccacgagccucacaguuuccagccaaucgaauggaagcagcugguccuuaauguguccaaaauguugagagcugauauaaggaaggagcuggagaaauacgcacgggacaugcgcaugaagauucuaaaaccggccucugcucauagccccacacagguacgauccagagggaagucacucaguccuaggcggcgucaagccagcccaccccgcagacugggaaggcgggaaaaaucuccugcgcuuccagagaagaagguugcagaucuguccaccuugaacgaaguggguuaucagauccgaauuuga

SEQ ID NO: 64674 - RNA, 1143 nt, Artificial Sequence
  derived and/or modified sequence opt3 from VASP__Homo_sapiens__NP_003361
augagcgagaccgugaucugcuccucuagagccacagucaugcuguacgacgauggcaacaagagguggcuccccgcugggacuggaccucaggcauucucacggguucaaauuuaucacaauccaacggccaacaguuuucgcgugguaggucgaaaaaugcagccggaccaacagguggucauaaauugugcgaucgugcguggcguuaaguacaaccaggcuacccccaauuuccaucaguggagagaugccaggcaagugugggggcuuaacuuuggaagcaaagaagacgcagcccaguucgcugcaggcauggccuccgcucuggaggccuuggaaggugggggaccuccacccccuccagcguuacccacauggucugucccuaauggcccaucgccggaggaaguggagcagcagaagcggcagcagcccggcccuucagagcacauugaacgcagaguaagcaacgcagggggaccacccgccccuccagcuggugggcccccgccucccccaggcccucccccacccccuggaccaccgcccccuccaggccugcccccuagugguguuccagccgcagcucauggggccggaggcgggcccccgccugcgccaccccuaccugccgcacaaggccccggagguggcggggcuggagccccaggccucgcugccgcaaucgccggugcuaaacugaggaagguguccaagcaggaggaagcgucugggggcccuacugcacccaaagccgagagcggacgguccggcgggggaggucuuauggaggaaaugaaugcuaugcuggcccgccgaagaaaggcaacccaggucggcgagaaaacaccaaaggaugaaucagccaaccaagaggaaccggaggcuagggugccugcccagagugagagcgugcggcgucccugggagaaaaauucuaccacuuugccacgcaugaaguccucaagcagugucacaaccucugaaacgcagcccugcacuccuuccagcucggacuauucugaucuccagagaguuaagcaagaacugcuggaggaagugaaaaaggagcuccagaaaguaaaggaggaaauuaucgaggcauuugugcaggaauuaaggaaacggggguccccauga

SEQ ID NO: 64675 - RNA, 1182 nt, Artificial Sequence
  derived and/or modified sequence opt3 from VAT1__Homo_sapiens__NP_006364
augagcgacgagagagaaguggccgaggcugcaaccggcgaagaugccuccucucccccuccaaagacagaggcggcuucagacccgcagcaccccgccgcaagugaaggggccgcugcagccgcugccagcccuccacugcucaggugccuuguccugacuggauucgguggcuacgauaaaguuaaguugcaaucccggcccgcggcaccuccagcccccgggccuggacaguuaacgcugcgccuacgagcuuguggccucaacuuugccgaccugauggcacgucagggucuuuaugauagacugccaccguugcccgugaccccugggauggagggagcuggcguagugaucgccgucggcgagggggugucugacaggaaagcgggagaucggguuauggugcucaaucgcucggguauguggcaggaagaggucacagugccaucaguacaaacuuuccugauucccgaagccaugaccuuugaggaggcagcugcccugcucguuaacuacauaacagcuuauaugguguuauucgacuuuggcaaucugcagccugggcauagcguccuugugcacauggccgcaggaggcguggguauggccgcuguccaguugugcagaaccguugaaaacgugacuguauucgggacagcgagugcauccaagcaugaggcccugaaagaaaauggagugacccacccaaucgauuaccauacgacugacuaugucgaugagauuaagaagaucucucccaaaggcguggacauuguuauggauccgcuaggcgggagcgacaccgcuaagggauacaaccuccugaaaccuauggguaagguggucacauauggcauggccaaucuucugacugggcccaaaaggaacuugauggcacucgcccggaccugguggaaucaguuuuccgugacagcucugcaauuacugcaggccaaccgcgcaguauguggauuccaccucggcuaccuugacggugaaguugagcuggugucaggggucguggcgcgauugcuagcucuguacaaucagggccacaucaagccacauauagauagugucuggccuuuugagaagguggccgacgcaaugaaacagaugcaagaaaagaaaaacguuggaaaggugcuccugguacccggcccagagaaagaaaauuga

SEQ ID NO: 64676 - RNA, 1260 nt, Artificial Sequence
  derived and/or modified sequence opt3 from VAT1L__Homo_sapiens__NP_065978
auggccaaggagggcguggaaaaagcugaggaaaccgagcagaugaucgaaaaggaggcagggaaagagcccgccgaaggagguggcggggacggaagccacagacugggcgaugcgcaagagaugagggcugucguucucgccgguuucgggggacuuaacaagcugcgguuguuucgcaaagcaaugccugaaccacaggacggcgaguuaaagauucgagugaaggccugcggccugaauuucauagaucuaaugguacgucaggggaacaucgacaauccgcccaaaacaccucucgugccaggauuugaguguuccgguauugucgaagcucugggcgauucugugaagggguacgagaucggagacagaguuauggcauucgugaacuauaaugccugggcugaagucgugugcacucccguagaguuuguuuacaaaauuccugaugacaugucauucagugaagccgcggcauuuccaaugaacuucgugacggccuaugucaugcuuuuugagguggcuaaucugagggagggcaugagcguguugguccauuccgccggugggggaguuggccaggcaguggcucaacucuguucuaccguacccaacgugacagucuucggcacugccucgaccuuuaagcacgaagcgaucaaagauucagugacacaucuguucgaccggaaugccgauuacguucaggaggugaagcgcauaagcgcagaaggggucgacaucgugcuggauugccucuguggagacaacaccgguaagggcuuaagucugcuuaaaccuuuggggacuuauauucuguacggauccucuaauaugguaacaggcgagaccaagagcuuuuucuccuucgcuaaaucaugguggcagguugaaaaggugaacccaaucaaacuauaugaggagaauaaggucauugccgguuuuagucuccugaaccuucuguucaaacaggggagagcuggcuugaucaggggaguggucgaaaagcucauaggccuguacaaucaaaagaaaauuaagccggugguugacagcuuaugggcccuggaggaagugaaagaggcaaugcagcggauccacgaucgcgggaacauuggaaagcucauccuugacguagagaaaacgcccacuccucugauggccaacgauucuaccgaaacauccgaggcuggugaagaggaagaggaccaugagggcgauucagaaaauaaggagcgaaugccauuuauccaguga

SEQ ID NO: 64677 - RNA, 2442 nt, Artificial Sequence
  derived and/or modified sequence opt3 from VAV1__Homo_sapiens__NP_001245136
auggagcuguggagacagugcacccacuggcucauccaauguagggugcuucccccuagccaucgggucacaugggacggcgcccagguuugcgaacuggcucaggcauugcgcgaugggguguuacugugucagcuacucaacaaucugcuuccacacgccauuaaccugcgagagguaaauuugcguccgcaaaugucccaguuccucugccugaagaacauaagaacuuuucugucuacguguugcgaaaaauucggacucaagaggucagaguuauuugaagcguucgaccuguuugaugugcaggacuucgguaaagucaucuacacccuuagugcuuugagcuggacacccauugcccagaaucggggcaucaugccuuuuccaacugaggaggaauccgugggggaugaggacauuuauucuggacugucggaucaaaucgacgauaccguugaagaggacgaggaucuauacgacuguguggaaaacgaggaagcagagggcgaugaaauauaugaggaccucaugcgcucagagcccgucagcaugccucauuuccugaagccacuucagagauuucugaaaccccaggacaucgaaauuaucuucauuaauaucgaggauuugcucagggugcacacacauuuucugaaggaaaugaaggaggccuuagguaccccuggggcugcaaaccuguaccagguauucauaaaauauaaggaacgguuucucguuuacggacgcuauugcagucaaguggaguccgccucuaaacaccuugaccgagucgcugccgcgagagaggaugugcagaugaagcuggaagaguguagccagagggcaaauaacggccgguucacuuugcgugaccuacugauggugccaaugcaacgcguccucaaauaccaucugcuucugcaggaauugguuaagcacacacaggaggccauggaaaaggagaaucucagacuggcuuuagaugccaugagggaccuggcacagugcgugaacgagguaaaacgggauaaugaaacccuacgacaaauuacgaacuuccagcucuccaucgagaaucuggaccagucacuugcucacuacggccgcccgaagauugauggggaauugaaaaucaccaguguggagagaaggagcaagauggaccgguaugccuuucugcucgauaaagcgcugcuuaucuguaagcgcagaggagacucuuacgaccugaaagauuucgucaacuugcauuccuuucaggugagggacgauucaagcggugaccgugauaacaagaaguggagucacauguuccuccugauugaggaccaaggcgcccagggguaugaauuauuuuucaaaacucgggagcugaagaaaaaguggauggaacaguuugagauggcaauaucuaauaucuaccccgaaaacgcuacagccaauggacacgauuuccagauguuuuccuucgaggagacuaccagcugcaaggcuugccaaaugcuacuccgaggcacauuuuaucaggguuacagaugucauaggugccgcgccucggcacacaaggaaugucuggggcggguuccuccaugcggaagacauggccaggacuuccccggcaccaugaagaaagauaaacuucacaggcgcgcccaggacaaaaagcgaaacgaguuggggcugccuaaaauggaaguguuucaagaguauuacggacucccacccccgccuggugcuauuggccccuuccugcgguuaaauccaggggauaucgucgaacugacgaaggcggaggcagagcagaacuggugggaaggacguaauacuucuacaaacgagauaggcugguucccuuguaauagagugaagcccuacguacaugguccaccccaggaccuuuccguucacuugugguaugccgggccuauggaaagggcuggcgccgagucaauucucgcaaaccgcagugauggaaccuuucuggugcggcaaagagucaaagacgccgcugaguucgccaucagcaucaaguacaauguggaagucaaacacauuaagaucaugacugcagagggccuauauaggauuacagagaaaaaggcguuucgagggcugaccgaacucguggaguucuaccagcagaacucccugaaggacugcuuuaaaucucuugauacgaccuugcaguucccauuuaaggaaccggagaaacgcacaauaagccggcccgcuguuggaucaacuaaguauuucgguaccgccaaagcaagauacgacuuuugugccagggaucguagugaacuguccuuaaaggagggcgacaucauuaaaauccucaauaagaaggggcaacagggaugguggcgcggcgaaaucuauggucggguggggugguucccugcuaacuacguagaggaagauuacagcgaguauugcuga

SEQ ID NO: 64678 - RNA, 2637 nt, Artificial Sequence
  derived and/or modified sequence opt3 from VAV2__Homo_sapiens__NP_001127870
auggagcaguggagacaaugcgggagguggcugaucgacuguaaggugcuucccccuaaccaccgggucguuuggccaagcgccgugguauucgaucucgcucaggcacugcgcgacggcguguuguuaugccagcugcuacauaaucucuccccgggaucuauugaucugaaagacauaaacuuucgaccccagaugucacaauuccuuugucugaagaauauccguaccuuuuugaaagucugccacgauaaguucggucucagaaacagugaacuguuugacccuuucgaucuguuugacgugagggauuucggcaaaguuauuagcgccgugucccggcucucuuuacauucgaucgcgcagaauaaggggauucgcccauuucccucagaggaaacaacugagaacgacgaugacgucuacagaagccuggaggaacuugcugaugagcacgacuugggagaagacaucuaugauugugugccuugcgaggacggcggugaugacauauacgaagauaucauuaagguagagguucagcagccaaugaucagguauaugcaaaagauggggaugacggaggacgauaagcggaauuguugccugcuagaaauucaggagaccgaagccaaauacuaucgcacacucgaggacaucgaaaagaacuacaugaguccccugcgacuugugcuguccccugcagauauggccgcugucuucauaaauuuggaggaccucauuaaagugcaucacucuuuucugagagcaaucgaugugagcgucaugguuggaggcuccacuuuagccaagguguuccuggacuuuaaggagaggcuccuuauuuauggcgaauacuguucacacauggagcaugcucagaacacccugaaucaguugcuagccagucgggaagacuuccgucaaaaaguagaggaaugcacacugaaggugcaggaugggaaauucaagcuccaggaccugcuugucgugccaaugcaacgcguucugaaauaccacuugcuccugaaggaguuacugagccauucugcggagagaccggaaaggcagcagcuaaaagaggcacucgaagccaugcaggaucuggcuauguauaucaacgaggugaagcgggacaaggaaacccuucgaaaaaucuccgaguuucaaucaagcauugagaauuugcaggucaagcuggaagaguucggacgccccaaaauagauggugaacucaaggugagaaguaucguaaaccacacuaaacaggacagguaccuguuucuuuucgauaagguugugauugucuguaagcggaaaggcuauucuuacgagcugaaggagaucauagaauugcucuuucacaaaaugacagacgauccuaugaauaacaaggacgugaaaaagucccaugggaagauguggagcuauggauucuaccugauucacuuacagggcaaacaagguuuucaguucuuuugcaagaccgaggauaugaaacgcaaguggauggaacaguucgagauggccaugucgaacaucaaaccagacaaggcaaaugcuaaccaucacucuuuucagauguauacguucgauaagacuaccaauugcaaagccuguaagauguuucugagagggacauucuaccaaggauacaugugcacuaaauguggcgucggcgcgcauaaggaaugccuagaggugauucccccuuguaaauucaccuccccagccgaccucgacgcaucaggggcuggacccgguccgaagaugguugccaugcagaacuaucacggcaauccugcucccccagggaaaccugugcugacauuucagaccggagauguacuugaguugcugaggggcgaccccgaaaguccauggugggagggucgucucguccagacgcggaaaagcggguacuuccccuccucuagcgugaagccuugcccaguugauggccgaccgcccaucucaagaccuccaaguagggaaaucgacuauacugccuaccccugguuugcaggaaacauggagcgccaacagacagauaaucuguuaaaaucccacgccagcggcaccuaucugauucgggaaagaccugcugaggcggagagguucgcaauaucuaucaaguuuaacgacgaagugaaacauauuaaggucguggagaaagauaauuggauccacaucacugaagccaagaaguucgacucacuuuuggagcucguagaauacuaucagugucauagucugaaagagagcuuuaagcaacuagauacaacccugaaauacccauacaagucccgcgagcgaucugcuucgcgggccagcucccguucacccgcaaguugcgccucuuauaacuucagcuuucucuccccgcaggggcugucauucgcuagccagggaccuucugccccauuuugguccguguucacgcccagaguuauugguaccgcagucgcgagguacaauuuugcugcccgcgacaugcgggaacuuaguuugagagagggcgauguggugaggauauauagccgaaucgggggagaccagggcugguggaaaggugaaacaaacgggcgcauuggcugguucccuucuacuuacgucgaggaggaaggaauccaauga

SEQ ID NO: 64679 - RNA, 2520 nt, Artificial Sequence
  derived and/or modified sequence opt3 from VAV3__Homo_sapiens__XP_011538805
augacccagagccuguccuaccucgccacaagagcugcacccuucaagaaagagaggacucuuuaugaccugaucucuauguacuugaaguuagaacacacgcaaucaagugugauucugggcgucagcguuuccucugggucgccugcccuacagauacuccauucacugccagugugccuucagccggcgggaggucagagccugcggaaaaaccgccacggcaguggggagucccauaccuauuugaaguuucucugucugaaaaauauccgaacauuccugacugcuugcugugaaaccuuuggaaugcguaagucugaacucuucgaggccuuugauuuauucgacguaagagauuuuggcaaggugauugagacacugagcaggcuuucccggacccccaucgcauuggccacugguauucgcccuuucccaacagaggaaucaaucaacgacgaggauauauacaaagggcugcccgaccuaaucgaugaaacccucgucgaggacgaggaagaucuguaugacugcguguacggagaggaugaaggcggcgagguuuaugaagaccuuaugaaggcugaggaggcacaccaaccuaaauguccagaaaaugauauuagaaguugcugucuggccgagaucaagcagacggaagagaaauacacugaaaccuuggagagcauugagaaguacuuuauggcuccccucaagagguuccugacagccgcggaauuugacucuguguucaucaacauaccugaguuagucaaacugcaucggaaucucaugcaggaaauucacgacuccaucgugaacaagaaugaucagaaccuuuaucaaguauuuauuaauuacaaagagcgccugguuaucuaugggcaguacugcucaggaguggaaagcgcaaucaguucuuuggacuauauuuccaagacuaaagaggaugucaagcuaaaacuggaggaauguagcaagcgagccaacaaugguaaguucacccucagagaccugcuuguggugccaaugcagaggguccugaaauaccacuugcuccugcaggaguuaguuaagcauacaaccgauccgacggaaaaagcuaaccugaagcuagcccucgacgcaaugaaagaucuggcucaauaugugaaugagguaaagcgggacaacgagacucuucgugaaauaaagcaguuccaguugucgaucgagaaucugaaccaacccgugcuccuguuuggccgcccucagggggauggagaaauuagaaucacaacccuugacaaacacacuaagcaggagaggcauauauuccuguuugauuuggccgucauugugugcaaacggaagggcgacaacuacgaaaugaaagagaucaucgaccuccagcaauacaagauugcgaauaacccaacaaccgauaaggagaauaaaaaguggucuuaugguuucuaccugauccacacgcaggggcagaacggauuagaauuuuauuguaaaaccaaggaccugaaaaagaaguggcuagagcaguucgaaauggcccucuccaauauucgacccgauuacgcagacucaaacuuucacgauuucaaaaugcauacauuuacucgcguuaccaguugcaaggugugccaaaugcugcuuagaggcacauucuaucagggcuacuuguguuuuaaaugcggggcuagggcccacaaggagugucugggacgggucgacaauugcggucgcgugaacagcggcgggcucccuaaaaugcagguaauaagaaauuauuccggaacuccacccccggcucugcaugaaggcccucccuuacagcugcaagccggugauaccguugagcuuuugaagggggacgcacacucucucuucuggcagggcaggaaccuggccagcggagaggugggcuuuuucccaucagaugcugucaaaccuugucccugcgugccaaagcccgucgacuacaguugucagccuugguacgcgggggcaauggaacgucuacaggccgagacagaacugaucaaucgggugaacuccaccuaucucguucgacauagaacuaaggagagcggagaauacgcuauuucuaucaaauauaauaacgaggccaagcacaucaaaauucugacgagggaugguuucuuucacauagcagagaaucgcaaguucaaaucacuuauggaauugguggaguacuauaagcaucacagucugaaggaaggcuuucggacauuagacaccacucuccaauucccauacaaagagccggagcauagcgccgggcagagaggaaacagggcuggcaacucccugcuuucucccaagguacuggguaucgccauugcacgcuaugauuuuugcgcgcgagacaugcgggaauugucgcuccugaaaggggacgucgugaagaucuacaccaaaaugagcgcuaauggcugguggcguggagagguuaacggcagaguggggugguucccuuccacauacgucgaagaggaugaauga

SEQ ID NO: 64680 - RNA, 1005 nt, Artificial Sequence
  derived and/or modified sequence opt3 from VAX1__Homo_sapiens__NP_001106175
auguucggcaagcccgacaaaauggaugugagaugccacagcgacgccgaggcugcaagggucuccaagaacgcccauaaagaaucucgggagucaaagggggcggaaggaaaucugccugcugccuuucucaaagagccacagggugcauucagugccagcggcgcugcagaagauuguaacaaguccaagucuaauucggccgcugacccggauuacugccgccgaauccuuguucgugacgccaaagggucaauuagagagauaauccugcccaagggauuggauuuagacaggccuaaacggacccgcacuagcuuuacagcggagcaacuguauagacuagaaauggaguuccagaggugucaguacgugguaggccgggaacgcacggagcucgcacgacagcugaaccuuagugagacccaagugaaggucugguuucagaauagaaggacaaaacagaagaaggaucaggguaaagacuccgaacugcggucugugguuagcgagacugccgcuaccugcuccguguugcgucuccuggaacaagggcgccugcucucaccacccggauuaccugcccugcuuccacccugugcaacaggcgcuuugggcagugcccugagagggccuagccuaccagcgcucggagccggugcagcugccggcucugcugccgcagccgcugcggcagccccggggcccgcuggagccgcauccccucacccacccgccgucggcggugcuccugggccaggacccgccggcccgggcgggcugcaugcaggagcgccugcugccggucacucacuuuucagccugcccgugccaaguuugcucggcucuguagcauccaggcugagcucggccccuuuaaccauggcugggucucuggccggaaaccuccaggagcuuuccgcacgguaucugucaaguagcgcuuuugaacccuacucccgaacuaauaacaaggagggcgccgagaaaaaggcguuggauuga

SEQ ID NO: 64681 - RNA, 873 nt, Artificial Sequence
  derived and/or modified sequence opt3 from VAX2__Homo_sapiens__NP_036608
augggcgacgggggagccgagagagauaggggucccgcucggcgcgcagaaagcggcgggggaggcggucgaugcggggaccguuccggagccggcgaucugagagcggacggcgggggacacucuccuaccgagguggcugguacaucagccaguagcccagcaggcuccagggaaucuggggccgauucggacggacagccgggccccggugaggcugaucauugucggcgcauccucgucagagacgcaaaggggacuauuagggaaauaguucuuccuaaaggacuggauuuggaccggccaaagcgcacgcgaaccucauucacagccgagcaauuauacagacuggagauggaauuucagaggugccaguaugugguaggccgggagcguacugaacuagcucgccagcucaaccugagcgagacccaagugaaagucugguuccagaauagaaggacaaagcagaaaaaggaucagagucgggaccuugagaagcgagccuccucuagcgcguccgaagcauuugccaccucaaacauccugcgcuugcucgagcaaggcagacugcugagugugcccagggcuccuagccucuuagcccugacuccaucucuucccggguugccugcaucccaccggggaacaucacugggugauccacgcaauagcaguccgagacuaaacccccucucuuccgcuagcgccucgccuccacugcccccuccacuucccgcgguuuguuucucuuccgccccgcuguuggaccucccugcaggcuacgaacuggggucaagugcuuuugagcccuauagcugguuagaaaggaaagugggauccgccucuagcugcaagaaagcuaauaccuga

SEQ ID NO: 64682 - RNA, 702 nt, Artificial Sequence
  derived and/or modified sequence opt3 from VBP1__Homo_sapiens__NP_001290472
augaacgugcacggcgacggggaggccggacugcaggucagaaccagccaauccaggaaucccgguggccggcgcccugggcgacagucucgugcuagaaucccaaagauggcagccguuaaagauucaugcggaaagggcgaaauggcgacagguaacgggaggcggcuccaucuuggcauuccggaggcuguguucguagaagacguggauaguuuuaugaaacagcccggaaaugagacugccgacacgguccugaagaaauuggaugaacaguaccaaaaguauaaguucauggaguuaaaccuggcacagaaaaagcgcagacuaaaaggccagauaccugagaucaagcagacccucgaaauucugaaauacaugcaaaagaagaaagagagcacaaauuccauggaaacuagguuucuucuggccgacaacuuguauuguaaggcuucugugccacccaccgauaaaguuugccucuggcugggggcaaaugugaugcuggaguacgacaucgaugaggcccaggcucucuuagaaaagaaccugucgacagccaccaaaaaucuugacucauuggaggaagaucuggacuuccuacgggaucaguuuacuacaaccgaggucaacauggcgcgcguguauaauugggacguaaagcgaagaaacaaagacgauagcacgaagaauaaggcauga

SEQ ID NO: 64683 - RNA, 1968 nt, Artificial Sequence
  derived and/or modified sequence opt3 from VCAN__Homo_sapiens__NP_001119808
auguucaucaacauuaagagcauacuguggaugugcuccacccucaucgugacacacgcccuucauaaagucaagguuggcaaaucucccccugugagagggucacugaguggaaaggugagcuugccaugucacuuuuccacuaugccgacguuacccccuucuuacaauaccucggaguuccugaggauuaaauggucaaagaucgaaguagacaagaacgguaaagaucuaaaggagacaacuguccucguggcucagaauggcaacauuaaaaucgggcaagacuauaagggacggguuagcgugccaacccaucccgaagcagucggcgaugccagucugacagugguaaaacuucuggcguccgacgcugguuuguaccgcugcgauguuauguaugggauagaggacacccaggauacugugucucucacagucgacggagugguguuucacuaccgagccgcaaccagccguuauacgcugaauuucgaagccgcucagaaggcaugucuggaugucggcgccguuaucgcuacuccugagcagcucuuugccgcguacgaggacggcuucgaacaaugcgaugcagggugguuagccgaccagaccgugagauauccaauuagggcuccccggguaggauguuacggugauaagaugggcaaagccggggugcgcacauacggauuuagauccccucaggagacuuaugacgucuacugcuauguggaccaucuggauggcgacguuuuccaccuuaccgugccaucaaaguuuacauucgaagaggcagcuaaagagugugaaaaccaggaugccagguuggcgaccgucggugagcugcaagccgcauggcggaauggguuugaccagugcgauuacggauggcuaagugacgcuagcgugcgccacccgguaacgguugcccgagcucaguguggcggcgggcuccugggagugagaacucuuuauagguucgaaaaccagacagguuuucccccuccagauucucgguucgacgccuacugcuucaagcgucccgaucgcuguaaaaugaauccuugccugaacggcgggaccugcuauccaacugagacauccuacgucuguaccugcgugcccggauacucaggcgaccaaugugaauuggauuuugacgagugccauagcaauccguguagaaacggugcaacgugcgucgacggguucaauaccuuuaggugucucugccugccuaguuaugugggcgccuuaugugagcaggauacagaaacuugcgacuacggauggcacaaguuccagggccaauguuauaaauacuuugcucaucggcgaaccugggaugcggcagagcgcgaaugcagacugcagggggcccaccucacaucuauccuuucccacgaggaacagauguucguuaacagggugggacaugacuaucaguggauuggucugaaugauaagauguuugagcacgacuuccgguggacugauggcagcaccuugcaauacgagaacuggcgccccaaccagccagacucguuuuucucugcuggggaagauugcguagucaucauauggcaugagaauggacaguggaacgacgugccuuguaauuaucaccuaacauauaccugcaagaaaggcacuguugccuguggucagcccccaguggucgaaaacgcaaagacguuugggaaaaugaagcccagauacgagauuaauucccugaucagguaccauugcaaagauggcuucauucaacgucaccucccuacaauccggugucugggaaacggccgaugggccaucccaaagauuaccugcaugaauccgucagcuuaccagagaacuuauaguaugaaguacuuuaaaaacagcuccucugccaaggacaauagcauaaacaccucaaaacacgaucauagguggagucgccgguggcaggaauccagaagguga

SEQ ID NO: 64684 - RNA, 3201 nt, Artificial Sequence
  derived and/or modified sequence opt3 from VCL__Homo_sapiens__NP_003364
augcccguguuccacaccagaacaaucgagagcauucuggaaccugucgcccagcaaauaucccaucucguuaucaugcacgaggaaggcgagguggacgggaaggcuauuccagaucuuacugcaccgguagccgcggugcaggcugccgucucuaaccuggugaggguuggaaaagaaacggugcagaccacagaggaccagaucuugaagcgggauaugcccccugcauuuauuaaagucgagaaugccugcacuaaguuagugcaagcugcacagaugcugcagucagacccauacaguguacccgcccgcgauuaucuaaucgacgguagccgaggcauacucuccgggaccucugaucugcuucugacauucgacgaagcugagguucguaaaaucauuagaguguguaagggaaucuuggaauaccucaccgucgccgaggugguggagacuauggaagaucuggucacauauaccaagaaccugggcccugguaugacgaaaauggcgaagaugauugacgagaggcagcaagaacucacucaucaggagcaccggguuauguuaguaaauucgaugaacaccgugaaagaacugcuuccaguguugaucucagcaaugaagauauuugucacaacuaaaaauagcaagaaccaggggauugaggaggcccugaagaaucgcaacuucaccguggagaaaaugagugcugagaucaaugaaauuaucagaguucuacagcucacauccugggaugaggacgccugggcaucuaaggauaccgaagcuaugaaaagggcccuggcgagcaucgacuccaaacuuaaccaagccaagggauggcugcgggaccccucagcaaguccuggcgaugcuggcgagcaggccauucgccagauauuggacgaggcugggaaggugggagaacucugcgccgguaaagagcgaagagaaauccugggcacguguaagauguuagggcaaaugacugaucaggucgcagaccugagggcccggggacagggcagcucuccaguggcuaugcagaaggcgcaacagguaucccagggucucgauguucuuacagcaaaaguggagaaugccgcucguaagcuggaagccaugaccaacucaaaacagagcauugcaaagaaaaucgacgccgcucaaaauugguuggccgauccgaacgggggacccgagggcgaggaacagauacgcggcgcacuagcggaggcuagaaagauugccgaacugugcgacgauccuaaggagagggacgauauccuccggagucugggggagaucucugcacuuacuuccaaacuggccgacuugcgacgccagggaaagggugacagcccagaagcuagagcccucgcaaaacaggucgcuacagcccugcaaaauuuacagaccaagacgaacagggcgguggccaacucgcggcccgcuaaagcagccguccaucuggagggcaagauugaacaggcucagcgcuggaucgauaauccuaccguggacgauagagggguuggacaagccgcaauuaggggccuaguggcggagggucaccgucucgccaacguaaugauggggccauaccggcaggaccugcuugcuaagugugaucgagucgaccaguugacagcccaacuggcagaucucgcugccagaggcgaaggagagucuccccaggcaagggcccuggcuucccagcuucaggacucacugaaagauuugaaggcgcgcaugcaagaggccaugacucaggaagugagugacguuuuuagcgauaccacaacuccgauaaaacuccuggcaguggcugccaccgccccucccgacgcuccaaaucgggaggaagucuucgaugagagagcagccaacuuugaaaaucacuccggcaaguuaggggcgacagcugagaaagccgcagccgugggaaccgcuaacaagucuacuguagaggguauccaggcaagcgugaagacggccagggaacugacaccucagguugucucagcggcucgcauucuacuccgaaaucccggcaaccaagccgcauaugagcauuucgaaaccaugaaaaaucaguggaucgacaacguggagaagaugacugggcugguggacgaagccaucgauaccaaaagucuuuuggacgcuuccgaggaggccauuaagaaagaucuggacaagugcaaagucgcaauggcuaauauacagccacagaugcucguugccggagcgacaagcaucgcccggcgugcaaacaggauucuguuaguggcuaagagagaaguggaaaauucugaagaucccaaguuucgcgaggccguaaaagcugcaucagacgagcugaguaagaccaucagcccuauggucauggaugccaaagccguggcuggcaacauuuccgacccaggucuucaaaagucuuucuuggauucgggguaccggauccucggcgcgguugcaaaagugagagaagccuuucagccgcaggagcccgacuucccuccacccccuccagaucuggaacaacuaaggcugacugacgagcucgcucccccgaagccuccacugcccgaaggagaggucccucccccacgaccucccccaccggaggaaaaggaugaggaauuuccugagcagaaagccggcgaagugauaaaucagcccaugaugauggcagcccgccagcuucacgacgaggcucggaaguggagcuccaaagggaacgacaucauugcggccgcaaagagaauggcuuugcugauggccgagaugucaagguuaguucguggagguaguggcacaaaacgcgcacucauccaaugugccaaggauauugcuaaggccucugacgaagugacgcggcuggcgaaagagguagcaaagcagugcaccgauaaaagaaucaggacuaaccuucugcaggucugugaacgaauaccaacaauuagcacccaguugaagauccucuccacagugaaagccacuaugcuggggcggaccaauauuucagacgaggaaagcgagcaagcuacggagaugcuagugcauaacgcccagaaucugaugcagucugucaaggaaaccguucgcgaggcugaagcagccuccaucaagauaagaacagaugcuggauucacucucaggugggugcggaaaacccccugguaucaguga

SEQ ID NO: 64685 - RNA, 2421 nt, Artificial Sequence
  derived and/or modified sequence opt3 from VCP__Homo_sapiens__NP_009057
auggccagcggcgcugacuccaagggggaugaccugucuaccgcaauccucaaacagaagaacagacccaauaggcuuauuguggaugaggccauaaacgaagacaauucagucguuagucugagccaaccuaaaauggaugaguugcaguuauuccggggagacacagugcugcuaaaggguaaaaagcgccgagaagcgguaugcaucgugcucuccgaugacacuuguucugaugagaagauucguaugaacagagucgugaggaauaaccugcggguucgccuuggcgacgugaucucgauucagccaugcccggaugucaaauacgggaagagaauccacgugcugcccauagacgauacgguagaaggaaucaccggcaauuuguuugagguuuaucucaaaccuuacuuccuggaggcuuauaggccaauucggaagggugacaucuuucuggugcgcgggggaaugcgagccgucgaguucaaagugguggaaacagaccccucaccuuacuguauugucgcaccagauacuguuauccauugcgaaggcgagcccauaaagagagaggacgaagaggaaagccucaacgaggugggcuaugaugacauugggggauguaggaagcaguuagcccaaaucaaagaaaugguagagcugccucuucggcacccagcuuuguuuaaggcaauuggugugaaaccgccccguggcauccugcuauacgggccuccaggaaccggcaagacacucaucgcccgcgcugucgccaaugagaccggugcguucuuuuuccugauuaacgggcccgaaauaaugaguaaacuugcaggagaguccgaaucuaaucugagaaaggccuuugaggaagcugagaaaaacgccccugcaaucauuuucaucgaugaguuggacgcuauagccccaaagagggaaaagacucauggcgagguggaacggcgaauuguuagccagcuccugacauuaauggauggccugaaacagcgcgcgcacgugaucgucauggccgcaaccaauagacccaacuccaucgacccggcucucaggcgguuugggcgcuucgauagagagguggacauuggaaucccugaugccacggguaggcuugaaauucugcagauacauacuaagaauaugaaauuggcugacgacguagaucuagagcaaguugccaacgagacccacggccacgugggggcagaccuggccgcucucugcucagaagcggcacugcaggccauccguaagaaaauggaucuuauugaccuggaggaugaaacaaucgacgcugaggucaugaacaguuuggccgugacuauggaugacuuucggugggcacucagccagucuaaucccuccgcccugcgagagaccgucguggaaguuccacaggugacaugggaggauaucggaggcuuagaagacguaaagagagagcugcaagagcuaguccaguauccuguggaacaucccgauaaguuccucaaauucgguaugaccccaucaaaggggguucuguuuuacggacccccuggcuguggcaaaacgcuuuuggcuaaggccauugcaaacgagugccaggcgaauuucauaagcaucaaagggccagaacugcucacuaugugguuuggagagagugaagcuaacgugagggagauuuucgacaaggcccgccaagcagccccguguguccuguuuuucgaugaacuugacucuaucgcuaaggcccgggguggcaauauuggggacggaggcggugcagcugauagagugaucaaccagauacugacagagauggacgggauguccaccaaaaagaauguauuuaucauuggcgccacuaacaggcccgauaucauugacccugcgaucuugcgcccaggacgacucgaucagcugauauacauucccuuaccugacgagaaaagccggguggccauccugaaggcuaaucuacguaaaucgccaguugcaaaggaugucgaccucgaguuccuggccaagaugacaaacggcuuuucuggggcugaucuuaccgaaauuugccagagagccuguaaauuggcaaucagggaauccauagagucagaaauccgccgggagagagagaggcaaacgaaucccagugcgauggaaguggaggaagacgauccggugccugagauucgacgcgaccacuucgaggaagccaugcgguuugcuagaaggagcgucuccgauaacgacauccguaaguaugagauguucgcccagacccugcagcagucucgcggauuugguagcuuccgguucccaucaggcaaucaagggggagcaggccccagucaggguuccgggggcggaacaggcgggagcguuuacacugaagacaacgaugacgaucucuauggauga

SEQ ID NO: 64686 - RNA, 420 nt, Artificial Sequence
  derived and/or modified sequence opt3 from VCX2__Homo_sapiens__NP_057462
augagccccaagccuagagccuccggcccaccggcuaaagcaaccgaggccgggaagaggaaaucuucaagucagcccagcccuuccgacccaaagaaaaagacaacuaagguggcgaaaaagggaaaagcuguccggcgcggucgacguggcaagaaaggggccgcaacgaagauggccgcuguuaccgcacccgaagccgagucugcuccugccgcgccaggacccucggaucaaccuucacaggaacugccacagcacgagcucccgcccgaagaaccugugagcgagggcacacagcaugacccacuuagucaagaauccgagguagaggagccccugucucaggagagcgaaguggaggaaccuuugacugucuggauggcauccuucucaccagugagugagagcaccgauuga

SEQ ID NO: 64687 - RNA, 561 nt, Artificial Sequence
  derived and/or modified sequence opt3 from VCX3A__Homo_sapiens__NP_057463
augagccccaagccuagagccuccggcccaccggcuaaagcaaccgaggccgggaagaggaaaucuucaagucagcccagcccuuccgacccaaagaaaaagacaacuaagguggcgaaaaagggaaaagcuguccggcgcggucgacguggcaagaaaggggccgcaacgaagauggccgcuguuaccgcacccgaagccgagucuggaccugcugccccaggccccucggaucaaccuucacaggaacugccacagcacgagcucccgcccgaagaaccugugagcgaggguacacagcaugacccacuuagucaagaauccgagcuggaagaacccuugucucaggagagcgaaguagaggaaccuuuaucccaggagucacagguggaggagccacugagucaagagagcgaagucgaggaaccccuaucucaggagucccagguggaggagccgcucucacaggagagcgaaguugaggaaccucugagucaagagucucagguggaggaaccccuuucccaggagagcgaaauggaggaacugccaucggucuga

SEQ ID NO: 64688 - RNA, 741 nt, Artificial Sequence
  derived and/or modified sequence opt3 from VCX3B__Homo_sapiens__NP_001001888
augagccccaagccuagagccuccggcccaccggcuaaagcaaaggaggccgggaaaaggaagucuucaagucagcccagcccuuccgaccccaaaaagaagaccacaaaaguggcgaagaaaggaaaggcuguccggcgcggucgacguggcaaaaagggggccgcaacuaagauggccgcuguuacggcaccagaagccgagucuggaccugcugccccaggccccucggaucaaccuucacaggaacugccacagcacgagcucccgcccgaagaaccugugagcgaggguacccagcaugacccacuuagucaagaauccgagcuggaagaacccuugucucaggagagcgaaguagaggaaccuuuaucccaggagucacagguggaagaaccacugagucaagagagcgaagucgaggaaccccuaucucaggagucccagguggaggagccgcucucacaggagagcgaaguugaggaaccucugagucaagagucugaaguggaggagccccuuucccaggaaagccaggucgaggaaccacugucgcaagagucugagguggaggagccuuugucccaggaaucacagguagaggaaccccucagucaggagagcgagauggaggagccacugucccaagaaucucagguugaggaaccccugagccaggagucagagauggaggaaccucucagucaggaauccgagauggaagaguuaccaagcguguga

SEQ ID NO: 64689 - RNA, 621 nt, Artificial Sequence
  derived and/or modified sequence opt3 from VCX__Homo_sapiens__NP_038480
augagccccaagccuagagccuccggcccaccggcuaaagcaaccgaggccgggaagaggaaaucuucaagucagcccagcccuuccgacccaaagaaaaagacaacuaagguggcgaaaaagggaaaagcuguccggcgcggucgacguggcaagaaaggggccgcaacgaagauggccgcuguuaccgcacccgaagccgagucugcuccugccgcgccaggacccucggaucaaccuucacaggaacugccacagcacgagcucccgcccgaagaaccugugagcgagggcacacagcaugacccacuuagucaagaagcagagcuggaagaacccuugucccaggagucugaaguagaggaaccuuuaagccaggagucccagguggaggagccacugucacaagagagugaagucgaggaaccccuaagccaggagucucagguggaggagccgcucucccaggagucagaaguugaggaaccucugagccaagagagucagguggaggaaccccuuucucaggaguccgaaauggaggaaccacugagccaagagucgcaggucgaggaaccucccucucaggaguccgaaauggaggaauugccaucaguguga

SEQ ID NO: 64690 - RNA, 378 nt, Artificial Sequence
  derived and/or modified sequence opt3 from VCY__Homo_sapiens__NP_004670
augagccccaagccuagagccuccggcccaccggcuaaagcaaaggagaccgggaaaaggaagucuucaagucagcccagcccuuccggacccaaaaagaagacaacuaaaguggccgaaaagggugaggcgguccggggcgggcgccgaggcaaaaagggagcugccacgaaaauggcagccguuaccgcuccagaagcagagucugguccugccgcuccagggcccucggaccaaccuucacaggaacugccacagcacgagcucccgcccgaggaaccugugagcgagggaacacagcaugauccacuuagucaagaauccgagcuggaggaacccuugucuaagggccguccuagcacuccauuaucccccuga

SEQ ID NO: 64691 - RNA, 852 nt, Artificial Sequence
  derived and/or modified sequence opt3 from VDAC1__Homo_sapiens__XP_005272132
auggccgugcccccuaccuacgcugaccugggcaagagcgcaagagaugucuucacaaaaggguauggauuuggucucaucaaguuagaccugaaaacuaaguccgagaacggcuuggaguucacgucuucagggagugccaauaccgaaacaacuaaaguuaccggaagccuugaaacaaaguacagguggaccgaguauggccugacuuuuacagaaaaguggaacaccgauaauacgcuagguacugagauuaccguggaggaccagcucgcgcgggggcugaaacuuacauucgauuccucuuuuucgccaaacacuggaaagaaaaaugcuaagauaaaaaccggcuacaagcgcgaacacaucaaccugggcugcgacauggauuucgacauugccgggccgucaauccgaggagcauugguacucgguuaugagggcuggcuggccggguaccaaaugaauuuugaaacagcuaagagccgugugacccagaguaacuucgcagucggauauaaaacggaugaguuucagcugcauacuaaugugaacgacggcacagaguucgguggguccauuuaccagaagguuaauaaaaagcucgaaaccgccgugaacuuagcuuggacugccggaaauucuaacacaagauuuggcaucgcggcaaaauaccaaauagaucccgacgccuguuucagcgcuaaggucaauaacuccucacugaucggccuuggguauacccagacguugaaaccuggaauuaagcugacccuaagugcccuccuggaugguaagaacgugaaugcaggcgggcacaaacuuggacugggcuuggaguuucaggcuuga

SEQ ID NO: 64692 - RNA, 930 nt, Artificial Sequence
  derived and/or modified sequence opt3 from VDAC2__Homo_sapiens__NP_001171712
augagcuggugcaacgagcugagacuccccgcccuuaagcagcacuccaucggcagggggcuggaaucucauauuaccauguguauaccuccaucauacgcugacuugggaaaagcagcccgggauaucuucaauaaggguuuuggcuucggguuagugaaacuggacgucaagacaaaaaguugcagcggaguugaguuuuccacuucuggcucgucaaacacggauaccgguaaggugacagggacucuagaaaccaaguauaaauggugugaguacggacucacauucaccgaaaaguggaauacugacaacacacugggcaccgagauugcgaucgaggaucaaauuugccagggccuuaaacugacguuugacacuaccuucagcccgaauacagggaagaaaaguggaaagaucaaguccucuuauaaacgcgaauguauaaacuuggguugcgauguagacuuugauuucgcuggccccgccauccacgggagcgcaguguuuggauacgagggcuggcucgccgguuaucagaugacuuucgacuccgcuaagucaaaacugacccgaaauaacuuugcagucggguaccguacaggagauuuccagcugcauaccaaugugaacgacggcacggaauuuggcgggaguauuuaucaaaagguuugugaggaucucgacacuagcgugaauuuagccuggacaucuggaaccaacugcacuagauucgguaucgcugccaaauaccagcuggacccuacagcguccauuucagcaaaggucaauaacagcagucuuaucggcgugggguacacccagacguugaggccaggaguaaaacugacccuaucugcccucguugauggcaaguccauaaaugcuggugggcacaaggugggccuggcccuugagcuggaagcauga

SEQ ID NO: 64693 - RNA, 1284 nt, Artificial Sequence
  derived and/or modified sequence opt3 from VDR__Homo_sapiens__NP_000367
auggaggccauggcugcaagcaccucccugcccgacccuggcgauuucgacagaaacgugccaaggaucugcggggucuguggagaucgggccacagguuuucacuucaaugcgaugacuugcgaaggcuguaagggguuuuuccgccgaucuaugaaacguaaggcucucuuuacgugcccguucaacggagacuguagaauuaccaaagauaauaggcggcauugccaggccugucgccuuaagagaugcguugacauaggcaugaugaaagaguuuauccugacagaugaagaggugcaaaggaagcgggaaaugauuuugaagcgcaaagaggaggaagcauuaaaggacucacugcgacccaaacuaagugaggaacagcagagaaucauugccauccuccuggaugcucaccauaagacuuacgacccuaccuauagcgauuucugucaguuuaggccacccguacgggugaacgacggugggggaucccacccuucucguccaaauucgcgccauacacccucauucagcggcgauaguuccucuagcugcuccgaccacuguauaaccucaagugacaugauggauucuagcuccuuuucaaaccuugaccugagcgaggaggauagugacgauccuucugucacuuuggaacucucccaacugagcaugcugccacaccucgcagacuuagugucguacucuauccagaaaguuauuggcuucgccaagaugaucccgggguuuagagaucugacauccgaggaccagauugugcuuuugaagucaagugcuaucgaagucauaaugcugaggagcaaugaguccuucaccauggaugacaugucuuggacgugcggaaaccaggauuauaaauaccgggugagcgacguaacuaaggccggucauucacuagaacucauugagccccugaucaaauuccaaguuggccuuaagaaacugaauuugcacgaggaggaacaugugcuccugauggcgauuugcaucgucaguccugaccgaccaggggugcaggaugcagccuuaaucgaagcuauucaggaccgccuguccaacacccuccagacauauauaagauguaggcaucccccuccaggaagccaccuucuguacgccaagaugauccaaaaauuggcagaucuacggucucugaaugaggaacacucaaagcaguaucgcugccucaguuuucagcccgaguguagcaugaagcugacuccgcuugugcuggaggucuucggcaacgaaauuuccuga

SEQ ID NO: 64694 - RNA, 1239 nt, Artificial Sequence
  derived and/or modified sequence opt3 from VEGFA__Homo_sapiens__NP_001020537
augaccgacagacagacagauacugcccccagcccuuccuaccaucugcucccaggcaggcggcgcacgguggacgcugcagccucucgagggcaaggaccggagcccgcgccugguggcggggucgaaggaguuggcgcucgugguguggcccuuaagcuguucguacaguuguuagggugcucaagauuuggaggcgcaguggucagggccggcgaggcugaaccaaguggggcagcccggagcgcuuccucuggacgcgaggaaccccagccugaggagggugaagaggaagaggagaaagaagaggaaagaggcccacaguggaggcugggggcccggaagcccggaucguggaccggcgaggcggcagugugugccgauucagcuccugccgcacgcgcuccacaagcccuagcgcgagccagcgguagagggggaaggguugcacggcguggcgcugaagagaguggcccgccccacuccccuucucgcagagggagcgccuccagggcuggaccaggucgggccucagagacaaugaacuuccuccugaguugggugcacuggagccuugcacuguugcucuaucugcaucacgccaaauggucucaggcugcgcccauggcagaaggcgggggacagaaucaucacgaggucgugaaguuuauggacguauaccagcgauccuauugccacccuaucgaaacucugguugauauuuuccaagaguacccagacgaaauagaguauaucuuuaaacccucaugugugccgcucaugcgcugcggcgguuguugcaacgaugagggguuagaaugugucccuaccgaggaaagcaauauuacaaugcagaucaugagaauuaagccccaucagggccagcacaucggagagaugaguuuccugcaacauaacaagugcgaauguaggccuaaaaaggaccgggcccgccaggagaaaaagucugugagaggcaaagggaagggacagaagaggaaacguaagaaaucccgguacaagagcuggucgguguaugucggugcucgaugcugucuuaugccauggucuuugcccggcccacaccccugcgggccuugcuccgagagaaggaaacaccuguuuguucaagauccacagaccuguaagugcucauguaaaaauacugacagucgcugcaaggcccggcagcuagaacucaacgagagaacauguaggugcgauaagccgcgccgauga

SEQ ID NO: 64695 - RNA, 567 nt, Artificial Sequence
  derived and/or modified sequence opt3 from VEGFB__Homo_sapiens__NP_001230662
augagcccccugcucagaaggcuucuguuggccgcuuuacugcagcuagccccugcacaagcgccagugucccagccggacgcucccggccaccagcggaaggucguuucuuggaucgauguguacacccgcgccacaugccagccucgagagguaguggucccacucacuguggaacugauggggacgguugcaaagcaacuugugcccucaugugucaccgugcagcguugcggagguuguugcccugacgauggccuggaguguguaccaacagggcagcaucagguuagaaugcaaauuuugaugauaagguaucccaguagccagcucggagaaaugucccuggaggaacacucucagugcgagugucggccuaagaaaaaggacucggccgugaaaccagauucaccgcgcccccugugcccuagauguacucagcaucaccaaaggccagacccccggaccugccgcugucgaugcagaaggcggagcuuccuccguugccagggccgcgguuuagagcugaacccugauacauguagaugcaggaaacuucggcgauga

SEQ ID NO: 64696 - RNA, 1260 nt, Artificial Sequence
  derived and/or modified sequence opt3 from VEGFC__Homo_sapiens__NP_005420
augcaccuucucggcuucuuuagcguggccugcucccuucuggcugcagccuuguuacccgggccuagagaggcgccagcugccgcagccgcuuucgaaucuggacuggaccuaucagaugcagagccggacgccggugaagcuaccgccuacgcgaguaaggaucucgaggaacagcugaggagcgucuccucuguugacgagcuuaugacagugcuguaucccgaguacuggaaaauguauaagugucaauugcggaaaggcggguggcagcauaaccgcgaacaggcaaaucucaacucgcgaacugaggaaacgaucaaguuugccgcugcccacuacaauaccgagauucugaaaucaauagauaacgaguggcguaagacacagugcaugccuagagaaguauguaucgacgugggaaaggaguucggcgucgcaacuaauaccuuuuucaaaccacccugcgugagcguuuauagguguggugggugcuguaacagugaaggacugcaaugcaugaauacauccaccucuuaccucagcaagacuuuauuugagauuacagugccucugucccagggcccaaaacccgucaccaucucauucgcuaaccauacgaguugucggugcaugagcaagcuggauguguaucgccagguacacucuauuaucagaagguccuugccugccacucugccacagugucaagcggccaauaaaaccugcccgacaaacuacauguggaauaaccauauaugccggugucuagcacaggaagacuuuauguucucaagcgaugcuggcgacgauaguacugacggguuucacgauaucugcggacccaauaaggagcucgacgaggaaaccugucagugcguuugucgcgccggucugcgaccugcuucuugcggcccacacaaggagcuugacagaaacuccugucagugcguguguaaaaauaagcuguuccccagccaaugcggggccaacagggaauuugaugagaacacaugucagugcgucugcaaacggaccuguccucguaaucagccauugaaccccggaaagugcgcaugugaaugcacggagucgccgcaaaaaugucuccugaagggcaaaaaguuccaucaccagacuugcucuuguuaccgcagaccuugcacaaauaggcagaaggccugugagcccgguuucuccuauucagaagaggugugccggugugugccaaguuacuggaaacgaccucagaugagcuga

SEQ ID NO: 64697 - RNA, 777 nt, Artificial Sequence
  derived and/or modified sequence opt3 from VENTX__Homo_sapiens__NP_055283
augagacugagcuccucucccccuaggggcccacagcaacucucaaguuucgggagcguggacuggcuuucccagucuucgugcucaggaccgacccacacaccccggccugccgauuuuagccuggguaguuugccaggccccgggcagacuuccggagcucgcgagccuccacaggcagucucuaucaaggaagccgcgggcagcuccaacuuacccgcuccugagcgaacgauggccggucugucaaaagaaccaaauacccuacgugcaccgagaguuaggacagccuucacuauggagcaagugcggacccucgaagggguauuucagcaucaccaguaccugaguccccuugagcgcaagagacuggcuagggagaugcaguugagcgaagugcaaauuaaaacaugguuccagaaccggcgcaugaagcauaaacgacagaugcaggacccucaacuccacucuccauuuuccggaucacugcaugcacccccugccuucuauagcaccaguucuggccuggcuaauggccuccaguuacuguguccaugggcgccccuuuccgggccgcaggccuugaugcugccucccgguagcuuuuggggacuaugccaagucgcacaggaggcccucgcuucggccggcgcaucuuguugcgggcagccacuggcuucccacccucccacuccaggaagacccucacuuggcccugcccugaguacagguccaaggggguugugugcgaugccgcagaccggagaugccuucuga

SEQ ID NO: 64698 - RNA, 2367 nt, Artificial Sequence
  derived and/or modified sequence opt3 from VEPH1__Homo_sapiens__NP_001161383
augcaccagcuguucagacucgugcuuggccaaaaggaccugagcagggccggggauuuguuuuccuuagacgauucugagaucgaagacucacugaccgaggcucuagaacagauuaaaauaaucaguagcuccucugauuaccagacaaacaauaacgaccaggcagucguugagauuugcaucacucggauuacgaccgccauccgcgaaacagagucgauagagaagcaugcgaaagcucucgugggacugugggauucaugucuugaacacaaucugcgacccuucgguaaggacgaggauacuccucaugccaaaaucgcaagcgacauuaugaguugcaucuugcaaaacuauaaucguccaccgguaauggcccucgcuauucccaucgcagugaaguuucugcacagaggcaacaaggaacuguguaggaauauguccaacuaccucucuuuagccgcuauaaccaaagccgaucugcuugcggaccauacagaggucauugugaagucuaucuugcaggggaauaccaugcugcuacggguucucccugcaguguaugagaaacagccacagcccauuaaccgccaccugacugaacuucuggccuugaugucccaacucgagcagccugaacaguaccaccuguuaagacugcuccaugucgcugccaagaaaaagcagcuugaggugguacaaaagugcaucccauuccugaucggacacuugaaagauucaacacauaaugacauuauacuaaacauccugauugaaaucgcaguuuaugagcccguggcucucaauaguuuucugccuaugcuuaaggagauaggcgaaagguucccauaccugaccggucagauggcccggauuuauggggcggucggacacguggacgaggaacgcgcccgaagcuguuugacguaccucgugucucagcuggcaaacauggagcacuccuuucaucacaucuuacugcuagaaaucaaaucaauuacugauaccuucagcaguauccucggcccgcaaucuagagacauuuuuaggauguccaauagcuucacagcuauagccaagcugcuuacucggcaguuggagaacaccaaagcuggcucggggcgucgcaagaucucuacagagauugaauuucccgagaaacuggaagagaccaagcucaucgucacggaaaacgaggaucaugagaagcugcagguuaaaauccaggccuucgaagacaagauuaaugcaggauccaacacuccugguucaauaagaagguacagucuuggccaagugagcaaagaggaacggaagaauauccgauuuaaccgcuccaaaucucuggccuuccacacaauguugaccaaggggguaggaagcgaugacggcgaggaugagaauagaggugacauuccagcuucaaucagucucuccgaaauugauccccuggggcagggaaacgacaaguuaccuuucaaaacugauacagagaggagccagcugggcgaaucuucagugaguuauccaaauaucauacauaucgacagcgagaaccuauccgaaaccgucaaggagaauagccaggaggaaacgcccgagaccacagcgucgccgauugaauaccaagacaaacucuaucugcaccuuaagaaaaacuugagcaaggugaaggcauacgccauggagaucggcaaaaagauuccuguucccgaucagugcacuaucgaagacaccgugcgguccugugucgcuaaacuguuuuucacaugcucacucaaggggcacuauugucuguacaguaaaucuagcuuuauauuaauuucccaggagccacagccuuggauccaaauuauguuccuguuucagcaggaucuugaccaggugcaauugcaucucgaggaaguacgcuucuuugauguuuucggauuuucagagacugccggugcauggcagugcuucauguguaauaaccccgaaaaggccaccguggucaaucaggacggccaaccacugaucgaggggaagcuaaaagaaaaacaggugagauggaaguuuauaaagagguggaaaacacguuauuucacccuggcuggaaaccagcuccuguuucagaagggcaaaagcaaggaugaccccgaugacugcccuaucgagcuuucuaagguccaauccgugaaagccguugcaaagaaacggcgagauagaaguuugccaagggcguucgagauuuucacugacaauaagacguacguguuuaaagcuaaggaugaaaagaacgccgaggaauggcugcagugcaucaacguagcagucgcccaggcuaaagagcgcgagagccgggaagugacaaccuacuuauga

SEQ ID NO: 64699 - RNA, 2340 nt, Artificial Sequence
  derived and/or modified sequence opt3 from VEZT__Homo_sapiens__NP_060069
augacccccgaguucgacgaagagguggucuuugaaaacagcccucuguaccaguaucuccaagaucuuggccacacagacuucgagaucugcuccucucugucaccaaagacugaaaaauguacgaccgaggggcagcagaagccgcccacaagaguuuugccuaaacagggaauuuuacugaagguggccgagacuauaaaaaguuggaucuuuuucagccaaugcaauaagaaggaugaccuacuccauaaacuggauauugguuuuaggcuugacucccugcacaccaucuugcagcaggaaguacuccugcaggaggauguggaacugauugagcucuuagacccaucuauccugucggcuggccaaucacagcagcaggagaacgggcaucuucccacauuguguagccuggcaaccccuaauauaugggaucuaaguaugcuguucgccuuuaucucccuccuugucaugcugccaacuugguggauugugucuagcugguugguuuggggagugauccucuucgucuaccuggugauucgggcguuacgccuguggcgaacagcuaagcuccaaguaacccuuaaaaaguauuccguucaccuggaagacauggccacgaacucacgugcauuuacuaauuuggugagaaaagcccuaaggcugauccaggagaccgaagucauaagucggggcuucacacucgugagcgcugcaugccccuuuaacaaggccggucagcauccuucucaacaccugauugggcuucgcaaggcuguguacagaacucugagggccaauuuccaggcggcacgguuggccacccucuauaugcugaaaaacuacccauuaaauuccgagucagauaacgucacaaauuauaucuguguugugccguuuaaggaacugggacuaggccucagcgaggagcagauuagugaagaggaagcucacaacuucaccgacggcuucucucugcccgcccuuaaaguauuguuucagcuguggguggcacaauccagcgaguucuuucgccgacucgcucugcuucugucgacggccaauucuccuccagggcccuugcucacuccugcgcuguuaccacauagaauccuguccgaugucacacagggacuaccccacgcccauucagcaugccucgaagaacugaagaggaguuacgaguucuaccgguauuuugaaacccagcaccagagcgugccgcaaugucuuuccaaaacucagcagaagucucgugaguugaacaauguucacacagcugugcgcagccugcagcuccaucugaaagccuuacugaacgaagucaucauucuugaggacgaauuggagaagcucgugugcaccaaggagacgcaagaacugguaucagaggcuuacccuauacuagaacagaaacugaagcucauccagccccacguucaggccaguaacaauuguugggaggaggcaauuucccaaguggacaaacugcuuagaaggaacaccgauaagaaagguaagccagaaaucgccugcgagaauccucauuguacagucgugcccuugaagcagccaacucugcacauagcugacaaagaucccauuccugaggagcaggaauuagaggcguaugucgacgauaucgacaucgauagcgacuuccggaaggaugacuuuuacuaucucucucaagaggauaaagaacgacagaagcgcgagcaugaagagucaaaaagagugcugcaggaacuuaagaguguucugggcuucaaggcaagcgaggccgagaggcagaaauggaagcaauugcucuuuuccgaccacgcugugcugaaaucucuaucgccaguagacccggucgaacccauuagcaacuccgagccuucaaugaauagugauauggggaaggugucuaaaaacgacaccgaagaggaaagcaauaaguccgccacaacugauaacgagaucucacggaccgaguaccugugcgaaaauagccucgagggaaagaacaaagacaauucuuccaacgaaguuuucccacagggcgcagaggagcgcaugugcuaucagugugaaagugaggaugaaccccaggccgacgguagcgggcugacaaccgcuccuccaacucccagagauucucuucaaccguccauuaagcagagguuggcccgucugcaguuaucaccugacuuuacguucacagcaggacucgcggcugagguggccgcacggagucugagcuuuaccacuaugcaggaacaaaccuucggcggcgaggaggaggaacagauaaucgaagagaauaaaaacgaaauugaggagaaguga

SEQ ID NO: 64700 - RNA, 1848 nt, Artificial Sequence
  derived and/or modified sequence opt3 from VGF__Homo_sapiens__XP_011514851
augaaggcccugagacucagcgcuuccgcacuuuucugccuguuguuaaucaacggccugggggccgcgcccccuggaaggccagaggcucagccgcccccucuaucuucagaacacaaagagccaguggccggugacgcaguccccggcccuaaggaugggagugccccagaaguucggggagcucgcaauagcgagccccaagacgaaggcgagcucuuucaggguguggauccucgagcacuggccgcuguacuucugcaggccuuggaccguccagcguccccgcccgcaccuucugggucgcagcaaggaccagaggaagaggccgcugaagcccuccugaccgagacagugagaucacagacucauagccugcccgcaccugagaguccagaacccgcugccccgccuaggccccagacgccagagaacggcccugaagcguccgaucccucugaggaacucgaggccuuagcaagccugcuucaggaguugcgggacuucuccccaucaagugcuaaacgccaacaggaaaccgccgcugccgagacagaaacuagaacccacacacugaccagggucaaucuagagagccccggcccugaacggguguggcgcgcaucuuggggagaguuucaggcccgaguuccagagagagcuccgcugcccccuccagcgcccucccaguuccaagcaaggaugccugauucagggccacuccccgaaacucauaaguuuggugagggcgugagcaguccgaaaacacaccuuggggaagcccuggcuccuuugucuaaggccuaccagggagucgcagccccauuccccaaggcucggcguccugaguccgcccuccugggcgguagcgaagcaggggagcgcuuacugcagcaaggacucgcucagguggaggcgggcagaaggcaggccgaagcaacccggcaggccgcugcccaagaggaacgacuugcagaccuggcuucggauuugcuacugcaguaucuccugcagggcggggcccgccagagaggacuugguggcagggggcugcaagaggcggccgaggaacgggagucugcucgcgaagaggaagaggcagagcaggaaagaaggggaggcgaggaacguguaggugaggaagacgaggaggccgcugaagccgaggcagaagcggaggaagccgagcgggcucgacagaacgccuugcucuuugcagaggaagaggauggggaagcuggcgccgaggacaaaagaucccaggaggaaacgcccggacauaggcgcaaggaggcagaaggcacugaggaagggggagaggaggaagaugacgaggaaauggacccacaaaccauugauucacugauagaguuaaguacaaaacugcaccuaccugccgacgauguugugagcaucauugaagaggucgaggaaaagcggaaaagaaagaagaaugcucccccagagccggugccucccccaagggcggcccccgcaccuacucacgugcgcuccccacagcccccuccgccagcucccgccccugcccgagacgaacucccagauuggaacgagguccugcccccuugggaccgggaagaggaugagguuuacccgcccgguccauaucauccuuuccccaauuacauccguccaagaacccuucagccucccucugcuuugaggcgccggcacuaucaucacgcacugccaccgagcagacacuacccuggcagggaagcccaggcgcgacgcgcucaagaggaagccgaggcagaggaacggagacuccaggagcaggaggaacuggaaaacuauauugagcaugugcuucugaggcgucccuga

SEQ ID NO: 64701 - RNA, 777 nt, Artificial Sequence
  derived and/or modified sequence opt3 from VGLL1__Homo_sapiens__NP_057351
auggaggaaaugaagaaaaccgccaucagacugcccaagggcaaacagaagccuauuaaaacagaguggaacuccaggugcgugcuuuucacuuacuuucaaggggacauaagcucugucguugaugaacacuucucacgggcucuuaguaauaucaagagcccacaggagcugacgccguccucucagucggaaggagugauguugaagaacgacgauucaaugagccccaaucaguggcgcuauaguuccccuuggaccaaaccacaacccgagguaccugugacaaaccgagcagccaauuguaacuuacaugucccaggucccauggcggugaaucaguuuucuccuagccuggcucguagagccuccguuaggccaggcgagcuauggcacuucucaagucucgcagggacuagcucucuggaaccgggauacucccaucccuuuccugcccggcaccuugugccagagccccagccugacggcaagcgcgaaccacuguugucacuccugcagcaagauagaugccuggcuaggccccaggagagcgcagcccgggagaacgguaauccggggcagauugcuggaaguaccggccucuuauucaaccugccucccggcucuguccauuauaaaaagcucuacgugucccgcgggagcgccucgacaucuuugccaaaugaaacccuguccgagcuagaaacuccuggaaaauauucacucacacccccaaaccacuggggucacccccaucgauaccugcagcaccuuuga

SEQ ID NO: 64702 - RNA, 432 nt, Artificial Sequence
  derived and/or modified sequence opt3 from VGLL2__Homo_sapiens__NP_703154
augagcugccuggacgugauguaccaggucuauggcccuccucaaccauacuucgccgcugcauauaccccguaccaccagaagcucgccuauuacuccaaaaugcaggaggcgcaggaauguaacgcuucucccucaaguagcggguccggaucuucgucauuuagcagucaaacacccgccuccaucaaggaggaagaggguucuccagaaaaagagagacccccugaggcagaauauauuaauuccaggugcguucuuuucacuuacuuucagggcgauauaagcucagugguagacgagcauuucagucgggcccugagccagccaucuuccuacucacccagcuguacgaguucuaaggcuccucgcuccagcgggccauggcgagcacguagauauucguugugcggagccucuuuacuguccuga

SEQ ID NO: 64703 - RNA, 981 nt, Artificial Sequence
  derived and/or modified sequence opt3 from VGLL3__Homo_sapiens__NP_057290
augagcugcgccgaggugauguaccacccccagccuuauggcgcuucccaauaccugccaaacccgauggcagccaccacaugucccacugcguauuaccagccugcuccacagcccgggcagcaaaagaaacucgccgucuucucuaagaugcaggacucacuugaaguuacgcugccuaguaaacaggaggaagaggaugaagaggaggaagaggaagagaaggaccagccagcagagauggaauauuugaauagcagaugcguguuauuuaccuacuuccaaggagauaucgguuccguaguggacgagcauuuuucuagggcccugggccaggcuauuacacuacaccccgaaucggcaauaucaaaaagcaagauggggcucacuccucuguggcgggauaguuccgcccuuucuagccagcgcaacuccuucccaaccucauuuuggacaaguagcuaucagccgcccccugcuccaugucugggaggcguccaucccgacuuccaagugaccgguccuccagggacuuuuucugccgcggaucccuccccguggccuggacacaauuugcaucagacaggccccgcaccaccucccgccguuucagagagcuggccauacccccucaccagucaggugucuccuuccuacagccacaugcacgacgucuauaugcgacaucaccauccacacgcucacaugcaucaccgucauagacaccaucaccaccaucaccauccgcccgccggcucggcacuggauccuucuuacgggccacugcucaugcccuccgugcacgcugccaggaucccugcgccacaaugcgacauuacgaagacugaacccaccacaguaacuucagccaccagugcaugggcuggagccuuccacgguacaguugauaucgugccgagcgucggcuuugacaccggguuacagcaucaggauaaauccaaggagucuccuugguauuga

SEQ ID NO: 64704 - RNA, 891 nt, Artificial Sequence
  derived and/or modified sequence opt3 from VGLL4__Homo_sapiens__NP_001121691
augcuguucaugaagauggaccuccuuaacuaccaguaucuggauaaaaugaauaacaauaucggcauuuugugcuacgagggggaagccgcuuuaagaggagagcccaggauacaaacccugccuguggcaagcgcccuauccucucaccggacagguccaccgcccaucucaccuaguaagcgcaaauuuagcauggaaccaggcgacgaggaucucgacugugauaacgaccaugucuccaagaugucucgaauuuucaauccccaccugaacaaaacugcgaauggggauugccguagagacccuagggaacggucgcgcucaccaaucgagagagcuguugcccccacgaugagccuucauggaagucaccuguauaccuccuugccuucucucggccuggagcagccacuggcacucacaaagaacagcuuagaugccuccaggccggcuggucugucacccacucuuaccccuggggaacggcagcagaaucgcccaagugugauuacaugugcaagcgccggagcucgaaacugcaauuugucucauugucccaucgcccacuccggcugcgcggcaccuggcccagccucauacagaaggcccccgagcgcugccaccacuugugacccuguaguggaggaacacuuucggcguagucuggggaagaacuauaaagagcccgagccagcaccuaauucugucuccauaacaggaagcguggaugaccauuucgcuaaggcccuaggugauaccuggcuccaaaucaaagcggccaaggacggcgcaucgucuucccccgaaucagcuagucgcagagggcagccagccagccccuccgcucacaugguuucucauagccacucaccuaguguggucuccuga

SEQ ID NO: 64705 - RNA, 642 nt, Artificial Sequence
  derived and/or modified sequence opt3 from VHL__Homo_sapiens__NP_000542
augcccagaagggccgagaacugggacgaagcugaggugggcgcagaagaggccggggucgaagaguacggaccugaggaagaugguggcgaggaaagcggggcggaggaguccggaccagaagagucuggcccggaggaacugggugcugaagaggagauggaagccgggcggccccgcccuguucuccgaucagugaauagucgugagccaagccagguaaucuucugcaacagaucccccagggugguccuuccuguguggcugaauuuugacggagaaccacaacccuauccuaccuugccaccgggcacaggccggcgcauucacucuuacagagggcauuuauggcuguucagggaugcaggaacucacgacggucuacucguuaaccagacggagcuguuugugcccucgcuuaaugucgauggccagccuauauucgccaacaucacccugccaguguauacauugaaggaacggugucuccagguaguucgcucacuggugaaacccgagaauuaccgaagacuggacauugucaggagccucuaugaggauuuagaagaccauccuaacgugcaaaaggaucuggagcggcuuacucaggaacguaucgcucaccagcgcaugggggacuga

SEQ ID NO: 64706 - RNA, 420 nt, Artificial Sequence
  derived and/or modified sequence opt3 from VHLL__Homo_sapiens__NP_001004319
augcccuggagagccggcaacggggugggacuggaggcucaggcagguacccaagaagccggcccugaggaauacugccaggaggaacucggggcggaggaggaaauggcugccagggcagccuggccaguccuucggagcguuaauucccgcgagcugucucgaaucauuauauguaaccacucaccgcguaucguguugcccguaugguuaaauuauuacggaaagcugcuaccuuaucucacacugcuuccaggcagagacuucaggauucauaacuuucggagucaccccuggcuguuccgcgaugcuagaacucaugacaaauugcucgugaaucagacggaacuguuugucccuagcuccaacgugaauggucagccaguuuucgcaaacaucacccugcaaugcauucccuga

SEQ ID NO: 64707 - RNA, 2484 nt, Artificial Sequence
  derived and/or modified sequence opt3 from VIL1__Homo_sapiens__NP_009058
augaccaagcugagcgcccaggugaaaggcucccucaacaucacaacucccgggcuucaaauuuggagaauagaggcuaugcagauggucccuguuccaucuucaacguucggaaguuucuuugacggugauugcuacaucauucuggcaauccacaagaccgccagcuccuugucuuaugacauucauuacuggaucggccaggauucgucauuagacgaacagggggcggcugccauauauacaacucaaauggaugacuuucugaaaggaagggcagugcagcaccgggagguacagggcaaugaaagcgaggccuuccgcgguuacuuuaagcaggggcuagugauccgaaaaggaggcgucgcuaguggcaugaagcauguggaaaccaacuccuaugauguucaacgucuccugcacgugaaggggaaaagaaaugucguggcaggagagguagagaugucuuggaaguccuucaacaggggugacguuuuucuucuggauuugggcaaacucauuauccaguggaaugggccggaaagcacacggauggagcgccugagaggaaugacccuggccaaggaaauuagggaccaggagcggggcggucgcacuuacgugggggucguggauggagagaacgaacucgcuucacccaaauuaauggaggugaugaaucauguccugggcaagcgaagagaacuuaaggccgcgguuccugacacagugguagagccagcauugaaagccgcucugaagcuauaucacgugagugauagcgaaggcaaccucgucgugagggagguugccacccggccccugacgcaggaccuucugucucacgaggacuguuacaucuuggaucaagggggacucaaaauauacguguggaaggguaaaaaggcaaaugaacaggagaaaaagggcgcuaugucccaugcccugaacuucauuaaggcgaaacaguauccuccaucaacucaagucgaagugcagaaugacggggccgagagcgcaguauuucagcaguuauuccaaaaguggaccgcuaguaaccguacaucuggacugggcaaaacucacaccguugguuccguggccaaggucgaacaggugaaauuugaugcuacaagcaugcaugucaagccccagguggccgcacagcaaaagaugguugacgaugggucgggcgaggugcagguauggcgcaucgagaaucucgaacuugucccuguggacucuaaauggcugggacacuucuacggcggggauugcuauuugcuacuguacaccuaucucauuggagagaagcagcacuaccugcuuuauguuuggcaggguucccaagccucacaggacgaaaucacggcuagugcguaccaggcagugauccuggaucagaaauacaacggcgagccaguccaaauuagagugccgauggggaaggaacccccucauuugaugagcauauuuaaaggaaggaugguaguguaucagggcgguacuucccggacaaauaaccucgagaccgggccaucuacucgacuguuccagguucaaggcacaggagccaacaauaccaaggcuuucgagguccccgcccgcgcaaacuuuuuaaauagcaacgacguguucgugcugaagacgcagucauguugcuaccuaugguguggcaaagggugcaguggagaugaaagagagauggccaagauggucgcugacaccaucuccaggacagaaaaacagguugugguggagggucaggagccugccaauuuuuggauggcacucggcgggaaggcgccauaugcuaacacuaaacggcugcaagaagagaaucuuguaauuacaccccgcuuguucgaauguagcaacaagaccggaagauuucuggccacugagaucccggacuucaaucaggaugaccucgaagaggaugacgucuuucugcuugaugugugggaccagguuuucuuuuggauaggcaagcacgcaaacgaggaagagaaaaaggccgcugccaccacagcacaggaauaccugaaaacccauccuucugguagggaucccgagacuccaauuaucguggucaagcaagggcacgaaccucccacguucacaggcugguuuuuggcuugggacccauucaaauggucaaauaccaagaguuaugaggaucucaaagccgagcugggaaacagccgugacuggucccagaucacugcggaagugaccucucccaagguugauguguuuaaugccaacucgaauuuaagcuccggcccucugccaauuuucccgcuagagcagcucguaaacaagcccgucgaggaacugccugaagggguggacccaucacggaaagaggagcaucuuaguaucgaagauuucacacaggcuuuuggaaugacccccgcagccuucucugcuuugccucgauggaagcaacagaaccugaaaaaggagaaaggccucuuuuga

SEQ ID NO: 64708 - RNA, 1401 nt, Artificial Sequence
  derived and/or modified sequence opt3 from VIM__Homo_sapiens__XP_011517951
augagcaccagauccgugucuucaaguagcuacaggcggauguucggcgggcccggaacagccucccgcccuucuucgucacgaagcuaugucacuacgaguacccguacauacucccuggguucugcucucagaccaagcacuuccaggucacuuuaugcaaguagcccgggcgggguuuacgccacccggucuuccgcggugcgccugagaucaagcguacccggagugagguuguuacaggacagugucgauuuuucucuggcugacgccaucaacacagaguucaagaauacccggacuaacgaaaaaguggagcuacaagaacucaaugaucgcuuugcaaacuauauugacaagguucgauuccuggagcagcagaauaaaauacuucuggccgaauuggagcagcucaagggccaagguaaauccagacugggggaucuguacgaggaagagaugagggaacuccggcgucagguggaccaguuaacaaacgauaaggcucgcgucgagguggagagagacaaucuggcagaagauaucaugaggcuucgggagaaguugcaggaagagaugcugcaacgagaagaggccgagaacacccuacagagcuuucgccaggacguagauaaugcuucgcucgccagacuggaccuugaaaggaaaguugagucucugcaggaagagauugcguucuugaagaaacuccacgaagaggagauccaagaacugcaggcacagauucaagagcagcaugugcagaucgaugucgacguguccaagccugacuuaacggccgcucugcgggaugugcgccagcaauaugaaucagucgccgcuaaaaaccuccaggaggcagaagagugguacaagaguaaguuugccgaccuuagcgaggcggccaauagaaacaaugaugcacugaggcaggcuaaacaggaauccacugaguaccgucggcaaguucagucuuugaccugcgaaguggacgcccuaaagggaacaaacgagagccuggagcgacagaugagagaaauggaggaaaauuucgcuguagaggccgcaaacuaucaggauacuauaggcaggcuccaagacgaaauccagaacaugaaagaggagauggcccgccaucugcgggaauaccaggaucuucugaaugugaagauggcuuuggacauugagaucgcgaccuauagaaaacuccuggaaggcgaggaaucaaggauuaguuuaccacugcccaacuuuuccagccuaaaucuccgcgagacaaaccuggauucucuuccuuuggucgacacccacucaaagcgaacgcugcucaucaaaacuguggagacacgggaugggcagguuauaaaugaaaccagucaacaccaugacgaccuggaguga

SEQ ID NO: 64709 - RNA, 1482 nt, Artificial Sequence
  derived and/or modified sequence opt3 from VIPAS39__Homo_sapiens__NP_001180244
augaacagaaccaagggcgacgaggaagaguacuggaauagcuccaaauucaaggccuuuacauucgaugacgaagaugacgagcugucucagcucaaagaaucaaagagggcugugaacagucuucgggauuuugucgacgaugacgaugacgaugaccuggagcgcguuagcugguccggggagcccgugggaucuaucucguggucaauucgagaaacugcagguaauagcggcaguacgcacgaggggcgugaacaauugaaauccagaaacucuuucagcuccuaugcccaguuaccuaagccaaccucaacauacagucugagcuccuuuuucaggggacggacucgcccgggcucuuuucagucacuaagcgaugcgcucagugacacccccgcuaagucuuaugccccugagcuggguagaccaaaaggggaguacagggacuauuccaaugauuggagccccucggacacaguacggcgccuucgaaagggaaaagugugcucucuggaaagauucagguccuugcaggauaagcuccaacugcuggaggaagcagucucaaugcaugacggcaacgugauaaccgccguucucaucuuuuuaaaacggacucugaguaaggagauucuuuuccgugaauuggaggugcgccaggucgcucugagacaccuaauccauuuucucaaggagauuggcgaucagaaacugcuucuggacuuguucagguuucucgaucggacagaggaacuggcauuaagccacuaccgagaacaucugaauauccaggacccugauaagcgcaaagaguuccucaagaccuguguggggcuuccauucuccgccgaagacucugcucacauacaagaucacuauacgcuguuggagagacagaucauuaucgaggccaacgacaggcaucuagaaagcgcgggacagacugagauuuuucggaaacacccccgcaaggcaucaauccugaauaugccucucguaaccacacuguucuacaguugcuuuuaccauuauacugaagccgaggguaccuucuccagcccaguuaaccuuaaaaagacauuuaagauaccggacaaacaguacgugcugaccgcuuuggccgcaagagcuaagcucagggccuggaaugaugucgacgcgcuguucacgacuaaaaacugguuaggcuauacaaagaaacgugcccccauuggguuucaccgggugguggaaauccugcacaagaauaacgcaccuguccaaauucuacaggaguacguuaaucucguggaggauguagacaccaagcugaaccuugcuacuaaauucaagugucaugauguggucaucgacacauaucgagauuugaaagacagacagcaacugcucgccuacaggucuaagguggauaaaggaucagcugaagaggaaaagaucgacgcccugcuuaguagcucccagauucgcuggaagaacuga

SEQ ID NO: 64710 - RNA, 513 nt, Artificial Sequence
  derived and/or modified sequence opt3 from VIP__Homo_sapiens__NP_003372
auggacaccagaaacaaggcccagcugcucgugcuucugacauuguuaagcguccuguucucccaaacuucugcuuggccccuauacagggcaccuucagcccuccggcugggcgaucgcaucccauuugagggggcgaaugaaccggaccagguuagucuuaaagaggauauugacaugcugcagaacgcuuuggccgaaaaugauacgcccuauuacgacgugagccgaaacgcacgucacgccgauggaguauucaccuccgacuuuucuaagcuccugggucagcugucggcuaaaaaguaucucgagucauuaaugggcaaaagagugagcaguaauauauccgaagauccugucccagugaagaggcauucugacgcaguuuucacagauaacuacacucggcugcgcaagcaaauggccgugaaaaaguaucuuaauagcaucuugaacgggaaaagauccucagagggagagagucccgacuuuccugaggaacuggaaaaguga

SEQ ID NO: 64711 - RNA, 1251 nt, Artificial Sequence
  derived and/or modified sequence opt3 from VIPR1__Homo_sapiens__NP_001238811
augaucgaggugcagcacaagcaaugccuggaagaggcccagcucgaaaacgagaccauuggcuguagcaaaaugugggacaaucuuacaugcuggcccgcuacuccuagagggcaggucguugugcuggcauguccauugauauucaaguuauuuuccucuauccagggaaggaacguaucacggaguugcacggaugaagguuggacccaucuggagccgggccccuacccuauugccugugggcuagacgauaaagcggcuagccucgacgagcaacagacaauguucuauggauccgugaagacuggcuacaccaucgguuaugggcugucucuugccacacuguuggucgcaaccgccauucucucgcuguuucgcaaacugcacugcacucgaaauuacauccauaugcaccucuucauaucauuuaucuuacgugcugcagccguguucauuaaggaucuggcucuuuuugacagcggagaaagugaucaguguuccgagggcucuguuggcugcaaggccgcgaugguguucuuucaguauugugucauggcaaacuucuuuugguugcugguggaagggcuauaccucuauacacugcuugccguuagcuucuuuuccgagagaaaauacuucuggggauacauccugauugguuggggcguaccaucaaccuucacgaugguguggacuaucgcuaggauacauuuugaggacuaugggugcugggauaccauuaauaguagcuugugguggaucauuaagggacccauccucacaucuauccuggucaacuucauuuuauuuauauguaucauucggauccugcuccaaaaacuucgcccuccagacauaagaaaguccgauucaagccccuacaguaggcuggcccggucuacuuugcuacugauuccucucuucggcgugcacuauaucauguuugcauucuuuccagacaauuucaaaccggaagugaagauggucuuugagcugguuguggguuccuuccagggguuuguaguggcuauccuuuacugcuuccugaacggagaaguccaggccgaguugcgccgaaaguggagaagguggcaccuccagggcgugcugggcuggaaucccaaauaucggcauccuagcgggggaucgaacggugcgaccugcucuacacaaguuuccauguuaacccgugugucaccaggcgcccgcagaaguagcuccuuucaggcagaagucucucugguguga

SEQ ID NO: 64712 - RNA, 1077 nt, Artificial Sequence
  derived and/or modified sequence opt3 from VIPR2__Homo_sapiens__NP_001291451
augagaacccugcuucccccugcccuccugacaugcugguuguuagcuccagugaacagcauccacccggaguguagguuccaucuggaaauucaggaggaagagacuaagugcgcagaacuacuccggucccaaacggagaaacacaaggccuguucuggcgucugggacaauauaaccugcuggcgccccgcgaacguuggggagacagugacuguaccuuguccaaaaguguuuucaaauuucuacaguaaggcuggaaacaucagcaaaaauugcaccuccgaugguuggucugaaacauuucccgacuucgucgaugccuguggcuauucggacccugaggaugaaucaaagguggggugcaagcugagccuuguuuuucugcaguacuguauuauggcaaacuucuuuugguugcucguggagggacuguaucugcauacccucuuagucgccaugcugccaccccgacguugcuuccuugcuuacuugcugaucggcuggggucuaccuacuguguguauuggggcauggacagccgcuagacucuaucuggaggacaccggaugcugggauacgaaugaccacaguguaccaugguggguuaucaggauaccgauccuuauuuccaucauugugaacuuuguccuguucaucucuauaauucggaucuugcuccagaaacugacuagccccgaugugggcggcaaugaccagucccaauacaagcgcuuagccaaaucaacccugcuccuuauuccucuguuuggggugcauuauauggucuucgcgguuuuuccaaucaguaucagcucuaaguaccagauuuuguucgaacuaugccugggauccuuccagggucucgugguagcagugcuguacuguuuucuuaacucagagguccagugcgaacugaaaagaaaguggaggagccggugucccacaccuagugccucucgcgauuaucgagugugcggcuccagcuucucgagaaaugggucugagggagcuuugcaauuucacaggggcucccgggcccagucauuccuccagacugaaaccaguguuauauga

SEQ ID NO: 64713 - RNA, 2037 nt, Artificial Sequence
  derived and/or modified sequence opt3 from VIT__Homo_sapiens__NP_001171440
augagaaccgugguccugacaaugaaggccagcguuaucgagauguuccucgugcuucugguaacuggcgugcacuccaacaaagaaacggcuaagaaaauuaagaggcccaaauuuaccgucccucagauaaauugcgacgugaaggcagggaagaucauugauccagaguucaucguuaaauguccggccggaugccaagaccccaaguaccauguguaugguacagaugucuacgcgucuuauucaaguguguguggcgcugccguacacagcgggguuuuggacaacuccggaggcaaaauuuuagugcggaaggucgcaggucagucuggguacaaaggaucguauucaaauggcgugcagagccugagucuaccucgcuggcgagaauccuuuaucgugcucgagucuaagccaaagaaaggcgucacuuaccccagcgcccugaccuauuccucaaguaagagcccugcugcacaggccggggaaacaaccaaggcuuaccaacguccacccauaccuggaacuacagcccagccaguuacccuuaugcagcuguuggcggugacgguagcaguggccacuccgaccacacuccccagaccuucuccauccgcugccucaacuaccagcauccccaggccucagagugucggucaucggucucaagagauggaucugugguccacagcaaccuacacgagcucgcagaaccgcccaagagcugaccccggcauucagaggcaggauccgucuggggccgcguuccaaaaaccugugggagccgacguuucccugggccucgugcccaaagaggaauuaucaacucagagucuggagccagucagccuuggugauccuaauugcaagaucgacuuguccuuucugauugaugggucuacaagcaucggaaaacggcgcuuccgaauacagaagcaacuacucgcagacguggcucaggcccuggauauuggccccgcuggcccacuuauggggguaguucaguauggagacaaccccgccacccacuuuaaucugaagacucauacaaacucaagagacuugaaaaccgcaaucgaaaagauuacgcagagggguggccucaguaauguggggcgggccaucuccuucgucaccaaaaacuuuuucagcaaggcuaauggaaaccguucuggcgcgccuaauguggucgugguuaugguggaugguuggccaacagacaaaguagaggaggcaucacgccuggccagagaaagugggaucaacauuuucuucauaacuaucgagggcgcugccgaaaaugagaagcaauacgucguggaaccgaacuuugcaaacaaggccguuuguaggaccaauggauucuauagcuuacacgugcaguccugguucggccugcacaaaacacuccagccccuugucaagcgggugugcgauacugaccgacuggcuuguucuaaaaccugcuugaacucggccgauauuggguuuguaaucgacggaagcuccucaguggguacaggcaauuuccgcaccguucuacaguuugucacuaaccugacgaaggaguucgagauaagugauacagacaccagaauuggggcagugcaauacacuuaugaacagaggcucgaguuuggauucgauaaauacucuagcaagccugacauccugaaugcgaucaagcgggugggcuauugguccggugggaccucaacaggcgcugccauuaacuuugcacuugaacagcuguucaaaaagagcaaaccaaauaagcgcaaauugaugauccucauuaccgauggaagaucuuacgacgacgucaggauacccgccauggcugcccaucugaagggcguuaucacuuacgcaauugggguggcuugggccgcgcaggaggaauuagaggugaucgccacacacccugcucgugaucauuccuuuuucguagacgaguuugauaaccugcaccaauaugucccacggaucauucagaauauauguacggaauuuaacagucagccccgaaauuga

SEQ ID NO: 64714 - RNA, 492 nt, Artificial Sequence
  derived and/or modified sequence opt3 from VKORC1__Homo_sapiens__NP_076869
augggcagcaccugggggucccccggaugggugagacuggcccucugccuuacaggucuggucuugucuuuauacgcucugcacguuaaggcagccagggcgcgggaccgcgauuaucgagcucuaugugacgugggcacugccaucucaugcagucguguauucagcuccagaugggggaggggauuuggccucguggagcauguccugggucaggauucuauucuuaaccaaucaaauucgauauucggguguaucuuuuacacgcugcaguugcuccugggaugccugcggacccgcugggcaagcgugcucauguuacugaguucccuuguuucuuuggccggcagcguguaucuggcuuggauucuauucuuuguccucuacgacuucuguaucgugugcauuacaacuuaugcaaucaacguaucccugauguggcuuucauuuagaaaaguucaggaaccucagggcaaggccaaaaggcacuga

SEQ ID NO: 64715 - RNA, 2538 nt, Artificial Sequence
  derived and/or modified sequence opt3 from VLDLR__Homo_sapiens__NP_001018066
augggcaccagcgcccugugggcucucuggcuucuguuggcauuaugcugggcccccagagaguccggggcgacaggaacugguaggaaggcuaaaugugaaccuucucaguuccaaugcacgaacggccgguguaucacccugcuauggaagugcgacggggaugaggacuguguggauggaucagacgagaaaaauugcgucaagaaaacaugugccgaaagugauuuuguuugcaacaauggccagugugugccaagccgcuggaagugcgacggugauccggacugugaagauggguccgacgagucucccgagcagugccacaugcgaacuugccguauucaugaaauaucguguggagcacacucaacccagugcaucccuguaagcuggagaugugauggcgagaacgacugcgauaguggcgaagacgaggagaauugugggaacauuacaugcuccccagacgaguucaccuguucuagcggaaggugcaucucccggaauuuuguguguaacggucaagaugacugcucagauggcagugacgaacucgauugugcucccccuacuugcggggcccaugaguuccagugcagcacaucuuccuguauuccaaucucaugggucugcgacgaugacgcagauuguagcgaccagagugaugaaucucuggaacagugcggacgccaacccgugauacacaccaaguguccugccuccgagauccagugcggcagcggugaguguauucauaaaaaguggagaugcgacggggacccagauuguaaagacggaucggaugaaguuaauugcccgucuaggacgugucggcccgaccaguuugagugcgaagauggcuccugcauccacggcucacgccaguguaacgggauucgagacugcguggauggaagugacgaggucaauuguaagaacgugaaucaaugccuugguccuggcaaauucaaguguagaagcggggaaugcaucgauauauccaagguauguaaccaggagcaggacugcagggauuggucugacgagccacugaaagaaugucacauuaaugagugcuugguuaacaacggaggcuguagccauaucugcaaggaucucgugauugguuacgaaugcgacugugcugccggguuugagcugaucgaccggaaaacuugcggcgauaucgacgaaugucaaaaucccggaauuugcucacagauauguaucaaccugaagggcggguauaaaugcgaguguagucguggauaccagauggaucucgcgaccggugucugcaaggcagugggcaaagagccuuccuuaauuuucacaaaucgcagagacaucaggaagauagggcuggaacggaaggaguauauucagcuuguggaacaauugcgaaacacugucgcccuggaugcugacaucgccgcacagaaacuauuuugggcugaucucagccagaaggccaucuucucugcgucaauugacgauaaaguuggacgccacgugaagaugaucgacaauguauacaacccagccgcaauugcuguggauugggucuauaaaaccauauacuggacagacgccgcuaguaagaccaucagcguggccacgcuggauggcacuaagagaaaauuucuuuucaauuccgaccugagggagcccgcaucuauugccguugacccguugucggguuuuguguauuggagcgauuggggcgagccugcuaagaucgaaaaagcggggaugaacggauucgaccggcgcccccucgucacagcagauauccaguggccaaauggcauuacccuggacuuaauaaaguccagacuguacuggcucgauucaaaacuucauaugcugaguucuguggacuugaacgggcaagauaggcguaucguacuaaagagccuggaguuccucgcccacccucuggcucuuacuauuuuugaagaccggguuuacuggaucgauggagagaaugaagccguguauggugcaaacaaguucacaggcuccgagcuggccaccuuggucaauaaccucaaugacgcucaggauauuaucguguaccacgagcugguccagcccucagggaaaaacuggugugaagaggacauggaaaacggaggcugcgaguauuuaugucugccagcaccccagauaaaugaccauagcccuaaguacacgugcucuugcccauccgguuauaacguggaagagaaugggcgagauugucaaagaaucaacguuaccacagccgugagugagguaagcgucccgcccaaaggcacuucugcggcuugggccauucuaccucuccugcuuuuggugauggcagccguuggaggcuaccugauguggaggaauuggcagcacaagaacaugaaauccaugaauuuugacaacccaguguaucucaagaccacagaagaggaucugucaaucgacauugggcgccauagugcuagcgucggacacacuuaccccgccaucucggugguauccaccgaugacgaucuugcauga

SEQ ID NO: 64716 - RNA, 306 nt, Artificial Sequence
  derived and/or modified sequence opt3 from VMA21__Homo_sapiens__NP_001017980
auggagagacccgacaaggccgcucugaacgcacuccagccuccagaguucaggaaugaaagcucccuugccucuacccugaaaacauuguuauuuuucacugcgcugaugaucacggugccgauuggccuauacuuuaccacaaagucauauauauucgaaggggcucucggaaugaguaaccgggauagcuacuuuuaugccgcaaucgucgccguuguggcuguacacgugguccuggcacuuuucguguacguugccuggaaugaggguucccgccaauggcgagaaggcaaacaggacuga

SEQ ID NO: 64717 - RNA, 345 nt, Artificial Sequence
  derived and/or modified sequence opt3 from VMO1__Homo_sapiens__NP_001138411
auggagagaggcgccggggcuaagcugcucccccuucuguuguuacugagggcaaccggauucacaugcgcccagacugacggucggaacggcuacacggcggugaucgaagucaccagcgggggaccuuggggcgauugggcuuggccagagauguguccggacggauuuuucgccuccggguuuucucuaaaaguugaacccccucaagguauuccaggcgaugacacagcacucaauggcauacgccugcacugcgcccgagggaacgugcuuggaaauacucauguaguggagucacagaguggucguuggggcgcuggggucgaagauccccugggauga

SEQ ID NO: 64718 - RNA, 1221 nt, Artificial Sequence
  derived and/or modified sequence opt3 from VMP1__Homo_sapiens__NP_112200
auggccgagaacggcaagaauugcgaccagagaaggguggcuaugaacaaagaacaccauaaugggaacuucaccgaucccagcuccgucaaugagaagaaacggcgcgaacgagaggaacgucaaaacauuguucuguggagacagccucucauuacacuucaguacuuuucucuggagauauuggugaucuuaaaggaguggacuucaaaacuguggcacaggcagaguauuguagugagcuuccuacuccugcuugcaguccugaucgccacguauuacguggaaggaguucaucaacaguaugugcagcggauugagaagcaguuuuugcucuacgcguauuggaucggucugggcauacuguccucugucgggcucggaaccggcuuacacacauuccugcuuuacuuggguccacauaucgcuucggugacucuggccgcauaugaauguaauucaguaaacuuuccggagcccccuuacccagaccaaauuaucugccccgaugaggaagggaccgagggaacaauuagccuauggaguaucauauccaagguucgcauugaagccuguauguggggcaucggcaccgcuauuggggagcucccuccauacuucauggcaagagccgcuaggcugucuggagccgaacccgacgaugaggaguaucaggaauuugaggaaaugcuugagcacgcggaaagcgcacaggacuucgccucccgggcuaaacuggccgugcagaaguugguccaaaaagugggcuuuuucgguauccucgcaugcgcuucaaucccuaauccacuguuugauuuagccgggauuacuuguggacacuuccuggugccguuuuggacauucuucggcgcgacccucauagguaaggccaucauuaaaaugcauauccagaagauauuugucauuaucacguucaguaagcacaucguugagcagaugguggcauuuauuggggcuguacccggaaucggcccuagccuucaaaaaccauuccaggaguaccuggaagcccagcgccagaaguugcaucacaaaucugagaugggcacuccccaaggggaaaacuggcuauccuggauguuugagaagcugguggucgugaugguuugcuauuucauucucucaauaaucaauagcauggcucagaguuacgccaaacgaauccagcagagacugaacucugaagagaagaccaaauga

SEQ ID NO: 64719 - RNA, 1188 nt, Artificial Sequence
  derived and/or modified sequence opt3 from VN1R2__Homo_sapiens__NP_776255
augacccacacacuguaccccacuccuuucgcccucuauccaaucaacauuagcgcugcauggcaucuuggcccgcugcccguguccugcuuugucucuaauaaguaccaguguucauuggccuucggggcgacgaccggauuaagaguucuggugguaguggucccucaaacacagcuaaguuuucucagcucccugugccuugugucucuguucuugcacucgcucguuucagcucauggugagaaaccaacuaagcccgugggccuggacccuacccuguuucaggucgugguagggauacucggaaacuucagcuuacuguauuacuauauguuucuuuacuucaggggcuauaaaccacggaguacagauuugauccugcgccaccuaaccguugccgacucccucgugauucugucuaagcgaauccccgaaacuauggcaacauuuggucuuaaacauuucgauaauuacuuuggguguaaguuccuguuguacgcccaccgugucggaagaggcgugagcauuggcucaaccugccuccuguccguguuucaggucaucacgauaaacccuaggaauagucggugggcugagaugaagguuaaagcaccaacuuauaucggguuaagcaacauucuguguugggccuuccacaugcucgugaaugcuaucuucccgauuuacaccacaggaaaguggucuaacaauaacaucacuaaaaagggugaccuuggcuauugcuccgcgccccugucagaugaaguaaccaaaagcguguacgccgcauugacaaguuuucaugacguccuaugucuggggcucaugcugugggccucuuccagcauagugcuuguucuguaucgccacaagcaacaggugcagcauauuugcagaaauaacuuguacccuaauucgucuccaggaaacagggcuauccaguccauucucgcccuggucucaaccuucgcauuauguuaugcucugaguuuuaucacguacguguaccuagcccucuucgauaauagcuccugguggcugguaaacacugcggcccuuaucauugcaugcuuucccacaauaucuccuuucguuuugaugugucgggacccaagccgcucacgacugugcaguaucugcuguagaaggaaccggcgcuuuuuccacgauuuucguaagauguga

SEQ ID NO: 64720 - RNA, 906 nt, Artificial Sequence
  derived and/or modified sequence opt3 from VN1R4__Homo_sapiens__NP_776256
auggccagcagauacguggcugucggcaugauccugucccagaccguuguggggguacucggaucuuucucagugcuucugcacuauuugaguuuuuacugcacagguuguagguuacggagcacugaccugauugucaagcaucuaauaguggcaaacuuccucgcccugcgcugcaaaggcguuccccaaacgauggcggcuuuuggggugcgauauuuccuuaaugcccugggauguaaguuggucuuuuaccuccaccgugugggcagagguguauccaucgggaccacaugccugcugucuguuuuccaggugauuacugucucgucaaggaaaagccggugggcaaagcucaaagagaaggccccuaagcaugugggauuuaguguguuacuguguuggaucgucugcaugcuuguuaacauuaucuucccaauguaugugaccggcaaauggaauuacacaaacauaaccguaaaugaagauuugggcuauuguuccgggggagguaacaauaagaucgcucagacucugcgcgcaaugcuacucucuuuuccggacgugcugugccuuggccugauguugugggucagcuccucaaugguguguauucuccacagacauaaacagaggguucaacacaucgaucggaguaaccugagcccccgcgccucuccugagaaucgagcuacacaguccauuuuaauccuggugucaaccuucgucagcaguuacacgcucucuugccuuuuucagguguguauggcccuguuggacaacccaaauucccuacugguaaacacuagcgcgcucaugucgguuugcuuccccacccugucuccuuuugugcuuauguccugcgauccaucagucuacagauucuguuucgcauggaagagguga

SEQ ID NO: 64721 - RNA, 1542 nt, Artificial Sequence
  derived and/or modified sequence opt3 from VNN1__Homo_sapiens__NP_004657
augaccacacagcugcccgccuacguggcuauccuccuuuucuaugucagcagagcauccugccaagacacuuuuacggccgcgguuuacgagcacgcugccauucugccuaacgcaaccuugacaccagugucuagggaagaggccuuagcucugaugaaucggaaccuagauauacucgaaggcgcaaucacuucagccgcugaccagggggcccauauuaucguaaccccggaggaugcgauuuauggauggaauuucaaccgcgacagucuguaccccuaucuugaagauaucccugacccagaggugaauuggauacccuguaacaaucgaaaccguuuuggucagacaccuguccaggagagacugagcugcuuggcaaagaauaacuccaucuacgugguugccaauauuggcgauaaaaagccaugugacaccucugauccccaaugcccuccagacgggagguaucaguacaacacugauguggucuucgacucgcagggaaaacucguggcucgguaccacaagcagaaucuguuuaugggcgaaaaccaauucaauguaccgaaagagcccgaaaucguuacauuuaacaccacguucgguucauuugggauuuucacuuguuuugauauccuguuccaugacccugccgugacccucgucaaggacuuucacguggauacaauaguguucccaacugcauggaugaacgucuuaccccaucugagcgcuguugaguuccacagugccugggcgaugggaaugcgcgugaauuuucuugccuccaacauucacuauccuucuaagaaaaugaccggcagcggcaucuacgcaccaaauuccucaagagcuuuccauuaugacaugaagacagaggaagggaaauugcugcuaagucagcucgauagccaccccucucauuccgccguagugaacuggaccucauacgcuagcaguauugaggcccugucuuccggaaauaaggaauuuaaagguacggucuucuuugacgaguucacuuuugugaaacuuacaggcguugcagggaacuauaccgugugccagaaggaucuguguugccacuugagcuacaagaugucggaaaauaucccgaacgaggucuaugcccucggagcuuucgacggccugcacacuguggaggguagguacuacuuacagaucuguacacugcucaagugcaaaaccacgaaucuuaacaccuguggggauucugcggaaacagcauccacucgguuugagauguucucacugaguggaaccuuuggcacacaauauguauucccugaaguuuugcuaagcgagaaucagcuggcccccggcgaauuucagguguccacugacgggcgccucuucucucugaagccaaccagcggaccuguccuuacagugacccuguucggucgauuguacgagaaagauugggcuucaaacgccaguuccggccucacugcacaagccagaauuauaaugcugaucgucauugcucccaucgugugcagcuuaucuugguga

SEQ ID NO: 64722 - RNA, 900 nt, Artificial Sequence
  derived and/or modified sequence opt3 from VNN2__Homo_sapiens__NP_001229279
auggugaccagcuccuuccccaucucugucgccguuuuugcucugauuacacuccaggugggcacucaagacucauucauagcagccguauacgagcacgcggugauccuuccuaacaagacggaaaccccagucagucaggaggaugcucugaauuugaugaacgaaaauauugacaucuuagagacagccauuaaacaggcagccgaacagggggcuagaaucauagugacuccggaggaugcacuguauggauggaaguuuaccagggagacaguuuuccccuaccuagaagacaucccugauccacaagugaacuggauucccugccaggacccucaucgguuuggucacaccccaguccaggcccgccucagcugucuggcuaaagauaauuccaucuaugugcuugccaaccugggcgacaagaaacccugcaauucucgagauucgacuuguccuccaaacggguacuuccaguauaauacaaacguaguuuacaauaccgagggaaaguugguggcgcguuaucauaaggucugcacgaugcucaaauguaagacuaccaaccugacaacuugcggcagaccgguggaaaccgcaucaacaagguuugagauguucagccugagugguaccuuugggacggaguacguguuccccgaaguccucuuaacugagauucaccuguccccuggaaaauuugaaguucuuaaggacggccgguuggugaauaaaaacggcucuagcgggccaauccugacaguaucccuauucggacgcugguacaccaaggauucacucuauaguagcugugguacuucuaauuccgccauaacauaccugcuuauuuuuauccuguugaugauuaucgcucuccaaaacaucgugaugcuguga

SEQ ID NO: 64723 - RNA, 732 nt, Artificial Sequence
  derived and/or modified sequence opt3 from VNN3__Homo_sapiens__NP_001278632
augggcgugaaccugcucgccgcuaauacccacaacacaagcaugcauaugacuggguccggaaucuacgcacccgaggccgucaagguuuaucacuacgacauggaaacggagucuggucagcuucuguugucagaauuaaaaaguagaccuaggcgggagccaaccuauccggcggcuguggacuggcaugccuacgcaagcuccguaaagcccuucucuucggaacaaucagacuuucugggcaugauuuauuucgaugaguuuacauucacuaaacuaaagcgcaauaccgggaacuacacagccugccagaaagaccucuguugccaccugaccuauaagaugagcgagaagcgaacugaugaaauauacgcucuuggagcauuugacggccugcauacaguggagggucaguacuauuugcagaucugugcccuccugaaaugccaaaccacggaucuggaaacuuguggggagccugucggaagugcuuucaccaaguuugaggacuucucccucucuggcacauuuggcacucguuacguguucccacagauuaucuuaagcgggucccagcuggcccccgaaagacacuaugagauuucaagggauggacggcuucgcaguagaagcggugcgccuuugccaguucuggugauggcacuauacggcagggucuuugaaaaagaucccccucggcucgggcagggaucuggcaaguuccaauga

SEQ ID NO: 64724 - RNA, 510 nt, Artificial Sequence
  derived and/or modified sequence opt3 from VOPP1__Homo_sapiens__NP_001271212
augcugagcgagacccucggcuaccuuuccucugugcuguugcagugcacagaggccaagaaacacuguugguauuucgagggguuauaccccacuuauuacaucugcagaucauaugaagacuguugcggaaguagguguugcguccgggcucugagcauucaacgccuaugguacuuuugguuccuccugaugauggguguucuguuuuguugcggcgcaggguucuuuauacgacguagaauguauccuccaccgcuuaucgaggaacccgccuucaacguguccuacacgaggcagccuccaaaucccggaccuggcgcgcagcagccaggucccccuuacuauaccgauccagggggaccgggcaugaaccccguaggcaauucuauggcuauggccuuucaagugccuccaaacucgccccaggggucagucgcauguccuccacccccggccuacugcaauacaccucccccaccuuaugaacaggugguuaaggcuaaauga

SEQ ID NO: 64725 - RNA, 4524 nt, Artificial Sequence
  derived and/or modified sequence opt3 from VPRBP__Homo_sapiens__NP_055518
augaccacaguggucguucacguggacagcaaggccgagcugacuacgcuccuugaacagugggagaaagaacauggcuccgggcaagauaugguacccauccugaccagaaugucucaguugauugagaaggaaacagaggaguacaggaaaggagacccugauccauucgacgaucggcacccgggucgcgcugaccccgaaugcauguuaggccaucugcuacgaauacucuuuaagaacgaugacuucaugaaugcacuggugaacgccuaugucaugacuucacgugagccuccacuuaauaccgcggcuuguagacuguugcucgauaucaugcccgggcuggaaacagccgugguuuuucaggagaaagagggaauuguggaaaaccuguucaagugggcaagggaggccgaccagccucuccggaccuacaguacuggcuuacuggguggggcuauggaaaaucaagauaucgcagccaacuaucgcgacgagaauagccagcuugucgcuauuguguugagaaggcugcgggaacuacagcuccaggagguagcccugcgccaagagaacaagcgaccaucccccagaaaacuuucuucggaaccucuguugccacucgaugaggaagcgguugacauggacuacggagauauggcaguggacgucguggauggcgaccaggaggaagccucaggcgauauggagaucagcuuucaccuggacagugggcauaagacauccucuagggugaauagcaccacgaaaccggaggauggagguuuaaagaaaaacaaguccgcuaagcagggcgaccgggaaaauuuccguaaagccaagcagaaacugggguuuucaaguagcgaucccgaccgcauguucgucgagcucucuaacuccucauggagcgaaaugaguccuuggguuauaggaacuaauuauacccuuuacccaaugacacccgcaaucgagcaaagacugauuuugcaguaucuaacuccucugggcgaauaccaggagcuccugccaaucuuuaugcaacuugguucuagggagcugaugauguucuacauugauuugaagcagaccaacgacgugcuccugacauuugaggcuuuaaaacaccuggccucccuacuccugcacaauaaguucgcgaccgaguuuguagcccaugggggagugcagaaacuuuuggaaaucccccggccgagcauggcagcuacgggcgucucgaugugccuguauuaccucucuuauaaccaggacgccauggagcgaguguguaugcacccucauaacguucuguccgauguggucaauuacacucuuuggcugauggagugcucacacgcuaguggcuguugccacgccacaauguucuucagcauauguuuuuccuuccgcgcaguguuggaacucuuugacagauaugaugggcugaggcgguuaguaaaccugauuucuacccuagagauccucaaucuggaagaccaaggagcccuuuugagcgaugacgagauuuucgcuucacgccagacugguaagcauacaugcauggcgcugagaaaguacuuugaagcacaccucgccaucaaacuggagcagguuaagcagaguuuacaaaggaccgagggcgggauccuggugcauccccagccaccuuauaaggcuuguuccuacacgcacgaacagauugucgagaugauggaguuccuuauagaguacggacccgcccaguuguauugggaaccagcagagguguuucucaaacugagcugcguccaacuacugcuccagcugaucucuauugccuguaacuggaaaaccuacuaugcucguaaugauacagugcgguucgcccuugacguuuuggcaauccugacugugguacccaagauacaguuacagcucgcggagucagucgaugugcuggacgaagcuggcaguaccguuagcacaguggguauuuccaucauccuuggggucgccgagggcgaauuuuucauucaugaugcagagauccaaaagucugcccugcagauuauaaucaacugcgugugcggaccugacaaucgaauuucgagcaucggcaaauuuaucuccgggacuccaagaaggaaguugccgcagaaccccaaaucaagugaacacacccucgcuaagauguggaauguagugcaaucuaacaauggaauuaaaguucugcuaagccugcucuccauaaagaugccuaucacagaugccgaccagauucgcgcacuggcuuguaaggcccuugucgguuugucacggagcucuaccgugagacagaucauuuccaaacugccauuauucaguagcugccagauccaacagcucaugaaggagcccgugcugcaggacaaaaggucugaucacgucaaguuuuguaaauacgcggccgagcuuauagaacgcguuuccggcaagccucugcuaaucgggacugacgugucacucgcucgacugcagaaggcagaugugguagcccaaagucggauuagcuucccagagaaagaauugcuguuacucauccguaaccaucugauuucgaagggacuuggcgagacggcuacaguccugaccaaagaggccgacuugcccaugacugcagcgucccacucuagcgccuucaccccggugacagcugccgcaucaccuguuagucucccaagaacccccaggaucgcuaaugguauagccacucgccuggggucccaugcagccgugggcgcuucugcgccuagcgcccccacagcacacccacagccucggcccccacagggaccgcuagcucugccuggccccuccuaugccgggaacucaccacuuauuggaagaaucagcuuuauuagggaacgacccaguccuugcaauggucgcaagauccggguccucagacagaaaucugaucacggcgccuacucccaaagcccagcuauaaagaaacagcuggacaggcauuugcccucgccuccgacgcuggauucaaucauuaccgaguauuuacgugaacagcacgcacgcuguaagaacccaguggccacuugucccccuuucucucucuuuacaccacaucaaugccccgagccuaagcagcggagacaggcgccgaucaacuucaccaguaggcugaaucgacgggcuuccuuucccaaauacgggggaguugacggcgguugcuucgaucgccaccuuauuuuuagcagauucaggccaaucucuguguuucgggaagccaacgaggacgagagcggguucacauguugcgcauuuuccgcccgagaaagauuccugauguugggcacuuguaccggacagcucaagcuguacaauguauuuucaggccaagaggaagcuaguuauaacugccauaauagcgcaauaacgcaccuagagccuucucgcgaugggucccugcuucucaccucagccacauggagucagccccugagcgcguuguggggaaugaaauccgucuucgacaugaagcacucuuucacugaagaucauuacguggaguuuucgaaacacagccaggacagggugauuggcaccaagggugacaucgcucauaucuaugauauucagacagggaacaaguuacugacucucuucaauccagaccuggccaacaauuacaaacguaacugcgcaaccuuuaauccuacggaugaccuuguccugaacgauggaguuuugugggacgugcggucagcccaagcuauccacaaguucgauaaauuuaauaugaacauuuccggcguauuccaucccaauggucuagaggugauaaucaacacagaaauuugggaccugagaaccuuucaccuccugcacacugucccagcccuugaucaguguagggugguuuucaaccauacaggcaccgugauguauggggcaauguuacaggcugacgaugaggacgaccugauggaagaacgcaugaagaguccguuuggaucuagcuuccgaacuuuuaaugccaccgauuacaaaccuaucgcgacaauugacgucaagagaaacaucuucgaucucugcacggacaccaaggauuguuauuuggccgugauagaaaaucagggcuccauggacgcacugaacauggauacuguuugccggcucuacgagguggggaggcaacgccuggcugaggacgaagaugaggaagaggaccaggaggaagaggaacaggaggaagaggaugacgaugaggacgacgaugacacagaugaccuugaugaacuggacaccgaucaguugcuagaggccgaacuggaggaagacgauaauaacgagaaugcuggagaggacggcgauaacgacuucucacccucugaugaagaacucgcaaauuuacuggaagagggugaagacggggaggacgaggauagcgacgccgaugaagaggucgaacuuauccugggagacacagauaguuccgacaacagcgaucucgaggacgauauuaucuugucucugaaugaguga

SEQ ID NO: 64726 - RNA, 438 nt, Artificial Sequence
  derived and/or modified sequence opt3 from VPREB1__Homo_sapiens__NP_009059
augagcugggcccccgugcugcucaugcuuuucgucuacugcaccggcugugggccucagccaguucugcaccaaccgcccgcuauguccucugcauugggaacaacuaucagauuaacgugcacccugaggaacgaccaugauauugguguguauucaguauacugguaucagcagcggccuggccacccaccccgcuuucuacuccgauacuucagucagagcgacaagucccaagggccucaggugccaccccguuuuucuggaucgaaagaugucgccagaaauaggggcuaucugucaauaagcgagcuucagccugaagacgaggcgauguacuauugugcuaugggugcccggaguuccgaaaaggaggaacgcgagagagagugggaagaggaaauggagccaacagcagccaggacucgggugccguga

SEQ ID NO: 64727 - RNA, 372 nt, Artificial Sequence
  derived and/or modified sequence opt3 from VPREB3__Homo_sapiens__NP_037510
auggccugcagaugucugagcuuccuccuuaugggcaccuuucuguccgugucucagacagucuuggcucaauuagacgcacugcuaguuuuccccggacagguggcccagcucucaugcacucugaguccucagcacguaacgaucagggauuacggggugagcugguaucaacagcgggcggguuccgcuccacgcuaccuucuguauuaccgaucugaggaagaccaucaccguccggccgauauucccgacagauuuucggcagccaaggaugaggcucauaacgcaugugucuugaccauaucaccugugcagccagaagacgaugccgacuauuacugcagcguuggcuauggguucagucccuga

SEQ ID NO: 64728 - RNA, 1740 nt, Artificial Sequence
  derived and/or modified sequence opt3 from VPS11__Homo_sapiens__XP_011541201
augcuguucaagaaaaaccucuuugagauggccaucaaucuugcuaagagccagcaccuggacuccgauggcuuggcacaaauuuucaugcaguacggggaccauuuauauucuaaaggaaaccacgauggugccgugcagcaguacauaagaaccaucggcaagcuggaacccucauaugucauuaggaaauuucuagacgcgcaacggauccauaaucucacagcuuaccugcagacucuucaccgccagagucuggccaacgcagaucauacgaccuugcuccugaauugcuauacaaagcugaaggacagcuccaaacucgaggaguucauuaagaaaaagucugaaucggaaguucacuuugauguggagacugccaucaaaguauuacgacaggcuggguacuauucacacgcacuguaccuugccgagaaccaugcucaccaugaaugguacuugaagauacaacuggaggacaucaagaauuaucaggaagcccuacguuacauuggaaaacucccuuucgagcaggcggagagcaacaugaagagauauggcaaaauccugaugcaccacauuccagaacagaccacacaacuucugaaggguuuguguaccgauuacaggccgagucucgaggggcgguccgaccgcgaagcacccggaugcagagccaauucugaggaauuuaucccuauauucgcuaacaauccaagggagcugaaagccuuuuuagagcauaugagcgaagugcagcccgauuccccucagggcauuuaugacacucugcucgagcuucggcugcaaaacugggcacacgaaaaggauccacaggucaaagagaaguugcaugcugaagccaucucacuacugaagaguggccgcuucugugacguguuugacaaagcgcucguucugugccagaugcacgauuuccaggacggggugcuuuaccuguaugagcaaggaaaguuguuucagcagauuaugcauuaccacaugcagcacgagcaauaccgacaggucaucagcgugugugaaagacauggugagcaggaucccucucucugggaacaggcccuguccuauuucgcaaggaaagaggaagacugcaaggaguacguagcugccguuuuaaaacacaucgagaauaagaaccugaugccuccacuacucgugguccaaacacuggcucauaauucaaccgccacgcuuagcgugauucgggauuauuuggugcagaagcugcagaaacagagucaacagauagcacaggacgaacuccguguccgcagauacagggaggaaacuacccggauccgacaagagauucaggagcugaaggccucuccgaaaaucuuccagaagacaaaauguuccauaugcaacagcgcucuugaacugcccucgguucacuuuuuguguggccacucuuuccaucagcacugcuuugaguccuauucagaaagugaugcggacuguccuacuugccucccagagaaccgcaaggugauggauaugauuagagcacaagaacagaagagggaccugcaugaucaguuccagcaccaauuaaaaugcagcaaugacuccuuuucuguaaucgccgacuacuucgggcggggaguguuuaacaagcugacccuacucacagaucccccuaccgcucgccugacgagcucacuugaggccggcuugcagagagaccugcucaugcauaguaggcgugguacuuga

SEQ ID NO: 64729 - RNA, 9408 nt, Artificial Sequence
  derived and/or modified sequence opt3 from VPS13A__Homo_sapiens__NP_001018047
augguguucgaaagcgucguuguggacgugcugaaccgcuuucucggcgauuacguggucgaccuugauaccucccagcugucuuuggggaucuggaagggagccguggcucuaaagaaucugcaaauuaaggaaaacgcauuaucacagcucgacguucccuucaaagugaaggucggucacauaggcaaucugaaacuuaucauuccuuggaagaaccuguauacucagccaguggaagccguauuggaagaaaucuaccuccugauuguuccgaguagcaggaucaaguaugauccccugaaagaagaaaagcagcucauggaggcgaaacaacaggaauuaaagcggauagaggaagcuaaacagaagguggucgaccaggaacaacaucugccugaaaagcaggauacuuuugccgaaaaacuugugacgcagaucauuaagaaucuacaggugaaaaucuccucuauucacauccgcuacgaggacgauauaaccaaccgagacaagccacugucguucgggauuucacugcaaaaucucagcaugcagacaacugaucaguauuggguccccugccugcaugacgaaaccgagaaacuuguucguaagcugaucagauuggauaaccucuuugcauacuggaaugugaaaagucaaauguucuaucuguccgacuacgacaacucuuuagaugaccugaagaauggaauuguaaacgaaaauaucgugccugagggcuacgauuuugucuucaggccaaucagcgccaacgcuaagcucgugaugaaucggcgcuccgacuuugauuucucagcacccaaaauuaaccuugagauagaacugcacaacaucgccauugaguuuaauaagccucaguauuucaguaucauggaauuguuggagagcguugacaugauggcucagaaccugccauacagaaaauuuaagccggaugugccccuccaucaccacgccagggaauggugggcguaugcaauacaugguguccuggaggugaauguauguccucggcuuuggauguggucuuggaaacacauucgcaagcaucgacagaagguuaaacaauacaaggagcuguauaaaaagaaauugacauccaagaagccacccggggaacuccuggugucauuagaggaacuggagaaaacccuagacgucuucaacaucacuaucgccagacagacagcugaaguggaggucaagaaagccggauacaagauuuauaaagagggcgugaaggauccugaagacaauaagggcugguucagcuggcucuggaguuggucugagcagaacaccaaugaacagcaaccagauguucagcccgagacgcuggaggaaaugcuuacuccggaggaaaaagcauugcuguacgaggcuaucggguacuccgaaaccgccguggacccuacacuccugaagacuuuugaggcgcuuaaauucuuuguacaccugaagucaaugucgauugucuugagggagaaccaccagaaacccgaacucguggacauaguuaucgaggaguucucuacccugauugugcagcggccaggagcccaagcaaucaaguuugagacaaaaaucgauuccuuccauauuaccgguuuaccugacaauucagaaaagccccgucugcuaaguagccucgaugacgcuaugucccuguuucagauaacguucgagaucaacccacuugaugagacugucucucagcgcugcauuaucgaagccgagcccuuggaaauuaucuaugacgcuagaacagugaauagcauaguagaguuuuucaggccuccaaaggaagugcaccuggcccagcucaccgcagccacucugacaaaauuagaggaguuucggucaaagaccgcuacgggccugcuuuacaucauugaaacccaaaaaguuuuggaucucaagaucaaccugaaagcgaguuauauuaucgucccgcaggacgggauauucucccccacaagcaaucuacugcuccuggaucuuggacauuugaaggugacuucuaagucacgaagugagcugccugacgugaaacagggcgaagcaaacuuaaaggagauuauggaucgcgccuacgacagcuuugauauccaacucaccuccguccagcugcuuuauucuagaguuggugacaauuggagggaggcucggaaacugucggugagcacacagcacauuuuggugccaaugcauuucaaccucgaacuguccaaggccaugguauucauggacguccgcaugcccaaauuuaagaucuacgggaagcuaccucugauaucacucagaaucagugauaaaaagcugcagggaauuauggagcuuaucgaaucuauuccaaaacccgagccggugacugaaguuagcgcaccugugaaguccuuccaaauccagaccucaacuuccuugggcaccucucagauaucccagaaaauuaucccacuguuagagcuccccagugucagcgaggacgauucugaagaggaauuuuucgacgccccuuguagcccccuggaggaaccacuucaauuuccuacuggcgugaagucaaucaggacgcguaagcugcagaaacaggauugcaguguuaacaugacaaccuucaagauucgguuugaggugcccaaaguacuaaucgaguucuaucaccucgucggggacugugaacugagcgugguggagauuuugguccugggauuaggugcugaaauagagauccgaacuuacgaucucaaggccaaugcauuucugaaagaguucugccuuaaguguccagaguaccuggacgagaacaaaaagccgguuuauuuggugaccacacucgauaauaccauggaagaccugcuaacucuggaguacguaaaggcggagaaaaacgugccugaucuuaagucgacauauaauaacguccuccagcugauuaaagugaauuuuuccucuuuggacauccaccuacacacggaggcuuuacucaacaccauuaauuaccugcacaacauccuuccccaaagcgaggaaaagucagccccaguuaguacuacagagaccgaagauaaaggcgacgugauaaagaagcugggguuggacuccgagaugaucaugagacccucugaaacagagauuaaugcaaaacucaggaacaucauuguccuggauagcgacaucacugccauauauaagaaagcuguguacauuaccggaaaggagguuuucuccuuuaaaauggugucauauauggaugccacggcaggcagcgcuuacaccgacaugaaugucguagauauccaggugaaccuaaucguugguugcauugaaguggucuucgugacaaaguuccuguacaguauacuugccuuuaucgacaauuuccaggcggccaagcaagcucucgcagaggccacuguacaggcugccgggauggcagcgaccggcgugaaagaacuggcccagagaucuucccggauggcuuuggauauuaacaucaaggccccugucguugugauuccacagagccccgugucggagaacgucuuuguggcagacuucggauuaaucacaaugacuaauaccuuucauaugauaacggaaucacaaucuaguccuccgccaguuaucgaucugauuacaaucaaacucuccgagaugagacuguauaggagccgcuucauuaacgacgcuuaccaggagguacuugaucuguugcuaccccugaaucucgaaguggucguggagcgaaaccuguguugggaaugguaucaggagguuccuugcuuuaaugugaacgcccagcuuaagccaauggaguucaucuuaucucaagaggacauaaccacuauuuuuaaaacacugcacggcaauaucugguacgagaaggacgggagcgcaucccccgccgucaccaaggaucaguauucagcuacaaguggagugaccacaaacgcgagccaccauucugguggcgccacgguagucaccgcagcugugguugaagugcacucccgggcccucuuggucaaaacuacacugaauaucucauucaagaccgacgaucucacaauggugcuguacaguccugggccgaaacaggccagcuuuacugacguucgugaucccucccuuaagcuggcugaguucaaauuggaaaacauuaucucuacccuaaagauguauacggacggaucgacauucagcucauuuucccugaagaauuguauacucgaugacaaaagaccacaugugaagaaagcaaccccuaggaugauuggcuuaacugucgguuucgauaagaaagacaugauggauaucaaguaccgcaaagugcgggacgggugcguaaccgaugccguguuucaggagauguacauuugcgcgaguguugaguuccugcaaacagucgcuaacguguuucuugaagccuauacuaccggcacagcaguggagacgucuguccagaccuggacugccaaggaagagguacccacacaggaaagcgugaagugggagaucaauguuauaauuaaaaacccagagaucguguucgucgcugacaugaccaagaaugacgcgccugcacuggugaucacuacacagugugaaauuugcuacaaaggaaaccucgagaacuccaccaugacggcagcuaucaaggauuugcaaguuagagccugucccuuucugccagugaaaaggaagggcaagauuacuaccguccuccagccgugcgaccuguucuaucagacaacccaaaaagggacugauccucaggugauagacaugucaguaaagucucuuacacuaaaagugagccccguuaucauuaauaccaugaucacaaucacaagugcacuguacaccacgaaggaaacaauuccagaggaaaccgccuccagcacugcucacuugugggagaaaaaggauaccaagacauuaaaaaugugguuucuggaggaaucuaacgagacugaaaagauagcccccaccacggagcucgucccuaaaggagaaaugaucaagaugaauauugacucaaucuucauugugcuggaggcagguaucggccaucgaacagugccaaugcuucuggcuaaaucccgcuuuaguggggagggaaagaacuggagcucgcucauaaauuugcacugucagcuggaacuagagguccacuauuacaacgaaauguucggcguuugggagccccugcucgagccucuugaaaucgaucagaccgaggacuuucggccguggaaucuggguauuaagaugaaaaagaaagccaagauggcgaucguggaaucugauccagaggaagagaacuauaaaguacccgaguacaagacugugauuuccuuccauagcaaagaccaauuaaauaucacauugucaaagugcgggcuggucaugcucaacaaucuggugaaggccuucaccgaagcagcuacuggcaguucugccgauuuuguuaaagaccuugcuccuuucaugauacugaacucccucggauugacaauuagcgugucacccagugauagcuuuuccguccugaauaucccaauggcaaagucuuacguacugaaaaacggcgagagccuauccauggacuauauuagaaccaaggacaaugaucacuucaacgccaugacgucacugucuaguaaacucuuuuucauccuucugacuccugugaaucauucgaccgccgacaagauacccuugacaaagguugggaggcgucuguacaccgugcgccaccgggaaagcggagucgagagauccaucgugugucagauugauacagucgaaggcucuaaaaaggugacuaucaggucaccaguucagauucgaaaccauuuuagcgugccucucuccguauaugagggugacacccugcuugggacggcuaguccggagaacgaguucaauaucccccucggaucuuaccggagcuuuauauuccugaaaccagaggaugaaaacuaucagaugugcgagggcauugacuuugaagagaucaucaagaaugauggugcguugcugaaaaagaagugucgcagcaaaaacccuuccaaggagaguuucuuaauuaauaucgugcccgaaaaagacaaccuaacaagccugucugucuacuccgaggauggcugggaccucccauauauaaugcaccuuuggccucccauucuguugagaaaucugcucccguacaagaucgcauacuauauugaagggaucgagaacucaguuuuuacucugagcgagggacacucggcccaaauaugcaccgcucagcuuggcaaagccagguuacaucugaagcucuuggauuaccugaaucacgacuggaagucugaauaucauaucaaaccaaaccagcaggacauuaguuucguguccuucacaugugucaccgagauggaaaagacugaucuagacaucgcagugcacaugaccuacaauacagggcaaacgguaguggccuuucacagcccuuauuggaugguuaacaaaacuggacggaugcugcaguacaaggcugauggcauucaucgaaaacaucccccaaauuauaagaaacccguacucuucucauuucagccuaaccauuucuuuaauaacaacaagguccaacuuauggugaccgacuccgagcugucuaaucaguucagcaucgauacagucgguagucacggggcggugaagugcaaaggauugaagauggacuaccagguuggcguaaccauugaucuguccagcuuuaacaucacuagaauagugacauucaccccguuuuacaugauuaaaaauaagucuaaauaucauaucucagucgccgaagaggguaacgacaaguggcucagucuggauuuagagcagugcauccccuucuggccagaauacgcauccagcaaacuucugauucaaguggagcgcucugaagacccucccaaaaggauauauuuuaauaagcaggagaacuguauccuccuacgucuggauaaugaauugggcgggauuaucgcugagguuaaccuggccgagcacucgacggugauuacuuuccucgacuaccacgauggagcagccacauuucuucugaucaaucauaccaaaaacgaauugguccaguauaaucagucaagccuguccgagauagaagacagucucccuccaggcaaggcuguguucuacaccugggccgaccccguagggucucggagauuaaaauggaggugccgcaagagccacggagaggugacucaaaaggaugacaugaugaugccuaucgaucugggcgagaaaacaauuuaucuuguuuccuucuuugaaggucugcagcgaaucauucuauucaccgaggacccaagagucuuuaaggugacauacgaaucagagaaagcggaacucgcagagcaggagaucgccguggcucugcaggaugucgggauaaguuugguuaacaauuacacuaagcaagaaguggccuauauuggaaucacgucuagcgacguagugugggagaccaaacccaagaagaaagcucgguggaagccgauguccgucaaacauacagaaaagcuggagagggaguucaaagaauacacugagucaagcccuucugaagauaaggugauccagcucgacaccaacguuccagugcgccuuacacccaccggccacaauaugaagauucugcagccucacgucauagcauuacguagaaacuaucugccagccuugaaaguggaguacaacacuuccgcucaucagaguagcuuucggauccaaauuuauaggauccagauucagaaucaaauccacggugccguauuccccuuuguuuucuacccggugaagccucccaaaucggucacgauggauuccgcaccaaagccuuuuaccgacgugucuauagugaugcgcucagcgggccauagccagaucagucgaauuaaauauuucaagguccucauccaggaaauggaucugagacuagaccuuggguuuauuuacgcccugacagaccucaugacugaggcugaaguuaccgagaacacagagguggaacuguuccacaaagauaucgaggccuuuaaggaagaguacaagaccgcauccuugguagaccagucucaagugagccuguaugaauacuuccauauuucacccauaaaacuccaccuuuccgucagucugagcucuggacgggaggaggcuaaggauucaaaacagaauggcggguuaaucccagugcacucccugaacuugcuccuaaagagcauuggagccacucuaacagacguucaggauguggucuucaaacuugcauuuuucgaacugaauuaucaguuucauacgaccucugaccuccaaagugaggugaucaggcacuacucgaagcaggccaucaagcagauguauguacugauuuugggcuuagauguucuggguaaccccuucgggcucauacgcgaauuuuccgagggaguggaggcuuucuuuuacgaaccuuaucagggcgcgauccaaggcccagaggaguucgucgaggggauggcccuuggacugaaagccuuaguggguggcgcuguugggggacuggccggcgccgcaagcaagauuacuggugcuauggccaaagggguggcggcuaugacaauggacgaagauuaccagcagaagagaagggaggccaugaauaaacaaccggcaggauuucgggagggcaucacccguggcgggaagggacucgucucagguuucgugucuggcauuaccgggaucguaacaaagcccauaaaaggagcccagaagggcggugcugcaggguuuuucaaaggagugggcaagggcuuggucggggccguugcgcgcccuacuggagguaucauugacauggcuagcuccacguuucagggcaucaaacgagccaccgaaacaagugagguggaaucacugagaccacccagguucuucaacgaggauggggucauucggccuuaccgccuuagagacggaacuggcaaucagaugcugcaagugauggaaaacgguagguuugcaaaguauaaguacuucacccauguaaugaucaauaaaacagauaugcucaugauaacccggcgagggguguuauuuguuacuaagggaacguucggccagcugacaugugaguggcaguauucuuuugacgaguucaccaaagaaccauuuauugugcacggcagacgcuugaggaucgaggccaaggaacgggucaaaagcguguuccacgcucgugaguuugggaagauuaucaacuucaaaacucccgaagacgccagauggauacugaccaagcuccaggaggcaagggagccuuccccgagucuuuga

SEQ ID NO: 64730 - RNA, 2592 nt, Artificial Sequence
  derived and/or modified sequence opt3 from VPS13B__Homo_sapiens__NP_056058
augcuggagagcuacgugacccccauccucauguccuaugucaacagauacauuaagaaucuuaaaccuucugaccugcaguugucauuauggggcggggauguugugcugaguaagcuagaacucaaacuggacguacuugagcaagaacugaaguugccauucacauuucucagcggacacauacaugagcugaggauccacgugccguggacuaaacuggguuccgaacccgucgugauuacgaucaacaccauggagugcauucucaaguuaaaggauggcauccaggacgaucaugagucuugugggaguaauucaacaaaccggagcacugccgaaaguaccaaauccucuauaaagccucgccgaaugcagcaggcugcaccaacagaccccgaucugccuccaggauauguucaaagccuuauccguagaguggucaauaacgugaauauuguaaucaacaauuugauucugaaauacguugaggacgauaucgugcuauccgucaacauaaccucagccgaaugcuauacugugggcgagcucugggacagggcguucauggauauuagugcuacagaccuggugcuucggaaggucaucaauuuuagcgauuguaccguuugccuggacaaacgcaacgccucugguaagauugaguucuaccaggaccccuugcucuauaaguguuccuuuagaacgaggcugcacuucacuuacgaaaauuuaaacucaaaaaugccuagcgugaucaagauccauacccugguagagagucucaaacuuucuauuacagaucagcagcugccaauguuuauacggaucaugcaauuggggauugcacuauacuauggagaaaucggcaauuucaaggagggcgaaauagaggaccugacuugccacaacaaagauaugcucgggaacauuaccggauccgaggacgaaacacgcaucgauaugcaguacccggcccagcacaagggucaggagcuguauagccaacaggacgaggaacagccccaaggcugggugucgugggcuuggucuuuugucccugcaaucguguccuacgaugacggggaagaggauuucguuggaaaugacccagccucaaccaugcaucagcagaaagcucagacgcuuaaggaucccauugugaguaucggcuuuuauuguacuaaggccacagucaccuucaaacugacugagaugcaaguggaaagcuccuacuauucuccucagaagguaaaaagcaaggagguuuugugcugggaacaggaggguacaaccguggaagcgcucaugaugggggagccauuuuucgacugucagauuggauucgucggcugccgagcaaugugucugaaaggcauaaugggggugaaggacuuugaggaaaacaugaauagaucagagacggaagccugcuucuuuaucugcggagauaacuuaaguaccaaggguuucacauaccugacuaauucccuauuugacuacaggagccccgagaacaauggcacccgggcugaguucauucucgauucuacacaccauaaagaaacuuauaccgagaucgccgggaugcaacguuuuggagcauucuacauggacuaucuguacacaauggaaaacaccucaggcaaggguaguacuaaucagcaggauuuuagcuccgggaaaucugaggaccuuggcacgguccaggaaaagucgacaaaaagccuggugaucggaccgcuggauuuccgccucgacuccucagcuguucacagaauuuugaagaugauagugugugcccuugagcacgaguaugaaccuuacaguaggcugaagucugauaucaaagacgagaacgaaaccauuuugaaucccgaggaaguagcgcuccuggaggaguauaucccaacucggcauaccagcgucacauuacugaagugcaccuguacuauuuccauggccgaauuuaaccuacucgaucaucugcuuccugugaucaugggcgagaaaaauucaagcaacuucaugaauacaacgaacuuucaaucuuugcgaccccugccauccauacgcauccucguugacaagauuaaccuggaacacagugugcccauguacgcagagcaguuaguccacgugguaagcucucugacccagccuuccgauaaucuuuugcauuacugcuaugugcacuguuaccucaaaaucuucggguuccaggcuggacugacuucacuagacugcagugguagcuauugucugccaguuccggucauucccucguuuuccacagcccucuacggcaagcugcuuaaguugccuaccugcuggacaaaaagaucucaaaucgcuauaacugaagggauuuucgagcugccaaacuuaaccauccaggccacgagggcacagacccuccugcuucaagccauuuaucagagcuggucacaccugggaaaugugaguuccucugcugugaucgaggcguugauaaacgaaaucuuucucagcauugagaucggcuccuguuacgucgcacagguugaccuggaacuacuggccucaaaugaucccccuacaagcacuucguga

SEQ ID NO: 64731 - RNA, 10887 nt, Artificial Sequence
  derived and/or modified sequence opt3 from VPS13C__Homo_sapiens__NP_001018098
auggugcuggaaucaguaguugcagaucuccuuaacagauuccugggagauuacguggaaaauuugaacaagucccaguuaaaacuggggauauggggagguaauguagcuuuagacaaccuccaaauuaaggagaaugcacugucugaacuugaugugcccuuuaaagucaaggccggccaaauagacaaacugaccuugaagaucccuuggaagaaccucuauggggaggcggugguugcuacacuggaaggacuguaccucuuaguggucccaggcgccucaauuaaauaugaugcagugaaggaggagaaaagucugcaggacguaaagcagaaagaacuuagcaggaucgaggaagccuugcaaaaggcugcagagaaggguacucacuccggggaguucauuuacggacuggaaaauuuuguuuauaaagauaucaagccgggccggaaacgcaagaaacauaagaaacacuucaagaagcccuuuaaaggccuagaccgaucuaaggauaaaccuaaggaggccaaaaaggacacguucguggaaaagcucgcuacccaggucaucaagaacgugcaagugaagaucacagauauucauaucaaauacgaggacgaugucacugacccaaagcguccccugucguuugggguuacccuuggagaacugucauugcucacagccaaugagcacuggaccccuugcauucugaacgaggcggacaaaaucauauauaaguuaauuaggcuggauagccucagugcauacuggaaugugaacuguuccaugucuuaccagaggagccgggaacaaauccuugaccagcugaagaaugagauuuugacuuccgguaacaucccacccaauuaucaguacaucuuccagccuauuucagccagugcuaaacuauauaugaacccauacgccgaaagcgagcugaagacaccgaaacucgauugcaacauagaaauccaaaauauugcaaucgagcugaccaagccccaguaucuuucuaugauagaccuguuggaguccguagauuacauggugcgcaacgcuccuuauagaaaauacaagccauaccucccccugcauacgaauggcaggcggugguggaaguaugccauugacucagucuuagaagugcacauccgccgauacacucagauguggagcuggaguaacaucaaaaagcacagacaacugcuaaaaucuuauaagauugcguacaaaaauaagcucacccaguccaaaguuagcgaggaaauccagaaggagauucaggaucuggaaaagacacuugacguguuuaacauaaucuuggccaggcaacaggcacaggucgaggugauucggucggggcagaaacugcguaagaaaucugcugauacuggagagaagcgcggcgguugguucuccgggcucuggggcaagaaagaaucaaagaaaaaggacgaggaaagucugaucccugagaccaucgaugaccuuaugacaccagaggaaaaagacaagcuguuuaccgccauuggcuauagcgaguccacgcauaauuugacucuccccaaacaauacguagcucacauaaugacacugaaguuaguuucuaccagcgugacuaucagagaaaacaagaauauuccggagauccugaaaauucagaucauaggccuagggacacaggucucacagaggccuggagcccaagcacucaagguggaagccaaacuggagcauugguauaucaccggucuucggcagcaggauauuguccccaguuugguggcuuccaucggcgacacgaccagcucucugcucaagauuaaauucgagacaaacccagaagauagcccugcggaccagacucugaucguucaaagucagcccguggagguaauauacgaugcaaagaccgucaaugccgugguugaauuuuuccagagcaacaagggguuagaccuggagcaaauuacauccgcuacucuuaugaaauuggaagagaucaaggagcgaaccgccacaggacucacccacauuaucgaaacucgcaaagugcuggaucuaagaauaaaucugaagccaucuuaccucgucgugccccagacgggcuuccaccaugagaaaucggaccugcuuaucuuggauuuugguacauuccagcugaacagcaaggaccagggguuacagaagaccacuaauuccucacucgaagagauuauggauaaggcauaugacaaguuugauguagaaaucaaaaacgugcagcugcuuuucgccagggcugaggagaccuggaagaaaugucgguuucagcacccuaguacaaugcauauucugcagccaauggacauccacguugaauuggccaaggcaauggucgagaaagacauacgcauggcgagauucaaggugucuggcggacucccgcugaugcaugugaggauuagcgaucaaaagaugaaagacguccuauaccugaugaacuccaucccccucccucagaagucaagcgcucagucuccagaacgucagguuuccaguauccccauuaucagcggcgggaccaaaggacugcuugguacuucuuugcuguuagauacaguggaguccgagucagacgaugaauauuuugacgccgaggauggcgaaccucaaacgugcaagaguaugaaagggagcgagcucaagaaggcagccgaagugccaaaugaggagcugauuaaccuucugcuaaaauucgaaauaaaggagguaauccucgaauuuaccaaacagcagaaggaggaagacacuauucuggucuucaaugugacacaauugggaaccgaggcuacaaugcggacuuuugaucugaccguugugucguaccucaaaaagaucucccuagacuaucacgagauugaaggcucuaagcgaaaaccccugcaccuuaucagcucaagugauaagccgggucuggacuugcucaaagucgaguacauaaaggccgauaaaaacgggccuuccuuccagacggcauuuggcaagaccgaacagacagugaagguugcuuucucuagccugaaucuacugcuucagacucaagcccucguggcguccaucaacuaucugaccacaauuaucccaucagacgaccagagcauuaguguagccaaagagguccagaucucuacugaaaagcagcagaaaaauuccaccuugcccaaggcuauagugagcucgagagauucagacauuaucgauuucaggcuguuugcaaaauuaaacgccuucugugugaucgucugcaaugagaagaacaauauugcugagauaaaaauccagggacucgacucuagucugucccuucagagccgcaagcagucucuguuugcccgguuggaaaacauuaucguuacggauguggacccuaagacaguacauaaaaaggcagugagcauuaugggcaaugaggucuucagauuuaaccucgaucuguaccccgacgcgaccgaaggggaucuauacacugacauguccaaaguggauggaguucugucacuuaauguggguuguauccaaauagucuaucuccacaaguuccugaugaguuuguuaaacuuucugaacaauuuccagacagccaaagagagccucucugcugccaccgcacaggcugccgagagggcagccacuuccgugaaggaccuggcucagcgcucauuucgaguuaguaucaacauugaccuuaaggcgccagugaucgucauuccucaaagcuccaucucuaccaaugccguagugguugaucugggcuugauacgggugcauaaccaguucucgcuagucagcgacgaagauuaccugaaucccccagugauugaccguauggauguacagcucacaaaacugacgcuuuauagaaccgugauccaaccggggaucuaccacccugacauucaguuacugcaccccaucaaccucgaguuuuuggucaauaggaaccuggcagcuucaugguaucauaagguuccagugguggaaauaaaaggacaccucgauuccaugaaugucagucugaaccaggaggaccuuaaucuguuguuccgcauucuaacugaaaaccugugcgagggcacagaggaucucgacaaggugaaaccccggguucaggaaaccggugagaucaaggaaccuuuagagauuucuaucagccaagauguacaugacuccaagaauacacugacuaccgggguggaagagauaagaucagucgauauuaucaacaugcuucugaauuuugagaucaaagaagugguugugacgcucaugaagaaaucugagaagaaaggcaggccauugcacgaacugaacguccuccagcugggaauggaggccaaggugaagacauacgacaugaccgccaaggcuuaucuuaagaaaauuagcaugcaguguuucgacuucacugauaguaagggcgaaccccuacauaucauuaacuccagcaauguaaccgacgagccucuguugaaaauguuacugacaaaggcagauucugacgggccggaguuuaaaacuauacacgauucaaccaagcagcgacucaaggucuccuucgccagucuggaccuugugcugcaccucgaagcguugcugagcuuuauggauuuccuaucgucugcugccccauuuuccgagcccagcucaagugaaaaagagucugagcugaagccucucguuggagaaucccgcagcaucgcagugaaagccgucucaaguaacauuagccaaaaggacguguucgaucuuaaaaucacagcugagcugaaugcauuuaacguuuucgugugcgaccagaaguguaauaucgccgauauuaagauacauggcauggacgcguccaucucugucaaaccaaagcagacggauguguuugcucgguuaaaagacauuaucguaaugaacguggacuugcagagcauucacaagaaagccguuuccauccugggugaugaagucuucagauuucaacucacccuguaccccgacgcaacugagggggaagccuacgcugauaugucaaagguggacggaaaacuuucuuucaaagugggcugcauacagaucgucuauguacauaaguucuuuaugagucugcucaauuucuugaacaauuuucagacagccaaagaggcacugucgaccgcuacugugcaagccgcggagagggccgcaagcuccaugaaggauuuagcucagaaaucuuuccgucuacugauggacauuaaccucaaggccccuguuaucauuaucccgcagucaagcgugucccccaaugcugucauagcagaucuuggucugauucgcguggaaaacaaguuuaguuugguuccaauggagcacuacucucugccucccgugaucgacaaaaugaauauugaacucacacagcugaaacuuagccggaccauccuccaagccucacugccacagaacgauauagagaucuugaaaccugucaauaugcuguuauccauucagagaaaccuagccgcugcgugguaugugcagauccccggcauggaaauuaaggggaaacugaagccaaugcaaguagcacucagugaggacgaucuuacggugcugaugaaaaucuugcuggagaaucucggagaagccagcucucagccguccccuacucagucaguucaggagaccgucagggugcgaaagguggacgucagcucgguucccgaccaucugaaggaacaagaggauuggacagacucuaaacuuaguaugaaccagauaguguccuuacaguucgauuuucacuucgaaagccugucaauuauccucuacaacaaugacaucaaccaggaguccggcguagcuuuucacaaugauucuuuccaauugggggagcugcggcuacaucugauggccagcaguggaaagauguuuaaagacggcuccaugaacgugagcgucaagcucaaaaccugcacucuugaugaccugcgcgaagguauugagagagcaacaucuaggaugaucgaucggaagaaugaccaggauaacaauucaaguaugauagacauuuccuauaagcaggauaaaaacgggagccaaaucgacgccguguuggacaagcuguacguuugugcuucuguggaguuccucaugaccgucgcggacuuuuucauuaaagccguaccacagucgcccgagaauguggcaaaggagacacagauccugccucgacagacugcuaccggaaaaguuaagauagaaaaggacgauucagugagaccaaacaugacguuaaaagccaugaucacagaccccgaggucguguucgucgcaagccuuaccaaggccgaugcuccugcccugacugcguccuuucaaugcaaucucagucuaucuaccagcaaacuggaacagaugauggaggcauccgugcgcgacuugaagguucuggccuguccguuccucagggaaaaacguggcaagaacauuacaacugugcuucagccaugcucacuguuuauggagaaguguaccugggcuagugguaaacagaauaucaacauuaugguaaaggaguucaucauuaaaaucucucccauaauuuugaauacggugcugacaaucauggccgcucucagcccuaagaccaaagaagauggcuccaaggacacuucaaaggagauggaaaacuuaugggggaucaaaagcauuaacgauuauaauacaugguuucugggagucgacaccgcaacugagauaacagaaucuuucaagggcaucgagcacucccuuauugaggaaaacugcgggguuguggucgagaguauccaagugacccuggaauguggacuaggccaucggacgguaccccuccuguuggccgagagcaaauuuucggguaauauuaagaacuggacuucccugauggcugccguggcagauguuacccuccaggugcacuacuacaaugaaauccacgcggucugggagccacuuauagagagaguggaagggaaaaggcaguggaaccugcgcuuagacgucaagaaaaauccugugcaggacaagucucuguugcccggagaugacuucaucccagagccucaaauggccauucauaucucaagcggcaacacaaugaauauuaccaucaguaaguccugccucaacguuuuuaauaaccuggcuaaagguuucucugaaggcacagccagcacuuuugauuauucacuaaaggaccgagcaccguucaccgucaaaaaugcuguggggguccccauaaaggugaaaccaaacuguaaucuuagaguuaugggauuuccugagaaguccgauauuuucgacguggaugccggccagaaccuggagcucgaauacgcaaguaugguccccagcucucaggggaaccugucaaucuugucccggcaagagagcucuuucuuuacgcugacaaucgugccacacggauauacugaaguagccaauauuccuguggcuaggcccggccgccgucucuacaacguuagaaauccgaacgcgagucauucggacuccguccuugugcagauagaugccaccgaggguaauaaggugaucacacugcggagcccauuacagauuaaaaaccacuucucaaucgcauuuauuaucuauaaguucgucaaaaauguuaagcuguuggaaaggauagggaucgcucgcccugaggaggaauuucaugugccccucgacucuuaccgaugccagcuguucauucaaccagccggaauccuagagcaccaguauaaagaaagcaccacuuacauuuccuggaaggaggaacuucacagaagucgggagguaagguguaugcugcagugccccucaguggaggucucuuuucucccucugaucgugaacaccguugccuugccggaugaauuaagcuacauuugcacacauggcgaggacugggauguggcauauauaauccaccuguaccccucccucacgcuucgcaaucugcuaccauauagucugagauaccucuuggaaggcacugcugagacccaugaacuggccgaggggagcacagcggacguccuucacuccaggauuucuggagagaucauggaacuggugcucguaaaguaucaggguaaaaacuggaauggccacuuccggauccgugacaccuuaccugaguuuuuccccguuuguuuuucaagcgauucgacugaagugacaaccgucgaccuguccgugcaugugcgccgaauugggaguagaauggucuugucuguuuucagcccuuacuggcugauaaacaagacgacuagggugcuccaauaucggucagaggauauccacguaaaacauccagcugacuuucgcgauauuauccuuuucuccuucaagaaaaagaauauuuuuacaaagaacaaagugcagcugaagaucucuaccagugccuggagcuccucauucagccuagacaccgucggaucuuacggcugcgugaaaugucccgcaaauaacauggaguaccugguuggugugaguauaaagauguccagcuuuaaccucucaagaaucgucacuuugacaccuuucugcaccauugccaauaaaucuucccuggaacuugaggugggggaaaucgcuucggauggaagcaugccaacaaacaaguggaauuauauugcaaguucugagugucugcccuuuuggccggaauccuuaagcggcaaacucugcguaaggguugugggcugugaggggucaaguaagccuuucuuuuacaaccggcaggacaauggaacucuguugucccuggaggaucucaacgguggcauccuugucgacgugaauacggccgaacacagcaccguuauaacauucucugauuaucaugaggggucagcgccagcucugauuaugaaccacacucccugggacauccuaaccuacaagcagagcggauccccugaagagauggugcugcucccacgacaagccagauuguuugcaugggccgaucccacaggcacccgcaaacugacuuggacguaugcugccaaugucggugaacacgacuuacuuaaggacgggugcggacaguucccguacgaugcaaacauucagauccauugggugucuuuucuggacggcaggcaacggguacuccuguucaccgaugacguggcuuuggucaguaaagcccugcaggcggaggagauggaacaggccgauuaugagauaacacucucgcuucacagccugggccuaucccugguuaauaacgaaucaaagcaggaggugucuuacaucgggauuacuagcaguggagucgugugggaaguaaaaccuaagcaaaaguggaaacccuuuucccagaagcagaucauuuuacucgagcagucauaccaaaaacaucagaucucucgugaccacgguuggauaaagcuggauaauaacuucgaggugaauuucgacaaagauccaauggaaaugagauugccuauuaggagccccaucaagcgcgacuuucuuuccggcauccagauugaguucaagcagaguagccaccaacggucucugcgagcaagacucuauuggcugcagguugauaaccaguugccaggggcuauguuucccguggucuuccauccuguggccccaccgaaaucaaucgcacuggacuccgaacccaagccuuuuauagacguuagcgucauuaccagguucaacgaguacaguaaagugcuacaguuuaaguauuucauggugcucauccaagagauggcucuuaaaauugaucagggauuucugggcgccaucauagccuuauucacaccaaccacugaccccgaagcggagcgccggagaacaaagcugauccagcaagauauugacgcucucaaugcagaacugauggagacgucuaugaccgauauguccaucuugucguuuuucgaacacuuucauauuagcccuguaaaacuucaccugucacucucccuggguucugggggagaggagagugacaaagaaaagcaggagauguucgccguccauagcgugaaccuauugcugaaaucaaucggcgcuacucucacagauguugacgaucuuauuuucaagcuggccuacuaugaaauccguuaccaguuuuauaaaagggaccaguuaauaugguccgugguccggcacuacagcgagcaauuccugaagcagauguacgugcucguucugggcuuggaugugcuugggaauccauuuggacugauccgcggucucucugaaggcguagaggcacuguucuaugagcccuuucagggggccguccagggaccugaagaguucgcugaaggccuagugauuggugugcgaaguuuauuugggcacaccguuggaggcgcggccggcgucguguccagaaucaccgggagcguaggaaaaggucuggcagcuauuacaauggacaaggaguaccaacagaagaggcgggaagaguugucacgccagccgagagauuucggcgacucucucgccagagggggaaaaggcuuucugcgagguguggucgggggcgugacuggaauaaucacgaagccaguugagggcgccaaaaaggaaggggccgcuggauucuuuaaagguauuggcaaggggcuugugggagccgucgcgcggcccaccggcgguaucguggacauggcaucgagcacauuccaggggauucaacgugccgcugaguccacugaagagguuaguucucugagaccuccccgccucauccaugaggauggcauaaucaggccauaugaccggcaggaaucagagggaagcgaucuguuggaacaggagcuugaaauucaagaguga

SEQ ID NO: 64732 - RNA, 756 nt, Artificial Sequence
  derived and/or modified sequence opt3 from VPS26A__Homo_sapiens__NP_001030337
augagcuuccugggcggguuuuucggacccaucugcgagauugacauagugcucaacgauggugagaccagaaagauggccgagaugaaaacagaagacggcaaggucgagaaacacuaccuguuuuaugauggggaauccguuucuggaaaggugaaucuugcuuucaaacagccuggcaagagguuggagcaucaagguauccggauugaguuuguagggcagaucgaauuauucaacgacaagucaaauacucacgaguuugugaaccuggucaaagaacuagcacucccaggagagcugacgcagagucgcagcuacgauuucgaguuuaugcaaguggaaaagccguaugaguccuacauuggcgccaauguucgacuucguuauuuccugaaagugaccaucgucagaagguugacagaccucgugaaggaauacgaucugauaguacaucagcuggcgacuuaucccgacguuaacaauucuaucaaaauggaggugggcauugaagauugucuccacaucgaguuugaguacaacaagucgaaguaccauuuaaaagacgucauuguggggaagaucuauuuccugcuugugcggauaaaaauucagcacauggaauugcagcugaucaagaaagagauuaccggaaucgguccuucaacaaccacugaaacagagaccaucgcuaaguacgaaauuauggauggcgccccagucaaaggggacaauuuuauggaaaagagcaguuga

SEQ ID NO: 64733 - RNA, 666 nt, Artificial Sequence
  derived and/or modified sequence opt3 from VPS28__Homo_sapiens__NP_057292
auguuccacggcauccccgccaccccugggauuggagcuccagguaacaagccggagcuguacgaagaggugaaacucuauaagaaugcaagagaaagggagaaauacgacaacauggccgaacuuuuugcggucguuaagacaaugcaggcucuggagaaagccuauauaaaggauugcgugagccccuccgaguacacugcagccuguucucgguuguuaguacaauauaaggcugcauuccgccaggugcagggcucagaaaucaguagcauugacgaguuuugccgaaaauuccgucuggauuguccucuagccauggaaagaaucaaggaggacaggccaauuacgaucaaagaugacaaggggaaucucaaccggugcauagcugaugucgugucccuguuuaucaccguuauggacaaacuucgccuggagauuagagccauggaugaaauccagcccgacuugagggagcucauggaaacaaugcaucggaugucucaucugccuccagauuucgagggacgccaaacugugucgcaguggcugcagacccucucaggcaugagcgcgagugacgaauuagaugacucccagguccgacaaaugcuguuugaccuugagucugcauacaaugccuucaacagauuuuugcacgcuuga

SEQ ID NO: 64734 - RNA, 1791 nt, Artificial Sequence
  derived and/or modified sequence opt3 from VPS33A__Homo_sapiens__NP_075067
auggccgcucaccugagcuacggcagagugaaccucaauguccuuagggaggcaguucggcgcgaacugcgagaguucuuggacaagugcgccggguccaaagcgaucgugugggaugaauauuuaaccggacccuuuggucugauugcucaguacucucuacucaaggagcaugaaguagagaaaauguucacacugaagggcaaccgucuuccugccgcagacgugaaaaauauaaucuuuuucgucagaccaaggcuggaguugauggauauuaucgccgaaaacgugcucucagaggaccggcgcgggccgacuagagauuuucacauucuguucguucccaggcggagucugcucugugaacaacgcuuaaaggaccugggagugcuuggcagcuuuauccaucgagaggaguauuccuuggaucugauaccuuucgacggugaucuacucucuauggaaucggagggggcuuuuaaggaaugcuaccuggagggagaccagacgucacuuuaucacgcagccaaaggccugaugaccuugcaggcucucuacggcacaaucccacagauuuucgggaagggagaaugugccagacaagucgcgaauaugaugaucaggaugaaacgggaguuuacugguagccagaacaguauuuuccccguguuugauaaucuguuacugcucgaccguaacguagaucuucugaccccuuuggcaacacagcuaaccuaugagggccugaucgacgaaauauacgggauucaaaauuccuacguuaagcucccacccgagaaauucgccccuaagaagcagggagacggcgguaaagaucugccaacugaagcuaagaaacuucagcugaacucugccgaggaauuguaugcagagauccgcgacaagaauuucaacgcuguggggagcguccucuccaaaaaggccaaaauuaucucagcggccuuugaggaaagacauaaugcaaagacagugggagagaucaagcaguucgugagucagcugccgcacaugcaagcugccaggggcagcuuagcuaaccacaccucuauugccgaacugauaaaagaugucacgacuuccgaggacuuuuucgauaagcuaaccguugaacaggaguuuaugucaggcaucgacacagauaaagugaauaacuacauugaggacugcaucgcacagaagcauagccucauaaaaguacugcggcuuguguguuugcaaagugucugcaacucugggcugaagcagaaggugcucgauuauuacaaacgagaaauucugcagacuuauggauacgagcacauccuuacccugcauaauuuggaaaaggccggucuccugaaaccccagacaggcgggcgcaacaauuauccuaccaucagaaagacguuaaggcuguggauggacgauguuaacgagcaaaauccaacugacauuuccuacguguacagcggauaugcuccccuaucgguccggcucgcgcagcugcuuucucgcccuggcuggagauccaucgaggaaguguugaggauucugccagguccccacuucgaggaacgucagccgcucccuacagggcugcagaaaaagcggcaacccggcgagaaccgaguaaccuuaauauuuuuccugggaggcguuacuuuugcagaaaucgccgcucuuagauucuugucacagcucgaggacgggggaacagaguacgugauugccaccacgaagcugaugaaugguaccaguuggaucgaagcacuaauggagaaaccauuuuga

SEQ ID NO: 64735 - RNA, 1854 nt, Artificial Sequence
  derived and/or modified sequence opt3 from VPS33B__Homo_sapiens__NP_061138
auggccuucccccacagaccugacgcuccagagcugccggauuuuagcaugcucaagaggcuugcacgggaccagcugaucuacuuguuagaacaacugcccggcaaaaaggaucuauucauugaggccgaccucauguccccucuggaucgcauagcgaacgugucuauccuuaaacagcaugaagucgacaagcuguauaaaguugagaauaagccagcuuugucaaguaacgaacagcucugcuuucuggugcgaccccguauuaagaauaugagauacaucgccagccugguaaacgcagauaaacucgccgggaggacccggaaguauaaagugauuuucuccccucagaaguuuuacgcuugugagauggucuuagaggaagagggaaucuauggugacgugucuugcgaugaaugggcauucucgcugcuuccauuggacguugaucugcuaucaauggagcuccccgaguuuuuccgcgacuacuuucuggaaggcgaucaaagauggauaaauacaguggcccaggcccuucaccuguugagcacucucuaugggccuuucccaaacuguuacggaaucgguaggugcgcuaaaauggcguacgagcuguggcggaauuuagaagaggaagaggacggcgagacgaaggggcgccgaccggaaauuggacauaucuuucugcucgacagagaugucgacuucgugaccgcacuuuguagucagguaguuuaugagggccugguggaugacacauuuaggauuaagugcggcuccgucgauuucgggcccgaagugacuucuagcgacaaauccuugaaggugcuacugaacgccgaggauaaagucuucaaugaaauccggaacgagcacuuuucaaauguuuucggauuucucagucagaaggcucguaaccugcaagcccaguacgaccgcagaagggguauggauauaaaacagaugaagaauuucgugagccaggagcuuaaaggccugaagcaagaacaucgguugcucucucugcacauuggggcaugugaguccaucaugaagaaaaagaccaaacaggacuuucaggaauuaauuaagacagagcacgcucugcuagaaggauucaacauccgagagucaaccagcuauaucgaggaacauauugaucgccaaguaaguccuauagagucucucagacugaugugccuuuuguccaucacugaaaauggccugauuccaaaagacuacaggagccucaagacacaguaucugcagucguacggucccgagcaccuucugaccuuuucuaacuugcggcgcgccgggcuccugacggagcaggcgccuggagacacuuuaaccgccguggaauccaaggucucaaaacuggugacagauaaggcagcuggcaaaaucacugacgccuucaguagccuagcuaagagauccaacuuuagggccauaucuaaaaagcucaaucugauuccacguguugauggcgaguaugaccuuaaggugccccgggauauggcauacgucuucgggggagccuacgugccguugagcugucgaaucaucgaacaaguacuggagagaaggucauggcagggucucgacgaaguugugcgccuguuaaacugcagugauuuugcuuucaccgacaugacaaaagaggauaaggcguccagcgagucucugcggcuuauuuuggucguguuucucggcggguguaccuucucagaaaucagugcacugagauuccuaggaagggagaaaggcuaucgcuuuauuuuccugacgacugccgucacaaauagcgcucgacucauggaagccauguccgaggugaaggcauga

SEQ ID NO: 64736 - RNA, 2391 nt, Artificial Sequence
  derived and/or modified sequence opt3 from VPS35__Homo_sapiens__NP_060676
augcccaccacacagcaaagcccucaggacgagcaggaaaagcugcucgaugaggccauccaggcugugaaaguccaauccuuccagaugaagagaugccuugacaaaaacaagcugauggaugcauugaaacacgccucuaauauguuaggcgaacugaggacuucaaugcuaaguccaaagagcuacuaugagcucuacauggcgauuuccgacgaacugcauuaucuugagguuuaccugacggaugaguuugcuaaggggcggaaaguggccgacuuguaugaacucguacaguacgcaggaaacauaaucccgcgccuguaucugcucauuaccgugggugucguguacguuaagucuuucccccagucgcgaaaagauaucuuaaaggaccugguggagaugugucguggcguccaacacccucuuagaggguuguuucugaggaauuaccuacuccagugcacacggaacauucugccagaugaaggagagcccacugacgaggaaaccacaggcgauaucucagacagcauggauuucgugcuucugaauuuugccgagaugaacaaauuguggguacgcaugcagcaucagggucacaguagagacagggaaaagcgggagcgcgaacgacaagagcucagaauacugguugggaccaauuuagugaggcugucccagcucgagggagucaacguggaacgguauaagcagaucgugcuuacuggcauucuggagcaagucguuaauugucgugacgcuuuggcacaggaauaccuaauggagugcaucauucagguguucccugaugaauuucaucugcagacacucaacccauuccugcgcgccugugcugagcuucaccaaaauguaaacgugaaaaauaucauaauugcccugaucgacagauuggcgcucuuugcacacagggaggauggccccgggauuccugccgacaucaagcuguucgauaucuuuucucagcaggucgcuaccgugauucagagccggcaagacaugccauccgaagauguugugucauuacaggucagucugauaaaccuagccaugaaaugcuauccggaccgaguggauuacguagacaagguucucgagacgacuguggaaaucuucaauaaacugaaccuugagcauauugcaaccagcucugcugucuccaaggaauugacacgccugcucaaaauccccguggauacuuauaacaauauacugaccguccuuaagcugaagcacuuucauccuuuguucgaguacuucgacuaugagucaagaaaaagcaugaguuguuacgugcucucuaacguucuggacuacaauacagaaauugugucccaggaucagguagacagcaucaugaacuuagucucgacccugauccaagaucagccagaccagcccguggaggauccugacccagaagauuuugccgacgagcagucucuaguuggaagguucauucaccuccugcgguccgaggaucccgaccaacaguaucuuaucuugaauacggcgcgcaagcacuuuggugccggcgggaaccagagaauuagguucacucugccgccucucguguuugcagcuuaccaacuggccuuccguuauaaagaaaauucaaaggucgaugacaaaugggagaagaagugccagaaaauauuuaguuucgcucaucagacaaucagcgccuuaauuaaggcagaacuggccgagcuucccuugcggcucuuucugcagggagcucuagcggcaggcgaaaucgguuucgagaaccacgagaccguggccuacgaauuuaugucccaggcuuucucucuguaugaggaugaaaucagcgacucaaaagcccaacucgcagccauuacucugauaaucgggacauuugagcgaaugaaguguuucagugaagagaaucaugagccacuuagaacccagugcgcuuuggccgcauccaaacuguuaaagaagccugaccagggaagggcgguaagcacgugugcucaccucuucuggucuggccgcaacaccgauaaaaauggcgaggaacugcaugggggaaagcgggugauggaaugccuuaaaaaggcccugaaaauugcaaaccaaugcauggaccccucauugcagguucagcucuuuaucgagauucugaauagauacaucuauuucuacgaaaaggagaacgaugccgucacaauacaggugcuaaaucaacugauccagaagauuagggaggaccucccaaaccuggaaaguagcgaggaaacugagcagaucaacaaacacuuucacaauacccuugagcauuugcgccugcgacgggaaucccccgagucugaagguccuauuuacgagggcuuaauccucuga

SEQ ID NO: 64737 - RNA, 1161 nt, Artificial Sequence
  derived and/or modified sequence opt3 from VPS36__Homo_sapiens__NP_057159
auggacagauucguguggaccagcggccugcucgagaucaacgaaacacuugucauucagcaaaggggaguucggauauacgauggggaggaaaagaucaaauuugacgccgguacucuguuguuauccacgcaccgccugauuuggcgagaucagaagaaucaugagugcuguauggcuauccuacucucucagauuguguucaucgaagaacaggcagccggcauagggaaaucagcgaagaucguagugcaucugcaccccgcuccuccaaacaaagagccgggacccuuucaaaguagcaaaaauuccuauauuaagcugucuuucaaagaacacggccagaucgaguuuuaccguagacugucggaagagaugacccagaggcggugggagaacaugccugucucacagagcuugcaaacaaaucgcgguccacagcccgggagaauuagggccgugggaaucguuggcauagaacggaagcucgaggaaaaacgcaaggagacugacaaaaacauuagugaagcauucgaggaucuguccaagcugaugaucaaggccaaagagaugguggaacucucuaagagcauugcuaauaaaaucaaggacaaacagggcgauaucaccgaggacgaaacaauucgauuuaaguccuauuuacugucaauggggauagcaaacccugucaccagagagacuuacggaagugguacacaguaucauaugcaacuugccaaacaguuggcuggcauccuucaggugccacuagaagagaggggagggauuaugagccucaccgagguauacugccugguuaaucgggcccguggcauggaacuucugucucccgaggauuuggugaacgcguguaagaugcucgaagcacugaaguuaccucugcgccucagagucuucgacuccggugugauggugaucgagcuucaaucacacaaagaagaggagauggucgccagcgcucuggaaacgguuagugagaaggggucuuugacuuccgaagaguuugccaagcuagugggaaugagcguacugcucgcaaaggagaggcugcuucuggcugagaaaaugggccacuugugccgggaugacucgguggagggccuccgauucuauccaaaucuguuuaugacccagucuuga

SEQ ID NO: 64738 - RNA, 1119 nt, Artificial Sequence
  derived and/or modified sequence opt3 from VPS37A__Homo_sapiens__NP_001138624
augagcuggcuguucccccucaccaaguccgccucuucaagugcugcaggcagcccugggggacuuacaucccugcagcaacagaaacagagauugaucgagucuuuaaggaacucgcacucacggcugcuaccaccgcaguuuccccaagaaaagccugugauuagcgucuacccacccauacgccaucaccucauggacaaacaggguguuuaugugacuagcccucugguaaauaacuucacgaugcauuccgaucuuggcaagaucauucagucucuguuggacgaguuuuggaaaaauccacccgugcucgccccuaccagcacagcguucccauaccuguauuccaacccgucagggaugagucccuacgcuagccagggauuuccuuuccugccacccuauccuccacaagaagccaaucgaucuaucacuucccucucagucgcagauaccgugagcaguucuacaaccucccacacuacagccaagcccgcugcaccgagcuuuggcguuuuaucgaaccugccucuucccauuccaaccguggacgccucuaucccuacgucccagaaugguuucggguacaagaugcccgaugucccagacgcuuuucccgaguugucagaacugagugugagccagcuaacugauaugaacgagcaggaggaaguacuccuggagcaauuccuuacccugccucaguugaaacagauaaucacagacaaggaugaccucguuaaauccauugaagaacuggcccguaagaauuuacugcucgagccaucucuugaagcgaaaagacaaacugugcuggauaaguaugaguugcuaacccagaugaagaguacauuugagaaaaagaugcagaggcagcaugagcugucagaaaguugcuccgcaagcgcccuccaagcucggcugaaagucgccgcacacgaggcugaggaagagucugacaacaucgccgaagauuuccuugagggaaagauggaaauugacgacuuucugucaaguuucauggagaaacgcaccaucugucacugcagaagggcgaaggaggaaaaauugcagcaggccauagcaaugcauagccaguuccacgcuccgcucuga

SEQ ID NO: 64739 - RNA, 858 nt, Artificial Sequence
  derived and/or modified sequence opt3 from VPS37B__Homo_sapiens__NP_078943
auggccggcgcugggagcgaggcaagauucgccggacugucccucgugcagcuuaacgaacuguuggaggacgaaggucaauuaaccgagaugguccagaagauggaagagacacagaauguucagcugaacaaagagaugacucuagcgucuaauaggucacucgcugaaggcaaccugcuuuaccaaccccagcuggauacguugaaggcccggcucacccagaaauaucaggagcugcaagugcuguuugaagcauaccagaucaagaaaacaaagcucgaccgccagaguagcuccgccucuuuagagacucugcuugcuuugcugcaggcagagggggccaagauugaagaggauaccgaaaauauggcugagaaauuccuagacggagaacucccucuggauucguuuauagacguauaucaaucaaagcgaaaacuugcccacaugcguagagugaagaucgagaaacugcaggagauggucuugaagggccagaggcucccacaagcgcuggcaccguuacccccucggcugccagaacucgcccccacagcuccucuuccauaccccgccccugaggcaagcgguccaccggcuguggcgccccgccgcauuccuccacccccuccacccguuccggccgggaggcuggccaccccuuucacugcagcuaugaguuccggacaggccgugcccuauccaggcuugcagugcccuccccuaccaccccgggucggccugccuacacagcaaggguuuucuagccaguucguguccccauacccgcccccucucccacagagacccccuccacgacugcccccgcaucagccuggauuuauccuucaauga

SEQ ID NO: 64740 - RNA, 1068 nt, Artificial Sequence
  derived and/or modified sequence opt3 from VPS37C__Homo_sapiens__NP_060436
auggagacccugaaggacaaaacacuccaggaacuugaggaacugcaaaacgauagcgaggccaucgaccaguuggcuuuagaaucccccgaggugcaggaucugcagcuagagagagaaauggcacucgccacuaauaggucucuggcggagcggaaccuugaguuccaaggcccucuggagauuucacgcaguaauuugagcgaccgauaccaggagcuccguaagcuggucgaaagaugccaggagcagaaagcuaagcuggaaaaauuuuccucugcccuccaaccagggacguuacuggaucuuuugcagguugagggaaugaagauagaagaggagucggaagcaauggccgagaaguuccuggaaggugaggugccgcuagaaaccuuucucgagaacuucucaagcaugaggaugcugagucaccuucggcgcguaagaguggagaaacugcaggaagucgugaggaagccccgggcuucccaggaguuggcaggcgacgccccuccaccccgcccuccacccccuguucgaccagugccgcaagggacacccccugucguggaagaacagccacagcccccucucgcuaugccacccuauccgcugccuuacucucccagcccauccuuaccuguaggacccacugcccauggcgcgcugccacccgcaccuuuuccaguugugucacaaccgaguuucuauagcgguccccucgggccuaccuacccagccgcucagcuuggacccagaggcgccgcaggcuauucuugguccccucagaggucaaugccaccccggccgggguacccuggaacaccaaugggugcuagcggccccggguauccucugcguggaggccgcgcccccaguccagguuacccucagcaaucucccuacccagcgaccgggggaaaaccgccuuaucccauccagccacaguugcccuccuuuccuggccagccacaacccagcgucccucuacagccgccauaucccccuggcccagcacccccuuacggguucccgcccccaccuggacccgccuggccagguuacuga

SEQ ID NO: 64741 - RNA, 2661 nt, Artificial Sequence
  derived and/or modified sequence opt3 from VPS39__Homo_sapiens__NP_001288067
augcacgacgccuucgagcccgugccuauccuggaaaagcucccacuucagauugauugccuggcugcaugggaggaaugguuguuagucggcaccaaacaagggcaucugcuacucuacagaauaaggaaggacguugugccggccgauguagcgagccccgaguccggaucuuguaaccgguuugaagugacacuggagaaaucaaauaagaacuucaguaaaaagauccagcagauucacgucgugagccaguuuaagauccuuguuucccuguuggagaauaacauuuaugugcaugaccuccugacuuuccaacagaucacgaccgucucuaaagcuaagggugccucgcuguuuacaugcgaucuccagcacacugaaaccggcgaggaaguguuacgcauguguguagcaguuaaaaagaaacugcagcuuuacuucuggaaggaccgagaguuucaugaguugcaaggggauuucucagugccugacgucccaaagagcauggccuggugcgaaaauaguauaugugugggauuuaaacgugauuauuaccugaucagaguggacggcaaggguuccauuaaagagcuauuccccacagggaagcagcucgaaccucuggucgcuccacuugcagauggaaaaguugccgugggccaggacgaucugaccguaguguugaacgaggaaggcaucugcacucagaagugugcucucaauuggacagacauucccgucgccauggagcaccaaccuccauauaucauagcggugcugccgagguacguugagauucggaccuuugaaccccgcuuacuggugcagucuaucgagcuccagagaccuagguucauuacgagcgggggauccaacaucaucuaugucgcaucaaaucacuuuguguggcggcuuauuccaguacccauggccacucaaauacagcagcuguugcaggacaaacaauucgaacuagcucugcagcucgccgagaugaaggaugacagugauagcgaaaagcagcagcaaauccaucacauuaaaaaccuguacgcauucaaucuuuucugccagaagcgcuucgacgagucuaugcagguuuuugcuaaacuggguaccgauccuacacaugugaugggcuuguacccagaccuccugcccacugauuaucgaaagcaguuacaauacccgaacccucugcccguccuauccggggccgagcucgaaaaagcgcaccuggcccuuaucgacuauuugacccagaagagaucacagcuggugaagaaacucaaugauagcgaccaccagaguucuacauccccacugauggagggaaccccuacgauaaagagcaaaaagaaacuucugcaaauuaucgauacuacauugcucaaguguuaccugcauaccaacgucgcauuaguggcuccccugcuaaggcucgaaaauaaccacugccauaucgaggaaucggagcacguucugaagaaagcccauaaguauucugagcuuauuaucuuguacgagaaaaagggccugcacgaaaaagcucuccaggugcugguagaccaguccaagaaggccaacucaccauuaaaaggucacgaacggacuguccaauaucugcagcaucuugggacagagaauuugcaccucauuuucaguuacagcguguggguucugcgugacuuucccgaggauggacuaaagauauucaccgaagaccugccugagguggaaucccucccacgcgauagaguccugggcuuucuuaucgagaacuucaaaggcuuggcaauuccguaccuggaacauaucauccacgugugggaggagacggggucuagguuucacaauuguuuaauucagcucuauugcgaaaagguacagggacugaugaaagaguaccuucugagcuuccccgccgguaagaccccugugccagcuggcgaagaggaaggggaguugggagaguaucggcaaaaacuccugauguuucuagaaauaucaaguuacuaugaccccggccgacugaucugcgauuucccuuuugacggucuccuggaggaacgcgcgcuuuugcuggggagaaugggcaagcaugagcaggcauuauucauuuacguucacauccucaaggauacaaggauggccgaagaguauugucauaaacacuacgaccggaacaaggauggaaauaaagacgucuaccugucccuucugcgcauguaucuaagcccacccucuauucauugccucggcccgaucaagcuggaguugcuggaaccuaaagcuaacuuacaggccgcacuccaggugcuggagcuucaccacucaaagcuggauacuaccaaggccuugaaucuccugccagcuaacacacaaauaaaugacaucagaauuuuccuagaaaaagugcuggaggagaacgcccagaagaaaagguuuaaucagguccuuaagaaccuccugcaugcagaauuuuugcguguucaggaggaacggauccugcaccaacaggugaaauguauuaucacugaggaaaaggugugcaugguauguaagaaaaagauagggaauagugcguuugcucgauaccccaacggagucgugguucauuauuucugcagcaaagaggugaauccugccgauaccuga

SEQ ID NO: 64742 - RNA, 2565 nt, Artificial Sequence
  derived and/or modified sequence opt3 from VPS41__Homo_sapiens__NP_055211
auggccgaggcugaagaacaggaaaccggcagccuggaggaauccacagacgagucugaggaagaggaaucagaggaggaacccaagcucaaauacgagagacuuaguaacggggugacugaaauccugcaaaaggaugcagccagcugcaugacgguccacgacaaauucuuggcguuaggaacccauuaugguaagguuuaccugcuagaugugcagggcaauauuacacagaaauuugacguauccccugugaagauaaaccagaucucucucgaugagucgggggaacacaugggagucuguucagaggacggcaaggugcaaguuuucggucuguauagcggggaggaauuucaugagacuuucgauugcccaauuaaaaucauugcugugcacccgcauuuugucaggaguuccuguaagcaguucgugaccggaggcaaaaagcugcuuuuguuugaacggucuuggaugaaucgcuggaaaagcgccguacuccacgagggcgaagggaacauccgauccguuaaguggcguggacaccugauagcaugggccaauaacaugggugugaagaucuucgacauuaucucaaaacagagaauuacaaauguccccagggaugacaucagucugcggccugauauguacccaugcagccucuguuggaaggacaacgugaccuuaauaauuggcugggggacuucugugaaagucugcuccguuaaggagcgccaugcuucagagaugagagaucugcccagcagguauguggaaaucguaagucaguuugagacagaguucuacauuucuggacuugcaccuuugugugaccaacuggugguccuauccuaugugaaagagaucagcgaaaagaccgagcgggaguacugcgcccgcccacgacucgacaucauucagccccugucggaaacgugugaggaaauaucuuccgaugcucuuacuguuagaggcuuucaggagaaugagugcagggacuaccaccuggaauauucagagggugaaaguuuguucuacaucgugagcccucgggaugucgugguagccaaagagcgugaccaggaugaccauauugauuggcuccuggaaaagaagaaauaugaggaggcguuaauggcagccgaaaucucccaaaagaacauaaaacgccacaagauucuggacaucgggcucgcuuacaucaaucaccuuguugagagaggagauuaugacauugccgcaaggaaaugucagaagauccugggcaagaacgcugccuugugggaauacgagguguauaaauuuaaggaaauuggccagcuaaaagcgauaucuccauaccugccgcgaggggaucccguccucaagccucugaucuacgagaugauucuucaugaguuccuggaaagcgacuaugagggauucgccaccuugauccgggaauggccaggugaccucuacaauaacucagugaucguccaagcagugcgcgaucaccugaaaaaggacagucagaauaagacauuacugaaaacucuagcugagcucuauaccuacgauaagaacuauggcaacgcccuggaaauuuaccuuacauugagacauaaagacguuuuucagcugauacacaagcauaaucucuucuccagcaucaaagauaagauugugcugcuuauggacuuugauucugagaaggcuguagacaugcuguuggauaacgaggacaaaaucucaauuaagaaagucguggaggaacucgaagauaggcccgagcugcagcacguuuauuuacacaagcuguucaaacgggaccaucacaaggggcaacgcuaccaugagaaacagaucagucuauacgccgaauaugauagaccuaaucuccugccauuucuuagggacagcacccacugccccuuggagaaggcacuggaaauaugccagcagcguaacuucguggaggaaacggucuaccuccugucccggaugggaaauucucgaucggccuuaaagaugaucauggaggagcugcacgacguggauaaagcuauugaauuugcgaaggagcaagacgauggcgaacuuugggaggacuugauccucuauagcauugauaaaccgccuuucaucacuggucugcuaaacaauauagggacacauguagaccccauucugcucauccacagaauuaaggaaggcauggagaucccaaaccugagggauucccuugugaaaauauugcaggacuacaaucugcagaucuuacuccgcgagggauguaagaagauucugguugcagauucacuuagucuguugaaaaagaugcaucggacccagaugaaaggcguccucguggacgaagagaacaucugcgaaucuugucugagcccuauucuacccuccgaugccgcuaagccauuuucaguggucguuuuccacugcagacauauguuucacaaagagugucugcccaugccuagcaugaacucugccgcacaauucugcaauaucuguuccgccaagaauagggggccaggaagugcuauacucgaaaugaagaaauga

SEQ ID NO: 64743 - RNA, 1314 nt, Artificial Sequence
  derived and/or modified sequence opt3 from VPS4A__Homo_sapiens__NP_037377
augaccacaagcacucugcagaaggccaucgaccucgugacgaaagcuaccgaggaagauaaggcaaagaacuacgaggaagcccuuagacuguaucaacacgcggucgaguacuucuugcaugcuauuaaguaugaagcccacuccgacaaagcaaaggagucuauaagggccaagugcguucaguacuuagaucgggcugagaaacugaaggacuaucuacgcucaaaagaaaagcauggcaaaaagcccgugaaggagaaucagagugaagggaaaggaagcgauuccgacucugagggugauaacccugagaagaaaaagcuccaggaacaacugaugggcgcaguagugauggagaaaccaaauauccgauggaacgacgucgccgggcuugaaggagcuaaggaggcccugaaagaagcggugauuuugccgaucaaguuuccccaccucuucacaggcaagcguacuccuuggagagguauucugcuguuugggccacccggaaccggcaaaucguaccucgcaaaggccguugcuacagaggccaauaacucaaccuucuuuagcgugaguuccucugauuuaaugagcaaauggcugggcgaguccgaaaaacuugucaaaaauuuguucgagcuggcaaggcagcauaagccuucaaucauauuuaucgacgaaguggauagucuaugugggagccggaacgagaaugaaucugaggcugcccgcagaauuaagacugaguuccucguacagaugcagggaguugguaacaauaacgacggcacacuggugcuuggggcgaccaauaucccauggguccuggauuccgccauuaggcggcgcuuugaaaaacgaaucuauauacccuugccugaggaagcagcuagagcccaaauguucaggcuccaccugggaucaacgccacacaacuuaacugacgcuaauauucaugagcuggcccggaagaccgaaggcuacagcggugcagacaucaguauuaucgugcgugauucucucaugcagccggugcgcaaaguccaguccgccacacacuuuaagaaaguuugcgggcccagcagaacuaacccuucgaugaugaucgacgaucuucugaccccauguucucccggagacccuggcgcuauggagaugacauggauggaugugccaggcgacaaguugcuagagcccguagugugcauguccgauaugcugaggucacucgcgaccacgcggccgacugucaacgcagacgaucugcuuaaggugaaaaaguucagugaagacuuugggcaggagagcuga

SEQ ID NO: 64744 - RNA, 1335 nt, Artificial Sequence
  derived and/or modified sequence opt3 from VPS4B__Homo_sapiens__NP_004860
augagcuccaccucucccaaccugcagaaggccaucgaccucgcuucaaaagcagcccaagaggauaaggcgggcaauuacgaagaggcccuucagcuguaucagcacgcugugcaguacuucuugcaugucguuaaauaugaagcacaaggggacaaggccaaacagaguauuagagcuaagugcacagaguacuuagauagggcagaaaagcugaaagaguaucuaaagaacaaagagaagaaagcccagaagccugugaaggaaggacagccaagcccggcugacgagaaagguaaugauuccgacggcgaaggggagucugaugaccccgagaagaaaaagcuccaaaaccagcugcagggagccauaguaaucgaacggccuaaugugaaauggucggaugucgcgggccuugagggugcaaaggaagcccugaaagaggcugugauuuugccaaucaaguuuccccaccucuucacugggaagcgcacgccuuggcgaggcauucugcuguuuggaccacccggcaccgggaaaucauaccucgccaaggcaguugcuacagaagccaacaauagcacuuucuuuaguaucuccucuagcgacuuaguguccaaauggcugggagagucagagaaacuugucaagaacuuguuccagcuggcgcgugaaaauaagccuaguauaaucuuuauugaugagaucgacagccuaugugguucuagauccgaaaacgagucagaagccgcaaggcggauuaagaccgaguuccucgugcaaaugcagggcguagggguugauaaugacggaauccuggugcuuggcgcuacaaacauaccauggguccuggacagcgccauucgcagaagguuugagaaacggaucuauauuccguugcccgaaccucaugcucgcgccgcaauguucaagcuccaccuggguaccacucagaauaguuuaacagaggccgauuuucgagaacuggggagaaaaaccgacggauacucuggcgcugauaucuccaucauugugagggacgcgcucaugcaaccagugcggaagguccagagcgcaacgcauuucaaaaagguucguggccccucgcgcgccgauccuaaccaccuuguggacgaucuguugacuccaugcucucccggggacccgggagcuauagagaugaccuggauggauguaccuggugacaagcuacuggaacccguggucuccaugucagauaugcucagaagucugagcaauacaaaaccaacugugaacgagcacgaccuucugaaguugaaaaaguuuaccgaggacuucggccaggaaggguga

SEQ ID NO: 64745 - RNA, 2349 nt, Artificial Sequence
  derived and/or modified sequence opt3 from VPS51__Homo_sapiens__NP_037397
auggccgcugcagccgcggcuggccccagcccuggguccggaccaggugacucuccggagggccccgaaggggaggccccugaaagaaggcggaaggcacacggaaugcugaaacucuacuauggccuuucagagggugaagccgcugggcgcccagcaggacccgauccucuggacccaaccgauuugaacggcgcccauuucgaccccgagguguacuuagauaagcugcgacgugagugcccucuagcucagcucauggacagugaaacagauauggucagacaaaucagggcccuggacagcgauaugcagacucuuguuuaugagaauuacaacaaauuuauuuccgcgacggacaccauacggaagaugaaaaaugauuuccgcaagauggaagacgagauggauagacuggcaacaaacauggccgugaucacugacuuuucugcuaggauuucggccaccuugcaggaccggcacgagcgcaucacaaagcucgcaggcguacaugcucugcugcgaaaacuccaguucuuauuugaacugccaucaagacuuaccaaguguguggaguugggggccuauggacaagcggucagguaccagggucgggcccaggcagugcugcagcaauaucagcaccuaccgagcuuccgugcuauucaggaugacugccagguuaucacugcccgccucgcucaacagcugagacagagguuucgggaaggcgggaguggagcccccgagcaagcagaauguguggagcuucuguuggcccucggcgagccugcugaagaacugugcgaagaguucuuagcgcaugcacgaggucgccuggaaaaagagcucagaaaucuugaggccgaacuggggccaucucccccugcuccagaugucuuggaguuuacagaccacggaggcuccggcuucguagggggacuaugucagguggccgcagccuaccaggaacuguuugcugcccagggucccgcaggcgcggagaagcucgcugccuucgcaaggcaacuggggagccgguacuuugcccuuguugaacgcagacuggcucaggagcagggaggcggugauaacuccuugcucgugagggcccuggaccguuuccaccggcgauuaagagcaccgggggcucugcuagccgcggccggccucgcugaugcagccaccgagauagucgaaaggguggcucgcgagcggcugggacaucaccuucagggcuugagagccgcauuccuggggugccucacggacgugaggcaagcgcuggccgcuccucgcgucgccggaaaagaaggucccggccuugcagagcuguuggcuaauguugccucaaguauccucagccauauuaaggcaucucuggccgcugugcacuuauuuacugcgaaggagguauccuucucaaacaaaccauauuuucgaggggaguucuguagccagggagugcgggagggccugaucgucgguuuugugcacaguaugugccagaccgcccagucuuucugugauuccccuggggaaaagggcggagcaacacccccagcucuacuccugcuuuugagccgucugugccucgacuacgagacugccaccauuucguauauccugacauuaaccgaugaacaauuucugguucaggaccaguuccccgugacgccugucucuacucuuugugccgaggcuagagagacagcaaggcgcuugcucacccauuacgugaaaguacagggccugguuauaucccaaaugcuacggaagucaguggaaacuagagacuggcugaguacacucgagccaaggaauguccgagccgugaugaaacgcgucguggaagauaccacggcgauugacguucagguggggcugcuuuaugaggaaggaguacggaaggcucagagcuccgauucuagcaaaagaaccuuuucagucuacaguuccagcaggcaacagggucguuaugccccgucuuacacacccucagcaccuauggacacuaacuugcugaguaauauccagaaguuauucagcgagcgcauugauguguuuuccccaguugaguucaacaaggugucuguccucaccggcaucaucaaaauuucgcugaagacacuucuggaaugcgugcgguugagaacuuuugggagguucggacuccagcaaguacagguggacugccacuuccugcagcuauaccuguggcgauuuguugccgaugaggaacucguccaucugcuuuuggacgaggugguggcuagcgcagcccugcggugucccgauccugucccaauggaacccuccguuguggaggugauaugcgagcgcggcuga

SEQ ID NO: 64746 - RNA, 1605 nt, Artificial Sequence
  derived and/or modified sequence opt3 from VPS52__Homo_sapiens__NP_001276105
auggagcagaugcugggcgccuuccaaagcgaccucuccucuaucucaagugaaauuagaacccuucaggagcagagcggggcuaugaacauaaggcugcggaaucgccaggcagugcgaggaaaguugggugaauuagucgauggccugguugugcccuccgcccuaguaacagcgauccucgaggcuccugugacugaaccacguuuucuggagcaacuucaggagcuggacgccaaagcagccgcugucagagaacaggaggcaagggggacggccgcuugcgccgaugugcggggaguuuuggaccgccucagagugaaggcggucaccaaaauuagggaguucauccugcagaagauuuacucuuuucggaaaccgaugacaaacuaucaaaucccccagacugcacugcucaaguaccgcuucuuuuaucaguucuuacugggcaaugagcgagccaccgcuaaggagauaagagaugaauacguggagacacuuucgaaaaucuauuugucauacuauaggagcuaccugggucggcuaaugaagguacaguacccuuuugaagcccucuuccguagucaacacuaugcacugcuugacaacuccugucgcgaguaccuguuuauuugcgaguucuuuguugugucugggccagcugcccaugauuuguuccacgcggucaugggaagaacccucagcaugacucugaaacauuuagacuccuaucuggccgauuguuacgacgcaaucgcuguguuucucugcauucacaucgugcuuagguuccggaauauagccgcuaagcgagauguccccgcccuggaccgcuauugggaacagguuuuggcacuacuguggccuagauucgagcucauucuggaaaugaacgugcagucaguaaggaguacagauccacaacggcuuggcggccuggacacccgcccccauuacaucacgagaagguaugccgaguuuagcucugcuuugguguccauuaaucagacuaucccuaacgaacguaccaugcagcuccuggggcaguuacaagucgagguggaaaauuucguucugcggguggcggcagaguuuucaagccgaaaagagcagcuagucuuccucaucaacaauuacgacaugaugcugggagugcuuauggaaagagccgcugaugacaguaaggagguagaaucuuuucagcaguugcugaacgccaggacacaagaguucauugaagaacuccuguccccaccguuugguggccuuguugcauucgugaaggaggccgaagcucugauagagcgcgggcaggccgaacgguugagaggagaggaggcaagggucacucagcucauccgcggcuuugguagcucguggaaaucuuccguggaaucacugagucaggaugucaugcggagcuucaccaauuuucgaaacgggacauccauuauccaaggagcguuaacccagcugauacagcuauaccaccguuuccacagagugcucucucagccccaacugagggcccuuccugcucgcgcagaguugauuaauauccaucaccugaugguugaacucaagaaacauaagccaaacuuuuga

SEQ ID NO: 64747 - RNA, 2499 nt, Artificial Sequence
  derived and/or modified sequence opt3 from VPS53__Homo_sapiens__NP_001121631
augauggaggaagaggaacuggaguucguggaggagcucgaggccguccuucagcugacccccgaaguucaauuggcuaucgaacagguguuuccuagccaggacccauuagauagagcagacuucaacgccguagaauacauuaauacacuguuuccgacugagcagucccuagcgaacauagaugagguggucaauaagaucaggcucaaaauucggcgccuggacgauaacauccgaacggugguucguggccaaaccaauguggggcaggacggaagacaggcucuugaagaggcccagaaggcaauucaacagcuguucgguaaaaucaaggauauaaaagacaaggccgaaaagucugagcagauggucaaagaaaucacaagggauauuaagcaguuggaccacgcuaaacggcaucucacuaccucaaucacaacccugaaccaccuucauaugcucgcaggcgggguggauaguuuagaggccaugacucgcagaaggcaauauggagagguagcuaaucugcuucagggcguuaugaacguguuggaacacuuucauaaguacauggguauuccccagauccggcaacugagcgagcgcgucaaagccgcgcagacagaacuagggcagcagauacucgcagacuucgaggaagccuuuccuucccaaggaaccaagcgaccaggcggccccucuaaugugcugagagaugcuugccuuguggccaacauucuggacccuaggaucaagcaggagauuaucaaaaaguucaucaaacagcacuugucggaguaucucguccuguuucaggaaaaucaagacguugcaugguuagauaagauugaccggcguuacgcuuggauaaaacgccagcugguggauuaugaggaaaaguacgggagaauguucccaagggagugguguauggccgaacggaucgcgguagaguuuugccacgugacgcgagccgagcucgcaaaaauuaugcgcacuagagcuaaggaaaucgaggucaagcugcuguuguucgccauacagaggaccacaaacuuugaaggauuccuagcuaaacgguucucagguuguacucugaccgacggcacacucaagaaacuggagagcccaccuccaaguaccaauccguuucuugaggaugaacccacgccugagauggaggagcuggccacugaaaagggggacuuggaucagcccaaaaagcccaaggcaccugacaacccauuccauggaauuguguccaaaugcuuugagccccaccucuauguuuacaucgagucucaagauaagaaucugggcgaauuaaucgaccgcuucguggccgauuuuaaagcucaggguccgccuaagcccaacacagacgaagggggagcgguccugccaagcugugcagaccuauucguguacuauaaaaagugcaugguacaguguucccagcucucaaccggcgaaccuaugauugcccugacuacaaucuuucaaaaguaccuuagagaguaugcuuggaaaauuuugaguggcaaccugcccaagaccacgaccagcucugggggacucacaauauccucacugcuuaaagaaaaggaggguagcgagguugccaaauucacucuggaagaguugugccucaucuguaauauucugaguaccgcagaauacugcuuagccacaacucagcagcuggaggaaaagcuaaaggagaaaguggaugucucucucaucgagaggaucaaccugaccggcgaaauggacacauuuuccaccgugauuagcucgucuauacaacuuuugguccaggaucuggacgcugccugugauccagcacucacugcgauguccaagaugcaguggcagaauguggagcauguuggggaccaaucacccuaugugacgaguguaauccugcacauuaaacagaacgucccuaucauucgugauaauuuagcuagcacacggaaguacuucacccaguuuugcgugaaauucgccaacuccuuuaucccaaaguucauaacucaccuguucaaaugcaagccgaucucuaugguuggagcagaacagcuuuugcucgacacccauagccugaagauggugcuacuggaucuccccucaauuaguucccaagucgugcgaaaagccccugcuagcuauacaaagaucguagugaaaggcaugaccagagccgagaugauucugaagguugucauggcaccacacgagccccuugugguguuugucgacaauuacaucaaauugcugacugauuguaacacagaaacguuccagaagauauuagacaugaagggucucaaaaggucugagcagucaaguaugcuggaacuucugcgccagcgguugccugcuccacccagcggggccgaguccucuggcucgcucagccugaccgcgccgacuccugaacaagaguccucaagaauuaggaagcuagagaaacugaucaagaaacgccucuga

SEQ ID NO: 64748 - RNA, 2898 nt, Artificial Sequence
  derived and/or modified sequence opt3 from VPS54__Homo_sapiens__NP_001005739
auggccagcucccacucuucaagucccgugccucagggcagcuccucugacgucuucuuuaagaucgagguugauccaucgaaacauauuagaccggugcccucacugccugacguaugcccaaaggaacccaccgugacagaucaacacagguggacugucuaccauagcaaagugaaccucccugcugcacuuaaugacccacggcuggccaagcgcgagagugauuucuuuacgaaaaccuggggguuggacuucguugauacagaagugauacccuccuuuuauuuaccucagaucucuaaggagcacuucacugucuaccagcaggaaauuagccaacgagagaagauccaugagcguuguaaaaacauuugcccaccgaaggacaccuuugaaagaacacugcuacacacccacgauaaauccaggacugaccucgaacaggugcccaagaucuucaugaaaccugauuuugcgcuggacgauucacuuacauucaauaguguacugccauggagccauuuuaacaccgcuggagguaagggcaaucgggacgccgcaucuuccaaguugcuccaggaaaaacugucacacuaucuggacauaguugaggugaacaucgcccaucagauuagccuccgcagugaggcuuucuuucacgcaaugacgucucaacacgaauuacaggauuaccugagaaagacuucccaggccgucaaaaugcuuagggacaagaucgcucagauugauaaagugaugugugaggggagcuugcauauccugcggcuagcccucacccgcaauaacugcgugaaggucuauaauaaacugaaacuuauggcgacaguucaccaaacucagcccaccgugcagguacuguugucgacaucugaguucgugggagcacucgaccugauagccaccacgcaagaggucuuacagcaggaacugcagggcauucauuccuuccgacaccucgguucacaacuuugugagcuggagaaguugaucgauaagaugaugauugcugaauuuaguacuuacagccauuccgaccuaaacagaccucuggaggaugacugccaggugcucgaagaggaaaggcugaucucucuuguuuucgggcuguugaagcagcggaaacucaauuuucuggagaucuauggagagaagauggugauuacagccaaaaacauaaucaagcagugugucauuaauaaggugagccaaaccgaagagaucgauacugacguaguugugaaauuagcagaucagaugcguaugcugaacuucccacagugguuugaccuacucaaggacauauucucaaaauuuacaauuuuccugcagcgcgucaaggcuacccuuaauaucauccacaguguggucuuguccgugcuggauaaaaaccaaagaacgagggaacucgaggaaauuagccagcagaagaacgccgcgaaggacaauucucuggauaccgagguugccuaccuuauccacgagggcauguuuauuucagacgcauucggcgaaggggagcugacacccauagcuguggauacuaccagucagcggaacgccagcccuaauuccgaaccguguucuucggacagcguauccgagcccgagugcacaacugauucaaguucuagcaaagaacauaccuccucaagcgcuaucccaggaggugucgacauuauggugucugaggauaugaaguugacagacuccgaacucggcaaacuggccaacaauauccaagaguuacuguacagugcaagcgauaucugccacgaccgagccguuaaguuucuaaugucucgcgcuaaagauggguuccucgaaaagcugaacuccauggaguuuauuacccuuucaagauugauggagacuuucauacuggacacggaacagaucuguggaaggaagaguacaagccuccugggcgcguuacagucgcaagcaauuaaauucgugaaucgguuucaugaggaacgcaagaccaaacugucccuuuugcucgacaacgagagauggaagcaggccgaugucccugcugaguuccaggaccugguggauucucuaagcgacgguaaaaucgcccugcccgaaaagaaaucaggggcaacugaggaaaggaagccagccgagguacucauuguggaaggacagcaauaugcuguugucggcaccgugcugcuuuugauccguauaauccuggaguacugccagugcguggauaauauucccagugucacaaccgacauguuaacucggcucuccgaucugcuuaaguauuuuaacucucgaagcugucagcugguuuugggcgccggggcacuccagguggugggacugaaaacaaucacgaccaagaaucuagcgcuguccucaagaugccuccaacugauuguacacuacaucccugucauaagggcucacuucgaagcccgccuuccaccgaaacaguauagcauguugcggcauuuugaccacauuacuaaggauuaccaugaccacaucgcagagauuagugccaaacugguggcuaucauggauucuuuauucgacaagcuccuguccaaguaugagguuaaagcccccgugccuagcgcauguuuuagaaacauaugcaagcagaugacaaaaaugcaugaagcuaucuucgaucuucugccagaggaacagacccaaaugcuauuucucaggauuaaugccucguacaagcugcacuugaaaaagcagcugucacacuuaaacgucaucaaugacgguggcccccagaacgggcucgugacagcggacguugccuucuacacuggaaaccugcaagcucuuaagggccugaaagauuuggaccucaauauggcagagauuugggagcagaagcgcuga

SEQ ID NO: 64749 - RNA, 1128 nt, Artificial Sequence
  derived and/or modified sequence opt3 from VPS72__Homo_sapiens__NP_001258016
augagccuggccggcgggagagcucccaggaagaccgcaggaaaccggcucuccggucuucuggaggccgaagaggaagacgaguucuaccagacaacuuauggcggguuuacggaagagucuggagaugacgaguaccaaggcgaucagucagacaccgaagaugagguggacagugauuucgacaucgaugaaggugacgagccuagcuccgauggggaggcggaggaaccacgccgaaaacguagagucguuacaaaggcuuauaaagaaccguugaagucuuuaaggccccggaaagugaauacuccugccggaucgucacagaaggcacgcgaggaaaaggcccugcuaccacucgagcugcaggacgauggcagcgacaguagaaaauccaugaggcaaucuaccgcugagcacacacggcagaccuuucuucgcguacaggaacgacagggccaaagcagaaggcggaaggggccccauugcgagcguccucugacucaggaagaguugcuccgcgaagcaaaaauuacagaggagcugaaccugagaucccucgaaaccuacgagagguuagaagccgacaagaaaaagcaagugcacaagaaacggaaguguccaggacccauaaucacguaucauucagucacugugccucugguuggugagccaggcccgaaagaagagaauguggauauugaggggagucuuugcuucagcuugucuuuuguccugcgacuagaccccgcuccuuccgugucagcccucaccccacacgcgggaacaggccccguaaacccuccagcacgcuguagcagaacuuucaucaccuuuagugaugacgccacauucgaagagugguuuccccaggguaggccgccuaagguucccgugcgggaagucugcccagugacccaucgcccugcucuguacagagaucccgugacggacauuccauaugccacugcaagggcuuucaaaaucauacgugaggccuacaagaaauacaucacagcgcacgggcuucccccuaccgccucugcacugggaccaggcccgcccccuccagagcccuugccuggcuccgggccacgggcucuccgacagaagauugucaucaaguga

SEQ ID NO: 64750 - RNA, 4287 nt, Artificial Sequence
  derived and/or modified sequence opt3 from VPS8__Homo_sapiens__NP_001009921
auggagaacgaacccgaccacgagaauguggaacagagccugugcgccaagaccuccgaggaggagcucaacaaaucuuucaaucuugaggcuucacugaguaaguuuagcuacaucgauauggacaaagaauuggaguucaagaacgauuuaauugacgauaaagaauuugacauaccucaagucgauacaccaccgacucuggaguccauccuaaaugagacggacgaugaagacgagucuuucauucucgaagaucccacccugcuuaacaucgacacaauugauucgcauucauaugacacuagcaguguugcauccucugacagcggcgauagaaccaaucugaagaggaagaaaaaguugccugacuccuuuucacuccacgggagugugaugcggcauagccugcugaaaggaaucucugcccagauaguauccgcggcugauaagguggacgccggucucccaacagcaaucgccgucagcucauuaauugcugugggcaccagucacgggcuggcacuuaucuucggaaaagaucagaaccaggccuugcgccugugucuaggcucuacuuccguuggugggcaauacggagcuauuagcgcccucucgaucaauaacgacugcucucgacugcuuuguggcuuugcgaagggccagauaacaaugugggaucuggcauccgggaaguugcuccguucaauuaccgacgcccaucccccuggaacggcuauccugcacauuaaauucacugaugacccaaccuuagccaucugcaaugauagugguggcagcguguuugagcugacauucaagagagucaugggggugaggacuugugaaucccggugccucuuuucuggaagcaaaggcgagguauguugcaucgagccccuucacucaaagccugaacugaaagaccauccaauuacccaguucaguuugcuagcaauggcuucccugacaaagauacucguuaucggucugaaaccgagccuuaagguguggaugaccuuucccuaugggcgcauggacccuucuucagucccacuguuggccuggcacuucguggcggugcagaacuacgucaaucccaugcucgccuucuguagaggagauguugugcauuuucuguuaguaaagagggacgagaguggcgcaauucacgugacgaaacaaaagcaucugcaccuauauuacgaucucaucaacuucacuuggauaaauagccggacagucgugcugcuugacuccguugaaaaauugcacgugauugaucgccagacccaggaggaacuggagacugucgagaucucugaagugcagcucguauauaacucgagccauuuuaagucccuggcuacaggcgggaacguuucacaagcccuugcucuggugggagagaaagccugcuaccagaguaucucuagcuacgguggccagauuuucuauuuggggaccaaguccgucuacgugaugaugcuccgaucauggagagaaagggucgaccaccuguuaaagcaagauugucugacggaggcacuagcccucgcuuggagcuuucaugaaggaaaagcgaaggcagugguuggccugucuggugacgccuccaaacggaaggcuaucguggccgaucguaugguagagauucuuuuccacuaugcagaccgcgccuugaaaaagugcccugaucaggggaagauacaggucauggagcagcacuuucaagacauggugccaguuaucguggauuacugccugcuccugcagagaaaagacuuacuguucagucagauguaugacaaacuuagcgaaaauucugucgcuaaaggcguguuuuuggagugucucgaacccuacauucuguccgauaagcuaguaggaaucaccccacaggugaugaaagaccugaucguucauuuccaagauaagaagcucauggagaacgucgaggcccugauugugcacauggacauaacaucacuugauauccaacagguggucuugaugugcugggaaaauaggcuguaugacgcaaugauuuacguuuacaaccggggcaugaaugaguuuaucaguccuauggaaaaauuauuccgagugauugcgcccccacucaacgcugggaagacucugaccgaugaacaggugguaaugggaaauaaacuucuggucuauaucagcuguugcuuggccggucgcgcauacccucucggcgacauacccgaagaucuggugccgcuaguuaagaaccagguguuugaguuccugaucagacuccauucggccgaggcuucccccgaagaggaaauuuauccuuacaucaggacacugcuucacuucgacacucgggaguuuuugaauguccuggccuuaaccuucgaagauuuuaaaaacgacaagcaggcaguggaguaucagcagcgcauuguugauauccuccugaaagugaugguagaaaauucugacuucacaccaagccaagucgggugucuuuuuaccuuccuggcuagacagcuagccaagccggacaacacucucuuugugaauaggacgcuguucgaucagguguuggaauuucugugcucacccgacgaugacagucgucacuccgagcggcaacaggucuuacucgaacugcuucaggcgggaggcauaguucaguucgaggaaucucgacugauuagaauggccgagaaggcugaguuuuaccaaaucugugaguucauguaugagagggaacaucaguacgauaaaauuaucgacugcuacuugcgcgauccucuccgggaggaggaaguguuuaacuauauacacaauauccugagcauuccaggucauuccgcagaggaaaagcagucaguauggcagaaagccauggaccacaucgaggagcuagugagccugaagcccuguaaagcugccgagcuugucgcaacacauuucagugggcacauugagaccgugaucaagaagcuccaaaaccagguucuguuguucaaauuucugagaucuuuacucgauccuagggaaggcauacacgugaaccaggagcugcuucagauuuccccaugcaucacugaacaauucaucgagcuguugugucaguuuaaucccacccaggucauugaaacacuccaagugcuggagugcuaccgccuagaggaaaccauccagauuacucagaaguaucagcugcaugagguuacagcguaccuucucgaaaagaagggagacauacacggcgccuuccugaucauguuggagcgauuacaaagcaaacugcaggaagugacgcaucagggggagaacaccaaggaggauccgucgcucaaggacgucgaagacacuaugguagagacaauugcucugugccagcguaauucacacaaccuuaaucaacagcagcgggaagcccugugguuuccuuugcuagaggcaaugauggcuccacagaaacugucuaguuccgccaucccccaucuccacagcgaggcacugaagucucuuaccaugcaaguguuaaacagcauggccgcuuucauugcgcugccuuccauccuccagagaauauugcaggaucccguuuauggaaaagguaagcugggcgaaauccaggggcucauucugggaaugcuugacacauuuaauuacgagcaaacucuguuggaaaccacgaccucacuacugaaccaggaucuccacuggaguuuauguaaucugagggccagcgugacacgcggccuuaacccaaaacaggacuauugcucuaucugucugcaacaguacaagcggagacaggagauggcagaugaaauuaucgucuucuccugcggucaucucuaccacucauuuuguuugcagaauaaggagugcacuguggaguucgaagggcaaaccagguggacauguuauaaaugcaguagcuccaacaagguaggcaaacugucugaaaauucgagcgaaauaaagaaaggacgaauuacuccuucacaggugaagaugucccccaguuaccaucagucuaaaggcgacccaaccgcuaagaaggggacgagcgagccgguccucgauccucagcaaauccaggccuuugaccagcugugucgccuuuaucggggauccucaagacuagcccuguugacagaauuaucucagaacaggagcagugaguccuaccgucccuucagcggcucucaaucagcuccagcauucaauuccaucuuucagaacgagaacuuccagcugcaacucauucccccuccaguuaccgaagauuga

SEQ ID NO: 64751 - RNA, 1191 nt, Artificial Sequence
  derived and/or modified sequence opt3 from VRK1__Homo_sapiens__NP_003375
augcccagagugaaggccgcucaggcaggcaggcaaagcuccgccaaacggcaccuggcggagcaguucgcugucggggaaaucauuaccgacauggccaagaaagaguggaagguuggacucccuauaggucagggcggguuuggaugcaucuaccuugcagauaugaacucuucagaaagugugggcagcgacgccccauguguagugaaagucgagccguccgauaaugguccccuguucacagaauugaaguuuuaucagcgcgcugcaaagccugagcaaauucagaaauggauccgaacucguaaguuaaaauaccugggggugccaaaguauuggggaucuggccuacaugacaaaaacggcaagucguacagauucaugauuauggauagguuugggucagaccuccagaagaucuaugaggccaaugcuaaacgguucagccgcaagacgguucugcagcuuagucugagaauauuggauauccucgaauacauucacgagcaugaauaugugcacggagacaucaaagccuccaaccugcugcucaauuacaagaaccccgaucaagucuacuuaguggacuauggucuggcguacagguauugcccugagggcguacauaaagaguacaaggaagauccaaaacggugucacgacgggaccauugaguuuacaucuaucgaugcacacaauggaguugcccccagccgccgaggcgaccuugaaauauuggguuauugcaugauucaguggcugacugggcaucuaccuugggaggacaaccucaaggauccaaaguacgugagagacuccaaaaucagguaucgggaaaauauugcuucacugauggauaaguguuucccggagaaaaacaagcccggagagaucgccaaauacauggaaaccgucaaacuucuggacuacacagagaagccuuuguaugaaaaucuccgugauauccuguuacagggccugaaggcaauuggcaguaaggacgaugggaaacucgaccuuagcgugguggagaacggaggucugaaggcuaaaaccauaacuaagaagcgcaaaaaggaaaucgaggagucuaaagaaccaggcgucgaggauacagaaugguccaauacccagacggaggaagccauucaaacuagaucaaggacccggaagcgaguucagaaauga

SEQ ID NO: 64752 - RNA, 1527 nt, Artificial Sequence
  derived and/or modified sequence opt3 from VRK2__Homo_sapiens__NP_001123953
augcccccuaagagaaacgagaaauacaagcugccaaucccguuccccgaaggcaaagugcucgacgauauggaggggaaucaguggguccuuggaaagaaaauugguagcggcggguuuggacugauauauuuggccuucccuaccaacaagccagaaaaggacgcuaggcacguugugaaaguagaguaccaagaaaauggccccuuauuuuccgagcugaaguucuaucagcggguggccaaaaaggauugcaucaaaaaguggauugagcgcaagcagcuagacuaccucgguaucccucuguuuuaugggucuggacuuacagaguucaaaggccgaucauaccguuuuauggucauggaaagacugggcauugauuugcagaagaucagugggcaaaacggaacuuucaaaaagagcacggugcuccagcuggguauaaggaugcuggacguucucgaauauauccaugagaaugaguacgugcacggcgauauuaaagcagcgaacuuacugcuuggguacaagaauccagaccaggucuauuuggcugauuacggacuguccuaucgguacugucccaacggcaaucauaaacaguaucaagaaaacccucgcaagggucacaaugggaccaucgaguuuacaucucuagacgcccauaagggaguggcacucucgagaaggucagauguagaaauucugggcuacugcaugcuucgguggcuguguggcaaauugccaugggagcagaaccucaaggacccgguugccgugcagacugcuaaaaccaaucuguuagaugaacugccccagagcguccucaagugggcaccuaguggguccucuugcugugagaucgcccaauuccuugugugcgcucacagccuggccuaugacgagaaaccaaacuaccaggcguugaagaagauacuaaauccccacgguauuccucugggaccacucgacuuuuccacaaaaggccagucaaucaacgugcauacccccaacagucaaaaggucgauagccagaaagcagccacuaagcagguuaauaaagcucacaaccgccugauugaaaagaaggugcauucugagcgauccgccgaaucaugugcaacauggaaaguacagaaggaggaaaaacuuaucgggcugaugaauaacgaggcugcccaagagagcaccagaaggcggcagaaguaccaggaaagucaggagccguugaaugaagugaacucuuucccucagaaaaucuccuauacgcaauuucccaauagcuucuacgagccacaccaggacuucacuucgccugauauuuuuaagaagucucguucccccucaugguauaaauacaccaguacagucagcacuggaauaaccgaccucgaauccucuacaggccuguggccaaccaucagccaguucacguuaucagaggagacuaacgcggauguguauuacuaucgcauuaucauacccguucugcuaaugcucguguuucuggcccuuuucuuuuuguga

SEQ ID NO: 64753 - RNA, 1623 nt, Artificial Sequence
  derived and/or modified sequence opt3 from VSIG10__Homo_sapiens__NP_061959
auggccgcuggcgggagcgcacccgagccuagagugcuggucugccucggagcccuucuggcggguuggguugcugugggcuuggaagccguagugaucggggagguccacgaaaacgugaccuuacauuguggaaauauuuccggccugaggggucagguuacaugguaccggaacaauucugagccaguguuccuacucucaaguaacagcucccugcgcccggcagaaccccgauuuucucuugucgacgccacuucgcugcacauagagucauugagccucggggaugagggaaucuauacgugccaagaaauucugaaugugacccagugguuccagguauggcugcagguugcuaguggcccuuaccaaaucgaggugcauauugucgcaacaggcacucucccaaacgggaccuuauaugccgcucguggaucccagguggacuuuucuuguaauagcuccucaagacccccuccaguggucgaauggugguuccaggcccugaacaguagcucugaguccuuuggucacaaucuuacaguuaacuucuuuucauugcugcuaaucagccccaaucuccagggcaacuauaccugccuggcgcuuaaucaacugaguaagaggcaucggaaagugacuacagaguugcucguauacuacccuccaccgucugcaccccaguguugggcccagauggcuuccgggagcuucaugcugcaguuaaccugccgcugggauggaggcuauccugacccagauuuucuguggauagaagaacccgguggggugaucgucggaaagucgaaacucggcguggaaaugcuuucugagucccaacugucagacggcaagaaauucaaguguguuacgagucacauuguggggccugaaagcggagccuccugcaugguccagaucagagguccaucuuugcuaagcgagcccaugaagacuuguuuuaccggcgggaacgugacacugacuugccagguaucaggagcauacccgccugcuaaaauucucuggcugaggaaucuuacccaacccgagguuaucauacagccaaguucccggcaccugauuacacaggauggccagaacagcaccuugacgauccauaacuguucucaagaccucgaugaagguuacuauauuugccgcgccgacucaccuguggggguccgagagauggaaaucuggcugagugugaaggagcccuuaaauaucggcggaauugucggcacuauagugagccugcuacuccuggggcuugcgaucauuuccggauugcugcuccacuacucuccaguuuucugcuggaaaguggguaacacaucgagaggccagaauauggaugacguaaugguccugguggauagcgaagaggaggaagaggaagaggaagaggaggaagaggacgccgcaguuggggaacaggagggagcuagggagcgggaggagcuucccaaggaaaucccuaaacaggaccauauacaccgugugaccgcccuggucaacggcaauauugagcaaauggguaacggguuucaggauuugcaggacgauuccucagaggaacagagugacaucgugcaagaggaagaucgcccaguauga

SEQ ID NO: 64754 - RNA, 1272 nt, Artificial Sequence
  derived and/or modified sequence opt3 from VSIG1__Homo_sapiens__NP_001164024
augguguucgccuuuuggaaggucuuccugauccucagcugccuugcuggccagguuuccgugguacaagugaccauucccgacggguuugucaacgugacaguuggaucuaaugugacucugauauguaucuacacgaccacagucgcaucaagagagcaguugaguauucaguggagcuucuuucacaaaaaggaaauggagccuaucucccauucuucgugcuuaucaacugaagguauggaggaaaaagccgugagccagugucugaagaugacccacgcgagggaugcucggggccgcugcaguuggacauccgagauuuauuucucucaagggggacaggccguagcaaucggccaguuuaaagaccgaauaaccgguagcaacgauccagggaaugccuccaucacuauuucacauaugcagccggcugacaguggaaucuacauuugugauguuaacaaucccccugacuuccuaggccaaaaccagggcauccucaaugugagcguccuggugaagccaucuaagccccuuugcuccgugcaggggcguccugagacaggacacaccauaucacugagcuguuugagugcacucgguacgccaucucccgucuauuacuggcauaaacuggaaggcagagauauuguuccugugaaggagaacuuuaauccaacuaccgggauccugguaauuggaaaccucacaaauuucgaacagggcuauuaccaaugcacugccaucaacagguuagguaauuccagcugugagaucgaccugaccucgucucacccggagguggggauuauagucggagcucuuaucggcuccuuggugggcgccgcgauuaucauaucaguugugugcuuugcacggaacaaagccaaggcuaaagccaaggaacgcaauaguaagacaauugcagagcuggaacccaugaccaaaaucaacccuagaggggagagcgaagcuaugccaagggaggaugccacgcagcuagaggucacucuccccuccucuauccacgaaacaggaccugacaccauucaggagccagauuaugaacccaagccgacucaagagccugcgcccgaaccagccccugguagcgagcccauggcagugccagaccuggauaucgagcuugaacuggagcccgaaacacagucagaguuggaaccugagccagagccggaacccgagagugaaccuggcguaguuguggagccacucuccgaggacgaaaaaggggucgugaaggcuuga

SEQ ID NO: 64755 - RNA, 984 nt, Artificial Sequence
  derived and/or modified sequence opt3 from VSIG2__Homo_sapiens__NP_055127
auggccgagcugcccggcccuuuccucugcggggcacuucugggauuuuuguguuuaagcggucuggcuguggaagucaagguuccaaccgagccgcuauccacaccccucggcaaaacugccgaacugacgugcaccuacucuacaucagugggggacaguuucgcgcuugaguggagcuuuguacagccuggaaagccaaucuccgaaucucaccccauucuguauuucacuaacggccauuuguacccuaccgguucgaaaucaaagagagugagccuccugcaaaauccacccacagucgggguggcuacccugaaacucacugauguucacccuagugacacaggaaccuauuuaugucaggugaacaauccaccggauuuuuacacgaacggccugggccuuauaaauuugacuguccuggugcccccuuccaacccacuaugcucucagagcgggcagaccuccguaggagguucaacagcccucagguguaguagcucugagggcgcacccaagccuguuuauaauugggugcggcuggggacuuucccaacccccuccccgggaucaaugguccaagacgaggugagcggccagcuuauccugacaaacuugagucucaccucuuccgguacguaccgcugcguggccacuaaucagauggggagcgcuucgugugaacugacauuaucugucaccgagccuucccagggacgaguugcaggcgcccugauuggcgugcuccuugggguacuguugcuaucaguggcugccuuuugccugguccguuuccaaaaggaaagaggaaagaagcccaaagagacuuaugguggcagugaucucagggaggacgcgaucgcaccagggauuagcgaacauacauguaugcgggccgauuccucuaagggauuucuggagcgcccuagcucagcuaguaccgugacgaccacaaaauccaaacuucccaugguuguguga

SEQ ID NO: 64756 - RNA, 918 nt, Artificial Sequence
  derived and/or modified sequence opt3 from VSIG4__Homo_sapiens__NP_001093901
auggggauccugcucgggcuucuguuguuaggacaccugaccguggacacauacgguagacccauucuagaggucccugaaagcguuacuggcccauggaagggggaugugaaccucccgugcacguaugacccccugcagggauacacccaaguacuugugaaauggcugguccagaggggcuccgauccugugacaauauucuugcgggacucuucaggugaucauauccagcaggccaaguaucaagggcgccuccacguuagucauaaagugccaggagacgucagccugcagcuguccacucucgagauggaugaccgaucucacuacaccugugaagugacauggcagacccccgauggcaaucagguaguucgugacaagauuacugaguuaagagugcaaaaacauucgucaaagcugcuuaagacaaaaaccgaagcuccuacgacuaugaccuauccauugaaggcaacaagcacugucaaacagaguugggauuggaccacagacauggauggcuaccugggggagaccuccgccggacccgguaagucucuaccuguguuugcgaucauucucaucauaagccugugcuguaugguggucuucacgauggcuuauaucaugcuuugcaggaaaacuucccagcaggagcacguuuacgaagccgcacgggcccacgcucgcgaggcaaacgacucaggcgaaacaaugagaguggccauuuuugcuaguggguguagcucugacgagccaaccucccaaaaucugggaaacaauuacucagaugagccgugcaucggccaggaauaucagauuaucgcccaaauaaacgguaauuacgcgagguugcucgacacuguaccccuggauuaugaguucuuagcaacagaaggcaagagcguguguuga

SEQ ID NO: 64757 - RNA, 576 nt, Artificial Sequence
  derived and/or modified sequence opt3 from VSNL1__Homo_sapiens__NP_003376
augggcaagcagaacagcaaacuggcccccgaggugauggaagaccucgucaaguccaccgaguucaaugaacacgagcuuaaacaaugguacaagggguuucugaaagauugcccuucuggaagauugaacuuagaagaguuccagcagcuguauguuaaguuuuucccauacggugacgcuucaaaguuugcacagcaugccuucaggacauuugauaaaaauggcgacgggacuaucgauuuccgggaguuuauuugugcgcuaaguauaacgagccgcggauccuucgaacaaaagcucaacugggcuuuuaauauguaugaccuggauggcgacgguaaaaucacccgaguggagaugcuugaaauuaucgaggccauuuacaagaugguagggacagugaucaugaugaaaaugaacgaggauggacugacuccggaacagcgugucgacaagauauucucuaagauggauaaaaauaaggacgaucagaucaccuuggacgaguuuaaagaagcagccaagucggaccccucaauugugcuccugcugcagugcgauauccaaaaauga

SEQ ID NO: 64758 - RNA, 447 nt, Artificial Sequence
  derived and/or modified sequence opt3 from VSTM1__Homo_sapiens__NP_001275720
augagaaagaggaugggccccacccggcugccucgccucgagugcagcggggccaucacagcucacuguucccuugaccugccaggaccggauaaacaugacgaauuggaggcacccucuaugaagacugauacgcgaaccauuuucguggccauauuuucaugcaucaguauuuuacugcuauuccucagcgucuuuaucauuuaccguuguucccagcacucuucgucaagcgaagagaguacaaaaagaacuucccauucuaagcugccugaacaagaggcggcugaggccgaccuuagcaacauggaaaggguuucccugucaaccgcagauccacagggugugacauaugccgaguugaguaccagcgcucucucugaagcagccuccgacacuacacaggagcccccuggcucacacgaguacgcugcccugaaaguauga

SEQ ID NO: 64759 - RNA, 711 nt, Artificial Sequence
  derived and/or modified sequence opt3 from VSX1__Homo_sapiens__NP_001243200
augaccggcagagacagccuguccgaugggaggacaucuucacgggcccucgugcccggagguaguccucgcggcagccgaccacguggguucgcuaucacugaccuucugggauuggaggcagaauuaccggcccccgcgggcccuggucagggguccggaugcgagggcccagcugucgcccccuguccuggcccagggcuggauggaucuucgcuagcaagaggugcccucccccugggccuugggcuguugugcggauuuggcacgcaaccuccagcugcagccagggcuccgugucuccugcuggccgacguucccuuccucccuccacggggucccgaaccugcggcaccauuagcccccucacgcccgccucccgcucuggggagacagaagaggagcgauaguguguccaccucugacgaggauagccaguccgaagaccggaacgaucuuaaagccucaccaacauugggaaagcgcaaaaagcgaagacacaggacuguauuuaccgcacaucagcuggaggagcuagaaaaggcuuucagugaggcccacuacccugacguguaugcgcgggaaaugcucgccgucaagacagagcugcccgaggaucguauucaaugcaaacuucuguugcucgaagcaccagugcauuggacccugcaggagacucaccgcuuacccagaccuaggggcggcgcuuga

SEQ ID NO: 64760 - RNA, 1086 nt, Artificial Sequence
  derived and/or modified sequence opt3 from VSX2__Homo_sapiens__NP_878314
augaccggcaaggccggggaggcucugagcaaacccaaguccgaaacaguggcaaaaucuacuucaggaggugccccugcgagaugcacgggcuucgggauccaggagauucucggacuuaacaaggaaccaccgaguagccaccccagggcugcccuggacggcuuggcaccuggucauuuacuggccgcucgguccguccuaucuccagcagggguuggaggcaugggccuccuggggcccggaggucuuccuggcuuuuacacccaaccaacauuccuggagguguugucggauccccagucaguacaccuccagccucuggggcgcgccagcggaccacuggacaccagucagacugcuuccucugauagcgaagacguguccucaagugaucgaaaaaugagcaagucugcccucaaucaaacaaagaaacguaagaaaagaaggcaucggaccauauuuacuuccuaucaguuagaggagcuggaaaaggcguucaacgaggcacacuacccggacgucuaugcccgcgaaaugcuugcuaugaaaacagaguugcccgaggauagaauccaggugugguuucagaauaggcgggccaaguggcgcaagcgagaaaaauguuggggcagaucaagcguuauggcagaguacggucuguauggggcuauggugaggcauaguauuccucuaccagaaucuauccucaaguccgccaaagacggaauuauggauagcugcgcgcccuggcugcuuggcaugcacaagaaaucgcuggaggccgcagcugaaucuggccggaagccugagggggagcgucaagccuugccaaaacucgacaagauggaacaggaugagcgcggacccgacgcucaggccgcaaucucccaggaggaacugagagaaaacucaauagccgucuuaagggcuaaggcgcaagagcacaguaccaaagugcuggguacgguaagcggcccggauucccucgcacggucuacugagaagccugaagaggaagaggccauggacgaagaccgacccgcugagcgccuuagcccaccucagcuggaggauauggccuga

SEQ ID NO: 64761 - RNA, 843 nt, Artificial Sequence
  derived and/or modified sequence opt3 from VTA1__Homo_sapiens__NP_001273300
auggccgcucuggcaccccucccuccacuuccggcccaguucaagagcauccaacaccaucugagaaccgcgcaggagcacgacaaaagggaucccguggucgcuuacuauugccgguuguacgccaugcagacaggcaugaagauugacuccaaaacuccugaaugucgcaaguuuuuaucuaaacugauggaucagcuagaggcacucaagaagcaacugggggacaacgaagccauaacgcaggagaucguuggaugcgcucaucuugaaaauuaugcacugaaaauguucuuguacgccgauaacgaggaccgagcuggucguuuucacaagaauaugauuaaaucauucuauaccgccagucuccugaucgaugugauuacaguauuuggcgagcugacugacgaaaacgugaagcauagaaaauacgcgagguggaaggcaaccuauauccacaauugucucaagaacggggagacaccacaggccggacccgucggcauagaagaggauaaugacaucgaggaaaacgaggaugcuggugccgcuagcuuaccuacccagccaacucaacccuccucuucgucaacauacgacccuagcaauaugccaagugggaacuacaccggcauucagaucccgcccggagcucacgccccugcgaauacgccagccgaagugccccauuccacuggcgauguucggcugaccccugaggacuucgcacgcgcucagaaauauugcaaguacgccgggucugcacuucaguaugaagacgugagcacagccguccaaaacuugcagaaagcacugaagcuacucacuaccggaagagaguga

SEQ ID NO: 64762 - RNA, 900 nt, Artificial Sequence
  derived and/or modified sequence opt3 from VTCN1__Homo_sapiens__XP_011540445
augggcagcgugaugcugcucaaggaguccugcgggaacgucuucuuuucugccguuagaaucaggcggucacgcaaacacaguauuauaagcaucauuaucauucuugcuggagcaaucgcccugauaaucgguuucggcauuuccgggcgacauucuaucaccgugacaacuguagcgucggcuggaaauauuggcgaagacgguaucuugucauguacguuugagcccgauauaaaguuaagcgacauugugauccaguggcugaaagaagggguccuaggacucgugcacgaguucaaggaaggcaaagaugagcugagugagcaagacgaaauguuucguggcagaaccgccguuuucgcagaucaggugauugucgggaacgccucccuuaggcugaagaaugugcaguugacagacgcuggaacuuacaagugcuauaucaucaccucuaaagguaagggcaacgcaaaucucgaguacaaaacaggggccuuuagcaugccugaaguaaacguugauuauaaugcuuccucagagacccugcggugugaggccccacgcugguucccgcagcccacuguggucugggcgagucaaguggaccagggagcaaacuuuagcgaagugucuaauacauccuucgagcugaacucagaaaaugucaccaugaagguugugagcguacucuacaacgugacgauuaauaacacuuauaguugcaugauagagaaugauaucgccaaagcuaccggcgacauuaaggucacagaaucugagaucaagagaaggucccauuuacagcugcuuaacagcaaagccucguugugugugucuuccuuuuucgcaauaucaugggcucugcuaccucucaguccauaccugaugcuuaaguga

SEQ ID NO: 64763 - RNA, 654 nt, Artificial Sequence
  derived and/or modified sequence opt3 from VTI1A__Homo_sapiens__NP_660207
augagcuccgacuucgagggcuacgaacaggauuuugccgugcugaccgcugagaucacaucuaagauugcaagaguccccaggcucccuccagacgagaaaaagcaaaugguugccaacguggaaaaacagcuugaagaggcgaaggagcuguuggaacagauggauuuagagguacgggaaauaccgccccagucacgcgggauguauaguaaucgaaugcguagcuacaaacaagagaugggaaagcuggagacugacuucaagagauccaggaucgcuuauucugaugaagugcggaacgagcuacucggugacgauggcaauucgucagaaaaccagcgcgcccaucugcuugacaauacggagagacuggaaaggagcagucggcgcuuggaggcaggguaccagauugccgucgagaccgaacagaucggacaagagaugcucgaaaaccugucccacgaucgagagaaaauucagagagcuagggaacggcugcgugagacagacgcaaaucucggcaagucuagccgcaucuuaacugguaugcugagaaggauaauccagaaccggauucuuuuggugauccuggggauuaucguugugauaaccauucuaauggccaucacauuuuccguccgacgccacuga

SEQ ID NO: 64764 - RNA, 699 nt, Artificial Sequence
  derived and/or modified sequence opt3 from VTI1B__Homo_sapiens__NP_006361
auggccagcuccgcugcaucuucagagcacuucgaaaagcugcaugagaucuuuagaggccuccacgaagaccuucagggggugcccgagaggcuguugggaaccgccgguacagaagagaaaaagaaauuaauucgggauuucgacgagaagcaacaggaagcgaacgagacucuggcugaaauggaggaggaacuacgcuacgccccucucaguuuucgaaauccaaugaugagcaaacugcguaacuauagaaaggaucuugcaaagcugcauagggagguccgguccacgccguugaccgccacacccggcgggcgcggagacaugaaauacggcauauaugcuguugaaaaugagcacaugaacagacuccagucucagagggcaaugcugcugcaagguacugaaucgcucaaucgggccacccagucaaucgagcgcagccaucgaauugcuacagagaccgaucagaucgggagugaaauuaucgaggaauuaggagagcagagagaccaacuggaaaggacuaagucccggcuugugaacacaucugagaauuugagcaaaucccguaagauacugcgcucaaugaguagaaaaguaaccacgaacaagcuacuccugagcaucauuauccuucuggaguuggccauucucggcggccugguguacuauaaguucuuuaggucucacuga

SEQ ID NO: 64765 - RNA, 1437 nt, Artificial Sequence
  derived and/or modified sequence opt3 from VTN__Homo_sapiens__NP_000629
auggcuccccugagaccucuccuuauccuggccuuguuagcauggguggcccuggcggaccaggagagcugcaaggggagguguaccgaaggcuucaacgucgauaaaaagugccaaugugacgagcuaugcuccuacuaucagucuuguugcacagauuacacugcugaauguaaaccacagguuacgcggggagacguguuuaccaugccggaggaugaauauacaguauacgacgauggugaggagaagaauaacgccacugugcacgaacaggucggcgggcccucacucaccagugaccugcaagcacagagcaaaggaaauccugagcagacaccagugcuuaagcccgaagaggaggccccugcuccagaaguuggcgcauccaagcccgaggguauugauucucgcccugaaacccugcauccagggcgaccgcagcccccugccgaggaagaguugugcucgggaaaaccauucgacgcuuuuacugaucucaagaacggcucacuguucgccuuucguggccaauauuguuacgagcuggacgaaaaagcggugagacccggguauccuaagcucauaagggaugucuggggaaucgaggguccaauugacgcagccuucacacggaucaauugccagggcaaaaccuacuuauuuaaggggagccaguacuggcgcuucgaagacggagugcuggaucccgacuauccgagaaacauuagugauggcuuugacgguaucccugauaauguagacgcugcccuugcauugcccgcucacuccuacucugggagggagcggguuuauuucuuuaagggaaaacaguacugggaauaucaauuccagcaucagccaagccaagaggagugugaaggcuccucacugagugccguguuugagcacuucgcgaugaugcagcgcgauagcugggaagacauauucgagcuacucuuuuggggccgaacgucugccgggacuagacagccucaguucaucuccagggauuggcauggaguccccggucaaguggacgcagcuauggccggccggauuuacaucucagggauggcuccacgucccagccuggccaagaaacagcgcuuuagacacaggaaccggaagggauaucgaagucagcgcggccacucuagagguaggaaucagaacucccggcgcccuagcagagcaaccuggcuuucgcuguucucuuccgaagagucaaauuugggggccaacaauuacgaugacuacaggauggacuggcucgugccagcuacaugcgagccgauucaaagugucuuuuucuuuagcggcgauaaauauuaccguguuaaccugcggacucgaagaguggacaccguagaucccccuuauccaagguccaucgcgcaguacugguuaggaugccccgcaccuggccaucuguga

SEQ ID NO: 64766 - RNA, 2268 nt, Artificial Sequence
  derived and/or modified sequence opt3 from VWA2__Homo_sapiens__NP_001258975
augcccccuuuccugcuccuugaggccgugugcgucuuucuguucagcagaguuccaccguccuugcccuuacaggaagugcacguaucuaaggagaccaucggcaaaauuucagcugcaaguaagaugaugugguguagcgccgcgguggacauaauguuucugcuagauggguccaacucugucggaaaagguucguucgaaaggucaaagcauuuugcuaucacagugugcgacggccucgauauuagcccugagcggguucgcgugggggccuuccaauuuaguuccacuccacaccuggaguucccccuugacucuuuuagcacgcagcaggaggucaaagcacgaaucaagcguaugguguucaagggaggcagaaccgagacagaacuggccuugaaauaccuccugcauaggggucugccugggggacggaaugcuuccguaccacagauucucaucauaguuacugauggcaagucacaaggcgacguggcauuacccaguaaacagcugaaggagcgcggggucaccguguuugccgugggagucagauucccuaggugggaagaacuucacgcuuuggccagcgagccacggggucagcauguucugcuagcggaacagguggaggaugcaacaaacggccucuuuucuacccuguccucaagcgccaucuguaguucugcuacuccggacugccgcguagaagcccaccccugugagcaccgaacacuugaaauggugagagaguucgcagggaaugcuccuugcuggaggggaucccggcguacccuggccgucuuggcggcccauuguccauucuauagcuggaaacgcguguuucucacgcaccccgcaacuugcuacagaaccacauguccuggcccaugcgauucgcaacccugucagaacggugggacuugcguuccggagggacuggacggcuaucagugcuuauguccucuggcuuucggcggggaagccaauugcgcucucaaacuuucucuggaguguaggguggauuugcuauuucugcucgacuccucagccggaaccacacuggaugguuuccuucgggcaaaggucuuugugaagcgauucguacgcgccguucugagugaagacagcagagcuagggugggcgucgcgaccuacucccgggaguugcucguggcaguccccgugggggaauaucaggacguuccagaucugguguggucuuuagacggcauuccuuuucgcggaggucccacgcugacugggagcgcccuaagacaagcugccgagaggggcuucggaucagcaacacguaccggccaggaucggccacgaagaguagucgugcuccugacugagagucauuccgaagacgagguugccgggcccgcuaggcacgcccgcgcacgggaacuuuugcugcucggaguggguagcgaggcggucagagcugaacuggaggagaucacaggcucuccuaagcacgugaugguauacucagauccacaggaccuuuuuaaccaaauuccggaacugcaggggaaauugugcaguaggcagcgccccggaugucgaacccaggcccucgaucugguguucauguuagacacgagcgcauccguuggcccugagaauuuugcccaaaugcagucuuucguccggucgugcgcucugcaguuugaagugaacccagaugugacccaggucggucuaguuguguaugggagccaagugcagacagccuucggccucgacacuaagcccacccgugcagcuaugcugagagccaucucccaggcgccuuaccuuggaggcguagggucagccggaacagcuuugcugcauauauacgauaaagucaugacugugcagaggggugcacgcccaggcguucccaaggccguggucgugcucaccgggggacggggcgcugaggacgccgcaguuccggcgcaaaaacugagaaauaacgguauuaguguguuaguagucggggugggcccugugcugucugagggacuuaggcgauuggccggcccacgcgacagccucauccacgucgcugccuaugcagaucugcgguaccaucaggacguucuaauugaauggcuguguggggaggcuaagcagcccgugaaucucugcaagccuucccccuguaugaacgaaggaucaugcguacugcagaauggcagcuauagauguaaaugcagggaugguugggaggggccacacugcgaaaaccguuuccuucgccggccuuga

SEQ ID NO: 64767 - RNA, 3555 nt, Artificial Sequence
  derived and/or modified sequence opt3 from VWA3A__Homo_sapiens__NP_775886
augaagaaauacagaaagaucagcauuggcugcuucgccauggcuacccagacaucccacguguuucaugggcaagagaacauguuccuggaaaaucacuguauaaggcggaacacuggacgcgacucuaaaaagccccucaaacagaagaauaugaacggucuuggccaaaauucagauaacgggcuguuggucacgcauguuaaucagacccaggacuuacugcgacuacagggaagugagacacagagcuccgauugggaagacucugaggauuggcucucggcacacucacugaagugccagaaacuuacucuggccgacuugaucagccaaggcaccgaagugcucgaggaggguacaaacguagugcagaagauuuguuuuaguacccagaucauucgucauuucgaauccaaacugucugauacuaucgaggucuaucaggaaagaauacaauggcugacagagaauagcaagaaagcguuugggcucaucaagggagcuaggguguccauuuuaaucgacguuucagccauuaguagcggcccucagaaggaggaguuccagaaagaucugaugucucuuaucgacgagcaauugucccacaaggaaaaacuguuugugcuaucauucggcaccaacgcagggagccucuggccagauccgauggaggucagugccucuacgcugcaggaacuuaagcugugggugaaaacuuugcagcccgacggagguuccaaucuccugcaggcuuuaaagaaaauauuuacccugaagggccucgauagccuuguagcaauuaugcggucgugcccugaccaaccaucugagauccuguccgacuacauucagcagucaacaauggggcgcgauuugaucauccacuucauuacuuauagaugugacgaucagaugcccccugccguucuaaagaaccuggcugaggccgugaggggauacuaucauugcuacaguccaaaaauggaacacuauaccagccgggacauggaugagcuccuggcggaaauacaaaaggcacagucccuucugucucauguccaggccuugcagcacagcucacccugugaggcucucacaugcaccauggaagagaucaguacggagauuacuaauggcccucugaucuccuuacugccaaaaccgcccaagcacgacgccccucuaacaauagaauuuccaaaccucgauaaaaccagcgcagaguggcugaaggugaauggucuuaaggcuaaaaaguugucucuguaccaagugcucgcccccaacgcguucucaccugucgaagaguuuguuccaauucugcagaaaacugugaguagcacaauccaugaaaaggccaugauccaguucgaguggcacgacgggaccgugaaaaacauucauguggaucccccguuccuuuacaaguaucagcaacagcugucccgcgcaaugcgaauguacgagagaaggaucgaaugguugucucucgcuucgcggcguauuuggggaacggucugugagaagcgcgugguugugcuguuagacauaagcgccaccaauuccauguauaucauucacauccagcauucacugagacuacuccuggaagaacaacuuaguaacaaagauugcuuuaauuugaucgcuuucggcucuacaauugagagcuggaggccugaaaugguccccgugucccacaacaaucugcagucagccuggcggugggcacucaaccugcgaugucgcggcagcagaaauguauuaucugcccugaggaaggcuguugagguggacuuuaaagacaaggauaaacaccagucccaggggauauaccuuuucacuggagguaucccagaccaagauaugccuaccuugagugcguauauggcagaagccugcggcgggugcgaccuccagcugaacgucugucuauuuuacgugggagagcccaagauggauacaacuccacccgcucgguaugccagccauaccgacacagcagccgcuuacaaggaagucacccgcgccgcaggcgguagauuccacugguuuggggauacuggcauuuacgagucugacgauaucaauuccauuaugucagagauggaaaaagcgcugaacuauagucagaagugcgcuuuccucauggccagccugaaaaaucauucgggaaaggugcuuggcuccucugcauugccuaaagagaagccaaaaacgcugcaguuaaggagccaaccgaagaagcucugucccccucguccaacaguuccccugggggcccggaugucaaucaaagacgauccugaccgagaaaagaguccaccccuuaaaucccugaaguggagaccguugucuagcagggugggaauauccccugcugccgcacagccaaccaaagaggguaugauggaacuccgccggaagacuaagucaagagaggcugagaccagccugcuacuguuuuacacagaaaaaggcaacgauguagggagugucuauaagaaauacccccagggaaggggccuccgccgaaccucuuccagcaucgaccugccucggaaggacacugugugcucgucacaggaguggguugccaaauauggucuuaagaaguugaaacuggaaauuucucguuguauggggcccaauugcacacaccaaaagaguggccagagauccgcgagcgccaaacacuguucuaucuucccaagcguggagauucauggagucgugaggcacauccaguggacgccucgcgaaauggagguauacauacggcauuuagagaaggugcucagaagguauguucaacgacugcaguggcuucuguccggcucacgccggcuauuugggaccguccucgaaaguaaagugugcauucuguuggauacuagcggaucuaugggucccuaccugcagcagguaaagacagaguuaguccuccugaucugggaacaacuuagaaaguguugcgacuccuucaaccuguugucauuugcugagaguuuccagagcuggcaggauacccucguugagacaacugacgcagccugucacgaagcuaugcagugggugacccaucugcaagcccagggcuccacgucuauucuacaggcacugcuuaaagcguucucguuucacgaucucgaggggcuguacuugcugaccgacggaaagccagauacaagcugcucauuagugcucaaugaaguacagaaacugagggagaagcgugacgucaaagugcacacuaucucccuuaacugcagugaucgcgccgcuguugaguuccugcggaaguuggccucuuuuaccggcgguagauaucauuguccggugggggaagacacacucagcaaaauacacucccugcuaacuaagggcuucaucaacgagaaggauccuacccugcccccauuugaaggagacgaucuuaggauucucgcacaagagaucacgaaagcucgaucauuccuguggcaggcccagucuuuucggagccaguugcaaaagaaaaaugacgcagaacccaaggucacauuaaguuga

SEQ ID NO: 64768 - RNA, 3885 nt, Artificial Sequence
  derived and/or modified sequence opt3 from VWA3B__Homo_sapiens__NP_659429
auggagaaguccggccccuccucuaccaucucagaacagcaacugcagagacaggagggguggauuaacacaaaaacugaccucgccgaacagagucuuauaagcuccgagaaguggcugcaauugcacggauuaaaaucuaauaagcugacgcuaaaacagauccucucgcagauugguuucccucauugcgaagauuacguggcuucacugggcaggccagucgcaagccgguaugccgacgggcuuuuuccgcagcuguaccgcgcggaggauggacgaguuuauaacuugaccgcuaagagugagcucaucuaccaauucguggaacaccugacacaggccguagaguccuauaagcagcguauggacuggcugacuucuaaaagcagacagauuuuuggcgugauccucgaacaaugugucaccauaguguuagauuucggugggauccuggagggagagcuugacuugugcagggaagcacugacaaugguucuacaggaacagguggcccauauuaccgaguuuaauaucauucgggucucccaagagcccgugaaguggcaggaaaacgcuacuccuguaacagagcagucaaucgcaaccgccauaaguuggguugagaaacucacgguggaacugacugucagcgaggcuggccgccuugaugcccuguuggaagcgggcagagacaagaccauugagucuaucuacuauuucguggugggggaugucccagaagaguccaaagagcuccuguuacagagggcacuggaaauucccuguccuguuuacacagugucauuuaaugcccggggagaggguacuaucgcuuuccucaaggaccuuagcgccaagacccacagucgcuuucaugcauucgcugaacgaacagagugcguagaauuuccagccuucucuaccaaagauggcgacaacgugaugacguggaauagcagaaagcugaaagggaaguugcccccuggagcgggcgucagggaggauguguuucuaguuuggcaagagauggaagaggccuguagcacucuggcacagauccagcggcucguggcugaaccaccgaaacccgacgucgccacaguggacugcgagucggagaccacuucuguagaaauugcuuccaacccugaggauacaugggacucaaagaccuggcugcagaaauacggucuuaaggcccaaaagcugaguuuguaugauguucucgcagacuguagcuuccgucacgccgaugggguggucgacauaaaagcuaagccagaaaaugaguccgugcagacgucugcggaaaccaacaaaaagacaguccacgcaaaauacugcagccgcuucgugcaugcccccuggaaggauggaucacugguucacgugaauaucacuaaggagaaauguaagugguauagugagcggauucauaccgcuuuagccaggauccggcgacgcauaaaauggcugcaggacggcucccagagccuauuuggcagacuccacaacgauugcauuuacauccugaucgacacaucucacucaaugaagaguaaacuugauuugguaaaggacaagauuauccaauucauucaggaacagcugaaauauaagagcaaauuuaauuucgucaaguuugacgggcaggcaguggccuggagggagcaacucgcugaaguuaacgaggauaaucuggaacaggcccaguccuggauacgggacaucaaaauuggaucuucgacuaacacccuuagcgcacugaagacagcguucgcugauaaggagacccaagccaucuacuugcucacugacggucgcccugaucagccacccgagacggugaucgaccaggucaaaagauuucaggaaauuccgauauauacaaucuccuucaacuacaaugaugagauugcaaacagguuucugaaggaaguggccgcuuuaaccggcggggaguuccauuuuuacaauuucggauguaaagacccuacucccccagaagccguacaaaacgaggaucugacccuacucgugaaggagauggaacagggccacucagaccuggagaaaaugcaggaucuuuauagugaaucuuugaucauggacuggugguacaaugcagagaaggauggugacagcaaacaucagaaggagauuugcuccaugaucucaacaccugaaaagugcgcuaaaccccaaagcgacguugauucuacccagacuuccagucugaacaugcucaaggggccauggggccugagcgaccagaaaguccagaagaaaaagguguuacacgccgagucuacaaagacgucccugcuucguucacaaaugaguagcuugcggucguccgcguguucugaacgaaaagauggacucagcaaugccucaaguagaaggaccgcucuguccgacaaggagaugucuauacuacuggcagaagaguggcucgaugacaaaagcuccgagaaggugacucgcgaaggcucacaggucuaugaucaugacagcagugauguuucuuccgagaacuggcugaaaacauacgggcuuguggccaagaaguugacccugauggacgcuuuaagcguggccgcaguaccccacucgucaacauaugucccugugcucgauaaacacguugugucuaaggucuuugacgaaguguucccacuggcgcauguuugcaaugauacuaacaaaaugacccuuaucaauccgcagggagccaagcugaacauuuacaaacggaagguggagcaagcuauccagaguuaugaaaagagauugaauaaaauuguauggagggcccucucccaggaggagaaggaaaaacuggacgcaaacaagcccauccaguaccuagagaauaaaacgguccugaaccaagcucucgaacgccugaacuggccuauaagccuuaaggaguugucuaugcuggaaagcgagauuuuagccgguaaaauguacauccagcaggcaauggagcuccaggaagccgcuaagaagaauuaugcgaacaaagccccaggcgagcaacagaagcugcaggggaaucccaccaaaaagacaaaauccaagcgaccugacccacuuaagggacagaaagugauugcacggugugaugaaaacggcuucuacuuucccgguguggucaagaaaugcguuucacguacucaagcucuggugggguucaguuauggcgacaccaagguagugagcacaucuuuuaucacuccggucggaggcgccaugccuuguccacuacuccaggugggggauuacguuuucgccaaaauagugauccccaagggauuugacuucuaugucccugcuauugugaucgcacugcccaauaagcacguugccaccgagaaauuuuacacgguguugaagugcaacaauagaagggaguucuguccacgcuccgcgcugauuaaaaucucacagaacaaguaugcuuuaaguugcagccauauaaaauccccucccauuccagaagauccggaggucgaagacguagaggccagaaauucugcauuucucuucuggccucugaaggaagccgauacacaggacucgagagagcccaggcgagagaagccacgccggaaaaagagacccgcuaaacaaccucuucagcaggcagccccaagcgauucagacgguuccagucacggcaucucuagccacggguccugucaaggaacccaucccgaaccuaggacugcgcaucugcacuuuccggcugccggccguuugggucucucaucucacgcaaucauugccacaccacccccucgcgcugcccugccaugcacccuacaggcaacucauagcaguaaggggcugcgguccgugcccgagacccuuuga

SEQ ID NO: 64769 - RNA, 2361 nt, Artificial Sequence
  derived and/or modified sequence opt3 from VWA5A__Homo_sapiens__NP_055437
auggugcacuucugcggccugcucacccuucauagagagcccgucccucugaagucaaucuccguuucugugaacauuuacgaauuuguagccggggugucagcuacauugaauuaugagaacgaagagaaagucccauuagaagcauucuuuguguucccgauggacgaggauagugccguuuacagcuuugaggcgcugguggacggaaagaaaauagucgcugaacuacaggauaagaugaaagccaggacuaauuaugagaaggcaaucucccaaggucaccaggccuuccuccuggaaggcgacucuucgucacgggauguguuuagcuguaacguagggaaucuucagcccggaaguaaggcugcaguuacgcugaaauacgugcaggaguugccucucgaggccgacggcgcucugcgcuucguccugccagccgugcucaacccccgauaucaauuuuccgguucuagcaaggauuccugcuuaaaugugaaaaccccuauugucccaguugaagaccugcccuacacacuuucaaugguggcgacuaucgauagucagcaugggauugagaagguacagagcaacuguccuuugucuccaaccgaauaucugggagaggacaaaacauccgcacaggugucacuagccgcuggccacaaguucgaucgugacgucgaacuccugaucuacuacaaugaggugcauaccccgagcguugugcuugagaugggcaugcccaacaugaagccugggcaccugaugggagauccaagugccauggucucuuuuuaucccaauauaccugaagaccaaccauccaacacuugcggugaguucaucuuuuugauggacagaagcggcucgaugcagucucccauguccucacaggauacaagucagcucaggauucaagcagcuaaagaaacccugaucuuacugcucaagagccuuccgauuggguguuacuucaauaucuauggauucggcuccucuuacgaggccugcuuuccugaaagcgugaaauauacgcagcagacuauggaggaggcgcugggucggguaaaguugaugcaagccgaccuagggggaaccgaaauacuggcaccccuccagaacauuuaccgcggcccaucaaucccuggccacccccugcagcuuuucguuuuuacagauggggaggugacugacaccuucagugucauuaaagaagugagaaucaauaggcagaagcaucgguguuuuuccuucggaaucggugagggcacaagcaccucucugauuaaagggauagcucgcgccucaggaggcacgagugaauuuaucacugguaaggaucgaaugcaaagcaaggcuuugagaacacucaaaaggucccugcagccagucguggaggacguuucuuuaucguggcacuuacccccugggcuaagcgccaagaugcucuccccagagcagaccgugauuuuccggggccagcgucugaucucauaugcacaacuuacuggacgcaugccggccgcugaaacaaccggcgagguaugcuugaaauacacgcugcaggggaagaccuuugaagauaaagucacauucccccuccagccuaagccagacgugaaccugacuauacauagacuugcggcaaagagucuguugcagaccaaagauaugggacucagggagacacccgccucugacaagaaagaugcucugaacuuaagccuggaguccgguguuauuagcagcuuuacugccuucaucgcaaucaauaaggaacuaaacaaaccugugcaaggcccacucgcccaccgggacgucccccgaccgauucugcuuggggcuucugccccuuugaagaucaagugucaguccggauuucgcaaagcacugcacagugacagaccacccagcgcgucucagccuaggggcgagcucaugugcuacaaggcuaaaaccuuccagauggaugacuauucccugugugguuuaauuucacauaaggaucaacacagucccggguucggcgaaaaucaucuggugcagcuuauauaccaccagaacgccaauggaagcugggacuugaacgaggaucucgcaaaaauccugggcaugucgcuagaagagauuauggccgcucaaccagccgagcugguagacuccucugggugggcaacaauccucgcugugaucuggcugcauagcaauggaaaggaucuuaagugcgaaugggaguugcuggaacggaaagccguugcguggaugcgcgcccacgcugguucaaccaugccuagugucgugaaggcagccauuacuuuucugaaauccucuguggaccccgcuauauucgccuuuuga

SEQ ID NO: 64770 - RNA, 3648 nt, Artificial Sequence
  derived and/or modified sequence opt3 from VWA5B1__Homo_sapiens__XP_011538989
augcccggccugcucaacuggaucaccggggccgcacuuccucugacagcuagcgacgugacuuccugcgucucuggauacgccuuggguuuaacggcgucacugaccuauggcaaucuagaggcucagccauuccaagggcucuuuguuuacccgcuggaugaauguacaacugugauuggauucgaggccguaauagcagacagaguggucaccgugcagaucaaggauaaagccaaacuugaaaguggccacuuugacgcuagccauguuaggucccccacagugaccgguaacauucugcaggauggggucucuaucgcaccucacucgugcacuccaggaaaagugacauuggacgaggaucucgaacggauucuguucguagccaaucugggcaccaucgcucccauggagaacguuacgauauuuaucucaacuagcagugagcucccuaccuuaccauccggcgccgugcgcguccugcuucccgcggugugugcaccuacagugccacaguucugcacuaagucuaccgggacaagcaaucaacaggcccagggaaaagaccgacauuguuuuggugcuugggccccgggcuccuggaacaaguugugccuggcaacccuacucaauacggaagucucaaaccccauggaguaugaguucaauuuucagcuggaaauucgugggccuugucuucuggcuggaguugagaguccaacucacgaaaucagagccgaugcggcccccagcgcaaggucugcuaaguccauuaucauaacauuggccaacaaacauaccuucgaccggccuguggagauucucauccacccaucagaaccccacaugccgcauguacugauugagaagggcgauaugacuuuaggugaauuugaccaacaccugaaagggcgcacagauuucaucaagggaaugaaaaagaaaagcagagcugagaggaagaccgagaucauucggaagcgccuccauaaagacauaccucaccacagugugaucaugcuuaauuuuugccccgaccugcagucuguccagccauguuugcgaaaggcccauggcgaguucauuuuccuaaucgauagauccagcucgaugucuggcauauccaugcacagggugaaagacgcaaugcugguugcccucaagucacugaugccugcuugccuuuuuaacauuaucggguucggaaguacguuuaaaagccuguuccccuccucucagaccuacagcgaagauucauuggcgauggcaugugacgauauccaacggaugaaggccgacauggguggcacaaauauucucaguccacugaagugggugauccgucagcccguccaucgcgggcacccuagauuacuguuugugauuacugauggagcuguaaacaauaccggcaaaguucuagaacucgugaggaaccaugccuucuccacacggugcuauagcuuugguauagggccaaacgucugccaccgacuggugaagggccuugcaucugucucagagggaagugccgaauugcugauggagggcgagcgccuccagccgaaaaugguuaagagccugaaaaaggcuauggcccccgugcuuuccgacgugacuguagaauggaucuucccugagaccacagaaguccuggugucuccaguuucggcaagcuccuuguuucccggggagagacucgugggauacgguauugucugugaugcgucacugcacaucaguaauccuaggucugacaagcggcgcagauauagcauguuacauucccaagaaucaggcagcucuguguucuaccacucccaggaugacgggccaggacuggagggcggugacugcgcuaaaaacaguggggcccccuuuauccuaggccaggcaaagaaugccaggcucgcuagcggagauucuaccacuaaacaugaccugaaccuuucccagcgucggcgagccuacucaacgaaucaaauuacaaaccacaagccguugccuagagcaaccauggcuagugauccaaugcccgccgcgaaaagguauccucugcgcaaggcccggcuccaggaccugacuaaucagaccagcuuagauguacagagauggcaaauagaccugcagccccuuuugaacucgggccaggaucucaaucaggggccaaagcugaggggaccuggugcucgccgacccucccuacugccacaaggcugucagccguuccucccuugggggcaggagacacaggcauggucucccgugcgggaacguaccagcgacucaagaaguccaggagaucuggagcccucccaccauccuucugccuuugaaacugagacaagcuccgacugggauccacccgcugagucacaagaaagggccagcccuagucgcccggcaacgccagcgcccguucuuggcaaagccuuggucaagggucugcacgacucucagcgguuacagugggagguguccuucgaacucgggaccccuggcccagagagaggaggcgcucaagaugccgaccuguggagcgaaacuuuccaucaccuugcagcuagggccaucauucgagacuuugagcagcuggcagagcgcgaaggggagaucgaacagggaucgaaccggagauaccaggugucagccuugcauacaucuaaggcuugcaauauuaucaguaaguauaccgcguucguccccguugauguguccaaaagcagguaccucccuacagugguagaguauccgaacucuggcgccgcacugcguaugcuagguagccgcgcucuggcccaacaguggcgggggacuuccucaggauuuggcagaccccagaccaugcucggugaagacagugccccaggcaaugauauggaggcuagcccuacggcacuguucucugaggccaggucccccgggcgagaaaagcacggagcgucagagggcccacagcggagucuugcuaccaacacauugagcuccaugaaggccucugaaaaucuguuugggucgugguuaaaccucaacaaaagccgccugcuuacuagagcagccaagggauuccugucaaaaccucuaauaaaggcugucgaguccaccaguggcaaucaaucuuuugacuacaucccccucgugagccugcaguuggcauccggugccuuccuguuaaacgaagcguuuugugaggcuacacacauuccaauggagaaacucaaguggacuucaccguuuaccugccauaggguuucucugacgacacggccuagcgaaaguaaaacccccuccccacagcuuuguacuagcucucccccucgacacccaucaugcgauuccuucagucuggagcccuuggccaaggggaagcucggacuggaaccuagagcaguggucgagcauacaggcaaacuaugggccaccgugguuggucuggcuuggcuugagcacagcucggccucuuauuucacugaaugggagcucguggcagcuaaggccaauuccuggcuggaacagcaagagguaccggaaggccgcacccaggggacauugaaagcggccgcaaggcagcuguuugucuuacuccgucauugggacgagaaccuggaguucaauaugcuuuguuacaacccaaauuacguguga

SEQ ID NO: 64771 - RNA, 2676 nt, Artificial Sequence
  derived and/or modified sequence opt3 from VWA7__Homo_sapiens__NP_079534
augcugcccaccgaggugccucagagccacccaggcccguccgcccuccuucuguugcaauuacugcuacccccuacaucugcuuucuuuccaaacaucuggucacuccuggcagcccccgggaguauuacucaucaggaccuuacggaagaggcggcucugaaugucaccuugcaguuauuccuggaacagccuccacccggaagaccuccacugaggcucgaggauuuucucggucggacacugcuugccgacgauuuguucgcagccuacuuuggcccggggagcucccgccgauuccgugcugcacugggagaaguuucuagagccaacgcugcccaagacuuucuacccacuucgaggaaugauccugaccuccacuucgaugcggagcggcugggccagggucgcgcaagacuugugggggcccugagggagaccguaguggcugcccgggcauuggaccauacacucgcucgccagcgacugggagccgcguuacacgcccugcaggauuuuuauucacauagcaacugggucgaacucggcgagcaacagccacacccccaccuucuguggccuagacaggaauugcagaaucuagcacaaguggcugacccaaccugcagugauugugaggagcuguccugccccaggaacuggcucggcuucacucugcuuacaucuggguacuuuggaacccauccgccuaagcccccagguaaauguagccacggcgggcauuucgaccgguccucaagucagccuccccguggaggcauaaauaaggauagcacgucuccagguuuuucaccccaccacaugcugcauuugcaggccgcuaaacucgcccuguuagcauccauccaagccuucagccugcuacgcaguagacucggggacagggacuucucucggcugcuugauauuacuccugcuuccagcuugucguuuguucuggacaccacaggaucuaugggcgaagagaucaacgcggcaaagauucaggcccgacaccucguggaacagcgcagaggcuccccaauggagccgguccauuaugugcugguacccuuccacgauccuggguuuggaccaguuuucacuaccucagaccccgauaguuuuuggcagcaacuuaaugaaauccaugcucuggguggcggggacgagccugagaugugcuugagcgcccuccagcuggcauuacugcacacaccaccccuauccgauauauucguguuuaccgacgccucuccgaaagaugcuuuccucacgaaccaggucgaaagccugacucaggagaggcggugucgcgugacauuucuugugaccgaagacacuucaagaguccaaggaagggcccgucgggagaucuugaguccucugcgauucgaaccauacaaggcaguugcgcucgcuuccggcggugaggugauuuuuacaaaggaucagcacaucagagacguagccgcaauugugggggagagcauggccgcucuggucaccuuaccccuggacccucccgugguugugccaggccagccucuugucuucucuguggauggauugcuccagaaaaucacgguaaggauacauggcgacauuucaaguuuuuggaucaagaaucccgccgggguuagccaaggacaggaagaggguggcgggccacugggacacacccgccgguucggccaguucuggauggugacaauggaugacccgccucagacugguaccugggaaauucaagucacagcagaggauacucccggggugagaguccaggcucagaccucccuagacuuucuguuccauuuuggcaucccaauggaagauggaccccacccuggccucuauccacugacacaacccguggccgggcuucagacccaguugcugguugaggugacuggauuagguucuagggcgaacccuggcgacccgcagccacacuucucgcauguaauccuccgcgggguccccgagggagccgaacugggccaagugccucuugagccaguuggucccccugaacgagggcuguuggcugcaagccucuccccgacgcugcuaucaacaccccggccauuuagucuggagcucauuggccaggaugccgcuggacguagacugcacagggccgcaccucagcccucuaccguggucccagugcuuuuggagcugagcggcccuuccggguucuuagcgcccggaucaaaaguaccacucagccugcgcauagccucuuuuuccggcccgcaggaccuugaucugcggacuuucgugaauccuaguuuuagccuaaccucuaaccucuccagagcucaucuggaauugaaugagucagccugggguaggcugugguuagaaguucccgacagugcagcuccagauagcgucgugauggugacagucaccgccgggggacgagaggcaaaccccguuccuccaacucacgccuuccuccgccugcuugugucggcucccgcgccucaagaccggcauacaacgccgaccggcuccucugacccaauccugacuacagccacccccgcauuuagcccuuucacauuggugacucaggguagagcuggcgccgggcucgccgcuggaucacccugguggggcaccguagggggaguccugcuacugcuuggccucgcaaguugguga

SEQ ID NO: 64772 - RNA, 3120 nt, Artificial Sequence
  derived and/or modified sequence opt3 from VWA8__Homo_sapiens__NP_001009814
augcagagcagacugcuccuucugggcgcccccgggggacacgguggcccugcuuccaggcggaugcgcuuguuacugcgacaagugguccagcguagaccagggggagacaggcagcggccggagguucgccuacuccaugcaggcucuggugccgauaccggggacacagugaacaucggagauguaucauacaagcugaaaauucccaagaauccugaacuugugccacagaacuauauaagugacagccuggcgcaauccgucgugcagcacuugagauggaucaugcagaaagaucuccugggccaggacguuuuccugauugggcccccuggcccacucaggcggucuaucgcuaugcaauacuuagagcugacuaagcgcgaaguggaguauauugcccuuucgcgagauacgaccgaaacagacuugaaacagagaagggagauccgggcaggaacugccuuuuacauagaucagugcgcuguccgugcagccaccgagggucgcacacugauccuagaaggccucgagaaggcugaaagaaaugugcugcccguacuuaacaaucuguuggagaacagggagaugcagcucgaagacgggcgguuccugaugucagccgagcgauaugauaaguuacugcgcgaccauaccaaaaaggaacucgauagcuggaaaauuguuagagugagugagaauuuuagggucaucgcgcuuggacugccugugccacgguacuccggcaacccguuggaucccccucuacgcucuagauuccaagcaagggacauuuauuaccugccauuuaaggaccagcucaaacugcuuuacagcaucggugccaauguguccgcugaaaaggucucacagcuguugaguuucgccacuacacucuguagccaagagucuuccacccugggguuacccgacuuuccucuggauucacuagcagcugccguucagauacucgacagcuucccaaugaugcccauuaagcacgcgauccaguggcuguauccguacaguauucuuuugggacaugagggcaaaauggccguggaaggcguacugaagcguuuugagcuccaggauucuggguccagccugcuuccuaaagaaaucgugaaggucgagaaaaugauggaaaaccacgugucgcaagcaucuguuacgauccggauugcugacaaggaggugacuauaaaaguccccgccggaacccgacuguugucccagccaugcgcuucagauagauucauccagacacucagucacaagcagcugcaagccgagaugaugcagagccauauggugaaggacauuuguuuaaucgguggcaaagggugcggaaagacuguaauagccaaaaauuuugcagauacccugggcuauaacauugaaccuaucaugcuauaccaggacaugacagcuagggaucuccugcagcaacgcuauacccuucccaauggugacacggcguggcgguccucuccauugguuaacgcagcccuggaggggaagcucgugcuguuagacggcauccacagagucaaugcuggaacucuggccgugcuucagagguugauucaugaucgcgaacucagccuguacgacggcucacgacuacugcgggaggaucguuauaugagacucaaagaggaacugcagcuuagugacgagcaguugcaaaagagguccaucuuccccauucacccuagcuuucgcauaaucgcacuggccgaaccaccggucauugggucuacagcucaccagugguuaggacccgaguuccucaccauguucuuuuuccauuacaugaagccucuggugaaaucagaagagauccagguuaucaaggagaaagugccaaacguaccccaagaagcccuugauaagcuguugaguuuuacucacaaacuccgggagacacaggacccuaccgcacagagccuggcggcuucccuaucuacgagacagcugcucaggauuucgcgacgccugagccaauacccaaacgaaaaucuucauuccgccgucaccaaggcauguuugucacgguuccugcccaguuuagccagaucugcucucgagaagaaccuggccgaugcaacaauagaaaucaauacugacgauaaccuugagccggagcugaaagacuauaagugcgaagugaccagcgguacacuaaggauuggcgcuguuuccgccccuaucuacaaugcgcacgagaaaaugaaggugccagauguccucuuuuaugacaacauucagcaugugaucguaauggaagauaugcugaaagacuucuugcugggggagcacuuacuccuggugggaaaucagggcguugguaagaacaagauagucgaccguuuucuucaccuguugaaucgcccccgggaauacauccagcuccauagagauacuaccgugcaaacacugacccuacagccuucagugaaagacgggcugauugucuaugaggauagcccccuuguuaaggccgugaaacucggccacauccuggugguagacgaggcugauaaggcaccaacuaacgucacguguauuuugaaaacacugguggaaaauggagagaugaucuuagccgacggcaggcgaauaguugcuaacucugccaaugugaacgggcgggaaaaugucgugguuauucauccugauuuccgcaugaucgugcucgcaaacagacccggauuuccauuccuggguaacgacuuuuucggcacccuuggggauaucuuuuccugccacgcgguagacaauccgaagccucacagugagcuggaaauguugaggcaguacggacccaacgucccagagcccauucuccagaaacugguggccgcuuucggcgagcuacggagccuggccgaucaagguauaaucaauuauccuuacucuacucgagaaguggucaacauuguuaagcaucuucagaaguucccaaccgaggggcucuccucagugguaagaaauguguuugacuucgauaguuacaacaaugacaugcgcgaaauccugauuaacacauugcacaaauauggcauccccauaggagcaaagccuaccagcguccaguuagcuaaagaguga

SEQ ID NO: 64773 - RNA, 2868 nt, Artificial Sequence
  derived and/or modified sequence opt3 from VWCE__Homo_sapiens__NP_689931
augugggccggccugcuccuuagagcugcaugcguggcccuguuguuacccggggcgccugcuaggggauacaccggucggaagccaccgggccacuucgccgcagagcgccgacgucuggggccccaugucugucuaagcggauuuggcuccgguugcuguccugggugggccccaucuaugggaggcggccacugcacacucccccuguguucauucgggugcggaagugguaucuguauugcuccuaacguuugcagcugucaggacggcgaacaaggggcaacuugcccagagacgcauggacccuguggcgaauaugguugcgaucuuaccugcaaucacgggggaugucaggagguggccagaguaugcccugugggcuuuuccaugacagaaacugcugucggcauaagguguaccgacaucgaugagugcgugacaucuucgugugaggggcauugcguuaacaccgaaggagguuucgugugugagugcggcccagggaugcagcugucagccgaccggcacagcugucaggauacugacgaaugcuugggaacaccgugucaacagcgcugcaaaaauaguauuggcuccuacaagugcucuuguagaaccgguuuucaccuccaugggaacaggcacagcugcgucgaugugaaugagugucggcgcccccuggagcgaagaguaugccaucacuccugucacaacacgguuggcucauuccugugcacuuguaggccuggauuucggcuccgugcggaccgcgugaguugcgaagcauucccaaaagccgucuuagcucccagcgccauccugcagccuagacagcauccaucuaagaugcuuuugcugcuacccgaggcaggcaggccggcucucuccccugggcacucacccccaagcggagccccuggucccccagcgggcgugcggaccacacgacugcccaguccuacuccacgccuuccgaccucuucccccagcgccccuguguggcuguugucgacacuccuggcaaccccaguccccacggcuucuuuacuggggaaucucagaccuccaucccuucugcaaggagaaguuaugggcacucccucaaguccgagggguccugagagcccacgguuggccgcugggcccuccccuuguuggcaucuaggcgccaugcacgaaucucgcagcagauggacagagcccggaugcucacaguguuggugcgaggauggcaaagugaccugcgaaaagguaaggugugaggcagccugcagucauccaauuccuucccgugacgggggauguugccccagcuguacugguugcuuucacucuggcgugguccgggcugaaggggauguguucucaccaccgaacgagaauuguacaguuugcgugugucuggcgggaaacgucaguugcaucagcccugaaugucccuccggcccaugccagacgcccccucagaccgacugcuguaccugcgugccaguacgauguuauuuucacgguagaugguacgcagauggggccguuuucucuggcggaggcgacgagugcacaacuugugugugccaaaauggggaggucgaauguucguuuaugcccugcccugagcucgcuuguccgagggaagaguggcgccugggaccaggccagugcuguuuuaccugccaggaacccacaccuagcacugguugcucccuugacgauaacgggguggaguucccaauaggacaaaucuggucacccggcgacccuugugagcugugcauuugucaggccgaugguagugucucuugcaagcggaccgacuguguggauagcugcccgcaucccaucaggauuccaggccaguguugcccugacuguuccgcagggugcacauauaccggaagaaucuucuacaauaacgaaacuuuccccucaguuuuggauccaugucucagcugcauaugccuguuaggcucuguggccuguuccccuguagacugccccauuacguguacauauccauuucacccggauggggagugcuguccugucugccgcgacuguaauuacgaaggacgaaaaguggcuaacggccagguuuucacccuggaugacgagcccugcacucgguguaccugccaacuaggugaggugaguugugaaaaggucccaugccagcgugccugugcagaccccgcgcuccugccuggggauugcugcagcucuuguccagacucccuuucacccuuggaggaaaaacagggacugaguccucauggcaacguggcuuuuagcaaggccgguagaucgcuccacggcgauacagaggcaccgguaaauugcuccucuuguccagggcccccuaccgccagccccucaaggccagugcugcaccuucugcaguugcuccugcgcacuaacuuaaugaaaacacaaacgcugccuaccagucccgcuggagcccauggcccacacucccuagcacucgggcugacugcuacauucccuggagaaccgggcgccucuccccggcuuagcccagguccuuccacacccccaggggcgccuaccuugccccuggccucaccgggagcuccacagccucccccaguuacucccgagaggagcuuuagugcaucuggcgcccagaucgucuccagauggccuccgcuccccgguacccuguuaacggaggcuagcgcccugucgaugauggacccaucaccuucuaagacccccauuacacuuuugggcccucgagugcucaguccaacuaccucccgccugagcacagcacuagcggccacuacccaucccgggccucagcaaccacccgugggagcuucucggggcgaagagagcacgauguga

SEQ ID NO: 64774 - RNA, 4773 nt, Artificial Sequence
  derived and/or modified sequence opt3 from VWDE__Homo_sapiens__NP_001129396
augcccggcggggccugcgugcuggucaucgcucucauguuccuugcauggggagaggcccaggaauguagcccugguggccaccaauuucugagauccccauacaggucuguucgguucgacucauggcauuugcagcagagugcggugcaggauuuaauuugcgaccacagccuguccccggggugguaucgcuuucuaauacucgaucgacccgcugagaugccuaccaaguguguagaaaugaaccauugcggaacacaagccccaaucuggcugucucuucgugacucggagacucugcccucaccuggcgaaauuaaacaguugacggcaugugccaccuggcaguuccucuuuagcacaacuaaggauugcugucuguuccagaucccagugagugucagaaauugcgguaacuuuuccguguaccugcuccaacccacccagggguguaugggauauugcgcugaggcaauuucugacgccagguuacacccuuguggcagcgaugagacagaaaccggcggggacugcguucggcagcuggcugccucccuuccaccgcccccugcgggacgcccagagguguuggucgaacugaucgagucaagacuauucuguaggugcaguuuugaugugcccgcaacuaaaaauagcguagguuuccauauagccuggucucggcucuccucacaggagguuaaggaagaacugacacaagaaaccacggugcaggcuuuuagccuucuggaguuggacggcaucaaccuccgccugggggaucgaauuuucugcagugccucugucuuuuucuuagaaaauccucacgugcaguccguggcaaucgagagccaagaguucuuugcuggauucaaacugcagccagaacucucgacuauuucugaggacggcaaggaauacuaucuuagaaucgaguccaccguccccauaauuuguucagaauuuagugagcuggaucaggagugcaagaucagcuugaaacuaaagacaauuggucaggggagggaacaccugggacucaaccuggcccuuuccucuugucauguugaccuguugcaaacuagcucaugcgcgaauggcaccuguagucacacauucguguacuauaccgccguaacggacuuuucccgggauggcgaccgugugagcaacaucgucgugcagccgaucguuaaugaggauuuccucuggaacaauuacauuccugacucuauacagaucaaagugaaggauguccccacugcauacugcuauacauuuaccgacccacauauuaucacuuucgaugggcgcguguacgacaacuuuaaaacaggaaccuucguacuguauaagucaaugaguagagauuuugaaguucacgugaggcagugggacugucggagcuuacacuacccugucuccugcaauugugguuucguggcucaagagggcggggauauagucacguuugacaugugcaacggacagcugcgagaaucucagcccuaucuauucauuaagucgcaggacgugacccgcaauaucaaaaucagcgaguccuaccucggcagaaagguuacaauuugguucucaaguggugccuuuaucagggcugaucugggggaguggggcaugucucuuacuauucgggccccaagcguggacuaucgcaacaccuugggacugugcggcacauucgaugaaaaccccgagaaugacuuucaugauaaaaacgggaugcaaauagaccagaauuucaacaauuacguagcauuuaucaacgaauggaggauucucccuggaaaguccaugucagauacucugccagucagcaugaccucuccggguaaacccuccuacuguaguugcagccuugacacagccgcuuauccuucuuccgaggaucuggacucagugaguagaagcgagaucgcguugggcuguaaggaucucaaucacguuucgcuguccucuuuaaucccagaacuggacgugaccagcgaguacauuaacucagauacucuaguccgugaaauaaauaaacauacgagucccgaggaauauaaccucaaucuguuccuucaggagaagaagcacaucaacuugacaaaacuggggcucaaugugcagaagcauccuggaaacgagaaagaagacucccugcaauacuuagcaaauaagaaauauacccagggccgggguucucacagccaggagaugcgauacaacagacaaaacagguggaagcgccagaauuuucacgaauuuccaccccuguuugccuucccgucccuuucacagacugacuuggaggaacucaccuauuucuucccugaggaucaugcugaggacguacagcaagaauuuuucccaagcuggcccacaccuagugggcugaccgaguacucuacucuaacacugugccaggaaacgcucgccaacuccagcauuggccggcugugucuugcauucuugggaaagagacuggauucggugaucgagaugugcguuaaagacgucuuacucaaggaugaccugucaugggccgaagcuggcguggcccuucuggagaaugagugugagaaaaggauuguggaggaagggaaguacaacaccgaggaguauggaacuucuaucgaagauauauugaguguccucaaaugccccaaucuguguuccgguaacggccagugcauggagugggggugugcaugcagcccaucuuuuagcuccuacgacugcucagauaguuaugacaaggcgccugaaaucacagagcuaggaaaugcuggcuucugugauguucagaaguacaacugcaugauggugcgcguguuugguaaaggguucaaggaacugcccagcauuaaaugugagguaaccaagcuccaauauaauucuuccgaguggaugccaggcgaaccgaucuacacacagacugucuuucacaacucacgagccguggacugccagcugccuaccgauguucagcaauucgacacgauggaccuugugggaggcaaacccaccgggaaguggcaguugaaggucaguaaugauggauauaaauuuagcaacccaaagauuacagugaucuacgacggcgcaugucagguuugcggucuguacaaaaaugauuccuguacuauaaaggagaacgugugcauuaucgacggguuauguuauguagaaggagauaaaaaucccaccucuccuugccucauuugucggccaaagaucucgcguuucacauggagcuuucuggagaacaaccaacccccugucauacaggcccuucaggacaaacugcagacuuucuacggcgaaaauuuugaguaucaauucguggcuuucgauccggaggguucagacauccauuuuacccuagauuccggcccagaaggggccagugugucuagcgcaggacucuucauguggaagacggaccuguugacaacccagcagauuacugucagacugaacgaugacugcgacgcugagacaaggguuaccaucgaagugacuguaaaguccugcgauuguuuaaauggcgggucaugcgugucugaccgcaacuuuagccccggaaguggcgucuaccucugugugugccugccugguuuccacgggucccuuugugagguugauauuagcggaugccagucuaauccauguggccuggguucauauaucuccggcuuucacaguuacagcugcgacugucccccugaauugaaaguggagacccaauucgucaaccaguuuacaacgcagaccgugguucucacucggucggauaagucugugaauaaagaggaagacgauaagaacgcccaggggagaaaaaggcaugucaagccgacauccggaaaugcguucaccauaugcaaguaucccuguggcaaaagccgagagugcguagccccaaacauuugcaaguguaaaccuggguacaucggaucaaauugccaaacagcucugugugaccccgauugcaagaaccacggcaaauguaucaagccaaauauuugccagugucuaccuggucaugggggagcaacuugcgacgaggaacacuguaaucccccaugccagcauggcgguaccugucuggccggcaaccuuugcacgugcccguacggguuugugggaccucgcugugagacaaugguuugcaaccggcacugugaaaacggcgggcagugccucacccccgauaucugucaaugcaagccaggaugguauggccccacuuguaguaccgcucugugcgacccuguguguuugaauggugggucuugcaacaaaccaaauacaugucugugccccaacggauucuuuggcgagcacugucagaaugccuucugccauccuccgugcaagaacggcgggcacuguaugagaaauaacgucugcguguguagggaaggauacacuggucgucgcuuucagaaauccauuugcgauccaaccuguaugaauggcgggaagugcguaggacccagcacauguucaugcccuaguggcuggagcgguaaacgguguaacacgcccauaugcuuacaaaaguguaagaaugggggagagugcaucgcaccauccauuugccauuguccuucuagcugggaaggcgugagaugccagauccccauuuguaacccaaaaugccucuauggcgggagguguaucuucccuaaugucugcuccugucgaaccgaguacucaggaguuaagugcgagaaaaagauacagauccggcgccacuga

SEQ ID NO: 64775 - RNA, 8442 nt, Artificial Sequence
  derived and/or modified sequence opt3 from VWF__Homo_sapiens__NP_000543
augauccccgccagauucgcuggcgugcugcucgcacuugcccugauuuugccugggaccuuaugcgcggaaggaacaaggggucgguccuccacugcucgcugcucucuguuuggcucagacuucgucaacacguuugaugggaguauguacagcuucgccggauauugcuccuaccuacucgccggcgguugucagaagcgaucuuuuucgauuaucggggacuuccagaauggaaagcguguuucacugagcguguaucuuggcgaauuuuucgauauucaccuguuuguaaacggcaccgugacacagggggaccagagagucaguaugccauacgccuccaagggauuguaucucgagacugaagcugguuacuauaaacugucuggcgaggcauacggguucguggccaggaucgauggaagcggcaauuuucagguucugcucuccgaccgguacuucaacaagaccugcgguuuaugugggaauuuuaacauuuucgcugaagaugacuucaugacacaagagggaacccugacuucagauccguaugacuuugccaauaguugggcgcuuagcucuggcgagcaguggugcgaacgcgcaucacccccuagcagcaguuguaacaucucuuccggcgagaugcagaaaggguugugggaacagugccaacugcuaaagagcacaucgguguucgccagaugucauccacucgucgaucccgagccuuuuguggcucugugcgagaagacccuuugugaaugcgccggaggucuggagugcgcauguccagcuuugcucgaauacgccaggacgugcgcgcaggagggcaugguacuguauggguggacugaccacucugccuguucccccguuugcccugcaggaauggaauaccggcagugugugucaccaugcgcucgcaccugucagaguuuacauauaaaugagaugugccaagagcgaugugucgauggcugcagcuguccggaaggucagcugcucgacgaggggcuuugcguggaauccacagagugccccugugugcacucuggcaaaagauauccuccaggaacuagccugucaagggacugcaacaccuguaucugccggaauagucaguggauuuguuccaacgaagagugccccggcgaguguuuggucacagggcaaagccauuucaagucuuuugauaaucguuacuucaccuuuucaggaaucugccaguaucuacuggcccgcgacugucaggaucacaguuucagcauuguuaucgaaacggugcagugcgcugacgauagagacgccguauguacuagguccgugacaguccggcucccuggucugcacaacucucuugugaaacugaagcauggcgcagggguugccauggauggacaagacgugcaguugccacuccugaaaggcgauuuacgaauacagcacaccgucacugcuucggugcgccugagcuacggugaggaccuacagauggauugggacgggagaggcaggcuccugguaaaacuuucccccguuuacgcgggaaagacaugcggcuugugcgggaauuauaacggaaaccaaggugacgauuuucugaccccgucaggccucgcagaaccucggguggaggacuucgggaaugccuggaaacugcauggagauugucaggaccuucagaagcagcacagugaucccugcgcucugaacccacgcaugacgagauuuucugaagaggccugugcagucuugaccagcccuacauucgaggccugccacagggcugugagcccccucccauaccugcguaauugucgguaugacgucugcucauguagcgauggccgagaaugcuuauguggugcccuggcaucuuacgcggcugccugcgcagggagaggcgugaggguugccuggcgcgagcccggacggugugaacuaaacugcccuaaaggccaaguguaucuccagugcgggacuccauguaaucugaccugcagaucccuuaguuacccggacgaggaguguaacgaggcuugcuuggagggauguuuuugucccccuggccuguauauggaugaaaggggugacuguguaccaaaggcccagugccccuguuacuacgauggggagauuuuccagccugaagacaucuucagcgaucaucacacaaugugcuauugugaggacggauuuaugcauugcacuaugucuggcgucccagguucccuccugcccgacgcaguguuaucaaguccgcugagccaccgcucgaaacgaucccuuucuugccggccuccaaugguuaaguuggugugucccgcugauaaucuccgugccgagggccuggaaugcaccaaaacaugucaaaacuacgaccuagagugcaugagcauggggugugucucaggaugccuguguccucccggcauggugagacaugaaaauaggugcguagcgcucgagcgcuguccaugcuuccaccaggggaaggaauaugccccuggagagaccgugaagauuggcuguaacacuugcguuugccgggauagaaaauggaauuguacggaccacgucugcgaugcuacauguaguaccaucgguauggcacauuaccugacuuuugacgggcuuaaguauuuguuccccggagagugccaguacgugcuggugcaagauuauuguggcuccaacccagguaccuuuaggaucuuagucggcaauaaagggugcucucacccgagcguuaaguguaaaaagcgagugacaauucucguggaaggaggcgagauagaacuguucgacggggagguaaacgucaagcgcccuaugaaagaugaaacccauuuugaggugguugaguccggacgguacaucauucuucuguugggcaaggcccucucaguggucugggacagacaccugagcaucagugugguucuaaaacagacuuaccaggaaaaggugugcggucugugugggaauuucgauggaauacagaacaacgaccucacaucuuccaaucugcaaguagaggaagaucccgucgacuuuggcaacagcuggaaagugucgucacagugcgcugacacgaggaaggugccacuugauucuagucccgccaccugucacaauaacauuaugaagcagacuauggucgacuccagcugccguaucuugacaucugauguuuuccaggacuguaauaaacugguggauccugagccauauuuagacguaugcaucuacgauaccugcagcugugaguccauuggugacugcgcauguuuuugcgauacaaucgcggccuaugcucaugugugugcccaacacggcaaggucgugacuuggcgcaccgcaacgcucugcccccagucaugugaagaacggaaccugagagaaaauggguacgagugcgaauggagguauaacaguugugcuccugccugccagguuaccugucagcauccggagccacuugcaugccccgugcaaugcgucgagggaugucacgcccauugcccuccaggcaaaauucuggacgaacuacuccagacauguguggaucccgaggacugcccuguuugugaaguggcugggcgacgguucgcgagcggaaagaaagucacucugaauccgucugaccccgagcacugccagauaugucacugcgauguagugaacuugaccugugaagccugccaagagccaggcggucugguugugccucccacagacgcaccagucuccccuacuaccuuauacguggaggauaucucagaacccccacuccaugacuuuuauuguagucgccugcuugaucugguauucuugcucgacgggagcuccagacugucugaggcugaguucgaggugcuaaaggccuuugucguugauaugauggaaaggcugcggauuucgcagaagugggugcgaguggccgucguggaguaccacgacggaagccaugcuuacaucggccuuaaagauagaaagcgcccgucagagcucaggcguaucgcaucccagguuaaauaugccggcagucagguagcgucuacgagcgaagugcugaaguacacauuguuccaaauauuuuccaaaauagaccggccugaggcuucaagaaucacccuguuacucauggccucucaggaaccccagaggaugagccgcaauuucguccgauaugugcaggggcugaagaaaaagaagguuauugugaucccagucggaauugguccccacgcaaaccuuaaacaaaucagacugauagagaagcaggccccugagaauaaggcuuuuguguugaguuccguagaugaacucgagcagcagcgggacgaaaucgucagcuaccugugcgaucuagcaccagaggcacccccuccgacucugccacccgacauggcgcaagugacaguuggcccugggcuucucggagugucuacccugggccccaagaggaacucaauggucuuggacguggcuuucguuuuagaagguuccgauaaaauuggggaggccgacuuuaaucgcaguaaggaguucauggaagaggugauccagcguauggaugucggacaggacagcauucaugugacuguacugcaguauucguacauggugaccguugaauauccauuuucugaggcacaauccaagggcgauauccuccagagaguccgggaaauaagguaccagggcgggaaccgcacaaacacgggacuggcccuucgauaccugagcgaccacucauucuuggugagucaaggugauagagagcaggcuccuaaucuaguguauauggucaccggcaaccccgccucugacgagauuaaacggcugccaggggauauccagguagugccuauuggaguuggcccgaaugcaaacgugcaggaacucgagaggaucgguuggcccaaugcuccaauacugauccaagacuuugaaacucuuccucgcgaggcccccgauuuaguccugcagagaugcuguuccggggaaggacuccagauuccaacauugagcccugcgcccgacugcucacagccgcuggaugugauccuccugcuugacggcaguagcuccuucccagccucuuacuucgacgagaugaaauccuuugcaaaggcuuucauuuccaaggccaacaucggcccuaggcugacccaaguuucaguguugcaguaugggucuauaacaacuauugauguccccuggaaugugguaccagagaaagcucaccuacugagucucguggacguuaugcagcgggaaggaggucccucgcagaucggcgaugcauuaggguuugccguccguuaccugaccagcgagaugcauggagcccgcccuggcgcuuccaaggcgguggugauccuugucacggacguuucuguggauucaguagacgcagccgcugaugccgcacgaagcaacagagugacagucuucccgauugguaucggggacagguaugaugccgcucaacugcggauucucgcgggacccgccggcgacuccaaugugguuaaguugcagcgcauagaagaucugccaaccauggugacucucggcaacaguuuucugcacaaacuuuguucuggguucgucagaaucugcauggacgaggacggaaaugagaagaggccuggugauguauggacccuacccgaccagugucauacagugacuugccaaccugauggccagacccuguugaaaagccaccggguuaacugugaccgaggguuaagaccaucaugccccaauucccagaguccugugaaggucgaagagacauguggaugccgcuggacguguccaugcgugugcaccggcagcucuacuaggcacauugucacauuugauggucagaacuucaaacugaccggguccuguucauacgugcucuuucaaaauaaggaacaggaccuggagguuauccuucauaacggagcaugcagccccggcgcucggcagggcuguaugaagucgauugaagugaaacacucugcccugaguguagagcuccauuccgauauggaggugacugucaacgggcguuugguuagcgugccguaugucggagguaauauggaagugaacguauacggcgcaaucaugcacgaggugagauucaaucaucuggggcacauauuuacauucaccccucagaacaaugaauuucaacuacagcugucaccaaagacguucgccuccaaaacuuacggacucugcggcaucugugacgagaacggugcuaaugauuucaugcuuagggacgggaccguuacaaccgauuggaagacucuggugcaggaauggacaguccagcgccccggccaaaccugccagccuauuuuagaggagcaguguuuggugccagacucuagccacugccagguccugcuccugccccuuuuugccgaaugucauaaagugcuggcgccggcaacauucuaugccaucugccaacaggauaguugucaccaggagcaaguuugcgaaguaauugcuuccuacgcccaucucugccggacuaacggagugugugucgacuggcgaaccccugacuuuugcgcuaugagcugucccccaucuuugguguauaaucacugcgagcacggcuguccuagacauugcgaugggaacguuucaaguuguggagaccaccccuccgaagguugcuucuguccacccgauaaggugaugcuggagggcagcugcgucccugaggaagcauguacgcagugcaucggggaggacggagugcagcaucaguuuuuagaagccuggguaccagaucaccaaccgugccagauauguacaugccuaucuggcaggaaagugaauuguaccacucagcccugcccuaccgcuaaggccccaacauguggucugugcgagguugcacgccuccggcagaacgcggaccaauguugccccgaguacgaaugugucugcgauccugugucgugugaccuuccacccgugccucauugcgagagagggcugcagccgacuuugaccaauccaggcgaaugccgucccaacuucacgugugccugcaggaaggaggaauguaaacgggucucaccucccagcugcccaccucaccgccugcccacacuccgaaagacccaguguugcgaugaguaugagugugcuugcaauuguguuaacuccacugugaguugcccacugggauaccuugccucuacagcaaccaaugacuguggcugcacuacaaccacgugccucccggauaaaguaugugugcacagaagcacuauuuauccugucgggcaguuuugggaagagggaugcgacguguguaccugcacagacauggaagaugcuguuaugggucugaggguggcccaauguucccagaagcccugcgaggacucaugucggaguggcuucaccuacgucuugcaugaaggggagugcuguggacgcugccugccaucugcaugugaggugguaacaggcagccccagaggugauucccagucaagcuggaaaucuguugggucccaaugggccaguccugaaaacccaugcuuaaucaacgagugcgugagggucaaggaagagguguuuauccagcagcgaaaugugagcuguccccagcuagaagucccuguuugcccgucgggcuuccaacuguccuguaagacuucugcuugcuguccaucaugccggugugagcguauggaggcgugcaugcucaacggaaccgugauuggccccgggaaaacgguaaugauagacguguguacaacuugcagauguaugguccaggugggaguuaucagcggcuuuaaacuugaaugccgcaaaaccacaugcaauccuuguccacuggguuacaaggaggaaaacaauaccggggagugcuguggaaggugcuugcccacugccuguaccauucagcugcggggcggucagaucaugacacucaaaagagaugagacgcugcaagacggcugcgauacucacuucuguaaggugaacgaacgcggggaguauuuuugggaaaagagggucaccggaugcccucccuucgacgagcauaaaugucuugcagaaggcgggaagauuaugaaaaucccaggaacaugcugugauaccugcgaggagccggaaugcaaugacauaacugcucgauuacaguacgugaagguaggcaguuguaaauccgagguugaaguggauauccacuauugccaggguaagugugccucuaaggccauguacagcauugacaucaacgauguccaggaccaaugcucauguugcuccccuacacggaccgagcccaugcaaguggcacugcacuguacgaaugggaguguuguguaucaugaaguccucaacgcuauggagugcaaauguagcccaagaaagugcucuaaauga

SEQ ID NO: 64776 - RNA, 3573 nt, Artificial Sequence
  derived and/or modified sequence opt3 from WAPAL__Homo_sapiens__NP_055860
augaccagcagauucggcaagacauacuccaggaaagggggaaacgguucuucaaaguuugacgagguguucaguaauaaacggacuacgcugagcaccaaguggggcgaaacaacuuuuauggccaaacucgggcagaagcgccccaacuucaagccugauauccaagagauuccaaagaagccgaaagucgaagaggaauccaccggagaccccuuuggcuucgauucugacgaugagucgcuuccuguuucaagcaagaaucuggcucaggugaaaugcaguuccuauucugagagcuccgaagcagcccaguuggaggaaguaacaucaguguuagaggcgaacaguaagauaagccacgucgugguugaggacaccguggucucugauaaguguuuuccacuggaagacacucuacucgguaaagagaaguccacaaaucgaaucguggaagaugacgcuucaauuagcaguugcaacaaacugaucaccucugauaagguagagaauuuccaugaggagcacgagaaaaacucccaucacauucauaagaaugccgacgauagcacgaaaaagcccaacgcagaaacuaccguugccucggagaucaaggaaacaaaugacacuuggaacucucaguuugggaaacguccugaguccccaucagaaauaagucccaucaagggaagcgugagaaccggccuuuucgagugggacaaugauuuugaggacauuagguccgaagauuguauccugucuuuggacagcgauccucuccuggagaugaaagacgaugacuucaagaaccggcuggaaaaucucaacgaggcuauugaagaggauaucguccaaucaguguuacgcccaacaaacugcagaaccuacuguagggcaaauaaaacgaagaguucccagggcgccagcaacuuugacaagcugauggaugggacuucucaggcucuugccaaagcaaauucagagaguagcaaggacggauugaaccaggcgaaaaaggguggcguguccugcgggacaucuuuccggggaaccgucggccgcacucgagacuauacaguucugcacccgucgugucuaagcgugugcaauguaaccauacaagauacgauggaaagauccauggacgaguucaccgccucaacacccgcugaucucggugaagccgggaggcugcggaaaaaggcagacauugcuaccaguaagacuacaacucguuuucgcccuucuaacaccaaaagcaagaaagaugugaaacuugaguucuuuggauucgaggaccacgaaacaggcggcgaugaagggggauccgguucaagcaauuacaaaaucaaguauuuuggcuucgacgaucugucugaauccgaggacgaugaagacgaugacugucaggucgagagaaagaccaguaaaaagaggacuaaaacggccccaagccccucuuugcagccuccacccgaguccaacgacaauucacaggauagucaaagcgggacaaacaaugcggaaaaccucgacuuuaccgaggaucugccgggagugccugaaucgguuaagaaacccauuaauaagcagggcgacaaauccaaggagaacacucggaagaucuucucugguccaaaacgaagcccuaccaaggccguguacaaugcacgccauuggaaccaccccgauucagaagaguuaccagggcccccugucgugaaaccacagaguguaacaguuagacuguccucuaaggagccgaaccaaaaagacgauggcguguuuaaggcucccgccccuccaagcaaggucaucaaaaccgugacuauucccacacagccuuaucaggacauagucacggcucucaagugcaggcgggaagauaaagagcuuuacaccgugguucagcaugugaagcacuucaaugacguagucgaauuuggagagaaccaagaguucacugaugacaucgaauaccuguuguccggccuaaaaucaacacagccacugaauacccgcugucucagcgugauuagucuggccacaaagugcgcaaugcccucuuuuagaaugcaccuuagggcccaugggaugguugcuaugguguucaagacucuggaugacucccagcaccaucagaacuugagccucugcaccgcggcacugauguauaucuuaucgcgugaccggcugaauauggaucuagaccgagccucacucgaucugaugauaagacuuuuggagcuggaacaagacgcuucuagugccaaacuccugaacgagaaggauaugaauaaaauuaaggagaaaaucaggcgccuuugugaaacgguccacaacaagcaucuggacuuggagaauaucaccacaggacaccucgcaauggaaacucuguuaucccugaccagcaagcgggccggugauugguucaaagaggaacuaagacuccugggcgggcuugaccacauuguggauaagguaaaagagugcguggaccauuugucuagggaugaagacgaggagaagcugguugcuagccucuggggagccgaacgcugucugcgagucuuagaguccgugacagugcacaacccggaaaaucagucauaccugaucgcauauaaagacagucagcuuauugucagcucugcgaaggcuuugcagcauugcgaggaacucauacaacaguacaaccgggccgaggauuccaucugucuggcagacucaaaaccucuaccacaccagaauguuacuaaccacgugggcaaggccguggaggauugcaugcgugcuauuaucgguguacugcucaaucugaccaacgacaacgaaugggggaguacgaagacaggcgagcaggauggacuuaucggcaccgccuugaauuguguccugcaagugcccaaauauuuaccucaggaacagagauuugacauuaggguucucgggcugggacuucugauaaacuugguggaguacagcgcacgcaaucggcauugccucgucaacauggaaacuuccuguucuuucgauucgagcaucugcucaggugagggcgacgauucccugagaauugggggacaagugcacgcuguucaggcccuagugcagcuguuucucgagagggaacgagcggcccagcuggcugagaguaagacagacgaacuuaucaaagaugcacccaccacucaacaugacaagucuggcgaguggcaggagaccagcggugaaauucaguggguauccacagagaaaacggaugggaccgaagagaagcacaagaaagaagaggaggacgaagaguuggaccugaauaaggccuuacagcaugcuggcaaacacauggaagauuguaucgucgccucauauacugcacuccugcuuggaugccugugccaagagucuccaauaaacgugacaaccgugcgcgaauaccuaccugagggcgacuucagcaucaugacagagaugcucaagaaauuucugaguuucaugaauuugacuugugcggucgggaccacgggacagaaguccauuagccggguuaucgaauaccuggagcacugcuga

SEQ ID NO: 64777 - RNA, 1014 nt, Artificial Sequence
  derived and/or modified sequence opt3 from WARS2__Homo_sapiens__XP_011538796
augaugguggccuggaccacaaaggacagcaaaaagagagucuucuccggcauccagcccacugggauucugcaccucggaaacuaccuuggugcuauagagucuuggguuaggcugcaagaugaauaugacucaguguuguacaguaucguagauuuacauagcauuacggugccucaggacccagcaguccugcggcaguccauccuagauaugaccgccgugcuccuggcgugcggcauuaauccggagaaaucuauccuuuuucagcaaucgcagguuucagaacacacacagcugagcuggauauugaguuguauggugcgccucccccgacugcagcaucugcaccaauggaaggcuaaaacuaccaagcagaagcaugacgggacagucggacucuuaaccuauccugugcugcaggccgcagauauccuuuuguacaaauccacucacguaccaguuggcgaggaccaggugcaacacauggaacugguccaggaucuagcccaggguuucaacaagaaauauggggaguuuuuccccgugccugagucuauucucacaagcaugaagaaagugaagucccugcgugacccaucagcuaagaugaguaaaagcgaucccgacaaacuugcaaccgucagaaucacggauucuccugaagagauuguucaaaaguuuaggaaggccgugacugacuucaccuccgaaguaacauacgacccagcuggacgggccggcgugucaaauaucgucgcggugcaugcagccguuacuggccugagcguggaggaggucgugcgcagaagugcugggaugaacaccgccagguauaaauuggcaguagcugaugccguuauagaaaaguuugcgccgauuaaacgggagaucgaaaagcucaagcuggacaaagaucacuuagagaaggugcugcagauuggaucugccaaagcaaaggaacucgcuuacacagucugccaggaggugaaaaagcuggucgguuuccuuuga

SEQ ID NO: 64778 - RNA, 1416 nt, Artificial Sequence
  derived and/or modified sequence opt3 from WARS__Homo_sapiens__XP_006720312
augcccaacagcgagccugccucccugcucgaacuuuucaauucuaucgcuacccagggcgagcuggugagaucauugaaggcagggaacgccaguaaagacgaaauugauagcgcggucaagauguuaguuucccugaaaaugucuuacaaggcugccgcaggagaggacuauaaagccgauugcccaccggguaaucccgcuccuacaucgaaccacggcccagacgcaacugaagccgaggaggauuuuguggaccccuggacgguacaaaccucaagcgcuaaggggauagauuacgacaagcuaaucgugagguucggaaguuccaaaauugauaaggaacucaucaaucggauugagcgcgccacaggccagcgaccucaucacuuucugcguagagguaucuucuuuucucauagggacaugaaccagguccuugaugcguaugaaaauaaaaagccauucuaccuguauacugggcggggacccagcuccgaggcaaugcacgugggccauuugauaccuuuuaucuucaccaaauggcuccaggacguuuuuaacgugccacuggucauucaaaugacagaugacgagaaguaccuguggaaggaccucaccuuagaucaggccuauucauacgcuguggaaaaugccaaagacaucauugcauguggcuucgauaucaacaagacuuuuauauucagugaccuggauuacauggggaugagcucuggauuuuauaaaaauguaguuaagauucagaaacacgugacauucaaccaggucaaggguaucuucggcuuuaccgacuccgauugcauugggaaaaucucauucccggcuauccaagccgcgcccagcuuuaguaauucuuucccucagauuuuucgcgacagaacggauauacagugucuuaucccaugcgccauugaccaggaucccuacuucaggaugacucgggacguggcaccucgcaucggauauccaaagcccgcuuugcugcacuccaccuuuuucccggcccuacaaggcgcucagacaaagaugagcgccucggacccuaacucuuccauauuucucacugauaccgcaaaacagauuaagacaaaagugaauaagcaugccuucucaggugggcgagacaccaucgaggaacacagacaauuuggaggcaacugugaugucgacguuaguuucauguaccugacguuuuuccuugaggaugacgauaaacuggaacagaucaggaaggacuauacuagcggcgcuauguugacaggggagcucaagaaagcgcugauugagguguuacagccccugaucgcagaacaucaggcccggcguaaggagguaaccgaugaaauugugaaagaguucaugacuccacgcaagcucuccuuugacuuccaauga

SEQ ID NO: 64779 - RNA, 1680 nt, Artificial Sequence
  derived and/or modified sequence opt3 from WASF1__Homo_sapiens__NP_001020106
augccccuggugaagagaaacaucgacccuaggcaccucugccauaccgcccuuccacggggcauuaaaaaugagcuggaaugugucacaaacauaucauuggcuaauaucauucgccaguuauccucucugucaaaguacgcagaggauaucuucggggaacuauuuaacgaggcccacaguuucagcuuucgaguuaauucccuccaagaacguguggacagacugucuguaucggugacucagcuugauccgaaagaggaggaacugucauugcaggacauuacgaugaggaaggcguuccggagcaguaccauccaggaucaacagcucuuugaccgcaaaacacugcccauaccucugcaggagacuuaugaugucugcgaacagccacccccucucaacaucuuaaccccauacagagacgauggaaaggagggucugaaguucuauacaaaucccuccuacuuuuucgaccuuuggaaagagaagauguugcaagauaccgaagacaaaaggaaggagaaacggaagcagaagcagaaaaaccuggaucgcccucaugaaccagagaaggugccgcgagcuccccacgacagaaggcgggaauggcagaaacuagcccaaggcccugagcucgcagaggacgaugccaaucugcuucauaagcacauugaaguugcuaacgggccagcaucucacuuugagacucguccccagacauauguggaccauauggauggaagcuacucccugucagccuugccuuucagucagaugagcgaacuccugacccgcgcugaggaaagagucuuagugaggccacacgagcccccgccucccccaccuaugcauggcgccggugacgcgaaacccaucccaacguguauuucuuccgcaacugggcugaucgagaaucggccccaaagcccugccaccggacgaacaccaguauuuguuagcccgacucccccuccacccccuccaccccucccgagugcucuuucuaccuccagccugcgcgccucgaugacaucuaccccuccacccccugugcccccaccucccccaccgccugcaacggcuuugcaggcccccgcggucccacccccuccagcaccccuacagauagccccuggcgugcugcacccggcuccacccccuauugccccaccccucgugcagccuuccccgcccgucgcuagagccgcaccaguuugcgaaacugugccuguacacccccugccacaaggcgaggugcaggggcuuccucccccaccgccucccccaccccugccuccacccggaaucaggccuucaaguccggucacagugaccgccuuggcucauccacccagcggucuccacccuacucccuccacagcgccaggcccucauguuccccugaugccaccuucuccgcccagccaggugauuccagcaucagaaccuaagcggcaccccaguaccuuaccagucaucuccgaugcccgcagcgugcugcuagaggcuaucagaaaagggauucagcucaggaagguagaagaacaacgugagcaggaagccaagcaugagcggauagaaaacgacguugcaacgauccugucucgaagaauugccguggaguauucagauagugaggacgauagcgaguucgacgaggucgauuggcuugaauga

SEQ ID NO: 64780 - RNA, 1500 nt, Artificial Sequence
  derived and/or modified sequence opt3 from WASF3__Homo_sapiens__NP_001278894
augccccuggugaagagaaacaucgagccuaggcaccucugccggggcgcccuuccagaagggauuaccagcgagcuggaaugugucacaaauuccacuuuggcugcaauaauccgccaguuaucuucacugaguaaacaugccgaggacauuuucggagaacuauuuaacgaggcgaauaacuucuacauccgagcuaauagccuccaagaucguauugacagacuggccguuaaggugacgcagcuugauuccaccguagaggaagugucucugcaggacaucaacaugaaaaaggcauuuaaaucgucaacaguccaggaucaacaggugguuagcaagaauaguauaccgaaccccguggccgacaucuauaaucaguccgauaagccuccacccuugaacauucucacuccuuacagggacgauaaaaaggacggucugaaauucuauaccgauccaucuuacuuuuucgaccuguggaaggagaaaaugcuccaggauacagaagacaagcggaaggagaaacgcagacaaaagagggagaaacacaaguuaaaucccaaccggaaucagcaggucaacgugcgcaaaguacgaaccagaaaggaagagugggaaaggcggaaaaugggcaucgaguuuaugagcgacgcuaagaagcuggaacaggcaggguccgccaaagaggaucguguuccuucaggaagucaugcuagcgacgugacugauuauucuuacccagccacaccgaaucacucccuucauccccaaccugucaccccaucauaugcggcaggcgacgugcccccucacgguccagccagccaggcugccgagcacgaauacagacccccgagugcaucugcucgccauauggccuugaacaggccucagcaacccccaccucccccacccccucaggcgccagaggggucccaggccagcgcaccgauggcucccgccgauuacggaaugcugccugcucagauuaucgaauauuacaacccaucgggacccccuccacccccgccuccacccgugauaccuucugcccaaacggcauucgucucaccccuacagaugccaaugcagccucccuuuccagccuccgcuaguagcacucacgcggcaccgccucaucccccauccaccggccuccugguuacagcucccccuccacccgggccuccgccacccccuccaggacccccugguccgggcucuagccuuucaaguucccccaugcacgggccaccuguggccgaggccaagcggcaggaacccgcacaaccaccuauuagcgacgcccgaucugaucuguuggcugccauccgcaugggcauucagcucaaaaagguacaggagcagagagagcaagaagcaaaaagggagcccgugggcaaugacgucgcgacuauccugucacggcgcaucgcuguggaauauagugauagcgacgaugacuccgaguucgacgaaaacgauuggucugacuga

SEQ ID NO: 64781 - RNA, 1440 nt, Artificial Sequence
  derived and/or modified sequence opt3 from WASH1__Homo_sapiens__XP_011515960
augggcgccgugugcaccagcggggcuagauccgagaggacaaugacucccguccggaugcagcacucucuggcaggacaaacguacgccguuccuuucauccagccagaccuccgccgagaagaggcggugcagcagauggcugaugcccuucaauaucugcagaagguaucaggugacaucuuuagucguauaagccaacagguggaacaguccagaucucagguccaggcaaucggcgagaaagugucguuggcccaggcuaagauugaaaagaucaaggggagcaaaaaggcaauuaagguuuucucaagugccaaauacccggcucccggaagguuacaagaguauggcuccaucuuuaccggugcccaggauccugggcugcagcggcgcccaagacauaggauacaaucuaagcaccggccccuagacgagcgcgcgcuccaggaaaaacugaaggauuucccugugugugucagcacaaaaccagagcccgaagacgaugcagaggagggacuuggcggccugccuuccaacaucucaagugugagcucuuugcuccuguuuaauacuaccgaaaaccuguacaagaaguauguauuccucgacccauuagccggggcuguuacaaaaacccaugugaugcugggagccgagacugaagagaaacuuuuugaugcaccguuguccauuucaaaacgagaacagcuggagcagcaaguccccgagaauuacuucuaugugccugaccuaggucaggugccagaaauccacguccccagcuaccucccugaucugccaggcauugcuaacgaccuuauguacagugccgaucuggggcccggaaucgcgccgucugccccuggcacaauacccgaguugccaaccuuucauacggaaguugcagagccucucaagguggaccugcaggacgguguauuaacucccccacccccuccaccgcccccuccacccgcuccugaagugcuggccuccgcuccaccccucccgccuagcaccgccgcaccagucgggcagggagccagacaagaugacucgucuuccucagcuagucccagcgugcagggcgcgccuagggagguuguggaucccuccggcgggugggcaacacuucuggagucuauucggcaggccggagguaucggcaaagcuaaguugcguagcaugaaagaacgcaagcuagagaagcagcaacagaaagaacaggagcaggucagagccacuucacaagggggacaccugaugagugaccucuucaauaagcuggugaugaggcggaaaggcauuuccgguaaggggccaggcgcaggagaaggcccugggggagccuuuguacgaguuagcgauucuauucccccacuuccgccuccccagcagccacaagcugaggaggacgaagaugacugggagucauga

SEQ ID NO: 64782 - RNA, 1509 nt, Artificial Sequence
  derived and/or modified sequence opt3 from WAS__Homo_sapiens__NP_000368
augagcggcgggcccaugggagguagaccuggcgggaggggagccccagcugugcagcaaaacaucccguccacccugcuccaggaccacgagaaucagcggcuuuucgaaaugcugggccgcaagugcuugacauuagcaacugccgucguucagcuguaccuagcgcucccuccuggugcugagcauuggacgaaagaacacuguggggccgugugcuuuguaaaggauaacccacaaaaaucuuauuucauucgacuguacggacuucaggcaggccgucuguugugggagcaggaacucuauucacagcugguguacaguacccccacacccuuuuuccauacuuuugccggcgacgauugucaagcugggcugaauuucgcagacgaggaugaggcccaggcuuuuagagcccucguccaggaaaagauacagaaaaggaaccaacggcagagcggagaccgcagacaguuaccacccccuccaaccccggcgaaugaggaaaggcgggguggccugcccccucuuccauugcaccccgggggagaucaaggcgguccuccaguggggccccugucccuaggacucgcaacaguugacauccagaacccggauauuaccucuucgcgcuaucgaggccugccugcccccggcccaucacccgcugacaagaagagaagcgggaaaaagaaaaucaguaaggccgauauuggagcacccuccgguuucaaacaugugucucacgucggcugggacccacagaauggguuugaugugaacaaucuugaccccgaccugaggagcuuguucucccgggcuggaaucucagaggcccagcucacugaugcggagacaaguaagcugauauacgacuuuaucgaagaucaaggcgguuuagaggccguacgucaggaaaugcgcagacaggagccucugccaccgcccccuccacccagcagggguggcaaccagcucccucggccacccauuguuggaggcaauaaggggcgaucuggaccgcuuccuccagugccccuggguaucgcaccucccccaccuaccccucgcggcccaccgccucccgggagaggaggcccacccccuccacccccuccggcuacggguagguccgggccauugcccccuccacccccuggcgccggaggcccgcccaugccaccucccccaccucccccaccgccucccccaucaagcgggaacggacccgcuccuccaccccuaccuccggcccuggucccagcagggggccucgcccccgggggaggccggggugcucugcuugaccaaauucgccaggggauccagcugaauaaaacuccuggcgcgcccgaaaguucugcauugcagccaccuccccaauccagcgagggacucgugggcgcccugaugcacgugaugcagaagagaucgagggcuauacauucuuccgaugagggggaagaccaggccggagaugaggacgaagaugacgagugggaugacuga

SEQ ID NO: 64783 - RNA, 1518 nt, Artificial Sequence
  derived and/or modified sequence opt3 from WASL__Homo_sapiens__NP_003932
augagcuccgugcagcaacagcccccuccaccgagaagggucaccaacguuggcucucugcuccuuacaccccaggagaaugaaucacuguucacguuuuuggggaagaaaugcgugacuaugaguagcgccguagugcaguuauacgcugcagaccggaacuguaugugguccaagaaaugcucuggagucgccugucuggugaaggauaauccucaacgcucguauuuccuacgaaucuuugacauuaaagaugguaagcuccugugggagcaggaacuuuacaacaauuucguuuauaacucaccacguggcuacuuucacaccuucgcgggggacacaugccagguggcucugaauuuugccaacgaggaagaggcaaagaaauucagaaaggccgucacugauuugcucggaaggcggcagcgcaaaagcgagaagagaagggaucccccuaauggcccaaaccugcccauggcuaccguggacaucaaaaauccugaaauaacaaccaaccgguuuuaugguccacaaguaaauaacauuagucauacuaaggagaagaaaaaggggaaagcaaagaaaaagcgccugacaaaagccgacaucggaaccccguccaauuuccagcacauuggccauguuggcugggaucccaacacgggguuugaccucaacaauuuagauccugaacugaagaaccuuuucgacauguguggaaucucugaggcucaguugaaggaucgagagacuagcaaagugauauacgacuuuaucgaaaagaccgguggcgucgaggccgugaaaaaugaacugagaaggcaggcgccacccccuccacccccgucccgugggggaccucccccaccucccccacccccucacaacucaggcccaccgcccccuccagcacggggucgcggggcucccccuccacccccgaguagagccccuacagccgcaccacccccucccccaccuagcaggcccucuguggcugucccaccgccucccccaaaucggauguaucccccuccacccccugcccuaccguccucagcgccaagcggacccccuccacccccuccgaguguucucggcgugggccccguagccccaccucccccaccucccccaccgccucccccagggcccccuccacccccuggacugccgucugacggugaucaucaagugccaacuaccgcaggcaacaaggcugcccuucuggaccagauucgagagggggcucaguugaaaaaggucgaacaaaauucccgccccgugagcugcucgggaagagaugcccuccuggaccagaucaggcagggcauucaguuaaagucuguugcagauggucaagaguccacaccucccaccccagccccuacgucagggaucgugggcgcucugauggaggucaugcagaaacggaguaaggcgauacacagcuccgacgaagaugaggacgaagaugacgaggaagauuucgaggacgacgaugagugggaagacuga

SEQ ID NO: 64784 - RNA, 1092 nt, Artificial Sequence
  derived and/or modified sequence opt3 from WBP1L__Homo_sapiens__NP_001077382
auggagagaaggcggcugcucggcgggauggcccuucuguuguuacaggcucugcccagcccucuauccgcacgcgccgaaccaccgcaagacaaggaggcgugcgugggaaccaacaaucagucuuacaucugugauacaggucacugcuguggccagucacagugcuguaacuauuacuaugaacucuggugguucuggcuggucuggacuauuauaaucauucuuaguugcuguugcguuugucaucaccgacgugcuaaacauagacugcaagcccagcagaggcagcacgagaucaauuugauugcauaccgggaagcccauaacuauagcgcucuccccuuuuacuuccgcuuucugccuaauuaucugcucccacccuacgaggaggugguaaacagaccuccaacgcccccuccaccguacuccgcauuccaauuacagcagcagcaacugcuucccccucagugcgggccagccggaggcucucccccugguaucgacccaaccagggggucgcagggagcucaaucaagccccuugagugaaccgucccggucuagcacacgcccucccuccauagccgauccagacccuucagaucugcccguggaccgagcggcaacuaaggccccaggcauggagcccaguggcagcgucgcugggcuaggagaacucgauccuggugccuuucuggacaaagaugcagaguguagagaggaacuucugaaggacgauucuuccgagcacggcgcuccagacucaaaagaaaagaccccggggaggcaccggcguuucacaggagauagcggcaucgaggugugcguuugcaaucgcggucaucacgacgacgauuugaaggaauuuaacacccucauugacgaugcccuggacgggcccuuagauuucugugacaguugccaugugagaccuccaggagaugaggaggaaggccugugucagucuuccgaggaacaggcgagggagcccggccacccucaccucccacggcccccggccugccuucuguugaauacuaucaacgaacaggacagcccuaauucgcaaucuuccucaaguccaagcuga

SEQ ID NO: 64785 - RNA, 786 nt, Artificial Sequence
  derived and/or modified sequence opt3 from WBP2__Homo_sapiens__NP_036610
auggcccugaacaagaaucacagcgagggcgggggagugaucgucaacaauaccgaauccauucucaugucuuacgaccauguugagcuuacauucaacgauaugaaaaaugugcccgaggcuuuuaaggguacuaaaaagggcacgguauaucugaccccuuacagagugauauucuugucaaaagggaaggacgcaaugcagaguuuuaugaugccauucuauuuaaugaaggauugcgaaaucaaacaaccggucuuuggagccaacuacauuaagggcacagugaaagcggaagcuggugggggaugggagggcagcgccuccuauaagcugacuuucaccgcaggcggggccaucgaguuuggacagaggaugcuacagguugcuucucaggcaucgcggggugaagugcccucaggcgccuacggguauagcuacaugccuaguggagcuuacgucuauccacccccuguggccaauggcauguacccaugucccccugguuauccauacccgcccccuccacccgaguucuauccugggccacccaugauggacggagcgaugggcuacguacaaccgccucccccaccuuaucccggcccaauggaacccccuguuuccgggccagaugugccgucuacacccgcagccgaggcuaaagccgcagaggcugccgcgagcgccuacuacaacccuggaaauccacacaacgucuauaugcccaccucccagccuccacccccgccuuacuauccacccgaagacaagaagacucaguga

SEQ ID NO: 64786 - RNA, 1797 nt, Artificial Sequence
  derived and/or modified sequence opt3 from WBSCR17__Homo_sapiens__NP_071924
auggccagccugagaagggugaagguccuccuuguucugaacuugaucgcuguggcaggcuucguauuauuucuggccaaaugccggcccauugcggugcgcuccggggacgcuuuccacgagauacgaccucgugccgaagucgcaaaucuaucugcccauucagcuaguccaauccaggaugcagugcucaagagacugagccuucuggaggacauuguuuacaggcaauugaacggacucuccaaaucucugggucugaucgaaggcuaugggggacggggcaagggugggcucccggccaccuuaucgcccgcugaggaagagaaagccaagggaccucacgagaaguacggcuauaauucauaccugagcgagaaaauuagucuugaucgcuccaucccagacuauagacccacaaaguguaaagaguugaaguacucuaaagaucugccucagauaagcaucauuuuuaucuucgugaacgaagcgcuauccgucauucucaggucagugcauagugcaguaaaucacacuccaacgcaucugcuuaaggagaucauacugguugacgauaacagcgacgaggaagaguugaaggugccccucgaagaguauguccacaaacgguacccuggccuggugaaggugguccgcaaucagaaacgagaaggguuaauuagagccaggaucgagggauggaagguugcuaccggucaggugacaggcuuuuucgaugcccacguagaguuuacugcagggugggcugaaccagugcugucucggauucaagagaaccguaaacgcgucauccucccguccaucgacaauauuaagcaggauaacuucgaagugcagagauacgaaaauucagcccauggauauagcugggaacuuuggugcauguacauaagucccccuaaagacuggugggaugcgggcgacccaucucugcccaucaggaccccugccaugauugguuguuccuuuguugugaaccggaaguucuuuggggagaucggauugcuagacccaggcauggaugucuauggcggggagaauauagaacugggaauuaagguguggcucugcgguggcagcauggagguacugcccuguucgcgaguugcacacaucgaacgcaaaaagaaaccguacaacucuaauaucggguucuauacaaagagaaacgcucuuaggguggccgaggucuggauggacgauuacaaaucccauguguauauugcuuggaaccugccuuuggaaaaucccggaaucgacauuggcgaugucucagagcggcgcgcccucagaaagagucugaagugcaaaaacuuucagugguacuuagaccacguguacccagagaugaggcguuauaauaacaccguugcauacggugaacugcggaauaacaaggccaaagaugugugucuagaccaagggccucucgagaaucacacugcuauacuguaucccugccauggcuggggaccacagcuugcgcgauacacaaaggaaggcuucuugcaccugggggcacucggaaccacgacucugcuucccgauaccagaugucugguagacaacagcaaauccagguugccucagcuccuggauugcgacaaggucaagucuagcuuauauaaacgcuggaauuucauccagaacggugccauuaugaauaagggcacagggcggugucuggagguggagaacagaggacuagcuggcaucgaccucauccugaggucaugcacuggucaacgcuggaccauuaaaaauaguauaaaguga

SEQ ID NO: 64787 - RNA, 897 nt, Artificial Sequence
  derived and/or modified sequence opt3 from WBSCR22__Homo_sapiens__NP_001189489
auggccagcagaggcaggcggcccgagcacgggggaccuccagaacuguucuacgacgagaccgaagcucgcaaguaugugcgaaacucccguaugaucgauauucagacaagaauggcagguagggcccucgagcuucuguacuugccggaaaauaaacccugcuauuuacuggacauaggcugugggacuggacuaucuggcucauaccucagugaugagggucauuauugggucgggcuggacaucagcccugcgaugcuugaugaggcuguugaccgggaaauugagggagaucuguugcucggcgacaugggccaagggaucccauuuaagcccggaacguucgaugguugcauuuccaucucugccgugcaguggcuguguaacgcaaauaaaaagucggaaaacccugccaaacgccuguacugcuuuuucgcuucacucuuuagcguauuagugagaggcaguagggcaguccugcagcuuuauccagaaaauuccgagcaguuggagcugauaaccacacaagccacuaaggcuggguucucuggaggcauggugguugacuaccccaacagcgccaaggcgaaaaaguuuuaccuaugucucuucuccgguccuucaaccuuuaucccagaggggcugagugaaaaucaggaugagguggaaccgcgggagagcgucuucacaaacgagcgcgaaggaggcgcauuugagcgaagaggcauuagggggcaccagacccggcguuucccccuucgcaugucuagaaggggaauggugcggaaaucccgagccuggguacuggaaaagaaagagcgccauagaaggcagggucgggaaguucgcccugacacucaauauacaggcagaaagaggaagccacguuuuuga

SEQ ID NO: 64788 - RNA, 1203 nt, Artificial Sequence
  derived and/or modified sequence opt3 from WDFY2__Homo_sapiens__NP_443182
auggccgcugagauccagcccaagccucugaccagaaaaccaauucuccuucaaaggauggaaggcagccaggagguggucaacauggcaguuauagugccgaaggaagaggggguaaucuccgugucugaagaccggacaguccgcguguggcugaaacgagauucaggacaguacuggcccaguguuuaucacgccaugccuagcccaugcuccuguaugucuuucaaucccgagacucguagauugucgauugguuuagacaacggcacgaucucagaguuuauucugagcgaagauuacaauaagaugaccccugugaaaaacuaucaggcgcaucaaaguagggucacaaugauccuauucgugcucgagcuggaauggguacuuuccacugggcaggacaagcaguuugcuuggcacugcucugagagcggacagcggcugggcgguuaccgcaccuccgccguugcaucaggguugcaauucgauguggagacaagacaugucuuuauaggagaccacaguggccaggugaccauccucaagcuggaacaggagaauuguacucuggugacaaccuucaggggccauacugggggagucacggcccucugcugggauccaguucagcggguguuauuuagcgguucuuccgaccacucaguaauuaugugggauaucggcgggcgcaaaggaaccgcuauugaacugcaaggccacaacgaccgagugcaggcacuuagcuaugcccagcauacaagacaauugaucaguugugguggggauggaggcauagucguguggaauauggacguugagaggcaggaaacucccgaguggcuggauucugacuccugccagaagugugaccagccuuucuuuuggaacuucaaacaaaugugggauagcaagaaaauuggccuacggcagcaccauugccguaagugugggaaggcugugugcggaaaauguucgucuaagcgcuccucaaucccacucauggguuuugaguucgaagucagagugugcgacaguugccacgaggccauuaccgaugaagagagggcgccgacagcaaccuuucacgacagcaaacauaauaucguacacguucauuucgaugccacgcggggcuggcugcuuacuuccgggacagacaaggugaucaaacugugggauaugacccccgucgugucuuga

SEQ ID NO: 64789 - RNA, 9555 nt, Artificial Sequence
  derived and/or modified sequence opt3 from WDFY4__Homo_sapiens__NP_065996
auggaagccgaagaccugagcaaggcugaggauagaaacgaagaccccggcuccaaaaaugaggggcagcucgcagccgugcaaccugaugucccacacgggggucagucuucaaguccgaccgcgcuuugggacaugcuggaaaggaaguucuuggaguaccagcaguuaacccauaaaagccccaucgagcggcaaaagucccugcuaucucuccugccucuuuuucugaaggcuugggaacacucgguuggcauuauuugcuucccaucauugcagcgccucgccgaggaugugagcgaccagcuggcacagcaacugcagaaggcccucguagggaagcccgcugaacaggcacgauuagccgcuggccagcugcuuugguggaaaggcgauguggaccaagaugguuauuugcugcuaaagagugucuacgugcucacugggacggacuccgagacccugggacguguugccgagucuggccuuccugcgcuguugcuccagugucuguauuuauuuuucguguuuccacuggauaaagacgaacuccuugagagcgaucugcagguccaaaagauguucgugcagauguugcuaaacaucugcuccgacucacagggccuggaagggcuccugaguggaagcgagcuucagucucuguugauugcaacaacuugucucagagaacauuccugcuguuuuuggaaagagcccaccuucugcguacugagggccaucucaaaggcucaaaauuuaagcauuauccaguaccugcaggccacagacuguguucggcuaagucuccagaaccugucucgccuuaccgauacuuugccugcaccagagguguccgaagcugucagccugauacucgguuuugugaaggacucguauccggugucuuccgcccuguuccuugaguuugaaaauucagagggcuacccccuguugcucaaaguccuguuaagauaugaugggcugacacaaagugaaguugacccucaccuagaggagcuccugggacuugugguaugguugaccacgugcggcaggagcgaacugaagguguucgauuccaucacuuacccacagcucgaggguuuuaaauuccaucacgaagcgucuggggucaccgugaagaaccugcaggccuuccagguuuuacaaaauguguuucacaaagcaagcgacucaguccuguguauucaggugcuuaguguaauccggacaaugugggcuuggaacgcccgcaauuucuuuuugcucgaguggacucugcagcccauuucccaguucguugaaaucaugccucuaaagccagcucccgugcaagagcacuuuuuccagcugcucgaggcccuggucuuugaacuucacuacgugccgcaugagauauugcgaaaaguccagcaccugauuaaggaaagcccuggacccucuugcaccuuaauggcacuccaaucaauccugaguauugccggcggcgauccacuuuucacagacaucuuuagagauagcgggcuguugggacuccugcuagcucagcugaggaagcaggcgaaaaucaugcggaaguccgguaacaaagugucuaccccuggcguucaggaccccgagcgugagcucacgugugugaugcugcgcauuguagucacucuuuugaaggggucggugagaaaugcaguugugcugaaagaucacggaauggucccauucauaaagaucuuuuuagacgacgaaugcuauagggaggccagccucuccauucuggaacaacuuucagcuaucaacgccgaggaauacaugaguauaauugugggcgcacugugcucuagcacacagggugagcuacagcucaagcuggauuugcugaaauccuuacuccggauccugguaacccccaaggggcgagccgcuuuccgcgugucaagcggcuuuaauggacuucugucuuugcucuccgaccuggagggcagucuacaggaaccuccacugcaagccuggggagcaguuagcccgagacagacucuugagcucguccuguauacauugugugcggugucugcugcccugcauugggaucccgugaacggauacuucuucaggcggaaugguuuauuugaaaaacucgcagaggaccugugccuucugggcuguuucggggccuuggaagaggagggaaaccuccugcgcuccugggucgauaccaaggcuagaccuuuugccgaccuacugggcacggcauucucaaguagcgguucgcuuccacccaggauccaguccugccuccagauucugggguuuuuggauucuauggcuagcggcaccuuacaucugcguggagaccucaaagaaucacugcggacaaagcaaggcccuguuguggaugugcagaagggggagacuggaagugacccacagcgaaacuucaaacaauggcccgaucuugaagagagaauggacgaaggugaugccgcgaucaugcauccgggcguagucuguauuauggugaggcuguugccucgccuauaucacgaggaccauccacagcuguccgaggaaauacagugcucucucgccagccacauccagucccugguuaagucagagaaaaaucggcaagugaugugugaagcugggcuuuuaggaacccugauggcaagcugccacagagcccucgucacaaguggcucucccuugcauuccaggcugauucgcaucuuugagaagcucgcuagccaggccaucgagccugacgugcugcgacaguuccuuggucuggggauucccucgucauugucugcaacuaccaaaauacuagauaguucccacacacaucggggcaacccaggauguagcggcucucagaccgcgcaagggcuggccgaaggaccuuggcccgcugccccagacgcaggccuccacccggguguuacucaggcuccucagcccuuaggggagagccaggauuccacgacagcccugcaaaccgcacuuucacugaucaguaugacuagcccacguaaucuccagccccagagagccgcuuuggcgccuucuuuuguggaguucgacauguccguagagggauacggcugccuguuuauuccaacccucucaacagucauggguaccaguacugaauauagcguguccggcgggaucggaacaggcgccacgaggcccuucccuccgccagggggacugaccuuuucuuguugguuccuuauuucgcgccacggcgcagcuacugagggucauccccuacgguuccugacauuggugagacacuuagccaggaccgagcagccuuuugucugcuucagcguuucacugugcccagaugaccucucccuggugguaaguacagaagagaaggaauuucaaccccuugaugugauggagccugaagacgauucugagccgagcgccgggugucagcugcagguccgaugcggacaacucuuggcuuguggccaguggcaucaccuggcagugguugugacuaaggagaugaaacgccauugcaccgucuccacgugucuagacggucaggugaucggcucagccaagaugcuguacauacaggcgcuccccgggccauuccuuucuauggauccuagcgcuuuuguugacguguacggauauaucgccacaccccgggucuggaaacaaaagaguucccugauuuggagauuaggcccaacauacuuguucgaagaggcaaucagcauggaaacucuggagguaauuaacaaacucgggccuagguauugcggaaauuuucaggccgugcacguucagggcgaagaucuggacucugaggcuacccccuucguggcagaggaacgugucucauuuggucuucacaucgccuccaguagcauaacaucgguggcggacauucgcaacgcuuacaaugagguagauucucggcugaucgccaaggaaaugaacauuuccagcagagacaaugcaaugccaguguuccucuugaggaacugugccgggcaucugucaggaaguuuacgaacuaucggcgcugucgccguuggucagcuaggcgugcggguguuucacucuuccccggcagcuagcucacuggauuucauagggggaccugccauccuccuuggccugauuaguuuggcgaccgacgaucauacgauguaugccgcagucaaagugcugcacagcguucucacauccaaugcuaugugcgacuuccugaugcaacauaucuguggguaccagauuauggccuuucuucuccgcaagaaggcuucucuguugaaccacagaaucuuccagcugauauuaagcguagcaggaaccguggagcuaggcuuuagguccucagccauuacuaauacaggugucuuccagcacauccugugcaacuuugagcucuggaugaauaccgccgauaaccuugaacugucuuuguucagucaucugcucgagauccugcaaucgccccgggaagggccacgaaacgcugaggcggcacaccaggcccagcuuauucccaaauuaaucuuucuguucaaugaaccuagccucauuccauccaagauaucuacuaucauuggaaucuuggcuugucaacugagaggccauuuuucaacccaggaccuacugcgcauuggccucuucgugguuuauacacuuaaacccagcuccgugaacgagaggcagaucugcauggauggggcccuggacccuaguuugccggcaggaucucagacgagcgguaagaccauauggcugcguaaucaacuccuggagauguuacuuucagucaucuccaguccacagcugcaccucagcucugaauccaaagaggaaauguuucuaaagcugggccccgauugguucuugcugcuccuucaggggcaucugcacgccucaacuacaguguuggcucugaagcucuuacuguacuuucuugcgagcccuucgcugcggaccagauucagggacggacuaugcgccggcucuuggguagagcgcaguacagaaggugucgacauugugauggauaaccucaaaucccagagcccccugccagagcaaucaccuuguuugcugcccggguuccgaguucucaaugacuuucuugcacaccaugugcacaucccagaggucuaccugauuguguccacuuucuuuuuacagaccccucugacggaauugauggauggaccgaaggacucucucgaugcuaugcugcaguggcuacuucagagacaucaccaagaggaaguucugcaggccggccucugcacagagggcgcacuguugcugcucgaaaugcuuaaagccaccaugagccagccccuggcugggagugaggacggagccugggcgcagacuuucccagcauccguguuacaauuucugagcuugguccaccggaccuauccucaggaucccgccuggagggcuccagaguuccuccagacacuggccaucgcugcauuuccucuaggugcccaaaagggcgugggggcugaaucuacucgcaacaccucaagucccgaggccgcagcggaaggagacuccacaguagagggccuucaggccccgacgaaagcucauccagcccguagaaagcugcgggaguucacccagcuccuguugagggaauuacugcucggugcaagcucuccuaagcaguggcuuccccuggaggugcuacuggaggcuucgccagaucacgccacuucacaacagaaacgcgacuuucagagcgagguucucuuguccgcaauggaacuguuccauaugacaagugggggagaugccgcuauguuucgagacggcaaggagccccagccuucugcggaggccgcagcugccccgagccuugccaauauauccuguuucacccaaaaacuggucgaaaagcucuacucaggcauguuuagugcagaucccagacacauuuuacuguucaucuuggagcacaucaugguggugauugaaacugcuucuagccagcgggacacaguccuguccacccucuauucaagccuuaacaaaguaauacuguacugccuaucuaagccacagcagucccugagugagugucucggguugcugagcauccuuggauuccugcaagaacauugggacgugguuuuugccacguauaauucgaacauuuccuucuuacucugccugaugcacuguuugcugcuccuuaaugagaggucuuacccugaggguuuuggccuggaacccaagccucgcaugucaacuuaucaucagguguuccuaagcccaaacgaggaugucaaagaaaagagagaggaccugcccagucucuccgaugugcagcacaauauccagaaaaccguucagacauuguggcagcagcugguggcgcaaaggcagcagaccuuagaagacgcuuuuaagauugaucuuucugucaaaccuggggagcgggaggugaagaucgaagagguaacuccacugugggaagagacaaugcucaaagccuggcagcauuaccuggcaagcgagaagaagucauuggccucccguaguaacguggcucaccacagcaaaguuacccuguggucuggaucacucuccagcgcaaugaaacuuaugcccggccgccaagccaaagacccggaaugcaagacagaggauuucgucucuuguauagaaaauuaccgaagaaggggucaggagcuguaugcgagucuauacaaagaccaugugcagcggcgcaagugcgggaacaucaaggcugccaacgcaugggccagaauccaagaacaacuguuuggagaguuaggccucuggucgcagggcgaggaaacuaaaccuuguuccccaugggagcuggauuggagggaagggcccgcucggaugcgaaagagaaucaaacgcuugagcccucuugaggcccugucaucuggaaggcacaaggaaagccaggacaaaaaugaucauauuucccaaaccaacgcagagaaucaggacgagcucacgcugcgggaagcugagggugaaccagaugaggugggcgucgacugcacacaguugaccuucuuucccgcccugcacgaaagucuacacucagaggacuuccucgagcuuugccgugaaagacagguuauccugcaagaguuacuggauaaggaaaaggugacucagaaauuuucucucguaauagugcaggggcaucuggucagcgagggaguguugcuuuucggccaccagcauuuuuauauuugugagaacuucacccuguccccgacaggugacguuuacugcacuaggcacugucucaguaauaucagcgauccuuucaucuuuaaccugugcuccaaggaccgcucuaccgaucauuauucaugucaaugccacagcuacgcggacaugcgggaacuacgacaggccagauucuugcugcaggauauugcacucgagaucuuuuuccacaauggguauucgaaauuucuuguguucuacaacaaugacagguccaaggcuuuuaaaaguuucuguucuuuucagcccagccugaagggaaaggccacgucagaagauacauuaucccugcgccgguacccaggcucugacagaauaaugcuccaaaaauggcagaagcgugauauuaguaacuucgaguaucugauguacuugaauaccgcagcuggcaggacuugcaacgacuauaugcaguacccugucuuucccuggguacuugccgacuauacaagcgaaacccugaaucucgccaacccaaaaaucuuccgggaucuguccaagcccaugggggcgcagacuaaagagcgcaagcuaaaguuuauucaacgauucaaagagguggaaaagacagagggagacaugaccguucagugucauuacuauacgcacuacucaagcgcuaucauaguggcaucuuacuuagucagaaugccuccauucacucaggccuuuugcgcucugcaagguggcaguuucgauguggccgacaggauguuucauuccgucaaaagcaccugggaaucagcaucucgggagaauauguccgaugugcgcgaauugacaccggaguucuuuuaucuccccgaguuccugaccaacuguaacgggguugaauuuggaugcaugcaggacggcacagugcuuggugauguacagcugccuccaugggccgacggggaucccagaaaguucauuucgcuccacaggaaagcucuggagagcgacuuugugagugcgaauuugcaucacuggaucgaucuuaucuucggcuacaagcagcaaggaccugccgcagucgacgcuguuaacauuuuucacccauauuucuacggcgaucgaauggaccugucuuccaucacugacccccuaauuaaaagcaccauacucggguuugugucaaauuucggacaggucccuaagcagcuguucacgaagccgcauccagcccggacagcagccgguaaacccuuaccuggcaaggaugugaguacucccguaucccugccagggcacccucagcccuuuuucuauagcuugcaaucucuccguccaucacaggugaccguuaaagacauguaccuguuuagccuuggauccgaaucuccgaagggcgcuaucggucauauugugaguacagagaaaaccauccuggccgucgaaagaaacaaggugcucuugccuccccuguggaaucgcacuuucucguggggguuugaugacuucagcugcugucuuggcuccuauggaucagauaagguccugaugaccuuugagaacuuagcggcauggggaaggugccuaugugccgugugcccaucucccacaacgaucguuacuagcgggaccaguacaguagugugugucugggagcucuccaugaccaaaggacggccuagaggucugcgccugaggcaggcuuuguacggccacacucaggccgugacaugccucgcagcuucaguuaccuucucucugcuugugagcgggucccaagacuguacgugcauucugugggauuuagaccaccucacucaugucacacgacugccagcccaccgggaaggaauaagugcuaucaccauuagcgaugugucuggcaccaucguaucaugugccggugcacauuugucccuuuggaaugugaacgggcagccccuggcgagcauuacuacagccuggggcccugagggagcuauuaccugcuguugccuaauggaaggcccggccugggacacaagucagauaaucauuacugggucucaagauggaaugguuagagucuggaagacggaggacgugaaaauguccgugccaggcaggcccgcuggugaagaaccuccagcacagcccccuucgccccgcgggcacaagugggagaaaaaucucgcccugagccgugaacuggacgucucaaucgcauugaccggaaagccauccaagacaucuccggccguuacugcgcucgcugugagucggaaccauaccaaacugcuuguaggcgaugagagagguaggauauuuugcuggagcgccgacggcuga

SEQ ID NO: 64790 - RNA, 3021 nt, Artificial Sequence
  derived and/or modified sequence opt3 from WDHD1__Homo_sapiens__NP_001008397
auggacagcucccagcaaaagaccuucagaggccacgaugcccccgugcugucucucucauuugacccuaaagauaucuuccuugcuagugcaagcugcgacggguccgucaggguuuggcagauuucugaucagacaugugccauaucguggccacuguugcagaagugcaacgacgugaucaaugcgaaaucaauuugucgguuagcuuggcaaccgaaaagcggaaaacugcuagccauccccguagagaagagugugaagcucuaccgccgagaauccuggucucaucaguuugaucugagcgacaacuucauuucccagacucuuaauaucgucacguggucaccuugcggucaguaucuggcagccggcaguauaaacggguugaucauuguguggaauguugagaccaaagauuguauggaacgugugaagcacgagaaaggauacgcuaucugcggccucgcauggcauccaacaugugguagaauuagcuauacugacgccgaagggaaccugggacugcucgagaaugucugcgaucccucuggcaagaccuccucaagcaaagugaguucuaggguagagaaggacuacaacgauuuauuugacggcgacgauauguccaaugcuggggacuuccugaacgauaaugccguugaaaucccuagcuuuucgaagggaauaauuaacgacgaugaggacgaugaagaccuuaugauggcgucuggucggccacgccaaagaucccacaucuuggaggaugacgaaaauucaguggauauuaguaugcugaaaacaggcagcucccuacucaaggaagaggaagaggacgggcaggaaggaucuauccauaaccugccccuugucaccagccagaggccuuucuaugacggcccaaugccgacuccccggcagaaaccuuuucaaucagguaguacaccacugcacuugacccaccgcuucaugguguggaacuccaucgggauuauacgauguuacaaugaugagcaggacaacgcaaucgauguggaguuucaugacacgagcauucaccaugccacucaccucucuaauacccugaacuauacaaucgcugauuuaucacacgaagccauacugcucgcaugcgagaguacugacgaacuugcuagcaagcugcauuguuugcacuucuccucuugggauucgagcaaagaguggauuaucgaccuaccccagaaugaagauaucgaggccauuugccugggacaaggcugggcggccgcagcuaccuccgcccuccugcuuagacuguuuacaaucggcgggguccagaaggagguuuucucauuggcuggaccugugguaaguauggccggucauggcgaacaacucuucauuguguaccacagggggaccggauuugacggcgaucagugccuggguguccaguuacuggagcuagggaaaaagaagaaacagauacuccauggcgacccacugccccuuacgcggaagucuuacuuggcauggaucggauucagcgccgaaggcacuccguguuauguggauuccgaggggauuguucguaugcugaaccgcggacucgguaauacauggaccccuaucugcaacacuagagaacacuguaaaggcaagucagaccacuacuggguggucgggauccaugagaauccccagcagcugaggugcauuccauguaaaggaagccgguuuccucccacacuuccacgacccgcuguggcgauacugucuuucaaguugccuuauugccaaaucgcaaccgagaagggccagauggaggagcaguuuuggcgcuccguaauuuuccacaaccaucucgacuaccuggccaaaaaugguuaugaauacgaggagaguacgaagaaccaggcuaccaaagaacaacaggaguuacugaugaagaugcuagcccucagcuguaaacuggaaagagaguuuaggugcguugaacuugcagauuugaugacacagaaugccgugaaccuggcuaucaaguaugccucucggucccgcaagcucauucuggcacagaaauuaucagagcuggcggucgagaaggcugccgaacuuacugcaacccaaguggaggaagaggaagaggaggaagacuucagaaagaaguugaaugccggguacaguaacacagcuacugaguggagccagccaagguuucguaaucaggucgaagaggaugccgaagacucgggcgaggcagaugacgaggaaaaaccggagauccacaagcccggacaaaacuccuucucuaagagcaccaacucaagugauguguccgcuaaaucuggcgccguuacauuuagcucccaggggcgggugaauccuuucaagguaucagcgagcaguaaagaaccagccaugucuaugaacuccgcucgaagcaccaauauacucgacaacaugggaaagucgucuaaaaagucaacugcacugaguagaacgacaaauaacgagaaaucccccaucauuaagccucuaaucccaaagcccaaaccgaagcaggccagcgcugccucuuacuuucagaaaaggaauagccaaaccaacaagacugaggaagucaaagaggaaaaucugaagaacgugcucuccgagaccccugcaauuuguccaccccagaauacagaaaaccagcgcccuaagaccgguuuccagauguggcuggaggagaaucggucaaacauccuuagugauaaucccgacuucagcgaugaagcggacauaauuaaagagggcaugaucagauuuaggguuuugucuacugaggaacgcaaggugugggccaacaaagcuaagggggaaacagccuccgagggaacggaggcuaaaaagcgaaagcgggucguggaugaaucagacgagaccgaaaaccaagaggaaaaagcaaaggagaaucugaacuuaaguaaaaagcagaaaccacucgacuucagcacuaaucagaagcuguccgccuuugcauucaagcaggaguga

SEQ ID NO: 64791 - RNA, 2241 nt, Artificial Sequence
  derived and/or modified sequence opt3 from WDPCP__Homo_sapiens__NP_056994
augagaagggaguucugcugggacgccuacagcaaggcugcaggcucccgggccucuucaccccugccucgccaggaucgagacaguuuuugucaccaaaugagcuucugccucaccgaacuucaucugugguccuugaaaaacacauuacacaucgcggaucgugacauugggauauaucaguacuaugauaagaaagacccaccggcuacugagcauggaaaucuggaaaagaaacagaagcuagccgagucuagagauuaccccuggacgcucaagaacaggcggccugaaaaacugcgcgacucgcuuaaggagcuggaggaauugaugcaaaauucaagaugugugcucagcaaauggaagaacaaauaugucugccagcugcuguuugguaguggcguucucguguccuuaucucugagcgggccacagcuugagaagguagugaucgauagguccuuggucggaaagcugauuucagacaccaucagugaugcacuacucacagacagcuucauuauccugucuuuucuugcccagaauaaacuguguuucauacaguuuacuaagaaaauggaauccucagaugugaacaagcgguuggagaaacucagcgcucuggacuacaagaucuucuauuacgagauucccggcccuaucaauaaaaccacagaacgccacuuagcaauuaacugcguucaugaccgaguggucuguugguggccacuggugaaugaugacgccuggcccugggcuccuaucaguucugagaaggauagagccaaccuccuucuguuggguuacgcgcaagggaggcuagaaguacuguccagcguucggaccgagugggacccacucgaugugcguuuuggaacuaagcagccguaucaggucuucacaguggaacacucggugucugucgacaaagagcccauggcagauuccugcauauacgaguguauucgcaauaagauccagugcguuucagugaccaggauuccucugaaaaguaaggccaucagcuguugcagaaacguaacggaagacaaacuuauccugggcugcgaggauuccucuuugauucucuaugaaacucaccggcgagugacccuguuagcucaaacagagcugcuaccaagccucauaucaugucaucccaguggcgccauccugcuugucggguccaaucagggagaauugcagauuuuugacauggcacugagcccuaucaacauacaacuccuggcugaggaucgccuuccaagagagacucugcaguucucuaaguuguuugacgccucaaguagccucgugcagaugcaguggauugcgccccaaguugugucccagaagggugaaggcucugacaucuacgaucuguuauuccugagguucgagcgggggccgcuaggaguccuccuguuuaaacuuggcguguucacccgcggucaguuggggcugaucgacauuaucuuucaguauauucacugcgaugaaauauacgaggccaucaauauucucucgagcaugaacugggacacacugggacaucaauguuucaucuccaugucagcaaucguaaaccacuuacugagacagaagcucaccccugaaagggaggcucaguuggagacgagucucggcacuuuuuaugcccccacacguccacugcuagauucuaccauucuggaauaccgggaccagauaagcaaauacgcucgaagauucuuucaccaucuccugagguaucaacgcuucgagaaggccuuucuuuuggcaguugaugugggcgcccgggaccuguucauggauauccacuacuuagcucucgacaaaggggaacuggcgcuugcagaggucgccagaaagagggcuuccgauauugacgccgagucaaucacuagcggaguggaacuguuggguccucucgaucgcggcgacaugcugaaugaggcauuuauugggcuaucucuggcuccccagggagaagacuccuucccagauaaccuucccccuaguugcccaacacaucgacacauccugcagcagcggauacuuaauggcagcucuaaccgucaaaucauugacagaaggaaugaguuggaaaaggauaucuguuccgguuuucugaugaccaacacgugcaaugccgaggacggggaguuacgcgaagauggccgggagcaggaaauuagagacggaggcucacucaaaaugauccauuucgggcuggucuga

SEQ ID NO: 64792 - RNA, 3675 nt, Artificial Sequence
  derived and/or modified sequence opt3 from WDR11__Homo_sapiens__NP_060587
augcugcccuacaccgugaacuucaaggucagcgccagaacacucacuggcgcucuuaaugcacacaacaaagccgcgguugacuggggguggcagggacugaucgcuuaugguugccauuccuuggugguagugauugauucuauaacggcccaaaccuuacagguccuggagaagcacaaagcagacgugguuaaggugaaaugggccagggaaaauuaccaucacaacaucggcucaccuuauugucuacggcucgcuagugcagaugucaaugggaagauuaucgugugggacguagccgcuggaguugcccagugcgagauucaggaacaugcgaagccaauccaagaugugcaguggcuguggaaccaggacgcaagccgcgaucuucuguuggccauacacccgcccaauuacaucguccucuggaacgcugacacaggcacuaaacuguggaagaaauccuaugccgauaauauucugucuuuuucguucgacccuuuugauccaucacaccucaccuuacugacaagcgaggguaucguguucauuagugacuuuucccccucuaagccuccaagcgggcccggaaagaagguguacaucuccucaccucauaguagcccagcacacaacaaacuugcuaccgccacuggcgcgaaaaaggccuugaauaaagucaagauacugauuacacaggaaaaaccgucugcagaguucaucacccuaaacgauugucuccaacuggcuuaucuucccuccaagcgaaaucauaugcuguugcucuacccucgugagauucugaucuuagaccuggaaguuaaccagacggugggcguaaucgccauugagagaacuggggugccauuucuccaggucauacccugcuuccagagggacggacuguuuugucugcacgaaaaugguugcaucaccuugcgggugcgcagaucauacaacaacauuuucacaacuagcaaugaggagccugauccagaccccguucaagaacuaaccuaugaucugaggagucagugugacgcuauccgggugacaaaaaccguccgcccguuuucuauggugugcuguccuguaaacgagaaugccgcagcccucguuguguccgauggccgagucaugauaugggaacuuaagagcgcugugugcaacagaaauucgaggaacucuuccucaggggucaguccccuuuacagcccaguguccuucugugggauuccuguuggcgugcugcagaauaaguugcccgaccucucucuggauaacaugaucggucaaagcgcgaucgcaggggaggaacacccacggggaucaauuuuacgugagguacaucugaaauuucuacucacgggccugcuuaguggcuugcccgccccucaguucgcuauccgcaugugcccaccgcugacuacaaagaauauuaaaauguaucagccccuccuggccgucgggaccuccaacggaagcgugcuuguuuaccaccugacuucugguuugcuccauaaggagcugucaauacacaguugcgaagugaaaggcaucgaguggaccagcuuaacauccuuccugucuuuugcaacgucgaccccuaauaacauggggcuagucagaaaugaacuccagcugguggaccuuccaacaggaaggagcauugccuuccggggcgagcgagguaacgaugaauccgcuaucgagaugaucaagguaucacauuugaagcaauaucuggccgugguuuuucgcgacaaaccccucgagcugugggaugucagaacuuguaccuuacugagggaaaugaguaagaauuucccuacaauuacugcacuugaguggucuccaagccacaacuugaaaucccuccggaagaaacagcuggcgacccgcgaagcuauggccagacagacaguggugucagacaccgagcuaagcauagucgaaucuuccguuaucagucugcuccaggaggcagagagcaagucugaacugucccaaaacauuucagccagggagcacuuuguguucacugacaucgauggacagguguaccaucuuacgguagaaggcaauagugucaaggacagcgcucguauucccccggauggaucgaugggcuccaucacaugcauagccuggaaaggggacaccuuggugcugggagauauggacgguaacuuaaauuuuugggaucucaagggccggguuucucgagggaucccuacucacagaagcugggugaggaaaauucgcuucgcaccaggaaagggcaaccagaaacugaucgcuauguauaaugacggugccgaggucugggauaccaaggaggugcagaugguuucaagucuucgguccgggagaaacgugacauuuaggauucuggacguagauugguguaccucugacaaggucaucuuggcgagcgaugacggcugcauacgcgugcucgaaauguccaugaaaucagccuguuuccgaauggacgagcaagaacugacugagcccguguggugcccuuaccuacuggucccccgggcuagccucgcacugaaggccuuucuuuugcaucagccauggaauggacaguacagucuggauauuucucacguugacuauccugaaaacgaggagaucaaaaauuuacuccaggaacaacugaacucccuuagcaaugauauuaagaaacugcuacucgaccccgaguucacacuguugcagcguugucuguuagugucgagacucuacggcgaugaaucagagcugcacuuuuggacgguagcugcccauuaucuucacucucugagucaggaaaaguccgcaagcaccacugcgccaaaagaggccgcuccgagggacaaguugucuaacccucucgauaucugcuacgacgugcugugugagaaugccuauuuccaaaaguuccagcuagaacgcgucaaccugcaggaggugaaacggagcacauacgaucauaccagaaagugcacagaccagcuucuccuguuggggcaaacugauagggcaguucagcuguuacucgaaaccuccgcugacaaucagcacuauuacugugauucacugaaagccugccuugugacgaccgucacaaguagcggacccucucaguccacuauaaagcugguggcaaccaacaugaucgccaacgguaaauuggcugagggcguucaacuccugugccuaauugacaaggcggccgacgcaugucgauaccugcagacauauggggaauggaaucgcgcugccuggcuugccaaggugcggcucaacccagaggagugcgcugauguccugagaagguggguagaccauuuguguucaccccaggugaaucagaaaaguaaggcauuacugguucuccugagccuuggaugcuuuuucuccguggccgaaacucugcacucuaugcguuacuuugaucgcgcggcuuuguucgucgaggccugucuaaaauauggcgcauuugaagugaccgaggacacggagaagcugaucacagccauuuacgcugauuaugcacggucgcucaaaaaccuggguuucaagcaaggggccguacuuuuugcgagcaaggcuggcgccgcaggaaaagacuuacugaaugaacucgagucaccuaaggaggaaccaaucgaagaguga

SEQ ID NO: 64793 - RNA, 1272 nt, Artificial Sequence
  derived and/or modified sequence opt3 from WDR12__Homo_sapiens__NP_060726
auggcccagcugcaaaccagauucuacacagacaacaagaaauaugcuguggaugacguccccuuuagcaucccugcagccuccgagauugcggaucucucuaauauaaucaacaaacuucugaaggacaagaaugaguuccacaaacauguugaauuugauuucuugauuaagggccaguuuuuaaggaugccacuggacaagcacauggaaauggagaacaucucaagugaagaggugguagagauugaauacguggagaaauauacugcuccgcagcccgaacagugcauguuccaugaugacuggaucagcuccauaaagggggccgaggaguggauccuaacgggaucuuacgauaaaaccucgcggauuuggucacucgaagguaagagcaucaugacaauugucggccacacugacgugguuaaagauguggcaugggucaagaaggacagucuguccugucuucuguugucugccagcauggaucaaaccauccuccugugggaguggaauguggaacgcaacaaaguaaaggcucugcauugcugucgagggcacgcaggauccguugacucaauagccguggacggcagugguacaaaauuuugcagcgggucuugggauaagaugcucaaaauuugguccaccgucccuacugacgaggaagaugagauggaggaaucaacaaaucguccaagaaagaaacagaagaccgagcaguuaggacugacgaggacucccaucgugacccuuagcggccacauggaagcugugaguucugucuugugguccgacgccgaggaaauuuguagcgcgucgugggaucauacaauccggguuugggacguggagucuggcucccugaagucaacucuaaccgggaacaaaguauucaauugcaucaguuauagcccucucuguaagcgccuggcauccggaucuacagauagacacauuaggcuuugggacccacggaccaaagaugguagccuggugucauugagucucacgucccauacuggcugggucacaagcgugaaguggucucccacccacgagcagcaacugauaucagggaguuuagacaacaucguuaaacugugggauacucgcagcugcaaggccccucucuacgaccuugcugcccacgaagacaaggugcuguccgucgauuggacagacaccggauugcuacugucuggcggugcagauaauaaacucuauucguaccgauacagcccaacgaccucccaugugggggcuuga

SEQ ID NO: 64794 - RNA, 3969 nt, Artificial Sequence
  derived and/or modified sequence opt3 from WDR17__Homo_sapiens__NP_733828
auggccuggaugaccuacaucagcaacugguucgagcaggacgauugguaugaaggccugcaaagagcuaauaugucccaggugaggcaggucgggcuccuugcagccggaugccagcccuggaacaaggacguuugugcggcuucuggugaucgguuugccuacugcgcaacacuggccauuuauauauaccaauuggaccaccgcuauaaugaguucaaauuacaugcuaucaugucagaacacaagaaaacuauuacggcaaucaguugguguccucauaacccagaucuguuugccagcggcuccaccgacaaucuagugauuaucuggaacguagcugagcagaaggugauagccaaacucgauucuacaaaggggaucccggcgucgcugucauggugcuggaaugcagaagacgucguggccuucguuagccaccgaggaccccuuuuuauuuggacuaucaguggcccugauuccggugugauuguccauaaggacgcucacucuuuccugagcgauaucuguauguuucguuggcacacccaucagaaagggaaggugguauucggacacauagacggcuccuugucaauuuuucauccaggcaacaaaaaucagaagcacguucucagacccgagagucuggaggggacagaugaagaggacccugugaccgcccuggaaugggacccacucagcacugauuacuuacuggucgugaaccuucacuauggaaucagguugguggacucugagucccugucaugcauuacaaccuucaaucuacccagcgcagcugccaguguccaaugucucgcguggguuccuucugccccagguauguuuaucacgggcgauucccagguggggguacugcggaucuggaacgugagccgcacuaccccgauugacaaucuuaaacugaagaagacaggauuccauugcuugcacguccucaacucgcccccuagaaagaaguuuucugugcaguccccaacuaaaaaucauuacaccucaaguacaagcgaggcaguucccccuccaacccugacgcagaaccaggcuuucuccuuacccccgggccacgccguguguugcuuccuggaugguggggucggacucuacgacaugggcgcuaagaaaugggauuuucuuagggaccugggccauguggaaacuauauucgauuguaaguuuaaaccugacgaucccaacuugcuagccacagcaucuuucgacgggaccaucaagguaugggacauuaauacucugacagccguuuauaccagcccaggaaacgagggugugaucuacucacucaguugggcuccuggcgggcugaauugcauagcgggaggcacgucccggaacggugcauuuauuuggaauguccaaaaggggaaaaucauccagcgcuucaacgaacacggcaccaauggaaucuuuugcauugccuggagccacaaggauucuaaacgaauugcuacauguucaagugacggcuucugcauaaucagaacuauugaugggaaggugcuucauaaauauaagcaccccgccgcagucuuuggaugugacuggagccaaaacaauaaggauaugaucgccaccgguugcgaggacacaaacgugaggguuuacuauguggcuacuuccucugaucagccacugaaaguauucucgggccauaccgccaaggucuuucacgugaaauggagccccuugcgggaagggauccucuguuccggaucagacgauggcacaguucguauuugggacuacacccaggaugcaugcauaaauauccugaacggucacacugcgccugugcgcggguuaauguggaauacggagauuccauaucugcuaaucaguggcucuugggacuacacaauuaaggucugggauaccagagagggaacuuguguggacaccguauacgaccauggcgcugauguguaugggcucacaugccacccgagcaggcccuucaccauggccuccuguucacgggacagcacuguucgacuguggucucuuacagcauuggucacgccugugcagaucaacauacuggccgaucgcuccugggaagagaucauuggaaauaccgacuacgcuaucgaaccagguacucccccucuccugugcggcaaagugaguagagauauuaggcaagagaucgaaaaacuuacagccaacagccaggucaagaaacugcggugguuuucugaguguuuguccccacccgggggaucagacaaccucuggaaucugguugcagugauaaagggccaggaugacaguuuacugccgcagaacuauugcaaagguauuaugcaucuaaagcaccucaucaaauuccgcaccagcgaggcucaagaacugacaacugugaagaugucgaaguucgggggcggaauuggcguaccugccaaagaggaaagacuuaaggaggcggccgaaauccauuugaggcuggggcagauacagcguuacugcgagcucauggucgagcugggagaaugggauaaagcucuuuccaucgcaccaggcgugucuguuaaguauuggaaaaagcugaugcagcggcgagccgaccaacuuauucaggaggauaaagacgaugugauccccuacuguauugcuaucggugacgucaagaaguuggugcacuuuuucaugagcagagggcagcucaaagaagcccugcuaguugcacaggcggccugcgagggaaauaugcaaccucugcacgugucaguacccaagggcgcuaguuauuccgacgauauauacaaagaggacuuuaacgaacuccugcauaaggucucuaaagagcuugccgaaugguacuuccaggaugguagggcaguguuggcugccuguugccaccuggcaauugacaauaucgaguuagccauggcuuaucucauccgcggcaacgaacuggagcuugcggugugugucgggaccguucugggagagagcgccgcaccagcuacgcauuacgccuuggaacuccuggcccggaagugcaugaugauuuccguguguuuuccuugcguaggcuauucagugcccuucuguuacgucaauagaaaccuagcugcagaucugcuccugaugaucccagacaaugagcuucacuugauuaagcugugcgccuuuuauccgggguguaccgaagagauaaacgauuuacaugacaaaugcaagcucccuacaguggaagagugcaugcagcuggcggagacugcuagggccgaugacaauaucuucgaaaccguuaaauacuaucuucugagccaagagcccgaaaaggcacuaccaauuggaaucaguuuugugaaagaguacauuucuuccagcgauuggacacucgacacuaucuaccccguccuggacuugcugucguauauacgcaccgaaaaguuacuccugcacacguguacagaggcccgaaacgagcuucugaucuugugcggcuacauuggugcucuccuggcaauccggcgucaguaucagucaauugugccugcccuauacgaauauaccucucagcugcuuaagagaagggagguuagugugccacucaaaaucgaauaccuguccgaggaguuggaugcguggcgcgcuuguacucaaagcacaaaucggucucuggaagacagccccuauaccccuccguccgauucacagagaaugauauacgccacuuuacucaagaggcugaaagaggaaagucuuaaggggauuaucggaccagacuacgucaccggcagcaaccugcccucucacuccgauauccauauuucaugcuugacaggucucaaaauacagggcccuguauucuuucuggaggacgggaagagugcaaucagccuaaaugaugcccugaugugggcuaaggugaacccauucucccccuuaggaacgggcauucgacucaacccuuuuuga

SEQ ID NO: 64795 - RNA, 4029 nt, Artificial Sequence
  derived and/or modified sequence opt3 from WDR19__Homo_sapiens__NP_079408
augaagagaaucuucagccugcucgagaaaaccuggcuuggcgcccccauucaguuugcuuggcaaaagacauccgggaacuaccuggcagugacuggagccgacuauauagucaaaaucuucgauaggcacggucagaagcggucugaaauuaauuugccuggcaacugcguugcgauggacugggauaaagacggggauguguuagcuguaaucgccgagaagucaaguuguauuuaccugugggacgcaaauacgaacaagaccagccagcuagauaauggaaugcgcgaccagauguccuuucuccuguggucuaaagugggcucguuccuugccgucgguacagugaaggggaaccuguugaucuauaaucaucaaacuucacgaaaaauaccaguucucggaaagcacaccaaacguaucacaugcggcuguuggaacgcugaaaaucugcuggcacucggcggggaggauaagaugauuaccgugagcaaccaggaaggagacacuaucagacagacacaggucaggagugagccguccaauaugcaauuuuucuuaaugaagauggaugaccggaccucugccgcugagagcaugauuuccgugguacuggguaaaaagacgcuuuucuucuugaaccugaaugaacccgauaacccugccgaccuagaguuucagcaggacuucggcaauaucguuugcuacaacugguauggggauggacgcauaaugauuggcuuuucauguggucauuucguggucaucaguacucacaccggggaacucggacaggagauuuuucaagcgagaaaccauaaagacaaucugacaagcaucgcagugucucagacucuuaacaagguggcuaccugcggcgauaauuguaucaaaauucaggaccuggucgauuugaaggacauguacguuauacucaaccuggaugaggaaaauaaaggcuuagggacacuguccuggaccgacgauggacaacuccuugcccugucaacgcagagggguagcuugcacguguuccuaacuaagcugccaauccucggcgacgccugcaguacacggauugcauaucugaccucucuucuggagguaacuguggcuaaccccgucgaaggggaguugccuaucacaguguccguugauguggaaccaaauuucgucgccgugggacucuaccaccuggcgguaggcaugaacaaucgcgccugguuuuacguuuuaggugagaacgcagugaagaaacugaaggacauggaguaucuagggaccgucgcuagcauaugucuccauucggacuacgccgcugcccuguucgaaggcaaagugcagcuucacuugauugagucugaaauccuggaugcacaggaggaacgagagacgagacucuuucccgccgucgacgauaagugcaggauccugugucaugcucuuaccuccgacuuccugauuuauggaacagauacuggcgugguucaauacuuuuauaucgaggacuggcaguucgugaaugauuaccggcacccuguaucagucaaaaagauuuuuccagacccgaacgggacccguuugguguucauagaugaaaagagugacggauuuguuuauugccccgugaaugaugcgacauacgagaucccugacuucagcccaacuauuaaagguguccucugggaaaacuggcccauggauaagggcguguuuaucgcauacgacgacgauaaaguauauaccuacguguuccacaaggacacaauccagggggccaaaguuauucuggcuggauccaccaaggucccuuuugcccauaagccauuacugcuauauaauggcgagcucacuugccagacgcaaucugguaaagugaacaacauauaccugagcacacacggguuccuuucaaauuugaaggauaccggccccgacgaacugcgcccgaugcucgcacagaaccugauguuaaaaagauucagugaugccugggagauguguaggauccugaaugacgaggcugccuggaacgaacuugcacgggcgugcuugcaucacauggagguggaauuugcuauucgagucuaucgcagaaucggaaauguuggcauugugaugucccucgagcagaucaaggggauagaggauuacaaccugcuagccggacaucuggcaauguucacuaaugacuauaaccucgcccaggaucuguaccuugcuagcucuuguccuaucgccgcauuggaaaugaggcgggaccugcaacacugggauucagcuuuacagcucgccaaacaccuggcgcccgaccagauuccauuuaucaguaaggaguacgccauucagcuugaauuugcuggugauuaugugaaugcacuggcccauuacgagaagggcaucaccggggacaacaaagaacacgacgaggcuugcuuggccggaguagcacaaaugagcauacgcaugggcgauauuagaaggggugucaaucaggcgcucaagcauccuucccgugugcugaaacgggacuguggggccauccuagagaacaugaagcaguuuucugaagcugcccaacuguaugagaaaggccucuacuaugauaaggcagcuucgguuuacauucgaagcaaaaauugggccaaggugggagaccugcuuccccacgucuccucaccaaagauccacuugcaguaugcaaaagccaaggaagcugauggcagauacaaagaggcggugguugccuacgaaaacgcaaagcaguggcagagugugauaaggaucuaucuggaccauuuaaauaaccccgagaaagcuguaaacauuguccgcgagacacaaucucucgauggggccaagaugguggcccgguucuuucugcagcuuggagacuacggcagcgcuauccaguuccuggugauguccaagugcaauaacgaagcauuuacccuagcccagcaacacaauaaaauggagauuuaugcggauaucauagguucagaagacacuacaaacgaggauuaccagagcauugcucucuauuucgaaggggagaagagauaccugcaggccggaaaauuuuucuugcuguguggccaguauucuagggcauuaaagcauuuucucaaaugcccuuccagugaggacaaugucgccaucgaaauggcuaucgagacgguuggucaagcaaaggacgaacugcuuaccaaccagcugauugaucacuugcucggcgagaaugacgggaugccaaaggaugccaaauaccuguuccgccuauacauggcgcugaagcaguaucgagaggcugcccaaacugcaaucauuauagcccgggaagaacagagcgcuggaaacuaccguaaugcccaugacgugcuuuucucuauguaugcagaacucaaaucccagaagaucaaaauuccgucagagauggcuacaaaccugaugaucuugcacaguuacauucugguaaagauccacgugaagaauggcgaucauaugaaaggggccagaauguuaauaagggucgcgaacaauaucagcaaguuucccucgcacauugugccuauccucaccuccacaguuauugaaugucaucgcgccggacugaaaaacucugcauucagcuuugcugccaugcuuaugcggccagaguauagaucaaagaucgacgcuaaauacaagaaaaagauagagggcauggugaggcgacccgauauuagugaaaucgaggaagcaacuaccccuugcccauucuguaaguuucuguugcccgagugcgaacuccugugcccggguuguaaaaauuccaucccuuauugcauugccacggggcgccacaugcuaaaggacgauuggaccgucuguccacauugcgacuuccccgcccuguacucugagcuuaaaauaaugcucaacacagagagcacuuguccuaugugcuccgaacggcugaacgcugcgcaguugaagaaaaucucagauuguacccaauacuuaagaacagaggaggagcuguga

SEQ ID NO: 64796 - RNA, 1401 nt, Artificial Sequence
  derived and/or modified sequence opt3 from WDR1__Homo_sapiens__NP_005103
augcccuacgagaucaagaaaguguucgccagccugccucaggucgaaagaggcguuuccaagauuauagggggagacccaaaagguaacaauuuucucuauaccaacggcaagugcgugauccuuaggaauauugaugaccacucucgguucguaaacugugugcgcuuuucaccggaugggaaucgauucgcuacagcaagugccgacggacaaaucuacauuuaugauggcaaaacuggugagaaggucugcgcgcugggagggagcaaggcucaugacggcggcaucuacgccauauccuggucucccgauucgacgcacuuguuaucagcaagcggggacaaaaccaguaagaucugggauguguccguuaacucuguggucagcacauuuccuaugggauccacugugcuggaccagcagcuagguugucucuggcagaaagaucaucugcuuucaguaagucugagcggcuauauuaauuacuuggaccguaacaauccaucuaagccccuccacguuaucaaagggcauuccaagucaauucaaugccugaccgugcacaagaacggaggcaaaagcuauaucuacagugguucucacgaugggcauauaaauuacugggacuccgaaacaggagagaacgacagcuucgccggcaagggccacaccaaucaggucucgagaaugacuguggaugaaucugggcagcugauuuccuguucaauggacgauacagugagguauaccagucucauguuacgggacuacagcggacagggugucguuaaacuggaugugcaaccuaagugcguagcugugggcccagggggauaugcagucgugguuuguaucggccagauugugcuuuugaaagaccagcgcaagugcuuuuccaucgauaaccccgguuacgagccugaggucguggccguacauccagggggcgacacgguugcuaucggaggcguggaugggaaugucagacuguauucuauucuaggaacuacccucaaagacgaagguaagcugcuugaggccaagggcccggugacagaugucgcguacagccacgacggggcauuccuggccgugugugacgcuucaaaaguugugacuguauuuagugucgccgauggauauuccgaaaacaacguguucuacggccaccaugcaaagauaguuugcuuggcuuggagccccgacaaugagcacuuugccucuggugggauggauaugaugguguacgucuggacccucucagacccugagacaagggugaaaauccaggaugcgcaucggcugcaccauguaaguagcuuagccuggcuggacgaacacacccucgugacgacuucccacgaugcaucuguuaaggaguggacaauuaccuauuga

SEQ ID NO: 64797 - RNA, 588 nt, Artificial Sequence
  derived and/or modified sequence opt3 from WDR20__Homo_sapiens__NP_001229344
auggccaccgagggcgggggaaaggaaaugaacgagaucaaaacacaguucacuacgagagaaggucuguacaagcuccuuccccacagcgaguauuccaggccuaaucgggugccauuuaacucucaaggcucaaauccgguccgcguuaguuucgugaaccugaaugaccagagcgggaacggagaucgauugugcuuuaauguaggccgugaauuauacuucuauauuuacaaaggugugagaaaggcugcagaccuguccaaacccauagauaagaggaucuauaaggggacccagccuacaugucaugacuuuaaccaccuaacugccaccgcggagucugucucgcuccuggugggauucucagcuggccagguucaacuuauugauccaaucaaaaaggagacaagcaaacuguuuaaugaagagaacaguugccagcauuuguggaagguggacuggaaugaggaacggcagaacgagggcuccaaaaccucugaagaggcccucgucacugugcagcccgcagaacacuucugucgccaagaggauagaaugcaggggguacugcaggaccagaauuga

SEQ ID NO: 64798 - RNA, 1938 nt, Artificial Sequence
  derived and/or modified sequence opt3 from WDR26__Homo_sapiens__NP_001108585
augcaggccaacggcgcugggggagguggcgggggaggcggugggggaggcggcgggggagguggcgggggaggccaaggucagacccccgagcuggcaugccucagcgcccagaauggggaauccucuccuucaaguagcuccucugcgggagaccuugcucacgccaacggccuguugccaucggcaccgucagccgcuagcaauaacaguaauuccuuaaacgugaauaacggcguccccgggggagcagccgcugccucuagcgcgacaguugcagccgcuuccgccacuacggcagcuucaaguagccuggccaccccugagcuagguucuucccucaagaaaaagaaaagacugucacagagcgaugaagacgugaucaggcuuauuggccaacaucugaauggguugggacucaaccagacaguagaucugcugaugcaggagaguggcugucggcucgaacacccaucugcgacuaaguuccgcaaucaugugauggagggugacugggauaaagccgagaacgacuuaaaugaacugaagccccuuguccacuccccucaugcaauagugcgaaugaaguuuuugcugcuacagcaaaaauaccucgaguaucuggaagaugggaagguucuugaggcucugcaaguguugcguugcgagcucaccccacugaaauacaacacagaaagaauccacgucuuaagcggcuaucugauguguucgcacgccgaggaccucagggcuaaggccgaaugggagggaaaaggcaccgcaucucgguccaagcugcuggauaaguugcagacuuaccuacccccuucagugaugcugccaccgcgcagacuccagacacugcuuaggcaggccguagaacugcagcgggaccgcugcuuguaucauaauaccaaacucgauaacaaccuggacaguguuagcuuacugauugaucacguguguucccgaagacaguuccccugcuacacgcaacagauccuaacugagcauuguaaugaggucugguuuugcaaguucucuaacgacgggaccaaacucgcuacaggaagcaaggacacuaccgugauuaucuggcaaguggauccugacacacaccuucuuaaauugcugaagacccucgaaggucacgcguauggcgucucauacauagcauggaguccagaugacaauuaccugguugccugugggcccgaugacugcuccgagcuuuggcuguggaacgugcagacgggagaauugaggacuaaaaugagccagucucaugaggauucacucacaaguguagcuuggaauccugacggcaagcgguuugugaccggugggcagcguggccaguucuaucagugugaucuggacggaaacuuacuggauagcugggaaggcguccgcgugcaaugccuauggugccucuccgacgggaagacuguucuggccucugacacacaccagagaaucaggggauacaauuuugaggaucuuaccgaccggaacauugugcaggaggaucauccaaucaugucguucacgauuagcaaaaauggucgauuggcacugcucaacgucgccacccagggcgugcaccugugggacuuacaagaucgcguacugguuagaaaguaucagggggugacacagggauuuuacacuauccauuccuguuucggcggucacaaugaagacuuuauagcuucagggagugaggaucacaaagucuauauuuggcauaagaggucugaacuucccaucgccgaguugaccggccacacacggacugugaacugcgucagcuggaauccgcagauuccuuccaugauggcaucagcgagcgacgauggaaccgugcgcaucuggggccccgcuccauucaucgaccaucaaaacauugaagaggaguguucuuccauggauaguuga

SEQ ID NO: 64799 - RNA, 1104 nt, Artificial Sequence
  derived and/or modified sequence opt3 from WDR31__Homo_sapiens__NP_001012361
augcugcuccuuagaugccagcugaagcaagcucccccucagaaagugagcuucagguuuugugucguuaugggcaagcagcaguccaaauugaagcacucuaccuacaaauaugggcggccagacgagaucauugaggaacgcauacaaacaaaggccuuccaggaauacucaccggcacauauggauacugugaguguaguggccgcguuaaacagcgaccugugcgucuccggagguaaggauaaaacggugguugcuuauaauuggaagaccggcaacguggucaaacgauuuaaggggcacgagcaugaaaucacaaaaguggccuguauucccaagucuucgcaguucuuuucagcaagccgugacagaaugguaaugaugugggaucuacacggaaguucccagccuaggcaacagcucugcggccaugccaugguugugacuggucuggcugucucuccagacagcucccagcuuuguaccgggucacgggauaauacacuguugcucugggacguggugaccggacagagugucgagcgcgcaagcguuucuagaaacgugguaacucaccugugcugggugcccagggagccuuacauccugcaaacauccgaagauaagacccuccgguuaugggacucacgcggccugcaggucgcccacauguucccagcuaaacagcauauucaaacguauugugaggugagcguugauggccacaagugcaucaguuguucuaauggguuuggaggugaaggcugcgaggccacucuuugggacuugcgacagaccagaaacaggauaugugaguacaaagggcauuuccagacaguggcguccugcgucuuucugccccgggcacuagcccucaugccucugaucgcuacuagcucgcacgauugcaaggugaaaauuuggaaucaggacaccggagccugucuuuucacacugucuuuggacggcuccgguccacucaccucacuggcaguaggggaugcuaucaguuuacugugcgccagcuuuaaccguggcauucaccuccuucgcauggaccauucccaaggacuggaauugcaggagguugcggccuucuga

SEQ ID NO: 64800 - RNA, 1611 nt, Artificial Sequence
  derived and/or modified sequence opt3 from WDR34__Homo_sapiens__NP_443076
auggccaccagagcucagcccggcccucugagccaagcaggguccgccggaguggcggcucucgccacagucgguguugcaucuggcccagggccgggaaggcccggcccucuucaggacgagacucuggguguggccucaguaccaagucaguggcgggcugugcaggggauccgcugggaaaccaagagcugccaaacggcauccauugccacagcuucugccucggcgcaggcacgaaaccacgucgaugcccaggugcagacugaggcucccguuccugugucaguccaaccacccagccaguacgacauaccucguuuggccgcauucuuaagaaggguggaagcuaugguaauccgggagcugaauaaaaacuggcagagucaugccuuugauggauucgaaguuaauuggaccgagcagcaacagaugguguccugucuauauacacucggcuacccaccggcgcaggcccaaggccugcacgucaccucuauuagcuggaacuccacugggucagugguggcaugcgcuuauggacgccuugaccauggugauuggaguacacucaagagcuuugucugugccuggaauuuggacagaagggaucuccggccccagcagccuucugcuguuguggagguaccauccgccgugcugugccuggcauuccaccccacccagccuucacaugucgccggcgggcucuacagcggagaaguguuaguuugggaccugagucgccuugaggauccauugcuguggcgaacgggccuaacugacgauacccacacagaccccgugucucaagucguguggcucccggaaccuggucacucccauagauuucagguacugagcguugcuacugaugggaaagugcuucuguggcagggaaucggcgucggccaguugcaacucaccgagggguucgcgcuggugaugcagcaguuacccaggucgacaaagcugaaaaagcacccacggggagagaccgaagucggugcaacggccguggcuuuuucuuccuucgacccucgucucuuuauucuuggcacugaagggggauucccccugaaguguucauuggccgcaggcgaggccgcucuaacacgcaugccaaguagcguuccccugagagccccugcacaguuuaccuucuccccacauggugggccgaucuauucugugagcugcucacccuuucacaggaaccucuuccugagugcgggcacugacggacacguacaucuuuacuccaugcugcaagcuccuccauugacaagccuccagcugucuuuaaaauaucuguucgccguccgguggucacccgugcgaccucuaguuuuugcagccgcuaguggcaagggggaugugcagcuguucgaccugcagaaaagcucccaaaagccaaccguccuuauaaaacagacgcaggaugagucucccguguacuguuuggaauuuaauucgcaacagacccagcugcucgccgcaggagacgcucaggguacaguaaagguguggcaacugagcacugaguucaccgagcagggcccgcgcgaagccgaggaucuugacugccuggcggccgaaguugcugcauga

SEQ ID NO: 64801 - RNA, 3546 nt, Artificial Sequence
  derived and/or modified sequence opt3 from WDR35__Homo_sapiens__NP_001006658
auguucuuuuaccugagcaagaaaaucuccauucccaacaaugugaagcuccagugcgucucuuggaacaaagagcaaggcuucauagccugugggggagaagacggucuucugaagguuuugaaauuagagacccagacagaugacgcuaagcugagaggccuagcagccccuucaaaucucaguaugaaccagacucuggaagggcacagcggauccgugcagguagugacguggaaugagcaauaucagaaacuuaccacaucugaugaaaacggccugaucauugucuggauguuguacaaagguucguggaucgaggagaugauuaauaacaggaauaagucagugguucggagcaugaguuggaacgcggacgggcagaaaaucugcauaguguaugaagauggagcugucaucgugggcuccguagacggcaaucgcauuugggggaaggaucucaaaggaauccagcugucucauguuacuuggagcgccgacuccaaggugcugcucuuugguauggcaaacggcgagauucacaucuacgauaaucaagggaacuucaugauaaagaugaaauuaucaugucuggucaaugugaccggagccauuaguaucgcuggcauucauugguaucacgguacagaaggguacguggagccagacugcccgugucuugcagucugcuuugauaacggacgaugucagaucaugcgucaugagaacgaccagaaucccguuuugaucgauaccggcauguaugugguaggcauucaguggaaccacauggggagcgugcuggccgucgcuggauuccaaaaggccgcgaugcaggacaaagacgugaauauaguucaguuuuacacuccuuucggugaacaccuaggcacacucaaggugccagggaaagagaucucugcacuguccugggaaggaggcggucuuaagauugcccuggcugucgauucauuuaucuacuucgccaacauaagacccaauuauaaauggggguacugcagcaacaccgugguauaugcauacacgaggccugaccggccagaguauuguguuguguuuugggauacuaagaauaacgaaaaguacgucaaauaugugaagggcuugauuaguaucaccacaugcggagacuucuguauccucgcuacuaaagccgaugagaaucauccccaagaggaaaacgagauggaaaccuuuggcgcgacauucguccugguguuaugcaauucuauugggaccccucuggacccaaaguacaucgauauuguuccccucuucguggccaugacgaaaacucacguaauagcagcuuccaaggaggccuuuuacacauggcaguaucgcgucgcuaagaaacuuaccgcccuggaaaucaaccagauuacuagaagcaggaaggagggacgggagcgcaucuaccauguggacgauacacccucggguucuauggacggcguuuuggauuauuccaaaaccauccaggggacgcgagacccuauuugcgcaauaaccgccucagacaagauccuaauugugggaagagaaaguggcacaauccaaagguacagccugccaaaugucggucucauucagaaauauucccugaacugucgggcuuaccagcuuucucugaauugcaacagcucacguuuggcgaucauagauaucaguggggugcucacuuucuuugaccuggaugcacgcguaaccgacuccacaggccagcaagugguuggagaguuacugaagcuagaaagaagggaugucugggacaugaagugggccaaagauaaccccgaccucuucgcuaugauggagaagacucggauguauguguuucgaaaucuggauccugaggagccaauucagaccagcggcuacaucuguaacuucgaggaccuugaaauuaaaucuguguugcuggaugagauccucaaggaccccgaacacccgaauaaagauuaccugauaaacuuugagauucgcucacuuagagacaguagggcccugaucgagaaggucgggauuaaggacgcaagccaguucaucgaagauaauccucacccccgguuguggcgccuccuggccgaggcugccuuacagaaacuggaccuauauacagcagaacaagcguuuguuagaugcaaggauuaccagggaauaaaauucgugaagaggcucgguaaacugcuuuccgagucuaugaagcaggcugaagugguaggcuauuuugggcguuucgaggaggccgaacggaccuacuuggagauggaccgaagagaucuggcaaucggacucaggcugaaauuaggcgacugguuucgcguccugcagcuuuugaagacugguucgggggaugccgacgauagccuccuggaacaagcuaacaaugccauuggcgacuauuucgcagaucggcagaaguggcuaaacgcugugcaguacuauguucaaggaagaaaucaggagaggcuggccgaauguuacuacaugcucgaggacuaugagggccuggaaaaccuugcgaucuccuugccagagaaucauaaacuguuaccugaaauugcccagauguucgugcgcgucgggaugugcgagcaggcugugacggcauuucucaaguguucacaacccaaagccgcuguugauacaugcgugcaccugaaccaguggaauaaggccguagaacuugcaaagaaccauaguaugaaggagaucggaucucuguuggcgcgauacgccagccaccuccuggagaagaauaaaacccuagacgcuauagaacuguaucggaaggccaacuacuucuuugacgcagcuaaacucauguucaagauugccgaugaggaagcaaagaagggcuccaagccacugcgugucaaaaaguuguaugugcuuucagcccuguuaaucgagcaguaccaugagcagaugaaaaacgcucaaagagguaaggugaaaggaaagagcucugaagcgacuuccgcccucgcagggcugcuugaggaagagguccugaguaccacagacagguuuaccgauaaugcuuggcgcggcgccgaagccuaucacuucuuuauccuagcucagcggcagcucuacgaggguuguguugacacugcacugaagacagccuugcaccugaaagauuacgaggacauuaucccgccuguggaaauuuauagcuuacucgcgcugugcgcuugugccucuagagcauucggcacgugcuccaaggccuuuauaaaacuuaagucacuggagaccuugaguagcgaacagaaacaacaguacgaggaucucgcucuggaaaucuucacuaagcauacaucgaaagacaacaggaagccagagcuagauucccugauggaagggggagaaggcaaacuuccgaccugcguagcaacagggucucccauuacugaguaucaguuuuggauguguagcgugugcaaacacggaguccucgcccaagaaaucucacauuacaguuucuguccucugugccacuccccagugggcuga

SEQ ID NO: 64802 - RNA, 2856 nt, Artificial Sequence
  derived and/or modified sequence opt3 from WDR36__Homo_sapiens__NP_644810
augugcuguaccgagggcagccugagaaagagggacucccagcgggcccccgaagcugugcucugccuucaacuguggcagcgcacagucccuuuggauacuuuaaaagggcugggaacguguuucccaucugguccggagcuacgaggcgcagggaucgccgcggcuauggaacgugccucagagagaaggaccgcaagugcccucuuugcuggauuccgggcacugggccuuuuuagcaacgacauuccccacguugugcgcuucuccgcccugaagagaagguuuuacguaacaacuugcguggguaaaucuuuccauaccuaugauguccagaaguugucgcucguggcuguuucaaauagcgugccucaggacauauguugcauggccgcggaugggcggcuggucuuugcagccuacggaaacguguucagugcuuuugcccgcaauaaagaaaucguacacacauucaagggccauaaggcagagauucacuuucugcaaccauucggcgaccauaucauuuccguugauaccgacgggauccucauaaucuggcacauuuauucugaggaagaguacuuacagcugacuuuugauaaaagcguguucaagaucuccgcuauucuucaccccucaacauauuugaacaaaauccugcuaggaagugaacaggguagccuccagcuguggaaugucaagucuaacaaacuucuguacaccuucccuggcuggaaggugggggugacggccuugcaacaggcgccagccgucgacguuguggcaauaggacucauguccggccagguaauuauccauaauauuaaguuuaacgagacucugaugaaauuccgacaggauuggggucccaucaccucaaucagcuuuagaacagacgggcacccugugauggcugccggaaguccauguggccauauuggcuuaugggaucuggaggacaagaaacucauaaaucaaaugaggaacgcucacucuacugccaucgcagggcuuaccuuccugcaccgggaaccguugcuagucacaaauggagccgacaacgcucugcguauuuggaucuuugauggucccaccggcgaggggcgccuccugagauucaggaugggacauuccgcgccucuuacgaauauacgguauuacggccagaacggucagcaaauucugagcgcaucgcaggacgggacuuugcagucuuuuuccacagugcacgaaaaguucaauaaaucacucggccauggacugaucaacaagaaacgaguuaagcgcaagggcuuacagaacaccaugagugugagacugccacccaucacuaaauuugccgcugaggaagccagggagagcgauugggacgggauuaucgcaugccaccaaggaaagcuauccuguucuacauggaauuaccagaaaagcaccauuggugccuauuuccucaagccuaaagagcugaagaaggaugacauaacggcuaccgccgucgauaucacaucaugcggcaacuuugcagugauugggcuuaguuccggaacuguagacguuuacaauaugcagagcggcauccaucgggguucuuucgggaaagaucaggcgcacaagggcucagugcgcggagucgcuguggacggcuugaaccaacugaccgucacaacugggagugaaggacuccugaaauuuuggaauuucaagaacaaaauccuuauucacagcgugucccugucuucgagcccaaauauaauguugcuccauagagauuccgguauccugggcuuagcccuggacgacuucucaauuaguguucuagauaucgagaccaggaagauugugcgugaauuuucugggcaccagggacagaucaacgacauggcauucagccccgauggccgguggcucauauccgccgcuauggacuguucaauccgaacaugggaucugccgagcgguugccuuauugacugcuuuuugcuggauucugccccucucaauguauccaugagucccaccggggacuuccuggcaacuagccaugucgaucacuuaggcaucuaucuguggucuaacauuucccuuuacucagugguuaguuugagaccacucccugcugacuaugugcccagcaucgucaugcugccaggaacgugucagacacaagauguggagguaucggaagagaccguggagcccuccgacgaacuaauagaguacgauucuccugaacagcugaaugagcagcucguuacucugagccuuuugccagaaucaagguggaagaaccuguuaaaucucgacgucauuaaaaagaaaaacaagccgaaagagcccccuaaggugccaaagagugcccccuuuuucaucccuaccauuccaggccuggugccccgcuaugcggccccggagcagaauaacgacccucaacaguccaaagucguuaaccuuggggugcuggcucagaagucugauuuuugcuugaaacucgaagagggacuggugaauaacaaguacgacacagcacuaaaucugcucaaagaaagcggcccauccgguaucgagaccgagcugcggucacuuagccccgauugugggggaaguauagaaguaaugcaaucuuucuugaagaugaucggcaugaugcuggacagaaaaagggauuuugaguuagcccaggcuuaccucgcccuguuccuuaagcugcaccuaaagaugcucccuuccgaacccguccuguuggaggaaauuacuaaccugagcucacagguggaggagaauuggacacauuuacagucgcucuuuaaccaaucuaugugcauccugaauuaucuuaaaagugcacuguuguga

SEQ ID NO: 64803 - RNA, 1485 nt, Artificial Sequence
  derived and/or modified sequence opt3 from WDR37__Homo_sapiens__NP_054742
augcccaccgagagcgccuccugcucuacagcuagacagacuaagcagaaaaggaagucacacagucugagcauccggcgcacgaacuccucugaacaagagcgaaccggccucccucgugacaugcuugaagggcaggauucgaaacugccaucaagcgugagaaguacauuguuagagcuguucggacagauugaaagggaguuugagaaucuauacauagaaaaccucgagcugcggcgcgaaaucgacacucuuaaugagagacuggcagccgagggucaagcgauugauggcgcugaauuguccaaggggcagcucaaaaccaaggccucucauagcacaucccagcugucacagaagcugaaaaccacuuauaaggcaaguacaagcaaaaucgucucuuccuucaagaccacgacuucaagggccgcuugucaacucguuaaagaguacauuggacaccgggacggcaucugggaugugagcguagcaaagacccagccgguggucuuagguacagccagugcugaccauacugcccugcuuuggucuauagaaaccgggaagugcuuggugaaauaugcgggacacguuggcuccgugaacagcaucaaguuucaucccucggagcagcuggcacuaacagccucuggcgaucagaccgcucacauuuggcgcuacgccguccaacucccuacgccacagcccguggcagacacuuccaucucaggggaagaugagguagaguguagugacaaagaugaaccugaccuggauggagacguuagcuccgacugcccaacaauucgagugccccuuaccucucuuaagagccaccagggugucgugaucgcuucagauugguuggugggcgggaaacaagccgucacugcgaguugggacagaacagccaaucucuaugauguugagaccuccgaacuggugcauagcuuaacgggacacgaccaggagcugacccauuguugcacacacccuacucagaggcucguagugaccucuucacgggauacaacuuuccgucuuugggacuuucgcgauccaaguauacacagcgucaacguguuccagggccauaccgacacaguuaccuccgcaguguuuacugucggugauaaugugguaucugggucggacgauagaacgguuaaggugugggaccugaaaaacaugaggagcccgauugcuacaauccggaccgacuccgccauuaaucgaaucaacgucugugugggacaaaagaucauugcuuugccccacgauaaucgccaggucagacuauucgacaugucaggcgugaggcuggcccggcucccucgcaguucuagacagggccauaggcguaugguuugcuguagcgcaugguccgaagaucacccagugugcaaccuguuuacuuguggguucgaccggcaggccauaggauggaauaucaacauucccgcucugcugcaagagaaguga

SEQ ID NO: 64804 - RNA, 2034 nt, Artificial Sequence
  derived and/or modified sequence opt3 from WDR43__Homo_sapiens__NP_055946
auggccgcuggcgggggagguagcugcgacccccuggccccugcaggcgugccaugugcguucuccccgcacucucaggcuuacuuugcccucgcaucaaccgaugggcaucuuagagucugggagacagccaacaauaggcugcaccaagaauauguucccagugcucauuugagcggaacuugcacguguuuagcaugggccccugcucggcugcaggccaaggaguccccacagcgcaaaaagcgaaaaucugaagcggugggcaugucgaaccagaccgaccuacucgcacuggguacagccguagggucaauccuucuguacagcacugugaagggagaguugcacaguaaacucauuuccggcggccaugauaaucgugucaacugcauacaauggcaccaggacucugggugucuguauagcugcuccgaugacaagcacaucguggaauggaauguucagaccuguaaggugaaaugcaaguggaaaggagauaacucaagugucagcucucuguguauuucccccgacgguaagaugcucuuaucagcuggcagaacaaucaaacugugggugcuugagaccaaggagguauacaggcauuucacugggcacgccacaccuguuagcaguuugauguuuaccacgauucggccacccaaugaaucucagccuuucgauggaaucacuggccuguauuuucuauccggugcagugcaugaccgccuccugaacgucuggcaagugagaagcgagaauaaggaaaaaucggcugugaugucuuucaccgucacagaugagccaguuuacauagaccuuacucuguccgagaacaaggaggaaccggugaaauuggccguagugugcagggaugggcagguccaccucuuugaacacauccugaauggauauuguaagaaacccuuaaccucaaacugcacaauucagaucgcgaccccuggcaagggcaaaaagaguacgccaaagcccauuccuauccuggccgcaggguucugcagcgacaaaaugucccuccuucugguguacggaucuugguuucagccaacuauagagcggguugcuuugaauagccgcgaaccccauaugugucuagugcgagacauuucaaacugcugggccccgaaggucgagacagcuaucaccaaagugagaacuccuguaaugaauagugaggccaagguucuggugcccgguauuccaggccaccaugcagccaucaaaccugcucccccacaaacagaacaggucgaguccaagaggaaaagcgggggaaacgaagugucuaucgaggaacggcucggcgcgauggauauugacacccacaaaaaggguaaagaggaucugcagacgaacucauuccccguccuucugacccaaggguuggagaguaaugacuuugaaaugcucaacaaggugcugcagacacguaauguuaacuuaauaaagaagacugugcugcgcaugccucuacauaccaucauuccacuccugcaggagcuuacaaagagauugcagggccacccgaauagcgcaguacugaugguccaauggcucaaaugugugcugacuguucacgccuccuaccuuucuacccugcccgauuuggugccucagcucggaacacuguaucaguuaauggaaucgagggucaagaccuuccagaaacugagccaucuacacggcaagcucauccugcuuauaacucaagugacggcuuccgagaaaacaaagggggccaccucaccaggacagaaggcaaaauugguauacgaagaggagaguucugaagaggaaagcgacgaugagauugccgacaaggauuccgaggacaacugggaugaagacgaggaagagucagaaagcgagaaagacgaggauguggaagaggaagacgaggaugcugaagguaaggacgaggagaauggcgaagaucgggacacugccucugagaaagaacugaacggggauuccgaccucgaucccgagaaugaaagugaggaggaauga

SEQ ID NO: 64805 - RNA, 1035 nt, Artificial Sequence
  derived and/or modified sequence opt3 from WDR45B__Homo_sapiens__NP_062559
augaaccugcuccccugcaauccucacggcaacgggcuucuguacgccggauucaaucaggaccaugguuguuuugcuugcggcauggagaacggguucagaguguauaauaccgauccauugaaggaaaaagagaagcaagaauuuuuagagggaggcgucggucacguugaaaugcuguucagguguaacuaccuagcacucguagggggaggcaaaaagccgaaauaucccccuaauaaggugaugaucugggacgaucugaagaaaaagacagugauugagauagaguuuagcacugaagucaaagccgugaaacuucggcgcgaccgaaucguugugguccuggauuccaugauuaagguguucacguuuacccauaacccacaccaguugcauguauucgagacaugcuacaaucccaagggccucuguguucugugcccuaacucuaauaacucacugcucgcguuuccagggacucacaccggacacgugcaguuagucgaccuggcuaguacagaaaagcccccuguggauaucccagcccaugagggugugcuuagcuguauugcauugaaucugcagggcacccguaucgccacugcuuccgagaaagggacacuaauaagaaucuucgacaccucuucgggacaccucauucaagaacugaggcggggcucacaggcagccaacaucuauugcauuaauuuuaaccaggaugcuagccuuaucugugucaguuccgaccaugguacgguucacauauucgccgcggaggauccgaagcgcaacaaacagucuagccuggcauccgccucauuuuugcccaaguacuucaguagcaaauggucuuucuccaaguuucaagugccuucagggagcccaugcauuugugcuuucggaacugaacccaaugccguaaucgcaauuugcgcugacggcaguuauuacaaauuucucuucaacccuaagggcgagugcaucagagauguguacgcccaguuucuggaaaugaccgacgacaaguuauga

SEQ ID NO: 64806 - RNA, 1083 nt, Artificial Sequence
  derived and/or modified sequence opt3 from WDR45__Homo_sapiens__NP_001025067
augacccagcaaccccugagaggcgugacaagccucagguucaaccaggaccaguccugcuuuuguugcgccauggagacugggguccggaucuacaauguugaaccucuuauggagaagggacaccuggaucaugaacagguggguucuaugggcuugguagagauguuacaccgcucaaaccugcuagcucucgucgggggaggcaguagcccaaaauucuccgaaauuucugugcugauaugggacgaugcacgagaggguaaggacucgaaagagaaacuugugcuggaauuuacguucaccaagccgguuuugucagugcguaugagacaugauaagaucgucauugugcucaagaauaggaucuauguauacagcuuucccgacaacccucggaaacuguucgaguuugauacacgcgacaauccaaaggggcugugugaucucugccccaguuuagaaaaacaacugcuuguuuucccuggacacaaguguggcuccuugcagcugguggaccuagccucuacuaaaccaggcaccagcuccgcgcccuuuacaauuaacgcucaucagucagauaucgccugcgucagucucaaucagccugggaccgugguggcaagcgccucucaaaagggaacucugauaagacuuuucgacacacaguccaaggagaaacuggucgaguugaggcgggguaccgauccagcuacgcucuauuguaucaacuuuucacacgacagcaguuuccugugcgcaucuuccgacaagggcacuguucacauuuuugccuuaaaagauacccgccugaaucgaagaagcgcucucgccaggguggggaagguaggaccgaugaucggccaguacguggacucgcaguggucucuugcguccuucacaguccccgcagaaucagccuguauuugcgcuuucggucggaacaccaguaaaaaugugaacagcguuaucgccauauguguggaugggacuuuucauaaguaugucuucacaccugacggaaauugcaaccgugaggcauuugauguguaccuggacauuugcgaugacgaugacuucuga

SEQ ID NO: 64807 - RNA, 1833 nt, Artificial Sequence
  derived and/or modified sequence opt3 from WDR46__Homo_sapiens__NP_005443
auggagaccgcccccaagccuggcaaagacgugccaccgaagaaagauaagcugcagacaaaaagaaagaagcccaggcgguacugggaagaggaaacugucccuacgaccgcuggggcaagcccaggacccccucgcaacaaaaagaaucgagagcuccguccacaaagacccaaaaacgccuauauccuuaagaaauccaggauuucuaagaagccucagguuccgaaaaagccacgggaauggaaaaaucccgagucacagcgcggucugaguggcacacaggacccuuucccagggcccgcgccugugccaguagaggugguccaaaaguuuugcagaauagauaaaagcaggaaguugccccacuccaaagcuaagacucggucucgcuuagaaguggccgaggcagaagaggaggaaaccucgaucaaggccgcucgaucagagcugcuacucgcagaggaaccgggauuccuggaaggcgaggacggugaggauacagccaaaauuugucaggcugacaucguugaagccguggauauugcgagcgcagccaagcauuuugaccuuaaccugagacaguucgggccuuacagguugaauuauagucggaccggacgucaccucgcuuuuggcggccgcagagggcaugucgccgcacuggauugggugacuaaaaagcugaugugcgagaucaacguaauggaagcuguuagggacauacgguuccuccacuccgaggccuuacuggcgguggcccagaaucgauggcuucauaucuacgauaaccaaggaauugaauugcacuguauccgcagaugcgacagggucacacggcuggaguuucuacccuuccacuuucuccuggcaaccgcuucugagacggguuuccuuacuuaucuggaugugagcgugggcaaaauugucgccgcuuugaaugcccgcgcagggagacucgacguuaugucccagaacccauacaaugccgugauccaucugggacacucaaacggcaccguaaguuuauggagcccugcuaugaaggaaccccuggcgaagauacucugucauagggguggggugcgugcagucgccguggacucuacaggaacuuauauggcuaccuccggccuugaucaccagcugaaaauuuuugacuugcggggcacauaccagccacuaucaacccgaacgcugccccacggggccggacaucucgcauucagccaaagaggucugcuuguugccggcaugggggauguggucaauaucugggcuggacagggcaaggccaguccuccaucucuggagcagccguacuugacucacaggcucuccggucccgugcaugggcugcaauuuugcccuuucgaagacguauuaggcguuggacacacaggcgggauuaccagcaugcuggugccaggagcgggugagcccaacuucgauggccuagaaucgaauccuuaucgcucucggaaacagagacaggagugggaggucaaggcacuccuggaaaaagugccagcugagcuuaucuguuuggaccccagggcccuggcagaagucgaugugaucucccucgagcaggggaagaaggagcaaauugaacgccugggauacgacccgcaggccaaagcuccuuuucagccaaagcccaaacagaagggccgaucaaguacugccagccuuguuaaacggaagcguaaggugauggaugaggaacauagagacaaaguaaggcaaucccugcagcagcagcaccacaaggaggcaaaagcuaagccuacaggugcccgccccucugcguuggaucgguucgucagauga

SEQ ID NO: 64808 - RNA, 1788 nt, Artificial Sequence
  derived and/or modified sequence opt3 from WDR48__Homo_sapiens__NP_001290331
auggagugccagagcgcccaagugaucuccgcuucuucagacaccacagucaagguuuggaacgcacacaagggcuucuguaugaguacucugagaacgcauaaggauuacgugaaagcccucgcguaugcuaaggacaaagaacuuguagccagcgcagggcuggauaggcagauuuuucuuugggacgugaauaccuuaacagcccugacugcuuccaacaauaccgucacaaccucuucgcuaucaggaaacaaggauagcauauacagucucgcaaugaaucagcuggguacuaucauuguguccggcucuacagagaagguucuucgggugugggacccccgaaccugcgccaaacugaugaaguugaaagggcacacggauaacgucaaggcucuccugcugaaucgcgacggaacucagugucucagcggcuccucagaugguaccauccguuuauggagucuggggcaacagagaugcauugccacauauagggugcaugacgaaggaguaugggcgcuucagguuaacgaugcauucacucacguguacagcggcggccgggaccgcaaaaucuauuguaccgauuugagaaauccugacauaaggguccugaucugcgaggaaaaggccccagugcuaaagauggagcucgaccggucugcugauccgcccccugccauuuggguggcaacaaccaaauccacggucaacaaguggacucugaaagggauccauaauuuucgcgcuucaggagacuacgauaacgacuguacaaauccaauuacccccuugugcacucagccugaucaaguuaucaaggguggcgccagcauaauucagugucacauccugaacgacaaacgacacauuuugacaaaggauaccaauaacaacguggcguauugggacguacucaaagccugcaagguggaggaucuggggaaggucgacuucgaagaugagaucaaaaagagauuuaaaaugguguacguuccaaauugguucaguguggacuuaaagacgggaaugcugaccaucacacucgacgaaucugauuguuuugcagcuugggucuccgccaaagacgcuggcuucagcucgcccgaugguucugacccuaaacuuaaccugggaggguugcuacugcaggcccuccuggaguacuggccaaggacucaugugaauccgauggaugaggaagagaacgaaguaaaucacguuaacggcgagcaggaaaaucgggugcaaaagggcaacggguauuuucaggugcccccucauaccccagucauuuucggagaggccgguggccguacacuuuuucgccuguugugcagagacuccgggggagagacugaaucaaugcuccugaaugagaccgucccccagugggugauagauaucacaguugacaagaacaugccuaaguucaauaaaauuccauuuuacuuacaaccccacgcaaguagcggcgcuaagacccugaaaaaggauaggcuauccgcgucugacaugcuccaggugcggaagguaauggaacacgucuaugagaaaaucauaaaccuggauaaugaaagccagacuacgucaaguuccaacaaugagaagccgggugagcaggaaaaagaggaagacauugcagugcuugccgaggaaaagaucgaguugcugugccaagaucagguucucgacccuaacauggaccugcgaacagugaaacauuucaucuggaaaagcgggggcgaucuuacccugcacuaccgccagaagucuacuuga

SEQ ID NO: 64809 - RNA, 2094 nt, Artificial Sequence
  derived and/or modified sequence opt3 from WDR49__Homo_sapiens__NP_849146
auggccuggagagaaaagagcaaaaagaggcugaacaugaccuccuucaauaucgcucagggcauucacgcauuugacuaccauucucggcucaaccuuauagccacagcggggaucaauaacaaagugugccuguggaaucccuaugucguuucaaagccugugggaguauuguggggucacagugcuagcgugauugccguccaauucuuuguggagcgcaaacaguuauucuccuuuucuaaggauaagguucugcgacuaugggacauccagcaucagcucucgauucaacguaucgcauguucauucccaaaaagccaggauuuuagaugccuguuccacuuugacgaggcccauggcaggcuuuucauaaguuuuaacaaucagcuggcuuugcucgcaaugaaguccgaagccucuaaacgggucaagagccacgagaaagcugugacuugugugcuguacaacuccauccugaagcagguaauuucaagugauacggggagcaccguuucuuucuggaugaucgacacaggacaaaagauuaaacaguuuacuggcugccacgguaaugccgaaaucuccaccauggcgcucgaugcaaacgagacacgcuuacugaccgggucaacugacggaacagugaagauaugggauuucaauggcuauugucaucacacccuuaacgucggccaggacggggccguggauauuagccagaucuugauucugaaaaagaaaauccuagugacgggaugggagagagcuaucacugucuucaggccgcaaaauuuuaaccaguucuuuauucagcccgaagaguggaaggguggcauacaacaucacgacgauauccucugcgccgcauuccugccuccacagacccuuguuacagggaguuacgacggagaaauugugcuguggaauaacucuacugagaacgcucaccauguauugcaccccgacuaucagcggcuccugaaauccaaguuagauaccaagccucagaaacugcucagcgccggccgcucgcaaccaucucaucccauggcggaccacuccacaaccggugugcgaaauuuugagaucgauacggaagggaagaacgccgucaugagacuuuguuuccugaaagcaaggaagaauacugcugugacaggaggcgccaacuugguuucaugcggcgggaguggauacgugcgguuuugggacauauauaaaaagcagcuacuggcugaguuccucgcccauagcggugucggcuccauuaucaugucuaccgauaagaugaaucguuaccugacuacaggggaccuugauggauggcugaaaaucuggaacauugaagaguacuguuugaauagcucaaagaacaaaaucaccaaggcaccuacgcucauucgcaguuuucagccacacgaagacagaauauccagccuggagaugugcgagccgggcggucaguuacugaucauuucuucaagugccgauuguagcaucugcgugaccgggguaugcaaugcucccguuuggaucuucggccaagcgaaacacuggcauauugaaaacugucuauuucucccuaagagggacacaaaucugguggaguccgaaauacagaaggagaucucucuuuucucgaaagaagagagcugcuuggauccaacugagcacucccugcucaacaagaaaaauaaggacgacucaaccuauaacguccggcccagugaagauauuaaucuggacaucaaauacaaggagcgaucuacauguaugaaggaaacucagaaaccuuauuacggagaggugauuaagaaauccuuuagcaccuuccgcucacuuaacaucggcgcacuggaagaguugccagaggucaacaagcccgccuuccuccuggauccggaaaaauauuuuagaaaggagccugaagaggagaggccccagauauuagaagcuccaagccuguucaaaacacuaaaggccguguuugacgagaagaaucucuucccuaaagaaauccugcaucacgagcggaaggcaaaacaacuuugccaggaaaagucuugugagguuaaaaagaacaagaaauga

SEQ ID NO: 64810 - RNA, 1239 nt, Artificial Sequence
  derived and/or modified sequence opt3 from WDR4__Homo_sapiens__NP_387510
auggccggcagcguggggcuggcucucugcggacagacccuugucguuagagguggcuccagguuccuggcaacaucuaucgccucaagugacgaugacagcuuguuuauuuacgauuguuccgcggcugagaagaaaucucaagaaaacaagggggaggacgcccccuuagaucagggaucgggcgcaauacuggccucaacuuucagcaaaagugguuccuauuuugcucuaacggacgauucuaagcggcucauccuguuccgcaccaaaccuuggcagugccuuagcgugcgaacaguagcacguagauguacugcccugaccuuuauugcuuccgaagagaagguguuggucgccgacaagucaggggauguguacaguuucagcguucucgaaccacacggaugcggcaggcuggagcugggccaucucucuauguuacuggacguggcggucuccccggaugaccgguuuauccuuacagcagaucgcgacgagaaaauuagagugucaugggccgcugcaccccacagcaucgaaaguuucuguuuggggcauaccgaguuuguaucuaggauauccguugugccuacucagccaggacugcuacucagcucgucuggugacggcacacugcggcuuugggaauaucgcuccgggcgacaacugcacugcugucauuuggccucacuccaggagcuggucgauccccaggcuccucagaaguucgccgcgaguagaaucgccuuuuggugccaagagaauuguguggcauuacugugcgacggaaccccaguggucuacauuuuccagcucgaugcuaggcggcagcagcuuguuuaucgucaacagcuggccuuucagcaccaagugugggacguagcuuucgaagagacgcagggcuugugggugcuacaggauugucaggaagcaccccugguccucuaccgcccugugggugaccaauggcagagcguuccagaguccacugugcugaaaaaggucucuggggugcuuagaggaaacugggccaugcuggaaggcagcgccggcgcugaugcgucauucaguuccuuguauaaagcaaccuuugacaauguaacaagcuaccucaagaagaaagaggagaggcugcagcagcaauuagaaaagaaacagcggcgacgcucuccgcccccugggccagauggacacgccaagaaaaugagacccggugaggcuacucugucaugcuga

SEQ ID NO: 64811 - RNA, 1152 nt, Artificial Sequence
  derived and/or modified sequence opt3 from WDR55__Homo_sapiens__XP_005268526
auggacagaaccugcgaggaaaggcccgccgaggauggcagcgacgaagaggauccugacuccauggaagcuccaacacggauccgcgauacuccggaggacauugugcuggaggcacccgccucugggcucgcguuccacccugcucgagaucuucuggccgcaggagacgucgauggugacguuuuuguguucucauacaguugucaggaaggcgagacgaaggaauuguggagcuccgggcaucacuuaaaagccugccgugcuguagcauuuucugaggauggacaaaagcugauaaccgugucgaaagacaaggccauccauguccuagauguggagcagggccagcucgaaagaaggguuucaaaagcucacggugccccaauuaacagccugcuucugguggacgagaaugucuuggcgacaggggacgauacuggaggcaucugucucugggaccagcggaaggaaggcccccugauggauaugcgccaacaugaggaauauauugcagacauggcccuggauccugcuaagaaacucuuacugaccgccaguggggacggaugccuugguaucuucaacauaaagagaaggcgguuugaguugcuguccgagccacagucuggcgaucuaacaagcgugacccucaugaaaugggggaagaaaguagcauguggauccucagaaggcacuaucuaccuguucaauuggaacgguuuuggggcuacaagugaccgcuucgcccuucgagcggagagcauugauugcaugguucccgugaccgaaucucuguuguguacgggauccacugacggcgucaucagagccgugaauauucucccuaacaggguggucggcucaguugggcagcacaccggagagccaguggaggaacuggcauuaagccacugcggucgguuucuggcuaguucuggccaugaucagcgucucaaguucugggacauggcccaacuucgcgcuguaguggucgacgauuauagaaggcggaagaaaaagggagggccgcugcgagccuuguccagcaaaacauggucgacugacgacuuuuucgcaggccuacgcgaggaaggugaggauucuauggcccaggaagagaaggaagagaccggggaugacuccgauuga

SEQ ID NO: 64812 - RNA, 1005 nt, Artificial Sequence
  derived and/or modified sequence opt3 from WDR5__Homo_sapiens__XP_005272220
auggccaccgaggaaaagaaacccgagacagaagcugcaagagcccagccuacuccaagcuccucugcgacgcaaucaaagccgacccccgugaaaccuaacuacgcucugaaguucacacucgccggccacacuaaagcagucaguagcguuaaguuuuccccaaauggggaguggcuugccucuucgucagcugacaagcugaucaaaauuuggggagcauaugaugguaaguucgaaaagaccauaagcggccauaaguuggggaucagugacguggccugguccucugauagcaacuuacugguauccgcuucagacgauaaaacacuaaagauuugggacgugaguagcggaaagugccucaaaacccugaagggccacucuaauuacgucuuuuguugcaacuucaauccccaguccaaccuuaucgugucagguagcuuugaugagaguguuaggauuugggacgugaaaacugggaagugucugaaaacauugccugcccauucugauccagucuccgcggugcacuucaaucgggacggaagccucaucguaucgucuuccuaugauggccugugccgcauaugggacaccgcaucaggccagugucugaagacgcucaucgaugacgacaaucccccuguuaguuuugugaaauucagcccaaacgggaaguacauuuuagccgcuacucuggauaacacccuuaaguugugggacuauuccaaaggaaagugccugaaaacauacacuggucauaagaaugagaaauauuguaucuuugccaacuucucugucaccggcgggaaguggauugugagcggaucagaagauaaucuaguguacaucuggaaccuccagacaaaggagauaguccaaaaacugcagggccacaccgacguugugauuaguacggcaugccacccgacugaaaauaucauugcuuccgccgcgcuugagaacgauaagacaaucaaacuguggaaaagcgacuguuga

SEQ ID NO: 64813 - RNA, 3201 nt, Artificial Sequence
  derived and/or modified sequence opt3 from WDR60__Homo_sapiens__NP_060521
auggagcccggcaagagaaggaccaaagacgauacauggaaggccgacgaucugcggaaacaccucugggcuauccagagcgggggauccaaggaagagaggaaacaucgagaaaagaaacuucguaaggagucugaaauggaccugccugagcacaaggagccaagaugcagggauccggaccaagaugcacggucacgcgacagaguggccgaaguccauacugcgaaagagagucccaggggugaacgggaucgcgaccgacagagagagaggcggcgugaugcuaaggaccgcgagaaagaaaaguugaaggagaaacacagagaagccgaaaagagccauuccaggggcaaagaucgggaaaaggagaaagaccgacgcgcaagaaaggaggaauuaaggcagacgguugcccaccacaaccugcuagggcaggagacccgggaccgccaacuccuggaaagagcugagaggaaaggacguucugugucgaagguacggucagaagagaaggaugaggacagcgaacgaggcgaugaggacagagaaaggcgcuaccgggagagaaaacuucaguauggugauaguaaggacaauccucugaaauacugguuguauaaggaagagggggagaggcgccaucgaaaaccacgggaacccgaucgugacaacaagcacagagagaaguccucuacaagggaaaaacgcgagaaguacagcaaagagaaguccaauucauucagugauaaaggagaggagcggcauaaggaaaagagacacaaagagggcuuucacuucgacgaugaaaggcaucagagcaacguggaccgaaaggagaaaucugcaaaggacgagccucgcaaacgggaaucccagaauggcgagcacagaaaccgcggggccucaagcaagcgugauggaaccaguucucaacaugcugaaaaucucguccgcaaccacgguaaggacaaagauucccggagaaagcauggccacgaggaagggagcucggugugguggaaacuggaccagaggccaggaggcgaggagacuguugaaauugagaaggaagagacagaucuggaaaaugcccgagcggacgcauauaccgccucuugugaggaugacuuugaggauuacgaagacgauuucgaggugugcgacggugaugacgacgaauccucaaacgagcccgagagucgggaaaaacucgaggaauuaccucuggcucagaagaaagagauacaggaaauccaacgcgccauuaaugcagagaacgagagaaucggggaacuuagcuugaagcuguuucagaagaggggacggacugaguucgaaaaagagccacgaacagauaccaauuccucuccgagcagagcuucagucuguggcauuuuuguggacuucgccagugcgucccaccgccaaaagagcaggacgcaggcccuaaaacagaagaugcguucuacuaaacuccugcggcuuaucgaucuggacuuuucauucaccuuuaguuugcucgaucugcccccuguaaacgaauaugacauguacauaagaaauuucggcaagaagaacacaaaacaggcauacguucagugcaacgaggauaauguggagagggacauccaaacugaagagauugaaacccgcgaggucuggacacagcauccaggggaaagcaccgugguguccggagguucugagcagcgagauacgucggacgcugucguuaugcccaagaucgauacuccuagauuauguagcuuucugcgggccgcuugccaggugauggccguacuccuugaggaagacaggcuggcagccgagccauccuggaacuugcgcgcucaagaucgugcgcuauauuucucagacaguucuagccagcugaauacaucccuccccuuccugcagaacagaaaagugucaagccuucacaccucucggguccagaggcaaauggugguuuccgugcaugaccugccggaaaagaguuuugucccuuugcucgauagcaaauacgugcuguguguaugggacauuuggcagcccucuggcccacagaagguuuuaaucugcgagucccaggugacuuguugcugucugucaccucuaaaggcauuccuccuguuugccgggacagcucacggaagugucguggucugggaucuucgcgaggacagccgauugcacuauucggugacccuguccgauggcuucuggacguuuagaaccgccacauucucuacugacgguauacucaccagcguuaaucaucggucaccccugcaagcaguggaaccaauuaguacauccguacacaaaaagcagucuuuuguccuuagccccuucuccacucaggaggaaaugucagggcugagcuuucauaucgccaguuuggaugagucuggcgugcucaacguuuggguggucguggaacugccuaaagcugacauugccggauccaucagcgauuuaggccugaugccagggggaaggguaaagcuagugcacucggcacucauccaacugggugacucacuuucucauaaaggcaaugaguucugggggaccacacagaccuugaacguuaaguuucugccgagugaucccaaucacuucauuauaggaacugacaugggccucaucucccacgguacgcgccaggaccugagagucgcgccuaaguuauuuaaaccacagcaacaugggauuaggcccgugaaggugaacgucaucgauuucagcccuuucggcgagccaauauuucuggcuggaugcucugacggcagcauucggcuucaccaguuguccucagccuucccccuccugcagugggauaguagcacagacucucaugcaguuaccgggcuacagugguccccgacucguccugccguguuucuggugcaagaugacaccucaaauaucuacaucugggaucuccugcagagugaccuuggaccaguagcuaaacagcaggucagccccaaccgcuugguggccauggcagcuguuggugaaccugagaaggccggcggguccuuccuggcguuagugcucgcccgagcuucuggaucgauugauauccaacaccugaaaagaaggugggcagcccccgaagucgacgagugcaaucggcuucgccuguugcuccaggaagcucuguggccagagggcaagcuacauaaauga

SEQ ID NO: 64814 - RNA, 4572 nt, Artificial Sequence
  derived and/or modified sequence opt3 from WDR62__Homo_sapiens__NP_001077430
auggccgcugugggcagcgggggauacgcaagaaacgacgccggugagaagcugcccuccgucauggcgggcguuccugcuaggcgggggcagucuucaccaccgcccgccccuccaaucugccuccgccgacguaccagacuuaguacagcaagcgaagagacugugcaaaauaggguaucccuggaaaaaguguugggaauuacggcccagaacucuucgggcuuaaccugugaucccgguacagggcacgucgcuuaucuggcaggaugcgugguugugauacuagacccuaaggagaauaaacagcagcauaucuucaacacugcccggaagucacucagcgcucuggccuuuaguccagauggcaaauacauugucaccggcgaaaaugggcaccgccccgcggugagaaucugggacguagaggagaagaaccaaguugcagaaaugcuuggacauaaguaugguguggccugugucgcuuucuccccuaauaugaaacacauugugucuaugggcuaccagcaugauauggugcugaacgucugggacuggaagaaagauaucguuguggccagcaauaagguauccugcagggugauagcauugucauuuagugaggacagcucuuauuucgucacaguggggaaccggcacguucgcuuuugguuccucgaaguguccaccgagacuaaagucacaucaaccgugccacugguaggacgaagcggcauccugggugagcuccacaauaacauuuucugugggguugcuugcggaagaggcaggauggccggcaguacguucugugugucuuacuccggguuacugugccaguuuaaugaaaagcggguccuugagaaguggaucaacuugaaagugagccugucgucuugucuaugcgucucccaggaacucauuuucuguggaugcacugaugguaucgugcguauauuucaagcgcauucacugcacuaucuugccaaucugccgaagccccauuacuugggcguugacguggcacaggggcucgagccuaguuuccuguuucaccgcaaagcugaagccguauacccagauaccgucgcuuuaacauucgaccccauucaccaguggcugagcugcguguauaaggaucauuccaucuacauuugggacguuaaagacaucaacagagugggaaaggucuggucugagcucuuucacagcucauauguguggaacguagagguguacccugaauuugaggaucagagggccugucuuccaaguggcuccuuccugacuugcagcucugacaauaccauccgguuuuggaacuuggauucaagucccgacagccauuggcagaaaaauauuuucuccaacacacuacugaagguugucuauguggaaaaugauauacaacaccuccaggacaugucucauuuuccggaucgagguucggagaacgggaccccuauggacgugaaggcaggcguccgcguuaugcaagugagccccgauggacagcaccuggccuccggcgacagaucagggaaucuuaggauccacgaacugcauuucauggaugaguuggugaaaguagaggcucacgacgcggaaguccucugucuggaguacaguaagccagaaacgggauuaacucugcuagcaucugccagccgggaccgccucauucaugugcugaacguugagaaaaauuauaaccuugaacagacauuggaugaccacuccucaagcaucaccgcuauaaaguuugccgguaauagagauauucagaugaucucuugcggcgcagacaaauccaucuacuucaggagugcccaacaggggagcgauggacugcacuuugugcguacucaucacgucgcugagaagacaacccucuacgacauggauauugacaucacgcagaaguauguggccguugcaugucaggaucggaacgugcgaguauacaauaccgucaacggcaaacaaaagaaaugcuauaaggguucucagggggacgagggcucccugcuuaaagugcauguggauccuucaggaacauuccuggcgacuagcuguagcgacaagucgauuuccgucauagauuuuuacucuggcgaaugcaucgcuaagauguucgggcacagcgagauuaucaccucaaugaaauuuacauaugacugucaucacuugaucacuguuaguggagacuccugcguguucauuuggcaccucggucccgaaauaaccaauuguaugaagcagcaucuguuagagaucgaucacagacagcaacagcagcauacaaacgacaaaaagaggucuggccacccacgccaggauaccuacguaagcacucccuccgagauucauucacugagcccuggggaacaaacggaggacgaucuagaagaggaaugcgagccagaggaaaugcucaaaacaccgaguaaggacucucuggaucccgacccucggugccuuuugaccaacggaaagcugccacucugggccaaaagacuguuaggcgaugacgauguggcagacggucuggccuuccacgcuaagagguccuaucagccccacgggcgcugggccgagcgagcaggccaggaaccucuuaaaacuaucuuggaugcucaagaccucgacuguuacuuuaccccaaugaagcccgagagccuggaaaauucgauucuagauucacuggagccgcagucucucgccagucugcuuuccgagagcgaaucuccucaggaggcgggacggggccauccaaguuucuugccccagcaaaaagaauccucagaggccagugaacugaucuuauacagccucgaggcugaggucacagugaccgggacugacucucaguauugccguaaggaaguugaggcaggaccuggcgaucagcagggugacuccuaccugagagugucaagugauagccccaaagaccaauccccaccugaagauucuggggagucggaggccgaccuugaauguagcuuugcugccauacacucacccgcaccaccgccugaucccgcgccaagguucgccacaucccugccccauuuuccuggaugcgcuggcccaacggaggacgaauugagucuccccgaggguccuucugucccgagcuccucacugccacagacccccgaacaggagaaguuccuacgccaccacuuugagacucugacagaaucuccuugucgggaacucuucccagccgcacugggcgauguggaggcuagcgaggccgaagaccacuuuuucaaccccagacuuaguaucuccacccaguuuuugagcucucugcaaaaggcaucaagguucacacauacuuuuccuccgcgagccacccagugcuuaguuaaaucccccgaggugaagcucauggaccgcgggggaagucagccacgggcuggcacgggguaugcgagcccugauagaacccauguccuggccgcaggaaaagcugaggaaacacuugaggccuggaggcccccaccucccugucugacuucgcuagccucuugcguaccagcuuccagcgugcucccgaccgaccguaaucugccuacacccacuucagcaccaacccccggcuuggcccaagguguucacgcgccuaguacguguucuuacauggaagcuacagccuccagccgcgcacggauuucaagaaguaucagccugggggauuccgagggaccaauuguggccaccuuagcucagccccucaggcgaccuucuagcgucggcgaacuggcaucccuuggucaggagcugcaggccaucacuacagcgaccacuccgucauuggacucugagggccaagaaccagcucuccggaguugggggaaccaugaggcccgcgcaaaucugagacuaacccugucgagcgccugcgauggacuucuccagcccccuguggacacacagcccggcguaacggugccagcugucuccuucccugcccccucuccaguugaagagucagcacugagguugcacgggagcgcuuuccggccuucccugccggcccccgagaguccaggauuaccugcgcaccccucuaacccacagcucccugaagcccgacccggcauaccgggugggaccgcaagccugcuugagccaacuucaggagcucugggcuugcuccaagguuccccugccagauggagugaacccugggugccaguggaggcucugcccccuagcccgcuagaacugucucgcgucggcaauauucuucauaggcuccagacaaccuuucaggaggcacuggauuuguaucguguguuaguuuccucagggcagguagacacaggacaacagcaggcccggacugagcuggugagcaccuuccucuggauccacucgcagcuggaagccgagugucuugucggcacgucuguggcucccgcgcaagcacugccaaguccugggcccccuuccccacccacauuguacccucuagccagcccagaucugcaggcucuccuggaacauuauucagagcuuuuaguucaggccgugagaaggaaggcacgcggacacuga

SEQ ID NO: 64815 - RNA, 3246 nt, Artificial Sequence
  derived and/or modified sequence opt3 from WDR64__Homo_sapiens__NP_653226
auggacaucagaaaggagaaaaggcugaacauggcccuccagaugagcaauuucaagaaagcucuuaaccgguuugaaaagcugguggagcaaaccgcagcccagaaacgcgaugaacgagcgggcuuguucauucacaaggaggacgcuauaggguacgauaaguuuuaugccuccguccagaaauuauucggacccgacguuaagaaucaggaugugaaacguuuuuacagaaagcugugcaacaauacagacgcaucugccgauuggugugaaaucuucgguuauuuuucaagugaggaggacccuauugcuagccaacuagaugaagagaaccucguauucuuuguguccaggaaacggcgcauccugauuucuggcucgagaaggcgggacgucaucaagucaauagugaagaucccacaucuugaucuguugauuacugcaacgcagaaagggcucaucaccguuuucaauaaccaggacacaagcuggauuacuggaugcgauuaccugcugcagcucaagcgcaucguggccaccacagaacgaaccauaauugucugggacuauaaagcucaaggcaguucccaggagaauuacuuugugaucaagccgauggaccacuguuuacugugcguauguguugugccccuuccugaucauuugugcagagacgauauucugcuaggugacgaugggggauucgucaacagguuuacuguaaauucugacgauuucggcaucaaacaggccaagagcaaacggaagcuccagaaccaagugcuggacuccaagaauuucaaaucagucaagcguaaacuucacaacgauuggguuaugaagauccgcuauauuagugcgcugaauuguuuuggcagcugcucuuuggacuccaaccauucacucgugcuggagagcuuaaaaagacuggaagauaaccucccaguaagggaguucaguaugccccgaggggcaaauacauuuuguuacugcgugaaggccaacgucauagugaccggaggugacgacaagguuauccggcuuuggcacccuaauauuucuacgaaaccagugggcaagcuggucgggcacauguucuccaucgcugaaauagugacuaacgagaaagaucagcauguaguuagcuugucgucugccaagguguuucgcgucugggacauucagacccuaucccugcuccaaguguuccacgauucacagggaggccccggugacaugcagaucuacaguaugaucuaugaugcaaaucaugggaugcugauuacaggaagcuccgucauggacauguacccucuuacuagaaugauccaggauaccaaacaagugccacacacacacgaaagggagauuaacguuaugcuguauaauaaguacuuucaucagguguugaccauauguucugagagcaucauucggguaugggaacucgagacgggccugcaggucuaucagaucuuagaaccgcacggcuucaacacugaggugacaucagcugccguugacgaaaguggguuucuguucgcgaccggagccuacaaugguacugugcgcaucugggauuuuggcuccgggcaagagaugaagguccuacccgagggaaaagacuggaaggaagaugagcauugccucagaaggcugauuuuccuuaaagcacaggaaaagcaccagcaguuggugcuggcucucgagcguaacggcacaauaaaaaugauccaagguaaggaagacgauauuuaucugaugguaaucugggagcuuccugacgugguuccauuucugcaggacgggaagcaugccguccacuugcggaugagcacccgagauagaaauauggcuauucccuucccugacguggagcucaucguggaaaggaacuucucucagccaacggauaaucccaccauggaccuguuacgcgucaacugcauagaucugcuacagguugagggcuacaaucucaucgccgcaggaacacugaacggcgugauuauccuuuggaacuuugugacuucaaccgugaaaaaggucuaccggccggaagacuguuucacagugaauccugauuugcaccccaaacauuuuaagauuaacgacauccuguuccucuuuagaacuccagagugcgccaggcgcaguagccaagauuccauauguucuucgagccagugcgaguccucaaaagggccucagaguucuaagggaagcaaacaauccauucacgacucagaaguuaagggugagcagaccgaugugauggucggcaagcagcagcccauggacaaaaagcauccagggaucgcuaaucugcccgaagcgcaaccuccaauuuuagugacagcacacgaggauggacaccuccgacuuuggaccuuggaaggccggcuccugaaagacaugcuaccguucacuaagcauagcgccaucucucugacgucccucuauacagacaguuguacccguauacugcuugcugguaacguugaggggcacgugaucuugugcaauauuagcucuuuucuggaucccccucaugacgagaaaaaguucaagcaguuacucuccuggagagcccacucacuggaaaucauucagguaaucuacgucgaggaaaaacagguggugcuuacugcaaguauagauggcagcgucaggcuguggcaugccuugaacggacacuauuguggcuacuuugggcaacgccggcuguucgagcugucgcagaccagagacuuuauucuaccaugcgauguuacagaauaucccaucgagaucaaggaggaauccaaauucaccgagaagcagaaauacgaauauccucugauuuuugacagggagaaguggcgaaagaugucuagcgugucacuccuguucaaacgcacuccacccaaggcuuucgaaguagagcaggauuuuaaauucuuuaagagucuuuccucuccgaaaauccggagauacccuuuggagggauucgugacagaaaauagggaggccgguauugucuuuggcagccugccaauauacuccaucucaagccccacgaguuuacguuuccucccucugauugggguggaagcacaaaaggacucuuccgauggaaucaccggcaagaaaaagggugggcacguucagcgcgagaaagcgccccggagaaggagccuuaagaaaaaccuggugccacagauuaaucuagcuucgucauuuuucccugccauccccaaguga

SEQ ID NO: 64816 - RNA, 2826 nt, Artificial Sequence
  derived and/or modified sequence opt3 from WDR66__Homo_sapiens__NP_001171474
augagcgacgccgcugaggcacccagagaagccaccggcgagaacggggaaacagagaugaaggaagaggaggaaccuaauccaaacuacaaagagguggaagauccgcagcaagaguccaaggacgauacuaucgcguggagggagucucaggaagaggaacggaaaacgggagaggaagagggugaggaagagggcaaggaagacaaaaagauugucauggaggaaaccgaggagaaggcuggggaaguucaggagaaagaagccucaggaauacaggaggaaacaacuguggagccccaagagguaaccgcaaguaugauccgccuggaaacacagauuaccgauagccaguccaucacuucuggcauuuucccuaagacacagcgagguucgaaaucaaagcucagccuucaacuggaggacgccgaaaccgaugaguuguuacgugaccugaguacgcagaucgaguuucuagaucucgaccagauauccccagaggaacagcaaaucucuagccccgaaagacagccuuccggggagcuggaagagaaaacugauaggaugccacaggacgagcuuggacaagaacggcgcgaucuggagcccgaaaauagagaggaaggccaggagaggcgggugucagacauucagaguaaggcuggcaucagccgcgagucuuuggucuccucaaccacagaagacauucucuuccagaaggauaaaagcacuccuguguauccacugaccaugacauggaguuuuggguggaacucuucccugccgguuuacuauauccgagaggaaagacaaagggugcucuuauacgucugcgcacacaccgccauaauuuauaauguguuccggaacaaucaguaccaucugcagggacacgcuaacaucauuagcugucuuugcguaucggaggaccgucgcuggaucgccacggcggauaagggucccgacuguuugguuaucauuugggauucuuuuacuggcauaccugugcauacaaucuucgacuccugcccagaagggaauggaauuauggcaauggccaugacccacgaugcuaaauaucuggccacuaucucagacgcagagguccagaagguguguauauggaaauggacacuagcuguggagacccccgccugcacgcucgaacugccuaccgaguacggcguccaaaacuacguuacauuuaauccaacuaacaauaaggaacuugugaguaacagcaaaaccagagcgauuuauuacgccugguaugaggagagggauacacuggcacauuccgcucccuugcucacugaaaagaccuucaauaagcugguagguaaauuuucucagagcaucuuccacuuaaaccugacacagauccucucagccaccauggaggggaaacuuguggucugggacauucaccggccgccuaguuccgcuagcacuuuucugggauuccccuacaucaagccauguaaguuggugcaucuacagaaagaaggcauuacgguucugacaaccauagauucuuauaucgugacuggcgacauuaaggggaacaucaaguuuuacgaccacacccucucaaucgucaauugguauagucaucugaaacuuggagccauucgaacacugagcuucuccaagaccccugcaacucccccaacagagaaaucuaacuaucccccugauugcacguugaagggugaccucuucgugcugcgcaauuuuauaaucggcaccucggaugccgcuguauaccacuuaacuacagacgggaccaaacuggaaaagcuauucguugagccaaaggaugcgauuugugcaaucagcugccacccguaccaaccccucauugccaucggauccauauguggcaugaucaaaguguggaacuacgagaauaagcaguaucuguuuucaagagucuucgaaaaaggucuuggggugcagaguuugacauacaacccugagggcgcucugcucggagccggcuuuacugaagggaccgucuauauucuggacgcaaugucucuugagaaugaaagcccagagcccuucaaguacuccaggacgucagugacccauaucagcuuuucucacgauucccaguauauggccacagcugaccggaguuucacuguugccguguacaugcugguaguccgcaacggacaaagagugugggaguacuuggcaaggcuccguagccaucggaaaucuauucgaucccuguuauuugguguuuaucuggauucaaaugaaccuagacuacucagucugggcaccgacaggcuuuugaucgaguacgaucugcuccgcagcuauaaggaccaccuggaaguguuagauauacaucacacagaccaggggugcuacccaacuugcauggucugguaucccccgcugacccgggagcuuuucuugcucauuuguaacucgggauacaaggugaaacuguuuaaugcgacgacaaagaugugcagaaaaacccuacugggcccugcuuaugguuccccaaucgaacagacucaaguacuccccgugaggucuauggccgagcugcagaagcgcuaccuuguuuucauuaaccgagacaaagucggguugcagauccugccuguggauggcaauccccacaagacaagcgcaauagugugucauccaaacggagucgccggcauggcuguuucauacgacgggugcuaugccuuuaccgcaggaggucacgaucggaguguggugcaguggaaaaucacuuuaucccauccuggcucucaagcucccauucucagcccauccgacaccucacguagcuga

SEQ ID NO: 64817 - RNA, 1965 nt, Artificial Sequence
  derived and/or modified sequence opt3 from WDR70__Homo_sapiens__NP_060504
auggagagaagcggccccuccgaagugaccgggucugacgccucaggaccugauccacagcuggcugucacaauggguuucacuggcuuugggaagaaagcaaggacguucgaccucgaggccauguuugaacaaacccggcgcacagcgguugagcgaagucguaagacucuugaagcuagagagaaagaggaagagaugaacagggaaaaggagcugcggcgccagaaugaggauaucgaaccgaccagcuccagaucuaacgugguaagggacugcucgaaaucaagcagucgggauacauccucuagcgaguccgaacagucaagugacagcucugaugacgaguugauuggacccccuuuaccacccaagauggugggcaagccugucaauuucauggaagaggauauacuggguccacuacccccuccacucaacgaggaagaggaagaggccgaagaggaggaagaggaagaggaagaggaggaaaauccggugcacaaaauccccgacucccaugagauuacccugaagcacgggacuaaaacaguuucagcacuuggacuggauccuagcggcgcccgcuuggugaccggcggguacgacuaugaugucaaguuuugggacuucgcuggaauggacgcaaguuuuaaagccuuccgaucucuccagccaugugaaugccaucaaaucaagucccugcaguacagcaacacgggugauaugauucuggugguaucggggucuucccaggcuaagguuaucgacagagauggguuugaggugauggaguguauaaaaggagaccaguauaucgucgauauggccaauacuaagggccacaccgcgaugcuccauacagguucauggcaccccaaaauuaagggggaguucaugacuugcaguaacgacgcaaccgugaggacaugggaaguggaaaauccuaaaaagcaaaagagcgucuuuaagccacggaccaugcagggaaagaaaguuauccccacgacuuguacauacucccgugauggcaacuuaauugccgcugccugccagaauggcucuauccagauaugggaccgcaaccugaccgugcacccgaaguuccauuauaaacaagcacacgauagcgggacugacacaucauguguaaccuuuaguuacgauggaaaugugcuugcuuccagagguggcgacgacagcuugaagcugugggauauuaggcaguucaacaaaccucuauucucugccucagggcuccccacgauguuuccaaugaccgacugcuguuucaguccugaugacaagcugaucgucacaggaacuagcauucagcggggcugcgguuccgggaaacuuguguuuuucgagcgacgcaccuuucaaagaguuuaugaaaucgauaucacagacgcgucuguggucaggugucuguggcaucccaaauugaaucagauuauggugggcacuggaaacggccucgccaagguauacuacgauccaaacaaaucgcagcggggcgcaaagcugugcguugugaaaacccagcgcaaggcuaagcaagccgagacauuaacccaggacuauauaaucacuccccacgcucugccuauguucagagagccaaggcagcguagcacgcggaaacagcucgaaaaggaucgacuugacccgcugaaaucccacaagcccgagccuccagucgccggacccgguagaggcgggagggugggaacacauggcgguaccuugucaaguuacauugucaaaaauaucgcacuagauaagacugacgauucuaacccucgcgaagccauacugcggcacgcuaaggcggcagaggacagcccauauugggugucccccgccuacucaaaaacccaaccgaagacaauguuugcucagguugaaagcgacgaugaggaggccaaaaaugaaccugaguggaagaaaagaaagauuuga

SEQ ID NO: 64818 - RNA, 3309 nt, Artificial Sequence
  derived and/or modified sequence opt3 from WDR72__Homo_sapiens__XP_011519737
augagaaccagccugcaggccguggcucucuggggccaaaaggcacccccucacuccaucacagccauuaugauaacugacgaucagaggacgaucgucaccgggucucaggagggacagcuuugccuguggaacuugucacaugaauuaaaaauuagugcgaaggagcugcuauucggucacagcgcuuccguuacaugucucgcccgggcacgcgacuuuucuaaacaaccauacaucgugucggccgcugaaaauggcgagaugugcguauggaacgugacuaaugggcaguguauggaaaaggcaacccugccguaucgacauacagccauuugcuacuaucacuguucauuccguaugaccggagagggcuggcuucugugcuguggugaguaccaggaugucuugaucauagacgcuaaaacucucgccgugguucauagcuuuagaaguucccaguuccccgauuggaucaacugcauguguauugugcacucuaugaggauccaagaagacagccugcuggucguguccguagcgggggagcucaagguuugggauuuaucaaguagcauuaauucuauccaggaaaagcaggacguguaugagaaagaguccaaguuucuggaaucacuuaacugccagacaauacgguucuguaccuacacggagcgcuugcugcuagucguguuuagcaaaugcuggaagguguaugauuacugcgacuucagucuccugcuuacugaagucucuagaaauggacaauuuuucgcaggcggcgagguuauugccgcucacaggauccugauuuggaccgaagaugggcauuccuacaucuaucaguugcucaacagcggacugucgaaaucuaucuacccugccgacggucggguguuaaaggagacaauuuauccacaucugcucuguuccacuucaguacaggagaauaaggaacaaagucgccccuuugugaugggcuacaugaacgagcgaaaagaaccuuucuauaagguccuuuuuagcggggagguguccggaagaauaacccuguggcacaucccagauguucccgugucuaaauucgacggcagcccuagggaaauuccagucacagcaaccuggacguugcaggacaauuucgauaagcacgacacuaugucacagaguaucauagauuacuuuuccggucuaaaagacggggcuggaacagccgugguaaccagcucugaguauauuccgucacuggauaagcucaucugcggcugugaggacggcacuaucauuaucacacaggcgcugaacgccgcaaaagcucggcuucuggaagggggaaguuugguuaaggauucucccccucacaaggugcucaaaggucaucaccaauccgucaccucucuguuauacccacauggccugucgagcaagcuagaccaguccuggaugcucucaggggaucuggacaguugcgugauucuuugggauauauucacggaggaaaucuugcacaaauuuuuccuggaggccggacccgucaccucucuccugaugagcccugaaaaguuuaaacuucguggcgagcagauuaucuguugcguguguggugaccauuccguugcucuguugcaccucgaggggaagucaugccuguuacacgcccgcaagcaucuguucccagugagaaugaucaaauggcaccccguagaaaauuuucuaauugucggcugugcagacgauagcguguacauaugggagaucgaaacaggaacucucgagaggcaugagaccggcgaacgggcccgaauuauccugaacugcugugacgauucucagcuuguuaaguccguguugccgauugcuagugagacacugaaacacaagagcaucgaacaacgcagcuccucaccuuaucagcucgggccccugccaugcccuggauuacaggucgagaguagcugcaaagugacugacgcgaaguucugucccagaccauuuaauguacugcccgugaagaccaaauggucgaacguugguuuccacauacuuuuguuugaucucgaaaaccuggucgagcuacugcucccuacaccacuguccgacguggauucuagcucaaguuucuacggcggggaggugcuuaggcgggcaaaguccaccgucgaaaagaagacuuugacgcugcgcaaaucuaagacagccugcggaccguuaagcgcugaggcccucgcaaagcccaucaccgaaucccuggcccagggcgacaauacuauuaaauuuucagaggaaaacgaugguaucaagagacagaaaaagaugaaaauuagcaagaaaaugcaaccuaagccaaguaggaagguugacgcuucucuuaccaucgauacagccaaacuguucuuguccugucuccugcccuggggcguggacaaggaucuagacuaucugugcauaaaacaucucaauauucugaaacuucaggggccuaucagcuugggaauuucgcugaacgaggacaauuucucauuaaugcucccaggcugggaucuguguaacucugggaugaucaaagacuacaguggagugaaucuguuuucccguaagguacuugaucuaagcgacaaguauaccgcaacucuccccaaccaggucgguauaccgcggggccuggagaauaacugcgauucuuugcgagaaagcgacacaaucguguaccuguuauccagacucuuccugguuaauaaacuugugaacaugccucuggaguuggcguguagggucgggucaaguuuucgcauggaaagcauucacaauaagaugcggggagcuggcaacgauauccucaauaugucuuccuucuauucaugccugagaaacgguaaaaacgagagucaugugccagaagccgaccuaagccugcuuaagcucauuuccuguuggagggaucaaucuguucaggugacggaggcaauccaggccguacuguuggcugagguccaacagcacaugaaaucgcuggggaagauacccgugaauagccagccugugucaauggccgaaaacggcaauugcgagaugaagcagauguuacccaaacucgaauggaccgaggagcuggaacuucaauguguccgcaacacucugccauugcagacaccuguuucccccgugaagcaugacaguaauucuaacagcgcaaauuuucaggauguagaggacaugccagaucgaugcgcucucgaagaguccgaaucaccgggagagccucggcaccacucuuggauugccaaagugugccccuguaaggucagcuga

SEQ ID NO: 64819 - RNA, 1158 nt, Artificial Sequence
  derived and/or modified sequence opt3 from WDR74__Homo_sapiens__NP_060563
auggccgcugcagccgcgagauggaaccacgugugggucggcacugagacagggauccugaagggaguuaaucuccagaggaaacaagcugccaacuucacugcagggggccagccccggcgcgaagaggccgugagcgcucuuugcugggggacgggaggcgaaacccagaugcugguagguugugcagaccgaacagugaagcauuuuuccacugaggaugggauuuuccagggacaacgucacugcccuggcggcgaagggauguuuagaggauuggcccaggcugacgguaccuuaauaacaugugucgauucuggcauccugaggguguggcaugacaaagauaaggacaccucaagugauccacuacucgagcugcggguugggccgggagugugccgcaugagacaggaccccgcccacccucaugucguggcgacuggcgguaaagagaaugcacuuaagauuugggaucugcaggggagcgaggaaccaguauucagggccaagaacguucggaaugacugguuggaucuccgcgugcccaucugggaccaagauauucaguuucugccuggaucccagaaacuggucacauguaccggcuaccaccaggugcgaguguaugacccagcuucuccccaaagaaggccuguccucgaaacgacuuacggcgaguauccauuaaccgccaugacacugacuccggguggaaacucgguuaucguggguaauacccacggccagcuugcagagauagacuugcggcaggggcgucugcuaggaugccucaagggccuggcugguucaguacgcgggcuucaaugucaucccagcaaaccucuguuggccaguugcggccucgauagagugcugaggauccaccggauucagaacccacgaggauuagaacauaaggucuaccugaaaucccagcucaauugucuucuguugucuggccgcgacaacugggaggaugaaccccaggagccucaagaaccaaauaaggugccccuagaggacacagagaccgaugaacugugggcgagccucgaggccgcagcuaagagaaaacuguccgggcuugaacagccgcagggagcccugcagacgaggcggcgcaagaaaaagagaccugguucaaccagucccuga

SEQ ID NO: 64820 - RNA, 1881 nt, Artificial Sequence
  derived and/or modified sequence opt3 from WDR76__Homo_sapiens__NP_079184
augagcagauccggcgccgcugcagaaaaggccgacucuaggcagcggccccaaaugaaagugaacgaauacaaggagaaucagaacaucgcguaugucucacugcgcccugcucagaccacaguucucauuaaaacugccaagguguaccuugcaccauucagucugagcaauuaucaguuggaucaauuaaugugcccgaaaucccugucugaaaagaacucgaauaacgagguagccuguaagaaaacgaagaucaaaaagaccugccgacguauaauucccccuaaaaugaagaauacaucaagcaaggcugaaaguacucuacagaacuccucuagcgcagugcacaccgaguccaauaaacuccagccaaagagaacagccgacgcuaugaaccugucagucgauguggagaguagccaggacggggauucugacgaagauaccacucccucccuugacuuuucaggacugagcccuuacgagaggaaacgguugaagaauaucagugaaaacgccgauuucuuugcgucucuccaacuguccgagagcgcagcccgccugagagagaugauugagaaaaggcagccacccaagucgaaacggaagaagccuaaacgcgaaaaugguaucggcugucgaagaucuaugaggcucuuaaagguugacccauccggggugucacugccggcugcccccacaccuccaacccuugucgcagaugaaacgcccuugcugccuccaggaccccuagagaugaccagugaaaaccaggaggacaauaacgagcgguucaaaggcuuucuccauacuugggcugguaugagcaagccguccucuaaaaacacagaaaaggggcugagcucaauaaagaguuauaaagccaaucuuaacggaauggugaucuccgaggauacuguauacaagguuaccacaggcccuauuuucagcauggcgcugcaccccucugaaacccguacguugguggccgucggcgcaaaauuuggccaggugggacucugcgaccugacucaacagccaaaggaggacgguguguaugucuuccauccucacucacagcccguuaguuguuuauacuuuagcccagcuaaucccgcccauauccugucccucucuuacgauggcacacuucgcugcggggacuucucgagagcuauuuuugaagagguguauaggaacgagcggagcuccuucucaaguuuugauuuccuggccgaagacgcaucuaccuugaucguaggacacugggauggcaauaugagccuaguggaccgacgcacuccugguacauccuacgagaaacugaccucaagcucuauggggaagauaagaacgguccacgugcauccaguucacaggcaauauuucauuaccgccggacuccgggauacacauaucuacgacgcucgcagacugaacuccaggcguagucagccgcuuauuagccugacugaacacaccaagucuaucgcguccgcauauuuuucacccuugacaggcaaucggguggucacuaccugugccgauugcaaccuccgaaucuucgacaguagcuguauuucguccaaaauaccucuguuaacaaccaucagacacaauacuuuuacggggagguggcugacacgcuuccaggcuaugugggauccaaagcaggaggacugcgugauuguagggucuauggcccauccccggagaguugaaaucuuucacgagaccggaaaaagggugcauagcuucgguggcgaguaccuagucucaguguguaguauaaacgcaaugcacccuacucgcuauauucucgccgggggaaauuccucuggcaagauccaugucuuuaugaacgagaaaagcugcuga

SEQ ID NO: 64821 - RNA, 2448 nt, Artificial Sequence
  derived and/or modified sequence opt3 from WDR78__Homo_sapiens__XP_011540464
augacccccggcaagcacagcggggccuccgcuagagcagccaacggaggugcguggggcuacagggacuuccgcgggggacagaaaaagggcuggugcacaacuccucaacugguggcuacgaugccagucucuccggccgguucacauaaacagcagaauuuugggcucaacaaugcaacccagcccaagaaaaguaucagcuucuuugccacaaugaaggcuacuuccguuaagggauauaccggcgcaaaccaaucucggauggccgugucgaaaacaguacuuauuccuccagagcugaagaccguggaaaaacccaauccuaacauaaagacuacacaggucuucgauaucaauggcaccgacgugacgccacgacccuuguaccacccugauccauuaacugggaccgcuaaaccgucaaagcugcuaacaagccaggagggaagucucgguuccgaauuuauuucuagcuauucccuguaccagaacacuaucaaucccucaacccuuggccaauucacacguaguguucuggggagcucuaccguguccaagucaagcgucagugccucugaguccauugcggaagacuuggaggagccuagcuauaaaagagaaaggcucacgucguuuacugaucuccaggugauccgggcagccccagagaagauaguaacaaaagaagaccuggagaagaacaucgagauuauccugaccgaaacugagacauuacgcuucuuugaucugcccaccguuauggugucugucgaauccgaggaagcugagaaagugacgcagagaaauaagaacuacgaggugcuuuguaggaaucgguugggaaacgaccuguaugucgaacgcaugaugcagaccuucaauggcgccccuaaaaacaaggauguucaaugcgacaagauuaucauggaggauaaagguauaaugucaacagcaugggaccuauacgauaguuacaacgcuauggaacucgugagccuguccguaaagcagucuguggucgagagcucaaguaaagccaaugugcuuccaaaggaccaggaccaacgacugcccggguccacuaccgaaaagaacagcgagacaucuucauugauggauauugagaauguuauccucgcgaagauucaugaagacgaggaagaucacagugacgccauccugaaaagcgauaaauuucaucaggacuuauucuuuauggagagagugcugauggaaaacaucuuccagccgaagcucgcagcuuauaggcagcuuccuguccugaaagagcccgagccagaggaaccugaagauguguuggaguccgccaagcacgaggaaguagaggaagagucuaaaaaggaagaggaggaagagauucacgcugaagagucgacuauacccgccaaucuagaacggcuguggagcuucuccugugaccucaccaagggacugaacguuucaagucuugcauggaauaaaacaaacccagaucuguuggccgugggcuacggccauuuuggguucaaggagcaaaaacguggacucgcuugcuguuggucuaucaagaaucccauguggccugagcgcauuuaucagagcccauacggugucaccgcgguggacuuuuccaucggcgcaccgaaccuguuagccgucggguaucacaauggaacuauagcuauuuacaacgugagaucaaauagcaacguucccgugcuggauucuuccgaaaguccucagaaacaucuaggcccaguauggcagcuccaauggaucgagcaggacagggguacgacaggggacggcaagcgggaaauccuggucagcauuucugccgauggacgaaucuccaagugggugauucgcaaaggccuugacugcuaugauuugaugagacugaagaggaccacugcagccucaaauaaaaagggaggggagaaagaaaagaaagacgaggcucucauaagucggcaggcccccgguauguguuucgcauuucacccuaagggcccaguuuacaaggugaccuggaaccccuucugccacgaugucuuucugagcuguucggcggacuggggagugaucauuuggcagcaagagaacguaaaaccgucccuuucuuucuacccugcuacaagcgugguuuaugaugucgccuggucaccaaagaguuccuacaucuuugcagccgcuaaugaaaaccgcguggagaucugggaccugcauauuucuaccuuggauccccucauagugaauacugccaacccugggaucaaauucacaacgauucuguuugcaaagcagaccgacugcuuacuggucggcgauagcgacggucagguuuccguguaugaacuaagaaauaugcccacugugcucgagacagggaggggcgauaucauggacacccugcuuggaucaaaaagcaaccagagugcuuga

SEQ ID NO: 64822 - RNA, 4473 nt, Artificial Sequence
  derived and/or modified sequence opt3 from WDR7__Homo_sapiens__NP_056100
auggccggcaacagccuggugcuccccaucguccuuugggggagaaaggcuccuacccacugcauuuccgcaguucuguugacagacgauggagccacuauagugacggguugucaugacggccagaucugcuuaugggaucugucuguagagcuacaaauuaauccaagggcgcuccuguucgggcacaccgcuucaaucacaugucuuaguaaagccugcgcaagcuccgacaagcaguacauugugucugccucggaaucaggagagaugugucugugggaugucagcgacggccggugcaucgaauuuacuaaauuggcuuguacccauacagguauacaguucuaucaguuuaguguggggaaccaacgcgagggacgacuccugugccacggccauuacccggaaauccugguuguggaugcaaccucccucgaggucuuauauucucuggugagcaagauuucccccgacuggaucucaaguaugagcauuauccguucucacagaacucaggaggauacaguaguugcccuuuccgugaccggcauauugaaagucuggauugugacgucagaaaucagcgacaugcaggauacugagccuauuuucgaagaggagaguaagccaaucuacugucagaauugccaaucuaucuccuuuugugcuuucacccagaggagccugcuaguggucugcucgaaguauuggcggguuuuugacgccggggauuacucucuccugugcuccggacccucagaaaacggucagacauggacuggcggggacuucgugaguagcgacaaaguaauuauauggaccgagaauggacaguccuauaucuacaaacuuccugcgucuugucugccagcaagcgauucauuucgcagugacgugggcaaagccgucgaaaacuugauucccccugugcaacacauccuccuggauagaaaggacaaagaguuacugauaugcccaccgguuacaagguucuuuuacgguugucgggaauauuuccauaagcuccuuauucagggggauuccagcggacgccugaauaucuggaacaucucugacaccgcugauaagcagggcucagaggagggcuuggccaugacgacaaguauuagccuacaagaagcauuugacaaacugaaucccugcccugcugggaucauugaucagcucuccgugauaccaaacucuaaugagccccugaaggucacugccucgguguacaucccugcgcacggacgacuuguaugugguagagaagacggcagcauuguuaucgugccagccacccagacugcaaucguccagcuguugcaaggggagcauaugcucaggcggggauggcccccgcaccguacacugcgcggccacagaaacaaagugaccugcuuacuguauccucaucaggucuccgcuagguacgaucagcgguaucuaauuucaggugggguggacuucaguguuauaaucugggacauuuucucuggcgaaaugaagcacaucuuuugugugcauggaggcgagauuacgcagcuccugguacccccagagaauugcagcgcccgaguccaacacuguaucugcuccguggcuucagaucauagcguugggcuuuugucucugcgcgaaaagaaguguauaaugcucgccuccagacaccuguucccuauccaggugauuaaauggaggcccagugacgauuaccuugucgugggaugcagcgacgguucuguauauguguggcagauggauaccggcgcacuggaccggugcguuauggggaucacagccgucgagauuuugaacgcuugugaugaagcggugccagcagccguggacucccucucacaccccgcugucaaucugaagcaggccaugacucgcagaaguuuagcagcccugaagaacauggcucaucacaaacuacaaacccucgccacaaaccugcuugcaagcgaggcgucggauaagggaaauuugccuaaauacucccauaacucucugaugguucaggcuaucaagacuaaucucaccgacccagauauacacgugcuguuuuucgacguggaagccuuaauuauccagcugcuuacagaggaggcaagcaggccgaacaccgccuugauuucacccgaaaaucuccagaaagcuaguggcuccucugauaagggugggagcuuucugacuggcaagcgugccgcaguacuauuccaacaggucaaagagacgaucaaggaaaacauaaaagagcaccuccucgacgacgaggaagaggaugaagagaucaugcggcagcgaagagaagaguccgacccugaguacaggucaagcaagaguaaaccacugacacuuuuggaauauaaucugaccauggauacugcuaaguuauuuaugucuugccuccaugccuggggacugaacgaggugcuugacgaaguuugucuggaucgcuugggcaugcucaagccccacugcaccguguccuucgggcugcuaagccggggaggucauaugucgcugaugcucccuggcuacaaucaaccagcguguaaacugucacacgggaagacagaggucggaagaaaacuucccgccucugaaggcguggguaaggggaccuauggcguuaguagggcugugacuacacagcauuugcuguccauuaucagcuuagcaaacacgcucaugucuaugaccaaugccacuuuuauuggagaccacaugaaaaagggcccgacacgcccuccacgacccagcaccccugaucuguccaaggcucgggggucacccccaacaaguagcaacaucguacagggacagauaaaacaagucgccgcaccuguggugucugcgcguuccgacgccgaucacucaggcagugaucccccaagcgcuccggcccuucauacuugcuuccuggucaaugaggguuggucccagcuagcagcuaugcacuguguuaugcucccugaccuguuggggcuggacaaguuuagacccccauuacucgagaugcuggccaggcgcuggcaggaucggugccuugaagugagagaggcagcccaggcucuguugcucgcggaacugaggcgaauugagcaagccggacgcaaagaagcaaucgacgcuugggcccccuaccuaccucaguauaucgaccauguaauuucuccaggcgugaccucggaggccgcucagacgaucaccacagcacccgaugccagcgguccugaggcgaagguccaggaagaggaacacgaccugguggaugacgauauuacuaccggcugucuuucauccguuccgcaaaugaaaaagauaaguacaucuuacgaggagcggagaaaacaggcuacugccaucgugcuccugggggucauuggagcagaguucggcgccgaaaucgaaccacccaaguugcugaccaggccucguagcuccucacagauuccagagggguuuggauuaacgucuggcgguagcaacuauagucucgcucgccauacaugcaaggcacugaccuuccuucuguugcaacccccuuccccgaaacugcccccacacagcacuauccggagaacagccauagaccugaucgggaggggauucaccgugugggaaccuuacauggauguuucugcggugcuaaugggccugcuugagcucugugcugacgccgagaagcagcuggcaaauauuacuauggguuugcccuuaucaccagccgcugauuccgcccgaagugcacggcacgcucugagccucaucgccaccgcgcgcccucccgccuuuauuacaacgaucgcaaaagaaguccauagacacaccgcucuggccgcuaacacucagucgcagcaaaacaugcauacaaccacacuugcaagggccaagggcgagauacugcggguaauugaaaucuugaucgagaaaaugccaacugacgugguugaucuacugguggaagucauggacauuauaauguacugccucgaggggucucuggugaagaagaaaggacuucaggagugcuucccggccaucugucgauuuuauaugguauccuacuaugaaagaaaucaccgcauugcugugggcgcgaggcacgggagcgucgcauuauacgacauccguaccggaaagugccagacgauucauggccacaaagguccuaucacagccguugcuuucgcccccgaugggcgguaucuggcaaccuacucaaacacugacagucauauaucuuuuuggcagaugaauaccucccucuugggaagcaucggcaugcugaacucagccccacaacucagauguauuaagacauaucaggugcccccugugcagccagcuagucccgguagccacaaugcgcugaaacuugccaggcugaucuggacuuccaaccgcaaugucauuuugauggcacaugauggcaaggagcaccgauucaugguguga

SEQ ID NO: 64823 - RNA, 2217 nt, Artificial Sequence
  derived and/or modified sequence opt3 from WDR81__Homo_sapiens__NP_001157145
augcuggugagagucguucucagccuuacccccuccuucccugagccaucugcccuguacacagcuugcaagauggugaggugguugucagcaaaauuaggcccgacuguagccagucggcacguggcgcgcaaccugcuacgacuccugacgagcuguuaugucgggcccacccgucagcaauuuacaguguccucuggagaaucgccuccacuuucagcugguaauaucuaccagaagagacccguucugggcgacauugugagcgggccugucuugaguugccuccugcacauagccaggcuguauggagagccagugcucacuuaccaguauuuacccuacaucuccuaucugguagcaccuggcucugccagcgguccaucccggcuuaacucacgcaaagaagcuggguugcuggcagccguuacccuaacacagaagauuaucguguaccucagugauaccacucugauggacauucuuccgagaaucagccacgagguccuguugcccgugcucucuuuccugacauccuuagugaccggauuuccuucaggcgcucaagccaggacgauacugugugucaaaacuaucagccucauugcgcuuaucugccugcggauuggccaggaaaugguucagcagcauuugagugagccaguggcaaccuucuuucaaguauucucucagcuacacgagcugcgccagcaggaucucaagcuggaccccgccgggcgaggagaaggucaacuuccucagguggucuuuuccgauggccagcaaagaccaguggaccccgcucuguuggaugagcuccagaagguuuucacacuggaaauggccuacacuaucuaugugccguuuagcuguuuacugggggacauaauuaggaaaaucauuccuaaucaugagcuagucggagagcucgcagcucuguaccuugaaucgaucucucccuccucacggaacccagccaguguggagccuaccaugcccggcacagguccagaaugggauccccacgggggaggcugcccucaggacgauggccacagcgggaccuucggauccguauugguugguaaucguauccagauuccaaacgacucucgcccggagaaucccggcccucuggggccaauaagcggagugggcggugggggccucggaucaggcagugaugacaacgcgcugaagcaagaacuucccagauccguccaugggcugagcggaaauugguuggccuauuggcaguacgagaucggugugucucagcaggacgcacacuuucauuuccaccaaauuaggcuccagucauuuccuggccacaguggggcugucaaauguguggccccacugagcuccgaggauuucuucuuaucuggaucgaaggaccggacgguucgacuguggccccuauauaacuacggcgaugguacuagcgaaacagcuccgcgccucguguauacccagcauagaaaauccguauuuuucgucgggcagcuggaggccccucaacacgugguuucaugcgacggcgcagugcaugucugggauccauuuacuggaaagacacuuaggaccguggaacccuuggacagucggguaccucugacggccguggcuguuaugcccgcgccacacaccucuaucacaauggcaagcuccgauucaacucuccgcuucgucgacuguagaaagccuggccugcagcaugaguuuagguuagggggaggucugaaucccggccuugugcgugccuuggcuauaagcccaucugggcgguccguggucgccggauucaguagcggcuuuaugguucuccuggauacccgaacaggucuagugcugagaggguggccggcacacgaaggcgacauucuccagaucaaagccguggagggaucuguacuggucuccucaaguagcgaucacucgcuuacuguguggaaggaguuggaacagaaaccuacccaucacuacaaguccgcuucugaccccauccauacauucgaccuguacggcagcgagguugugaccgggacugucucaaacaaaauuggagugugcaguuuacucgaaccacccucccaagccacgacaaagcugucuagcgagaauuuuaggggcacccuuacuucccuggcauugcucccuaccaaacgccaucugcuacuggguucagauaacgggguuauccggcuccuggcguga

SEQ ID NO: 64824 - RNA, 948 nt, Artificial Sequence
  derived and/or modified sequence opt3 from WDR83__Homo_sapiens__NP_115708
auggccuuccccgagccuaagccaagaccgcccgaacugccucagaaaaggcucaagacccuugacugcggccaaggggcugugcgggcaguccgcuuuaacguugauggaaauuacugucugacaugcgguagcgacaaaacuuugaaguuauggaacccacugcgaggcacgcuacuccguaccuauuccgggcacggauacgaggugcuggaugccgcgggcucuuucgacaauucaagucuuuguagcggugggggagauaaagcuguagugcugugggacgucgccuccggccaggugguuagaaaguuuaggggccaugcagggaaggugaacacaguccaguucaaugaagaggccacugugaucuugucuggaucgauugauucaagcauacggugcugggacugucgcaguagaaggcccgaaccuguacagacccucgaugaggcucgggacgguguuuccucugugaaagucagcgaucacgagauccuggcaggcuccguggacgggcgcgugcgaagauaugaucugaggaugggacaacucuuuucagacuacgucggcaguccaauuacaugcaccuguuucagccgggacggucagugcacuuuaguuucuucccuggauucaacacuucguuugcuggacaaggauaccggggaacuacucggagaguauaaaggccauaagaaccaggaauacaaacuggacuguugccuuagcgagcgcgauacgcacgugguaaguuguucugaggacggcaagguguuuuucugggaucuggucgaaggggccuuggcucucgcccugcccgugggauccgguguugugcagagcuuagcguaucauccuacugagccaugccugcucaccgcaaugggcgggucgguccaaugcuggagagaagaggccuacgaagcugaggacggagccggcuga

SEQ ID NO: 64825 - RNA, 834 nt, Artificial Sequence
  derived and/or modified sequence opt3 from WDR86__Homo_sapiens__NP_001271190
augagcagagaguucaggggccaccggaacugcgugcugacccucgccuacuccgcucccugggaccuuccuucuacaccaugugcagaagaggccgcggcugggggacuguuggucacugguucaacggauggcaccgccaagguuuggcaaguggcaagugggugcugucaucagacauuacgcggacacacuggcgccguacugugccuagugcucgacaccccgggucauacagcuuuuaccgggagcacugaugcaacaauccgagccugggacauucuguccggagaacagcuucgugucuucagagagcacaggggcucugugauaugucuggaaugcucgcgggcugccggcaccuuggcgcccgggccuucaacgcgcagccucgagaguuguggagguugcuccggcgcaacucauucuagcuccaccgccucaagauguacagcuaggugcaguacuccaccccggaccacagccccuugugcaagcgggaccugcgcuggaucugagguuccacgcggcccccugcgaccuugcgccgcguccagagguucaagcgccacgaggugggcagcuccaccgcggcccuguagucguccugauccagccgggccccugcagacuccugcucagacaccaucuggaucccaaagcgcacccccgugcuauccucgcugguggagacccauggccggcgaaggcaggggagcccggaaaccagggcgagaggaaucgccuucucaggcuuccgguuuuucacucguggcgcgcagaaggugggagcgggaguguagucccuggggcccacccccuuucccauuuuga

SEQ ID NO: 64826 - RNA, 1977 nt, Artificial Sequence
  derived and/or modified sequence opt3 from WDR93__Homo_sapiens__NP_001271324
augagcuuccccagaggcucccagacccaaaagaucaaacacccuauugggacaaggaagggaccacuggaggugccgcccccuacugaaaaagacuggccaaaggaugacgagcaggaucauguccucguugaccccgaugaagaacuugacucucugccucagccauaccggaugauaaacaaauuggugaauuuacuguuugaucagucaugggaaaucauugaggagcgcaacgcccuacgagaagcugagaguagccaaauccagcccacgguauauccuccacucggugaaauucagcugaauaagaugccgaacugcauggcagugucccaggacuacgucuucaucggcggggccaagggauuuucuauauauaaucuuuacucggcgaaacaaaucuaugcuugggagaagcugaaaguggauguuaccucaauuugggccacagacuugggcaacgagauccucauugcacccguggaugaaauggguaucauacgucuguucuacuuuuauaaggaggggcuguaccucgucaaagccauuaaugaaguggacgauacuagcaagcagaccacauguaucaagauggagauuagucagggaggcgacuucgcugcauuuuuacugcagggcgccggggacaucuggcuugauguauacaaauugccuaaggaaaccuggcugaaaaagcuagagcacccacaacucacuuccaaccccaaaaagaaaguuagacagccucagcuuaauucucugggaccaaucagcgcugacccccuggagauggaugccaacguguccuucaagggugacauuaaguugucacucccggucuauauaaugaaaaucaagccucccaaaccagugacaggcaccacguuuaagaguccucuggaaguguucgcgaaaauuaaggauugcuacggguuaggaagcggccaaaaucauuuuaucaaggacucucagugggagcagcaggcagaaauauucaacgccuccuauaaaaaguaccuggauagggagugggaagaggagccccucucaacugcuaccuuuuauuuccuucugccaagcuguuuguucgccaugcccccugaagucaaagguccaagugggauggcaugcguucuaggcauucacuggacacggucucauaacuuuuuccuguacucccucaaucgcacucugaaggacaaagcugauccggagggaguguggcccugugccgcgccuaucgccguaagccaacuuucguguucuuccucauaucugguguuggcaugcgaagacggcguccucacccugugggauuuagcuaaggggcagaauauguacccagagggacaggugaagagucagaugaaaugcguugugcuguguacagacgccagccuacaccucgucgaggcuuccgguacccaaggccccacgaucucugugcugguagagagaccuguuaagcaccuugacaaaacuauuugcgccguggcaccaguccccgccuugccggggauggugcugaucuuuagcaagaacggaucagucugucucauggauguggcuaaaagggagauuauaugcgcguucgcaccuccaggcgccuuuccccuggaaguuccuuggaagcccguguucgcuguaaguccagaccauccuugcuuucuucugcggggugauuacucccacgagacagccagcaccgacgaugcagggauccaguauucugucuucuacuuuaacuucgaagccugucccuugcucgagaauauuucaaagaacugcacuaucccacagcgcgaccuggauaauauggcuuuuccgcaggccuuaccucuggagaaacgaugugaaagauuccuacaaaagaguuauaggaaacucgagaagaaccccgaaaaagaggaggaacauugggcacggcugcagcguuacagccuuuccuugcagcgcgagaauuuuaagaaauga

SEQ ID NO: 64827 - RNA, 1299 nt, Artificial Sequence
  derived and/or modified sequence opt3 from WEE1__Homo_sapiens__NP_001137448
auggacaccgaaaagagcggcaaaagagaguucgaugugaggcagacaccccaagucaacaucaauccuuuuacuccagacucccugcuccuucacucuucagggcagugccggcgccgaaagcguacguacuggaacgauaguuguggagaggacauggaagccagcgauuaugagcuggaagacgagaccagaccggcuaaaaggauuacaauaacugaguccaauaugaagucucgguacaccacagaguuccaugaauuggagaaaaucgguucgggcgaauuugggucaguuuucaagugcgugaagcgcuuagauggauguauuuaugcaaucaaaagaagcaagaaaccccuggccggcaguguagacgagcagaacgcgcuaagggaaguguacgcucacgccguccucggucagcauucccacgugguucgguauuuuucugcaugggccgaggaugaccauaugcugauucaaaaugaauacugcaacgggggaagccuugcugaugcaaucuccgagaauuaucgcauaaugucauacuucaaggaagccgagcugaaagacuugcuccuccaggugggccgaggccugagauacauccacaguaugagccugguccacauggauauuaagccuucuaacaucuuuauuuccaggaccucaaucccaaaugcugccagcgaggaaggggacgaggacgauugggcgaguaacaaggugauguucaaaauaggagacuuaggucauguaacucggauuucuagcccccagguugaagagggcgauucccguuuucuggcaaaugaagugcuucaggagaacuauacacacuugccuaaggccgacaucuucgcucuggcccuaaccgucgugugugcagcuggggccgagccacucccccgcaauggagaucaauggcaugaaauuagacagggcaggcugccucggaucccacaggugcuuucgcaggaguuuacggaacuguugaaagucaugauccacccggaccccgagcgacgcccuucugcgauggcccucguuaagcacuccgugcuguuaucagcaaguagaaaaagcgcugaacaacugaggauugagcucaacgccgagaaguucaaaaauucccuucugcagaaggaauugaagaaagcucagauggccaaggcagccgcugaggaacgggcgcuauuuacugaucgcauggcaaccagaucuacaacucaaagcaacaggaccucacgucugauagguaaaaagaugaaccggaguguaucccucacaaucuacuga

SEQ ID NO: 64828 - RNA, 663 nt, Artificial Sequence
  derived and/or modified sequence opt3 from WFDC1__Homo_sapiens__NP_001269395
augccccugaccggcguggggccuggaagcugcagaaggcagaucauucgggcccucugucuucuguuguuacugcuacacgcugguuccgcaaagaacauauggaaacgcgcccucccagcgcgacuggcugagaagucucgugccgaagaggcaggcgcccccgggggaccgagacaaccuagggcugaccggugcccacccccuccacgcacacuucccccuggcgcaugucaggccgcuagaugccaggccgauucagaauguccaaggcaucggcgcugcuguuacaaugguugcgcguaugcaugucuggaggccgucccgcccccuccaguuuuggacuggcucgugcagcccaaaccucgauggcucgggggaaacggcuggcugcuggauggcccagaagagguauuacaagcugaggccugcaguacuacggaagacggggcagagccccugcuuuguccgagcggauacgaaugccacaucuuguccccuggugauguggcugagggcauucccaauagagggcagugcgucaagcagaggcggcaggccgacggacguauccugcgccauaaacuauauaaggaguacccagaaggcgauucuaagaacguggcggagccugguagagggcaacagaaacacuuccaguga

SEQ ID NO: 64829 - RNA, 375 nt, Artificial Sequence
  derived and/or modified sequence opt3 from WFDC2__Homo_sapiens__XP_011526797
augcccgccugcagacugggcccucucgcugcagcccuucuguugagcuuacugcuauucggguuuacccucguguccggaacaggugcggagaagacuggcgucuguccagaacugcaggcugaccaaaacugcacgcaggaguguguuucugauucagaaugcgccgacaaucuuaaauguugcagugcagggugugccaccuucugcagccugccgaacgauaaggagggauccuguccccaggugaauaucaacuuuccucaguugggccucugcagggaccaaugucagguagauucucagugcccaggucagaugaaaugcugucggaaugggugcggaaaggugucgugugucacacccaacuucuga

SEQ ID NO: 64830 - RNA, 2673 nt, Artificial Sequence
  derived and/or modified sequence opt3 from WFS1__Homo_sapiens__NP_001139325
auggacagcaacaccgcaccccugggcccuuccugcccacagccgcccccugcuccacaaccccaggcaagaucuaggcucaaugccacagcgucacuugagcaggaacggagugagcgcccucgagcuccagggccccaggccggaccugguccaggcgugcgugaugcagccgcuccggcagaaccccaagcccagcacacuagaagcagggagcgggcugacgggacgggaccuaccaagggcgauauggaaaucccauucgaggagguccuggaacgcgccaaagcgggugaccccaaggcacagacagagguugggaaacauuacuugcaguuagccggagauacugacgaagaacugaacuccuguaccgcuguggauuggcuaguacucgccgcaaagcaaggcagaagggaggcugugaaacugcuucggcgcugccuggccgaccgaagaggcauuacaucugaaaaugagagggaaguccggcaguugucgucagagaccgaucucgaacgugcggugcgcaaggccgcacugguuauguauuggaagcugaacccuaaaaagaaaaagcaaguggcugucgccgagcucuuagagaauguggggcagguaaacgaacacgacggaggugcucagccaggccccguuccgaaaagccugcagaagcagagaaggaugcuugagcgguuggugaguuccgaaucuaagaauuacauagcccuggaugacuuugucgagaucacuaaaaaguaugcaaaaggggugauuccuagcucccuauuccuccaagaugacgaagacgaugacgagcuggccggaaagucacccgaggaucuuccacugcgauugaaaguggucaaguacccucuccaugcuaucauggaaauuaaagaguaucugaucgacauggcgagucgcgcaggcaugcacugguuaagcacaauaauccccacccaucacauuaacgcccugaucuuuuucuuuauuguuucuaaucucacgaucgauuucuuugcuuucuuuauaccacuugugauuuucuaccuguccuuuaucucaaugguaauuuguacuuugaagguguuccaggacagcaaggccugggaaaacuuuagaacccuaacagaucugcuccugagguucgagcccaaucuugacgucgaacaggcagaggugaacuucgguuggaaucaccuggagccuuaugcccacuuuuugcucaguguuuucuuugugaucuucucuuuuccaaucgcuuccaaagauugcauuccguguagcgaacuggccgucauaacuggguucuuuaccgugacaucguacuuaucucuguccacccaugcagagcccuacacgcggcgcgcgcuagcuacugaaguaacagccggacuccugucacuuuugccuaguaugccacugaacuggcccuaucucaagguucugggccagaccuucaucacugugccugucggccaucuugugguccugaaugugagcguuccaugcuugcucuacguguaucuguuauaccuguuuuucagaauggcacaacuaaggaacuuuaaagggacauauuguuaccucguacccuaucuggucugcuucauguggugugagcuuuccgugguuauuuugcuggagucuaccggacucggucuguuacgugccagcaucggcuacuuucuguuccuuuucgcuuugccgauacucguggccgggcuggcccuagucggagugcugcaguuugcucggugguucacgucacucgaacugaccaagauugccguaacaguggcgguuugcagugucccucuuuugcugcgaugguggacuaaagccuccuuuagcguggugggcauggucaagucuuuaaccagaucaaguaugguuaagcucauccugguguggcuuacagcuaucgugcuguucuguugguuuuacguauauaggagcgaggguaugaaagucuacaacuccacuuugaccuggcagcaguauggggcacucugcggcccacgcgccuggaaggaaacaaauauggcucggacccaaauucugugcucucaccuagagggacacagagugacuuggacgggcagguucaaauacguucgcgugacagacaucgauaacucggccgaaagcgcaauuaauaugcugcccuuuuucauaggggacuggaugcgaugucucuauggagaggcguacccugccugcucccccgguaacaccucaacugcugaggaggagcugugucggcuuaaguugcuggccaaacauccaugccacaucaagaaguuugaccguuauaaauucgaaauuaccgucggcaugccuuuuaguucuggggcagauggaagcagauccagggaggaagacgaugugacaaaggacaucguuuuacgcgcuucaagcgaguucaaaucugugcuccugucccuucggcagggcagucugaucgaguuuagcaccauucuagaagguagacucgggucuaaguggcccguauucgagcugaaagccauauccuguuugaauugcauggcacagcugucaccaacuaggcgacaugucaagaucgaacacgauuggcgcaguacagugcauggcgccgugaaguucgcuuuugacuucuuuuucuuuccguucuuaagcgcggccuga

SEQ ID NO: 64831 - RNA, 1890 nt, Artificial Sequence
  derived and/or modified sequence opt3 from WHSC1__Homo_sapiens__NP_015627
auggaguucagcaucaagcagucaccccugucugugcaaucagucguuaaaugcauuaagaugaaacaggccccugaaauacucggcagugcuaacgggaagaccccaagcugugaggugaauagagaaugcuccguauuucuuucuaaagcacagcugucguccagcuugcaggagggagugaugcaaaaguucaacggucacgacgccuuaccguuuauccccgcggauaagcugaaagaccuaacaaguagggucuucaauggcgaaccuggggcucaugaugccaagcuccgguuugagucccaggagaugaaaggaauuggcacuccacccaacacgaccccuaucaagaaugguucuccagaaauuaaacugaagaucacaaagacuuacaugaacgggaaaccccuuuucgagagcuccauauguggagacucagcagccgaugugagucagagcgaagagaauggccagaagccugagaacaaagcucgccgaaaucguaagagaucuaucaaauaugacucccuguuggaacaaggccucguugaggcagcccuggugucaaagauuagcaguccaucugauaaaaagaucccggcuaagaaagaauccugccccaacaccgggagggacaaggaucaucugcucaaauacaaugucggagacuuaguguggagcaagguaucggguuauccuugguggccauguaugguuucugccgauccccugcuucacuccuacacaaaauugaagggccagaagaaaucagcgcggcaguaucacgugcaguuuuucggggacgcaccugagcgcgccuggauuuuugaaaagagucuggucgcuuucgagggagagggccaauuugaaaaacuaugccaggagagcgccaagcaggcaccaaccaaagcugaaaagaucaagcuccugaaacccauauccgguaaacuuagagcccaaugggagauggggauugugcaggcggaagaggccgcaucuaugagcguggaggaaaggaaagcuaaguucacuuuucuguacgucggagaucaguugcaucucaacccgcagguugccaaagaggcuggcaucgccgcagaaucacugggcgagauggccgaaaguuccggggugagcgaggaggcugcggaaaauccuaagucuguacgggaggaauguauucccaugaagcgccgaagaagggcaaaauuaugcucaagugccgagacacuggagagccacccagacaucggaaaguccaccccucaaaagacggcugaagccgacccccggcguggugugggcucuccacccgggcgcaagaaaacuaccgucucgaugccuagaagcaggaagggagaugcagccucccaguuccucguguucugucagaaacaccgggacgagguuguggcugaacauccagaugccucaggcgaggaaaucgaggagcuucugcgaagucaguggucuuugcuaagcgaaaagcaacgcgcaagauauaacacaaaguuugcgcuggucgcuccggugcaggccgaggaagacuccgguaauguaaacgggaaaaagaggaaccacacuaaacggauucaggaucccaccgaggacgcagaagccgaggauacaccucgcaagagacucaggaccgacaaacauucacugcguaagcgggauacgauaacugacaagacagcucgaaccagcucuuacaaagccauggaggcagcuuccagucuuaagagccaggccgcgacuaaaaaucugucugaugccugcaagccauugaaaaagagaaacagggcuuccacagcagccucaagugcucucggcuucagcaagucguccucucccagcgccucacugaccgaaaaugagguuaaauga

SEQ ID NO: 64832 - RNA, 1938 nt, Artificial Sequence
  derived and/or modified sequence opt3 from WHSC1L1__Homo_sapiens__NP_060248
auggacuucagcuuuuccuucaugcagggcaucauggggaacaccauucaacagcccccucagcugauagauucugccaauaucagacaggaggacgcuuuugauaacaauucagacauugcagaagauggaggucaaacaccauacgaggccacucuccagcagggcuuccaguauccggcgacgaccgaagaccuucccccucugacaaacggguacccaaguagcaucuccguguaugagacucaaaccaaguaccagucuuauaaucaguaccccaacggaucggcuaauggcuuuggugccgucaggaacuucucaccuacagauuauuaccacagcgaaauuccaaauacccggccccaugagaucuuggagaaaccuaguccaccgcagcccccuccacccccuuccguuccacaaacugugauacccaagaaaacagggucuccggaaaucaaguuaaaaauuaccaagacgauccagaacggacgcgagcuguuugaaagcucccuaugcggcgaccuccugaaugagguacaggcaucagagcacacuaagaguaaacaugaaagccgaaaggagaaacguaagaaaucuaacaagcacgauuccucaagaagcgaagagaggaagagucauaaaauuccuaaacuugaacccgaggagcaaaaucggccaaacgaacgcguggacaccgucucugagaaaccuagagaagaacccgugcugaaggaagaggccccaguucagcccaucuuguccagcgugccuacaacugaggucucgaccggcgugaaauuccagguaggggaucucguuuggucuaaggugggaacauacccaugguggccguguauggucuccucagacccccagcuggaagugcacaccaaaauaaauacgaggggugcucgggaguaucacgugcaauuuuucaguaaccagccugaacgcgcauggguccaugagaagcgaguuagagaauacaagggccacaaacaguaugaggagcugcucgccgaagcuacuaagcaggccagcaaccauuccgagaaacaaaagauuaggaaaccacggccccagcgugaacgcgcgcagugggauaucgggauugcacacgccgagaaggcuuuaaagaugacaagagaggaaaggaucgagcaguacaccuuuaucuauauugacaaacaaccugaagaggcccugucucaggcaaagaaaagcguggcuucaaagacugaaguaaagaagacacggcgaccacgcagugugcuuaauacccagcccgagcagacgaacgccggagaggucgcguccagcuugucuucaaccgaaauaagaaggcacagucaacggcgccauacaagcgccgaggaagaggaaccgccuccagugaagaucgcauggaaaacugcugccgcuagaaagucccugcccgccucuauuaccaugcacaaaggcucgcuagaccuccagaagugcaauaugagcccuguugugaaaaucgagcaggucuucgcacugcaaaacgccacaggugaugggaaguuuauagaccaguucguguacuccacuaagggaauuggcaauaaaaccgagaucucaguaaggggccaggaucgucuuaucauuaguacacccaaccagcggaaugaaaagccaacccaaucuguuagcuccccugaggcuacuucagggagcacgggaucuguggagaaaaagcagcagcgaagauccaucaggacacgcagugagagcgaaaaaucuaccgaggucgugcccaagaaaaagauuaagaaagagcaggucgaaacugugccacaagcgaccguuaagacaggucugcagaaaggcuccgcagacagaggggugcagggaucaguacgguucagugauagcucggucuccgccgcuauagaggaaaccguggacuga

SEQ ID NO: 64833 - RNA, 1140 nt, Artificial Sequence
  derived and/or modified sequence opt3 from WIF1__Homo_sapiens__NP_009122
auggccagaaggagcgcuuuccccgcagccgcgcuguggcucugguccauccuucugugcuuguuagcucugcgggccgaggcaggcccuccacaggaagagucucuauaccucuggauugacgcccaccaagcucgcgugcugauaggguuugaagaggacauccuuauugucucagaaggaaagauggcaccguucacccaugacuuucgaaaagcccagcagcguaugcccgcuaucccuguuaacauucacaguaugaauuucacauggcaggccgcgggucaagcagaguauuuuuacgaguuccugagcuugagaucccucgauaagggcaucauggccgacccaacugugaacguaccccugcuggggacggugccucauaaggcuucugucgugcagguuggauuuccaugucucggcaaacaggaugguguggccgcauucgaagucgacgugauaguaaugaacucggaggggaauaccaucuuacagacaccccaaaaugcuaucuuuuucaaaacuugccagcaggccgaauguccuggaggcugcaggaacggcggguuuuguaaugagcggcgcauuugcgaguguccagauggauuccacgguccgcauugcgaaaaggcgcuguguacccccagaugcaugaacggcgggcuuuguguuacaccuggauuuugcauuugcccacccggcuucuauggugugaauugugacaaggccaacugcucaaccacuuguuucaaugggggaacaugcuuuuacccuggcaaauguaucugcccacccggcuuggagggggaacagugugagauaagcaagugcccgcaaccuuguaggaacggagguaaaugcauuggcaagaguaaauguaagugcuccaagggguaucagggagaucugugcucuaaacccgucugugaaccaggcugcggugcacacgggaccugucacgagccuaauaagugccagugucaagagggcuggcauggacggcacugcaacaaacgcuacgaagcuagccuaauccaugcccuccgacccgcuggcgcccagcugagacagcacacgccaucccuuaagaaagcagaggaaaggcgggaucccccugagucaaauuauauuugguga

SEQ ID NO: 64834 - RNA, 1512 nt, Artificial Sequence
  derived and/or modified sequence opt3 from WIPF1__Homo_sapiens__NP_003378
augcccgugccuccaccgcccgccccuccacccccuccaaccuucgcccuggcaaacacagagaagcccacucucaauaaaacggaacaggccggcagaaacgcgcuucugagcgacaucuccaaggggaaaaaguugaaaaagaccgucacaaaugauaggucugcuccuauuuuagacaagccaaaaggagccggugcaggcgggggaggcgguggguuuggaggcggcgggggauucgguggcgggggaggcggugggggaggcggcucauuugggggagguggcccgcccgggcugggaggccuauuccaagccgguaugccuaagcuccggaguacugcuaaccgcgauaaugacagcgggggcucccgaccaccccugcuuccuccaggaggccguucuaccucggcaaaacccuuuucaccgccuagcgggcccggaagauucccaguuccuagucccggucacagguccggcccacccgagccucagcggaaccgcaugccaccgcccagaccugauguggggucuaagccagacagcauacccccuccaguacccuccacaccgaggccuauccagucaaguccacauaaucggggaucucccccugugcccggcgguccacgccagccuagccccgggccaaccccgccucccuuuccaggcaaccgaggaacugcccugggcgggggauccauuagacaaucacccuugagcaguucuuccccuuucagcaauaggccaccccucccuccgacaccaucgcgggcucuggaugacaaacccccuccacccccuccgcccgucgguaaccguccaucuauccaccgcgaagccgugccucccccaccuccccagaauaacaagccaccgguuccuuccacccccagaccaucagcgaguagccaggcacccccuccacccccuccgccauccaggcccggcccucccccacugccucccucuagcucagggaaugaugagacgccacggcucccucagcgaaacuuaagucuguccagcucuacuccgccccuuccaucaccuggacgcaguggccccuugccaccucccccgagcgaaagaccaccucccccagugagggaucccccuggucgguccgggccgcugcccccaccucccccugucucucgcaauggcucgaccagcagagcccuaccagcuacaccccaacucccuuccaggucaggaguggacaguccacguucuggcccccggccgccucugccacccgaccgaccuagcgccggggcaccacccccgccucccccauccacuucaauuagaaacggauuucaggauagcccuugcgaggacgagugggaaucuagguucuacuuucaucccaucuccgaccuuccacccccugagccauauguacagaccacaaagaguuacccgagcaaacuggcucgcaacgaaucucgguccggcucaaauagaagggagcgcggugcucccccuuugccacccauaccucgauga

SEQ ID NO: 64835 - RNA, 1323 nt, Artificial Sequence
  derived and/or modified sequence opt3 from WIPF2__Homo_sapiens__NP_573571
augcccaucccuccaccgcccccuccacccccuggcccacccccuccaccgaccuuccaccaggccaacacagagcaacccaagcugagcagagacgaacagagggggcggggagcucuccuucaggauauuugcaaagguacuaagcugaaaaaggugacgaauauaaacgaccgcuccgcaccuaucuuggagaaaccaaaggggucuucaggcggauacggcagugguggggccgcguuacagcccaagggaggccuguuucaaggcgggguccuaaaacuccgaccuguuggagcuaaggaugguagcgaaaaucuggccggcaaaccagcacuucagauucccuccucucgugccgcugcaccgagaccucccgugucggccgcuucagggaggccacaggacgauaccgacagcagucgggccucccugccugaguugccccgcaugcagagaccaucucuccccgaucugagcaggccuaacacaacuuccucaaccggaaugaagcauaguagcucugcgccaccgcccccuccacccggccggcgcgcaaaugccccuccaacaccccugccgaugcacuccucaaaagcuccugccuauaaccgagaaaagccauuacccccuacccccggucaaagacuccauccagggagggagggaccucccgcaccaccgccuguaaagcccccacccagcccugugaauauccggacuggcccaaguggccagucucuggcucccccuccgccacccuaccgucagccuccagggguccccaacggaccuuccagcccgacaaaugagucggcccccgaacuuccacagcgccacaacucuuugcauagaaaaaccccuggucccgugaggggccuggcgccaccucccccaacguccgccucaccgagucuacucagcaaucggccucccccacccgcacgagacccuccaucccgcggggcugcucccccuccgccacccccuguuauuagaaacggagccagggaugcacccccaccucccccaccuuaucggaugcacggcucugagccgcccagccgcgguaagccaccucccccaccuucaagaacucccgccgggccgccaccucccccacccccuccgcugaggaauggccaccgugacaguaucaccacagugcgguccuuccuugaugacuuugaaagcaaauacucuuuccaucccgucgaggauuuuccagccccugaggaauauaagcacuuccaacgaauauaccccucaaaaacuaacagagcugcgaggggagcaccuccacugcccccuaucuugcgcuga

SEQ ID NO: 64836 - RNA, 1452 nt, Artificial Sequence
  derived and/or modified sequence opt3 from WIPF3__Homo_sapiens__NP_001073998
augcccgugccuccaccgcccccuccaccccugccuccacccccuccaccgcucggcgccccucccccacccccuccaagcgcucccccggucuccaccgacacaucuucacuuagaagggcagauccuaaggggcggagugcccuguuggcggacauccagcaaggaacucgcuuacgaaaaguuacgcagauuaacgaucguagcgcuccccagauagaguccucuaaggguaccaauaaagaaggcgggggaucggccaacacaagaggcgcaucaacuccaccuacccugggugaccuauucgccgggggauuucccgugcucaggccagcuggccagcgggauguagcaggcgggaagacaggacaaggucccggcagccgcgccccuaguccaagacugccgaauaaaaccaucuccgggccccuuauuccuccagcuucucccaggcugggaaacacuagcgaggcccacggcgcggcacggacagccccuccacgccccaaugugccggcuccuccacccccuaccccacccccucccccaccgccuuugcccccaccccucccuuccucaaguccaaucaagacgccccuggucagcccuccggguccacugacuaaggggaaccuccccgugguugccccuccagugcccugcgcaccuccgcccccaccucccccaccucccccaaccccgccucccuuaccacccgcuucuguccuguccgacaaagccgugaagccucagcuugcgccauugcaucugcccccuauuccgccaccccuaccucuccugcccccauguggauacccuggccuuaaagccgaacccgcaucaccagcucaggaugcccaggagccuccggcucccccaccuccccugccaccuuaugccagcugcaguccccgagcaucuuugccggccccaccucuccccggcguaaauuccagcucggaaacaccacccccucugccgcccaagucuccauccuuccaagcuccuccccagaaagcgggggcacaggccuuaccugcuccacccgccccuccaggaucacagcccuuucugcaaaagaagagacacgguaggccgggcgcagggggaggcaaacucaacccuccacccgccccuccagcucggagucccacuaccgagcuuagcuccaagucucagcaggccacagcauggaccccgacgcaacagccuggugggcagcugcguaauggcagcuugcauaucauagacgauuucgagucaaaauuuacuuuccacaguguugaagacuuucccccaccugaugaguacaagcccugucagaaaaucuauccauccaagauuccccgcagcagaacaccuggaccauggcuacaagcggaagcugugggccagucuucagacgauaucaaagggaggaacagucagcugagccucaagacccugcgguga

SEQ ID NO: 64837 - RNA, 1341 nt, Artificial Sequence
  derived and/or modified sequence opt3 from WIPI1__Homo_sapiens__NP_060453
auggaggccgaagcugcagacgcgcccccuggcgggguggagagcgcccuguccugcuucucuuuuaaccaggauuguaccucacucgcuacaggaacuaaggccgguuacaaacuuuucagucugagcuccgucgaacaauuggaccagguucacggcucuaaugagaucccagauguguauauuguagaaagauuauuuucgucaagccugguggucgugguuagucauacgaagccgaggcagaugaacguguaccacuucaaaaaggggaccgagauaugcaauuauuccuacucuagcaacauccuauccauucggcucaaucgccagcgacugcuugucugucuggaggaaucaaucuauauucauaacaucaaagacaugaaguugcucaagacacugcuggauauacccgcaaauccuacuggacucugcgccuuaaguaucaaccacagcaauucuuaccuggcuuauccaggcucccuuaccucaggugagauuguguuguacgacgggaacagccugaaaacaguauguaccaucgcagcccaugaaggaacucuagcugccauuacauuuaaugcgaguggcucuaagcucgcauccgccagcgagaaaggcaccguuauccguguguucucgguccccgaugggcaaaagcuguacgaguuuagaaggggaaugaaacgguaugugacgauaucuucccuuguguucucaauggacagucaguuucugugcgcuagcuccaacacugaaaccguccacauuuucaaguuggagcagguuacaaauucucgcccugaagaaccaagcacuuggucagguuacaugggcaagauguuuauggccgcaaccaacuaucuccccacacaggugagugauaugaugcaccaagacagagcuuucgccaccgcgaggcugaauuuuuccgggcagcggaacaucuguacguuaagcacuauucagaaacugccucgccuccuuguagccucuucaaguggacaucuguacauguauaacuuggauccacaggacggcggugaaugcgugcuaaucaagacacacagccugcucggguccggaaccacugaggagaauaaagaaaacgaucugcgaccgucucuuccccaaucguacgcagcuacagucgccagaccuagcgcuuccucagccaguaccgugccaggcuauucugaggacggcggggcacugaggggagaaguuauccccgagcaugaguucgccacggguccuguguguuuggacgaugagaaugaguucccacccauuauacucugccggggcaaccagaaggggaaaaccaagcagagcuga

SEQ ID NO: 64838 - RNA, 1332 nt, Artificial Sequence
  derived and/or modified sequence opt3 from WIPI2__Homo_sapiens__NP_001028690
augaaccuggccagccaguccggcgaggcuggggcaggacaacuccuuuucgccaauuuuaaccaggacaauaccgaagugaagggugcgucuagagcugccggccuggggaggcgggcagugguuuggucauuggccgugggaaguaaaagcggcuacaaguucuuuuccuuaucuucgguagauaaacuggagcagaucuaugaaugcacagacacugaggauguguguauugucgaacgccuauucucaagcagucucguggcuauaguuucccugaaggcaccccgaaaacuuaaggugugccacuuuaagaaagguacggagaucuguaacuacucuuauagcaauaccauucuggccgucaaguugaaccgucagagacucaucgugugccuggaggaaucccuguacauucauaauaucagggacaugaaaguacuccacacaauacgggagacuccuccaaacccggcuggguuaugugcccugucaaucaauaacgauaauugcuaucuugcguaccccggaagugcaaccauuggcgaaguucaaguguucgacacaaucaacuugcgcgccgcuaauaugauuccugcccaugauagcccacuggcagcucuagccuuugacgcgucuggcaccaagcucgccacugcauccgagaaagggacagucaucagaguguucucaauacccgagggacagaagcuguuugaguucaggcggggugugaagcgcugugucagcauuugcagucuugcuuuuucuauggauggcauguuccuguccgccagcucgaacaccgagacgguucacaucuuuaaauuggaaacugugaaggagaaaccuccagaagaacccaccacauggacuggguauuucggaaagguacucauggcuucuaccuccuaccugccuucacaggugacagagauguucaaucagggccgagccuuugcaaccgucagauuaccauucuguggucauaaaaacauuugcagucuggccacgauccaaaagaucccgaggcuccuugugggggcugcggacggauaccuguauauguacaacuuggauccccaggaaggcggcgagugugcacuaaugaaacagcaccggcuggacgggagccucgaaacuacaaaugagauucuggauuccgccucucacgacugcccucuuguuacccagacuuauggagcugccgcagguaaggccuacacagacgaucugggcgcugucgggggagccugcuuggaagacgaggcaagcgcgcuccgucuggaugaggacucagaacauccacccaugauauuacgcaccgauuga

SEQ ID NO: 64839 - RNA, 468 nt, Artificial Sequence
  derived and/or modified sequence opt3 from WISP1__Homo_sapiens__NP_001191798
augagaugguuccugcccuggacccucgccgcugugacagcagccgcggcuagcacuguccuugccacggcacuguccccugccccaaccacaauggacuuuacuccggcucccuuggaggauaccucuucaaggccucaguucugcaaguggccaugugaaugucccccuaguccaccccggugcccuuuaggcguuagccugaucacagacgggugcgaguguugcaaaaugugugcacaacagcuaggagauaacugcaccgaagccgcuauuugugacccacaccgcggucucuacugcgauuauuccggcgaccgaccgcguuacgccauaggggugugugcgagaagggaggaaguaucuggaugcgugcccgcacggggcauccaugagcugcacacuugcggucuucaucagcacacacuguugucgacccagguccucuggucacugcaugggcaauga

SEQ ID NO: 64840 - RNA, 753 nt, Artificial Sequence
  derived and/or modified sequence opt3 from WISP2__Homo_sapiens__XP_005260660
augagaggcacccccaagacacaccuacucgccuucagccuucugugcuuguuauccaaagugaggacucagcuguguccuacgccaugcaccuguccguggcccccuccacggugcccccuaggggucccucucguucuggacggaugugguugcugucgcgugugcgcucgacgucuuggcgagccaugugaucaacugcauguaugcgacgcaucucagggguuggugugucagcccggagccggcccuggugggagaggagcgcucugccugcuggcugaagaugacucaaguugcgaggucaacggcaggcucuaccgggaaggcgagacauuucagccacacuguagcauccgcugcagaugugaagaugggggauucacuugcgugccguuauguuccgaggacguuaggcugcccucuugggauugcccucauccacggcgcguggagguccuugguaaguguugccccgaauggguguguggccaagggggaggcuuggguacccagccucugccagcccaggggccccaguuuucgggacugguaucaagccucccgccuggcguucccugcccagaguggaguacagcauggggcccuuguuccaccacuugcgggcugggaauggccacacgagugucuaaucaaaacagauucugcaggcuugaaacccagcggcgucuguguuugagccgccccugcccacccuccagagguaggucaccucagaauagugcuuuuuga

SEQ ID NO: 64841 - RNA, 1065 nt, Artificial Sequence
  derived and/or modified sequence opt3 from WISP3__Homo_sapiens__NP_003871
augcagggccugcucuuuagcacccuucuguuggccggguuagcucaauuuugcuguagagugcagggaacagguccccuggacacuacgccugagggcaggccaggggaagucuccgaugcaccgcagcggaagcaguucugccacuggcccuguaaaugcccucaacagaagccacgcugucccccuggaguuucucuagugcgagacggcugcgguuguugcaaaaucugugccaagcagccaggggagauuugcaacgaagcggaucucugugacccccauaaaggacuguacugcgauuauucaguagaccguccuagauacgagaccggcgugugcgcuuaucuugucgccgugggcugugaauuuaaucagguucacuaccauaacgggcaaguguuccagccaaauccgcuguuuaguugcuugugugucagcggagcaauagguugcacaccccucuucaucccuaagcuggccggcucccacuguucuggggcuaagggaggcaaaaagucggaucagucaaacugcagccuggagccacucuuacagcaacugaguacuuccuauaaaaccaugcccgcauacaggaaucuuccuuugauuuggaagaaaaagugucuggugcaggccacaaaguggaccccaugcucucggacuugugguauggggaucagcaaccgcguaacaaaugagaacuccaauugcgaaaugagaaaagagaagaggcuauguuauauucagcccugcgacucaaacauccucaaaaccauaaagaucccgaaaggaaagacgugccaaccuacuuuucagcugaguaaagcugaaaaguucguuuuuagcggcuguucuuccacccagucauacaagcccacauucugcggcauuugucuugauaaacggugcuguaucccaaauaagagcaaaaugauuacuauccaguuugacugcccuaacgaggggaguuucaaguggaaaaugcuguggauaaccucuugugugugccaacgcaauugucgagagcccggagauauuuucuccgaauugaagauccucuga

SEQ ID NO: 64842 - RNA, 1638 nt, Artificial Sequence
  derived and/or modified sequence opt3 from WLS__Homo_sapiens__XP_011540493
auggccggcgcuaucauugagaacaugagcaccaagaaacugugcauagucgggggaauccuccuuguguuccagauuaucgcauuucugguugguggcuugauugcccccgggccuacaacugcgguguccuacaugucuguaaaguguguggacgcuaggaaaaaucaccauaagacgaaaugguucgucccauggggaccgaaccacugcgauaagaucagagacauagaagaggccaucccccgggaaauugaggcaaaugauaucguguuuucaguucauauuccuuuaccacacauggaaaugagucccugguuccaauuuaugcuguucauccuacagcucgacauagccuuuaagcugaacaaucagauucgcgagaacgcugaggugagcauggaugucucccuugcauaucgagacgaugccuucgcugaauggaccgagauggcccaugaacgugugccuagaaaacugaaguguacauuuacuucuccaaaaacccccgagcacgagggcagguacuaugaaugcgacguauugccuuucauggagaucgguucgguugcgcacaaguuuuaccuccugaauauucggcugccagugaacgagaaaaagaagaucaaugucgggaucggagaaauuaaagauauacgccucgugggcauccaucagaacggcggguucacaaaggugugguuugcaaugaaaaccuucuuaacuccgucaauuuucaucauaauggucugguauuggagaaggauuacaaugaugagccggcccccuguucugcuugaaaaggugaucuuugccuugggaaucaguaugaccuucauuaauaucccaguagagugguuuuccauugguuucgacuggacguggaugcugcuauuuggcgauauacgccaagggaucuucuacgcuaugcuccugucuuuuuggauuaucuucuguggagagcacaugauggaccagcaugaacgaaaccacaucgccggcuauuggaaacaggugggucccauugcagucgggagcuuuugccuuuucauauuugauaugugugagagaggagugcagcugacuaauccuuucuacuccaucuggaccacagacauuggcacugaauuggcuauggccuuuaucauuguugcgggcaucugccucugucuguacuucuuauuccugugcuuuaugguguuccaagucuuuaggaacauaucagggaagcagaguagccucccagccaugucuaaagugcggcgucuucacuaugagggacugaucuuccgcuuuaaguucuugaugcuaauuacccuggcaugugcugccaugacaguaaucuuuuucauuguuucccaggugaccgaaggucauuggaaguggggcggggucacggugcaggucaauucagccuuuuucacuggaaucuacggcauguggaaccucuauguguuugcucugauguuccuuuacgcacccagccacaaaaacuauggugaggaccaaaguaaugggaugcagcugccgugcaagucuagagaggauugcgccuuguuuguuuccgaacucuaccaggagcuguucagcgcuucgaaauauucuuucauaaacgacaaugcggcauccggcauuuga

SEQ ID NO: 64843 - RNA, 7929 nt, Artificial Sequence
  derived and/or modified sequence opt3 from WNK1__Homo_sapiens__NP_001171914
augagcggcggggccgcugagaagcaguccucuacacccggaucacuguuccucaguccuccagcaccggcccccaagaacgguagcuccucugacucgucagugggcgaaaaacuuggggcggcugccgcagaugccgucacaggaagaacugaggaauacaggcggcgccgacacacgauggacaaggauagccguggcgcugcagccaccacaacuaccacagagcauagauuuuucaggcggaguguuaucugcgacuccaacgcuaccgcccuggaauugccugguuuaccacugucucuaccccaaccuagcauuccagcggcagugccccaguccgccccuccagagccgcaccgcgaggaaacuguaacagcuaccgccacgucacagguggcacagcagcccccugcugccgcggccccaggggagcaggcagucgcuggacccgccccuaguacugugccaagcucuaccuccaaggauagacccguuucacagccgagccucgugggcaguaaagaagaaccucccccagcuaggucuggcuccgggggagguagcgccaaggagccucaggaggaacggucgcaacagcaggacgauauagaggaacuggaaacaaaggcagucggcaugucuaacgacgggcgcuuucuuaaauucgauaucgagauuggacgaggcuccuuuaagacuguguacaaaggucuggacaccgagacaaccguagaaguugccuggugugaguugcaggauagaaagcucacgaaaucagaaaggcaacgguucaaggaggaagcugagaugcugaaggggcugcagcaucccaauaucgugcguuuuuacgacaguugggagagcacugucaaaggaaagaaaugcauugugcucgugacagaauuaaugaccuccggcacucugaagacauaucuuaaacgcuucaaggucaugaaaaucaagguuuugagaucuugguguaggcagauacugaagggccuacaauuucuccacacccggacgccacccaucauucaucgagaucugaaaugcgacaacaucuucauuaccgggccuacaggaagcgugaagaucggugaccuuggccuggcgacuuugaaacgcgcaucauuugccaagaguguaauagggaccccagaguucauggcuccggaaauguacgaggaaaaauaugaugaguccguggacgucuacgccuuuggaauguguaugcucgagauggcaacaagcgaauaucccuacucugagugccagaaugccgcucagauuuacagaagggugacuucaggcguuaagccugccaguuucgauaagguggcaaucccagaagucaaagagauuaucgaggguuguauccggcagaacaaggacgaacgcuauagcauuaaagaucuguuaaaucacgcguucuuucaagaggaaaccggggugagaguagagcuggcugaagaggacgauggcgagaagauagccaucaaacucuggcuuaggauugaagacaucaagaagcugaaaggaaaguacaaagauaacgaggcaauagaguucuccuuugacuuggagcgugauguucccgaagacguggcccaggagauggucgagucuggcuaugugugcgaaggggaccacaagacaauggcuaaagccauuaaggaucgggucucgcuaaucaagcgaaaaagagagcagaggcagcuggugcgcgaagaacaagaaaagaaaaagcaggaggagagcucccucaaacagcagguugaacaaucaagugcaucucagaccggaaucaagcagcugccuagcgcuuccacugguauuccaacggccucaacaaccagcgcgucuguguccacucagguagagcccgaggaaccggaggccgaccaacaucagcagcuucaauaccagcagccuaguaucagcguccugucugauggcaccguggacuccgggcagggaucaaguguuuucacagaaagccgggugucgucccaacagaccgucucuuauggcagccagcacgagcaggcucauucaacugguacagugccagggcacauucccaguacgguacaagcacagucccagccucacggcguguaucccccaucuagcguuccucaguccauggcccaucccuguggaggcaccccaacuuauccggaaucacaaauauuuuucccuacaauccacgagagacccgucagcuuuaguccacccccuaccugcccacccaaaguggcuauuucucagaggcgcaaguccaccagcuucuuggaagcccagacucaucacuuucaaccucuccugcgaaccguggggcagucguuacugccgccaggagguucacccacgaauuggaccccugaggcagucguuaugcuaggcacaacugcgucucgggugaccggggagaguugugaaauccaggugcauccaauguucgagcccucccagguauacagcgauuaccguccuggacucguccugccggaagaggcccacuauuuuaucccccaagaagcuguguacguugccggcgugcacuaucaggcaagagucgcugagcaguacgaggguauuccauauaacucuagcgugcuuuccucaccuaugaagcagauacccgaacaaaaaccaguucaagggggcccuacaaguagcucuguguucgaguuucccuccggacaggccuucuugguaggccaucugcagaaucucaggcuggacucagggcuuggaccaggcaguccgcugagcuccaucucugcaccuauuucgacugaugccacccgcuugaaguuccaccccgucuuugugccacauagcgcucccgcggugcucacgcacaacaaugaaucacgguccaacugcgucuucgaguuucacguucauacaccuaguucuagcuccggugaagggggaggcauccugccacaaagaguguacaggaaucgacagguagccguggacuuaaaccaggaggagcugcccccucagucagucggucuacacggcuaucuccaaccggugaccgaagagaaacauaacuaccacgcaccagaacugacuguuucuguggucgagcccauugggcagaauuggccuaucggaagccccgaguacaguuccgauagcucucagauaacaucauccgacccaagugauuuccaaagcccucccccaaccggcggggcugccgccccuuuuggaucggacgugucuaugccguucauccaucuuccccagacuguuuugcaggaauccccacuguuuuucugcuuuccucagggcaccacaagccaacaggugcucacggcuucauucaguucugguggguccgcacugcacccccaggcccagggacaaagccagggccagccaucaaguagcuccuuaaccggugucucuagcucccagccuauucaacacccccagcagcaacagggcauccagcagacugcgccgccacaacagacaguacaguauucacugucucagaccaguacaucgagcgaggcuacuaccgcccaaccugugucccagccccaggcaccacagguucuuccccaagugucugccgggaagcagggauuuccuccgcgcuugcccccacaguacccuggcgauucaaacauugcucccagcuccaaugucgcaaguguguguauccauucuacgguacucagcccuccaaugcccacagaagugcuggccaccccuggguauuucccaacugucguucagcccuacguggagucaaaccuacuggugccgaugggaggcgucggugggcaagugcagguuucccagccuggaggcagucucgcgcaagcuccaaccacaagcucucagcaggccguacuggaauccacucagggugugucacaagucgcacccgccgagccuguggcuguugcccagacccaggcaacacagccaacgacccuugcuagcucgguggacucugcccacagugacgucgcguccggcaugagcgaugggaaugagaacgugcccucauccucuggacggcaugaaggcagaacuacaaaaaggcacuaucguaagagcguacgcagucgguccagacaugagaagaccagcaggccgaaauugcgaauacugaaugucucuaacaagggggaccgggugguugaaugccaauuagagacucacaaucgcaaaauggugacauuuaaguucgaucucgacggagauaacccugaagagauugccaccaucauggucaauaacgacuucauucuggcaaucgagagagaaucauuuguggaucagguuagggagauaaucgaaaaagcugacgagaugcuuagugaagauguguccgucgagcccgagggcgaccagggucuggagagcuugcaggggaaggaugacuacggauucucuggcucgcaaaagcucgagggcgaauuuaaacagccaauuccugccucaagcaugccccagcaaaucgggauuccaacguccagucugacucaggugguacacucugcuggacggcgauucaucgugagccccguuccugaguccagacuacgcgagucaaaggucuuuccaagugaaauaaccgauacaguggcagccucuaccgcccagagcccggguaugaaucugucccauucagcuagcucucucucccugcagcaagcguucagugagcuuaggcgugcacagaugacugaaggccccaacacagccccuccaaauuuuagccacaccgggcccacauucccuguggucccacccuuuuugucguccauugcuggaguaccuacuaccgccgcagccacggcuccggugccagcgacaucuucacccccuaacgacaucagcaccaguguuauccaguccgaggugacuguccccaccgaagagggcauugccgguguggcaacaucuacugggguugugaccagcggaggccugccaaucccucccgucucagaguccccaguguuaaguagcguagugucuucaauuacgauaccggcuguugucuccaucagcacaaccucuccuagucuccaggugcccacuucgacauccgaaauuguggucagcucaaccgcccuguauccaucuguuacugugagcgcaacauccgccagugcuggcgggucaaccgccacgcccggaccuaaaccacccgcgguagugucucaacaggcagccgguagcacuaccgucggcgcuacacuuaccuccgugaguacaacuaccagcuucccuuccacggccucucagcuguguauccagcuaucaagcucgacauccacuccgacccucgcugagacaguuguggucagugcacauucucuggacaagaccagccacucauccacuaccggguuggccuuuucucugagugcuccaagcuccucaagcucucccggagccggcguaaguuccuacauuagccaaccugguggguuacacccacucgugauccccucaguuauagcaucuacaccuauccugccccaggcggccggaccaacguccacuccgcuucugccucaggugcccucgauuccaccuuugguccaacccguggcuaacgucccagccgugcagcagacccucauccauagccagccucaacccgcacugcuaccgaaucagccacacacacauugcccugaaguugauagugacacccagcccaaagcuccaggcauugaugacaucaagacucuggaggaaaaacuucggucucucuucuccgagcacagcucaaguggcgcccagcaugcauccgugagccuggagacaucuuugguaauagaaucaaccgugacgcccgggauuccuacuacagccgucgcuccgagcaaacuguuaaccuccaccacuucuacaugucucccacccaccaaccugccucuuggaacaguugcgcugcccgugacuccagucgugacgccuggucaaguaaguacccccgugucgacaacuaccagcggcguuaagccagggacagccccuuccaaaccgcccuugaccaaggcaccagugcucccugucggaacugagcugcccgcuggcacgcuaccaucagaacagcugccucccuucccggguccaucucuuacccagagccagcaaccucucgaggaucuggacgcccaguugagaaggacauuaagucccgaaaugaucacugugaccuccgccgucgggccagugucaauggcagcucccacagccaucaccgaggcgggaacucagccucagaaaggcguuucucaaguaaaggagggccccgugcuggcuacaagcuccggggccggagucuuuaaaaugggucgcuuccaggugaguguugcagccgauggcgcucagaaggaagggaagaauaaaagcgaggacgcaaagucugugcacuuugaaucauccacgagcgagaguucuguccucuccucgagcucaccagaguccacccuggugaaaccugaaccgaacggaauuacuauacccggcaucucuagugauguaccagagagcgcccacaagacaaccgcgucagaagcuaaauccgacaccggucaaccuacaaagguggggcgauuccagguuacuacgaccgccaauaaggucggaagauuuagcgugucuaaaacagaggauaagauuacugacaccaaaaaggaaggccccguggcaaguccaccuuucauggaccuugagcaggccguccugcccgcuguuaucccgaaaaaggagaagccugaauuguccgagccaagccaucuaaacggccccucaucugauccugaagccgcauuucugucgcgggacguggaugacgggagcggauccccacacaguccccaucagcucucuucaaaaagccugccuucccaaaaucuuagucagucuuuaagcaacuccuucaauucaagcuacaugucuuccgauaacgagagugacauugaagaugaggaccugaagcucgaguugaggcgccugcgugauaaacaccucaaggaaauccaggaccugcagucaagacaaaaacacgagauagaaagccuuuauacaaagcuggguaagguaccacccgcugugaucauuccgccugccgcgcccuugucgggccggaggcgccgaccaaccaaauccaaggggucuaaaaguagcagaucauccucucuaggaaauaagagcccccagcugaguggcaaccucuccggucagagcgccgcaucugucuuacauccucagcaaacucugcacccacccgggaauaucccugagucaggccagaaccagcuucugcaaccacucaaaccgucccccagcagugauaauuuguacucugcuuuuacgucagacggagccauuuccgugccuagccugucggcaccaggccaggggacaucuaguaccaacacuguuggagcuaccgugaacucccaggccgcccaggcgcaacccccugcuaugacaagcucacggaaggguacuuucaccgaugaccuccauaagcuggucgacaauugggcaagggaugccaugaaccuuucuggccgcagagggagcaaaggacacaugaauuaugaaggcccagguauggcuaggaaguuuuccgcccccgggcagcuaugcaucaguaugacaucaaaccugggcggaagcgcaccgauauccgccgcuucugcgacgaguuugggccauuucaccaaaagcauguguccuccacagcaguacggguuucccgccacuccuuucggagcacaaugguccgguacaggcgggcccgcuccacagccguuaggacaguuccagccugugggcaccgccucacugcaaaauuuuaacauuucuaaucuccagaagucgaucagcaaucccccagguuccaaucugcggacuacauga

SEQ ID NO: 64844 - RNA, 6894 nt, Artificial Sequence
  derived and/or modified sequence opt3 from WNK2__Homo_sapiens__NP_001269323
auggacggcgaugggggacggagggacgugcccgguacacugauggagccuggcagaggggccggaccagcuggcauggcugaaccgcgcgccaaggcggcucgacccgguccucagcguuuccuccggaggagcgucguugaguccgaucaagaggaaccacccgggcuugaagccgcagaggccccuggaccacagcccccucagccacugcagcggcgcguguuguuacugugcaaaacacggaggcucaucgcugagcgggcacgcggccgaccggccgcucccgccccugcggcacucguagcccaaccaggcgcucccggggccccugcagacgcuggaccagaacccguggguacucaggagccgggcccugaucccauugccgcggccgucgaaacggcaccagcuccugacgggggacccagagaggaggccgcugccaccgugaggaaggaagaugagggcgcagccgaagcuaaaccagagcccggucggacacgucgcgacgaaccugaggaggaagaggaugacgaagaugaccugaaggcgguugcaacuucucuugaugggagauuucugaaauucgacauagaguugggaaggggcucauuuaagaccguguacaagggccucgacacagaaaccugggucgagguggccuggugcgagcugcaggaucggaaacugacuaagcucgaacgacagcgcuucaaagaggaagcugagauguuaaaggggcugcaacacccaaacaucguaagauuuuaugacuucugggaaagcagcgccaaaggaaagaggugcauuguucuugugacagaguugaugaccuccgguacgcugaagacuuaccuaaaacgguuuaaggucaugaaaccgaaggugcuccgcucuugguguagacagauccugaaaggccuucuguucuugcacaccaggacacccccuauuauccaccgugaucucaagugcgacaauauauuuaucacugggccaaccggaucggugaaaauuggcgaucuggguuuagcaacacugaagcgggccucauucgcuaagagcgucaucgggacccccgaguuuauggccccugaaauguaugaggaacacuacgacgagaguguugauguguaugcauucggcauguguaugcucgagauggcgacguccgaauacccauauucugagugccagaacgcugcccagauuuaccgaaaaguaacuuguggaaucaagcccgccagcuuugaaaaagugcacgacccggagauaaaggaaauuaucggcgagugcauuuguaaaaauaaggaggaaagauacgagaucaaggaucuucugucccacgccuucuucgcugaagacacaggggucaggguggaguuggccgaagaggaucacggacgcaaaucaaccaucgcacuacggcuguggguugaggacccuaagaaacucaaggguaaaccaaaggacaacggcgcuauugaauuuacuuucgaucuggagaaggaaacacccgacgagguggcccaagaaaugauagagaguggguuuuuccacgagagcgaugucaaaaucguggcgaagucuauuagagacaggguagcccuuauccaguggcgccgagaacggauauggccugcucugcagcccaaagagcaacaggauguuggauccccagacaaggcacguggcccucccgugccauugcagguccaggugaccuaucaugcccaagcuggucagccggggccucccgaaccagaggagcccgaagccgaucagcaccuccugccuccaacguuacccaccucagcaacaagccuggcgagugacucuacuuuugauuccggccagggaagcaccgucuacucggacucucaauccucacagcagagugugaugcuaggcagccucgccgaugcugccccuuccccggcacagugcguuuguucuccacccgugagcgaggggccuguacugccacaaucacuucccaguuugggagcuuaucagcagccuacagccgcaccgggucugcccgucggcuccgugccagccccugcuuguccaccaagccuccagcaacauuucccugaccccgcgaugucuuuugccccaguucugccgccucccucaacuccaaugcccaccgggccuggacagccagcacccccuggccagcaaccgccaccccuugcucagccuacaccccugccacagguguuggccccucagcccgucgugccacuccaaccuguaccgccccaucugccaccuuacuuagcccccgcuagucaggugggugcaccagcccagcugaaaccucuacagaugccccaagcgccgcuccagccacuggcucagguuccuccccagaugccacccauuccugucgugccgcccaucaccccacuugccgggaucgauggcuugccucccgcacugccugaccucccaacugccacggugcccccugucccacccccgcaauauuucagcccugcuguuauucugccauccuuagcagcaccccugccuccagcgucucccgcacuuccguugcaggccgugaagcucccucaucccccaggagcaccucuggccaugcccugcagaacaaucgugccaaaugcucccgccaccauuccucuacuggcaguagcuccaccgggcgucgccgcgcucucgauacauagcgccguggcacagcugcccgggcaaccuguuuacccagcugccuuuccccagauggcuccuacugacgugccacccuccccucaccauaccguccagaacaugagggcaacaccgccacagcccgcccuuccuccccaaccaaccuugccuccccagccagugcugccgccucagcccacuuuaccaccccagccuguucucccaccccaaccuacacgcccgccacagcccgugcugccuccacagcccaugcuuccuccccagccaguacugccgccucaacccgccuugccaguccggccugaaccccuccagccacaucugccugagcaggcugcgcccgcagccacgccgggaucacagauccuacugggccauccagcuccuuaugccguggauguggcagcccaaguccccaccguuccagugcccccugcugcgguacucaguccgccacugcccgaagugcuuuugccugccgcacccgagcuguuaccacaguucccuucuagccucgcuacugucuccgccucagugcagagcguucccacacaaaccgcaacacugcuucccccugccaauccgccccugccaggugggccuggaauugcuucucccuguccaacugugcagcuaaccgucgagccugugcaggaggaacaggccucccaagacaagcccccgggccucccacagaguugcgaaagcuacgguggcucugauguuacguccgggaaagagcugucagacaguugugaaggagcguuuggcgggggaagauuggagggcagggcagcccgaaagcaccaccgccggagcaccagagcuaggucgcgucaggagcgcgccucccggccuagacugacaaucuuaaacgugugcaauacuggugauaaaauggucgaaugucagcucgagacccauaaccacaagaugguaacauucaaauuugaccuggauggggacgcucccgaugaaaucgcaacuuacaugguggagcaugacuucauucuucaagccgaaagggagaccuucauagagcagaugaaggauguuauggacaaagcugaagauaugcugucugaggacacggacgccgaucgaggaagcgacccaggcacaucacccccucacuugaguaccugcggucucggcacuggggaagagucccggcagucucaggcaaaugcgcccguguaucaacagaacguccugcacacaggaaagcgcugguuuaucauuuguccaguggccgagcauccugcuccggaagcccccgagagcuccccaccucuaccccugucaagccuuccaccugaagcaagucagggccccugcagagggcucacccugccguguuugccuuggaggcgggcugccugcggagcaguauuccugucuuuauuuuccgccgagagcgcucaaucgaagcagccacccgauucagcgccuuacaaagaccagcucucuaguaaggaacagccauccuuccuggccagccaacagcuucugucucaggcaggccccagcaauccuccaggugcucccccggccccuuuggcccccuccucaccacccgugacugcacucccucaggauggggcugccccagcgaccaguacaaugcccgagccugcuagcggaacggccucucaagcaggcgguccaggcaccccgcaggggcugacuuccgagcuagaaacaucacagccccuggccgagacccacgaagcuccucuugcaguccagccacucguugugggacuggcccccuguaccccugcgccagaggcugccaguacucgagacgcaagcgcccccagagaaccguugccuccacccgcuccugagcccuccccacauucuggcaccccgcaaccugccuuagggcagcccgcaccacugcuccccgcugccgugggagcggucucgcuggccacgagccagcuuccuucaccaccccugggcccuacagugccaccgcagcccccuuccgcauuggagagugauggugaagggccacccccucgcguuggauuuguagacucuaccaucaaaagccuagaugagaagcugaggacucuccuguaucaagaacacgugccaaccuccucagcuucugccggcacacccgucgaggugggcgaccgugauuucacucuugaaccuuuaagaggggaccagccgagaagcgagguuugcggaggugaccuggcacuacccccagugccuaaagaggcugucaguggcagggugcaguugccccaaccacugguagaaaaguccgagcucgccccuacccgcggggccgucauggaacagggaacaaguucuucaaugacggcggaguccaguccccgaagcaugcugggcuacgauagagacgguagacagguggcuucggauucucauguugugccauccgucccgcaggacgugccugcauuuguuaggcccgcccgcguggagccaaccgaucgugacgggggagaagcuggcgagagcucagccgaacccccuccaagugauaugggcacugucgggggacaagcaucucacccccagacacuuggugccagagcucugggcuccccucggaagaggccggagcagcaggacgugagcucacccgcgaaaaccguagggcgcuucagugugguuagcacucaagaugaauggacauuggccuccccacacucucuacgauauagcgcaccucccgacgucuaccuggaugaggcuccauccucaccugacgugaagcucgccgugagacgggcacagaccgccucuaguauugaggucggaguaggcgaacccgugucgagcgauuccggugacgaggggccaagggcucgcccgccuguucagaaacaggccucuuuacccgugucaggaagcgucgcgggcgacuuugugaagaaagcaacggccuuccugcaaagaccauccagggcuggcagucuugggccugaaacucccucucggguuggaaugaaggugccaaccaucagcgucacaucauuucauucccagaguagcuauauaucuuccgauaacgacucagagcuggaagaugccgacaucaagaaagagcuccagagcuugcgugagaagcaccugaaagaaauuucggagcuccaaucucagcagaagcaggaaaucgaggcacuguaccgccgacuugguaaaccucuacccccgaaugugggcuucuuucauaccgcuccacccacugggagaaggcggaagacaaguaaguccaaacugaaggccggaaaauuguuaaacccucugguacgccaacucaaggugguugcuagcucaaccggccaccuggccgauuccucuagagguccacccgcaaaagacccugcgcaggccagcgucgggcuuacagcugauaguacuggacuguccggcaaggccgugcagacccagcaaccgugcagcgugagggcaucucucucaagugacauuuguuccggcuuggcuagcgaugggggaggugcccggggccagggguggacggucuaccaucccacaucugaacgaguuaccuauaaaucgucaagcaagccaagagcacgcuuccuguccggaccugugaguguaucuaucuggagcgcccuaaagaggcugugccucggcaaagagcacuccucacggaguucuacuagcucccuugcgcccgguccagagccugggccccagccagcucugcacgugcaggcccaagucaacaauucaaacaauaagaaaggaaccuucacagacgauuuacauaaguugguggacgaauggacuagcaaaaccguuggcgcagcccagcugaagccuacgcucaaccagcugaagcaaacacagaaacuucaggauauggaggcucaggccggcugggcagcucccggggaagcccgugcgaugaccgcuccgagagccggaguggguaugccuaggcugccacccgcaccuggcccacucucuacuacagucauacccggggccgcuccgaccuuguccguaccuacucccgacggagcacugggcacagcccgccggaaucaagugugguuugguuuacgaguuccacccaccgcguguugcgggcacaguacgcagccuagaggcggacagagggugggcagcaagacugccucguucgcugcauccgacccaguccgcucuuga

SEQ ID NO: 64845 - RNA, 5403 nt, Artificial Sequence
  derived and/or modified sequence opt3 from WNK3__Homo_sapiens__NP_065973
auggccaccgacagcggagaucccgcuuccacugaagacucugaaaagccugaugggaucucauucgaaaacagagugccacaggucgcagccacucugacgguugaagcgaggcucaaggagaagaauaguaccuuuagcgcuuccggggaaacaguggagcggaaacgcuucuuucgaaagucuguagagaugacugaagacgauaaaguggccgagucgucaccgaaggacgaacguauuaaggcagccaugaacauccccagagucgauaaacuuccuagcaaugugcugagggguggacaagagguuaaguacgagcagugcaguaaauccaccucugaaaucagcaaggacuguuucaaagagaagaacgaaaaggagauggaagaggaggcugaaaugaaagcaguggccacauccccaucagggcgguuuuugaaguucgauauugaguuaggacgcggcgcuuuuaaaaccgucuauaagggucuggacacugaaacauggguggagguagccuggugcgaacugcaggauagaaaacucaccaaggcggagcagcaaagguucaaagaggaagcagagaugcugaaggggcuucagcaccccaauaucguucgguuuuacgacaguugggaaagcauucugaagggcaagaaguguaucguguuggucacggagcucaugacuucuggcacccugaaaacauaucugaagcgcuucaaagugaugaagccuaaggugcuccgauccuggugcagacagauauuaaaaggccugcaguuucuucauacuaggaccccacccaucauucaccgggauuugaagugugacaacaucuucauuacagggccuaccggaucagucaaaaucggugaccugggccuagccacgcucaugcguacuagcuuugcuaagaguguuauagggacaccagaguucauggccccggagauguacgaggaacauuaugaugagucuguggacguauacgcauucggaaugugcaugcuggaaauggcuaccuccgaguaucccuacagcgagugucaaaaugccgcgcagauuuaccgcaaagugacuucgggcaucaagccugccucuuuuaacaaggucacagauccagaagugaaagagauuaucgaagguugcaucagacagaauaaguccgagaggcuuucaauucgggaccuguugaaccacgcauucuuugcugaagauaccgggcuccgaguugagcuggccgaggaagacgauuguaguaauagcuccuuagcucugcgccucuggguggaggaccccaagaaacuuaaaggaaaacauaaggauaacgaagccauagaguucucuuuuaaucuggaaacggacaccccugaggaggucgcauaugaaauggugaaaagcggcuucuuucacgagucagauaguaaggccguagcuaaauccaucagagacaggguuacaccaauuaagaaaacucgggaaaagaaacccgcgggcugcuuggaggaacgcagagacagccaguguaagucuauggggaacguguucccgcaaccucagaauaccacacuaccccuggcaccagcccagcaaacuggagcugagugcgaggaaaccgaggucgaucagcacgugaggcagcagcuccugcaacguaagccucagcagcauugcucaagugucacaggugacaaccuuagcgaagccggcgcagccuccgugauccacucugauaccucgagccagcccuccguugcuuacucaaguaaccaaacuauggggucucagauggugagcaauauaccacaggccgagguaaacguccccggacagauuuauuccucacaacagcuggugggccauuaccagcagguuagcgguuugcaaaaacacucuaagcucacgcagccucagauccugccauuagugcaagggcaguccacaguccugccggugcacguacuaggccccaccgugguuagucagccucaggucagcccacucacugugcaaaaagugccccagaucaagccugucucucagccaguuggagcagagcagcaagcggcucugcuuaaacccgacuuggugcggucccugaaucaggauguggccaccacaaaggaaaacguaucaaguccggacaauccuagcggcaacgggaagcaggaucgaauuaaacagagaagggcaucguguccacgccccgagaagggaaccaaauuucaacucacuguccuacagguguccacaucuggugacaauaugguugaaugccagcuugagacgcauaacaauaagauggugaccuucaaauuugaugucgacggcgaugccccugaagacaucgcugauuauaugguggaggacaacuucguucuggagagcgaaaaggagaaguuuguggaagaguugcgggccauuguagggcaagcacaggaaauacuccacguccauuucgcuacugagagagccacaggaguggacucaaucaccguggauaguaauuccucucagacaggcagcuccgagcagguccaaauuaacucaacuagcacccagacgaguaaugaaucugcgccccaguccagcccaguugguagguggcgcuucuguaucaaccagaccauccgaaaucgggagacacaaucgccucccucacugcagcacucuaugagugccgugccagggcgucauccguuaccuucccccaaaaacacuagcaacaaggaaauuucuagagacacccugcuaacaauagagaauaacccaugccacagggcucucuuuacuagcaaauccgaacacaaggauguaguggacggcaaaaucucagagugugcaagugucgagaccaagcagcccgccauucuguaccagguggaagauaaucgccaaaucauggcuccuguuacgaacaguucuuccuauucaacaaccagugugcgggccgucccagcagagugcgaaggacuuacuaagcaggcgagcauuuucauccccguguacccuugucaucagacagccucccaggcugacgccuugaugucucacccgggcgagucgacccaaacuagcggaaauucacugaccacacucgcauuugaucagaaaccacagacgcuguccguucaacagcccgcuauggacgccgaguucauaagucaggaaggagagaccacugugaacacagaagcaucuagcccuaagaccgucaucccaacacagacucccgguuuagagccuaccacgcugcaaccgacaaccguacuugaauccgauggcgagagacccccaaaauuggaguuugccgacaauaggauuaagacucucgaugaaaaacugcgaaaccuacuguaccaggagcauucaaucucuagcauuuauccugaaagucagaaggacacccaguccaucgauagccccuucucuucauccgcugaggacacacucaguugcccagugacugaaguuauagcgauuagccacugugggaucaaagacucgccugugcaaucucccaauuuucagcagaccggauccaagcugcuuagcaacgucgccgcaucacagccagcuaauauuaguguguucaagcgcgauuugaacguaaucacaucugugccguccgagcugugcuuacacgagaugagcucagacgccagucucccuggcgaucccgaagccuacccagcugcagucagcuccgguggggccauacaucugcaaacgggcggaggcuauuuugggcuuucuuucaccugucccagccugaaaaauccuaucuccaagaaaucauggacucggaaguugaaaucuugggcguacagacucaggcagaguacaucguuuuucaagcguagcaagguucgccagguggagaccgaagagaugcgguccgcuauugccccagaccccaucccucugacuagagaaucuacagcagauaccagggcccuaaaccgaugcaaagcuaugucaggcagcuuucaacggggccgcuuccaggugauuacgaucccgcagcagcaauccgcaaagaugaccagcuucgguauagagcacauuucugucuuuagcgagacaaaucauucauccgaagaggccuucaucaaaacagcgaagagucagcugguggaaaucgagccagcuacccagaaccccaaaacuagcuuuucuuaugagaagcuccaggcccugcaagaaacaugcaaggagaacaaagggguuccuaagcagggagacaauuuccuuuccuuuucagcagccugugaaaccgauguaagcucggugacacccgagaaagaguucgaggagacuucugcuaccggcaguuccaugcagagcgguucagaauugcuguuaaaggagagagaaauucucacggccggcaaacagccauccucugacagcgaguuuagugcaucccuggcugggagcggaaagucugucgccaagacaggcccugaaucaaaccaaugccuuccccaccaugaggagcaggcguacgcccagacccagaguucccuguucuauagcccaucuucgccuaugucaagcgaugacgaauccgagaucgaagaugaggaccuaaaaguggaacuccaaaggcugcgggagaagcacauucaggagguugugaauuugcagacucaacagaacaaagaacugcaggaguuauacgaacgacucagaaguauaaaggacucuaaaacccagagcacagagaucccgcugcccccagcauccccucgcaggccccguucauuuaagaguaaacuucggucuagaccacaaagccugacucacgucgauaaugggauuguggcuaccggaaaauccuguuugaucaacgagcucgaaaauccucugugcguagagucaaacgccgcuagcugucagcagucucccgcauccaagaaaggcauguucacggacgaucuacauaagcuggucgacgauuggacaaaagaagccguggguaauagucuuauuaagccgagccucaaccagcugaaacaaucgcagcacaaguuggagaccgaaaauuggaacaagguuuccgagaauacuccaucuacaaugggguacaccucaacuuggaucagcagucugucccagauaaggggagccgugccuacaucuuuaccccagggccucagccugccaucauuucccgguccucuuuccaguuauggcaugccgcaugucugccaauacaacgcuguggcgggggcaggauaucccguucagugggugggcaucagcgggaccacgcagcaaucugucgugauuccagcccagucaggaggcccuuuccagcccgguaugaauaugcaggcuuucccuacuuccagcguacaaaacccagccaccauacccccugggccaaaauga

SEQ ID NO: 64846 - RNA, 3732 nt, Artificial Sequence
  derived and/or modified sequence opt3 from WNK4__Homo_sapiens__NP_115763
augcuggccagccccgcuaccgagacaacugugcucaugucccagacggaagcagaccuugcccugagaccuccaccgcccuugggcaccgcggggcaaccuagguuaggaccacccccucggcgcgcucgacguuucucugguaaggccgagccaagacccaggucaagucggcugagccgcagauccucugucgaucuaggccuccugucgucauggagccuuccugcaaguccagccccggaucccccugacccacccgacuccgcugggccuggaccagcaaggucucccccgccuagcuccaaagaacccccagagggcacauggacugaaggugccccuguuaaggcugccgaggauucagcgcggcccgagcugccagacagugcaguggggcccggaagccgcgaaccuuugcgaguaccagaggccguggcucucgaaagaaggcgggagcaggaggaaaaagaggauauggaaacccaggccgucgcaacaucuccggacggccguuaccugaaguuugauaucgagauuggccgcggguccuucaaaaccguguauagaggacuggacacugauacaaccguugaaguggcuuggugcgagcuccagacgaggaaguuaucacgggccgagcgacaacgcuuuagcgaagaggucgaaaugcugaagggucuucagcaccccaacauagugagauucuacgacaguuggaaaucuguauugaggggccagguuuguaucgugcuggucacugagcuaaugaccuccgggacacucaagacuuaucugcggcgcuuuagagaaaugaaaccuagggugcuucagcguuggagccggcaaauucugcgaggauugcauuuccuccacucgagagugccacccauccugcauagggauuuaaagugcgacaaugucuuuauuaccggcccuacagguucuguuaaaaucggggaccugggacucgcgacccuuaagcgcgccuccuucgcaaagucagugauaggcacgccagaguuuauggcucccgagauguacgaagagaaauaugaugaagccguagacguguacgcuuucggcauguguaugcuggagauggccacaagugaauauccguacagcgagugccagaacgcagcccagaucuaccggaaggucacuuccgggagaaaaccuaauucuuuucacaaggugaaaauuccagagguuaaggaaaucauugagggauguaucaggaccgauaaaaacgaacgcuucacuauacaggacuugcuagcucaugcguuuuuccgagaggagcggggugugcacgucgaacuggcagaggaagaugacggcgagaagcccgggcucaagcuguggcuucguauggaagaugccagaaggggaggccgcccucgggacaaucaagcuauugaguuccuguuucaguuggguagagaugccgcagaggaaguggcccaggagaugguagcucucgggcugguuugcgaagccgacuaucaacccguggcaagggcgguccgagagcgcguggcugccauccagcggaaaagagaaaaguuaaggaaagcacgugagcuggaggcccuaccaccugaacccggcccaccgccugcuacaguccccauggccccaggacccccuagcguguucccacccgagccugaagaaccggaagcagaucagcaccagccauuucucuuccgccaugcuucauacaguuccaccacgagcgacugugagaccgacggcuaucugucuucaaguggguuucuugaugccagcgaccccgcguugcaaccuccaggagguguucccuccucucuggccgagucgcaccucugccugccuagcgcuuucgcacuuuccauuccgcggucaggccccgggagugauuuuucuccaggagacagcuacgccuccgaugcugccucaggccugagcgacgugggugaagggaugggccagaugagaaggccucccggacgaaacuugcggcgcagaccaaggucucggcuccgaguaacauccgucagugaucagaaugacagagugguugagugucagcugcaaacucauaacagcaagauggugaccuuccgcuuugauuuagacggcgauucuccugaagagaucgcagcggccauggucuauaaugaguucauccugcccuccgaaagggacggguuucuacgucggauuagagagauaauccagaggguggaaacacuccugaaacgcgauacuggaccaauggaggcugccgaagacacccuuucaccgcaggaggagccugcacccuugccagcucugcccguaccucucccagaccccaguaacgaggagcugcagagcucgacauccuuagaacaccgaucuuggaccgccuucagcacuucaaguuccucuccugguacgccgcugagcccaggcaaucccuuuuccccugggacacccauuucaccaggaccuaucuuccccauaaccagcccaccuugccacccgagucccucuccauucuccccuauuagcucgcaagugucaucuaaccccaguccacauccuacuuccagcccccuuccguuuucuagcuccaccccagaguucccuguucccuugucacaguguccauggaguagccuccccacaaccucuccuccgacuuuuucccccacaugcucacaggucacgcugaguagcccauucuuuccucccugcccuuccaccucuucguucccaagcacuacagcagcuccccuacugucacucgcuuccgcguuuagucuggccgugaugaccguggcacagucucuuuugagcccuuccccaggccuguuaucacaaucucccccggcuccuccaagcccccucccuagucugccacuucccccgccugucgcccccggugggcaggaauccccaagcccucacacagccgagguugagucugaagccucacccccacccgcaagaccucugccaggcgaggcccgguuggcgccgaucuccgaagagggaaagccccagcucgugggcagguuccaagugaccaguagcaaggaaccugcugagccacugccccuacagccuacuucgccaacgcugucugggucccccaaaccuagcaccccgcagcucacaucagagaguucugauacugaagacuccgccggaggcgguccagagacccgcgaagcacuggccgagagcgaucgugcugcagaggggcuuggagccggcguagaagaggaaggugacgauggcaaggagccccaggucgggggaucaccucaacccuugagucauccaagcccuguguggaugaauuacuccuauucuagccuguguuuauccucagaagagucugagaguucgggcgaagacgaggaauuuugggcggagcuccagagccugagacagaaacaccuuuccgaaguugagacacugcagacucuacaaaagaaagagaucgaagaucucuacucucggcuggggaagcagcccccaccgggaauuguggcuccugccgcaauguugucaagcaggcagcgccgacuguccaagggcaguuuccccaccucuagacggaacagcuuacagaggucagagccacccgguccugggaucaugcgcagaaauucccucaguggaagcucuacgggcucccaagaacagagggccucaaaaggugucacauuugcuggcgacguggggcggauguga

SEQ ID NO: 64847 - RNA, 1254 nt, Artificial Sequence
  derived and/or modified sequence opt3 from WNT10A__Homo_sapiens__NP_079492
augggcagcgcccaccccagaccuuggcugaggcuccggccacagccgcaaccccgcccugcucuuugggugcuguuguucuuuuuacugcuacucgcagccgcgaugccacgauccgcucccaacgacauccuggaucuucgucugccuccagagcccgucuugaaugccaacaccguuugccucacacugccugggcugucuagaaggcagauggaaguguguguacggcauccagacguggcagccucagcuauucagggaauacagaucgcaauucacgagugccaacaucaguuccgcgaucagagauggaauuguaguagccucgaaacuaggaacaagaucccguacgagucccccauuuucucucgggguuuccgcgaaucggccuuugcuuaugccaucgcggcagccggcgucgugcacgcuguuucaaaugccugcgcauuagggaaacugaaggcuuguggaugcgacgccagccgaagaggcgaugaggaggcguucaggcggaaacuucaucguuugcagcuggacgcccuacaacgcgguaaggggcucagucacggagugccugaacacccagcacugcccacggcuuccccuggccuucaggauucuugggaguggggcggguguagcccagacaugggauuuggugaaagauucuccaaagauuuucuggacucaagggagccccaucgggauauacacgcccgaaugcgcuugcauaacaauagagucggcaggcaggcugugauggagaacaugcggcgcaagugcaagugucacgggaccaguggaagcugccagcucaaaacauguuggcaaguaacuccggaauuuagaaccguuggcgcccuguuaaggucucguuuucaccgggcaacacugauccgaccucauaauagaaacggugggcagcucgagcccggaccagccggcgcuccuucccccgcgccaggcgcacccgggccuaggcgccgggccucaccagcugaccuuguguacuucgaaaagagcccggauuuuugcgagagagaacccaggcuggacagugccggaaccgucggucgcuugugcaauaaaucuuccgcaggcagcgacggguguggaucgaugugcuguggccgaggucacaacauucuacggcagacucguucugagagaugccauuguagguuccacuggugcuguuucguggugugcgaggaaugucgcaucacagagugggucuccguuugcaaguga

SEQ ID NO: 64848 - RNA, 1170 nt, Artificial Sequence
  derived and/or modified sequence opt3 from WNT10B__Homo_sapiens__NP_003385
augcuggaggaacccagaccuaggccaccgcccagcggccucgccgggcuucuguucuuggcuuuaugcucccgggcacugucuaacgagauccuaggacucaagcugccuggugaaccaccccuuaccgccaauacagugugucugacuuugucaggccucaguaaacgccagcuggggcugugccuccgaaacccugacgucacggcgagcgcuuuacaaggacugcacauugccguucaugagugucagcaccagcuucgugaucagagauggaauugcuccgcauuggaaggcggugggaggcugccacaucacucugccauacuaaagcggggauuucgcgagucggcuuucucauuuagcaugcucgcagccggcgugaugcaugcuguagccaccgcguguagucugggcaaacuuguguccugcggguguggauggaaggguucuggcgagcaagacagacugagggcaaaauugcuccagcugcaggccuuaagccgggggaaguccuucccccacucacugccuaguccaggaccgggcagcucucccuccccugguccacaggauacaugggaauggggagggugcaaccacgacauggauuuuggcgagaaguucucacgcgacuuucucgauagccgagaagcucccagagacauccaagccaggaugcggauucauaauaaccgugucggccgccaggugguuacugagaaucuuaaaagaaaguguaaaugccacgggaccaguggaucuugucaguucaagacaugcuggagggcagcuccugaguuucgggccgugggugcggcccugcgagaacgcuugggcagagcaaucuucauugauacccauaacaggaacuccggggcuuuucagccacggcuacgccccagaaggcugagcggagagcucgucuacuucgaaaaaucgccggacuuuugcgagcgugauccuacuaugggcucucccgguacacgggggcgagccuguaauaagaccuccagacugcuugacggcugcggaucacuguguugcggcagggggcacaauguguugcgccaaacgcggguagaaagaugucacugcagguuccauugguguugcuauguucucugugaugagugcaaggugacugagugggucaacguguguaaauga

SEQ ID NO: 64849 - RNA, 1065 nt, Artificial Sequence
  derived and/or modified sequence opt3 from WNT11__Homo_sapiens__NP_004617
augagagccaggccccaggugugcgaggcucuccuguucgcacuugcccugcaaaccggcgucuguuacgggaucaagugguuggcguuaagcaaaacaccuuccgcucuggcccuaaaccagacucagcacugcaagcagcucgaaggacugguuucugcacaagugcagcuuugucggucaaaucuggaguugaugcauacgguagugcacgccgcucgcgaagucaugaaagcaugccgacgugccuuugcugacaugagauggaacuguaguagcauugagcucgccccaaauuaucugcuggaucucgaaagggguacccgggaguccgcguucguguacgcauuaucugccgcugccauaucgcaugcaaucgcucgcgccugcacaucaggcgaccugccgggguguagcugcggacccguuccuggcgagccacccgguccugggaacagauggggaggcugugcggauaaucuuaguuauggcuugcugaugggggccaaguuuuccgacgcaccaaugaaagugaagaagacuggaucucaggcuaacaaacuaaugaggcuccacaauagcgaagucggucggcaggcccugcgcgcuucccuugagaugaagugcaaaugucauggcgugucagggaguugcagcauucgaaccugcuggaagggacugcaagaauugcaggauguagccgcagaccucaaaacaagauaccugucugccaccaagguugugcacaggcccaugggcacucggaagcacuuagucccuaaagaucuggacauccguccagugaaggauuccgagcucguguaucuucagucaagcccggacuucuguaugaaaaacgagaaggucgguagucaugggacacaggaucgccaaugcaauaaaaccucuaacggauccgacagcugugaucugaugugcuguggcagaggcuacaaucccuauacggacaggguuguggaacggugccacuguaaguaccauuggugcuguuacguaacuugccgacgcugugagagaaccguggaaagguaugucugcaaauga

SEQ ID NO: 64850 - RNA, 1068 nt, Artificial Sequence
  derived and/or modified sequence opt3 from WNT16__Homo_sapiens__NP_057171
augcagcugaccacaugccucagagagacucuuuucacgggcgccagccaaaagaccucccuguggugguuggggaucgcuucuuuuggagugcccgaaaaauuagguugugcaaaccugccucuaaauucaaggcagaaggagcucugcaaacggaagccauaccugcuuccgaguauucgcgaaggcgcccgacuggggauacaggaguguggaagccaguuccgucacgaaagauggaacugcaugaucacagcggcugccacuaccgcacccaugggcgccuccccuuuguuugguuaugagcucucuucggggacaaaagagaccgcuuucauuuacgcagucauggccgcuggacugguucauucagugacuaggagcuguagugccggcaauaugacagaaugcuccugugacaccacgcugcaaaacggcgggucugcgagcgagggauggcacugggguggcugcuccgaugacguacaguaugggaugugguuuucacggaaguuccucgauuuuccaaucggaaauacuaccggcaaggaaaacaaaguguuacuggcaaugaaucuucauaacaaugaggccggucgccaggcugucgccaaguugaugaguguggacuguagaugccacgggguuagcggaucuugugcagugaaaacaugcuggaagacuauguccucauucgagaaaauuggccaucugcuaaaggauaaguacgaaaacagcauccagauaagugacaaaaccaagaggaaaaugcggcgccgagagaaggaucaaagaaaaauccccauucacaaggacgaucuccuguaugucaauaaaucuccuaacuacugcguggaagacaagaaacuuggcaucccagggacacagggaagggaguguaaucggaccuccgaaggugcugauggcugcaaccuguuguguugcgggcguggauauaauacgcacguaguucgccauguggagagaugugagugcaaguuuauuugguguugcuacgucaggugucggcgaugcgaaagcaugacugacgugcacacauguaaguga

SEQ ID NO: 64851 - RNA, 1113 nt, Artificial Sequence
  derived and/or modified sequence opt3 from WNT1__Homo_sapiens__NP_005421
augggccugugggcccuccuucccgggugggugagcgcuacccuguuguuagcacuggccgcgcuaccugcugcccucgcagccaacuccucuggaagauggugggguaucgucaauguugcuucaaguacaaaccugcuuacugacagcaagucccugcaguuggugcucgagccaucucugcaacugcucucgaggaaacagcggcgcuuaauucgacagaauccgggcauacugcacucaguaagcgggggacuucagagugcagugcgugaaugcaaguggcaauucagaaacaggcgguggaauugucccacggccccuggcccacauuuguuugguaaaaucgucaaccgcgggugcagagagaccgcuuucauuuuugccaucacauccgcgggagugacucacucuguugcaaggagcuguuccgaaggcucaauugagaguugcaccugugauuaccggcgccgaggccccgggggaccugacuggcauugggguggcugcagcgauaauaucgacuucgggagacuguuuggaagggaguucguggauucuggcgaaaagggucgggaccuacguuuucucaugaaccugcacaauaacgaggccgggcgcacaaccgucuucuccgaaaugagacaggaguguaaaugccauggaaugucaggcagcuguacugugaggacaugcuggaugcggcuuccaacccugcgagcuguaggcgauguuuugcgcgacagauuugauggggccaguagggugcucuauggaaaucgggguucuaaccgcgcauccagagcugaacuguuaaggcuggagcccgaggacccugcccacaagccaccgagcccccacgaucucgucuacuucgaaaagucgccuaauuuuuguacguauucuggccgucuugggacugcgggaaccgccggccgggcaugcaacuccucaaguccagcucuggacgguugcgaguugcuauguugcgggcgaggccauagaacaaggacucagcgcgugaccgaacgguguaauugcacauuccacugguguugccaugugagcuguagaaacugcacccacacgaggguccugcacgagugucucuga

SEQ ID NO: 64852 - RNA, 900 nt, Artificial Sequence
  derived and/or modified sequence opt3 from WNT2B__Homo_sapiens__NP_001278809
augagaagcgugggcgagggggccagggaauggauccgggagugccagcaccaauuccgccaucaccgauggaacuguaccacacuggaccgugaucauacugucuuuggaagaguuaugcucagguccucucgggaagcugcauucguguacgccauuucaagugcggguguagugcacgcuauaacgcgcgccugcagccagggcgagcuuuccgucuguucuugcgacccauauaccagagggaggcaucacgaucagcggggagacuuugauuggggcgguuguucggacaauauccacuacggggugcgcuucgcaaaggccuuuguugaugcuaaagaaaagcgacugaaagacgcaagagccuugaugaacuuacauaauaacaggugcggacggacagcugugcgucgcuuccugaagcuagaguguaaaugccacggcgucucaggcagcuguacucucagaaccugcuggagggcccugagugauuuucggcgaacaggggacuaucuucgcagaagguacgauggagcggugcagguaauggcaacccaagacggugccaauuucacugcugcccggcagggcuaucgcagagcaacaaggaccgaucugguuuacuuugacaacuccccugacuauuguguguuggauaaggcugccgggucucucggaacggcgggccgugucugcagcaagacuuccaaagguaccgacgggugcgagauuauguguugcggacggggcuacgauacaacucgagugaccagagugacacagugugaaugcaaguuccauugguguugcgccgucagguguaaagagugccgcaauaccguugacgugcacacguguaaggcacccaaaaaggcugaauggcuggaucagacuuga

SEQ ID NO: 64853 - RNA, 1083 nt, Artificial Sequence
  derived and/or modified sequence opt3 from WNT2__Homo_sapiens__NP_003382
augaacgcccccuugggcgggaucuggcucuggcuuccucuguuguuaaccuggcugacaccagaggugaauagcuccuggugguacaugagagcuacuggagguucuucaagggucaugugcgacaacguuccgggccuagugaguagccagcggcaacucugucaccgccaucccgauguaaugcgagcaauuucccaggggguggccgaauggacggcggagugccagcaccaguuccgucaacauagauggaauuguaacacccuggacagggaucacucucuuuuuggacggguccuguugcgcucgucaagagaaagcgcuuucguguaugccauaaguuccgcaggcguuguguuugccaucacaagggcuugcucucagggugaggucaagagcuguuccugcgacccuaaaaagauggggucagcaaaagauaguaagggaauuuucgacuggggcggcuguagcgauaauaucgacuacgggauuaaauuugcccgggcuuucguggaugccaaggaacgcaagggaaaagacgcgcgagcacucaugaaccugcauaauaacagagccgguaggaaggcuguaaaacgguuucugaagcaggagugcaaaugucacggcguuucuggguccugcacucuccguaccuguugguuagccauggcagauuuccgcaagacaggagacuaucuguggagaaaguacaauggcgcuauccagguggucaugaaccaagaugguaccggguuuacuguggccaaugagagguucaaaaagccaaccaaaaacgaccuuguguauuuugaaaauucacccgacuacugcauacgggaucgagaggcgggaagccugggcacagccggccgcgucugcaaccugacgaguagagggauggacucuugugaaguuaugugcuguggaagggguuaugauacuucccacgugacccggaugacaaagugcggcuguaaauuccauuggugcugugcaguacgcugccaggacugucuagaggcucucgaugugcacacuugcaaggccccuaaaaaugcugacuggaccacagccaccuga

SEQ ID NO: 64854 - RNA, 1059 nt, Artificial Sequence
  derived and/or modified sequence opt3 from WNT3A__Homo_sapiens__NP_149122
auggcuccccugggcuacuuccuccuucugugcagcuugaagcaggccuuaggguccuauccuaucugguggucucuggcagugggaccacaauacucaagucuagguagccagccgauucucugugccuccauacccggccuggucccuaaacagcuuagauuuugcaggaacuauguugagaucaugccaucuguggcggaagggauuaagaucggcauucaggagugucaacaccaguuccggggacgccgauggaauugcaccacaguacaugacucgcuggcuaucuuuggucccguguuggauaaagccacucgugaaucagcauucguccacgccauagcuagcgcagggguggccuuugcuguuacgagaaguugugccgagggaaccgcggcaaucugcggcuguuccucuaggcaucagggcagcccugggaagggauggaaaugggguggcugcuccgaagacauugaguucgggggaauggugucacgggaguuugccgaugcucgcgaaaacagaccagacgccaggagugcaaugaaucggcacaacaaugaggcuggccgccaggccaucgcgagccauaugcaccucaaguguaagugccacggucugucuggguccugugaagucaaaacaugcugguggucacaacccgauuuccgagccauuggagacuuucugaaggauaaauacgacagcgcaagugagauggugguagagaagcauagagaaucuaggggcuggguugagacucuccggccucguuauaccuacuucaaagugccaacagaacgcgauuuagucuauuacgaggcuuccccgaacuuuugcgaacccaauccugagaccggcagcuucgggacuagagacaggacauguaacgugucgucucacggaaucgaugguugcgaccugcuuuguugcggccgggggcauaaugcccgagcugagcgcagaagggaaaagugucggugcguguuucacugguguugcuacgucuccugucaggagugcacccgcguuuaugaugugcacacguguaaguga

SEQ ID NO: 64855 - RNA, 1068 nt, Artificial Sequence
  derived and/or modified sequence opt3 from WNT3__Homo_sapiens__NP_110380
auggagccccaucugcucggccuucuguugggguuacugcuaggagguaccagagugcucgccggcuacccuaucugguggagccuggcucuugggcagcaauauacaucccugggaucucagccauugcucugcggcucaauuccgggucugguccccaagcagcugagguucugucggaacuacauagaaaucaugccuaguguugcagagggggugaaacucggcauucaggaaugccaacaccaguuucgcggccgacguuggaauuguacuacgaucgacgauagcuuagccauuuucggcccaguacuggacaaggcgaccagagaguccgcuuuugugcacgccaucgcaucugccggggucgcuuucgcagugacaaggucgugcgccgaaggaacuucaaccauaugugguugcgauagccaucacaaaggacccccuggggagggauggaaguggggcgguuguagugaggacgcugauuuugggguucuugugucccgggaguucgccgacgcgcgcgaaaacagaccagaugcaaggucugccaugaauaaacauaacaaugaagcuggacggacaaccaucuuggaccacaugcaccugaagugcaagugucauggccuaagcggcuccugcgaggucaaaacuuguuggugggcccagcccgauuuucgcgcaauuggggacuuccucaaggauaaauaugacucagcuagugagauggugguagaaaagcaccgagagagcagaggauggguugaaacacugagggccaaauacucucuuuuuaagccuccaaccgagcgggaucugguguauuacgaaaacuccccgaauuucugcgagcccaacccugagacggguucauuuggcacucgugacagaaccugcaaugucacaagccaugggaucgacggaugugauuugcucugcuguggccgcggucacaacacuaggaccgaaaagcggaaagagaagugccacuguauuuuccauuggugcuguuaugugaguugccaggaauguauccgaauauacgacgugcacacaugcaaauga

SEQ ID NO: 64856 - RNA, 1122 nt, Artificial Sequence
  derived and/or modified sequence opt3 from WNT4__Homo_sapiens__XP_011539899
augacccagcugacacccgccccuccaccggcuagcucccaaggcucucucugcucaacucaggggaagagaaacaaaaggcuuccccggacgcugccuaaucagcgcggauacgagggugaagacaccggccacaucccacgauauuuggcaaaguuaaguagcgugggguccauuucugaggaagagacaugugaaaaacugaagggacuaauacagcgucaaguccagaugugcaaaagaaaccucgagguuauggauucggugaggcggggcgcccagcuggcgaucgaggaaugucaguaccaauuccgcaauagaagguggaacugcucaacucuugacagccugcccguauuugguaagguggucacccaggggacacgggaggcugccuucguguaugcaauuaguuccgccggaguugcuuuugcagugacccgcgccuguucuagcggcgaauuggagaagugcggcugugaucgaacuguccaugggguguccccucagggauuccaguggucagguugcagugacaauaucgcuuacggcguagccuuuagccaaucuuucguugaugugagagagagguccaaaggggcgucaagcagucgggcacucaugaaccugcacaauaacgaagccggacguaaggcuauucugacacauaugcgcgucgaguguaaaugccacggcgugucugguuccugugaagugaagaccugcuggagagccgucccacccuuuaggcagguugggcaugcacucaaagagaaguucgacggagcuacggaaguggagccucggcgaguaggcagcucgcgcgccuuagugccaagaaaugcgcaguuuaagccgcacacugaugaggaccuggucuaucuugaacccucuccugauuucugcgagcaagacaugagguccggcguguuggggacccggggacgcacauguaacaaaacuucaaaggccaucgaugguugcgaacugcuauguugcggcagaggguuucacaccgcacagguugagcucgcugaaagguguaguugcaaauuccauugguguugcuuugugaagugucgucagugccagcggcuggucgagcuucacacaugucgauga

SEQ ID NO: 64857 - RNA, 1098 nt, Artificial Sequence
  derived and/or modified sequence opt3 from WNT5A__Homo_sapiens__NP_001243034
auggccggcagcgcuauguccucuaaguucuuucugguggcacucgccaucuucuuuucauucgcgcaggucguuauugaggcuaacaguugguggagccuugggaugaauaaccccgugcaaauguccgaaguauacauaaucggagcccagccucugugcucucaguuggcagguuuaucgcagggccaaaagaagcugugucaccuauaucaggaccauaugcaguacauuggggagggagccaaaaccggcaucaaggaaugccaguaucaauuuagacacaggcgguggaauuguucaacaguggauaacacuagcgucuucggucgcgugaugcagauugggagucgagagacggcuuuuaccuacgcaguuuccgccgcuggaguggucaaugccaugucucgugcgugcagagaaggcgagcucagcacauguggcugcuccagggcagcccggccaaaagaccugccgcgcgauuggcuuuggggaggguguggugacaacaucgauuauggcuacagauucgcuaaggaguuuguggacgccagggaacgggagcgcauacaugcaaaggggucauaugaaagugcucgaauccugaugaauuugcacaacaaugaggccggaagaaggacuguauacaaccucgcggauguugccugcaaaugucauggcgugagcgguucuugcucccugaagaccuguuggcugcagcucgcagacuuccggaaagucggggaugcuuuaaaggagaaauacgacucagccgcugccaugcgucugaauagccgcggaaaacuuguccaggugaacaguagauuuaauucucccacaacccaagauuugguguauauugacccuuccccagauuacugcguuaggaacgaaagcacuggcucgcugggcacacaggggcggcuaugcaauaagaccucugagggaauggacgguugugaacucaugugcuguggccgaggguaugaccaguucaaaacggugcaaacugagcgcugccacuguaaguuucacuggugcuguuacguaaaaugcaagaaauguaccgaaaucguggaucaguucgucugcaaguga

SEQ ID NO: 64858 - RNA, 1080 nt, Artificial Sequence
  derived and/or modified sequence opt3 from WNT5B__Homo_sapiens__NP_110402
augcccagccugcuccuucuguucaccgccgcuuuguuauccucuugggcacagcugcuaacagacgccaacucaugguggagucucgcgcugaauccugugcaaagaccagagauguuuaucauuggcgcucagccggucugcagccagcuucccgggcuguccccuggacagaggaaguugugucaacucuaccaggaacacauggccuauauaggugagggcgcaaaaacugggaucaaggaaugccagcaucaguuccggcaacgccgauggaacuguucuacggccgauaaugcuucgguuuuuggacgugugaugcagauuggcucaagagagaccgcauucacacacgccguaagcgcugccgguguggucaacgcgaucaguagggcaugccgggaaggggagcuguccacuuguggaugcucucgcaccgccagaccaaaagaccugcccagggauuggcucuggggcggcuguggggacaauguggaguacggauaucgguuugcuaaggaguucguugaugcccgcgaacgagaaaagaacuuugcaaaagguagcgaggagcagggcagaguguuaaugaaucugcagaacaaugaagcugggaggcgggccgucuacaagauggcggacguggccugcaaaugucauggaguauccggcucaugcagucuuaagacauguugguugcaacuggcagaguuccguaaaguuggugaucgccuaaaggaaaaauaugacagcgcugccgcuaugagagugaccaggaaggggcggcucgagcuggucaacucucgauuuacucagccuacaccagaagaucuuguguacguggaccccuccccugauuauugccugcgcaaugagucaaccggaaguuugggcacgcagggcagacucugcaacaagacuagcgaggggauggacggaugugaacugaugugcugugguaggggcuacaaucaauucaaaucuguccagguugagcggugccacuguaaguuucauuggugcuguuucgugcgcugcaaaaaguguaccgaaauuguagaucaguacaucugcaaauga

SEQ ID NO: 64859 - RNA, 1098 nt, Artificial Sequence
  derived and/or modified sequence opt3 from WNT6__Homo_sapiens__NP_006513
augcugcccccucucccaagcagacuuggccuguuguuacugcuacuccugugcccggcccacgucgggggacuuuggugggcuguggguucuccccugguuauggacccuaccuccaucuguaggaaggcacggcgcuuggccggccgacaggcggagcucugccaagcugaaccagaggugguagccgaacuggcacguggggccagacugggagugagggagugucaguuccaguuucgguuccgcagauggaacugcucaagucauagcaaggcuuuuggcaggauucuccagcaagauauacgggaaacagcauucgucuuugccaucacugcugccggugcgucccacgcagugacgcaggccuguucuaugggggaguuacugcagugcggaugucaggcuccccgcggccgagccccuccaagacccucgggccuuccugggaccccaggaccgcccgguccugcaggcucaccagaggggagcgcugccugggaauggggaggcugcggugacgauguugacuucggggaugagaaaaguagguuguuuauggacgcgcggcauaaacguggacgcggcgauauuagagcccuggugcaacuacacaauaacgaagcaggcaggcucgcuguccggucccauacacgaacugaguguaagugccacgggcugucuggaagcugugcccuuagaaccugcuggcagaaacugcccccuuuccgcgaggugggugcuagguugcucgaacgguuucacggcgccucccgcguaauggggacaaaugacggaaaggcacuguuaccagccguuagaacccugaagcccccgggcagggcugaucuccuuuacgcggcagacucaccugauuucugcgcccccaaccgucggacugguaguccagggacacgaggcagagcuuguaauagcucugccccugaccuguccggaugcgauuugcuauguugcggcagggggcaucgccaggagucagugcagcuggaagagaacugucucugccgguuucacugguguugcgucgugcaaugucauagaugcagggugcgcaaagaacugagccuuugucuguga

SEQ ID NO: 64860 - RNA, 1050 nt, Artificial Sequence
  derived and/or modified sequence opt3 from WNT7A__Homo_sapiens__NP_004616
augaacagaaaggccaggcggugccugggccaccucuuccuuagccuggggaugguguacuugcgcaucggagguuuuuccucugucguugcuuuaggcgcaucaauuauauguaauaaaauccccgggcuggccccucgacagcgugcgauuugccaaaguagaccagacgcuaucauugugaucggagagggcagccagaugggucuagaugaaugucaguuccaguuuaggaacgggcgguggaauugcuccgcccucggagagcgcaccguauucggcaaggaacugaaagugggcucuagagaggcagccuuuacauaugcuauaaucgcagccggggucgcucaugccauuacugcggcauguacgcaaggaaaccuuucggacugcgguugugauaaggaaaaacagggccaguaccacagggacgagggguggaaguggggaggcugcucagccgauauccgguaugguauuggguucgcuaagguguuuguugacgcccgcgagaucaaacagaaugcacgaacccugaugaacuugcauaauaacgaagcuggaagaaagauacucgaggaaaauaugaaacuggaguguaagugccacggcgugagcggcaguuguacaacuaaaaccugcuggacaacccugccgcaauucagggagcucggguacgucuuaaaggauaaguauaacgaagccgugcauguagagcccguucgggcgucccguaauaaacgcccuacuuuucugaagauuaaaaagccacuuucuuacagaaaacccauggacacagauuugguguauaucgaaaagagcccuaacuacugcgaggaagacccagucaccggauccguggguacgcagggcagggccuguaauaaaacugcaccccaggcuucagggugcgaucugauguguugcggacggggcuacaacacccaccaguaugcccgaguguggcaauguaauugcaaguuccacugguguugcuacgucaaguguaacacaugcagugagcgcacugagauguauaccuguaaauga

SEQ ID NO: 64861 - RNA, 1050 nt, Artificial Sequence
  derived and/or modified sequence opt3 from WNT7B__Homo_sapiens__NP_478679
augcacagaaacuucaggaaguggaucuuuuacguguuccugugcuuuggcguccucuauguuaaacuuggggcccugagcuccgugguagcuuugggagcaaauauuauauguaacaagauccccgguuuagccccucggcagcgcgcgauuugccaaucucgaccagacgcuaucauugugaucggcgagggggcccagaugggaauaaaugaaugucaguaccaguuccguuuuggcagauggaacugcucagcacugggugagaaaaccgucuucgggcaagaacuaagggugggaagucgggaggccgcuuuuacauaugcaaucacugccgcuggcguugcccaugcggugacggcagccuguagccagggcaaucucuccaacugcgggugugaucgcgaaaagcagggauacuauaaucaggcugaggguuggaaauggggcgggugcucugccgacgucagauacggaauugauuucucgaggcgguuuguggacgcacgcgagaucaagaagaacgcucgaagacugaugaaucuucacaacaaugaagccggcaggaaaguacuggaggaucggaugcaauuggaauguaagugccaugguguuucagggagcuguaccacaaaaacuugcuggaccacacucccgaaguuccgugaggugggacaucugcugaaagagaaguauaacgcggccguccagguggaagugguccgcgcaaguagacucaggcagcccaccuuuuuacggauuaagcagcugcgauccuaccaaaaaccuauggagacugaccuuguuuacaucgaaaagucuccaaauuauugcgaggaagaugcugccacaggcagcgugggcacccaggggcgcuuguguaacagaacgucccccggagcugacgguugcgauacuauguguugcggcaggggguacaauacccaccaguauacaaaaguauggcaauguaacugcaaguuccacugguguugcuuugugaaauguaacacuugcucagagcggaccgaggucuucacauguaaguga

SEQ ID NO: 64862 - RNA, 1056 nt, Artificial Sequence
  derived and/or modified sequence opt3 from WNT8A__Homo_sapiens__NP_490645
augggcaaccuguucaugcucugggccgcucuugggaucugcugugcagccuuuagcgcguccgcuuggucugugaauaacuuccugauuaccggacccaaggccuacuugacauauacuacgucagucgcauuaggugcccagaguggcauagaggaaugcaaauuucaauucgcuugggagagauggaauuguccugaaaacgcacugcagcuaagcacccacaauaggcuccgguccgccacacgcgagacuucuuuuauccaugcuauuucgucagccgggguuauguacaucauuaccaagaacugcagcaugggagacuucgaaaauuguggcugcgaugguaguaacaaugggaaaacaggaggccacggcuggaucuggggaggguguuccgacaacguggaguuuggugagcgaauaucuaagcuguucguagauagccuugaaaaaggcaaggacgcgcgugcacugaugaauuugcauaacaauagagccgggaggcucgcugugcgggccaccaugaagcgcacuugcaaaugucacggaaucuccggcucaugcaguauucagacauguuggcugcagcuggcagaguuuagagaaaugggugauuaucucaaggcuaaauacgaccaagccuuaaagaucgagauggauaaaaggcagcugcgggcggggaacagcgccgagggacauugggucccagcagaggcuuuccuuccgucugccgaggcugaauugauuuuucuggaggaaucccccgacuauuguaccugcaauucaagccuaggcaucuacggcacggaggggcgcgagugccuccagaacagucacaacacuucucgaugggaaagaagguccugcggacggcuguguaccgagugcggucuucagguggaagaacguaagacagaaguuauaagcucguguaauugcaaguuccaaugguguugcacugugaaaugugaucagugccgccacgucgugucuaaguauuacugugccagauccccuggcucagcacagagucuggggaaaggaagcgccuga

SEQ ID NO: 64863 - RNA, 1056 nt, Artificial Sequence
  derived and/or modified sequence opt3 from WNT8B__Homo_sapiens__NP_003384
auguuccugagcaagcccuccguguacaucugccucuuuaccuguguccuucagcugucucacucauggaguguuaacaauuucuugaugacaggcccuaaagccuauuuaauuuacagcuccucuguggcugcaggggcccaaucgggaauagaggaaugcaaguaucaguuugcgugggacagauggaacuguccagagagggcucugcagcuaucaagccaugguggccuccggagugccaaucgcgaaacugcauucguacacgccaucuccucugcuggggugauguacacgcugacccgaaacugcagccuuggagauuuugacaauuguggcugcgaugacucccguaacggucagcugggagggcaaggcugguuguggggcggguguucagauaaugucggauucggugaggcaauuaguaaacaguuuguggacgcccucgaaacaggccaggaugcuagagccgcgaugaaccugcauaauaacgaggcagggaggaaggccguuaaaggaacuaugaagcggaccugcaagugucacggcgugagcgguucuugcacaacccagacuuguuggcugcaacucccggaguuccgcgaagucggggcucauuuaaaagagaaguaucacgccgcacugaaaguggaccuuuugcagggagcuggcaauuccgccgcgggcagaggggccaucgcagauacauuuaggucaauuagcacccgggaacugguacaccuagaggacagucccgauuacugccucgagaacaagacgcugggacuucuggguacugaaggccgcgagugcuugcgaagagggagggcucucggacggugggaacgucgcucuuguagaaggcugugcggcgacugugguuuagccguugaggaacggcgagcugagaccguguccagcugcaauuguaaauuccauuggugcugugccguccgcugcgagcaguguagaaggcgggugacaaaguauuuuugcucgcgcgcagaaagaccucgugggggcgccgcucacaagccaggaaggaaacccuga

SEQ ID NO: 64864 - RNA, 1098 nt, Artificial Sequence
  derived and/or modified sequence opt3 from WNT9A__Homo_sapiens__NP_003386
augcuggacggcagcccccucgccagauggcuugcugcagccuucgggcugaccuuguuacuggcggcucuaaggccuuccgccgcauacuuuggacucacagguucugagccacugacuauccuuccgcugacguuggaacccgaggccgcugcacaggcccacuauaaggcuugcgaucggcucaaacuggaacgcaagcaacgacguauguguagaagggacccuggcguggccgagacccuggucgaagcgguuucaaugagugcacucgagugccaguuccaguuucgguucgagcgcuggaacuguacauuagaagggagauacagggccagccugcuuaaacggggauuuaaggagacugcuuucuuguaugccauuuccucugcaggccugacccaugcucuagccaaagcgugcucggccggucgcauggaacgauguacaugcgaugaggcaccagaccucgagaauagagaagccuggcaguggggaggguguggcgauaaccugaaguacucaagcaaguuugugaaagaguuccuuggcaggcggaguuccaaggaccugcgugcucgcguagauuuucacaauaacuuggugggggucaaagugauaaaggcuggaguugaaaccacuugcaaaugucauggugugucuggcagcugcacagucagaaccuguuggaggcaacucgcccccuuccacgagguggggaagcaucugaagcacaaauaugaaacggcauuaaagguaggauccacuaccaaugaggccgcuggcgaggcgggugcaaucucaccuccacgggggcgagccaguggagcuggcggcagcgacccccugccucgcacaccagaacucguucaccuugaugacucuccguccuuuugccuggccgggagauucucacccggaacugcagguaggcggugccaucgcgagaaaaacugugaaagcauuugcuguggcagagggcacaauacccagaguaggguggucacacguccuugccagugucaggugcgguggugcuguuacguggagugccgacaauguacccagagagaagaggucuauacgugcaagggauga

SEQ ID NO: 64865 - RNA, 1074 nt, Artificial Sequence
  derived and/or modified sequence opt3 from WNT9B__Homo_sapiens__NP_003387
augagacccccuccagcccuggcucucgcaggccuuugccuguuggccuuaccggcggcugccgcaagcuacuucgggcugaccggaagggaggugcuaacacccuuuccuggucucggcacugccgcugcaccagcccaagggggagcucaccugaagcagugugaccuucugaaauugucccggcgccagaagcagcucugccgacgugaacccggccuggccgagacgcugagagaugcggcacaucucgguuuacuggaaugucaguuccaauuuaggcacgagcgguggaacugcucucuugaagggcgcaugggauugcugaaaagaggcuucaaggagaccgccuuucuauaugcugucucaagugccgcacucacacauacucuggcuagggccuguagcgcgggccggauggagcgcugcaccugugacgauuccccugggcuugaaucucgacaggccuggcaguggggaguuugcggugacaaucugaaauacucgacaaaguucuugucaaacuuucucggcagcaagagagggaauaaagaucugagggcacgggcugacgcccacaacacccaugugggaaucaaggcuguaaaaaguggcuuacguacuacauguaagugccacgguguguccgggucuugugccgucagaaccugcuggaaacagcugagcccauuccgcgagacgggacaagugcucaaacuuagguaugauuccgcaguuaaggugucaagugccacuaaugaagcucugggccgguuggagcuaugggcgcccgcacgacagggcagccugaccaaggggcucgccccucgcucuggagaccuggucuacauggaggauuccccaucauuuugcagaccgagcaaguauagucccgguacagcuggcaggguguguucucgggaagccuccugcagcucgcuuuguugcgggcgcggauacgacacucagucuagacugguagcauucuccugucacugccagguucaaugguguugcuauguggagugucagcagugcguccaagaagaguugguguacaccuguaaacauuga

SEQ ID NO: 64866 - RNA, 1647 nt, Artificial Sequence
  derived and/or modified sequence opt3 from WRAP53__Homo_sapiens__NP_001137462
augaagacccuggagacacagccccucgccccugacugcuguccaagcgaucaagacccggcucccgcacacccuuccccacaugccucucccaugaacaaaaaugcggauucagaacuuaugccuccacccccugagagaggcgacccaccgaggcugagucccgauccuguggcugggagcgccgucucccaggaauugcgggagggagacccaguuucuuuaucgacuccccuggaaacggaguucgguucaccuagcgagcuaaguccacgcaucgaggagcaggaacucuccgagaacaccucucugcccgcagaggaagccaauggcagccuuuccgaggaagaggcuaacgggccggaacugggaucaggcaaggcaauggaggauacaaguggugagccugccgcugaagacgagggggauacugccuggaauuacagcuuuucucaguugccccgauuccucuccggaucauggagcgaauuuaguacccaaccagagaacuuccugaaaggcugcaagugggcgccugacggcucuuguauucugacaaauuccgcagauaacauacuccguaucuauaauuuacccccagaacuguaccacgagggggaacagguggaauaugccgagaugguacccgugcuuagaauggucgaaggagacaccauuuacgauuauugcugguacagcuugaugucgucugcucagccugacacuuccuauguggccucaaguagcagggagaacccaauccauauuugggacgcauuuacaggugaacugcgggcuuccuuccgcgccuacaaucaccuagaugagcucaccgcggcccauucucuguguuuuagcccggacggcucacagcuuuucugcggguuuaacagaacgguuaggguguucaguacugcacggcccggacgcgauugugagguccgagcuaccuuugccaaaaagcaaggccaguccgguaucauaagcugcaucgcuuucucuccugcccagccacuguacgcaugugggucauauggaagaaguuugggccucuacgccugggacgauggcagcccccuggcuuuacucgggggacaccaggguggcauuacacaccugugcuuucauccugacgggaauagguucuucuccggagcgcggaaggaugcagaacuucuguguugggacuugcgucaaucuggcuauccacuauggucgcugggucgcgaggugacuaccaaccagagaaucuacuuugaucucgaccccacagggcaguuccugguaagcggcuccaccucaggagccguuagugugugggauacggacggcccggggaaugacggaaaaccugaaccaguccuuucuuuucugccccaaaaggauugcacuaacggugugagcuugcacccuucccucccccuguuagcuacagccucaggccagaggguguucccagagccuaccgagagcggggacgaaggagaggaacugggccuaccccuccugucuacucggcauguccaccuugagugccgauugcagcugugguggugugguggggcaccagauuccaguauuccggacgaucaccagggcgaaaaaggacaaggcgggacagagggagguguuggcgagcucaucuga

SEQ ID NO: 64867 - RNA, 423 nt, Artificial Sequence
  derived and/or modified sequence opt3 from WRB__Homo_sapiens__NP_001139690
augagcagagugcugcagaaggacgccgagcaagaaucccagaugagggcugagauccaggauaugaaacaggaacucucuaccgucaacaugauggacgaguucgcacgguacgcccgccuugaacgaaagauuaauaaaaugacagauaagcugaaaacucacguuaaggcgcguacggcucaauuggccaagauaaaaugggugaucucaguagcauuuuauguguuacaggccgcucugaugauuagucuaaucuggaaguacuauagcguccccguggcaguugugccuuccaaauggauuaccccacucgacagacuggucgccuucccgacaaggguggcuggcgggguaggaaucacuugcuggauacuuguuuguaacaagguggucgccaucgugcugcaucccuuuucuuga

SEQ ID NO: 64868 - RNA, 4299 nt, Artificial Sequence
  derived and/or modified sequence opt3 from WRN__Homo_sapiens__NP_000544
augagcgagaagaaacuggaaaccacagcccagcaaagaaagugccccgaguggaugaacgugcagaauaaaaggugugcugucgaagaacggaaggcaugcguucgcaaauccguguucgaagacgaucucccuuuucuugaguucacuggcucuaucguauacucauaugacgccagugauuguagcuuucuguccgaggacauuucuaugucguugucagauggggacguggucggauucgauauggaauggccaccguuauacaaccgagguaagcugggcaagguggcgcuaauacagcucugcguuagcgagaguaaauguuaucuguuucacguguccucuaugagcgucuucccccaggggcuuaagaugcuguuggaaaauaaagcugugaagaaagccggaguaggcaucgagggugaccaauggaagcuccugcgugauuuugacauuaagcugaaaaacuucguugagcucacggauguggcaaauaagaaauuaaagugcaccgaaacauggucccugaacucacuugucaaacauuugcuggggaagcagcuacucaaagacaagaguaucagauguagcaauuggucuaaguuuccucugacugaggaucagaaacuuuacgccgcuaccgacgcauaugccggauucauuaucuacaggaaccuggaaauauuggacgauacagugcagcgguuugcuaucaauaaggaggaagagauucuccuguccgacaugaacaaacaauuaaccucaaucagcgaggaagugauggaucuggccaagcaccucccacaugcguucaguaaacuugagaauccccgcagagucucuauucuguugaaggacaucuccgaaaaccuauauagccugaggcggaugauaauuggcucgacuaauaucgagacagaacuccgcccuucuaacaaucugaaccuucuguccuuugaggauucaaccacgggcgggguucagcagaagcagauucgagagcacgaaguguugauccauguagaggacgaaacuugggauccaacccucgaccaccuggcaaaacacgauggagaggacguguuagguaacaaggucgaaagaaaagaggauggcuucgaggacgggguggaagacaauaagcugaaagagaacauggaaagggccugccuaaugagucucgauaucacagagcaugagcugcaaauucuugaacagcagagccaagaggaauacuuguccgacauagcuuacaagucuacugagcaccugagccccaaugauaacgaaaaugacaccucauauguuaucgagagugaugaggaccucgaaauggagaugcugaagcaucuuuccccuaacgauaaugaaaacgacacaagcuacgugauugagucugaugaagaccuggagauggagauguugaaaucacucgaaaaucugaacaguggaaccgucgagccaacgcacagcaaguguuuaaaaauggaacggaaucugggccuaccgacuaaggaggaagaggaggaugacgaaaacgaggccaaugaaggugaggaggaugacgacaaagauuuccucuggcccgcaccuaacgaagaacaggugacaugccugaagauguauuuugggcacuccucuuucaagccaguacaguggaaaguuauccauucggugcuugaggagcgucgcgacaaugucgcugugauggccaccggauacggcaagagcuuguguuuucaguaucccccugucuacgugggcaaaauagggcugguuauuuccccacucaucucacugauggaagaucaaguguuacagcugaagaugaguaacauccccgcgugcuuccuuggaucugcccagagcgagaacguauugacugacauuaaacucgguaaguauagaaucgucuacgugacaccggaguacugcuccggcaauauggggcugcuacagcaacuggaagcagauauuggaauaacccucaucgcuguugacgaggcccacuguauuucagaauggggccaugauuuuagggacagcuuccggaaacuggguucucuuaagacggcuuugccuauggugcccaucgucgcccugaccgcaacagccuccaguagcauccgagaggauauugugcgcugcuuaaaccucagaaauccacagauaacuuguaccggguuugacaggccuaaccuguaucuugaaguacggcgcaagacaggcaauauccugcaggauuugcagcccuuccucgugaaaacuucuucccacugggaguuugagggaccaaccauuaucuacugccccucaagaaagaugacacaacagguuaccggcgaacugaggaaacuaaaccugaguugugggacuuaucaugcuggaaugagcuucucgacgcguaaggacauucaccaccgguuuguccgagaugagauccagugcgugauagcgacaaucgcauucgguaugggcauuaauaaagccgacaucagacaggugauucauuacggggcuccuaaggacauggaauccuauuaccaagagaucggaagggccggccgcgauggucuccagucuagcugucacguccugugggcaccagccgacauaaaccuuaaucggcauuugcugaccgaaauuagaaacgagaaguuuagguuauauaaacucaagaugauggcuaaaauggagaaguaccugcacucaagucgcugccgacggcagaucauucuuucccacuucgaagauaaacaaguucagaaggccucucuggggaucaugggcacugagaaguguugcgacaauugucguagcagacuagaucauugcuacuccauggacgauucagaagacaccagcugggauuucggaccgcaggcauuuaaacuccugagugcgguggacauauugggcgagaaguucgggaucggacugcccauuuuauuucucagggguucuaacucccagcgccuggcugaucaauaucggagacacagccuuuucggcacagggaaagaccagaccgagucgugguggaaggccuuuucaaggcagcugaucacugaaggauucuugguggagguaucucgauacaauaaauuuaugaagauuugcgcacucacaaagaaaggccgcaacuggcugcauaaggccaauacggaaagucagucccuaauccugcaagcuaacgaggaacuuuguccuaaaaagcuccuguugccaagcucuaaaaccgucagcuccgguacuaaggagcacugcuauaaccaggugcccguugagcugucaacagaaaagaagaguaauuuagagaagcucuacagcuauaaaccuugugacaagauaucuuccgggucaaacauuaguaaaaagagcaucauggugcaguccccagaaaaagccuacucuucgagccagcccgucaucucagcacaagagcaggaaacccagauugugcuguauggcaaacuuguugaggcucggcaaaagcaugccaauaaaauggaugugccgccugcgauccuggccacaaacaagauuuugguagacauggcuaaaaugagaccaacuaccgucgagaaugugaagaggauagauggaguguccgaaggcaaagcagccaugcucgcuccccugcuagaggucaucaagcacuucugccagacgaacaguguucagaccgaccuguuuucuagcacaaagccucaggaggagcagaaaacuucccuuguggccaagaauaaaauuuguacccucucacaaucuauggcaaucacauacagccuguuccaggaaaagaaaaugcccuugaagaguauugcggagucccguaucuuaccacugaugacuauagggaugcaccucagccaggccguaaaggcuggaugcccucuggaucuugagcgcgccggccugacccccgaagugcagaaaaucauugcagacgucauccggaacccaccgguuaauucugauaugucaaagauuuccuugaucagaaugcuagugccugagaacauagacacguaccugauucauauggcuaucgaaauccucaaacacggucccgauagugggcugcaaccaagcugugacgugaauaagaggcgaugcuuucccggaucggaggagauuuguucuuccagcaaacggucaaaggaagaggucggcauaaacacagaaaccaguucugccgagcgcaagagaaggcuuccugugugguucgcaaaagguuccgauacuagcaagaaauuaauggacaagacaaaacggggcgggcuguuuucauga

SEQ ID NO: 64869 - RNA, 1998 nt, Artificial Sequence
  derived and/or modified sequence opt3 from WRNIP1__Homo_sapiens__NP_064520
auggaggugagcggccccgaagacgauccuuuccugucccagcuccaccaaguccagugcccaguuugucagcagaugaugccggccgcucauaucaacucucaccuugacagaugccuguuguuacaucccgcagggcacgccgagccugcggcuggaucacauagggccggugaacgggcaaagggcccaagucccccuggggccaaacgccgacgucugagcgaguccucugcucuaaagcaaccagcaacccccacagccgcugaaucgucagagggagagggcgaagagggugaugacgggggagaaacugagagcagagagaguuacgaugccccuccaacgccguccggcgcgaggcucauucccgacuuuccuguggcacggucuagcuccccaggccgcaaagggucaggaaagagacccgccgcugccgcagcugccgguagugcgagcccuaggucuugggaugaagccgaggcacaggaagaggaagaggcuguaggcgacggggauggagacggcgaugccgacgcugauggugaggacgacccagggcacugggaugccgacgcagccgaagcugcgaccgcauucggagccuccggcggcgggcggccccacccgcgcgcucuggccgcagaggaaauacgacagaugcuucagggaaaaccucuggccgauacaaugagacccgacacuuugcaagauuauuuuggucagucaaaggcugugggccaggacacccuccugaggagccugcucgagacaaaugaaaucccaaguuuaauucugugggggccucccggauguggcaagaccacucuugcccauaucauugcaucuaacuccaaaaagcacagcauccgguucgucacauugucggcgaccaaugcuaaaacgaacgaugugcgugacguuauaaagcaggcccaaaaugagaaauccuuuuucaagcgcaagacuauccuguuuauugaugagauccauagauucaacaaaucucagcaggacaccuuucuaccacacguggaaugcgguacaauuacucucaucggggcaaccacagagaaucccucauuccaagucaacgccgcucugcuuaguaggugucgggugauaguacuggaaaaguugccuguugaggccauggugaccauucucaugcgagcaaucaauagccugggcauucacgucuuagauuccucucgcccaacggacccgcugagccauucaaguaacuccagcucugaacccgcuauguuuaucgaggacaaagccguggauacucucgcguaccuuucagacggagaugccagagcuggccugaauggguugcagcuagcagugcuggccaggcucaguagccggaagauguucugcaaaaaguccggacagucuuauucgccuagccgcguccugaucacagagaacgacguuaaagaaggucuucagagaucccacauucuguacgauagggcuggcgaggaacauuauaauuguauaucagccuugcacaagaguaugcgugggucugaccaaaacgcaagccucuacuggcuggcgcggauguuagagggaggcgaggauccacuguauguggcccgaaggcuaguaagauuugcuuccgaagacaucggucucgccgaucccucagcacugacccaggcuguggccgcauaccaggggugccauuucauuggcaugccugagugugaaguccuuuuggcccagugcgugguuuacuucgcucgcgcgccaaagagcaucgagguguauucugccuacaauaacgucaaagcaugucugcggaaccaccaaggaccccucccgccugugccacugcaccuuagaaaugcucccacuaggcugaugaaggacuugggcuaugggaaaggauacaaguauaacccuauguacuccgaacccguagaucaggaguaucucccagaggaacugcgcgguguugacuuuuucaaacagcgacggugcuga

SEQ ID NO: 64870 - RNA, 1266 nt, Artificial Sequence
  derived and/or modified sequence opt3 from WSB1__Homo_sapiens__NP_056441
auggccagcuuucccccuagagugaacgaaaaggaaaucgucaggcugcggaccauuggcgagcuccuugcuccagcagccccguucgacaaaaagugcgggcgcgaaaauuggacaguugcguucgcucccgauggauccuacuuugccuggucucagggucaccgaacugugaaacugguaccuuggucacaauguuugcagaacuucuuacugcauggcacgaagaaugugaccaacaguagcucccuacgucucccaagacaaaauucugacgggggacagaaaaacaagcccagggagcacauaaucgauugcggcgacauugucuggucgcuggcauuugguucaagcgugccugaaaagcagagucgguguguuaauaucgaguggcaucgcuucagauuugggcaggaucagcuucuguuggccacaggacucaacaauggcaggauuaaaaucugggacguguauacuggcaagcugcugcucaacuuagucgaucacaccgaggugguacgggaccugacauucgcuccagaugggucccuuauauugguuucugcaagccgcgacaaaacccugcgagugugggaucuaaaggacgauggaaauaugaugaaaguccucagaggucaucagaacuggguguacuccugcgccuuuucacccgacaguagcaugcuguguucugugggcgcuuccaaggccgucuuccuuuggaauauggacaaguauacuaugaucaggaaacuggaagggcaccaccaugauguuguggcgugcgacuuuucaccugauggagcauugcucgccacagcuagcuacgacacccggguauauauuugggauccacacaacggcgacauccugauggaguucggucauuuauuuccgcccccuacgccaauuuucgccgggggagcaaaugaucguugggugcgcagugucucuuucucccacgacggccugcacguggcuagccucgccgaugacaagaugguuagauuuuggaggaucgaugaagacuaccccgugcaagucgcgccucuuucgaacggccuguguugcgccuucucuacugacggguccguguuggcagcuggaacccaugaugguucaguauauuuuugggccacaccacggcagguucccagucuacagcaccugugucgaaugagcauacgcagagugaugccgacucaggagguccaagagcucccuauucccuccaaacugcuugaguuccugucuuacaggaucuga

SEQ ID NO: 64871 - RNA, 1728 nt, Artificial Sequence
  derived and/or modified sequence opt3 from WSCD1__Homo_sapiens__NP_056068
auggccaagcccuucuuuagacugcagaaauuccucaggcggacccaauuucuucuguucuuuuugacagcugcauacuuaaugacuggcagccugcuacuccugcagcgcgugcgagucgcccuuccucaggggccacgugcgccgggaccccugcagacguugccuguugcugccguggcacucgguguaggccugcuggacuccagagcccuccacgauccaagggugucucccgaguuacugcuuggggucgacauguugcaaucaccucugacccggccacgccccggaccuagauggcuaaggagucggaacagcgaacuccgccagcugcgaagaaggugguuccaucacuuuauguccgauucucagggcccaccggcucuuggucccgaggcagcccggccugcuauccauucgcgugggacauauauuggaugcuucucagacgauggccacgaacgcacucugaagggcgccguguuuuacgacuugagaaaaaugaccguuagccauugucaggaugcgugcgcagagaggaguuauguguacgccgggcucgaagcuggagccgaguguuauugcgguaaucggcugccagcagucuccgugggcuuagaggaauguaaccacgagugcaagggggaaaaaggaucuguauguggcgcuguugaccgacugagcguguaccgcgucgaugagcuccaacccgguuccagaaagaggcggacagccaccuaucgcgggugcuucagacuuccugagaauauaacucacgcguuuccaucaagucugauccaggccaacgugacagugggaaccuguagcggcuucugcucucagaaggaauuucccuuggcaauucuaaggggcugggaguguuacugcgcuuacccgacgccucguuucaaucugcgggacgccauggauuccucagucugcgggcaggaccccgaagcucaacgacucgccgaguauugugaaguuuaccagacuccagugcaggauaccagaugcacagacaggcgcuuccugccuaacaaaagcaagguauuuguggcacuuaguucuuuccccggagccgguaauacuugggcucggcaucugaucgagcacgcgaccggcuuuuauacaggguccuacuauuucgacggaaccuuguacaacaaaggcuuuaagggugagaaagaucauuggagaagcaggcgcacgauuugugucaagacucacgaaucggggcgacgggagaucgaaauguucgacucugcaauacuccugauccguaauccauauagauccuuaguggccgaguuuaacaggaagugcgcuggccaccugggauacgccgcagaucgcaauuggaaaucaaaggaauggcccgacuucguuaacaguuacgccagcuggugguccucucaugugcuagauuggcucaaauauggcaagcggcugcuugucgugcacuacgaggaguugagaaggagccugguaccuacacuccgagaaaugguugcuuuucugaaugugucagucagugaggaacgccuucuguguguggagaacaauaaagaaggguccuuccggagaaggggacgucgcagccaugacccagagccguuuacccccgagaugaaggauuugauuaacgguuauauccggacugucgaccaagcccucagagaucacaacuggacaggccugccuagggaauacgugccacgauga

SEQ ID NO: 64872 - RNA, 1698 nt, Artificial Sequence
  derived and/or modified sequence opt3 from WSCD2__Homo_sapiens__NP_001291376
auggccaagcugugguucaaauuucagagauacuucaggcggaagcccgugcgcuuuuucaccuuucucgcucuuuaucugacagcaggcagcuuggucuucuuacacuccggguuuguuggacaaccugccgugucugguaaccaggcgaauccagcugccgcaggcgggccggccgagggagcugaacugucauuccuaggcgacaugcaucucggucgaggguuucgugauacuggagaggcaaguagcaucgccagaagguacggccccugguucaaaggcaaggacgggaacgaacgggcuaaacugggagauuaugguggcgccuggucccgcgcgcuuaaggggagaguagugagggagaaggaagaggagcgggcaaaauacauuggaugcuaucuggacgauacgcagucucgcgccuugcgaggcgucucguuuuucgacuacaagaaaaugaccauauuuagaugucaggauaauugcgcugaaagggguuaucucuacgggggacuggaguucggcgccgaauguuacugcggccacaagauccaagcaacaaacgugucagaggcugagugugacauggaaugcaaaggggagcggggaagcguuugugguggcgccaaucgucugaguguguaucgccuccaguuagcgcaggaauccgccagaagguacgggucugcagucuuccggggaugcuuucgacgcccugauaaccugagccuugcuuugccagugacugccgcuaugcugaauauguccguagacaaguguguugauuucugcaccgagaaggaauauccccuagccgcacucgccggcacagcuugucauugcgguuuuccuaccacuagauucccacugcacgacagggaggaugagcagcuuugcgcgcaaaaauguucagcagaagaguuugaaaguugcgggacacccagcuacuucauuguguaucagacccagguccaggacaaccgguguauggaccgcagauuucugccuggcaagucuaaacaauugaucgcccucgcuuccuucccaggagccggcaauacgugggcaaggcaucugauugaguuagccacuggguuuuacaccggaucauauuacuucgaugguagccuguacaacaagggcuuuaaaggggaacgugaccacuggcggaguggacgaacaaucugcauaaagacucacgagucuggccagaaagagaucgaggcuuucgaugccgcaauucuccuuaucagaaauccguauaaggcgcugauggcugaauuuaacaggaaguacggugggcauauuggcuucgccgcacacgcccauuggaaaggaaaggaauggcccgaguucgugcgcaauuaugcuccuuggugggccacccacacauuggacuggcuaaaauuuggcaagaaagugcuggucguucacuucgaagaucucaagcaggaccuguuugugcaacuugggcggaugguaucccuguugggaguggcagucagagaggauaggcuccuguguguggagagccagaaggacgguaacuucaaacgcucgggcuuacgaaagcuggaauacgauccauauaccgcugacaugcagaaaacgaucucugccuacauaaagaugguugaugcggcccuaaaagggcggaaucucacuggagugcccgacgacuauuacccucguuga

SEQ ID NO: 64873 - RNA, 1494 nt, Artificial Sequence
  derived and/or modified sequence opt3 from WT1__Homo_sapiens__NP_000369
augcaggaccccgccagcacaugcgugccugagccagcuucccaacacacccugagaucuggcccggggugucuccagcagcccgaacagcaaggagucagggauccugguggcaucugggcaaaacuuggggccgcggaggcuucagccgaacggcugcagggacgccgaagucguggcgcaagcgguuccgagccacagcagauggggucugacguuagagauuugaacgccuuacugcccgcugugccuucgcuaggaggcggcgggggaugcgcacucccaguaucaggugccgcucaaugggcccccgugcuggacuucgcgccuccaggcgcaagcgccuacgggagucuuggaggcccggcucccccuccagcacccccuccacccccgccucccccaccucauuccuuuauuaagcaggaacccucuugggguggggccgagccacacgaggaacagugucugagcgcuuucacuguccauuuuuccggacaguucacgggcaccgccggcgcgugcagguaugggcccuuuggaccuccaccgcccucacaagccaguagcggucaggcacggauguucccuaaugcuccauacuugcccucuugucucgagucccagccugccauacgcaaccaaggcuauucaacagugacuuuugaugggaccccaagcuacggacacacacccagucaucacgcugcccaguucccgaaucacucuuuuaagcaugaagacccuaugggccagcaggguucccugggggagcaacaguauagcguuccacccccuguguacggcugccacacccccacugauucguguacaggaucucaggcacugcucuuaagaaccccauauuccucagacaaccuguaccagaugacgagucaacuugagugcaugacuuggaaucagaugaacuugggcgccacccugaaagggcauagcacaggauacgaauccgauaaucacacuaccccuauccuauguggugcucaguauaggauucacacacauggcgucuuccgggggauccaggacgugcgccgaguacccggaguugcgccaacccucgugagaucugcaagcgagacgucagaaaagaggccguuuaugugcgccuacccuggcuguaacaaacgguauuucaagcugagucaccuucaaaugcauucccguaagcacacuggugagaaacccuaccagugcgauuuuaaggacugcgaacgcagauucagcaggucugaucagcugaaacggcaucagcgacgccacacaggggucaagccauuccaauguaaaaccugccagagaaaguuuucaaggagugaccacuugaagacucauacacggacccacacgggcgagaaacccuucagcugucgcuggccuuccugccagaagaaauuugcuagaucugacgagcucgugaggcaucacaauaugcaccaacguaacaugaccaagcugcaguuagcccuguga

SEQ ID NO: 64874 - RNA, 1191 nt, Artificial Sequence
  derived and/or modified sequence opt3 from WTAP__Homo_sapiens__NP_001257460
augaccaacgaggaaccccugccuaagaaagugagacucagcgagacagacuucaaggucauggccagggaugaacuuauccugcgguggaaacaguacgaggcuuauguucaagcauuggaaggcaaguacacugacuuaaauuccaacgaugugacggggcugcgcgagucugaggaaaaacuaaagcagcagcagcaagagucagcccgacgugaaaauauucucguaaugagacuggcgaccaaggagcaggagaugcaggaaugcacaacucagauacaauaucuuaaacaggugcagcagccaagugucgcucaacugaggagcaccaugguggacccggccaucaacuuguuuuuccucaagaugaaaggagagcuggaacagacaaaggauaaacuggagcaggcacaaaaugaacucuccgccuggaaguuuacccccgacucucagacugguaagaaauuaauggcuaagugucggaugcugauucaggagaaccaggagcuuggccgccaauugucgcaggggagaaucgcacagcuggaagccgagcuagcucuccagaaaaaguacucagaggagcugaaaagcagucaagaugaacuuaaugacuucauuauccagcuggaugaggagguugaaggaaugcaguccacaauauuggugcuccagcaacagcugaaggagaccaggcagcaguuagcccaauaucagcagcaacagucucaggcgagcgcaccuuccacgucacggacuaccgccagugaaccagucgagcagagcgaagcuacaucuaaagacugcucccgccugacuaacggccccucaaaugguagcaguucucgacaaagaaccuccgggagcggauuucacagggagggcaacacaaccgaggaugacuucccuucgucuccaggcaaugggaacaaguccucaaauaguagcgaggaacggacgggacgugguggcuccggguacgugaaccagcucucugccggauaugaaagcguagauucacccacuggcagugaaaauucccuuacacaucagagcaacgacaccgacucuucacacgauccucaggaggaaaaggcaguuagugguaaagggaaccgcacugugggaagcagacauguccaaaauggccuggacuccucugugaacgugcagggcucggucuuguga

SEQ ID NO: 64875 - RNA, 1293 nt, Artificial Sequence
  derived and/or modified sequence opt3 from WTIP__Homo_sapiens__NP_001073905
augcagagaagcagggccggcgcugacgaggcagcccugcuccuugcggggcuggcuuugcgggaauuagagcccggaugcgguuccccuggccgcgggcgacguggaccaagaccgggccccggugaugaagccgccccugcacuggggaggcggggaaagggcucuggcgggccagaggcuggagcagacggucuaucacgcggcgaaagagggcccaggcgggccgcugugccugagcucagugcccaaccagcgggaagcccccgcgcaucccuggccggcucugauggugggggaggcggcgggucggcucgaucaagcggaaucagucuugguuacgaccagagacacggcuccccuaggucugggcggagcgauccacguccgggacccggcccuccauccgucgguucagcccgcaguagcguuucuucccuggggucaagaggcagcgcaggagcuuaugccgacuucuugcccccuggcgcguguccagcccccgcaaggaguccggagccugcugggcccgccccauuuccucuccccgcucugccacugcccccuggacgggaagguggcccaucugccgcagagcgacgccucgaagccuuaaccagagagcuggagagggcucuugaagcgcggacagcacgcgauuacuucgggauuugcauaaaauguggauugggcaucuauggugcccagcaggcuugccaagccauggggucccuguaccauacugacuguuuuacgugcgauagcuguggcagaaggcuacguggaaaggcauucuauaacgugggcgagaaaguauacugccaggaagacuuucucuauucgggguuccagcagaccgccgauaaguguucugugugcggacaccugauuauggagaugauccuucaagcucuggguaaauccuaccauccgggcuguuuucggugcucagucugcaaugaauguuuggacggggugcccuucacaguugauguggagaacaauauuuacugcguccgagacuaucacacuguguuugccccuaagugugcaaguugcgcgagaccaauccuccccgcucagggaugugagaccacaauaaggguaguuagcauggaccgcgauuaccauguggccugcuaucacugugaagacugcggccugcaguuauccggugaggaagggcggagauguuacccucuggcaggccaccuccuuugcaggcgcugucaucugcgacgguugcagccaggaccccuaccgucuccuaccguccacgugacugagcuguga

SEQ ID NO: 64876 - RNA, 3360 nt, Artificial Sequence
  derived and/or modified sequence opt3 from WWC1__Homo_sapiens__NP_001155133
augcccagaccugagcugccacucccggaaggcugggaggaagccagggacuucgaugggaagguguacuauaucgaccacaccaaccggacaacuagcuggauugauccccgcgaccgauacacgaaaccucuuaccuuugcugauugcauauccgacgagcugccauugggaugggaagaggcauaugauccccaggucggugacuacuucaucgaucauaauacaaagacuacccaaauugaggacccucguguucaguggagaagggaacaggagcacauguuaaaagauuaucuggugguagcccaggaagcgcuaucugcucaaaaggagaucuaccaggugaaacagcagcggcucgagcuggcccaacaggaauaucagcagcuucaugcagucugggagcacaagcugggcucacaagugaguuugguuagcggguccucuucgucaagcaaguacgacccagaaauucucaaagccgagaucgcuacagcaaagagucgcgugaacaaacugaagagagaaaugguccaucugcagcacgagcuccaguuuaaagagaggggauuccaaaccuuaaagaagauagauaaaaagauguccgacgcccagggcucuuacaaacuggacgaagcucaggccgugcuucgggagacuaaggcgaucaaaaaggcaauuacauguggugaaaaagagaagcaggauuugaucaagagccuggccaugcuaaaagacggguuucgcaccgaucgaggaucccacucagaccucuggaguucuagcuccucacuggaaagcaguucuuucccccuuccuaagcaauaucuggauguauccagccagacggacauuucgggcucuuuuggcaucaauuccaacaaucaguuggcugagaaaguuagacucaggcugcgguacgaggaagccaagcgucgcauagcaaacuuaaaaauucagcuggcuaagcucgauucagaggccuggccaggggugcuugacagugaaagagauaggcugaucuugauuaaugagaaggaagaacuacugaaagagaugcgguucaucagcccgcgaaaguggacucaaggagaagucgagcagcucgaaauggcgcgcaaaagacuggagaaggaccuucaggccgcaagggauacccaguccaaagcucugacagagcgguugaagcucaacucuaagcgcaaucaacuggugagagaauuagaggaagccacucgucagguggcuacccugcauagccagcuaaaaucacucaguuccagcaugcagucucugucaagugguagcucccccggcucucuuacaucgagcaggggguccuuggucgccucaagucuggacucuagcaccuccgcaucauuuacggaccucuauuacgauccuuucgagcaacuggacagcgaacuucagucuaagguugaguuucuguugcucgagggagccacuggcuuccggccauccgguugcaucacaaccauucacgaagaugagguggcuaaaacucagaaggcggaagggggaggccgacugcaagcauuaagaagucugagcggcacacccaaaucuaugaccucccuaucaccuaggaguagccucucguccccaucucccccguguagcccucugauggccgacccccuuuuggcuggggaugccuuucugaacucacucgaguucgaagacccagagcugagugcaacguuaugcgagcugucccuuggaaauucugcccaggaacgcuaucgguuggaggaaccugguaccgagggcaagcagcucgggcaggcuguaaacacagcccaaggauguggccugaagguggcaugcgucagcgcggcuguguccgaugaaucaguugccggugacagcgggguguacgaggcaaguguccagagacuaggcgccucugaggcugccgcauucgauuccgacgaaagcgaggcugugggagccacuaggauacagaucgcgcugaaauaugaugaaaagaauaaacaguuugccauucucaucauacaacugucgaaccuuucagcuuugcugcagcagcaggaccaaaagguaaauauucgcguugcaguguuacccuguucugagaguaccacaugccucuuccgaacucggccacuggaugccuccgacacccuugucuuuaacgagguguucugggucagcaugucuuaccccgcucugcaucagaaaacauugcguguggacguuuguaccacugauagaagccaccucgaagagugccugggcggggcccagaucucccuagcagaaguguguaggucaggagagcgcaguacgcggugguacaaccugcucagcuauaaguaccugaaaaagcaaucuagagaacuuaagccuguaggugucauggcgccagccuccggcccggcuucaacagacgccgugagugcauugcuggagcagaccgcuguugaguuagagaaaaggcaggaggggcgaagcuccacucagacccucgaagauucuuggcgcuaugaggaaacaucggagaaugaggccguggcagaagaggaagaggaagaggucgaggaagaggaaggagaggaggacguguuuaccgaaaaggccagccccgauauggacggcuacccugcucugaaaguagauaaggagacuaacacagaaacgccagcgcccucaccuaccgugguucggccaaaagacagaagggucgguacucccucccaagggccguuccuucguggcaguacaaucauucgcucuaagaccuuuagcccuggaccacagucccaguaugugugccggcugaauagaucagauucugacagcaguacacuauccaagaaacccccuuucgugaggaacagccucgagcgacggucuguccgcaugaagagacccucaccaccuccccagccauccaguguuaaaagccugaggucggaacgguugauccgaacuucucuggauuuagagcucgaccugcaagccaccagaacguggcacucccagcuuacccaggagauuagcgugcugaaggaauugaaagagcagcucgaacaagcaaagucacauggcgagaaggaacugccgcaguggcuacgcgaggaugagagguuucgucugcuucuccggaugcuggagaaaagacagauggacagggcugaacacaagggggaauugcagacagacaaaaugaugcgcgccgccgcuaaggaugugcaucgacugagaggacaaaguugcaaagagccucccgaaguacagucuuuccgggagaagauggcauuuuucacuaggccacgcaugaauauacccgccuuauccgcggacgaugucuga

SEQ ID NO: 64877 - RNA, 3579 nt, Artificial Sequence
  derived and/or modified sequence opt3 from WWC2__Homo_sapiens__NP_079225
augcccagaagggccggcagcgggcagcugccucucccacggggaugggaggaagcucgcgacuacgaugguaagguguucuauaucgaccacaacacccgacguacauccuggauugauccgagagacaggcuuacuaaaccccugucuuuugcagauugcgucggcgacgaguugccuugggggugggaagccggauucgauccacaaauaggcguuuacuauaucgaccauauuaauaagacgacccagaucgaggauccccggaaacaguggcgcggugaacaggagaagauguuaaaagacuaccugucaguggcgcaagaugcucuaagaacacagaaggagcucuaucacguaaaggaacagaggcuggcccuugcacuggacgaguacgugcgguugaacgaugccuauaaagaaaagaguagcucccauacuucucucuuuucggggucaagcaguuccaccaaauacgacccugacauucugaaggcugagaucucuacaacccgccugcgagucaaaaagcucaagagagaguuaagccagaugaaacaagaacugcuuuacaaggagcagggauucgaaacuuugcagcagauagauaaaaagauguccggcggccaaucaggguaugagcugagugaagcaaaagccauccuaacagagcucaagagcauuaggaaagcuaucucuuccggagagaaggaaaagcaggaccugaugcagucacuugccaaacugcaagagcgguuucacuuggaucagaauauuggucguagcgaaccagaccuccgcuguagucccgugaacucucaucugugcuuauccagacagacccuggaugcgggcagccagacgucgaucucuggggacauaggaguuaggucccggucaaaucucgcagagaaggugcgacuuagucugcaauacgaagaggccaaacgcagcauggcuaacuugaagauugagcuauccaaacuggauucugaagccuggccuggcgcacucgacaucgagaaggaaaagcugaugcuuauuaaugagaaagaagaacuguugaaggagcuccaguucgucacuccacagaaaagaacccaggaugaacuggagagguuagaagcugagcggcaacgccuggaggaggagcuacucagcgugagagguacaccgucaagggcccuggcggaacgucuucgguuggaggaacgaagaaaggagcugcuccagaaacuggaggaaacuaccaagcugacaaccuaucugcacagucaguugaagucccucagcgccucuacgcugucaaugaguagcggguccucuuuaggaucgcuggcaagcuccaggggcucacuaaacacaaguucucgcggcagccucaauucccugucaagcacugagcuuuacuauucuucccagagugaccaaaucgauguagacuaccaguauaaauuggacuuucugcuccaggaaaagagcggguacauccccucuggaccuauuaccacuauacacgagaacgaaguugugaaauccccaucacagcccggucaaaguggccuguguggggucgcugccgcugccacaggacauaccccuccauuagcagaggcccccaagagcguggcuucgcuguccucucggagcucacuuaguuccuugucuccgccuggcagcccccucgugcuggaggguacguucccaauguccucaagccacgaugcgagucuacaucaguuuaccgcagacuucgaagauugcgagcugucuucccacuuugccgacaucagccucauugaaaaucagauccugcuugauucggacucagggggcgcuucucaaaguuuguccgaggauaaagaccugaacgaaugugccagagagccuuuauacgagggaacagcagaugucgaaaagagccuccccaagaggcgcguuauacaccuucuuggcgagaaaacuaccugcgugucugccgcuguaagcgacgaauccguggccggggauucaggagucuaugaggcauucgugaagcagccaagugagauggaagacguuacauacagcgaggaagauguggcgauugucgagacugcucaggugcagaucggucugcgauauaaugccaaaucuuccucauuuaugguaaucauugcacaauugcggaaccuccaugccuuccugaucccccacaccaguaagguuuacuuccguguggcuguccuaccuagcuccacagacgugucuugucuguuuagaaccaaaguccauccaccgacugaaucgauucucuucaaugacguguuuaggguugccauaagccagacggcacugcagcagaagacacuucgcguggauuugugcucaguauccaaacaccggagagaggagugucuggcuggcacccaaaucaguuuagccgaccuccccuucucuagcgaagucuuuacucugugguauaaccuucugccuuccaagcagaugccaugcaagaaaaacgaggaaaaugaggauucaguguuccagcccaaccagccucuaguugacucuauugaucucgacgcggugagcgcccuguuggcuaggaccagugcagaacuguuagccgucgagcaagagcucgcucaggaagaggaagaggaauccgggcaggaggagccacgaggacccgauggcgacuggcugacaaugcuucgcgaagccagcgaugagaucguggcagaaaaggaggcggagguaaaacugccggaagacucuucauguaccgaggauuuguccaguugcacuagcgugccugaaaugaaugaggacgguaaccggaaggaaucgaauugcgccaaagaucucagaucucaaccacccacaaggaucccuacgcugguugacaaggagaccaacacugacgaggcugccaaugauaacauggcaguccgucccaaggaacgcuccagccuaucaagucggcagcauccauuugugagaucuuccgugauugucaggagccagacauucucaccuggggagcgaaaucaguacauaugucggcugaaccgcagugacagcgauuccucuacccuugcuaaaaagagccucuuuguuagaaauuccacagaaaggcggucacugcgagugaaaagaacugugugccaaucuguauugcgcaggaccacgcaggagugucccguccguaccagucuggacuuagaacucgaucugcaggccucgcuuacacggcagagcagacugaacgacgaguugcaagcacucagggaucugcgccagaagcuagaggaacugaaagcccagggcgagacugaccuuccaccgggagugcucgaagaugagcgauuccagagacuguugaagcaagcugaaaagcaggcggagcaguccaaagaggaacagaagcaaggcuuaaaugccgagaaacugaugcggcagguuucuaaggacgugugcaggcuccgcgaacagucacaaaaagucccucgucaggugcagagcuuuagagagaagaucgcauauuucacccgggcuaagauuuccauccccagucugccagccgaugacguuuga

SEQ ID NO: 64878 - RNA, 906 nt, Artificial Sequence
  derived and/or modified sequence opt3 from WWOX__Homo_sapiens__NP_001278926
auggagauccugcagggcagagacuucaccgggaagguggucguugugacaggagccaacagcgguauuggcuuugaaacugcuaaauccuucgcacuccacggggcccauguaauacuugcgugcaggaauauggcucgggccucugaggcagugucacgcauccuggaagaguggcacaaggccaaagucgaagcuaugacguuggauuuagcacugcuacgaagugugcaacauuuugccgaggcuuucaaggccaaaaacguuccccuccacgugcuggucuguaaugcggcaaccuuugcccuuccuuggagccugacaaaggacggauuggagacuaccuuccaggugaaccaucucggccacuuuuaccugguacagcugcuccaggauguuuuaugccguuccgcuccagccagagugauugucgugucuucggaaucacacagguucacagacaucaaugauagccuggguaaacuugacuuuagucgguuguccccgaccaagaacgauuauugggcaaugcuggcuuacaaucgcucuaagcuauguaacauucucuucagcaaugagcugcauagaaggcuuucaccccgcggggugacuuccaacgccguccacccuggaaauaugauguauaguaacauccaucggagcugguggguuuacacacuguuguuuacccucgcgcgaccauucacgaaaucuaugcaacagggcgccgcaacuaccguguauugcgcugccguacccgaacuggagggcuuagggggaauguacuuuaauaacuguugcagauguaugccuuccccagaggcucagucagaagagacagccaggacucugugggcacucagcgaacggcuuauacaggagcgucuggguagucaaucuggcuga

SEQ ID NO: 64879 - RNA, 2769 nt, Artificial Sequence
  derived and/or modified sequence opt3 from WWP1__Homo_sapiens__XP_005250817
auggccaccgcuagccccagauccgacacaucuaacaaucacucaggcaggcugcagcuccaagugacugucaguagcgcaaaacuuaagcggaagaaaaacugguucgggacggccaucuacaccgagguugugguagauggagaaauuacaaagacugcgaaauccucuucgucaagcaauccuaagugggacgagcagcugaccgugaacgucacaccacagaccacuuuggaauuucagguguggagucaucgcacauuaaaggcugaugcccugcuagguaaagcaaccauagaccucaagcaagcccugcuuauccacaaucgaaaacuggagcguguuaaggaacaguugaaacucucccuggagaacaagaauggcauugcucagacgggggagcugacugugguccucgauggauuagugaucgaacaggagaacauuaccaauugcucuagcuccccgacaaucgaaauacaagagaacggcgacgcacugcaugagaauggugaacccucagccagaacuaccgcuaggcuugccguagaggggacaaacggaaucgauaaucacguuccuaccaguacguuggugcagaacagcuguugcucuuaugucgugaauggcgacaacacuccauccucacccagccagguggcggcacggccuaagaacacaccagcccccaaaccucuggcuagugaaccagccgaugacaccgucaauggcgagucuuccagcuucgcaccgacugauaacgcuucgguuacagggacccccgugguaucugaagagaaugcccuauccccuaacuguacgucaaccacaguggaggacccacccguccaggaaauucucacuagcagcgagaauaacgaaugcaucccuuccaccucugcggagcuggaaagcgaggcccgcucaauucuugagccagauacaaguaauuccagaaguucuucagcauuugaagcugccaagaguaggcaacccgacggauguauggacccggugcggcagcagagcgguaacgcuaauacugagacccugccuuccggcugggaacaacgcaaagauccccaugggcgaacauacuauguugaccacaacaccagaacuacgacaugggagaggccacagccuuugcccccaggaugggaacggcguguggaugaccgcagaagggucuacuauguggaucacaauacccggacuaccacauggcagcgacccaccauggagucuguacgcaacuucgagcaguggcaaucgcagagaaaucagcuccagggcgccaugcaacaguuuaaccagagguaccuguauagcgcauccauguuagccgcugaaaaugacccuuacgguccacugccgcccgggugggagaagcggguugauucaacugaccgcguguacuucgucaaccauaacacaaaaacgacccagugggaagauccuagaacucaaggacuccagaaugaggagccacuucccgaaggcugggagaucagguauacacgugaaggcgugcgguacuuugucgaccacaacacccgaacaacuaccuucaaggauccuagaaaugggaaaaguucugugacgaagggagguccacagauagcguaugagaggggcuuucgcuggaagcuggcacauuuccgguacuugugccagagcaacgcccuacccucccacguuaaaauuaaugugucaagacaaacccuguuugaagacagcuuccagcagaucauggcucucaagccguaugaccugaggcgccgacuuuacguaauuuuucguggggaggagggacuggauuauggcgguuuggcccgggaaugguucuuccuccugucucacgaggucuuaaacccuauguacugucuguuugaauacgcagggaaaaauaacuauugccuacaaaucaauccagccuccacaaucaaccccgaccaucucaguuacuucuguuuuauuggcagauucauagcuauggcccuguuucacggaaaguucaucgauacuggcuuuagccuuccuuucuauaaaaggauguugucuaagaagcugaccauuaaagaccucgaguccaucgauacagaauuuuacaauucacugauauggauucgcgacaacaauaucgaggagugcgggcuugaaauguauuucaguguggauauggagauccugggaaagguuacuagccaugacuugaaacucgguggcucgaacauucuggugaccgaagagaauaaggaugaauacaucggguuaaugacggaguggcgguuuuccagaggaguccaggagcagacaaaagcauuccuggacggcuuuaacgaagugguaccccuacaguggcuccaauauuucgaugagaaggaacuggaggugaugcuuugugguaugcaggagguugacuuggcggauuggcagaggaacaccgucuaccgacacuacacucgcaauucuaagcagauuauaugguucuggcaauuugugaaagaaacagacaacgaggugcggaugagacugcuccaguucgucaccgggacuugcaggcugccauuaggcggauuugcugaacugaugggcagcaaugggccucagaaguucugcaucgagaaaguuggaaaggacaccuggcuuccccguucacauacauguuuuaaccgcuuggaucucccaccguauaaaaguuacgaacagcugaaggagaagcuacuguucgccauugaggaaacggaggguuuuggccaagaauga

SEQ ID NO: 64880 - RNA, 1008 nt, Artificial Sequence
  derived and/or modified sequence opt3 from WWP2__Homo_sapiens__NP_001257384
auggccagcgcuuccucuucaagagcaggcguggcccugcccuucgagaagagucagcucacccuuaaagucguuagcgcgaagccuaaagugcacaacaggcaaccacggaucaauuccuacguagaaguggcugucgacgggcugccgucugagacaaagaaaacuggaaagcgcauugguucgucagaauuguuauggaacgagauaaucauucugaaugugacggcccagagccaucuagaucucaagguuuggaguugccacacccugcgaaacgaacuucugggcacagcauccgugaauuugucuaacguccucaaaaauaacgggggaaagauggagaauaugcagcugacucugaaccuccagaccgagaauaaaggcagcgugguauccgguggggaauuaacaaucuuucuggacggacccaccguugaucuuggcaacgugccuaauggcucagccuugacugacgggagucaacugccaagccgugauucuuccggaacagcugucgcacccgagaacagacaucagccuccaucaaccaauuguuucgguggcaggagccggacgcaccgccauaguggggccucugcuagaacuacccccgccacaggagaacaguccccuggcgcgaggagccggcaccgccagccagugaagaacucgggucacucugggcuagcaaacggaacugugaaugacgagccgaccacagccaccgaucccgaggaaccuuccgucguuggcgugacgucaccacccgcugccccucucaguguaacuccaaaccccaauacaaccagccugccggcuccugcaacucccgccgagggcgaggaaccauccacaucugggacccaacagcuuccugcggccgcacaggcucccgacgcccugccagcuggaugggaacagcgagaguugcccaacgguagaguguauuacgucgaucauaauacgaaaaccacaacuugggagaggccucucccaccgggcuga

SEQ ID NO: 64881 - RNA, 1203 nt, Artificial Sequence
  derived and/or modified sequence opt3 from WWTR1__Homo_sapiens__NP_001161750
augaaccccgccagcgcuccuccaccgcugcccccuccaggccagcaagugauccacgucacccaggaccucgauacagaccuugaggcacuguucaauuccguuaugaaccccaagccuucuucauggaggaaaaagauuuugccagaaaguuucuuuaaagagcccgauagcgggucccauucuagacagucgucaacugacagcaguggaggucacccuggcccacgguuagccgggggagcgcagcaugugcgcucccacucuagcccggcuucccugcaacuaggcacgggugccggggcagccggaucacccgcucagcagcaugcacaccuccgacagcaaaguuacgauguaaccgacgaacugccucuuccacccggcugggagaugacauuuacugccaccggccagcguuauuuccugaaucacauagaaaagaucacaaccuggcaggauccuagaaaagcuaugaaccagccauugaaucauaugaaccuccaccccgccgugagcucuacuccggucccucaaagguccauggcggugucacagcccaaucugguuaugaaccaucagcaccaacagcagauggcaccaagcacacugagucagcaaaaucacccuacccagaaucccccagccgggcucaugucuaugcccaacgcuuuaacgacucagcagcaacagcagcagaagcugcggcuucaacgcauucagauggagagagagaggauccggaugcgccaggaagaguugaugcgacaggaagccgcacugugcagacaacuaccuauggaggcugagacccucgccccagugcaggcggccgucaacccgcccacaaugacuccugacaugagguccauuaccaauaacagcucggauccauuucugaauggaggucccuaccauucucgggaacaguccacagacucaggccuugggcugggauguuauagugugccuaccacgccagaggauuucuugagcaacguagacgaaauggauacuggcgagaacgcaggucaaacacccaugaauaucaacccgcagcagacccguuuuccugacuuccucgacugccugccagggacuaauguugauuuaggaacacuggaauccgaggaccucauaccccuuuuuaacgauguggagucugcucugaauaagagcgaaccuuucuugaccuggcuauga

SEQ ID NO: 64882 - RNA, 2568 nt, Artificial Sequence
  derived and/or modified sequence opt3 from XAB2__Homo_sapiens__NP_064581
augguggucauggccagacugagcaggcccgagcggccugaccucguuuucgaagaggaagaucuuccauacgaggaagagaucaugcgcaaccaguuuuccgugaagugcuggcugcgauauauugaguucaaacaaggcgcuccgaagccccguuugaaucaguuauacgaaagagcacugaaacuacucccuuguucuuauaagcugugguacagguaucuuaaagcccggcgcgcgcagguaaagcacagaugcgugaccgacccagcuuacgaggaugucaacaauugucaugaaagggccuuuguguucaugcacaagaugccccggcugugguuggacuauugccaguuucucauggaucaagggcgcguuacacauacucgaagaacguucgacagggcacugcgggcccugccuauaacccagcacucacguaucuggccacucuacuuacgcuuucugagaagucauccccuuccugagacagcugugaggggauaccggcgauucuugaaacugagcccagaguccgcagaagaguauauugaauaccuaaagucuucggaucgccucgacgaggccgcucagagacuggccacugucgugaacgaugaaagguuuguaucaaaagcggguaagagcaauuaucagcuuuggcacgagcugugugacuugaucagucaaaacccggauaaaguucagucccucaauguggacgcaauuauccggggcgggcugacccgcuucacagaucaguuaggaaagcuguggugcucucucgccgacuacuauauaagaagcggccacuuugagaaggcuagggacgucuacgaagaggccauccguaccgugaugacugugcgggauuucacacaggucuuugacuccuaugcacaauucgaagagucaaugauugcugccaaaauggaaaccgcgagugagcuuggucgagaggaagaggaugacguugaucuggaauugagacuagccagguucgagcagcugaucagccgccggccccuccugcuuaacucugugcuguugagacagaauccucaucacguacaugaauggcacaagaggguggcacuccaccaagggcgcccacgagagauuaucaacacguacacugaggcuguccagaccguggaccccuuuaaagccacaggaaagccucauacucuguggguugcuuucgccaaauuuuacgaagauaauggccaguuagacgaugcacgggugauacuggagaaggccaccaaagucaacuucaaacagguggacgaucuagcuuccguauggugucaaugcggcgaacucgagcugcgucacgagaauuaugacgaagcgcuuagauugcugaggaaggcaacagcccucccagcucgccgggccgaguacuuugacgggucagaacccguucagaacagaguguauaagagccugaaggucuggaguaugcuugcagaucuggaggaaucuuugggaaccuuccaguccacgaaagccguguacgacaggauucucgaucugcgaaucgcuacuccgcagauugucaucaauuaugccauguuuuuagaggagcauaaguacuucgaagagagcuuuaaagcauaugaacgcgguaucucgcuguucaaguggccuaacgugucugacauuugguccacauaccuaaccaaguuuauagcgcgguacggcgggagaaaacucgagagggcucgugaucuguucgaacaagcccuugacggaugucccccaaaguaugcaaaaacuuuguaccugcucuaugcccagcuggaggaggaauggggcuuagcucgccacgccauggcaguuuacgagcgggcuacaagagccguggaaccugcgcagcaguaugauauguuuaacaucuacauuaagagggccgcugagaucuaugguguaacccauacgcgagggauauaccaaaaagcaauugaaguccugucagacgagcacgcccgggagaugugccuucgcuucgcugauauggaauguaaguugggagagaucgacagagccagggcaaucuacaguuucugcagccagauuugcgauccccggaccacaggcgcguuuuggcagacuuggaaggacuucgaagugcgacacggcaaugaggauaccaucaaagagaugcuccgcauuagaagguccguucaggccacauauaacacucaagugaauuuuauggcuucucagaugcugaaggucagcgggucagccaccggaacagugagugaccuagcaccaggucaguccggcauggacgauaugaaacugcucgaacaacgugcugagcagcuggccgcagaagccgagcgggaccagccccuuagagcucagagcaagauauuguucguaaggucugaugcgucacgcgaggaacuggccgaguuagcacaacaggugaacccugaagagauccagcucggggaagacgaggaugaagacgagauggaucuggagccaaaugaaguucgacuugagcagcaaagugucccggcugccguguuuggaagccugaaagaagacuga

SEQ ID NO: 64883 - RNA, 906 nt, Artificial Sequence
  derived and/or modified sequence opt3 from XAF1__Homo_sapiens__NP_059993
auggagggcgacuucagcgugugcagaaacuguaagaggcacgucguuuccgccaauuuuacccugcaugaggcuuacugccuccgguuccuugugcugugucccgagugcgaagaaccuguaccaaaagaaacaauggaggagcacuguaaguuggaacaucagcaaguggggugcacuaugugucagcagucuaugcagaaaucaaguuuagaguuucacaaggcaaacgaaugccaagagcgcccggucgaguguaaauucugcaagcuggauaugcagcuaagcaagcucgaacugcaugaguccuauuguggaucucgaacggaacuuugccaggguugcggccaguuuaucaugcaccguaugcuggcccaacacagagacguguguaggucggagcaggcgcaguuggggaaaggagaacggauuucagcucccgagcgcgagauauacugccauuauuguaaucagaugaucccugaaaacaaguacuuccaccauaugggcaaaugcuguccagauagcgaguuuaagaaacacuuccccguugguaauccugaaauucucccaaguucccugcccucucaagccgcagagaaccagaccagcacaauggaaaaggacgugagaccuaagacuagguccaucaaucgguuuccacugcacucagagaguagcucuaaaaaggccccgcgcuccaaaaacaagacccucgaucccuuacugaugucagagccuaaaccacgaacaagcagucccagaggggacaaggcugcauaugauauucuuaggcggugcucucaguguggaaucuugcugccucuaccaauacucaaucaacaucaggaaaaaugccguuggcuggccuccagcaagggcaagcagguccgcaacuucucguga

SEQ ID NO: 64884 - RNA, 210 nt, Artificial Sequence
  derived and/or modified sequence opt3 from XAGE1B__Homo_sapiens__NP_001091065
auggagagccccaagaaaaagaaccagcaacugaaagugggcauccuccaccuuggguccagacagaagaaaauuaggauacagcugcggucucaggucuugggacgcgaaaugcgagacauggagggugauuuacaagaacugcaucagucaaauaccggcgacaagaguggguucggauuucguagacagggcgaggauaacacauga

SEQ ID NO: 64885 - RNA, 246 nt, Artificial Sequence
  derived and/or modified sequence opt3 from XAGE1E__Homo_sapiens__NP_001091073
auggagagccccaagaaaaagaaccagcaacugaaagugggcauccuccaccuuggguccagacagaagaaaauuaggauacagcugcggucucagugcgccaccuggaaggucaucuguaagucaugcauuagucaaacaccuggaaucaauuuggacuuagguagcggcguuaaagugaagauuaucccaaaagaggaacauuguaagaugccggaagcuggggaggaacagccccagguauga

SEQ ID NO: 64886 - RNA, 1131 nt, Artificial Sequence
  derived and/or modified sequence opt3 from XBP1__Homo_sapiens__NP_001073007
augguggucguugccgcugcacccaacccugccgacggcaccccaaaggugcugcuccuuagcgggcagccggcguccgcugccggagcacccgccggucaagcucugccuuugaugguaccagcacagagaggcgccucucccgaggcugccucagggggauuaccucaggcgaggaaacggcagcgccugacacaccuaaguccagaagagaaggcacuccgacguaaacugaagaauagaguggccgcucaaacugccagggaucggaaaaaggcacgcaugagcgaacuugagcagcaggucguggaccuggaagaggagaaccagaaguugcuccuggaaaaucaacugcucagagagaaaacgcauggcuuaguuguggaaaaccaggagcugaggcagcggcuugguauggaugcuuuggucgccgaggaagaggcggaagccaaggggaaugaggugcgccccguagcaggauccgcugaaucugccgcuggcgccggcccuguugugaccccaccggagcaucugcccauggacucagggggaaucgauucgagcgacagugaguccgauauucuacucgguauacuggacaaccuugauccugucauguucuuuaaaugcccaucucccgaaccugcaagccuggaggaauugccagagguguaccccgaaggcccguccucacucccugccagucugagcuuaucuguggggacauccucagcuaagcuggaggcgaucaaugagcucauucgauucgaccacaucuauacuaaaccccuuguccuggaaauuccaagcgagaccgaaagucaggcaaacguugugguaaagaucgaggaagccccuuugucucccuccgagaaugaucacccagaguuuauagugagcgucaaggaggaacccguggaagacgaucuaguuccugagcugggaaucucgaaccuccugucuuccucacauuguccaaaaccgaguagcugccuucuggacgcuuacuccgacuguggcuauggugggucuuugagccccuucucagauaugaguucccuccugggagugaaucacagcugggaggacacauuugccaacgaauuauucccucaacugauuucugucuga

SEQ ID NO: 64887 - RNA, 345 nt, Artificial Sequence
  derived and/or modified sequence opt3 from XCL1__Homo_sapiens__XP_011508167
augagacugcucauccuugcccuguugggcauuugcagcuuaaccgcuuacauaguggagggggucggauccgaaguuucugacaagaggacaugugugucacugacuacgcagcggcuacccguaagucgcaucaaaaccuauacaauuacugaggguagccuccgagcagugaucuucauuaccaagcguggccugaaagucugcgccgauccucaagcgacaugggugagagacguugugagguccauggaucggaagucuaacacccgcaauaacaugauccagacuaaaccaacagggacccagcagucgacgaauacugcugucacccuuacaggauga

SEQ ID NO: 64888 - RNA, 345 nt, Artificial Sequence
  derived and/or modified sequence opt3 from XCL2__Homo_sapiens__NP_003166
augagacugcucauccuugcccuguugggcauuugcagcuuaaccgcuuacauaguggagggggucggauccgaaguuucucacaggcggacaugugugucacugacuacgcagcgccuacccguaagucgaaucaagaccuauacaauuacugaggguagccuccgugcagugaucuucauuaccaaaagaggccugaaggucugcgccgacccucaagcgacaugggugagggauguugugcgguccauggaccgcaaaucuaacaccagaaauaacaugauccagacuaagccaacagggacccagcagucgacgaauacugcugucacccuuacaggauga

SEQ ID NO: 64889 - RNA, 1002 nt, Artificial Sequence
  derived and/or modified sequence opt3 from XCR1__Homo_sapiens__NP_001019815
auggagagcuccggcaaccccgaaucuaccacauucuuuuacuaugaccugcagucacaaccuugcgagaaucaggccuggguguucgcuacucucgcaacgaccguccuuuacugucugguuuuucuuuuaagucugguggggaacagccuaguacucugggugcuggucaaguaugaaucccuugagucucugacaaauaucuucauuuugaaccucugccugucggaucugguguuugccugucucuuaccaguuuggauaucaccguaccacuggggaugggugcugggugacuuccuuugcaaauugcugaauaugaucuuuagcauuagucuauauuccucuaucuucuuucucacuauuaugaccauccauagauaccugagcgucgugucccccuugucaacacugaggguaccuaccuugcggugucgcguucucgugacuauggcggucuggguggcuaguauacugagcucuaucuuagauacaauuuuccacaaggugcuguccucaggcugcgacuauagcgaacucaccugguaccuuacgagugucuaccagcauaaccuguuuuucuugcuaucucuggggaucauucucuuuuguuauguugagauccugcgaacucuuuuccguuccagaagcaaaaggcggcaccgcaccgugaagcugauauucgccauuguaguggcauacuuuuugucguggggaccauauaauuucacacucuuucugcagacuuuauucagaacccaaaucauuaggucuugcgaggccaaacagcagcuggaauacgcucuacucaucugucggaaccuggcauuuucccauugcuguuucaaucccguccuuuauguguuuguuggcgugaaguuccgcacacacuugaagcacguccugcgacaguuuugguucugcagacuccaagccccuucaccagcuaguaucccccauagcccuggugccuuugcguacgagggggcauccuucuauuga

SEQ ID NO: 64890 - RNA, 4002 nt, Artificial Sequence
  derived and/or modified sequence opt3 from XDH__Homo_sapiens__NP_000370
augaccgccgacaagcugguguucuuugucaacggcagaaaaguuguggagaagaaugcugaucccgaaacaacucuccuugcauaccugaggcggaaauugggguuaagcggaacgaagcuggguugcggcgaagggggauguggcgccugcaccguaaugcuauccaaauaugaccgccuccagaacaagaucgugcacuucucugcgaaugcuugucuggccccuauuugcucacuucaucacgucgcagugacaacuguugaagguauagggaguaccaagacacgacugcauccagugcaagagcguaucgccaaaagccacggaucccaguguggcuuuugcaccccgggcauugucaugucuauguacacuuugcucagaaaccagcccgaaccuacaauggaggagaucgaaaaugcuuuccaggggaaccuguguaggugcaccggauaucggccaauucugcaagguuuucgcacguucgcaagagauggcggguguugcggaggcgacgguaauaaccccaauuguugcaugaaccagaagaaagaucauucggugucacucagcccuaguuuauuuaagccagaggaguucacuccccuggacccuacccaggagccaaucuuuccgcccgagcuuuugaggcugaaagauacaccucggaagcagcuacgcuucgaaggggagcgaguaacuuggauacaagccuccacccucaaggaacugcuugaccugaaagcucagcacccagaugccaaguugguugugggaaauacagagaucggcauugaaaugaaauuuaagaacaugcuguuccccaugaucgucugcccugcguggauuccagagcucaauucuguggagcacggccccgacgggaucagcuuuggagcagccuguccguuauccauaguggaaaagacccuggucgaugcuguugccaagcucccugcacagaaaacggagguguucagagguguacuugaacagcugaggugguucgcuggcaagcaagugaagucagucgccaguguugggggaaacauuaucacugcgagccccauuucugacuugaauccaguguuuauggccuccggcgcaaaacuaacacuggugucacgggguacccgucgcacuguccagauggaucauacauucuuuccuggguacagaaagacccuccugagccccgaggaaauccuucugaguaucgagauuccauauucuagggagggcgaauacuucuccgcuuuuaaacaggccagccggcgagaggacgacauagcuaaggugacgucgggaaugcgcguauuguucaaacccggcaccacagaaguucaagagcucgcccugugcuaugggggaauggcaaacagaacuaucucugccuuaaagaccacacagaggcagcuguccaagcuauggaaagaggagcuccugcaggaugugugugcuggucuugcggaggaauugcaucugccuccagacgcaccgggcgggauggucgauuuucggugcacucucacccugucauucuuuuucaaguuuuaccuuacagugcugcaaaaauugggacaggagaaccucgaagacaaguguggcaaacuggaucccaccuucgccagugcuacuuuacuguuucagaaggacccuccagccgauguccagcuauuccaagaggugcccaagggucagagcgaggaagacaugguugggcgcccucucccacaccuggcagccgauaugcaggcuuccggcgaggccguguacugcgacgauauucccagauaugaaaaugagcuuucuuugaggcugguaacgagcacacgugcacacgcgaaaaucaagucaauagacaccagugaagcuaaaaaggucccgggauucguguguuuuauuuccgccgacgauguuccuggcagcaacaucacugggaucugcaaugacgagaccguguucgcaaaagauaaggucacaugugugggacacauuaucggugccguaguggcugacaccccagagcauacucagcgggccgcacaaggcguuaagauuacauacgaggaacuccccgcuauaaucacgauugaagaugccaucaaaaacaauucuuuuuaugggccugagcugaagaucgaaaaaggagacuuaaagaaaggcuucucagaggcggauaacgucgugaguggugagauuuacauagggggccaggaacacuuuuaucuggagacccauugcacuaucgccgugcccaagggagaagcuggcgagauggaacuuuucgucagcacacagaauaccaugaaaacacaguccuuuguugcaaagauguugggggugccagccaaccgaauugugguaagagucaagaggaugggaggcgguuucgggggaaaagagacucgcucuaccgugguuucgacggcuguggcccucgcagcguacaagaccggccggccugucagauguaugcuggacagggaugaggacaugcuaaucacagguggccgccaccccuuucuggcccgauauaaagugggguucaugaagacuggaaccguuguggcucucgaaguagaucauuuuagcaaugucggcaacacacaagaccugucccagucaauuauggagcgggcccuuuuccacauggauaauugcuacaaaaucccaaacauacgugggacuggaagauugugcaagaccaaucugccgaguaacacggcauuuaggggcuucggugggccucagggaauguuaaucgcugaauguuggaugucugagguggccgugacaugcggcaugcccgcagaggaaguccgccggaagaaucucuacaaagagggugaccugacccacuucaaccaaaaacuugaaggcuuuacucugccaagauguugggaggaaugcuuggccagcucccaguaucaugcuaggaaaucagagguugacaaguucaacaaagagaauuguuggaagaagcgagggcucugcauuauccccacaaaauuuggaauuagcuucaccgugccuuuucugaaccaggcgggcgcccuacugcacguauacacugaugggucugugcuccugacccauggaggcacagaaaugggucaggggcuucacacgaagaugguccaaguggcaucccgcgcuuugaaaaucccaaccaguaagauauauauuagcgagacuucuacaaauaccguucccaacacauccccuacugccgccucagugagugcugaccugaauggacaggcagucuacgccgcgugucagaccaucuuaaaacggcucgaaccguauaagaagaaaaacccaagcggcucgugggaggauugggugacggcugccuacauggacacaguuucccugucugcaaccgguuucuauagaacucccaaucuuggcuacagcuuugaaaccaacucagggaauccuuuccacuacuuuaguuauggaguggccugcuccgaggucgagauugauugucugacaggcgaccauaagaaccuaaggacugauaucguaauggacguggggucuagccucaauccagcuauagauaucggacagguugaaggcgcauucgugcaaggucugggguuguuuacccuggaggaauuacacuacucccccgagggaucacuccauacacguggcccuagcacguauaaaauuccggccuucggcaguauccccauugaguuccgcgucucucugcuucgggacugcccaaacaagaaagcgaucuacgcuuccaaggccgugggggaaccuccccuguuuuuggcagccagcauauucuuugcuauuaaagaugccaucagagcagcuagggcccagcacaccggaaauaacguaaaggaacucuuccgacuggacucgccagcgacuccugaaaagauccggaaugccuguguggauaaauuuacaacccuaugcgucacugguguucccgagaacugcaagccauggucagugcgcguguga

SEQ ID NO: 64891 - RNA, 588 nt, Artificial Sequence
  derived and/or modified sequence opt3 from XG__Homo_sapiens__NP_001135391
auggagagcugguggggccugcccugccucgccuuccuuuguuuucugaugcacgcuagagggcagagggacuucgauuuggcagacgccuuagaugacccugaaccaaccaagaaaccgaacuccgauaucuaccccaagccuaaaccacccuauuacccucaaccagagaaucccgacucuggagguaacauuuauccucggccaaagccgcgcccccagccucagccaggcaauucagggaacaguggaggcuacuuuaaugauguggaccgagaugacggucguuaucccccuagaccaaggccccggccgccugcugggggaggcggcgggggauacagcuccuaugguaacucugauaauacacauggccgcgggggauacagacugaacucgagguacggcaauacuuaugguggggaccaccauucaacguacggaaaccccgaaggcaauauggucgcgaaaauaguuagcccaaucgugaguguaguggucgugacccuacucggcgccgcagccuccuauuucaagcugaacaaucggcgcaacugcuuucgaacacacgagccugaaaauguuuga

SEQ ID NO: 64892 - RNA, 1494 nt, Artificial Sequence
  derived and/or modified sequence opt3 from XIAP__Homo_sapiens__XP_011529631
augaccuucaacagcuuugagggcuccaagacaugcgugcccgccgacaucaauaaagaagaggaguucgucgaagaauuuaacagacugaagacuuucgcuaauuuuccuucugggucaccaguuagugcaagcacgcucgccagggcgggauuccuuuacaccggugagggcgauacagugcgguguuuuuccugccacgcugccguagaccgcuggcaguauggggauucugcagugggacgacaucguaaagucucgccgaacuguagauucauuaauggcuuuuaccuggagaacucagccacucaaagcaccaauagugguauacagaacgggcaguauaagguggaaaauuacuugggauccagggaccacuucgcuuuagaucggcccucugagacacaugcagacuaucugcuacgcaccggccagguuguggauaucagcgacacuauuuacccuagaaacccagccauguauuccgaagaggcuaggcucaaaucauuucaaaauuggcccgauuacgcccaccugacaccucgggagcuugcgagugcaggccuguacuauaccgggaucggagaccagguccagugcuucuguugcgguggcaaguugaagaacugggaaccaugugaucgcgccuggagcgagcaucgaagacacuuucccaauugcuucuucgugcucgggaggaaccugaauauucggucugaauccgacgcuguaucaagcgaucguaacuuuccuaacaguacgaaucugccacgcaacccgucuauggccgacuacgaggcaagaaucuucacuuuuggaaccuggauauauuccguuaauaaagaacagcucgcuagggccggcuucuacgcguuaggugagggggacaaggugaaauguuuucacugcggaggcggccugacagauuggaagcccagcgaggacccuugggaacaacaugccaaaugguauccaggguguaaguaccuuuuggagcagaagggacaggaauauaucaacaauauucaccugacucauucgcuagaggaaugccucguccggaccacagagaaaacccccucucugacgcgacgcaucgaugacacuauuuuccagaacccuauggugcaagaggcaaucagaauggguuuuuccuucaaggauauuaaaaagauaauggaagagaaaauccagauuucaggcaguaauuacaagagccuugaagugcuggucgcugacuugguuaacgcccagaaagauuccaugcaagacgagucuagccagacaucacuccagaaggaaaucaguaccgaggagcagcugaggcgguuacaagaagagaagcugugcaaaaucuguauggaucgcaauauugcuauaguguuuguaccaugcgggcaccucgugacuuguaagcagugcgccgaagcagucgacaaaugucccaugugcuacacagugaucaccuucaagcagaaaauuuuuauguccuga

SEQ ID NO: 64893 - RNA, 3366 nt, Artificial Sequence
  derived and/or modified sequence opt3 from XIRP1__Homo_sapiens__NP_001185550
auggccgacacccagacacaaguggcucccacuccuacgaugagaauggcaaccgccgaggaucugccacucccgcccccuccagcgcuugaagaccugcccuugccuccacccaaggagagcuucuccaaauuucaccagcagaggcaggcuucugaauuacggcgccuguaccgacauauccacccugagcuacguaagaaccucgccgaagcagucgccgaggaucuggcugagguucuuggcucagaagaaccaacagaaggggacgugcaaugcaugagauggauuuucgagaauuggaggcuggaugcaauaggagagcaugaacggccggccgcuaaagagcccguauuguguggugacgugcaggccaccagucgcaaguuugaagagggcagcuucgcgaacuccaccgaucaggaaccuacaagaccacagcccgggggaggcgacgucagggcagcccgguggcucuuugagaccaaaccucuggaugagcugacuggucaagcuaaggaacucgaggccacagugcgcgaaccagcagcuucuggggacguucagggaacccgaauguuauucgagacgagaccccuggauaggcuuggcucgcggccgucauugcaggaacagagcccucuggagcuacguagugagauccaagaacucaagggcgacgugaaaaagacugucaaacuguuucagaccgagccccuuugcgccauucaggaugcggaaggggccauccacgaggugaaggcagcuugucgcgaagagauucaauccaaugccguaagaucugcuagguggcuguucgagacacggccauuggacgccaucaaccaggacccuagccagguucgagugauacgcggaaucucccucgaagagggugcaagacccgaugucucagccacuagguggauuuuugaaacccagccacuggacgcuauccgggagauuuuaguggaugagaaagacuuccaacccaguccugaucugaucccaccgggccccgacgugcagcagcagcaacaucucuuugaaacacgcgcgcuugauacccugaagggggacgaggaagcaggagccgaggcuccuccaaaggaagaggucguucccggcgaugugagaagcacguuguggcuauucgagacuaaaccucuggacgccuuuagggauaagguacaggugggucaccuccagcgugucgacccacaggacggggaaggacaccugucuuccgauucaagcagugcacuucccuucucucaauccgccccgcagcgggacgagcugaaaggcgaugugaagacauucaaaaauuuguuugaaacccucccucuggacagcauaggccagggggagguuuuagcucauggaucgccaucucgagaagaggguacugauuccgccggccaggcacaagggauuggaucacccguguaugcgaugcaggacaguaagggcagacugcacgcucuaacaagcgucuccagggagcagaucguggguggggauguacaaggcuaccgcuggauguucgaaacccagccucucgaccagcugggacggucucccagcacgauugauguugugagaggcaucaccaggcaggaggucguggccggggacgucggaacagcacgcuggcuuuuugaaacucaaccauuggagaugauccaucagcgagaacagcaggagcggcaaaaagaggaagguaagucacagggcgauccucagcccgaggccccaccgaagggggacgugcagaccauucguuggcuguucgaaacaugcccuaugagugagcucgcugagaaacaaggauccgaaguuacugaucccaccgccaaggcagaggcucagagcuguacauggauguuuaaaccacagcccguggacagaccuguaggcucuagggaacaacaucugcaggucucacaggugccagccggugagcgccagaccgaccggcacguuuucgaaacugagccccuucaagcgagugggagaccuugcggcaggcgaccggugcgcuauuguagccgggucgagauaccauccggacaggugucuagacagaaggaaguauuucaggcccuggaggcuggcaaaaaggaagaacaagaacccagggugaucgcagggucgauuccugccggaagcguucacaaguucacgugguuguuugagaacugcccaauggguucccucgcugccgagucaauccagggcgggaaucuguuagaggagcagcccaugaguccuucuggaaaccguaugcaggaaagccaagagacagcagcggaaggcacccugcgcacucuacacgccaccccggguauacuccaucacgggggcauucugauggaggcucggggacccggcgagcuuuguuuggccaaauacguccuguccgggacaggacagggccauccauauaucagaaaggaggagcucgugucaggugaacugccuaggaucauuugccagguguuacgacggcccgaugucgaccagcaagggcugcuuguucaggaggauccaaccggacaguugcaacucaaaccucugcgccuacccacuccaggcagcucugguaauaucgaggacauggauccggaacugcagcagcuccuggcauguggccuugggacauccguggcuagaacgggauuggugaugcaggagaccgaacaaggccugguagccuuaacugcauacagucuccagccuaggcugacaagcaaggccucugagcgguccucaguccagcuucuggcuaguugcauugacaaaggggauuugagcggacuccacucgcugcgaugggaacccccagcggaccccuccccugugccagccucugagggcgcacagagccuacaccccaccgagucaauaauccauguuccuccgcuggauccaaguauggguauggggcaccucagagcuuccggagccacacccugcccuccccaagccauuggcaaggcugugccacuggccggugaagcagcggcuccugcccagcuucagaacacugagaagcaggaagacucucauagcggccaaaaagggauggcagucuugggaaaguccgagggcgccaccacgacucccccagggccuggagcuccggaucuguuagcagccaugcagucacuccgcauggcgacagcugaagcccagagccugcaccaacaggugcuuaauaaacacaagcagggccccacuccaaccgcaacaaguaacccuauccaggacggucugaggaaagccggggcuacucaaucuaauauccgucccggaggcgguuccgauccacggauuccugccgcacccagaaagcuacucuga

SEQ ID NO: 64894 - RNA, 2817 nt, Artificial Sequence
  derived and/or modified sequence opt3 from XIRP2__Homo_sapiens__NP_001073278
auguuccccaugcagaagggcagccugaaccuccuuagacaaaaaugggaguccugcgacuaccagaggucugaaugucacccucgggauucacauugcaccaucuuucagccacaggagaguaagcuguuggccccggaaggggagguggucagcgcuccccaauccuuagacccuacaucucugccauauucgacuggagaagagauguggucaagcaaacccgaggaaaaggauaguguugacaaauccaauaacacgcgcgaguacggucgaccugaagugcuaaaggaggauucucucagcucccguagaaggauugagcgguucucaauagcacuggacgaacuucgcaguguauuugaggccccaaagagcggcaauaaacccgcggaauaugggggaaaggagguggaaaucgagagaucucuguguuccccugcuuucaaaucacacccaggcagccaguuggaggauagugucaaggacucugauaaaaaggguaaggaaaccuccuuugacaaaaugagcccggagucggggcauucuaggauuuucgaagccacagcaggacccaacaagccugaguccggcuuugccgaagauucagcugcacggggcgagggggugagugaccuccacgagguugugagccugaaagaacgcauggcccgauaccaggcugccgucuccagaggagauugcaggucuuucagcgcgaauaugauggaggaaucagagaugugugcagugccagguggccuggccaagguaaagaagcaguuugaagacgagaucaccaguucccggaacacuuucgcucaauaucaguaccagcaucagaaucguagcgagcaagaagccauucacucuucacagguugggacaagucgcagcucccaggagauggcaagaaacgaacaagagggaucuaaagugcagaagaucgacguccacggcaccgagauggugucgcaucucgaaaagcacacugaggaagugaaucaggcuagccaguuucaucaauauguccaggagacaguuauagauacccccgaagacgaggagaucccuaaaguguccacgaaguuacugaaagaacaguucgagaagucagcccaggagaaaauucuuuacagugauaaggagaugacuaccccagcgaagcaaaucaaaaaguugcugcuacaggacaaagaaauuugcauccucugucagaagacaguauaccccauggagugccugguggccgauaaacagaacuuucacaagucuuguuucaggugccaccauuguaauagcaaacuuucccuggguaacuaugcaucauugcacgggcaaauauacugcaaaccgcauuucaagcagcucuuuaaaagcaagggaaauuaugacgagggcuucggccacaaacagcauaaggaucgguggaacugcaagaaucagucucgauccgucgacuuuauuccuaacgaagaacccaacauguguaaaaauaucgcugaaaacacucuggugccaggggaucgcaaugagcacuuagacgccggaaacagugaaggucaaagaaaugaucugaggaagcucggcgagcgggggaaacuuaagguuauuuggccucccagcaaagagaucccaaagaaaacccugcccuucgaagaggaauugaagaugucuaagccuaaauggccaccggagaugacaacccuacugucccccgaguuuaagucagaaagucuccuggaggacgugcgcacgccugaaaacaaaggacagagacaggaccacuucccauuucuucaacccuaccugcagagcacucaugucugccagaaggaggaugugaucggcauuaaagaaaugaagaugccugaggguaggaaggacgagaaaaaggaagggcguaaaaauguacaggaucggccaucggaggcugaagacacaaaguccaaccgaaaaucugccauggauuugaaugacaacaauaacguuauagugcaaagcgcagagaaggaaaagaaugagaaaaccaaccagacuaauggcgccgagguccuccaggugacaaacaccgaugacgaaaugaugcccgagaaccacaaggaaaaucugaacaaaaauaacaauaacaauuaugucgcugugucauacuuaaacaauuguagacagaagacgaguauccuggaguuccuagaucuccugccgcuuuccucugaagcgaacgacaccgcaaaugaguaugagauugaaaaauuggagaacacaagcaggaucuccgaacugcucggaauauuugagucagagaagacuuacagccgcaauguucuggccauggcucuuaagaaacaaaccgaucgggccgcagccggcaguccugugcagccagcucccaagccuucucuguccagaggguugaugguaaaaggagguagcucgauuaucucacccgacacaaaccuccugaauaucaagggcucucauaguaaauccaagaacuuacacuucuuuuucagcaacacugucaaaauuaccgccuuuucuaagaagaaugaaaacaucuucaauugcgaucugauugacagcguggaccagaucaaaaacaugccaugucuagaucucagggaguucgggaaggacguuaaaccuuggcacguggaaacaaccgaggcagcgcgcaauaacgaaaauacuggauuugaugcucugucccaugagugcacggccaagccccuuuucccacgagucgaggugcagucagaacaauugacaguagaggaacagauaaaacggaaccguuguuacagugacaccgaguga

SEQ ID NO: 64895 - RNA, 1335 nt, Artificial Sequence
  derived and/or modified sequence opt3 from XK__Homo_sapiens__NP_066569
augaaguuccccgccagcgugcuggcuuccgucuuucucuucguugcagagaccacagccgcgcuuucucugucaaguacuuacagaagcggcggggacaggauguggcaggcuuugacguuacuguuuucccuacucccuugcgcccuggugcaacuuacccuguuguucguacaccgggaucucucucgcgaccgaccacuggugcugcucuuacaucugcuucaguugggaccgcuguuucguuguuucgaagucuuuugcaucuauuuccagucggguaacaaugaggaacccuacgugucaauuacuaaaaagagacagaugccuaaaaacggccuaagcgaggaaauagagaaggagguugggcaagcagaaggaaaacucaucacacacaggagugccuuuucccgggcuucugugauucaggcauuccugggcagcgccccacagcuuacccugcaguuguauaucuccgucaugcaacaggaugugacaguaggucgcucacuccugaugaccauuaguuuacugagcaucguuuacggggcucucagauguaauauacuugccaucaagauuaaguaugacgaguacgaagugaaagucaagccccuggcguaugugugcaucuuuuuguggaggucuuucgagauugcaacucggguggucguucuagugcuguuuacauccguacucaaaaccuggguggucgugaucauacugauuaacuucuucucauuuuuccuuuacccuuggauccuguuuugguguagcggaaguccauuccccgagaauauugaaaaggccuugucucgcguuggcacgacuaucgugcucugcuuucugaccuuacuguacacaggcaucaacauguucuguugguccgcuguccagcuaaaaauugauagcccugaccucauaucgaagucucauaauugguaucagcugcuuguguacuauaugauccgauuuauugagaacgccaucuugcugcuccugugguaccuuuucaagacugauauauauauguacguaugcgcaccacuguugguucuccaacuguuaauuggguauuguaccgcuauccuguuuaugcuaguguucuaccaguuuuuccacccgugcaaaaagcucuuuuccucaagugucagcgaaggauuccagagauggcugagguguuucugcugggccugccggcaacagaaacccugugagccuaucgguaaggaagaccuucaguccucucgugaucgcgacgagacaccaagcucaaguaaaaccucccccgagccuggccaguuuuugaaugcggaagaucugugcagcgccuga

SEQ ID NO: 64896 - RNA, 1953 nt, Artificial Sequence
  derived and/or modified sequence opt3 from XKR4__Homo_sapiens__NP_443130
auggccgcuaagagcgacggcagacugaaaaugaagaaauccucugauguggcauucacccccuuacagaacucagaccacagugggagcguccaaggacuugccccuggucugccauccggcucuggggcggaggaugaagaggcugccggaggcgguugcuguccggacgggggaggcugcucgagguguugcuguugcugugcaggcucagggggaagcgccgguaguggcggguccggaggcguugcuggucccgggggaggcggcgcagggucugccgcuuugugcuuacggcugggacgcgaacagcgacguuacagccuaugggauugucucuggauccuggccgcgguggcaguauauuuugccgacguggguacagaugucuggcuugcuguggacuacuaucugagaggccagagguggugguucggguugacucucuuuuucguugugcugggaucccugucaguccagguguuuaguuuccggugguuuguacaugauuucagcacggaggacucugccaccgcagcugccgcguccucaugcccucaaccaggcgccgauuguaagacaguugugggugggggcagcgcagcuggagaaggcgaggcccgccccaguacuccucagagacaggcuucuaaugccuccaaaagcaacauugcagccgcuaauucggggucuaacuccucaggagcgaccagggcaagugguaagcaccggagcgccuccugcucuuuuugcauauggcucuuacagagccugauccauauucuucaauugggccagaucuggcgcuacuuccacacaauuuaucuggggauccgaucaagacagaguggagagaaugacagguggcgguuuuacuggaagauggucuaugaauacgcugauguguccaugcuacaucuccuggccaccuuccuugagagcgcaccacagcugguguugcaacucuguauaaucguccagacucacucucugcaggccuuacaaggcuuuacagcugccgcaucacugguuagucucgcgugggcucuugccagcuaccagaaagcacugcgugacucccgcgacgauaagaaacccauuucuuauauggccgugaucauucaguucugcuggcacuucuuuaccaucgcugccagaguaauaacguucgcauuguuugcuucgguguuccagcuauacuuugguauuuucaucguccugcauugguguauuaugacuuuuuggaucgugcacugcgaaaccgaguucuguaucacaaagugggaggaaauuguuuuugacaugguggucgggauaaucuauauuuucagcugguuuaacgugaaagagggcaggacucggugccgacucuucaucuacuauuuuguaauacugcuugaaaauaccgcccuguccgcguugugguaccucuauaaggccccucaaauugcugaugcauucgccaucccagcucuguguguuguguucucaaguuuucucacaggagucguguucaugcugauguacuacgccuuuuuccauccgaacggcccccgcuuugggcagucuccuagcugcgcaugugaggacccagcggccgcuuucacccuacccccugaugucgccacguccacucucagaucaaucagcaauaacaggucugugguuuccgaccgggaucagaaguuugcagaacgcgacggaugcgugccaguauuccaggucagacccacagcuccgaguaccccuagcucuaggcccccacguauugaggaguccgugaucaaaauugaucuguuucggaaucgauauccugccugggaaagacacguucuugacaggucauugcgcaaggcaauacuggccuucgaguguagucccagcccaccccggcuccaauacaaagaugacgcucugauccaggaaagacuugaguaugaaacuacacuguga

SEQ ID NO: 64897 - RNA, 1926 nt, Artificial Sequence
  derived and/or modified sequence opt3 from XKR6__Homo_sapiens__NP_775954
auggccgcuaagagcgacggcgggggagugggugucggcuucgcacagcugcacaaccucgaugaggccguuggguccggaggcgaagaggacggugaacccgggggaggcggcugcgggggagguggcgaugggucugagccuggagaaucaaguagcaugcauaucugucacugcuguaauaccuccucuugcuacuggggcuguagaucggcgugccuuaggucacuguugggucggaaaccacgccgaagcgcugccgcagacgggggagaucaaccguuacagcccccugccgcuccaggcgcaggccgucagcccccuacaccaagugccgcuagacccgagccuccaccgccccagguggagaggccuuggcuggacugucuauggauuguacucgcccugcuuguguuuuucggggaugucggaacugaccugugguuggcgcucgauuauuaccggaagggugacuauguguacuuuggccugacgcuguucuuuguucucgugccauccuuacugguccaaucucuuagcuuccgcugguuugugcaggauuauaccgggggaggcuugggugcaguagaagggcugacauccagaggacccccuaugaugggcgccggcuacguucauggggcugccaggggagguccaggcgugcgggucucacccacuccgggggcacagcgccuaugccgacucaguguguggauauggcagagcgugauccaucugcuucaaaugggacaggucuggagauauauuaggaccauguaccugggcauccagucucagcggcguaaagagcaccaacgcagauucuacugggcuaugauguaugaauacgccgacguuaacauguugaggcuccuggagacauuuuuagaguccgcgccucagcuggugcuccagcuuuauauuaugcugcaaaagaacucagccgaaaccuugcccuguguaagcagugugacuucucuaaugucccuggcauggguccucgcuagcuaccacaaacugcuucgggauucgcgagacgacaagaagucuauguccuaucgcggugccaucauacagguguucuggagacuguuuacaaucucaaguaggguuauuagcuucgcuuuguuugccuccaucuuccagcucuacuucgggauuuuuguggucgugcacuggugcgcaauggccuucuggaucauacauggcggaaccgauuuuuguaugucuaaaugggaggaaauucuguucaauaugguaguuggcaucguguauaucuuuugcugguucaaugucaaggaggggcggacgcgcuacagaauguuugcuuacuauacuauuguguuaaccgaaaacgcggcacugacauuccuaugguacuuuuauagggacccagagacuaccgauagcuacgccgucccugcucucugcuguguguucaucucauuuguugccggaauugcaaugaugcugcuuuauuacgguguguugcaccccacaggcccacgugccaaaauacuggcuaguuccugcugugccgagcuccugugggggaucccccuuccuccagacguagaaccgauggcacccgagauuccuggauaucggggcacccaggucacgccaacucgagcggugacagaacaacaggaggaucugaccgcugacacuugcuugcccguuuuccaggugagaccuauggguccacccacaccgcucgggaggccuuaccugccagaaggccccuuaaucaagauagauaugccucgcaaacgguaccccgccugggacgcacauuuugucgauagaaggcugcgccgaaccauuaauauccuacaguaugugacgccaaccgccguaggaauccgguaccgugacggcccucuccuguaugagcuuuugcaauacgagagcucucuguga

SEQ ID NO: 64898 - RNA, 1122 nt, Artificial Sequence
  derived and/or modified sequence opt3 from XKR9__Homo_sapiens__NP_001274188
augaaguacaccaaacagaacuucaugaugagcgugcugggcaucauuauauaugucacagaccucaucguugauauuuggguguccguaagauuuuuccacgaggggcaauacguguuuucugcccuugcucugucauucauguuguuuggaacuuuagucgcacagugcuucaguuauagcugguuuaaggccgaccugaaaaaggcgggucaggaaucccagcauuguuuccuacuccugcacugccuucaaggcgggguguuuacgagguacugguucgcucugaaacggggauaucaugccgcauuuaaguacgauucuaauaccucgaacuucguugaggaacagaucgacuugcacaaggaggugauugaucgcgucacagaccucucaaugcugcgacuguuugaaacuuaucucgagggcuguccccaguuaauccugcagcuuuacauauugcuggagcauggucaagccaauuucagccaguacgcugcaaucauggugaguugcugugccauuuccuggucuaccguagauuaucagguugcucuacguaaaagccucccugacaagaaacugcuuaacgggcugugcccaaagaucacauacuuguucuauaaacucuuuacccuguuauccuggaugcugucagugguccuccuucuguucuugaaugugaagauugcccuauuucugcuccuguuccuuuggcuguugggaaucauaugggcguuuaagaacaauacucaguucuguacaugcauuaguauggaauuucucuacagaaucguggucggcuucauucugaucuuuaccuucuuuaacaucaaaggccaaaauacgaaguguccgaugagcugcuauuacauuguuaggguguuagggacucugggaauacuaaccguauucuggguguguccccucacaaucuuuaacccugauuauuucauuccaaucucuauaacuauuguccugacccuuuugcuggguauccucuuccugaucguguacuacggcuccuuucaccccaaucggucagcagagacaaaaugcgacgaaauugaugggaagccuguucuucgcgagugcagaaugagguauuuccugauggaguga

SEQ ID NO: 64899 - RNA, 822 nt, Artificial Sequence
  derived and/or modified sequence opt3 from XPA__Homo_sapiens__NP_000371
auggccgcugcagacggcgcccugcccgaggcggcugcccucgaacagccugcagagcuuccagccagcgugagagcuuccaucgaaaggaagcggcaacgcgcacugauguugcgacaggcccguuuagcugccagaccguacucugcgaccgcagccgcugccacagggggaauggcaaacgucaaagcugcccccaagauuauagauacugguggcggguucauccuggaggaagaggaggaagaggaacagaaaauuggaaagguugugcaccagccuggcccaguaauggaguuugacuaugugaucugcgaggaaugugguaaagaguucauggauucauaccuaaugaaucauuuugaccuccccacgugcgauaacuguagggacgcggaugacaagcacaagcugauuaccaaaacagaagccaagcaagaguaucuucugaaagauugcgacuuggaaaagcgggagccuccacucaaauucaucgucaagaagaauccccaucacagucaguggggagauaugaaacuguaccugaagcuccagauagugaaacgcagcuuagagguuugggggucccaggaagcacuggaggaagcuaaggaggugagacaagaaaacagggagaaaaugaagcagaaaaaguuugacaagaaagucaaggagcuucggcgcgccgugcgaucuucgguauggaaaagagaaacuaucguucaucagcacgaguauggcccugaagagaauuuggaagaugacauguacaggaagaccuguacaaugugcggccacgagcugaccuaugagaaaauguga

SEQ ID NO: 64900 - RNA, 2823 nt, Artificial Sequence
  derived and/or modified sequence opt3 from XPC__Homo_sapiens__NP_004619
auggccagaaagagggcugcaggcggggagccccggggacgcgaacugcgaagccagaaauccaaggccaaaucuaaggcgcguagagaggaagaggaagaggacgcuuucgaggaugaaaaaccuccaaagaagucacuccuuaguaaagugagccaagguaagaggaaacggggcugcucccaccccgggggaucugccgacggcccggcaaagaaaaaggucgccaagguuaccgugaaaucggagaaccugaagguaaucaaagaugaggcuuugucagacggugaugacuuacgcgauuuuccuagcgaccugaagaaagcacaucaccuaaagagaggggccacaaugaaugaagauaguaacgaggaagaggaagaguccgaaaaugacugggaggagguggaggaacucucugaaccaguccugggagaugugagggagagcacugcuuucucccggucacuucugcccguuaaaccuguggaaauugagauagagacgccagaacaggccaagacccgcgagcgaagugaaaagaucaaauuggaguuugaaacauaccucagaagggcgaugaagcgguucaacaaaggcguccaugaggacacucacaaggugcaucugcugugucucuuagcaaauggcuuuuaucguaacaauauuugcagccagcccgaucugcacgccaucgggcuuucuauuaucccugcucgcuucaccagaguauugccaagggacguugacacauacuaucuguccaaccuagugaaaugguuuauaggaaccuucacugucaaugccgagcucucagcaagcgaacaggauaaccugcaaacaacccuugagcggcgauuugcuaucuacagugcccgcgacgaugaggaacuggugcacauuuucuugcucauccugagagcguuacagcugcucacgaggcuugugcugucuuugcagccgauuccccuaaaguccgccacugcaaaggguaaaaagccuagcaaagagcggcugaccgcugacccaggcgggucgucugaaacauccucacagguccucgagaaucauacuaagcccaaaaccaguaagggaacaaagcaagaagagaccuuugccaaaggcacgugucgcccuagcgcuaaggguaaaagaaacaaagggggaaggaaaaagcguuccaagccaucuagcucagaagaggaugagggccccggcgacaaacaggaaaaggccacucagcggcgaccgcacgggagagagaggcgcguugcaagucggguguccuauaaagaagagagcggaucugaugaagccgguucaggcagugacuucgagcugagcuccggggaggcuucugauccuucggacgaagauagcgagcccggaccaccuaagcagagaaaagcgcccgcaccacaaaggacaaaggccggcuccaaaucagcuagucgcacccaucgagguucucaccggaaggaccccagccuuccugccgcauccucaucuagcuccaguagcaagcgugggaaaaagaugugcucugacggcgaaaaagccgagaagagauccaucgcuggaauagaucaguggcuggaaguauuuugugagcaggaggaaaaaugggugugcgucgacugugugcacggcguuguggggcaaccauugacuugcuacaaguaugccacaaagccgaugaccuacgucgugggaauugauucagacgguuggguaagggauguuacgcagcgcuacgaccccguguggaugaccgucacacggaaauguagaguggaugcagaguggugggcggaaacucucaggccuuaucagaguccauucauggaccgagagaagaaagaggaucuggaguuccaggcuaagcauauggaccaacccuuaccuaccgccaucggccuguacaaaaaucacccacuauaugcacucaagcgccaucugcuuaaguacgaagccauuuaucccgaaacagcugccaucuugggguacugccggggagaggcagucuauagcagagauugugugcacacucugcauucgagggacaccuggcucaaaaaggcucguguugugcgccugggcgaaguaccguacaaaauggucaaggguuuuuccaaccgggccagaaaagcgaggcuugccgagccucagcugcgagaggaaaaugauuugggccucuucggguacuggcagacagaggaauaucagccacccguggcuguugacggaaaggugccucggaacgaguuuggcaacgucuaccuguucuuacccucuaugaugccaaucgggugcgugcaacugaaucuaccuaaccuccaccgcguagcaagaaagcuggacauugauugcgugcaggccauaaccggauuugacuuccacgguggcuauagccaucccguuacugauggguacaucgucugugaagaguuuaaagacgugcuuuugacggcuugggagaaugaacaggccgugauugagaggaaggaaaaagagaagaaagaaaagcgggcacugggaaacuggaaacuccuggcgaagggcuuacugauccgagagagacuuaagcgcagguaugguccaaaaucagaggccgcugccccgcacacagaugcagggggcggauugaguuccgacgaagaggaaggcaccucuagccaggcugaggccgcacguauacucgccgcuuccuggccucaaaaucgggaggaugaagagaagcagaaacugaaagggggacccaagaagacuaagagagaaaagaaggcggccgcaucacaucuauucccauuugagcagcuguga

SEQ ID NO: 64901 - RNA, 1929 nt, Artificial Sequence
  derived and/or modified sequence opt3 from XPNPEP1__Homo_sapiens__NP_001161076
auggccgcuagcagaaagcccccuagggugcgggucaaccaccaggacuuccaacugcgcaaucuccgaaucauugagccaaacgaaguuacccauuccggcgauacagggguggagacugacggacguaugccgcccaaaguaacgucugaacuucugagacaguugaggcaggcaaugcgcaauucagaguacgugaccgaaccuauacaggccuauaucauuccaaguggugaugcgcaccaaagcgaguacaucgcucccugcgacugucggagagccuuugucuccggcuucgaugggucugcaggaacagccauuaucacugaggaacaugcugcaauguggaccgacggcagguauuuucugcaggccgcuaagcagauggauucgaacuggacacugaugaaaaugggucuaaaggacaccccuacucaggaggauuggcucgugucaguucugccagaagggagccgggugggagucgacccccuuauaaucccuacagauuacuggaaaaagauggccaaggugcugcgcagugcgggccaccauuugauuccaguaaaagagaaucucguugacaagaucuggaccgaucgaccggagagacccugcaaaccucugcugacgcucggcuuagacuauacugggauuuccuggaaggacaaaguggcagaucugaggcuuaagauggccgaacggaacgucaugugguucguggugaccgcuuuggacgagaucgccuggcuguuuaaucuacguggaucugaugucgaacacaacccaguuuucuuuagcuacgcaauaauuggucucgagacaaucaugcuguucauugacggcgaucgcaucgacgcucccuccgugaaggaacaccuucuguuggaucucgggcuggaggccgaguauagaauccaaguacauccuuacaaaucaauuuuaagugaacugaaggcgcucugugccgaccuuagcccaagggagaaagugugggucucugauaaggcauccuacgcugugucagaaacuauacccaaagaccaccggugcuguaugccguauaccccuaucugcauugccaaggcuguuaaaaauagcgccgagagugaaggaaugcgacgcgcacauaucaaggaugccguggcucugugugaguuguuuaacuggcuagagaaggaaguccccaaaggcggugugacagagauaucugcggcagacaaggccgaagaguucagaaggcagcaggcugacuuuguagaucuguccuucccaaccauuagcucgacggggccuaauggagccaucauccacuacgcagacggcacuacagauguuacccggacuaugcacuuuggcacacccaccgccuaugaaaaagagugcuucacguacgugcucaaggggcauauugcugucucugccgcaguguucccaaccggaacaaaaggucacuuacuugacuccuuugcgcgcucagcucugugggauaguggcuuggacuaucuccaugggacuggacacggcgucgguagcuuccugaacgugcaugaggggcccuguggcaucuccuacaagaccuuuucugaugaaccuuuagaggccggaaugauuguuacagacgaaccaggcuauuacgaggauggggcauucggaauaagaaucgagaaugugguacuggucgugccgguuaagacuaaauacaacuuuaauaacagggguagccuaaccuucgaaccccucacacuggugccuauucagaccaagaugaucgacgucgauucacuuacugacaaagagugcgauugguugaacaauuaucaccugacgugucgugacgugaucggcaaggaacuccaaaaacaggggcggcaggaggcccuggaauggcuuauucgagagacacaaccaauaaguaagcagcacuga

SEQ ID NO: 64902 - RNA, 2025 nt, Artificial Sequence
  derived and/or modified sequence opt3 from XPNPEP2__Homo_sapiens__NP_003390
auggccagagcucacuggggcugcugucccuggcuggugcuccuuugcgcaugugccugggggcauaccaagccugucgaccugggaggucaggauguuaggaacugcagcacaaauccaccguacuugcccgugacuguagugaacacgaccauguccuuaacagcgcugcggcaacagaugcagacucagaaucuaucugcuuauaucauuccuggcaccgacgcccacaugaacgaguacauagggcaacaugaugaacgccgagcauggaucacaggauucaccggcucagccgguacugcugucgugacaaugaaaaaggcagccguuuggaccgacagucguuauuggacgcaggcugagagacagauggauuguaauugggaacuccacaaagagguggggacuaccccaauugucacauggcugcuuacugaaauccccgccggaggcagggugggcuuugacccuuuccuguugagcauugauaccugggaguccuacgaccucgcgcugcaggggucuaaccggcaacugguaucgaucacaaccaaucucguugauuuaguguggggaucagagcgcccacccgucccuaaccagccaauauaugcacugcaggaagccuuuacggguagcacuuggcaggagaaggugaguggcgugagaucccaaaugcagaaacaucagaaggucccgacagcuguucuuuugucugcccuggaagagaccgcauggcuauucaaucucagggcuagcgacauccccuacaacccuuucuucuauuccuacacucugcuuacagauucaaguauucggcuguuugccaauaagagccgcuucucuuccgagaccuugucauaccucaacagcaguugcacggggccaaugugugugcaaaucgaagacuauucucagguacgagauuccauucaggcguacagccugggagacgugagaaucuggauaggcaccucguauacaauguacgguauuuaugagaugauccccaaagaaaaguuagucacugacaccuacucuccugugaugaugacaaaagccguuaaaaauuccaaggagcaggcacugcucaaggcuucacacgugagggaugccgucgcugugauucgguaucuuguauggcuggaaaagaacguuccaaaagggacuguggacgaguuuaguggagccgagaucgucgauaaguuccguggcgaggaacaauuuagcuccggccccucuuucgaaaccaucagcgcaucaggguugaaugccgcucuagcgcacuacaguccgacaaaagagcugaaccgcaagcucuccagcgacgaaauguaccugcuugauucuggaggucaguauugggacggcaccacugauauuacgagaacagugcauugggggaccccuucagcauuucagaaagaggccuacacuaggguccugauaggaaacaucgacuugagucggcucauuuuccccgcugccaccagcggccgaaugguggaggcauucgcccgcagagcucugugggaugccgguuuaaauuaugggcacggcacaggacauggcaucgggaacuuucugugcguucacgaauggccagugggauuccaguccaauaacauagcaauggcgaaggguauguuuaccucuauugagccuggcuacuauaaagacggggaauuuggaaucaggcuagaggauguagcucucgucguggaagccaagacuaaguaccccggcucguaucugacauuugagguugugagcuucgucccauacgaccggaaucuuaucgacguguccuugcugucacccgagcaccuccaauaccugaaccgcuauuaccagacgauuagagaaaaaguagguccugagcuucagaggcgucagcuguuggaagaguuugaguggcuccaacagcauaccgaaccacuggcagcccgggcuccggauacugccaguugggcaucuguguuaguugucagcacacuggcuauccuagggugguccguguga

SEQ ID NO: 64903 - RNA, 1524 nt, Artificial Sequence
  derived and/or modified sequence opt3 from XPNPEP3__Homo_sapiens__NP_071381
augcccuggcugcucagcgccccuaaacuugugccagcugucgcaaacguuagaggccuguccgggugcauguuguguucucagaggcgguacucauuacaaccggugcccgagcgccgaaucccuaaucguuaucugggacagccaagucccuucacccacccucaucuacucagaccaggugaaguaacacccggccugagccagguggaguacgcccuuaggcggcacaagcugauguccuugauucagaaggaagcgcaagggcagucuggaacugaccagacggucgugguucucucgaacccuaccuauuacaugucaaaugauauaccauauacauuucaucaggacaacaauuuccuguaccugugcggcuuucaagagccggauagcauccucguguuacagagucugcccgguaaacagcuuccuucccacaaggcuauuuuguucgucccacgcagagaccccucuagggaacugugggaugggccucggagcggaacugacggcgccaucgcacuaaccggcguggaugaggccuauacacucgaggaauuucagcaucugcuuccaaaaaugaaggcugagaccaacaugguaugguacgacuggaugcgccccucccacgcacaacugcacucagauuacaugcagccguugacugaagccaaggcuaaaaguaagaauaaaguucgaggggugcagcaacucauucagagacugagguuaaucaagagcccugccgagauagagcggaugcagaucgcgggaaaacugacaucucaggcauucauugaaaccauguuuacguccaaggcccccgucgaggaagccuuccucuaugcuaaguuugaguucgaaugucgugcacgcggugcugacauccuugccuacccaccugugguggcgggcgggaacagaucaaauacucugcauuaugucaaaaacaaucaauugauuaaggauggagagaugguucuacuggacggcgguugcgagagcaguuguuacgugucugauaucaccaggacauggcccguaaacgggcgguuuacugccccacaggcagaacucuaugaggcugugcuggaaauacagcgagacugccuugcccuguguuuccccggaaccuccuuggagaauauuuacagcaugaugcucacacugaucggccagaaauuaaaggaccugggcauuaugaaaaacaucaaggaaaauaacgcuuuuaaagccgcacgcaaguauugcccucaccaugucgggcacuaccuaggaauggaugugcacgacaccccagauaugccgagaucgcucccccugcaaccugguaugguuaucacgauugagccaggcauauacauccccgaggacgauaaggacgccccugaaaaauucagggggcuuggagugcggauugaggaugacgucgugguaacucaggauucuccauugauccuguccgcugacugucccaaggaaaugaacgauauagagcagauuugcucacaggcgaguuga

SEQ ID NO: 64904 - RNA, 3216 nt, Artificial Sequence
  derived and/or modified sequence opt3 from XPO1__Homo_sapiens__XP_011531399
augcccgccaucaugaccaugcuggcugaccacgcagccagacagcuccuugauuucagccaaaagcuggacauuaacuuguuagauaauguggucaacugccuguaccauggcgagggggcgcagcagaggauggcucaggaaguucuaacacaccucaaagagcauccugacgccuggacucggguggauacgauacuggaauuuucccaaaauaugaacaccaaguauuacggacuucagauccuggagaauguaauuaaaacacgcuggaagaucuugccacgaaaccagugugaagguauuaaaaaguauguggucggccucaucauaaagacuucuucagacccgaccugcguggagaaagagaagguuuacaucgggaaacugaauaugauucuggugcagauccucaagcaagaauggcccaaacacuggccuacauucauuagugauaucgucggagcaagccguaccuccgagucuuuaugucagaacaauauggugauacugaagcuguugucggaagagguauuugacuucucaagcggccagauuacucagguuaagaguaaacaucugaaggauuccaugugcaacgaguuuucucaaaucuuccagcuaugucaguuugugauggaaaauagccaaaacgccccacucguccacgcuacacuggagacccuucugagauucuugaauuggauuccccucgguuauaucuuugaaacgaaacugaucuccacuuuaauuuacaaguuccugaacgugccuauguuuaggaaugugucacucaaaugccuuaccgagauagcaggggucaguguuagccaguaugaagaacaguucgugacacuguuuacuuugaccaugaugcagcuaaagcaaaugcugccacucaacacaaacauccggcuggccuacucuaauggaaaagacgaugagcagaacuucauucagaaucuuucccuguucuuguguaccuuucucaaggaacacgaccagcugaucgagaagcgcuuaaaccugagagaaacgcuaauggaggcucuccauuacaugcugcuuguaucagaaguggaggagacugaaauauucaaaauuugcuuggaguauuggaaucaccuggccgcggaacucuacagggagagccccuuuaguacaucugcauccccucugcuuagcggcucgcaacauuucgaugucccaccgcggcgccagcuguauuugcccaugcucuuuaaggugcgacuguuaaugguuucuagaauggccaaaccugaagaggugcuggucguggagaacgaccagggcgaaguaguuagggaguucaugaaggacaccgauuccaucaaucuauacaaaaacaugcgggaaacucucguguaucugacacaccuugacuacgucgauaccgagcguaucaugacggagaaguugcacaaucaggugaacgggaccgaauggucauggaagaaucugaacacacucuguugggcuauuggaaguaucagcggugccaugcaugaggaagacgagaaacgcuuucuggucacugugauuaaggauuuacugggccuuugcgaacaaaagagagggaaggacaauaaagcaauaaucgcuuccaacauuauguauaucguuggacaguacccaagguucuugcgggcccacuggaaguuucucaagaccgugguaaauaaacuguucgaguuuaugcaugagacacacgauggcguccaggacauggcgugugauacuuucaucaagauugcccagaaaugccgacgccauuuugugcaaguucaggugggugaagucaugcccuucauagacgagauccuaaacaacauuaauaccaucauuugcgaucugcagccucaacaggugcacacauucuacgaagcaguaggguauaugaucggagcucagaccgaccagacugugcaagagcaccucauagaaaaguacaugcugcuuccaaaccagguuugggacucuaucauucagcaggccacgaaaaaugucgauaucuugaaggaccccgagacagugaagcaacugggcagcauuuuaaaaaccaacgugagagcuuguaaggccgucggccauccguuuguuauccagcucgggaggauauaucuggauaugcuuaauguguacaaaugccugucagagaacauuagugcagccauccaggcuaauggagaaauggugacuaagcagccuuugauucgguccaugcgcaccguaaaaagagagacacucaagcugaucagcgguugggucucuaggucaaacgacccccaaaugguggcggaaaauuucguuccaccucuacuggaugcagugcucauagacuaucagcguaacguccccgccgcucgggagccagaagugcugaguaccauggccaucauuguuaauaaacuuggcgggcacaucacugcagagauuccccagaucuuugaugccguguucgaguguacauugaacaugauaaauaaggacuuugaagaguacccugaacaucgaacgaacuucuuucuguuacuccaagcuguaaauagccacugcuucccagccuuucuggcaauuccgcccacccaguucaaacuuguccuggauuccaucaucugggcguuuaaacacacuaugagaaacguggcugacacaggacuacagauucucuucacccuguugcagaacguggcccaagaggaggcagccgcucagucuuuuuaucagacauacuucugugauauccugcagcauauuuucucggucguuacugacaccagccacacggccggcuuaaccaugcaugcauccauacucgcuuacauguuuaaucugguggaagaggguaagaucucaacaagucuuaacccugggaauccaguaaacaaucaaauuuuccugcaggaauauguggccaacuugcucaaaucugcguuuccccaccuucaggaugcccaggucaagcuauucgugacuggccuguuuagccuuaaucaagacaucccugcuuucaaagagcaucucagggacuuucugguucagauuaaggaguucgcaggagaggauaccuccgacuuguuucuggaggaacgcgagaucgccuuacggcaggcugaugaagagaagcacaaaagacagaugucagugccaggcauauucaacccccacgaaaucccggaggagaugugcgacuga

SEQ ID NO: 64905 - RNA, 3456 nt, Artificial Sequence
  derived and/or modified sequence opt3 from XPO4__Homo_sapiens__NP_071904
augauggccgcugcacuggggcccccugaggugaucgcccagcucgaaaacgcggcuaagguccuuauggccccaccgagcaugguuaauaacgagcaaagacagcacgcagaacauauuuuccuguccuuuaggaaaucuaagucacccuucgccgugugcaaacacauauuggagaccaguaagguagacuacguguuauuucaggcugcaacagccaucauggaagcugucgugcgggaguggauucugcuagagaaagggagcaucgaaucccuccgcacuuuccugcuuacguauguucugcagcgaccuaauuugcaaaaguacgugcgugagcagauucuccuggccgucgcggugaucguaaagagaggaucucuggauaaaucgauagacuguaagucaaucuuucaugaaguuagccagcucauuaguuccgguaacccaaccgugcagacauuagcaugcucuauccugacugcccuuuugagcgaguucuccucaaguagcaaaaccucuaauauuggccuguccauggaguuucacgggaacuguaagagggucuuccaagaagaggaucuacggcagaucuuuaugcucacaguggaagugcugcaggaguucucacgcagagaaaaucuuaacgcucagaugagcagugucuuucaaagguaucuggccuuggcaaaucagguucucucuuggaacuuccugcccccuaauuuaggacggcauuacauagcuauguuugaguccagccagaacgugcugcucaaaccaaccgagucguggcgcgaaacucuucuggacucucgaguaauggaguuguucuucacagugcacagaaagauuagggaagauuccgacauggcccaagauucacuacagugccuggcgcagcucgccagucugcacggccccaucuuuccugacgaggguagccaggucgauuaucuugcacauuucauugaagggcuguugaauaccaucaacggaaucgagauugaggacuccgaagcugugggcauaucuagcaucauuucaaaucucaucacgguuuuuccacggaacgugcugacugccauaccgagugaguuauucuccagcuuugucaacugucugacccaccuaacaugcucuuucggccguucagcugcccucgaagaggugcuggauaaggacgauaugguauacauggaagcauaugacaaacuuuuggagaguuggcugacucucguucaagacgauaagcauuuucacaaaggguucuuuacccagcacgccgugcaggucuucaauagcuacauucagugucaucuggcugcgcccgacggaacacgcaaccuuaccgcaaaugguguggccuccagagaggaagaggaaaucucugagcugcaagaggaugacagggaucaguuuucggaccaguuggcuagcgucggcaugcucgggcggaucgccgcagaacacugcauuccucuguuaacgucccugcuagaggaacgagugacucgccuccauggacagcugcaaagacaccagcagcagcuuuuggccucaccaggcaguucuacaguugauaacaagaugcuggacgaucucuacgaggacauccauuggcugauuuuagugaccgguuaucugcuugcugaugacacucaaggggaaacacccuugauaccuccagagaucauggaguacagcauuaaacacuccucagaaguagacaucaauaccacgcuccagauccugggaagccccggcgagaaggccucuuccauuccgggcuauaacaggaccgauagugucauacggcuacugagcgcaauccuccgcgugucugaaguugaguccagagcgauuagggcugaccugacacaccuuuugucaccucagauggggaaagauaucgugugguuccugaagcguugggccaagacuuacuuacucgucgacgaaaaacuguaugaucaaauuagucuucccuuuagcaccgcauucggagccgacacagaggguucgcaguggaucauaggcuaccuguugcagaaggugaucuccaaucucucuguauggagcucagagcaggaucuggcuaacgacacugugcaacuacugguuacccucgucgaacggcgagagagagccaaucuggugauucagugugaaaacugguggaaucuugcaaaacaguucgcuaguagguccccaccuuugaacuuucugucuagccccgugcagcgcacauuaaugaaggcccucguccugggcggauucgcgcauauggauaccgagacuaaacaacaguauuggacggaaguucuucagccacugcagcaacgguuucuaagagugaucaaucaggagaacuuccagcaaaugugccagcaggaggaagugaagcaggagauuacagccacccucgaagcucuguguggcaucgcagaggccacucaaauagacaauguagcuauuuuguuuaacuuccugauggacuuuuuaaccaacugcaucggucucauggaggucuacaagaauacacccgaaaccgugaaccugauuaucgagguuuucguggaagucgcccacaaacagauaugcuaccuuggggaguccaaggcaaugaaucuguaugaagcguguuugacucuccuacagguguacagcaaaaacaaucuaggcaggcagcgcaucgauguuacagccgaggaggaacaauaucaggaucugcuucucauuauggagcuguugacgaaccuguuaucaaaggaauuuaucgacuucagugacaccgaugagguguuucgaggacaugaaccuggccaggcugccaaucggucuguauccgcagcugacgucgugcucuacggggugaaccugauucuuccacugaugagccaggauuugcucaaauucccgacucugugcaaucaauauuacaagcuaaucacauuuauaugugagauuuuccccgagaagaucccucagcugccagaagaccuuuucaaaucgcucauguauucacuggaguugggaaugaccucuaugaguuccgaagucugccaguuaugucuggaggcccucacaccccuggcagaacagugcgccaaggcucaagagacugauagcccucuuuuucuggcgacccgucacuucuugaaacugguuuuugacaugcuggugcuccagaagcacaacacggagaugaccacagccgcuggugaagcauucuacacucugguaugucuucaucaggccgaguacucugaauuaguggagacccugcucagcucccaacaggauccagucaucuaucagagauuggccgacgcuuuuaauaaacugacagcaucaaguacucccccgacccucgauaggaagcagaagauggccuuccugaaaagccuugaggaauuuauggcgaacgugggcgggcuguugugcguuaaguga

SEQ ID NO: 64906 - RNA, 3615 nt, Artificial Sequence
  derived and/or modified sequence opt3 from XPO5__Homo_sapiens__NP_065801
auggccauggaccaggugaacgcucugugcgagcaacucgucaaggcaguuaccgugaugauggaucccaauagcacacagagauacaggcuugaagcccugaaauucugugaggaauuuaaggagaaaugcccuaucuguguaccaugcggcuugcgguuagcggaaaagacucagguggcuauuguccgccacuucgggcugcagauacuagagcaugugguuaaauuucgauggaacggaaugucccgucucgagaagguguaucugaaaaauucugucauggaacuuaucgccaacgguacgcugaauauuuuggaggaagagaaccacaucaaagacgcacucucaagaauugugguagagaugaucaagagggaauggccgcaacauuggcccgauaugcugauagagcuggacacccucaguaaacagggcgaaacacagacugaguuaguuauguucauccugcuucgguuggccgaagauguggucaccuuucagacacugccuccacaacgcagaagggacauucagcagacccuaacucagaauauggagcggaucuucagcuuucuccugaacacacuucaagagaaugugaacaaguaccaacaggugaaaaccgauacgucccaagaaucuaaggcucaggcaaauugucgcgucgggguugccgcucugaacacuuuggccggauauauugacugggugucgaugucacacaucaccgcggagaauugcaagcuccuggaaauauuaugucugcuccuuaacgagcaggaacugcaguugggcgcagccgagugccuacugauugcuguaagccgaaaagguaagcucgaggauagaaaaccccugauggugcuuuucggggacgucgccaugcauuacauccugagugcagcucaaacagccgauggaggcggcuugguggaaaagcacuauguuuuucucaaaaggcugugucagguguuaugcgcgcuggggaaucagcuaugugcccuccugggagcagacuccgaugucgagacuccuucuaacuucgguaaguaccuugagagcuuuuuggcuuucaccacacacccaucccaguuucugcggucaaguacccaaaugacguggggcgcccucuuccgucaugaaauucugagccgcgacccccuucuguuggcuaucaucccuaaauaucucagagccucuaugacuaaccuggugaagaugggguucccauccaagacagacucaccgagcugcgaauacaguagguuugauuucgacucugaugaggacuuuaaugcauucuuuaacuccagccgggcccagcagggagagguaaugcgauuagcuugccgccuggaucccaaaaccucguuccagauggcgggcgaauggcuaaaguaccaacucucuacuuuucuggacgcagguuccguuaauucauguagugccguggggacaggagagggcagccuuugcuccgucuucucuccuagcuuugugcagugggaagcuaugaccuuguuccuggagucagucauuacgcagauguuuagaacccucaacagggaggaaauaccagugaaugauggcaucgagcuguuacagaugguucugaacuucgacacaaaagauccccuuauuuugaguugugugcucacuaauguauccgcccuguuuccuuucgucaccuaucggccagaguuccuaccccaaguguuuagcaagcuguucucuucaguuacauuugaaacuguggaagagaguaaagcaccgcgcaccagagccgucaggaacgugcgucggcacgcuugcagcuccaucauaaagaugugucgagacuacccucagcucguacugcccaauuucgauaugcuuuauaaccaugugaagcaguugcugucuaaugaguuacuccugacacaaauggaaaaaugcgcccuuauggaggcacugguuuugauuucgaaccaguuuaagaauuacgaaagacagaaagucuuccucgaggaacugauggcgccaguggcuagcaucuggcuaucccaggacaugcacagggugcugucagacgucgaugccuuuaucgcauauguugggaccgaccaaaagaguugugauccuggacucgaggaccccugcggucugaaccgcgcccggaugucuuucuguguguacagcauucuuggcgugguaaaaagaacuugcuggccaacggauuuggaggaagcuaaggccgggggauuugucgugggcuauacauccucagguaaucccaucuucaggaacccuuguaccgagcagauucugaaguuacucgacaaccugcuugcacugauacgcacucacaauacccuauacgcuccagaaaugcucgccaaaauggcggagccguuuacaaaggcccuggauauguuggacgcugaaaagagcgcaauccugggguuaccccagccucuccuggagcuuaacgauucuccaguuuucaagaccgugcuggagcgaaugcagcgguuuuucuccacuuuguacgaaaauugcuuccauauucucggcaaagccggacccaguaugcaacaggacuuuuauacagucgaggaucuggcuacgcagcuacugagcucugccuucgugaaccuuaauaacaucccugacuaccgucucagaccaaugcugaggguuuuugugaagcccuugguacuguucugcccgccugaacacuaugaggcauuagucuccccaauccucggcccccuguuuaccuaccuucauaugcgccugucacagaaguggcaagugauuaaucagcggaguuugcucuguggggaggaugaagcggccgacgagaacccugaaagccaggagaugcuggaggaacagcuagugagaaugcugacuagggaggucauggaccuuauaacaguuugcugugugucgaaaaagggagcugaucacuccucugcacccccagccgacggugaugacgaagagaugauggcuaccgaaguaacaccuagcgccauggcagagcucacugaucugggcaaaugcuugaugaagcaugaagacguguguaccgccuuacugaucacggcuuucaauucacucgcguggaaagauacccugaguugccagcgaacaacuucccagcuuuguuggccccuguugaagcagguccuaucugggacccugcucgccgacgcagugacauggcuguuuacuagcguucuuaaaggauuacaaaugcacggccagcacgaugguugcauggcuucccuggugcaucucgccuuccagauuuaugaggccuugcgcccacgguaccuggagaucagagcugucauggaacagauuccggagauccaaaaggacucacucgaucaguuugacuguaagcugcuuaacccuagccugcagaaaguggcagauaagaggcguaaagaccaguucaagcgcuugauagccgggugcaucggcaaaccccuaggagaacaauuucggaaggagguucacauuaagaaucugccaagucucuucaaaaagaccaaacccauguuagaaacggaggugcuggacaacgauggcgggggacuugcgacaaucuucgagccuuga

SEQ ID NO: 64907 - RNA, 3336 nt, Artificial Sequence
  derived and/or modified sequence opt3 from XPO6__Homo_sapiens__NP_001257869
augaccgaguucuuucacgacugcacaacuaacgaaagaaagagggagaucgaggagcugcucaauaacuucgcccagcaaauuggcgcuuggcgguuuugucuuuacuuccugagcuccacgcgcaaugauuaugugaugauguacucuuugaccgucuuugaaaacuuaauaaauaaaauguggcuggggguucccucacaggacaagauggagauccgaaguugccuaccuaaacuccugcuugcacaucacaagacacugccauauuucauucguaacaaauuguguaaggugaucguagauauuggaagacaggacuggccgauguuuuaccaugauuucuuuacuaauauccuccagcugauacaaagccccgugaccacaccucugggucucaucauguuaaagaccacuuccgaggaacuggccugcccaagggaggaccuuucugucgcgcggaaagaagaguugcgcaagcugcuacucgaucaggugcagacaguucugggccuucugaccgggauuuuggagacggugugggacaaacacucggucacugcugccacacccccuccaucacccaccagcggagaaaguggcgaucuccuguccaacuuacugcagucuccuagcuccgcaaagcuccuuaaucaaccaaucccgauucuggacguggagucagaauauaucuguaguuuggcccuagagugccuggcucaucucuucagcuggauaccccugucugcauccauuacuccuucacuucugaccacaaucuuucacuucgccagauuugguugugauauuagggcucggaaaauggccagcguaaacgggaguucucagaauugcguuuccggacaggaacgcggccgauugggcgugcucgcgaugagcuguaucaacgagcugaugucgaagaauugcgucccaauggaguucgaagaguacuuacugagaauguuccagcaaaccuuuuaucuacuccagaagaucacgaaagacaacaaugcacacacugugaagucuaggcuggaggaacuugaugaauccuacauugagaaauucacagacuuuuugcggcuguucgugucaguccaucuccgucgcauagagaguuacagccaguuucccguuguggaguuccugacccuucuguuuaaguauacuuuccaccaaccuacacaugaaggguacuuuuccuguuuggacaucuggacccucuuccuggauuauuuaacgucuaaaauuaagagcagacugggagacaaagaagccguacuaaacagguacgaggaugcucucgugcugcuuuugaccgaaguccugaaccggauccaguuucgauauaaucaggcccagcucgaggagcuggacgaugaaacauuagacgaugaccaacagacugaguggcagcgcuaccugagacagucacuugaagugguugcaaaggugauggaguugcucccaacccacgcuuucaguacacuguuucccguccuacaagauaaccuggagguguaucucggucugcagcaguucauaguaacuuccggcagcgggcacaggcuuaauauuaccgccgaaaacgacugccggcgcuugcauugcucucugagagauuuaucaagucuccugcaggcgguuggaaggcuugccgaguacuucaucggcgacguguuugcagcucguuucaaugacgcccugacagucguggaacgguuggucaaggugacccucuacgguagccaaaucaaacuguauaacauugagacugcuguuccguccgugcuaaagccugaucugaucgacguacacgcccagucucucgcagcccugcaggcuuacucgcauuggcuugcgcaguauuguagcgaaguccaccgacaaaauacgcagcaguuugugacauugauuuccaccacuauggaugcaauaacccccuuaaucucaacaaaaguucaagacaaguuacuccugagugccugccaucuucuggugucucuagcuaccacugucagaccaguguuccucauuagcaucccugccguacagaaaguguuuaacaggaucacagaugcauccgcccugcgcuugguugacaaggcucagguccuggugugucgggccuuaucaaauauucuccugcuucccuggccaaaccugcccgagaaugagcagcaauggccugugagaagcauaaaccacgcaucuuugaucuccgcgcucaguagggauuaccgcaaucugaagccaagcgcugucgccccgcagcgaaaaaugccccuagacgauacgaagcugauuauccaccagacccuuucuguucucgaagacauuguggagaacaucuccggggaaucaacuaaaagucggcagauaugcuaucaaagccugcaggagucggugcagguauccuuggcacuguucccugccuuuauccaucagucugaugucacagacgaaaugcugagcuucuuucucacccuguuccguggacuuagagugcaaaugggcguuccauuuacagagcagauuauccagacuuuccugaauauguuuaccagggagcaauuggcugaaucaauucuccacgagggcaguacggggugucgcguggucgaaaaguuccugaaaauccuacaggugguugugcaggagcccggacagguauucaagccuuuucugccauccauaauugcccuuugcauggaacaagucuaccccaucauugcagagcggccgucuccugaugugaaggcugaacucuucgaacuguuguuuagaaccuuacaucacaacuggagguauuucuuuaaaagcacagugcuggccuccguccagcgagguaucgcggaggaacagauggagaacgagccacaguucucagccauaaugcaagcauuuggccagagcuuccuccagcccgacauccaccuguuuaagcagaaucuuuucuaccuggaaacuuugaacaccaaacaaaagcuauaccauaaaaagauuuuucgcacagcuaugcuguuccaguucguuaaugugcuccugcagguacuugugcacaagagucaugacuuacugcaggaggaaaucgggauugccaucuauaacauggcuucugucgauuuugacggauucuuugccgcauuccucccugaguuuuugacuuccugugauggcguggacgcgaaucagaaaagcguucugggucggaacuucaagauggauagagaccuccccucguuuacccaaaaugugcacaggcuggucaacgaucuucguuacuaucgccugugcaaugacucauugccaccugggacggugaaacuauga

SEQ ID NO: 64908 - RNA, 3264 nt, Artificial Sequence
  derived and/or modified sequence opt3 from XPO7__Homo_sapiens__NP_055839
auggccgaccacgugcagagccuggcucaacucgagaaccuuugcaagcagcuguacgaaaccacagauacuacgaccagauugcaggcagagaaagccuuagucgaguucacaaauucccccgacugucugucuaagugccagcuacuccuggaaaggggcucaaguagcuauucccaacuucuggcggcuacuuguuugaccaaacucguuucucggacaaacaauccucugccacuggaacagcgcaucgauauucgaaacuacgugcucaauuauuuagccacccguccgaagcuggcaacuuuuguaacacaggcccuuauacaguuguacgcuagaaucaccaaacuggggugguucgacugccaaaaggaugacuauguguuuaggaacgcaauuacggaugucacucgguuccuacaggacucgguggaguacuguaucauuggaguuaccauccucucacagcugacaaaugagauaaaccaggccgauacuacccauccccuuacaaagcaccgcaaaaucgcuagcaguuuuagagacuccucucuguucgauauuuuuaccuugagcugcaaucuccugaagcaagccuccgguaaaaacuuaaaucugaacgacgaaucacagcauggccuccuuaugcagcuguugaagcuaacgcacaauugucugaacuucgauuuuaucgggacuucaacagacgagagcucugacgaucucugcaccgugcaaauuccuacuuccuggaggucagcguuccuggacagcaguacacuucagcuguuuuucgauuuguaucauucuaucccacccuccuuuagcccucucguccugucguguuuagugcagauagcaucuguacggcgcucccuguucaauaacgccgaacgagcuaaauuccuaucacaccucguugacggagugaagaggauucuggagaacccacagagucuuagcgaucccaauaacuaccacgaguuuugcagauugcuggcccggcucaaguccaauuaccaacugggcgaacuugucaaaguggagaacuauccugaagugauccgucugauugcaaauuucaccgucacgucuuugcagcauugggaguuugcuccaaacagcguucacuaccuccugucauuauggcagcgccuggccgcgagugugccguauguaaaggccaccgaaccccauaugcuagagacauacacuccugaggugaccaaagcauauaucacauccagacucgaaagcguccacaucauucugagggacggucuugaggauccauuggaagacacugggcuggugcagcaacagcucgaucagcugucuaccauaggacggugugaguacgaaaagacaugcgcuuuacugguucagcuuuucgaccaaucagcccagaguuaucaggaguugcuccagagcgcuuccgccucucccauggauaucgcagugcaagagggccgacugaccuggcuagucuacauuaucggcgccgugauagggggacgcguaucguuugcuagcacugacgaacaggacgcgauggauggugagcugguuugcagagugcuccagcugaugaaucuuacggacuccagguuggcacaagccggcaacgaaaaacuggaguuagcuaugcucucauucuuugaacaguuccggaagauuuacaucggggaucagguccagaaaaguucuaagcuguaucgcagacuuagcgaggugcugggauugaaugacgagacaaugguccucuccguguuuaucggcaagauuaucaccaaccugaaauacugggguaggugugaaccuauuacuucaaagacccuacaacugcucaaugaucugagcauaggguauucuuccguucguaaacuugugaaguugagugccguacaguucaugcugaacaaucacacaagcgagcauuuuucuuucuuaggaaucaacaaucaguccaaccucaccgacaugcggugccgaacuacauuuuacacggcacugggcagacuucugauggucgaucuaggcgaagacgaggaucaguaugagcaauucaugcucccacugaccgccgcuuucgaagccguggcacagauguuuucaacuaacaguuucaaugagcaggaagcgaaaaggacauugguugggcuggugcgcgacuuacggggaauugcuuuugccuucaacgcaaagaccagcuuuaugaugcuguucgaguggaucuaccccucguauaugccgauccuccagagagccauugaacuuugguaccacgauccugcuuguacaacucccguccugaaguugauggccgagcucgugcauaauaggucccaacgccugcaguuugacguaucuagcccaaacgguauacuacuguuccgagagaccucaaaaaugaucacgauguacggcaaucggauucuuacccucggggaagugccuaaggaucagguuuaugcacugaaauugaagggaaucaguauuugcuuuuccaugcugaaagcugccuuaucuggcagcuacgucaacuucgguguguuucgucucuauggggacgacgcgcuggauaaugcccuucaaacauucaucaagcuguugcucuccauaccccacucagaccugcuagauuacccaaagcugagccagaguuauuacucucuucucgaggugcugacucaggaccauaugaacuuuaucgcuuccuuggaaccccacgucauuauguauaucuuaagcucgauuucagagggccugaccgcacucgauacaaugguuuguacuggaugcuguucuugccuggaccacaucgugaccuaccuuuucaaacagcugaguagauccacgaagaaaaggacaaccccuuugaaucaagaaagcgaucgcuuccuacauauaaugcagcagcacccagagaugauucagcaaaugcugucuacugugcucaacaucauuaucuuugaggacugucggaaucaguggagcauguccagaccgcugcuuggcuuaauacugcucaacgaaaaguacuucucagauuugaggaauaguaucguaaacagccagcccccugagaaacagcaagccaugcaucugugcuuugaaaaucucauggaggggauugaacgaaaccugcuuacaaagaaccgcgaccgguucacccagaaucugucugcuuuuagaagggaggucaacgauuccaugaagaauaguacuuauggagugaacaguaaugacaugaugagcuga

SEQ ID NO: 64909 - RNA, 1896 nt, Artificial Sequence
  derived and/or modified sequence opt3 from XPR1__Homo_sapiens__NP_001129141
augaaguucgccgagcaccugagcgcucauaucacccccgaauggagaaaacaguacauucaauaugaggcauuuaaggacaugcucuacuccgcccaggaucaggcgccuucuguggaagucacagacgaggauacuguuaaaagguauuucgcuaaguuugaagagaaauucuuucagacgugcgagaaggaacuugccaagauaaacaccuucuacucagagaaacuggcagaagcccaacggcgcuuugcuacauugcagaaugaguuacagaguagccuggacgcacagaaggaguccacuggcgugaccacacuacgacaacguagaaaaccaguauuccaccucucucaugaagagagggugcagcaccggaacaucaaggaucugaaacuugccuuuucggaauuuuaucugucauugauucuccugcagaauuaccagaaccugaauuuuaccggguuccgcaagauccucaagaaacaugacaagauuuuagagacuagcagaggagcugauuggagggucgcccacguggaaguugcgccguuuuauacauguaaaaagaucaaccaacugauaagugagaccgaggcaguggucacgaaugaacuugaggacggugaucggcagaaagccaugaagcgcuugcgagugcccccucugggcgcugcccagccagcacccgcuuggacuaccuucagaguagggcuauucugcggaaucuuuauuguucucaacaucacacuggugcuugccgcggucuucaaacuggaaacugacagguccauuuggccuuugauccggauauaccguggcgguuuucuccugauugaguucuuauuucugcucgggaucaauaccuacggauggcgccaagccggcgugaaccacgugcuuauuuucgaacugaauccaagaucuaacuugagccaucagcaccuauuugagaucgcaggcuuccuggggauccucuggugucugucccuucuggcuugcuuuuucgcccccauuucagucauaccuacauauguuuacccauuggcucucuauggauuuaugguguucuuucugaucaauccgaccaagacguucuacuauaagaguagguucugguuacugaaacuacucuuucggguauucacugcccccuuucauaagguggguuucgcagauuuuuggcuggccgaccagcuuaacagcuugucugucauucugauggaucucgaguacaugaucuguuucuauucccuggaacuuaaaugggacgagucaaagggccuguugccuaauaacagcgaggaacgagggcacagugacacaaugguguuuuucuaccucuggauaguuuucuacauuaucucuuccugcuauacccugaucugggauuuaaaaauggacuggggacuguucgauaagaacgcuggcgaaaauacuuuucuacgcgaggagauuguguacccacagaaggcguauuacuauugugcaaucauugaagacgucauacucagauucgccuggacaauccaaauuagcaucaccucgacgacccugcuuccccacucuggugauaucauugcuacaguguuugccccuuuggagguauucaggcgguucguuuggaacuuuuuccgccuggaaaaugagcaucucaacaauugcggggaguuuagagcagugagggacauauccgucgccccacugaacgcugaugaccagacuuuacuggaacagaugauggaucaggacgauggagugcguaaucggcagaaaaaccgaucauggaaguacaaucaaaguaucagccuuagaaggccccgcuuggccucccagucuaaagcacgggacaccaagguccucauugaggacacagaugacgaagcgaacacuuga

SEQ ID NO: 64910 - RNA, 1902 nt, Artificial Sequence
  derived and/or modified sequence opt3 from XRCC1__Homo_sapiens__NP_006288
augcccgagaucagacugaggcacguggucagcugcuccucucaggacucaacccauugugccgaaaaccuccuuaaggcugauacauaccggaaauggcgcgcagccaaggcgggcgagaaaacuauuaguguugugcugcaauuggaaaaggaggaacagauacacagcguagacaucgggaaugauggauccgcuuucguggaggucuuaguggguucuucggccggcggggcaggagagcaggacuaugaaguucugcuagugacgagcagcuuuaugaguccuuccgagucucgaagcggcuccaacccaaaucgugucagaauguucgguccggauaaacucgugagggccgcugcagaaaagcggugggaccgcguaaagauuguuugcucacagcccuacaguaaagauagcccuuuugggcugucuuucgugagauuucauuccccacccgacaaggaugaggccgaggcuccuucacaaaaagucaccgugacaaaacuuggacaguucagggugaaggaagaggacgaaagcgccaacagucugcggccaggcgcguuguuuuucucucgcaucaauaagacuucccccgucaccgcaagcgauccugccggcccaucguaugcugccgcaacacuccaggcuucuuccgccgcgucaagugccagcccgguuucccgagcaauugggucuaccagcaagccccaggagucaccuaaaggaaagagaaaacuggaccugaaccaagaagagaagaaaacuccaaguaagcccccugcucagcucuccccaagcgugcccaaaaggccgaaguuaccugcccccacacggaccccagcuacggccccuguacccgcacgugcccagggugcugugacuggcaagccacgcggggagggaaccgaacccagaaggccucgggcgggcccagaggaacuggguaaaauccuucagggggucgugguuguguugucuggauuucaaaauccguuccgaucagagcugcgcgauaaggcacuagaacucggcgccaaauacagacccgacuggacaagggacaguacucaccugauaugugcuuuugccaacaccccuaaguauagccagguccuuggccugggcggacggaucgugcgcaaagaguggguauuggauugccauagaaugaggcgucggcucccaucccagcgauaccugauggcaggucccgggucuucgagcgaggaagacgaggccucccacucagggggaaguggcgaugaagcuccuaaguuaccacaaaagcagccccagacaaaaaccaagccgacgcaggccgcagguccuucuagcccacaaaaacccccuacucccgaggaaacaaaggcggcuuccccaguucugcaggaggacauugauaucgagggggugcagucagaaggccaggacaauggagccgaggauagcggcgacaccgaagaugagcucagaagggucgcagagcaaaaagaacaccgccuuccucccgggcaggaggaaaacggagaggacccauaugccgguucuacugaugaaaauacagacuccgaggagcaucaggaaccgccugaccugcccgugccagaguugcccgauuucuuucagggcaagcacuucuuccuauacggggaauuuccuggagacgagcggagaaagcugauuagguacgucaccgcuuucaacggcgaacucgaggauuauaugagugaccgcgugcaauuuguuaucacggcccaggagugggauccaucauucgaagaggcacugauggacaaucccucucuugcuuuugugcgaccucgguggauauacuccuguaacgaaaaacagaagcuguugccgcaucagcucuaugguguagucccacaagccuga

SEQ ID NO: 64911 - RNA, 843 nt, Artificial Sequence
  derived and/or modified sequence opt3 from XRCC2__Homo_sapiens__NP_005422
augugcagcgccuuccacagagcugaguccggcaccgaacugcucgcaaggcuugaggggcggucuucacugaaggaaaucgagcccaacuuguuugccgacgaagauaguccugugcauggagacauuuuagaguuccacgguccagagggcacagggaaaacugaaaugcuguaccaucuaacggcgcgcuguauacuccccaagagcgagggaggccuggaagucgagguucuuuuuaucgauaccgacuaucacuucgauaugcugcgauuggugacaauucucgagcaucgucugucccagucuucggaagagaucauuaaauacugccuggguagauuuuuccucguauauuguucaagcaguacucacuuacugcuuaccuuguacucccuggaaucuauguuuugcagccacccgucccuaugucuccugauccuugacucacugagugcuuucuauuggauagauagggugaaugggggagagagcgucaacuugcaagaaucuacacuccggaagugcucccagugucuggagaaauuagugaaugacuaccgccugguucucuuugccaccacucagacaaucaugcagaaggcaucaagcaguucugaggaaccuucccaugccagcagaaggcuuugcgauguggacauugauuaucggccauaccuguguaaggcuuggcaacaguuggucaaacaccgcauguucuuuucgaagcaggacgauucucaguccucaaaccaauucagucuagugagccgaugccugaaauccaauucucucaagaaacauuucuucaucauuggcgagagcggcguagaauuuuguuga

SEQ ID NO: 64912 - RNA, 1041 nt, Artificial Sequence
  derived and/or modified sequence opt3 from XRCC3__Homo_sapiens__XP_005268103
auggaccuggaucuccuugaccugaaccccagaaucauugccgcuauaaagaaagcaaaguugaaaagcgugaaggaggucuuacacuucuccggcccugaucugaaaaggcuaaccaaucucucuucaccagaaguuuggcaucugcuucggacagccagucugcacuugcgcgggagcuccauccucacugcgcugcagcugcaucaacagaaggagcgauuuccgacgcagcaccagcgucucucuuuaggaugccccgugcuggacgcucuuuugagagguggccugccucuagaugggauuaccgaacucgccggaaggucgucagcaggcaagacacaacuggcccuucagcuguguuuggcuguacaguucccacggcagcauggugggcucgaggcaggagccguguacaucugcacugaagacgcuuuuccccacaaacgccugcaacaguuaauggcccagcagccuagacugaggaccgaugucccaggcgagcuccuucaaaagcugcgguucggcagccagauuuuuaucgagcacguggcggacguugauacauugcuagaaugugugaacaaaaagguccccgugcugcucagucgcgggauggcacgacugguaguuauagacuccguggccgcuccuuucagaugcgaguuugauucucaggccagcgcaccaagggcucggcaucuucaaucccugggagccaccuugcgugaacucucaagugcguuccagagcccgguccuguguaucaaucaggugacugaggccauggaggaacagggugcagcucacggccccuuaggguuuugggacgagcgcgugucuccugcccugggaauuacaugggcuaaccaacuacucgucagacugcuugccgauagguugcgggaagaggaagcagcccugggcugcccagcucgaacccuccgcguucuguccgcgccccaucuuccuccaucaagcuguaguuauacgaucucugcagagggugugagagggacucccggaacccagucccacuga

SEQ ID NO: 64913 - RNA, 1005 nt, Artificial Sequence
  derived and/or modified sequence opt3 from XRCC4__Homo_sapiens__NP_072044
auggagagaaagaucagcaggauucaccugguguccgaacccucuauaacccauuuccuccaggucucaugggagaaaacacuugaaaguggcuuuguuaucacucugacggacgggcacagcgccuggaccggaacaguguccgagucugaaauuucgcaagaggcugaugacauggcaauggagaaggguaaauacguaggcgaauugcggaaggccuuacugucaggggcgggaccugcugauguguauacuuucaacuuuagcaaagagaguugcuacuucuuuuucgaaaagaaucuaaaggacgucuccuuucgccucggcucuuucaaccuggagaaaguggagaauccagccgaaguuauccgagagcuuauuuguuauugccuggauaccaucgcagaaaaccaggccaagaaugagcauuugcagaaagaaaacgagcgucuccugagagacuggaaugaugugcaggguagguuugagaagugugucagcgcuaaagaagcacuggagacagaccucuacaagcgguucauauuagugcugaacgaaaagaaaaccaagauccgcucccuucacaauaaauugcugaacgccgcucaagagagagaaaaggauauuaaacaggagggggagacugccaucugcucagaaaugacagcggacagggauccgguauaugacgagaguaccgaugaagagagcgaaaaucagacggaccuaucuggacucgcauccgccgcuguuucaaaggacgauagcauuaucaguucucuggacgugacugauauagcccccucccggaaacgccgacagagaaugcaaaggaaccuuggcaccgagccuaagauggcaccacaggagaaucagcugcaggaaaaggagaaacccgacagcucguugccugaaacaucuaagaaagagcauauuuccgcugagaacaugucacucgaaacucugcggaauaguagcccagaggauuuauuugacgaaaucuga

SEQ ID NO: 64914 - RNA, 2199 nt, Artificial Sequence
  derived and/or modified sequence opt3 from XRCC5__Homo_sapiens__NP_066964
auggugagaagcggcaacaaggccgcugucguucugugcauggacgugggguucaccauguccaauucuauccccggaauugagucaccuuuugaacaggccaaaaagguaauaacaauguucgugcaaaggcaggucuuugcagagaacaaagaugaaaucgcgcucgugcuuuucgguacugacggcacggauaauccacugagugggggagaccaguaccagaacauuaccguucaccggcauuugauguuaccggauuuugaccugcuagaggauaucgaaagcaagauucaacccggcucccagcaggcugacuuccucgaugcccugaucgugucuauggacgucauacagcacgagacaaucgguaaaaaguuugagaagcgccauauugaaaucuucacugaucuuucgucacgauuuagcaaaagucaacuggacauuaucauacacuccuugaagaaaugugauauuucucuccaguucuuucugccuuucagccuggggaaggaggacggauccggcgaccguggcgaugggccauuuagacucggaggucauggccccucauucccuuuaaaagggaucaccgaacagcagaaggagggacuggagauugugaagaugguaaugaucagucuugaaggcgaggacgguuuggaugaaaucuauagcuucucugagucccugaggaaacuaugcguuuuuaagaaaauugaacggcacucaauacacuggccaugucgccucacaaucgggagcaaucugaguauuagaaucgcagccuacaagucuauacuucaagagagggugaaaaagaccuggacugucguggacgcuaaaacacugaagaaggaggauauucagaaagaaaccguguauugcuugaacgacgaugacgagacggaaguccucaaggaggauaucauccagggauuccgguacggcuccgacauuguucccuuuagcaaaguggaugaggaacaaaugaaguauaaaucggagggcaaguguuucucuguacugggguuuugcaaguccucacaggugcagcgccgauucuuuaugggaaaucaggucuuaaaaguguucgcagccagagacgacgaagcugccgcgguugcacugaguagccucauccaugcccuugaugaccuggauaugguggcuauugucagguacgccuaugacaagcgggcaaacccucaaguggguguagcuuuuccacacauaaaacauaauuacgaguguuugguuuacgugcagcuaccguucauggaagaucugcgucaguauauguuuuccucucucaagaacagcaaaaaguacgcccccacugaggcgcagcugaaugccgucgacgcacuuaucgauucaaugagucuggcuaagaaagacgaaaagaccgauacauuggaggaccucuucccuacuaccaaaauuccaaacccccgcuuucaaagacuguuccagugcuuacugcacagggcccuacacccucgggagccacugcccccgauccagcagcauaucuggaauaugcucaacccucccgcugaagugacaaccaagucccaaauuccacuuagcaaaauaaagacguuguucccucugaucgaggccaagaaaaaggaucaggucacugcacaggaaauuuuucaggacaaucacgaggauggccccacagccaaaaagcucaaaaccgagcaagggggagcucauuucucugugucaagucuggcggaaggcagcguuacuuccguggguucuguaaacccagcagagaacuuucgaguccuugugaagcagaaaaaggccucguucgaagaggcuagcaaucagcugaucaaccacauugaacaauuuuuggacacaaaugagacccccuauuucaugaaguccaucgacuguauacgcgccuuuagagaggaagcaaucaaauucucagaggaacagagguuuaacaauuuccucaaggcccugcaggagaaaguugaaauuaagcaguuaaaccauuuuugggagaucgugguccaagaugggauuacgcugaucaccaaagaggaagcuaguggcucuagcgugacagccgaggaagcaaagaaguuccuagcgccuaaagacaagccauccggagauacugcugccguauuugaggaaggcggggacguggaugaccuccuggauaugauauga

SEQ ID NO: 64915 - RNA, 741 nt, Artificial Sequence
  derived and/or modified sequence opt3 from XRCC6BP1__Homo_sapiens__NP_150592
auggccggcgcucccgacgagagaaggcgggggccugcagccggagaacagcugcaacagcagcacgugagcugccaggucuucccagagcgccucgcgcaagguaacccgcagcagggcuuuuucuccucauuuuucaccucuaaucagaagugucaacuucgacuguugaaaacauuagaaacuaaccccuacguuaagcugcuacucgaugcuaugaaacauagugggugcgccgugaauaaggaccgucacuuuagcugugaggauugcaacggaaauguauccggcgguuucgacgcaucuacgucgcagaucgugcugugucagaacaauauucauaaccaggcccacaugaauagagucgugacccaugaacuuauacacgcuuuugaucacugcagggcacauguugacugguucacaaacauccggcaccuggccuguucagaggugcgcgcugccaauuugagcggggauugcagucucgucaacgagauuuuuagacugcauuucggacugaaacaacaccaccagacuugugugagggaccgggcgacccucuccaucuuagcaguacgcaauauuucuaaggaaguugccaagaaagcuguggaugaggucuuugaaagcugcuucaacgaccaugagccuuuuggccgaaucccacacaauaagacauaugccagauacgcacauagggauuucgagaaccgggaccguuauuacuccaacauauga

SEQ ID NO: 64916 - RNA, 1830 nt, Artificial Sequence
  derived and/or modified sequence opt3 from XRCC6__Homo_sapiens__NP_001275905
augagcggcugggaguccuacuauaagaccgaaggggacgaggaagccgaggaagaacaggaggaaaaccuggaggcuucuggagauuacaaauauucagguagagacagucucaucuuccuuguggaugcaagcaaggccauguuugaaucccaaucugaggacgagcugacacccuucgauaugucgauucagugcauacagucagucuacaucagcaaaauuaucaguuccgacagggauuuguuagcgguuguguuuuauggcacugaaaaggacaaaaauucuguaaacuucaagaauauuuacgugcugcaggagcuagauaacccuggggcuaagcggauccucgaacuggaccaauuuaaaggacagcagggccagaagcgcuuccaagauaugaugggucacgggagcgacuauucccuuucagagguccugugggugugugccaauuuguuuagugauguucaguucaaaaugagccauaagcgaauaaugcucuuuacgaacgaagacaauccacacggaaacgacucugcaaaagccucccgugcuagaaccaaggcaggcgaucugagggacacaggcaucuuccuggaucucaugcauuuaaagaaacccgggggauuugacauuucacuguucuaccgggauaucauuagcaucgccgaggacgaggaucuucgcgugcacuuugaagagaguucuaaguuggaagaccugcuaagaaaagucagggcuaaggagacucggaaacgcgcccucucccgacugaaguugaaacugaauaaggauauagugauuagcguagguaucuacaacuugguucagaaggcgcucaaaccgccuccaauuaagcuguauagagaaaccaaugagcccgugaaaacaaagaccaggacuuucaacacaucgaccggcggguuacugcucccuucugacacgaaacggucccagaucuacggaucacgucaaaucauucuugagaaggaagagacugaagaacugaagcgcuucgaugacccaggcuugaugcuaauggguuuuaaaccccugguccuccugaagaaacaucacuaucuuagaccuagucuguucguguacccagaagagagcuuggugauaggguccucuacccucuuuagcgcacuguuaaucaagugccuggagaaagaagucgccgcucuauguagguauacaccgcggcgaaauauucccccuuacuucguugcccucgugccacaggaggaggagcuggacgaucagaagauccaaguaacucccccuggauuucagcuuguguucuugccauuugcagacgauaagcgcaaaaugcccuucaccgagaagauaauggcuacaccggaacaggucggcaaaaugaaggccauuguggagaaacugagauuuaccuauaggucagacaguuucgaaaacccuguucuccagcaacacuuucggaaucuggaggcgcuugcccuggauuugauggaacccgagcaggcaguggaccucacgcugccaaaggucgaggcuaugaacaagcgcuuaggcucccugguggaugaguucaaagagcuaguauacccucccgacuacaacccagaagggaagguuacuaaaagaaagcaugauaaugagggaagcgguucuaaaaggcccaagguggaauauucagaggaggaacucaaaacacacaucaguaagggcacccuggggaaguuuacugucccuaugcuuaaagaggccugccgugcuuacggacuuaagagcggccugaaaaagcaggaacuccuggaggccuuaacaaaacauuuccaggacuga

SEQ ID NO: 64917 - RNA, 5085 nt, Artificial Sequence
  derived and/or modified sequence opt3 from XRN1__Homo_sapiens__NP_001269786
augggcgugcccaaguucuacagauggaucagcgagagguauccuugccuguccgaagucguuaaagagcaccagauuccagaauuugacaaccucuaccuugauaugaaugggauaauccaucaauguucucacccgaacgacgaugacgugcauuuccggauuucagaugacaagaucuuuaccgauauuuuccacuaucuggagguauuguuucgcaucauaaaaccccgaaagguguucuuuauggccgucgacggaguggcuccucgugcaaaaaugaaucagcagagagguaggcgguuccgcagugccaaggaagcggaggauaagaucaaaaaggcuauugagaaaggcgaaacauuaccaacugaggccagauuugacagcaacugcaucacgcccgggaccgaauucauggcaaggcugcaugagcaccuaaaguacuuuguuaauaugaaaauuuccacagauaagucuuggcagggagugacuaucuauuucucgggccacgagaccccuggugaaggggagcauaagauaauggaauuuauucggucagagaaagccaagccagaccacgaucccaacacacgccauugucucuacggacuggacgcugaccuuaucaugcugggcuugaccagccacgaagcacacuucagucuccugcgagaggaggucagauucggcgggaaaaagacucaaagggugugcgccccugaagagacaaccuuucaucugcuccacuuaucccugaugcgggaauauauugauuacgaguucucuguacuuaaagaaaagaucacguuuaaauacgacaucgagcguauuauagaugacuggaucuugaugggauuccugguugguaaugauuuuauuccacaucuaccgcaccuccauaucaaccacgacgcucugccccuucuguauggcacuuacgugaccauauugccugagcucgggggauauauuaaugaaagcggccaccugaacuuaccacgcuucgagaaguaccuggucaagcucuccgauuuugacagagaacauuucucagagguguuuguggaucuuaaaugguucgaaaguaaggucgguaauaaauaucugaacgaggccgcggggguugcagccgaggaagcuaggaauuacaaggagaaaaagaaguugaaaggacaggaaaacagccuauguuggacagcccuggacaagaaugagggcgagaugaucacuucuaaagauaaccucgaagacgagaccgaagacgaugaccuguuugagacagaauuccggcaguauaagcgaaccuacuacaugacgaaaaugggcguggauguaguguccgacgauuuucuugcagaccaggcugccugcuauguccaagcgauccaguggauucugcacuacuauuaccauggggugcagucauggagcugguauuaccccuaucacuacgccccuuucuugagugauauccacaacauuucuacucucaagauacauuucgagcugggaaagccauuuaaacccuucgagcaguuacuggcaguucuaccggcugccuccaagaaucuccugccugcuuguuaccaacaccuuaugacaaacgaagacagccccaucauugaguauuacccaccugauuuuaaaaccgacuugaaugguaagcagcaggaaugggaggccgugguccugauccccuucaucgaugaaaaacgccuccuggaggcaauggagacuugcaaccauucgcuuaagaaggaagagagaaaaaggaaucaacacucugaaugucugaugugcugguaugaccgggauacagaguuuauuuacccaucccccuggccugaaaaguucccagccauagagcgcuguugcaccagauauaaaaucauuucauuggacgcuuggaggguggacaucaacaagaauaaaauuacgcguaucgaucagaaggcgcucuacuuuugcggcuucccgacccugaaacauauacggcacaaguuuuucuuaaagaaaagugggguacagguuuuucagcaaagcucccgaggagagaacaugaugcuggaaauccuaguggacgcagagucugaugaacucacagucgagaauguggccagcucaguccugggcaagaguguguucguuaacuggccccaccuugaggaagcuagagugguagccgucuccgacggugagacuaaauuuuauuuggaagagccuccagggacccagaagcuguacagcggcaggacagcacccccuucuaaagugguucaucucggagauaaggaacagucaaauugggccaaggaggugcagggcauuagugagcacuaccugcgccggaaagggaucauuaucaacgaaacuagcgcugucguguaugcccaauuacugaccggaagaaaguaccagauaaaucagaacggugagguaaggcuugaaaaacagugguccaagcaagugguuccauucgucuaucagacaauugugaaagacauccgcgcauucgauucucgauuuucgaauauuaagaccuuggacgaucucuucccccugcggagcaugguguuuaugcuaggcacuccguacuauggguguacgggagagguccaggacuccggcgauguuaucacagaaggucguauaagagugaucuucucaauuccuugcgagccaaaccuggacgcgcucauccagaaccaacauaaguacaguauuaaauauaaucccggguacgugcuggcuucuaggcuuggcguaagcggauacuuggucucccgcuuuaccggcucaaucuucauagggcggggaagcagaaggaacccucacggugaucauaaggccaaugugggccugaacuuaaaauuuaauaagaaaaacgaggaaguucccggguauacuaagaaggugggaucugaguggauguacuccagugcagccgaacagcuccuggcugaguaucuugaacgagccccagagcuguucagcuacauugcaaaaaauucucaggaggacgucuuuuaugaagacgauaucuggccuggcgagaacgaaaauggugcugagaaggugcaagagaucauuaccugguugaaagggcaccccguuuccacacucucacgcaguagcugugaccugcagauccuagaugccgcgauuguggaaaagauagaggaagagguagaaaaaugcaagcagcggaaaaacaauaagaaggucagagugaccgugaaaccacaccugcucuacaggccgcuggagcagcaacauggcgucaucccugaccgugaugccgaguucugucuuuuugaccgcguugugaacguacgggaaaauuucucggugcccgucggauugagaggcacuauuaucgggauuaagggagcuaacagggaggcagaugugcuguucgaaguuuuauuugacgaggaauucccaggcggucucacaauccgaugcucccccgggcggggauaucgccugccuacgucugcccuugugaaucugagccacggcucaagaagugagaccgguaaccagaaacuaacugcuauagucaagccacagcccgccgugcaucagcacuccucuagcuccucaguuagcaguggccaccucggggcacugaaccauucuccucaauccuuguuugugccgacacaggucccaaccaaagaugacgaugaguucuguaauaucuggcagagccugcagggaucgggcaagaugcaauacuuucagcccacaauucaggaaaagggggcgguauuaccucaagagaucucacaggugaaccagcaccauaaaucuggauucaaugacaacaguguuaaguaccagcaaaggaaacacgacccacaucggaaguuuaaagaagagugcaagucccccaaggccgaauguuggagccagaaaaugucuaauaagcagccuaacagcggcauugagaauuuccucgcuucccugaacaucucaaaagagaaugaagugcagaguagccaccacggugagccgcccucugaagagcaucuuuccccacaaucauuugccaugaaggggacucgaaugcugaaagagauauugaagauugauggaaguaacaccgucgaccacaagaaugaaaucaaacagaucgcaaacgagauuccugugagcuccaauagacgcgaugaauauggccuccccucucagccaaagcagaacaaaaagcuggcuucguacaugaauaaaccucauagcgccaacgaguaucacaacguacaaucaauggacaauaugugcuggcccgcaccaucccagauaccgccugugaguacgcccgucaccgaacuaucuaggaucuguagccugguugguaugccacagcccgauuucuccuuucuucguaugccucagacaaugacugugugccaagugaagcucucaaacggccuguugguccacgggccacagugccauucugagaaugaggccaaggaaaaagcugcgcuguucgccuuacagcaacucggaagccugggcaugaacuuuccccuuccuagucagguguucgcaaauuacccguccgcuguuccacccgggaccauuccucccgccuucccaccucccacagccaacaucaugccaagcucuucacaccuguuuggauccaugccuuggggcccgaguguacccgugccagguaagccuuuccaucacacuuuguauagcgggaccaugcccauggcuggaggcauuccagguggcguccauaaucaguuuaucccucuccaggugacgaaaaagcggguugcaaacaaaaagaauuucgagaacaaagaagcccaaucgucucaggcgacacccgugcagaccucccagccggacagcucaaauauagucaaggugaguccaagagagucuuccagcgcuucacugaagaguagcccuaucgcccaacccgcauccucuuuucagguagaaacugccagccaggggcacuccauuucacaccauaaaucuacaccaaucaguucgagcaggcgcaagucccgaaaacuagcugucaacuucggagugucuaagcccucagaguga

SEQ ID NO: 64918 - RNA, 2853 nt, Artificial Sequence
  derived and/or modified sequence opt3 from XRN2__Homo_sapiens__NP_036387
augggcgugcccgccuucuuuagauggcugagcaggaaguacccuuccaucauugucaacugcguugaggaaaaaccaaaggaguguaauggggugaaaauaccgguagacgcuucuaagcccaacccuaaugauguggaguucgacaaccucuaucuugauaugaauggaaucauucacccaugcacccaucccgaagacaaaccugcaccaaagaacgaagaugagaugauggucgccaucuuugaguacauugaccggcuguucucaaucgugcgcccccgacguuuguuauauauggcgauagaugguguugcuccuagagccaagaugaaucagcaaaggagucggcgcuuuagagcaagcaaagaaggcauggaggccgcuguggaaaagcagaggguccgggaggagauccuggcaaaagggggauuccuaccaccggaagagauuaaggaacgcuuugacuccaacuguaucacacccggcacugaguucauggauaaucucgccaaaugccugcgauacuauauugcugacagacuuaacaaugauccugguuggaagaaccugacggugaucuugucugacgccucggcgccaggggaaggagagcacaagauaauggauuacauuaggcggcagcgugcacagcccaaucaugacccuaacacccaccauugucucugcggcgccgacgcugaucugaucaugcugggccucgccacacacgagccaaauuuuacuauuauccgcgaagaguucaaacccaacaagccgaaaccuuguggguuaugcaaccaauuuggacacgaaguaaaggacugugagggucugcccagagagaaaaagggcaaacaugaugaacuugcagacucauugccaugcgcugagggggaguucaucuuucugaggcuaaauguucuccgggaauaucuggaacgagagcuuaccauggccagccugccuuucacauucgauguggaacgcaguauugacgauugggucuuuauguguuucuuugugggaaacgacuucuugccccaccucccaucccuggagauaagagagaaugcgaucgauagguuagugaacauuuacaagaaugucguucauaagaccggcgguuaccugacugaaucuggguaugugaaccuccagcggguacagaugaucaugcuugccgugggagaggucgaagacagcauauuuaaaaagcgcaaagaugacgaggacuccuucagaaggcgucagaaggagaaacggaagcgaaugaagagagaucaacccgcauuuacaccuucaggcauucugaccccacacgcuuugggcaguaggaauagcccggggucucagguggccuccaacccccgccaggcugccuacgaaaugcggaugcagaauaacucaagcccuaguaucucuccaaauacguccuucacuagcgacggaucgcccucuccucuagguggcaucaaaagaaaggcagaggauuccgacucagaaccagagcccgaagauaacguuaggcugugggaggccggguggaaacaacgcuauuacaagaauaaauuugacguggaugcugcggacgagaaguuccgacggaaggucgugcagaguuauguagaaggacucugcuggguucugcguuacuauuaccagggcugcgcaagcuggaaaugguacuauccguuucacuacgccccuuucgcuuccgauuuugaggguauugccgacaugccaucugauuucgaaaaggggaccaaacccuucaagccucuugagcaacugaugggcguguuucccgcagccagcggaaacuucuugccaccuucauggagaaaacucaugagugaccccgauuccagcaucauugacuuuuauccagaagacuucgcuauagaucugaauggcaagaaguacgccuggcagggggucgcauuacugccguuuguggacgagaggcgccuacgggcggcucucgaggaagucuauccugaucugacacccgaggaaacuagaaggaacucucuuggaggugacguguuguucguuggcaaacaucacccacugcaugauuuuauccucgagcuguaccagaccgggucaacagaacccguggagguaccuccagagcuuugucacggcauucagggaaaguucagucuggacgaagaggccaucuugcccgaucaaaucgucugcagcccugugccgaugcuccgagaccugacccagaacacgguuguguccauuaauuuuaaagauccacaguucgcagaagacuauauauuuaaggccgucauguuacccggugcucgcaaaccugccgcagugcugaagccaucugauugggagaaaucgagcaacgggcggcaguggaagccccaacuaggcuucaauagagacaggcguccuguacaucucgaucaggcugccuuucgcacucugggacacgugaugccgcggggcuccgggacaggaaucuacucaaacgcggcucccccaccuguuaccuaccaggguaaucuuuauagacccuugcugaggggccaggcccaaauuccaaagcucaugaguaacaugcgaccucaggacucuuggcgggggcccccaccgcuguuccagcagcaacgcuucgacagaggagucggcgcagagccuuuacugcccuggaauaggaugcuucagacucagaacgccgcuuuucaaccaaaucaguaccagauguuggccggucccgggggcuauccuccacggcgagaugacagaggaggccgccagggguaccccagggaaggacguaaauauccucucccgccacccagcggccgguacaacuggaauuga

SEQ ID NO: 64919 - RNA, 1797 nt, Artificial Sequence
  derived and/or modified sequence opt3 from XRRA1__Homo_sapiens__NP_001257309
auggccuucagcggcaucuacaagcuggacgaugggaaacccuaucucaacaauugcuuuccugcuagaaaccuucugagggugccagaggaaggacagggucacugguuggucguucaaaagggcaaucuuaaaaagaaaccgaaggggcuggugggagcacaggccgagcggcgcgaaucccuaaaggcgaccucuuucgaguuuaaaggcaagaaagaaucacgacgugagaaccagguagaccuccccggucauauucuggaucaggcuuuccuucugaagcaccauugugugagaaaaccuagugacuugugcacaauaaaugccaaggagaacgauuuuaagcacuuccauagcgucaucuacauuaaugcauccgaaaaccuccugccacuggaggccuuucacacuuuccccgcucucaaagaauuagaccuggcauuuaaugggaucaagacgauuuaugugaaauacggagauuucaaacuuuuggaguuucuggaccuaucuuucaacucgcucaccguugaggccaucugugaucugggcauacuuccucaccugaggguguugcuccugacaggcaauggguuaacuucacugccacccaaccucgcugucgccgaacaagaggcgagcgugaccagucuuacauccaaacgguauauccugcgcuuuccugcauuggaaacccuaaugcuggacgauaauagacucucuaacccaagcugcuucgccucccuggcuggacuuaggcggcugaagaaauugucacucgacgagaaucgcauuauccgaaucccguaccugcagcagguacaguuauaugaugaaaguguugacuggaacgguggcagagggagcccccauaaggagccucaauucaugcugcagucuaagccaaggaugcuagaggacuccgaugaacagcucgacuacacugugcugcccaugaaaaaggaugucgaccggacaggagugccuccacuuuugaaaucauuucugcaggagcgucucggcauucaccugauacgcagaaagauugugaaacccaagcaucacguccuuaugagcaggaaggaaaguuggaaaguuaagucugagaucccgaaagugccuaagcaaccccugguauugcaccauccacggaugaccacgacuaaauccccuagcaaggauaugcucgaacccgaggccgagcuggcagaagacuuaccaaccacaaagucgacuucuguggaguccgaaaugcccaccgagaaccuggaaggucacucaccuaguugucgaacauucgucccacuaccgcccauuugcagcaauuccaccgugcauucugaggagacgcucagccaccugucagauacuacaguucgccuuaguccugaaagaccauccgacgaggauagcaaaucuaccgaaucaaucuuuuugacucaggugagugagcugcccagcuccgucauccauaaggacgaucucgagcugaaagaaaaggaccagaaaaagccuccaacagcucccagggaggugaaggggacccggcgcaaauuaccgacggccuuccugccuucuaaguaccacggauaugaagaguuauugaccgcgaaaccagaccccgccuuuauugaaccuaagggcauacaaaagaacgcacaggcucuccagcagaugcugaagcacccccuacugugucauucgagcaaaccaaagcucgauacacugcaaaagccuuacguacacaaagagaagagaguucuuuccugcacuucaggccagaaugggggaugguga

SEQ ID NO: 64920 - RNA, 1182 nt, Artificial Sequence
  derived and/or modified sequence opt3 from XXYLT1__Homo_sapiens__NP_689744
augggccugcucagagggggacuucccugcgccagggcuauggcacggcugggugccgugcgcagccacuacugugcguuguuacuggcugccgcacuagccgucugcgcuuucuauuaccucggcuccgggcgagagaccuuuucuucagcaacaaagcgucugaaagaagccagagcuggagccccugcggcaccaaguccgcccgcccuugagcuggcuaggggcagcguugccccugcaccaggugcuaaggccaaauccuuggaagggggaggcgcgggccccguggacuaucaucuccugaugauguucacuaaggccgagcacaacgcagcucugcaggccaaagcucggguagcccuccgcucuuuacugagacuugcaaaguuugaagcccaugagguguugaaucugcacuucgucucggaggaggcuucaagggaaguggcgaaggggcuacuccgggaacugcuuccuccagcagccggauuuaaauguaagguuaucuuccaugauguggcuguccugacggacaaauuguuucccauuguggaggccaugcaaaagcacuucagcgcaggucucggcaccuacuauagugauuccauauuuuuccugucuguagccaugcaccagaucaugccuaaagagauuuuacagaucauucagcuggaccucgaucuuaaguuuaagacaaacauccgcgaacuguucgaggaauuugacagcuucuugccaggggcuauaaucggaauugcccgagagaugcaaccgguuuacagacauacuuucuggcaguuuaggcacgaaaauccccagacccgggugggcgguccuccacccgaggggcuaccuggauucaacuccggcgucaugcugcucaaucuggaggcaaugcgucagucaccacuuuauagucgccuguuggaacccgcgcaagugcagcagcucgcugauaaauaccauuuuagaggccaccugggggaccaggauuucuuuacaaugaucggaauggagcacccgaaguuauuccaugugcuggacugcaccuggaacaggcaacuauguacuugguggcgggaucacgguuacagcgacgucuuugaagccuauuuccgaugcgagggccauguuaaaauuuaccacgggaauuguaacacaccuauccccgaagauuga

SEQ ID NO: 64921 - RNA, 1611 nt, Artificial Sequence
  derived and/or modified sequence opt3 from XYLB__Homo_sapiens__NP_005099
auggccgagcacgcucccagaaggugcugucugggcugggacuucagcacccagcaagugaaggucguugcaguggaugccgaacucaacguauuuuacgaggaauccgugcauuucgaccgggaucuuccugaguuuggcacacagggagguguccacgugcauaaagacggccugacuguuacgucuccaguguugauguggguccaggcguuagauaucauucuggaaaagaugaaagccucaggguucgacuuuagucaggugcuagcccucagcggagcaggccaacagcacgguuccauauauuggaaggccggggcucagcaggcacugaccucucuuucgccggaucugcgcuugcaucaacagcuccaggacugcuucucaaucagcgauugucccguauggauggacaguuccacaacugcccagugccgacaacuggaggcugccguuggaggcgcgcaggcacugucuugucucaccggcagccgugccuacgagagauuuacagggaaucagauugcuaaaaucuaucaacagaacccugaagccuacucccacaccgagaggauuucauuagugaguagcuucgcagcuucucuguuucuuggauccuauucaccaaucgauuacagcgacgguaguggcaugaauuugcugcagauacaggauaaggucuggucucaagccugccuaggggcgugugcuccccaccucgaagagaagcuguccccuccagugcccagcugcucgguggucggagcaaucucuuccuauuacguucagcgguacggcuucccuccagguuguaaagugguagcuuuuacuggggacaacccggccucacuugcuggaaugcgccuggaggaaggcgacauugccgugaguuugggcacaagcgauacccucuuccugugguuacaggagcccaugccugcacuggaagggcauaucuuuugcaauccagucgacucccagcacuauauggcccuccuuuguuucaagaacggaucucugaugagagagaaaauuaggaaugaaagcgugucacggaguugguccgauuucagcaaggcuuugcaaucuacggagauggguaacggcgggaaucuaggauuuuacuucgacguuauggagaucacucccgaaauaauuggccgccaucgauuuaacaccgagaaucacaaaguggcggcauucccuggugaugucgaagugagagcccugaucgaggggcaguuuauggcuaagaggauucacgccgaaggccucggauaucggguaaugucaaagacaaaaauccuggcaacuggcggggccagucauaaccgugagauccuucagguucuggcugacguguucgaugccccagucuacgugauugacaccgcaaauagcgcgugcgucggauccgcuuaucgcgccuuucacgguuuggcaggcgggacagaugugcccuucucugagguugugaagcucgccccgaacccuagacuggcugccacccccucgccaggagcaagccagguauacgaggcuuuacugccucaauaugccaaacuagaacagaggauacucucccagacgcgggggcccccagaauga

SEQ ID NO: 64922 - RNA, 2880 nt, Artificial Sequence
  derived and/or modified sequence opt3 from XYLT1__Homo_sapiens__NP_071449
augguggccgcucccugcgcaagaaggcuggcccggcgcagccacuccgcgcuccuugcugcccugaccgucuuguuacugcagacacucguuguguggaacuucucuucacucgacaguggcgcaggggagcgacguggaggugccgcuguaggcgggggagaacaaccuccaccggcacccgccccuagaagggagcggcgcgaucugccagcugaacccgccgcggcaagaggcggugggggaggcggcgggggagguggcgggggaaggggcccucaggcccgggcucgcggugggggaccaggcgagccccgaggccagcagccugccagcagaggggcacuuccagcuagggcccuggacccgcaucccuccccuuugaucacucucgaaacgcaagauggauacuuuucucaccggccaaaggagaaagugcguaccgacucgaauaacgaaaauucaguccccaaggauuucgagaacguggacaauagcaacuuugcgccucgcacacagaaacagaagcaucagccagagcuggccaaaaagcccccgaguagacaaaaggaacugcucaaaaggaaguuagagcagcaggagaaagguaagggccacacuuucccugggaaaggacccggcgaaguucugccaccuggugaucgggcagcugccaauuccucucaugggaaggacgugagccgacccccacacgcucgcaagaccggcggauccucacccgagacaaaauaugaucagccuccaaagugugacauuaguggcaaagaagccauaagcgcacuuucuagagccaaguccaaacacugcaggcaagagaucggggaaaccuacugucggcauaaguugggacugcuaaugccggagaaagucacucgcuuuugcccccucgaggguaaggcuaacaagaaugugcagugggaugaagacucaguagaguauaugccugcgaacccaguuagaauugcauucgugcuggucgugcacggcagggccagccgucagcuucaacggauguuuaaagcuaucuaccauaaggaucacuucuauuacauucacguggacaaacgaaguaauuaucugcauagacaggucuugcagguuucuaggcaguacuccaacgugcgcguaacacccuggcggauggccaccaucuggggaggggcaagccuccugucgacguacuuacaaucuaugagagaccugcucgaaaugacugauuggccuugggacuuuuucauaaaucuuuccgccgcugauuauccaaucaggaccaacgaccagcugguggccuuuuugucacgcuaccgagauaugaauuuccuaaagagucacggccgggacaacgcacguuuuauuagaaaacagggucuggauaggcuauuccuggagugugacgcgcauauguggcgccuuggggaucggagaauccccgaaggcauugcugucgacggaggcagcgauugguuccuguugaacaggcgauuuguggaguauguuacauucuccacugacgaccucgugaccaagaugaagcaguuuuacucuuauacacuguuaccggccgagagcuucuuucacaccguccuggaaaauucaccucauugcgauacgaugguggacaacaaucuacgcaucacuaacuggaaucggaaacucggguguaagugccaauacaaacacauaguagauugguguggaugcaguccaaacgacuucaagccccaggauuuucacagauuccagcagacagcaaggccuaccuuuuucgcccguaaauuugaggcuguugugaaucaagaaauuaucggucagcuggacuauuaccuuuacggcaacuaucccgccgggacuccaggauugcgcuccuacugggagaaugucuaugaugaaccugacggcauucauagccugucugaugugacacucacccuguaccacucauucgcacggcuuggucugagaagggcugagacgaguuugcauaccgacggggagaacagcugucgauauuaccccaugggccacccagccuccguccaccucuauuuucuggcggaucgguuccagggauucuuaaucaagcaucacgccacaaaucuggcugugucuaagcuagaaacucucgagaccuggguuaugccgaaaaagguguuuaaaaucgcaucgccucccagcgacuucggccgccugcaguuuuccgaaguagggacagauugggacgccaaggagagacuuuucaggaacuuuggaggcuugcuggguccaauggacgagcccgucgggaugcaaaaauggggaaagggcccuaaugugacuguuaccgugauuugggucgauccagugaacguaauagcugccacauacgacauccucauugaaucaaccgcagaguucacucauuacaagcccccucugaauuuaccgcugcggccagguguguggacgguuaaaauccuucaccauuggguccccguggcggaaacaaaguuuuugguggccccucucaccuucaguaaccgacagccaauaaaacccgaggaagcucugaagcuacacaacggcccucugagaaaugccuauauggagcagucuuuucaaagccucaacccgguccugucccuucccauuaauccagcacagguugagcaggcucgcaggaacgccgcaucaacugggaccgccuuggaaggauggcuggauagcuuagugggcgggauguggacagcuauggacaucugcgcgaccggaccuacugccugccccgugaugcagacauguucucaaacggcaugguccaguuucagcccagauccuaaaucugagcucggcgcuguaaagcccgacggucgucugcgguga

SEQ ID NO: 64923 - RNA, 2598 nt, Artificial Sequence
  derived and/or modified sequence opt3 from XYLT2__Homo_sapiens__NP_071450
augguggccagcgcuagaguccagaagcugguuaggcgguacaaacucgcaaucgccaccgcgcuugcuauucuguuguuacaaggccuggugguaugguccuucucugggcuagaggaagacgaggccggagaaaagggucgccagcgaaaaccccguccucucgauccaggcgaggggucaaaggacacagauaguagcgcaggaagaaggggcuccacuggucggcgccacgggagauggaggggacgggccgaaucuccgggcgugcccgucgcuaaagugguucgcgcagugacgucgcgacagagagccucaaggcgggucccuccagcucccccuccagaggcccccggccgucagaaccugagcggggcggcagccggagaggcucuugugggugccgcaggcuuuccuccacauggggacaccggaaguguagaaggcgcuccgcaacccacagauaaugguuucacuccuaagugcgagauaguugggaaggacgcccuguccgcguuggcccgcgcaucuaccaaacagugucagcaggaaaucgcuaacguggucugccuccaccaagccggaagccugaugccaaaggcugugcccagacauugucagcugacaggcaaaauguccccuggcauucagugggaugagucacaggcccaacagccaauggacgggcccccggugaggaucgcauauaugcucgucguucacggacgggccauucgacaguuaaagcgccugcuuaaagcuguguaccaugagcaacacuuuuucuauauccacguagauaagagaagugacuacuugcauagggaaguggucgagcuggcgcaggguuaugauaaugugcggguuaccccuuggcgcauggugacuauauggggcggggcaagccuacucagaauguaccugaggucuaugcgugaccuucuggaaguccccggaugggccugggacuuuuucaucaacuuguccgcuacagauuauccaacccggacgaaugaggaacucguggccuuucugucaaagaaccgagacaaaaauuucuuaaagagccacggcagagauaacaguagguuuauuaaaaagcagggucuggaccgccucuuccaugagugcgauucucacauguggcggcuuggggagagacagaucccugcaggcauuguaguugacggaggcuccgauugguuugugcugacuaggagcuucgucgaauacguggucuacaccgacgaucccuugguggcccaacuacgccaguuuuauacauacacucugcucccagcugagucguucuuccacaccguucuggaaaauucucuugccugugagacacugguggacaacaauuugcgaguaaccaacuggaaucggaaacucgggugcaagugucaguauaaacauaucgucgauuggugcggauguucccccaacgacuuuaagccucaggauuuccugcguuuacaacaggugucaagaccaacguuuuucgcaaggaaguuugaaaguacuguuaaucaggaggugcuggagauacuagacuuccaccucuacgguagcuauccgcccggcaccccugcgcugaaggcuuacugggaaaacacauaugacgccgcagaugggccauccggacuuucugacgucauguugacugccuacacagcuuuugcccgccugagccuccaucacgcagcuaccgccgcgcccccuaugggcacgccacugugccgguucgagcccagaggucuuccgucaagugugcaucuguacuuuuaugaugaccacuuccagggguacuugguaacccaagccgugcagccuuccgcucagggcccagcagaaacacucgagauguggcugaugccccagggcagcuuaaaacugcuaggaaggucugaucaagccucacgacuccagagucuggaaguugggacugacugggauccuaaagagcgccuuuuucggaacuucggagguuugcugggcccccucgacgagccagucgcugugcagagaugggccagggggccuaaucugaccgcaacaguggucuggauugaucccacuuauguuguggcgaccagcuacgacaucacaguggauaccgaaacugagguaacgcaauauaagccaccguuaucccguccucugcgccccggaccauggacaguccggcuuuugcaguuuugggaaccccucggcgagaccagauuccuggugcuaccucugacuuucaacaggaaacucccacugcgaaaggacgaugccucuuggcuucacgcuggucccccucauaaugaguacauggaacagucguuucagggguugagcuccauucugaacuuaccgcaaccagagcucgccgaagaggcagcucagcggcacacccagcugacaggccccgcccuugaagcauggaccgaccgcgagcugucaaguuucuggucuguugccggauugugugcuaucggcccuagcccaugccccucccucgagccuugcagacugacuucauggagcucucuauccccggaccccaagagugaacuggggccagugaaagcggauggaaggcuccgguga

SEQ ID NO: 64924 - RNA, 621 nt, Artificial Sequence
  derived and/or modified sequence opt3 from YAE1D1__Homo_sapiens__NP_001269375
augagcugggugcaggccgcuucccugauccaaggccccggggacaagggagaugucuucgacgaggaagcagaugagucucuccuugcccagagagaauggcagucaaacaugcagaggcggguuaaagaggguuaccgcgacggcauugaugcggggaaggcugugacccugcaacagggauuuaaucagggcuauaaaaagggugccgaaguaauauugaacuacgggcgauuacguggaacacugagaaauaguacugacuggagccuacucggccugagggcaccucuucgguccccagaggugggcacgcagcuguugccgcgcccccucccugucccagggcacauggccucuggagcuacccccaaacaaccuacagagcuggaagcaacucugcucucguuagugccacagucagguagagccacccccagguucccugcucggcugcgcgccccaggcccggggacacccagccaucgaagaagguuucggcguaagccucaccgcgauccagcggcagccugccccgcuuggccuccagaggcccccaguaacuccgaaacccauuucucuacuuauaauagaaucauuaucaggggaggccacauuuga

SEQ ID NO: 64925 - RNA, 1515 nt, Artificial Sequence
  derived and/or modified sequence opt3 from YAP1__Homo_sapiens__NP_001123617
auggaccccggccagcaaccuccaccgcagcccgccccucaggggcagggacaaccacccagccagccuccacagggucaggggcccccuuccggcccaggacaaccggcucccgcagccacccaggcggcuccucaggccccacccgcaggccaccagaucgugcaugucagaggugauucugagacagaccuggaagcccucuucaacgcuguuaugaauccuaagacugcaaacgugccacaaacgguacccaugaggcuucggaaacugccggauucauuuuucaagccucccgagccaaaaagucacagccgccaggccuccaccgacgcugggacagccggagcguugacuccucagcaugugcgagcacacucuucgcccgccucauuacaacugggcgcugucagcccaggcacccuaacacccaccggggugguuaguggaccugccgcaacuccaacagcucagcaucuccgucaguccucuuuugaaauuccggaugacgugccccugccugccgguugggagauggcgaagaccagcuccggccagagauacuuccuuaaucacauagaucaaacgacuaccuggcaggacccaaggaaagccaugcugucacagaugaacgucacagcacccaccaguccuccagugcagcaaaauaugaugaacagcgcuucugggcccuugccggauggaugggaacaggccaugacucaggacggcgagaucuauuacauuaaucacaagaacaagacaaccuccuggcucgauccucggcuggacccacgcuuugcuaugaaucagagaaucucacaaagcgcccccguaaaacagccucccccacuggcaccucagaguccccagggugggguuaugggaggcucuaacuccaaucaacagcagcaaaugaggcuccagcaguuacagauggagaaggaacggcugcgccuuaaacaacaggaguugcugcgacaggccaugagaaacauuaauccaagcacggcuaacucgccgaagugccaggaacuagcgcucaggucucaacugccuacucuugagcaggauggcgggacacagaaucccguguccucaccaggaaugagucaggagcugcggaccaugacuacaaacagcuccgaccccuucuugaacucugguaccuaucauagccgugacgaaucaacggauaguggccucuccaugagcucuuacucagucccucgcaccccagacgauuuucugaauaguguggacgagauggauacaggggacacuaucaaccaaagcaccuuacccucccagcagaauagauucccugauuaucuggaagcaauaccgggaacaaacguggaccucggcacucuugagggugaugggaugaauaucgaaggcgaggagcugaugccaucuuugcaagaagcccuaucgagcgacauucugaacgauauggaguccguccucgcugccaccaaacuggacaaggaaucauuucuuacauggcuguga

SEQ ID NO: 64926 - RNA, 1434 nt, Artificial Sequence
  derived and/or modified sequence opt3 from YARS2__Homo_sapiens__NP_001035526
auggccgcucccauccugaggagcuucuccuggggcagauggucugggacccucaaccuuucagugcuguugccuuuaggacugcggaaggcacacaguggugcccagggccuacucgcggcucaaaaagcccgcgggcuguuuaaggacuucuuuccagagacaggaacuaaaauugaacuuccggagcuguucgaucgaggcacggcaaguuuuccccagaccauauacugcgguuucgacccuacagccgauuccuugcaugucgggcaccuccuggcucugcucggauuauuucaucugcagcgugcaggccacaauguuaucgcccuugugggcggggcuacugccagauugggagacccaucugguaggaccaaggaacgggaggcgcuggaaacagagcgcguaagagcaaacgccagggcucuacggcucggccuggaggcccuugcagcuaaucaucagcaacuguucaccgaugggcgcucguggggaucauuuacuguguuggacaacagcgccugguaucagaaacagcaccucgucgauuuccuggcggccgugggcggucacuuucgaauggggacauuacugaguagacaguccguucaacucaggcuuaagucucccgaaggaaugagccuggcagaguucuuuuaccagguguugcaggcuuaugacuucuacuaucuauuccagcgguacggcugucguguccaacugggcggguccgaucagcucggaaauauuaugucagguuaugaauuuaucaacaagcugaccggcgaggacguguucgggauuacgguaccucuuaucacuagcaccacaggagccaaacugggcaagagcgcugguaaugccguuugguugaaccgcgauaaaacuucuccauuugagcucuaccaguucuuugugagacaacccgacgauuccgucgaaagguaccugaaguuauucaccuuucugccucuaccagagauagaccauaucaugcagcuccacgugaaagaaccggagcggcgagggccccagaagcgccuggcagccgaagugacaaaacuuguccauggcagagagggauuggacucagcuaagaggugcacccaggcgcuguaucacagcaguauugaugcacucgagguuaugucugaccaagaacugaaggagcuuuucaaagaagccccuuuuuccgaguucuuucuggauccaggcacgagcguguuggacacuugucggaaggcuaaugccauccccgaugggccucgcggauacagaaugauuacagaagguggcguaucgaucaaccaccaacaggugaccaauccagagucuguccucauaguggggcagcauauucugaaaaacggauuaucccugcuaaagaucggcaaaaggaauuucuauauuaucaaguggcuccagcuguga

SEQ ID NO: 64927 - RNA, 1095 nt, Artificial Sequence
  derived and/or modified sequence opt3 from YBX2__Homo_sapiens__NP_057066
augagcgagguggaagccgcugcaggcgccaccgcggugcccgcugccacaguuccugcaacugccgcuggggugguagcaguggucgugccaguuccggccggagagccccagaaggguggcggggcuggaggcggugggggagccgcguccggcccugcagccggcacgccaucugcucccgggucaagaaccccuggaaacccagccacagcagugagugguacucccgcuccuccagccaggagccaagcggacaaaccgguccuggccauccaggugcucggcaccguaaagugguucaauguucggaacggguacggauuuauuaaucgcaacgauacaaaagaagacguguucguccaccagaccgcaauaaagcgaaauaacccccguaaauuucuuagauccgugggcgauggugagacuguggaguucgacgucguugaaggggagaagggagcugaagccacaaaugugaccggcccuggcgggguaccagugaagggaucuagguaugcucccaaccggcgcaaaucgagaagguuuaucccucggccacccucagucgccccgccucccaugguggcagagauuccaagcgccgguacgggcccugggaguaagggagaacgcgcugaggauuccggccagcgacccagaagguggugcccacccccuuucuuuuaccggcgucgcuucguuagagguccaaggccgcccaaucaacagcagccuaucgaggggacugaccggguggaaccaaaagagaccgcgccccuggaaggccaucagcaacagggagaugagcgagucccuccaccccgcuuuagaccgagguaucggcgcccuuucagaccaaggccccgucagcagccuacaacugaaggcggggacggagagaccaagcccucucaagguccagcagauggcagccggccugagccccagcgaccaagaaacaggccguacuuucagcgccggagacaacaggccccugggccccagcaggcuccaggacccaggcaaccugccgcaccagaaacauccgcccccgucaauucaggcgacccuaccacgacuauuuuggaguga

SEQ ID NO: 64928 - RNA, 912 nt, Artificial Sequence
  derived and/or modified sequence opt3 from YBX3__Homo_sapiens__NP_001138898
augagcgaggccggcgaagcuaccacaacuacgaccacaacucugccccaggcaccuaccgaggccgcggcugccgcaccacaagacccggcccccaaguccccuguggggucuggagcuccacaggcagccgcucccgccccugcggcacacgucgccgguaacccaggcggggaugcugcccccgcagcuacaggaaccgccgcggccgcaucacucgcuacugccgcuggcagugaagacgccgagaaaaagguucuugcaacaaaagugcuggguaccguaaagugguucaaugugagaaacggguacggauuuaucaauaggaacgauacgaaagaagacgucuucgugcaucagacugccauuaagaagaauaacccucggaaauauuugcgcagcguuggcgauggcgagaccguggaguuugacgucguggaaggggagaagggagcugaagcggcaaauguaacagguccagauggcguuccgguggaggggucccgauacgccgcugaccguagaagguaucggcgcggauacuauggcagaaggcggggucccccucgcaacgccggggagauaggagaaaugaaagauggcgucccagagggcgcacaguuacaagggcccgugcaccgaaauccuacuuacagaccaagguaucggucucguggacccccgcgcccuagacccgccccagcugugggugaagccgaggacaaggaaaaccagcaggcaaccucgggcccuaaucagcccucagucaggcggggguaccgacgcccauacaacuauagaaggcggccccgcccuccaaaugcgccgagccaagauggaaaagaggcuaaggccggcgaggcacccacagaaaacccugccccacccacccagcagaguuccgcugaguga

SEQ ID NO: 64929 - RNA, 972 nt, Artificial Sequence
  derived and/or modified sequence opt3 from YDJC__Homo_sapiens__NP_001017964
augagcagacccaggaugcggcugguggucaccgccgacgauuucggcuacugcccucgccgagacgaggggaucguugaggcuuuucucgcaggagccgugacauccguaucucuucuggugaacggugcggcuacugaaucagccgcagaauuggcccguagacacaguauuccaacgggcuuacaugcuaaucugagcgaggggaggccggucggacccgcacggcgcggcgccuccucucuacucgguccugaaggguucuuucugggaaagaugggcuucagagaggcuguggccgcgggcgauguugaccuuccacaggugagggaggaacuggaggcacaauugucguguuuucgggaacuccuggggcgcgcccccacccacgcugauggacaucagcacguccaugugcugccugguguaugccagguuuucgccgaggcacuccaggcuuauggcgugcgauuuacaagauuaccacuggagaggggagucgggggcuguacuuggcuugaagcccccgcgcgggccuucgcaugcgcuguggagcgugacgcccgcgcugccguggguccuuuuucaagacacggguugagguggaccgaugcauucgucggacugagcacauguggccggcacaugagugcccaucgaguuuccggcgcucuagcgcgcgugcucgaagggacccuggcaggacacacucuuacagccgagcugauggcucauccagguuacccgucuguacccccuaccggcgggugcggagaaggcccagacgccuuuagcuguuccugggagagauugcacgagcucagggugcugacggcacccacuuuacgggcccaacuggcucaggaugguguccagcucugcgcccuugacgaucuggacucaaaacgcccuggggaagaggugccaugugaacccaccuuggagccguuccuagaaccuagucugcucuga

SEQ ID NO: 64930 - RNA, 684 nt, Artificial Sequence
  derived and/or modified sequence opt3 from YEATS4__Homo_sapiens__NP_006521
auguucaagagaauggccgaguuuggccccgacagcgggggaagggugaaaggugucaccaucguuaagccuauuguguacggcaacguagcucgguauuucgggaaaaagcgcgaagaggauggacacacacaucaguggacuguguacgucaaaccauaucgaaaugaagacauguccgcauacgugaagaagauacaauuuaaacugcacgagucuuauggcaacccgcuccguguugugacgaagcccccuuacgaaaucaccgagacagguuggggagaguucgaaauuaucauuaaaaucuuuuucauagauccaaaugagagacccgucacucuuuaucaucuguugaaguuauuucagucagacaccaacgccaugcuggggaaaaagacagugguaagugaguucuacgaugaaaugaucuuucaggacccuaccgcgaugaugcagcaacuacucacuacaagcaggcagcugacccuuggcgcuuacaagcacgagacggaguucgccgaacuggaaguuaaaacucgggagaaguuggaagcagccaaaaagaaaaccuccuuugagauugcugagcucaaggaacgccugaaagcaucuagagagacaaucaauugccugaagaacgaaauuaggaagcucgaggaagaugaccaggccaaagauaucuga

SEQ ID NO: 64931 - RNA, 1632 nt, Artificial Sequence
  derived and/or modified sequence opt3 from YES1__Homo_sapiens__XP_011524038
augggcugcaucaagagcaaagagaacaagucccccgccauuaaauacagaccugaaaauaccccagagccggugucuacaucagucagucacuauggggcugaacccacuacgguuagcccuuguccauccucuucggcaaagggaaccgccgugaacuucucaagccugaguaugacacccuuugguggcuccucugggguaacuccuuucggaggcgcgagcuccucauuuaguguggucccaagcucuuaccccgcuggucucaccgggggagugacaauauucguugcccuuuaugacuacgaggcaaggaccacugaagaucuguccuuuaaaaagggcgagcgguuccagaucauuaauaacacagagggcgacuggugggaagcccgcucaaucgcuaccgggaagaauggauauauuccuagcaacuacguggcaccagccgauaguauccaagcugaggaaugguauuuugguaaaaugggccgaaaggacgccgagcguuuguuacugaauccggggaaccagagaggaauauuccuagucagggagucugaaacgacuaaaggcgcguacucccucagcauccgggauugggacgagauucgcggugauaaugugaagcauuacaaaaucagaaagcuggacaacgggggauauuacauuaccacaagggcacaguuugauacucuucagaagcugguaaaacacuauaccgaacaugccgacggcuugugccacaagcucacaaccguuugucccacggugaaaccucaaacucagggccuggcuaaggaugccugggagaucccacgggaaucgcugcgccucgaggucaaauuagggcagggaugcuucggugagguguggaugggcacauggaaugggaccacuaagguggcaauaaaaacacugaagcccggaaccaugaugccugaggcuuuucuucaggaggcccaaauuaugaagaaauugcgacaugacaagcuggucccacuauacgcgguugugucugaagaacccaucuauauuguaacggaguucauguccaaaggcucacuccuggauuuucuuaaggaaggugacgggaaauaccugaaguugccgcagcucguggacauggccgcacagaucgcugauggcauggccuauaucgagagaaugaacuacauucacagggaccugcgggcugccaauauauuagucggagaaaaccugguguguaagaucgcagauuucggccucgcccgucuuauugaggacaaugaauacaccgcucgccagggggcgaaauucccuaucaaguggacagcacccgaggccgcucuguauggaagauuuacuauaaaaagugauguuuggagcuucgguauuuugcaaaccgagcuagugacaaagggcagggucccauacccugggauggugaaccgggaaguacuggagcagguugaacgaggauaucgcaugcccugcccacagggcugucccgagucccuccacgaacugaugaaccuuugcuggaaaaaggacccugaugagagaccaacuuuugaguacauccaaucuuuccuggaagacuauuuuaccgccacagagccgcaguaccagcccggugaaaauuuguga

SEQ ID NO: 64932 - RNA, 882 nt, Artificial Sequence
  derived and/or modified sequence opt3 from YIF1A__Homo_sapiens__NP_065203
auggccuaccacagcggcuauggggcucauggauccaagcacagagcaagggccgcgcccgacccuccaccgcuguucgaugacaccucugguggcuacucaagucagcccgggggauauccugcuacaggcgccgauguggcauuuagcgucaaccaucuccuuggugacccaauggccaauguugcuauggcauacggguccucuaucgccucgcacggaaaagauauggugcauaaggagcugcaccgguucguaucagugagcaaauugaaguacuuuuucgcugucgacacugccuauguggcgaaaaaguuaggccugcuaguuuuucccuauacgcaccaaaacugggaagugcaguacagucgcgaugcaccucucccaccccgacaggaccugaaugccccugaucuuuacauuccaaccauggcuuucauaacauauguccuguuggccggcauggcacucgggauccagaagcguuuuuccccggaggugcugggacugugcgcuucuacugcccucguauggguugugauggaagucuuagcgcugcuuuugggucuguaccuagccaccgugagaagcgaccucuccacauuccaucugcuugcauauucaggcuacaaauauguggggaugauucugagugucuugaccggacuccuguuuggcagcgaugguuacuauguugcuuuagccuggacuucuuccgcucugauguacuucaucgugaggucacuccggacagccgcacuugggcccgacagcaugggaggcccuguaccacgccaaagacugcaguuguaccuaacccugggcgccgcugcguuucagccccucauuaucuauuggcugacguuccaccuugugagguga

SEQ ID NO: 64933 - RNA, 372 nt, Artificial Sequence
  derived and/or modified sequence opt3 from YIPF1__Homo_sapiens__XP_011539907
auguggagaaacagcaaggugaugaauaucgucuccuacucuuuccuggagauuguuugcguguauggcuacucacucuuuauauauauccccaccgccauucuuuggaucauuccucagaaagcuguaagguggauccuggugaugauagcauuggggaucagugguagcuuacuggccaugacauucuggccagcgguccgggaagacaaccgccgaguggcucuagccacuauuguuacgaucgugcuccugcacaugcuucuguccgucggauguuuggcauacuuuuucgaugccccggagauggaccaucuccccaccacaacugcuaccccuaaucaaacaguggcagccgcuaagucuucguga

SEQ ID NO: 64934 - RNA, 1053 nt, Artificial Sequence
  derived and/or modified sequence opt3 from YIPF3__Homo_sapiens__NP_056203
auggccaccacagcugcacccgccggcggggcgagaaacggagcugguccugaguggggcggguucgaagagaauauccagggaggcgguagcgccgugauugacauggaaaacauggaugacacuuccgggucuucauuugaggauaugggagaacugcaccaaaggcuccgggaggaggaagucgacgcagaugccgcugacgcagccgcugccgaggaagaggauggcgaguuccuuggcaugaagggguuuaaaggacagcugagucgccagguugcggaccagauguggcaagcagguaagcgacaggccagccgugcuuucuccuuguacgccaauauagauaucuuaagaccauauuuugacguggaaccggcacagguaaggucucggcugcuagagucgaugauucccaucaaaauggugaacuucccucagaagauugcuggcgaacucuacgggccacugaugcuugucuuuacgcugguggccaucuugcuccauggaaugaaaaccucagauacaauaauccgcgagggcacucugauggguaccgcgauugggacaugcuucggauauuggcugggcguuagcaguuuuaucuacuuccucgccuauuuauguaaugcacaaauuaccaugcugcagaugcuugcuuugcugggcuacgggcuauuuggacacugcaucgugcuuuucauaacuuauaacauucaucugcacgcccucuuuuaccuguucugguugcucgucgguggccuguccacauuaagaaugguggcuguacugguuucuaggaccguggggcccacgcagcggcuccuucuguguggaacuuuggccgcacuacauaugcuguuccuccuguaccuucacuuugccuaucacaaggucguggaaggcauccuggacaccuuggaggguccuaauauuccacccauccagcgcgugccucgagauaucccagcuaugcucccggcggcaagacugcccacaacugucuuaaacgccaccgcuaaggccguugcagugacacugcaaagccauuga

SEQ ID NO: 64935 - RNA, 774 nt, Artificial Sequence
  derived and/or modified sequence opt3 from YIPF5__Homo_sapiens__NP_001020118
augagcggcuucgagaaccugaauaccgacuuuuaccagacauccuauucuaucgaugaccaaucacagcagaguuacgauuaugggggaagcgguggccccuacuccaagcaguaugccggguacgacuauucucaacagggaagauucgugccuccagauaugaugcagccgcagcaacccuacacuggccagauuuaccagccuacgcaggcuuauaccccagcaucgccccaaccuuuuuacgguaacaauuucgaagacgagccaccccuccuugaggaacuggggauaaacuuugaucacaucuggcagaaaacauugacugucuuacauccucugaagguugccgacggaucaauuaugaaugaaaccgaucuagcgggcccaaugguguucugccucgcuuuuggcgccacacugcuucuggcagggaaaauccaguucggauauguauacgguauuagcgccaucggcuguuuggggauguuuugccuccugaaccugaugaguaugaccggaguguccuucggcugugucgcuucugugcucgguuauugcuuacugccgaugauacuuuugagcuccuuugcaguuaucuucucacugcaagggauggugggaauuauccuaacugccggcauuaucggcugguguaguuuuagcgcuucuaagauauucauuuccgcccucgcgauggaggggcagcagcugcuugucgcauaccccugcgcccuguuguauggaguguucgcucucaucucaguauuuuga

SEQ ID NO: 64936 - RNA, 597 nt, Artificial Sequence
  derived and/or modified sequence opt3 from YKT6__Homo_sapiens__NP_006546
augaagcuguacagccucuccgugcuuuauaaaggcgaggccaaggucguucuguugaaagcugcauacgacgugucuucauucagcuuuuuccagagaaguuccguacaagaauuuaugaccuucacaucucaguuaaucguggagaggucgucaaaggggacucgggccagcgucaaagaacaggauuaucugugccacguguacguucgcaacgacagucuagcgggaguggucauugcugauaaugaguaucccucccgaguggccuuuacgcuccuggaaaagguacuugacgaguucucuaagcagguugaucguauagacuggccuguggguagcccagcaaccauccauuacccggcccuggauggccacuuguccagauaucaaaaccccagggaggcugacccuaugacaaaaguccaggcagaacucgaugagacuaagauuauccugcauaauaccauggaaucacugcucgagcgcggggagaaauuagacgaucuggugaguaagagcgaagugcuuggaacacagucuaaagccuuuuacaagaccgcucggaagcagaacuccuguugcgccauuauguga

SEQ ID NO: 64937 - RNA, 6441 nt, Artificial Sequence
  derived and/or modified sequence opt3 from YLPM1__Homo_sapiens__NP_062535
auguaccccaacuggggccgguaugggggcagcucccacuacccuccaccgcccgugccuccacccccuccagucgcccugcccgaggcuucuccugguccaggcuauucaaguagcaccacuccggcagcccccuccucuucgggguucaugucauuuagggaacagcaccucgcgcaacuucagcagcugcagcaaaugcaccagaagcagaugcagugcguuuugcaaccucaccacuuaccacccccuccacugcccccgccucccgugaugccaggaggcgguuacggggacuggcagccucccccacccccuaugccaccgcccccuggaccagcucucagcuaucagaaacagcaacaguacaagcaccagaugcuccaccaccaacgggauggacccccuggccuggucccaauggagcuugaaagucccccggaguccccuccagugcccccugggucuuauaugcccccaagccaguccuacaugccucccccacagccgccucccucauacuauccacccacaaguagccagccuuaccugccacccgcccaaccuucuccgucccagucaccacccagccagaguuauuuggcaccuacgccaucuuacuccagcucgucuuccucaagucagagcuaucucucccauucucaaagcuaccugcccucaagucaggccuccccuagccgcccgucucagggacacucaaaaagucagcugcucgcucccccaccucccagcgcaccaccugguaauaagaccacaguccaacaggaacccuuagaguccggcgccaaaaacaagucuacugagcagcagcaagcugccccagaaccggacccuucgaccaugacaccccaggagcagcaacaguauugguaccgacagcaucugcuuagcuugcagcaacguaccaaggugcaucugccagggcacaaaaagggacccguuguggcgaaagauacuccugaaccagucaaggaggaggugacaguacccgcaaccucccagguuccugaaucaccgaguucugaggaaccacccuugccucccccaaaugaggaagugccucccccacucccuccggaggagccccagagcgaagacccagaggaagaugccagacugaaacagcuucaagcugccgcagcucauuggcagcagcaccagcaacauagggucggcuuccaguaccaggguaucaugcaaaagcacacgcagcugcagcagauuuugcaacaguaucagcagaucauccaaccucccccacauauucagacuauguccguggacaugcagcuccggcacuacgagaugcagcaacagcaguuucagcaccuguaucaagaaugggagcgcgaguuccaguuaugggaagaacagcugcauucauacccucacaaggaucaacuccaggaauaugagaaacaguggaagaccuggcaggggcauaugaaagccacacaaagcuaccuucaggaaaaggugaacucuuuucagaauaugaaaaaccaguauaugggaaauauguccaugcccccgccauucgucccuuacagucaaaugcccccaccccugccuacuaugccgcccccaguuuugccucccagccuaccuccacccgugaugccuccagcgcugcccgccaccguaccgccuccaggcaugcccccuccagugaugcccccgucucucccuacauccguacccccaccuggcaugcccccaucacugaguagcgcagggcccccuccagugcuuccgcccccuucgcuguccucugcuggaccacccccuguuuugccacccccuagccucucaaguaccgccccgccacccgugaugccucugcccccauuauccucugcuacgccucccccagguaucccgccucccggcgucccacaggggauucccccucagcugacugccgcaccagugcccccugccagcuccucacagagcagucaaguaccggagaagccaagacccgcucuacucccuacaccaguuucuuuuggauccgcgcccccuaccacuuaccaucccccacugcagagcgcaggcccgucggaacaagugaacucaaaagccccucuuucuaagagugcuuugcccuauuccagcuucucuagcgaccaaggucugggggaauccucagccgcaccaagucagccuaucacagccgucaaggauaugcccgugaggagcggcggacuccugccagacccuccccggucuuccuaccuugagucaccgcgcggcccacgauuugaugggccuagaagguucgaagaccugggaagucggugugaggguccccguccaaaaggcccccgcuuugaggggaauagaccugauggaccgaggccacgguaugaaggccaccccgcugaggguaccaagagcaaaugggggaugauaccucgaggccccgccucccaguucuacaucacgccaucuaccucguugagcccucgccagucaggaccccaauggaagggcccaaaaccugcauuugggcagcagcaucagcaacagccgaagucccaggcggaaccccucaguggaaacaaggagccacuggcugacacaucuagcaaucagcagaaaaacuucaagaugcaguccgccgcauucucaauugccgcugacgucaaagaugugaaggccgcacagucuaaugaaaacuuaagcgacagucagcaagagccucccaaauccgagguuagcgaagguccaguggagccuucuaauugggaucagaacguacagucaauggaaacucaaaucgacaaggcucaggccgucacccagcccgugccgcuggcgaacaagccaguuccugcccaguccacauuucccaguaaaacuggcgggauggagggaggcaccgcuguggcaacaagcucgcuaaccgccgauaaugacuucaagccagucgguauugggcucccccacucugaaaacaaucaagauaaaggccugccuagacccgacaacagggauaaucggcuugagggaaaccgcggcaauuccagcucauauagagggccaggacagaguaggauggaggacacucgugauaagggcuuggugaaccggggucgagggcaggcuaucucuagaggaccuggccugguaaaacaggaagacuuuagggacaagaugaugggucgccgggaggauuccagagaaaagaugaauaggggcgaggggagccgcgaccgaggacucgugcggccgggcucaagucgugaaaaaguucccgggggacugcaaggcagccaggauagaggugccgcaggguccagggagcgcggaccaccucggagagcgggcucucaggagaggggucccuuacgacgcgccggcagccgggaaagaauaccaccuaggcgugcugggucccgcgagcggggacccccgagaggcccugggucaagggaacgaggacugggccggucugacuucggucgcgauagagggccauuuaggcccgagccuggagacggcggugagaagauguacccauaucaucgggaugaacccccucgagccccauggaaccacggcgaggaaagagggcaugaggaguucccccuugacggacgcaaugcaccgauggagagggagcguuuggaugacugggaucgggaaagauacuggagggagugcgaacgcgacuaccaggaugacacgcucgagcuguauaaccgagaagacagauuuagugcuccucccucgcggagccacgauggcgacaggcgcgggccauggugggaugacugggagcgugaucaagacauggaugaggacuacaauagagaaauggagcgggauauggacagggaugucgaccgcauuucccgacccauggauauguaugacagaucucuagacaacgaaugggaucgggacuacggaaggccucuggaugagcaggaaucacaguuccgcgagagagacaucccaagccuacccccucugccaccgcuucccccuuugccaccccuggauagguaucgggacgaucguuggcgcgaggaacgaaauagagagcacggcuacgacagggauuuucgggaccgcggugaauuaagaauuagggaguauccugagagaggggauacauggcgagagaaaagagacuacgugccagaccgcauggauugggaaagggaacggcucuccgaccguugguaccccagugauguggacagacauucuccgauggccgagcacaugccuagcucacaucacuccagugaaaugaugggaagcgaugcaucucuggacuccgaucaaggccuuggcggggucaugguucugucacagaggcagcaugagaucaucuugaaggccgcucaggagcucaaaaugcugcgcgaacaaaaggagcagcuacagaaaaugaaggacuucggaagcgaaccacagauggcggaucaucugcccccucaagagucgcggcuccagaacaccucuagucgacccgguauguauccaccgccuggcuccuacagacccccacccccuauggggaagccacccggaagcauugugaggccuucagccccaccggcacgcuccucugugcccguaacucggccuccaguccccauaccuccacccccuccgcccccaccucugcccccaccucccccagugaucaaaccgcagaccagcgcuguugaacaggagagaugggacgaggauaguuuuuauggccuuugggacacaaacgaugaacaaggucuaaauuccgaguucaagagcgaaaccgccgccauuccuucugcucccgugcugccacccccuccaguccacucaaguauacccccuccggggcccgugccaaugggaaugccucccauguccaaaccaccucccguucagcagacuguggacuacggccauggccgugacauaagcacaaacaagguagagcaaauuccauauggggaaaggaucacguuacggccggauccucuccccgagcgcucuaccuuugagacugaacacgcaggacagcgagacagauacgauagggagcgggaccgcgaaccauauuucgauagacagucgaaugucaucgccgaccauagggauuucaaacgagaccgggagacacaccgugauagagaccgcgauaggggugugauugacuacgaucgggacagauuugaccgcgagaggcgaccucgggaugacagagcgcagucauacagggauaagaaggaccacagcuccagucgccguggcggguucgaucggcccucuuaugacagaaaaagcgauaggccaguguacgaaggaccuuccauguuuggcggugagcgccgaaccuaucccgaggaacggaugccgcugccagcucccucacuuagucaucaaccuccacccgccccuagagucgaaaagaaaccggagucuaagaacguugacgauauccugaaacccccagggagggagagccgcccugaaagaauugugguaauaaugcggggacuacccggcuccggcaagacacacguggcaaagcucaucagggacaaagaggucgaguucgggggaccagccccucgugugcugucauuggaugacuacuuuauuacugagguugaaaaggaggagaaagaccccgauagcgguaagaaagugaagaagaaagucauggaauaugaguacgaagcugagauggaagagaccuaucgaacgucuauguucaagaccuuuaaaaagacacuggacgauggcuucuuuccauucaucaucuuagacgcaauuaaugaucgcgugagacauuuugaccaguucugguccgccgcgaaaacuaagggguuugagguuuaccucgcugaaaugagugccgauaaccagaccuguggaaaacggaauauacacggcaggaagcugaaggagaucaacaaaauggcagaccauugggaaacagccccucgccacaugaugagacuugauauucggagccuguugcaggacgcugccaucgaggagguggaaauggaggauuucgacgcaaauauugaggaacaaaaggaagagaaaaaggaugcugaggaagaggaaucggagcucgguuacauccccaaauccaagugggaaauggacacuucugaggccaagcuggacaaacuagaugggcugaggaccggaacgaagcgaaaacgugacugggaggcgauagccucaagaauggaagauuaucuucagcucccggacgauuacgacacacgcgcaagcgagccuggcaagaaacgggucaggugggcugaucuggaagagaagaaggacgccgauagaaaacgcgcuaucggcuucguaguggggcagaccgacugggaaaagauuacugaugagaguggacacuuggcagagaaagcccugaaccggacaaaguauaucuga

SEQ ID NO: 64938 - RNA, 2052 nt, Artificial Sequence
  derived and/or modified sequence opt3 from YME1L1__Homo_sapiens__NP_001240795
auguucagccuguccucuaccgugcagccccaagucacaguuccucucucacaccuuaucaacgccuuucauacuccaaagaauacgagugugagccuguccggcguaucugugucgcagaaccagcacagagacgucgugccggagcaugaagcucccucaagcgagccuaguuugaauuuaagggaucuggggcuauccgaacucaaaauuggacagauagaccaacugguugagaaccuucugccagguuucugcaagggcaaaaauaucucuagccacuggcauaccucccacgugucagcacagagcuuuuucgaaaacaaguacgucuuuauucagagucggggguucaaaacauugaagucucgcacucgacgucuccaguccaccucagagagacuggccgagacacaaaauaucgcgcccagcuuugugaagggauuccugcucagggaucggggcagugacguagaaucuuuagauaaacugaugaagaccaaaaacauuccugaggcucaccaggacgccuuuaagacugguuucgcagaaggguuucuuaaagcccaggcuuugacacagaagaccaaugauucccugcgcagaacgaggcuaauccucuucguucugcuucuguuuggaauauauggcuugcucaagaacccauuccugagcgugcgguuccgcacuaccacaggcuuagacucggcagucgaucccgugcaaaugaaaaaugugacuuuugagcaugucaaggggguugaggaagccaaacaggagcugcaggaagugguagaguuccucaagaacccucaaaaauuuaccauccuuggagguaagcugccaaaaggcauuuugcuaguggggccgcccggaacaggcaagacccugcucgcucgagccgucgcgggugaagcagacgugccuuucuacuaugccucuggguccgaguuugaugagauguucguuggagugggcgcuucaagaaucaggaaucuguuucgggaagccaaggcaaacgcuccaugugucauuuucaucgacgagcuugauagugugggcgggaaacguauagaaagccccaugcacccuuacucccgccagacgauuaaucagcuguuggccgagauggacggauuuaagccaaacgaagguguaaucauuaucggcgcgacuaacuuccccgaggcccucgacaaugcacugaucagaccggggagguuugauaugcagguuacagugccucggcccgacgucaaaggacgaaccgagauuuuaaagugguaucugaacaaaauaaaguucgaucaaucuguggacccagaaaucauugcucgcggcacugucgguuuuagcggggccgagcuagaaaaucucgugaaccaggcugcccugaaggcagccguugauggcaaagagauggugacaaugaaggaacuugaguucucaaaagacaagaucuugaugggaccugagagaaggaguguagaaauagauaauaaaaacaagaccauuacggcuuaccaugaguccggccacgcgaucaucgcauauuacaccaaggacgccaugcccauuaauaaagcuacaaucaugccacgggggcccacucugggacacgucagccuccugccugaaaacgaucgcuggaaugagaccagagcccagcuucuggcacagauggacgugucuauggguggcaggguugccgaggaauugauuuucgggacagaucauauaacuaccggagcuucaagugacuuugacaacgccacaaagaucgcaaaacguauggugaccaaguucggcaugagcgagaaacucggugucaugacuuacuccgauacggggaagcugucuccagaaacacaaucggcgauugagcaggaaauccggaucuuacugcgagacagcuaugagagagcuaagcacauucuaaaaacccaugccaaggagcacaaaaaucucgcagaagcccugcuuacuuacgagaccuuggaugcuaaggaaauacagaucgugcuggagggcaaaaagcucgaaguaagguga

SEQ ID NO: 64939 - RNA, 360 nt, Artificial Sequence
  derived and/or modified sequence opt3 from YPEL1__Homo_sapiens__NP_037445
auggugaagaugaccaaaagcaagacauuccaggccuaccugcccaacugccacagaacuuauuccuguauccauugcagggcucaccucgcaaaucaugacgagcuuauuucuaaaucauuucaaggcagucaggggcgggccuaccuguucaacagcgucguuaaugugggaugugguccugcggaggaacgcguauuguuaacgggccugcacgcuguggccgauauauauugcgaaaacuguaagaccacacuaggguggaaauacgagcaugcauuugaauccucucagaaguauaaggagggaaaauucaucauugagcucgcccacaugaucaaggacaauggcugggaauga

SEQ ID NO: 64940 - RNA, 360 nt, Artificial Sequence
  derived and/or modified sequence opt3 from YPEL2__Homo_sapiens__NP_001005404
auggugaagaugaccagaagcaaaacauuccaggccuaccugcccuccugccacaggacuuauucuuguauccauugccgggcucaccucgcaaaccaugacgagcuuauuucaaagaguuuucaaggcagccaggggcgcgccuaccuguucaauuccgucguuaacgugggaugugguccugcggaggaacgaguauuguuaacgggccugcacgcuguggccgauauauauugcgaaaauuguaaaaccacacuaggguggaaguacgagcaugcauuugaaucuucgcagaaauauaaggagggaaaguacaucauugagcucgcccacaugaucaaagacaacggcugggauuga

SEQ ID NO: 64941 - RNA, 360 nt, Artificial Sequence
  derived and/or modified sequence opt3 from YPEL3__Homo_sapiens__NP_001138996
auggugagaaucagcaagcccaaaaccuuccaggccuaccuggacgauugccacaggcgguauuccugugcucauugccgcgcacaccucgccaaccaugacgaucuuauuucuaagucauuucaaggcagucaggggcgagcguaccuguucaauagcgucguuaacgugggaugugguccugcugaggaacguguauuguuaacaggccugcacgccguggcagacauacauugcgagaauuguaaaacuacgcuaggguggaaguaugaacaggccuuugaguccucucagaaauacaaggaaggaaaguauaucauugagcucaaccacaugaucaaagauaauggcugggacuga

SEQ ID NO: 64942 - RNA, 384 nt, Artificial Sequence
  derived and/or modified sequence opt3 from YPEL4__Homo_sapiens__NP_659445
augcccagcugcgacccuggcccagggccggccugucugcccaccaagacauucagauccuaccucccuaggugccaccggacuuauucuugugugcauugccgcgcucaccuugcaaaacaugaugagcugaucucaaagaguuuucagggaagccacggucgagccuacuuguucaacuccgucguuaaugugggcugugggccagcggaacaacguuuacugcuaacgggacuccauucuguagcugacauauuuugcgagucguguaaaaccacacugggcuggaaguaugaacaggccuucgagacuucacagaaauacaaggaagguaaguauauuaucgagaugagccacauggugaaagauaacgggugggacuga

SEQ ID NO: 64943 - RNA, 366 nt, Artificial Sequence
  derived and/or modified sequence opt3 from YPEL5__Homo_sapiens__NP_001120872
augggcagaaucuuccuggaccacauugggggaaccaggcucuuuagcugcgccaacugugauacaauacuuacuaaucgguccgagcugaucucuacgcgcuucaccggugcuacaggccgagcauuuuuguucaacaagguggucaauuuacaguacucagaaguucaagaccgugugaugcugacugggagacauaugguaagggaugugaguugcaaaaacuguaauagcaagcuaggauggauuuaugaguuugccaccgaagacucccagcgguacaaagagggccgcgucauccucgaaagagcgcuggugagggagucugaggguuucgaggaacacguucccucggauaacucauga

SEQ ID NO: 64944 - RNA, 2184 nt, Artificial Sequence
  derived and/or modified sequence opt3 from YTHDC1__Homo_sapiens__NP_001026902
auggccgcugacagcagagaggaaaaggauggcgagcugaacgugcucgacgauauccuuaccgaaguccccgagcaggacgaugaacuguacaauccugaguccgagcaagacaaaaacgaaaagaaagggucuaagaggaaaucagaucggauggagaguacagacacuaagcgccagaagccaagcguucacucccgacaguuggugucuaaaccguuaucgucaagcguaaguaauaacaagcguauuguguccacgaaaggaaagucugcaaccgaauauaaaaaugaggaguaccagagaagcgaaaggaacaagcggcuggaugccgaccgcaagauaagacuauccucaagugcgagcagggagcccuauaaaaaucaaccugaaaagacaugcguccggaaacgcgauccagagagacgagcuaagucucccacuccugacgguuccgaaaggaucggccucgagguggaucggcgugccucacgcagcagucagucuuccaaagaggaaguuaacagcgaggaauacgggucggaccaugagaccggaucuuccggcucaagugacgaacaggguaauaacacagagaaugaggaagaggggguggaagaggaugucgaagaggacgaggaaguggaggaagaugcagaggaggacgaagagguagaugaagacggagaggaagaggaggaagaggaagaggaagaggaggaagaggaagaggaagaggaggaagaguaugaacaggaugagagagaccaaaaggaggaaggcaacgauuacgacaccaggagcgaggccuccgauucuggcagcgaaucaguuaguuucacugacggguccgugcggagcggaucugguacagacggcucagaugagaaaaagaaggaacgaaaacgcgcuagagggauuaguccaaucgucuuugacaggagcggauccucugcaucggagagcuaugccggcuccgagaagaaacacgaaaagcugucaaguucugugcgggcugugcgcaaagaucagaccagcaaacuuaaguacguccugcaggacgccagauucuuuuugauuaaguccaauaaccaugagaauguuucacucgcgaaggcaaaagguguguggagcacgcugcccguaaacgaaaagaaacugaaccucgccuucaggucugcucguuccgugaucuuaauauuuaguguccgggagagcgggaaguuccagggauuugcccgacugucuuccgaaucacaccauggcggcaguccuauccacugggugcuuccagcagggaugagcgcuaagauguugggagguguuuucaaaauugauuggaucuguagaagggagcugccguuuacuaagucggcccaccuaaccaaucccuggaacgagcauaaaccugugaagauuggccgcgacgggcaagaaaucgagcucgaaugcggaacacagcugugucuucuguucccacccgaugaguccauagacuuguaccaggucauucacaaaaugcggcauaagagaaggaugcacucucaaccucgcagccgaggccggccaucacguagagaacccgugagggauguaggucgccggagaccggaggacuaugauauccacaauaguaggaagaaaccucgaauugacuaucccccagaguuucaucagcgcccuggguaccucaaggauccccgguaccaggaaguugacagaagguucuccggcgugcgucgcgacgucuuucugaacggaucuuauaaugauuacgugcgggaguuccacaacaugggcccacccccuccauggcaggggaugccgcccuauccuggaauggaacaaccaccccaucacccuuacuaccagcaucacgcgccacccccgcaggcccacccuccauauagcggucaucaccccgucccucaugaggcaagauacagggacaaacgagugcacgauuaugacaugcggguugaugacuucuuacgcagaacucaggcugugguauccggcaggcggucacgacccagagagcgcgauagggaacgugagcgggacagaccaagggauaaucgccgagacagagaacgggauagggggcgcgaccgugagagagaacgggagaggcugugcgaucgcgaccgagacagaggagagcggggcagguaccgcagauga

SEQ ID NO: 64945 - RNA, 4293 nt, Artificial Sequence
  derived and/or modified sequence opt3 from YTHDC2__Homo_sapiens__NP_073739
augagcagacccuccucugugucaccuaggcagccagccccgggcgggggagguggcgggggacccaguccuugcggcccaggugggggaggccgggcuaagggccugaaagacauccgcauugaugaagaagucaagauagcaguuaacaucgcccucgagcgauuccguuacggggaccaaagagaaauggaguuucccagcucccuuaccucuacagaaagggcguucauucaccggcugucgcagucauugggauuagugagcaaaaguaaggguaaaggcgcuaaucgcuaucugacuguaaagaagaaagauggguccgagacggcccacgcaaugaugaccuguaaccuaacacacaauacuaagcaugccgugagaucucucauccagagguuuccugucaccaacaaagagcggacagaacugcuuccaaagaccgagcgcggaaauguguucgcuguugaagcagagaaccgagagaugagcaaaacuuccggcagacugaauaacgguauuccccagaucccugugaagaggggagaaucagaguuugacaguuuccggcagagcuugccagucuuugaaaagcaagaggaaauagugaaaaucauuaaggagaauaaaguaguucucaucgugggggagacaggcucuggcaagaccacgcagauuccgcaguuccugcuggaugacugcuuuaaaaacgggauccccugucguauauucugcacucaaccucgcagacucgccgcuauugccgucgcggaaaggguggcagccgagcggcgagaacgcaucggacagaccauugguuaccagaucagauuagaguccagggugucaccaaagacacugcuuacuuuuuguaccaauggcgucuugcugcggacacuaauggcuggggauagcacccucaguacgguuacucacgugaucguagacgaagugcaugagcgcgauagauucucugacuuucugcuuacaaaacugagggauuugcuccagaagcaccccacccugaaguuaauucuguccagcgccgcacucgacgucaaccuuuucauacguuauuucggaucgugcccugugaucuacauucaaggccggccauuugagguuaaagaaauguuccuggaggauaucuugcgaacuacagguuauaccaauaaggaaaugcuaaaauacaagaaagagaagcagcaggaagagaagcaacagacgacccugacagagugguauucugcucaggaaaacuccuuuaaacccgagucacagagacaaaggacugugcucaaugucaccgacgaauacgaccugcuugaugacgggggcgaugccguguucagucagcugacagagaaggacguaaacuguuuggagccguggcucauaaaagaaauggaugcgugccugagcgacauuugguuacacaaggauaucgacgccuuugcacagguuuuccaucugauccuaacugagaacguguccgucgauuaccgccacucugaaaccagcgcuacagcccucaugguggcugccggacggggcuuugcaucacaggucgagcaacugauuaguaugggggccaaugugcauuccaaagcuagcaacggauggauggcgcuugacugggcaaagcacuucggucagaccgaaaucguugauuugcuggagucuuauucagccacucucgaguuuggcaaucuggacgaaaguagccuugugcagacgaacggguccgaccugucugcugaggauagagaauugcucaaggccuaccaccauucguucgacgaugagaaaguagaccuggauuuaauuaugcaucugcuauauaauauaugucacagcugcgacgcaggagccguccucaucuuucugccuggcuacgaugaaauugugggucuuagggaccgcaucuuguucgaugacaagcgauuugcugauuccacacaccgguaucagguuuucaugcugcauucaaacaugcaaaccagugaccagaaaaaggugcucaaaaaucccccagccgggguccguaagaucauucugucuacuaacauagcagagaccagcaucacagugaaugauguaguguucguuauugacuccggcaaggucaaagagaagucauuugacgcguuaaacuucgugaccaugcugaaaaugguguggaucagcaaggcuucugccauucagagaaaaggaagggcaggccgcugucggccugggaucugcuuuagacuuuucuccagguugcgauuucagaauaugcucgaguuccaaacucccgaacugcuacgcaugccacugcaggaacucugccugcacacaaaacuuuuggcccccgucaacuguccuauagcugauuuucugaugaaagccccagagccgcccccugcauuaaucguucggaaugcugugcagaugcucaagacgauugacgccauggauaccugggaagaccugacugagcuuggauaccaccuggcggauuugccaguggagccccaucucgguaagaugguacugugcgccgucgugcuaaaaugucuggacccuauccucacaauugcuugcacccuggcauauagagauccauucguucuucccacacaagccagucagaagagggcugccauguugugucguaaacgcuuuacugcaggcgcguucagcgaccacauggcccuguuacgggcuuuucaggccuggcagaaggcaagaucugaugggugggaaagggcuuucugcgagaaaaacuuucucucccaagccaccauggaaaucauaauuggaaugcgaacgcagcugcuuggccagcugcgggcaucagguuucgugcgcgccagagggggcggagacaucagggaugucaauaccaacagugagaacugggcugugguuaaggcggcccuaguggcaggcauguacccgaaucucguacaugucgaccgggagaaccugguguugacagggccuaaggaaaagaaggugcgauuccacccagcuagcguccugucgcagccccaauacaaaaagauuccucccgccaauggacaggccgcugcaaucaaagccuuaccaacugauuggcucauauaugacgagaugaccagagcgcaccgcaucgcuaacauuagguguugcuccgccguuacaccugugacuauccugguauuuuguggccccgcacgucuugccucuaaugcucugcaggaaccaagcucauuccggguggacgguauuccgaacgauaguuccgacucugagauggaagauaagaccacggcaaauuuggccgcgcucaagcuggacgaguggcuacauuuuacacuggagccugaagcugccagccuucuccugcaguugagacaaaaauggcacucccuguucuuaaggcgcaugcgagcacccucaaagccauggagccaggucgaugaggccaccaucagagcuauaauugccgugcucaguacugaggaacagucugcagggcugcaacagcccuccggaaucggccagcggccuaggccaaugagcucggaggaacuuccccuggcuucaucuuggcgcaguaacaauucccguaaaagcucugccgacacagaguuuagcgaugaaugcaccacugcggagagaguuuugaugaaguccccuucaccggcccuccauccaccccagaaauacaaggaccgggguauccugcacccuaagaggggcaccgaagaucgcagugaccaaagcucucuaaaauccacagauucaaguagcuauccaucccccugugcaucuccuucgccgcccagcucagggaagggauccaaaaguccaucuccucgacccaacaugccagugagauacuucauuaugaaaagcuccaaucugcggaaccuugagaucucacagcagaaaggcauuuggucuacgaccccuagcaaugaaaggaagcucaaccgcgcuuuuugggagaguuccauagucuaucugguguucagcguucaggggucuggacauuuucaaggcuucucaagaauguccagugagaucgguagggaaaagagccaggacugggggucggccggauugggcgguguguuuaaggucgaguggauucggaaggaaucuuuacccuuccaguucgcucaccaucugcucaauccauggaacgacaacaaaaagguacagaucucccgugauggccaagagcuggagccgcuugugggggaacagcuguugcagcuaugggagcgccugccucucggagagaaaaauacuacagacuga

SEQ ID NO: 64946 - RNA, 741 nt, Artificial Sequence
  derived and/or modified sequence opt3 from YWHAB__Homo_sapiens__NP_647539
augaccauggacaagagcgagcuggugcagaaagccaagcucgcugaacaagcagagagauacgaugacauggccgcggcuaugaaagccgucacagaacagggccacgagcuuuccaacgaagagaggaaucuguugucuguugcauauaagaacgugguaggggcccggcgcucaaguuggcgagugaucagcuccauugagcagaaaacugaacguaaugagaagaagcagcaaaugggaaaagaauacagagagaagauagaggcugaauuacaggauaucugcaacgacguccuggagcuacucgauaaauaucugauucccaaugcaacgcagccugaaucuaagguguucuaccuuaaaaugaagggugacuauuuuagguaccugucggagguugccucaggcgauaacaagcagaccacagugagcaauagucaacaggcuuaucaggaagccuucgagaucuccaaaaaggagaugcagccaacucauccgauucgguuggggcucgcgcugaacuuuucugucuucuacuacgaaauccugaauagccccgagaaagcauguucccucgccaagaccgcuuuugacgaagccauagcagaguuagauacacugaacgaagagucauauaaagacaguacccuuaucaugcaauugcugcgcgauaaucuaacucucuggacaagcgagaaccagggagacgaaggcgaugcuggugagggggaaaauuga

SEQ ID NO: 64947 - RNA, 768 nt, Artificial Sequence
  derived and/or modified sequence opt3 from YWHAE__Homo_sapiens__NP_006752
auggacgauagagaggaccugguguaccaggccaagcucgcugaacaagcagagagguaugaugaaauggucgagagcaugaaaaagguugccggcauggacguggaacuuaccguagaggagcggaaccuguuguccguggcguacaaaaaugucaucggggcucgccgagccucuuggcguauuauaucaaguaucgaacagaaggaggaaaacaaaggaggugaggauaaguuaaagaugauuagagaguauaggcagaugguggaaacagagcugaaacuaaucugcugugacauucucgauguucuggacaagcaccuuauccccgcagccaauacuggcgaaagcaaaguguucuacuauaagaugaaaggggauuaccaucgguaucuggcugaguuugcaacgggaaacgaccgcaaggaagccgcugaaaauuccuuggucgccuacaaggcggcaucugauauagccaugaccgagcucccuccaacacacccgaucagacugggccuggcucucaacuucucgguguuuuacuaugaaauuuuaaauucacccgacagggccugccggcuggcaaaagcugccuucgaugacgcgaucgccgagcuugacacuuugagcgaagagaguuacaaggauuccacccugauuaugcagcuacuccgcgacaaccugacacuuuggaccucugauaugcaaggugacggggaggagcagaauaaagaggcacugcaggauguagaagacgagaaccaguga

SEQ ID NO: 64948 - RNA, 744 nt, Artificial Sequence
  derived and/or modified sequence opt3 from YWHAG__Homo_sapiens__NP_036611
augguggacagagagcagcugguccaaaaggccaggcucgcugaacaggcagagcgguacgaugacauggccgcggcuaugaaaaacguuacugaacuuaaugagccccugagcaacgaagaacgcaauuuguuauccguggccuauaagaacguagugggcgcacgacguucuucauggagagucaucaguagcauugagcagaaaacauccgccgaugggaaugaaaagaaaauagagauggugagggcuuaccgggaaaagaucgagaaggagcuggaagcaguuugccaggacgugcuaucucuccuggauaacuaucuuauuaaaaauuguucggagacucaauacgaaucaaaggucuucuaucugaaaaugaagggagacuacuaucgcuacuuggccgagguggcuacgggugagaaaagagccaccguaguugagagcagugagaaggcguacuccgaagcacacgagaucucuaaggaacauaugcagccuacacacccaauuaggcucggccuggcccugaacuauagcguguuuuacuaugagauccagaaugcuccggaacaggccugccaucucgcaaaaacugcuuucgaugacgccauagcggaguuagauacccugaacgaggacuccuacaaggauucaacacuuaucaugcaauugcugcgggacaaucuaacccucuggaccagugaucagcaggacgacgaugggggagaaggcaacaauuga

SEQ ID NO: 64949 - RNA, 741 nt, Artificial Sequence
  derived and/or modified sequence opt3 from YWHAH__Homo_sapiens__NP_003396
augggcgacagagagcagcugcuccaaagggcccggcuugcugaacaggcagagcgcuacgaugacauggccagcgcgaugaaggcugugaccgaacugaacgagcccuuguccaaugaagaucgaaacuuacugucugucgccuauaaaaauguugugggggcacguagaucaaguuggaggguaaucagcuccauugagcagaagacaauggccgacggaaacgagaaaaagcuagaaaaagugaaggcuuaccgggagaagauagaaaaagagcucgagacugucugcaaugaugugcugucucuucuggacaaguucuugaucaaaaacuguaaugauuuucaguaugaaucgaagguuuucuaccucaaaaugaagggugacuauuaccgcuaucuggcagagguggccucaggcgaaaagaaaaacagcgucguggaggcuagugaagccgcguacaaggaggcauuugagauuuccaaagaacaaaugcagccuacgcacccaaucagacuggggcucgccuuaaauuucucuguauuuuacuaugagauucagaacgcuccggaacaggccugccugcuugcaaagcaggcuuucgaugacgccaucgcggaguuggauacccugaaugaagacagcuacaaagauuccacacuaauaaugcaacuccugagggacaaccuuacucuguggaccucagaccagcaggaugaggaggccggagaaggcaauuga

SEQ ID NO: 64950 - RNA, 738 nt, Artificial Sequence
  derived and/or modified sequence opt3 from YWHAQ__Homo_sapiens__NP_006817
auggagaagaccgaacugauccagaaagccaagcucgcugagcaagcagaaagauacgacgauauggccacaugcaugaaagcggugacugagcagggcgcugaacuuagcaacgaggagaggaaucuguuguccgucgccuauaagaacguuguagggggacggcgcucugcauggcgagugauuucaaguauagaacagaaaacggacaccagcgauaagaaguuacagcugaucaaagacuaccgugagaagguggaauccgagcuaagaucuauuuguacaacuguccucgagcugcuugauaaauaucugaucgccaaugcuaccaaccccgaaucgaagguguucuacuugaaaaugaagggugacuauuuuagguaccucgcagagguugccugcggcgaugaccggaagcaaacaauugauaauucacagggggcuuaucaggaagccuucgacaucagcaaaaaggagaugcagccuacccacccaauacgccugggacuggcgcucaacuuuaguguguucuacuacgaaaucuuaaauaacccggagcuggcauguacucuugccaaaacagcuuuugaugaggccauugcagaauuggacacccugaaugaggauuccuauaaggacucuacgcuaaucaugcaacuccugagagacaaccuuacucuguggaccagcgauuccgcuggcgaagagugcgacgccgcggaaggugccgagaauuga

SEQ ID NO: 64951 - RNA, 738 nt, Artificial Sequence
  derived and/or modified sequence opt3 from YWHAZ__Homo_sapiens__NP_001129172
auggacaagaacgagcuggugcagaaagccaagcucgcugaacaagcagagagauacgaugacauggccgcgugcaugaaaagcgucaccgaacagggcgcugagcuuuccaaugaagagaggaaccuguugucuguugccuauaagaaugugguaggggcacggcgcucaaguuggcgaguggucagcuccaucgagcagaaaacagaaggagccgagaagaagcagcaaauggcucgugaauacagagagaaaauugagacugaauuaagggauauauguaacgacgugcugucucuacucgagaaguuccugauccccaaugcaucgcaggccgaaucaaaaguguuuuaucuuaagaugaaaggugauuacuaucgguaccuggcugagguugccgcgggcgacgauaagaaggggauugucgaccagagccagcaagcauaucaggaagccuucgagaucaguaaaaaggagaugcagccuacgcacccaauucgcuugggacucgcucugaacuuuuccguguucuacuacgaaauccucaauucuccggagaaagccugcagccuggcaaagaccgcuuuugaugaagccauagcggaguuagacacacuguccgaagagucauauaaagauaguacucuuaucaugcaguugcugagagacaaccuaacccucuggacaagcgauacccaaggcgacgaggccgaagcaggggaggguggagaaaauuga

SEQ ID NO: 64952 - RNA, 2667 nt, Artificial Sequence
  derived and/or modified sequence opt3 from YY1AP1__Homo_sapiens__NP_001185832
auggccggcguggggagaagcggaggucccuggggcaggacccgcgggggacgguccggccgacugggugucucucucggggcucuuucaagucugccuuuggaggaauuaccacguccgcugugcuguagaaggugccggcgccacuucggauuugcacuaagaggcgagacaauccccguuagcguggccggcuccgcgucuucgcaguucgcuccucucgcccugcaucuuucacuguugcucagcaggauuagugcaucccggcugacucgcuggccacccccugacaagcgagaagggucugccguagauccaggaaaaagaaggagccuggcugcaacgcccuccucaagucucccuuguaccuuaauagcccugggucuucggcacgagaaggaagcuaacgaguugauggaggaccuguuugaaacauuccaagaugagaugggcuuuagcaauauggaagacgaugggccagaggaggaagaacguguggccgaaccgcaggcgaacuucaauacuccccaggcacuacgcuuugaggaacuccuggccaaccuucugaaugagcagcaucaaaucgcuaaagaguuguucgaacagcucaagaugaaaaagccuucugccaagcagcagaaagaggucgaaaaggugaaaccacaaugcaaggagguucaccagacccugauuuuagaccccgcacagagaaaaaggcugcagcaacagaugcagcaacaugugcagcuccuuacacagauccaccuguuggcuaccuguaacccuaaucuaaacccagaagccuccucaacucggauuugccugaaggagcucggaacauuugcgcagagcaguaucgcccugcaccaucaauacaaucccaaguuccagacccuuuuucagccguguaaccugaugggcgcaaugcaguugauagaggauuucucuacgcacgucuccaucgacugcagcccucauaaaacugugaagaaaaccgcuaaugaauuucccugucucccaaagcaaguagccuggauucuggcuacaucgaaaguuuucauguauccugaguuacugcccgugugcucucuaaaggccaaaaacccacaggauaagauccucuucacuaaggcagaagacaaucugcuugccuugggucugaaacacuuugaggggaccgaguuccucaacccccugauuuccaaguaccuucugacauguaaaaccgcucgacaguugacgguccgcaucaagaaucucaacaugaacagagcgccugauaauauaauuaaauuuuauaagaagacuaaacagcugccaguguuaggaaagugcugcgaggagauccaaccgcaccaguggaaacccccuauugaaagggaggaacaucggcugccauucuggcuaaaggcaucacuccccaguauccaggaggagcugcgccacauggccgacggcgcuagagaagugggcaacaugacagggaccacugagaucaauagcgaucagggacuugaaaaagacaacuccgaguuggguucugaaacaagguacccucugcuccugccaaagggcgucguuuuaaagcugaaacccguggccgaccguuuuccgaagaaagcauggcggcaaaagcgaagcucaguacuuaaaccuuugcucauucagccaagucccucccugcagccuagcuucaaucccgggaagaccccagcccaaucuacgcauucagaggcuccucccaguaagauggugcuaagaauaccacacccgauccagccugccaccguccugcagacagugcccggaguuccaccccucggcgugagcgguggggaguccuuugaaucuccugcagcgcugccagcuaugcccccugaggccaggacuucguucccgcuuagcgaaucccagaccuugcugucaagugcaccaguccccaaagugaugaugccuucuccagccagcuccauguuucgcaagcccuauguacggagaaggccuucaaaacgccgaggcgcucgggccuuccguuguauuaagccggcacccguuauccauccagcuagcgugauauuuacagucccugccacuaccgugaaaauugucucuuuaggaggcgggugcaacaugauccaacccgugaaugcggccguugcucaguccccacagacaaucccuauugcaacccuccuggugaaccccacgaguuucccauguccgcuuaaucagccucugguagccagcucugucucccccuugaucgugucaggaaacaguguuaaucucccaauucccagcacuccugaggauaaggcucacaugaacguggacauagccugcgcagucgcggauggugaaaaugccuuucaaggccuggagccaaaacuagagccccaggaacugucgccucucuccgcuacaguguucccgaagguagagcacucuccagggcccccucccguggacaagcagugucaggaaggacugagcgagaacucagccuacagauggaccguugucaaaacugaagagggcaggcaagcacuugagccauugccucaggguauccaggaaagucugaauaacuccucucccggggauuuagaggaaguggugaagauggagccagaggacgcuaccgaagagauuagcggcuuccucuga

SEQ ID NO: 64953 - RNA, 1245 nt, Artificial Sequence
  derived and/or modified sequence opt3 from YY1__Homo_sapiens__NP_003394
auggccagcggcgacacccuguacaucgcuacagauggguccgagaugcccgcagaaauuguggagcuccacgaaauagaggucgaaacuaucccuguugagacgauugagaccacagugguaggagaagaggaagaggaggacgaugacgaugaagacgguggcgggggagaucauggcggugggggaggccacggccaugccgggcaccaucaccaccaucaccaucaccaccaucacccaccgaugaucgcgcuucagccccuggugacugacgauccuacccaaguccaucaccaucaggaggugauuuugguucagacaagagaagagguggucggaggugacgauucugacggcuuaagggcugaagauggguucgaggaccagauccugauaccagugcccgccccugcaggaggcgacgaugacuauaucgagcaaacccuaguaacuguugccgcugcagguaagucagggggaggcggcaguagcuccucugggggaggucgggugaaaaagggcgggggaaagaagucgggcaaaaagucauaccucagcgguggggccggcgcugccggaggcgggggagcggauccagguaacaagaaaugggaacagaagcagguccagauuaaaacacuggagggcgaauuuagugugaccaugugguccucugacgagaagaaagauaucgaccacgaaacgguggucgaggagcaaauuaucggggaaaauagcccucccgauuauuccgaguacaugacuggaaagaaacuuccaccgggcgguauacccgggauugaccugucagauccuaaacaguuggcagaguucgcccgcaugaagccacgaaaaaucaaggaagacgaugcuccccguaccauugccugcccucacaaaggcuguacaaagauguuuagagacaacagugcaaugaggaaacaucuccacacucauggaccacggguucacgugugcgcugaauguggcaaggccuucguagagagcucuaagcugaaacgccaccagcuggugcauaccggggagaagcccuuucagugcacauucgaaggaugugguaaaagauuuucccucgacuucaauuuaaggacccacguccggauccauacgggcgaucgcccguaugugugcccuuuugacggguguaacaagaaauucgcgcaaucaacuaaucugaaaagccacauccuuacacaugccaaggcaaagaacaaucaguga

SEQ ID NO: 64954 - RNA, 1239 nt, Artificial Sequence
  derived and/or modified sequence opt3 from ZACN__Homo_sapiens__NP_851321
augauggcccuguggagccuccuucaccugaccuucuugggcuuuuccaucacauuacugcuagugcaugggcagggauuccaagguacugcugcaauuuggcccucucucuuuaacgucaaucugucaaagaaaguucaggagaguauacagaucccuaacaauggcagcgccccacuucugguggacguaagaguguucgucuccaacguguuuaauguugauauuuugagguacacgaugucuucgaugcuccugcugcggcucucaugguuagacacccgccuggcguggaacacaagcgcucacccgcgacaugccaucacucuucccugggaaaguuuguggaccccucgucugacaauucuagaggcacucuggguggauuggagagaccaguccccacaagccagggucgaucaggacgggcacgugaagcugaaucuugcucuggcaaccgaaacuaacugcaauuucgaguugcuccauuuuccccgggaucacucuaacuguagccuguccuucuaugccuuaucaaauacagcuauggaacuggaguuucaggcccacguaguuaacgagaucgugagugucaaacgcgaauacgugguguaugaccucaagacccaggucccuccacaacagcuuguucccugcuuccaggugacgcugagauugaaaaauacugcgcuaaagagcauaaucgcacugcucguaccugccgaggcucugcuucuggccgauguguguggaggcuugcucccacugagggcaauugaacggaucgguuacaaggucaccuuacugcuaucuuaucucgugcugcauuccucacuuguucaggcuuugccgagcaguucuuccugcaacccccugcucauuuacuauuuuacaauccugcuucuguugcucuuucugagcacuauagagaccguguuacuggccgggcuacucgcgcgcggaaaucugggcgccaaaucgggcccuucuccagcaccccgaggggagcaaagagaacacggaaacccugguccacaucccgcugaggaaccguccaggggcgucaaggggucacagcggaguuggccugagacagccgaccguauuuucuuccuuguguacguaguuggaguguuguguacccaguucgucuuugcuggcaucuggaugugggccgcaugcaaaagcgaugccgcucccggugaagcggcaccacacgggcgcagaccuaggcuguga

SEQ ID NO: 64955 - RNA, 1368 nt, Artificial Sequence
  derived and/or modified sequence opt3 from ZAK__Homo_sapiens__NP_598407
augagcucccugggcgccucuuucgugcagaucaaguuugacgaucuccaauucuuugagaacugcgggggagguucauucggcagugucuacagagcuaaauggauuagccaggacaaggaaguugcagugaaaaagcugcuuaaaauagagaaggaagccgagaucuuguccguauuaucucacaggaauauuauccaguuuuauggggugauucuggaacccccuaacuacggaaucgucaccgaguaugcgucgcuaggcucacucuacgauuauauaaauagcaaccggagugaggaaauggacauggaucauaucaugacaugggcuacugacguggccaaggguaugcacuaccugcauauggaggcaccaguuaaagugauucaccgcgaucuuaagucccgaaaugucgugaucgccgcugacgggguacugaaaauuugugauuucggagcaucucguuuucauaaccacacgacccacaugagcuugguuggcacauucccguggauggcccccgaagugauccagucccucccugucucagagacuugcgacaccuauaguuacggcguggugcugugggagaugcugacaagagaagucccauuuaaggggcucgagggauuacaaguugcuuggcuggugguagagaaaaaugaaaggcuuaccauacccagcucuuguccucgguccuucgccgaauugcugcaucagugcugggaggcggaugcaaagaagcgcccaucauuuaaacagauuaucagcauucuagagaguaugucuaacgacacuucccuccccgauaaguguaauagcuuccugcacaacaaagccgaauggagaugcgagaucgaagcuacacuugagaggcugaagaaauuggaacgggaccucucguuuaaggagcaggagcugaaagaacgcgagcgaagauuaaagaugugggaacaaaagcugaccgagcagucuaauacgccucuccuucugccauuggccgcaaggauguccgaagagucauacuucgagaguaaaacugaagagagcaacuccgcugaaaugucuugucagaucaccgccacaagcaauggugagggccaugggaugaacccgucacuacaggcgaugaugcugaugggauucggcgacauuuuuaguaugaauaaggccggugcagugaugcacuccgggaugcaaauaaacaugcaggcuaaacagaacagcucuaagacuaccucaaaacggcguggaaagaaggucaauauggcccucggcuucagugauuuugaccugagcgagggcgaugacgaugacgaugacgauggggaagaggaagacaacgauauggacaauuccgaguga

SEQ ID NO: 64956 - RNA, 1860 nt, Artificial Sequence
  derived and/or modified sequence opt3 from ZAP70__Homo_sapiens__NP_001070
augcccgacccugccgcucaccuuccauucuuuuacggcagcaucuccagagcagaggccgaagaacaucucaagcuggcggggauggcugauggacuguucuuguuaaggcagugccugcggucucuagguggcuaugugcucucacugguccacgacguucgcuuucaucacuucccgauugaacgacaacuuaacgggaccuacgccauagcaggaggcaaagcccauuguggucccgcugagcugugcgaauuuuauagucgugauccugacggguugccauguaaucucagaaagcccugcaacaggccuagcggacuggagccacagcccggcguguucgauugucugcgggacgcaaugguacgcgauuacgugagacagacauggaaacucgagggcgaagccuuagagcaggcuaucauuucccaagccccucaggucgaaaagcugaucgcgacuacggcacacgagaggaugccaugguaucacucuucgcuuacccgggaggaagccgagcgcaaauuguacucaggggcucagacagacggaaaguuucugcuacgaccgagaaaggaacaggguacuuaugcccucagccugauuuacggcaaaaccguguaccauuaucuuaucagucaagauaaggcagggaaauacugcauacccgagggaacaaaguucgacacccuguggcaguugguugaauaucucaaacugaaggcugauggcuuaaucuacugucugaaggaggccugcccuaauuccucugcgagcaacgccuccggugcagcugccccaacucuccccgcucacccuucaacacuuacccauccacagaggcggauugacacgcugaauagugauggguauacucccgagccggcccguaucaccagcccugacaaaccccgcccaaugccuauggacacaucuguguacgaaucccccuauucagauccagaggaauugaaggacaaaaagcuauuucugaaaagagauaaccuccugauugcagacaucgagcuuggauguggcaauuucggcagcgucaggcaggggguguaccggaugcgaaagaaacaaauagauguagccauuaagguucugaagcagggaacugaaaaagcugacaccgaggagaugaugcgcgaagcgcagaucaugcaccaauuggauaaccccuacauugugagacucaucggugucugccaggcagaggcccugauguuagugauggaaauggcuggcgggggaccucugcacaaguuucuagugggcaaaagggaggaaaucccagucaguaauguugccgagcuccugcaucaggugucuauggguaugaaguaucuugaggagaaaaacuucguacaccgggacuuggcagcccgcaaugugcugcucgucaacagacauuacgcuaagauuuccgauuuugggcugagcaaggcccuuggcgcagacgauucguauuacacagcgaggucugcuggaaaauggccgcugaagugguaugcccccgaguguauaaauuuccguaaauucuccucacggagugacguguggagcuacggcguuaccaugugggaagcauuguccuaugggcagaagccuuacaaaaagaugaagggaccagaggugauggccuuuaucgagcaagguaaacgaauggaaugucccccugagugcccacccgaacucuacgcucugaugucugacugcuggauuuauaagugggaggauagaccggacuucuuaacggucgaacagaggaugcgcgccugcuacuauagccuggcaucaaaaguggagggcccuccagggaguacucagaaggcugaggccgcgugugccuga

SEQ ID NO: 64957 - RNA, 1275 nt, Artificial Sequence
  derived and/or modified sequence opt3 from ZAR1__Homo_sapiens__NP_783318
auggccgcucugggcgacgaggugcucgauggguacgucuuccccgcaugcccuccauguagcuauagauacccguaucccgccgcgaccaagggaaaaggugcugccggcggguccuggcagcaaaggggacggggcugccuuccugcaucuucaccauguagugccggugcugcaagccuguccuuucccgggugcggacgcuugacagccgcugaauacuucgacucuuaucagcgagagcguuuaauggcccugcuagcgcagguuggcccuggccucgggccaagagcaaggcgggccggaucgugugauguggcuguacaggugucaccccgcaucgacgccgcaguccaaugcagccuggguagaaggacucuucagcggcgcgcucgagauccugaaaguccagccggcccgggggcggagggaacgaccggcgguggguccuuuucucagcagcccagcagaaggggacuggaacaaggcuccccucagaacggcgccccacggcccaugcguuucccucgcacaguggcaguuuacucaccauuggcucucagaaggcugacugccuuucuggaggggcccggaccggcugccggugagcagcggaguggcgcaagcgacggggaacgaggaccucccccagcccgccuccagggcccugaggaaggugagguguggaccaagaaagcucccagaaggccacaaucugaugacgauggggaggcgcaggcagccguccgggcuuccugggaacagcccgccgacggcccugaguuaccaccgcgcgaagcacaagagggagaagccgcucccagaucagcccugaggagcccuggccagccacccagugcagggcgugcgcgggauggaggugacggccgagaggcugccguggcaggggagggaccuucuccaagaucccccgaacuuggcaaggagagguugcgcuuccaguuucuggaacagaaauaugguuacuaccacuguaaggauugcaauauucggugggagagcgccuauguaugguguguucaagggacaaacaagguguacuucaaacaguuuugcagaaccugucagaagucguauaauccguacagggucgaagacauaacuugccagucuugcaaacaaacacgcuguuccugcccugugaagcuacgacauguggacccaaaacggccccaccgucaggaucucuguggcagaugcaagggaaagaggcugucaugugacaguaccuucagcuuuaaauauaucauuuga

SEQ ID NO: 64958 - RNA, 966 nt, Artificial Sequence
  derived and/or modified sequence opt3 from ZAR1L__Homo_sapiens__NP_001130043
auggagagauucgugaggguccccuacggccuguaucagggguacggaagcaccguuccucucggucaaccaggccuuuccgggcacaagcagccggacuggcggcagaacaugggacccccuacauuucuggcccgcccaggcuuguuagugcccgcuaaugcaccugauuauugcaucgacccauacaaacgagcccagcugaaggcgauucuaucucaaaugaaccccucacucaguccucgucuguguaaaccaaauacuaaggaaguaggugugcaggucagcccgagaguggauaaagcuguucagugcucccuugggcccaggacgcugucuucguguucaccuugggacggacgggauccacaggagcccuugccugccugcggcgugaccagcccagcaacaggccgcagagggcucauaaggcugcggcgcgacggagaugaagccgagaguaaggcucugcccgguccggcagaagccucccaaccucagcccccaucucgaagaagcggcgcugacaggcaggaggagccugggcagcucgaagaguccggagaaaaggaugcccccuguccacaagagacuaaaucaaagcagguccccggcgacgcggcaagugagccuuuacggcguccaaacuuccaguuucuggaaccgaaauaugguuacuuccauugcaaggauuguaaaacccgcugggagagcgccuauguguggugcaucucugggacaaauaagguauacuuuaagcaacuuuguugcaaaugucagaaguccuucaaccccuacagaguugaagcuauucagugccagaccugcucaaaaagccacuguaguugcccucaaaagaaaaggcauaucgacuugcggcgaccacaccgccaggagcuguguggaagaugcaaggauaaaagguuuucuuguggcaauauuuauuccuucaaguacgugauguga

SEQ ID NO: 64959 - RNA, 507 nt, Artificial Sequence
  derived and/or modified sequence opt3 from ZASP__Homo_sapiens__NP_001276862
augcccgccagccacgcuccuggcgcauccgccaacccaccgugccaucugcccucugugaucgcggacucauuccucgcuagucaccuuagcccuuccccagagagaaccgucaugcuggggucugcccccgauccuuugccacaggcaggaucgaggcggggucaucgcggcgaggccaaucccgcuccuucaccacgaagccacugugcaaguccgacaacuuccuggaagcguagagggcccagggagggagccucuccuacgagcuuacuguccucaaccccaugcuggacaggccuacggggugaagggggaggcacuggccccaccccuccagggacacccggagcugaggacgccccgggucuccgcgcgcugagagaagcaaggggcgaagggggacuuggccuggguaccuuggggcucccugccuggcugccccugggaagucggguuuggguggagggcccacgcguaagccaagugucuugucagccucaguga

SEQ ID NO: 64960 - RNA, 2085 nt, Artificial Sequence
  derived and/or modified sequence opt3 from ZBED1__Homo_sapiens__NP_001164606
auggagaacaagagccuggaauccucucagaccgaccucaaacuuguggcccaccccagagcuaagucaaaagucuggaaguacuucggcuuugauacaaaugcagaggggugcauccugcaauggaaaaagauuuauuguaggauaugcauggcccagaucgcguacaguggaaacacuagcaauuuguccuaucauuuagaaaagaaccacccugaggaguucugugaauuuguuaaaucuaauacggagcagaugcgggaggcuuucgccaccgcauuuucgaagcugaaaccagaaucaagccagcaaccgggucaggacgcccuagcugugaaggcaggccauggguacgauaguaaaaagcagcaggaacucacagccgcuguacugggacuuauuugcgagggccuguaucccgccuccaucguggacgagccuacuuucaaggucuugcucaaaaccgcggauccacgcuacgaacugcccucucgaaaguauauuagcacaaaagcaaucccugagaaguacggugccgugcgugaaguuauacugaaagagcucgcugaagccaccuggugugggaucuccacugacauguggagaucagagaaccaaaauagggcauacgugacauuagcugcccacuuucugggacuuggcgcgccaaacugcuugaguaugggcagccggugucugaagaccuucgagguccccgaagagaauacggccgaaacuauuacccgcgugcuauaugagguauuuaucgaaugggggauuucugcaaaaguuuucggagcuacaacuaacuacgguaaggauaucgugaaggccugcucccuccuggacgucgcugugcauaugccuugucuuggccacaccuuuaaugccgggauacagcaggcauuccagcugccaaaauugggagcccuccugucaagaugcaggaaguuaguggaguauuuucaacagagcgcugucgcgauguacaugcuguaugagaaacagaagcaacagaacguugcacacuguaugcucgugaguaaucggguaucuugguggggcuccacacuugccaugcugcagcgcuugaaagaacagcaauucgugauugcugguguccuaguggaggauagcaacaaucaucaccugaugcucgaagccucggagugggcaaccaucgaagggcugguugagcuucugcagccguucaaacagguggccgagauguugucugcuucccgauaccccacgauuucaauggucaagccucuccugcauauguuacugaacacuacacuaaacaucaaggaaaccgacaguaaggagcucagcauggccaaagaagugaucgcaaaggagcuguccaaaacuuaucaggagacaccagaaauugauauguuucuuaauguagcgaccuucuuggaccccagauacaagaggcugccuuuucucucugcuuucgagcggcaacagguugaaaaccguguggucgaggaagccaagggacugcuugauaaagugaaggacggcggcuaccgcccagcagaggacaaaauauuucccgucccggaggaaccucccgugaagaaacugaugagaacgagcaccccaccucccgccucaguuaucaauaacauguuggcugagauuuucugccagacagggggaguggaagaucaggaggaauggcacgcccaaguagucgaggagcucaguaauuuuaagucccagaaggugcuggguuuaaacgaagacccacugaaaugguggagcgauaggcuagcacucuucccccugcuuccuaagguuuugcagaaauauuggugcgugacugcuacccgggucgccccagagcgacuguuuggcucugcggccaaugugguaucagcuaagcgcaacagacucgcaccggcccacguggacgaacagguuuuccuguacgagaaugcuaggaguggggccgaagcagagcccgaggaucaagacgaaggagaguggggcuuagaucaggaacaggucuuuagccugggugacgggguguccggcggauucuuuggcauccgggauucuucguuccuuuga

SEQ ID NO: 64961 - RNA, 3516 nt, Artificial Sequence
  derived and/or modified sequence opt3 from ZBED4__Homo_sapiens__NP_055653
auggagaacaaucugaagaccugccccaaagaagacggcgauuucgugagcgacaagaucaaauuuaagauugaggaagaggaugacgaugggauaccuccagacucccucgaaagaauggauuucaaaucugagcaggaggacaugaagcaaacagauucaggaggugaaagggccggccuugggggaacuggcuguaguugcaagccgcccgguaaauaccugagcgcugaguccgaagacgauuauggggcauuguuuucucaguacucgucaacguuauaugacgucgccauggaggcgguuacccagagccugcuaaguucccggaacaugucuagccgcaagaaauccccugcuuggaagcacuucuuuaucucaccacgagauaguacaaaagccauuuguauguacugcgugaaggaguucagccguggaaagaaugaaaaagaccucucuacuuccugucugaugagacauguaaggcgggcacaccccaccgugcuuauccaggagaacggcucagucagcgccgugaguucuuuuccuuccccaagccuguugcugcccccucaaccagcugacgcaggcgaucucucgacaauucugucuccgaucaagcucguucagaaaguggccuccaagauacccucaccugaccgcaucaccgaagagagugucagcgugguauccucugaagagauuagcucagauaugaguguuuccgagaaaugcgggagagaagaggcuuuagugggaagcucuccacaucugcccgcccuucacuaugacgaaccugcggagaauuuggcagaaaagucacugccacuacccaaaaguacuagcgguuccaggcggcgcucugccgucuggaagcauuucuaccucucgccgcuggauaacagcaaggcuguguguauccacugcaugaaugaguuuucccgaggcaaaaacgggaaggaccuuggaacaucaugucugauuagacacauguggagggcccaucgggcaaucguguugcaggagaauggcgguaccgggauaccuccccucuauaguacgccaccuacucuguuacccucucugcucccacccgaaggagagcuuagcuccgucucaagcucuccuguuaaaccagugcgugaauccccgagugcuucuagcucccccgaucgccugaccgaggacuugcagucacaccuaaacccuggcgauggccugauggaagacguagccgcguucaguagcucggaugacauuggggaggccuccgcaucuagcccagagaagcaacaggcugacggacucucacccagacuguuugaaaguggugccaucuuccagcagaauaaaaaggugaugaagaggcuuaaauccgaggucuggcaucacuuuucucuggcuccuauggauagcuugaaggccgaaugccgguacuguggcugcgcaauuucccgagggaaaaagggagacgugggcacaucaugccucaugcgccaccuguacagaaggcauccagagguuguggguagccaaaaaggguucuuaggcgccagucuggcuaacucucccuaugcgacucuagcauccgccgagagcucgucaucuaagcucaccgaucugccgacagucgugaccaagaauaaccagguaauguucccuguuaauaguaaaaagacguccaaacuuuggaaccacuuuagcaucuguucugcugacagcacuaagguggucugcuugcauuguggacggacaaucucccgcggcaaaaagccaaccaaccuggggacuucaugccuccugagacaccuucagagguuccauaguaaugugcugaagacagaagucagcgagaccgcccgucccucuuccccugauacgcgggugccccgaggaaccgaauugucaggugcaaguagcuuugacgauacaaacgagaaauucuacgacucccacccaguugccaagaaaauuacuucucucauagcugaaaugaucgcccuggauuuacaaccuuauucguuuguggacaauguaggcuucaacagacugcuagaguaccucaagccccaguauagccugccagcaccgucauacuuuuccaggaccgcgauuccugggauguaugauaaugucaaacagaucauaaugagucaccuuaaggaggcugaaucuggagugauucauuucacaagcggcaucuggauguccaaccagacucgcgaguacuugacccugacagcccacuggguuucauuugaaucucccgcacggccaagaugugacgaucaucacugcagcgcccuccuggacgugagucaagucgacugugauuacuccgguaauagcauccagaaacaguuagagugcuggugggaggcuugggugaccucuacugggcugcagguaggcauuacggugacagacaacgccucaaucggaaagacccuuaaugaaggcgagcacuccaguguucaauguuucagccauacugucaacuugauugugucggaagcaauaaagucucagaggauggugcagaaucuccugucccuagcucgcaaaaucugcgagcgaguccaccggagccccaaggccaaagaaaagcuggcggagcuccagcgugaauaugcccugccucaacaucaccuuauucaggauguuccaucaaaauggaguaccucuuuucauauguuggagagacugaucgagcagaagagggcuaucaacgaaauguccguggaguguaauuuccgcgaauuaauuagcugcgaccagugggaggugaugcaaucaguaugccgggcacucaagcccuuugaggccgcuaguagagaaaugagcacacagauguccacccugucucaggucauaccuauggugcacauccuuaacaggaaaguugagaugcuguucgaagagacuauggggauugauacaauguugcgaagccucaaggaagccauggugucccgccugucagcaacgcuacacgacccgcgguacgucuucgcgacccugcucgauccaagauauaaagccucucuguuuacugaggaggaagcugagcaauacaagcaggaccuuaucagggaauuggagcugaugaauaguacaucggaagauguggccgcaagccaucguugugacgcuggaucccccucuaaagauucagccgcagaggagaacuuauggagccucguugccaaggugaagaaaaaggacccucgcgaaaaacugccagaggcuaugguacuugcguaucuggaagaggaaguccuagagcacuccugcgauccccucaccuacuggaaccugaagaaagccaguuggccugguuugucugcacuggcugugcgguucuuaggcuguccgcccagcauugugccaucagagaagcucuuuaauacaccuacugaaaacgggucccugggacagaguagacuuaugauggagcauuucgaaaagcugaucuuuuugaaagucaaucucccccugauauauuuccaguacuga

SEQ ID NO: 64962 - RNA, 2082 nt, Artificial Sequence
  derived and/or modified sequence opt3 from ZBED5__Homo_sapiens__NP_001137139
augaucgcuccccugcucugcauucuuagcuacaacuucaauaccuuugccauacugaacguguauuccaaguugacaauguucuguacuaccaauucuuuaccuauggaccugcuacucaaacagggcucacugaagcaagaggucgaaaguuuuugcuaccagaucguuagcgaguccaacgaucagaaaguggggauucuucagucugaagacaagcaacugcagccaucgguaagcaaaaagucagagggagaauugaguagagugaaguucaucuccaauucuaacaaaauuacguuuagcaagaaaccgaagaggcggaaauaugaugaguccuaccucucauucgguuuuacauauuucggcaaucgcgacgcaccccacgcccaguguguccugugcaagaagauccugaguaacagcucucucgcgccuuccaaauuacgacgucaucuggagacuaagcacgcugccuacaaagauaaggacauaucauuuuucaaacagcaucuugauagcccagaaaauaacaagcccccuaccccaaaaaucgugaauacagacaacgagagugcaaccgaagccucuuauaauguuuccuaccacauugcuuugagcggggaggcacauacuaucggagagcugcuaauuaagcccugugccaaggauguggucaugagaauguuugacgaacaauacucgaaaaagaucgaugcugugcagcucucuaacuccacaguagccaggcggauaaaagaccuggcggcagauauugaggaagaacuuguuugccgccugaagaucugugacggcuucucauugcagcucgacgaaagugccgaugugagcggucuggcugucuuacugguguuugugagauauagguucaauaaauccauugaggaggaccuccuucugugcgaaucuuugcagagcaacgccaccggggaggaaaucuucaacuguaucaauucauuuaugcaaaagcacgagauugaaugggagaagugcgucgauguuuguagugacgcaucccgggcuguggauggaaaaauagccgaggcgguaacgcuaaucaaguacguggccccugaaagcacuucuucacacugccugcucuaucgccaugcacuggcugucaaaauuaugccaaccagucuuaagaacgugcuggaccaggccguucagaucauaaauuacauuaaagcucgaccgcaccaaagcagauugcucaagauccugugcgaggaaaugggcgcccagcauacagcauuacugcuaaacacugaggugagguggcucucccggggcaagguccuggugcgucuuuucgaauugcgcagagagcugcucguauuuauggauucugccuucaggcugucggacugucuuaccaauagcuccuggcuguugcggcucgcuuaucuggcggauaucuuuacaaaauuaaacgagguuaaucugucaaugcaggggaagaacgugaccgucuucacgguguuugacaaaaugaguucucuacuccgaaagcuggaguucugggcaagcuccgucgaggaagagaauuuugauugcuuccccacucuuucagacuuuuugacagagauuaacagcaccguggacaaagauaucuguucugccauuguucagcaucugcgcggacucagagcuacucuguuaaaguacuucccugugacaaaugacaacaaugccuggguaaggaacccauuuaccgucacggugaagcccgcaucccugguugcccgggauuaugaaagucuuauagacuugaccagcgauucucaagugaaacagaauuucuccgagcucucacugaacgacuucuggaguagccuaauccaggaauacccuucgauugcucgcagagccgucagggugcugcucccauuugcaacaaugcaccugugcgagacugguuucuccuacuaugcggcuaccaagacaaaauaccguaagcggcuugaugccgcaccccacaugcgaaucagauugucuaacaucacuccgaauauuaaaaggauaugugacaagaaaacccagaagcacugcagccauuga

SEQ ID NO: 64963 - RNA, 1065 nt, Artificial Sequence
  derived and/or modified sequence opt3 from ZBP1__Homo_sapiens__NP_001153890
auggcccaggcucccgcagacccuggcagagaggccgaaaggccacaacagcacgcggcuaccaucccggagacacccgggccucaguucagccagcaacgggaagaggauauuuaccgcuuucugaaggacaacggaccacagcgagcccucgugauagcacaggcccuugguaugcguacugcuaaagaugucaauagagaccuguauaggaugaagucccggcauuuguuagauauggacgaacagucuaaagcauggacgaucuaccgccccgaggauucaggcagaagggccaagagugcuagcauuaucuaucaacacaacccuauuaauaugaucugccagaacgggccaaauuccuggauaucuaucgccaacucggaggcgauucagaucggacauggcaauauuaucacccggcagacaguuucacgcgaagacgguagcgcagggccccgacaucugccuaguauggccccaggagauuccucuacuuggggcacccuaguggacccguggggcccccaagauauacacauggagcagagcauucucagaaggguacagcuggggcacuccaacgaaaugcggcuucacggagugccuucagaggguccagcucauauucccccuggcaguccacccgucagcgccacagcagcugggccggaggccucuuucgaagcgcguaucccuucccccggaacccacccagagggcgaagccgcacaacgcauccauaugaaaucauguuuucuggaggacgcuacuaucgguaauagcaacaagaugaguauuucuccugggguggccggacccggcggcguugcuggguccggagaaggugagccaggcgaggaugccgggagaaggcccgcagacacacagagccggucgcacuucccucgagacauaggacagccaaucaccccgucucacuccaaguugacgcccaaacucgaaacuaugacccugggcaaucgcucacauaaggccgcugaggguagucacuacguggaugaagcgagccaugagggguccugguggggcggaggcauuuga

SEQ ID NO: 64964 - RNA, 2616 nt, Artificial Sequence
  derived and/or modified sequence opt3 from ZBTB10__Homo_sapiens__NP_001099009
augagcuucuccgagaugaacagaaggacccuggccuuucggggcgggggacucgugacagcuucugguggcgggucaacuaauaacaaugcaggaggcgaagccagugcguggcccccucagccacaaccgcgccagcccccuccacccgcuccuccagcccuucagcccccuaacggucgaggggcagacgaggaagucgagcuggaaggauuggagccacaggauuuagaggccagcgcuggcccggcagccggcgcugccgaagaggcgaaggaacugcuacucccccaagacgcagggggaccuacgucccuggguggcggggccggaggcccacuucuggcugagcguaauagaaggaccuuggccuuccggggugggggaggcggcgggcucggaaacaaugguucuucgcgcggcagacccgagacaucaguuuggccucugaggcacuuuaacgggcggggaccagcaacuguggaucuggaacucgacgcuuuagagggcaaagaacugaugcaggauggugccagccuuagugacuccaccgaggaugaagaggagggggcgucuuugggcgacggaagcggcgccgaagggggauccugcucaaguagccgccgaucugguggcgaugggggagacgagguagaaggcuccggugugggggcaggcgagggagaaacaguccagcauuucccccuggcuagaccgaagucacuaaugcagaaacuccaauguagcuuucagaccaguuggcugaaggauuucccuuggcuuagguacucuaaagacacuggccugauguccugcggguggugucagaagacacccgccgauggagguagcguggacuugccaccuguuggccacgacgagcucucgcgggggacccguaauuauaagaaaacgcuguuacugcgccaucacgugucuacugagcauaagcuccacgaagcuaacgcccaggaguccgaaauccccucagaggaaggauacugcgauuuuaauaguagaccaaacgagaauagcuauuguuaccaacuucugaggcaguugaacgagcagcggaaaaagggcauucuaugcgacgucuccauagugguaucugguaaaaucuucaaggcacacaagaauauucugguugccgggagccgauuuuucaaaacccucuauuguuuuucaaacaaggaaagucccaaccaaaauaacacaacucaucuggauaucgcugcggugcagggcuucuccgucauucuugacuuucuguacagcggaaauuuggugcucaccucucagaacgcaaucgaggugaugacagucgccucauaucugcagaugagugaaguugugcaaaccugccgcaauuucauaaaagaugcuuuaaacaucagcauuaaguccgaggccccugagucuguaguggucgacuacaauaacagaaaaccagugaauagggauggccugucgagcucccgggaccagaagaucgcaucauucugggccacgcgcaaccuaacuaaucucgcuaguaacguuaaaauugaaaaugauggguguaacguggacgagggacagaucgaaaauuaccagaugaacgauucuagcuggguccaagacggcuccccggagauggccgaaaacgagucagagggucagacaaagguguuuauauggaauaacauggggagccagggcauucaggaaaccggaaagacuagaaggaaaaaucaaacaaccaagcguuucaucuauaacauucccccuaauaacgagacgaaucuggaagacugcucuguaaugcagccacccguugcauacccugaggaaaacacccuuuugaucaaagaggagccagaucuggacggugcgcuccuguccggccccgauggggaccggaaugugaacgcuaaucuucuggccgaagcaggaacaagucaggauggcggggacgccggaacuagccacgauuuuaaguauggcuugaugccggguccuucuaacgacuucaaauacgggcucaucccaggaaccuccaaugauuuuaaguauggccugauucccggugcuucaaacgacuucaaguacggcuuacugccugagaguuggcccaaacaggaaacaugggagaauggggaaagcucgcuaauaaugaacaagcucaaauguccacauugcuccuaugucgccaaguaccgaagaacucugaaaaggcaccuuuugauccacaccggagugcgcucuuuuagcugcgauauuuguggcaagcuguucacacggagagagcaugucaagaggcacucacucgugcauaaaaaggacaaaaaguacaaaugcaugguuuguaagaagaucuuuaugcuggcagcuaguguggggauacgccacggaucccgacgguauggcguaugcgucgauugugccgacaaaucucaaccuggugggcaggagggaguggaccagggccaagauaccgaguucccccgugacgaagaauacgaggagaacgaaguuggugaggcggaugaagaguuaguggacgauggcgaagaccagaaugauccaagcagaugggacgaguccggggaggucugcaugucacuggaugacuga

SEQ ID NO: 64965 - RNA, 1380 nt, Artificial Sequence
  derived and/or modified sequence opt3 from ZBTB12__Homo_sapiens__NP_862825
auggccagcggcguggagguccugagauuccagcuccccgggcacgaagcugcaacccuuaggaacaugaaucaacugcgggccgaggaacgcuuuugcgacguuacaaucguggcggauuccuugaaguuccgaggacauaaaguaauuuuagcugccuguucuccuuuucugcgugaccaguuccuacucaacccaucaagugagcuucaggugagccugaugcacuccgcaagaauagucgccgaucuguugcucucuugcuacacuggugcucuggaauuugcagugagggacaucguuaauuaucugacggccgcuucguaccuccagauggagcauguggucgagaagugucggaacgccuuaucacaauucauugaaccgaaaaucggccugaaggaggauggggugagcgaagcgagucuuguauccucuauuagcgcaaccaaauccuugcugcccccugcccgcacaccaaagcccgcuccuaagccacccccuccaccgccccuaccuccaccccuccugagaccuguuaaacuugaguuuccacuggacgaggauuuggaacucaaggccgaggaagaggacgaagaugaggacgaggaugugucagacaucugcauagucaaaguggaaagugcacuggagguggcucacagguuaaagcccccgggaggccugggugggggacucggcaucggcgggagcgucggaggucaucuuggcgaacuggcccagucuuccguuccucccucaacuguggcgccaccucaggggguagugaaagccuguuauagcuugagugaggaugcagaaggagagggccuacugcucauucccggugggcgggcuucugucggagccaccuccggccugguggaggcugccgcaguugccauggcugcgcgcggcgcagggggaagccuuggugccggcgggucgcgaggaccacugcccggcgguuucucugggggcaauccuuugaagaacaucaagugcacaaaauguccagaaguguuucagggagucgagaagcucguguuccacaugagagcucaacacuuuauuuucaugugcccgagguguggcaaacaguuuaaucauuccucaaaccugaaucggcacaugaacguacaucgugggguuaagagucacagcugcggaaucugugguaaaugcuucacccagaaguccacuuuacacgaccaucugaaucuacacucuggcgcccgccccuacagaugcagcuauugugacgugagguucgcacauaaaccugccauacggcgacaccucaaggaacagcaugggaagacaaccgcugagaacguccuggaagccucaguggcagagauuaauguccuuauccgcuga

SEQ ID NO: 64966 - RNA, 1350 nt, Artificial Sequence
  derived and/or modified sequence opt3 from ZBTB14__Homo_sapiens__NP_001137295
auggaguucuuuaucagcauguccgaaaccauuaaguacaacgacgaugaccacaaaacacuguuccucaagacucuuaaugagcagagacuggaaggcgaguuuugcgauauagccaucguggucgaagacguuaaauucagggcucaucgguguguguuggcagccugcucuacguauuuuaagaaauuauucaagaagcuggagguagauucaaguagcgugauugagaucgacuuucuacgcuccgauauuuucgaagagguccucaacuacauguauaccgcgaaaaucucugugaagaaagaagacguuaaucugaugaugucgucagggcaaauacuuggaauccgauuucuggauaaguuguguagccagaaacgugacgugaguucccccgaugagaacaauggucagucuaagagcaaguacugccucaaaauuaacagaccuaucggcgacgcugccgauacacaggacgacgaugucgaggaaauuggggaccaagaugacuccccaucagaugacacuguggagggaaccccgcccagucaggaagauggcaagagcccuacaaccacucugaggguacaggaggcaauccugaaagaacucgguucugaggagguucggaaggugaauuguuaugggcaggaagucgaguccauggaaacaccagagucaaaagacuuaggaagccaaacgccccaggcccugaccuucaacgauggcaugagugaagugaaggacgagcagacuccuggcuggaccacagcugcaucugauaugaaauuugaguaccuuuuguaugggcaccaucgcgaacagauagccugccaggcuuguggaaagacuuucuccgacgaggguagacugaggaagcacgaaaaacuacauaccgccgaccggccauuugugugcgagauguguacaaagggcuucaccacgcaagcgcaccucaaagaacaccugaagauucauacuggguacaaacccuacagcugcgaggucuguggaaagucguucauccgcgcaccugaucuuaagaaacacgagcgaguucauucuaaugaaagaccauuugccugccacaugugcgacaaggcuuucaaacacaagucccaucugaaagaucacgagaggcggcaucguggcgaaaagccguuugugugugguucaugcacaaaggccuucgcaaaagcuagugacuugaagcgccacgagaacaauaugcauagcgagagaaaacagguaacccccuccgccauucaaucugaaacugagcagcuccaggcggccgcaauggcugccgaagcugagcagcaacuggaaacaaucgccuguagcuga

SEQ ID NO: 64967 - RNA, 2022 nt, Artificial Sequence
  derived and/or modified sequence opt3 from ZBTB16__Homo_sapiens__NP_001018011
auggaccugaccaagaugggcaugauccagcuccaaaaccccagccacccuacagggcuucugugcaaagccaaucagaugagauuggcuggaacuuuaugugauguggucauuaugguugacucccaggaguuccaugcacacaggacggugcuggccugcaccucuaagauguuugaaauacuauuccaucggaacucacagcacuacacacucgauuuucugaguccaaaaacuuuccaacagauccuugaguaugcguacaccgcuacacugcaggccaaggcagaagacuuggaugaccuccuguaugccgcugagauucuggaaaucgaguaccucgaggaacaguguuuaaaaaugcuggagaccauucaagcaagcgaugacaaugauacugaagccacaauggcugacgguggcgccgaggaggaagaggaucgcaaggcgcgauaucuuaagaacaucuuuauauccaaacauucuucggaagagucaggguacgcaagcguagccggacagaguuugccgggccccaugguggaccaguccccuucugucagcaccuccuucggucugucagcuaugaguccaacgaaggccgcaguggauagccuaaugacuaucgggcagucucuccugcaaggaacccuucagcccccugcuggcccagaggaacccacacuggccggcgggggacgucacccugguguugcggaggugaaaacugaaaugaugcaggucgacgaggugccaucccaagacucaccgggcgccgcagaaagcaguauuucugggggaaugggcgauaagguagaggaaagagguaaagaggggcccggaaccccuacaagguccagcguuaucaccucggcucgggaguugcacuauggccgcgaagagucugccgaacaggugccacccccugcugaggccggccaggcaccaacggggagacccgaacauccggccccucccccagagaagcaccucggaauuuacuccguccugccuaaucauaaggcugacgcgguguuaucaaugcccaguagcgugacuuccggucugcacguccagccagcacucgccguuucuauggauuuuagcacauacggcgggcuucugccccaaggauucauccagagggaguuguuuucaaaacuaggcgaacuggcuguggguaugaagagugagucccggaccauaggggaacagugcagcguauguggcguggagcucccugacaacgaggccgucgaacagcaccgcaaacugcauucuggaaugaagacuuauggcugcgagcuuugugggaaacgauuccuggauucauugagacucaggaugcaccuguuagcacauagugccggagcuaaggccuuugugugcgaccaauguggugcacaguucagcaaagaagaugcgcuggagacacaccggcagacccauacgggcaccgacauggcuguguuuugccuacucugugggaagcguuuccaggcccaauccgcacugcagcagcacauggaaguucacgccggaguccgcucuuacauuugcucggagugcaauagaacauucccaagccauacugcucuuaagaggcacuugcggucccauaccggcgaucacccguaugagugugaauuuugcgguucauguuuccgagacgagaguacacugaaaucucacaagcgcauccauacuggggaaaaacccuacgagugcaacggcuguggaaagaaauuuagccucaagcaccagcuggaaacccauuauagagugcacacaggcgagaagccuuucgagugcaaacuuugucaucaaaggucccgggauuacucagccaugauuaagcaucugcgcacccacaauggggcaagcccauaucagugcacuaucuguacggaauacugccccucuuuguccaguaugcagaaacacaugaagggacacaaaccugaggaaaucccacccgacuggagaauugagaagacauaccucuaucuguguuacguauga

SEQ ID NO: 64968 - RNA, 2205 nt, Artificial Sequence
  derived and/or modified sequence opt3 from ZBTB17__Homo_sapiens__XP_011540387
auguacaccgccaagcugagccucucccccgagaacguggacgauguccuugcuguugcaacauuccugcagaugcaagacaucauuacugccugccacgcguugaaaucuuuagcugaaccugccacgucaccaggcgggaaugcagaggcccuggcuaccgaaggaggugauaagagagcaaaagaggaaaagguggccacaaguacucuaagcaggcucgagcaggcuggccgguccaccccgauagggcccucucgcgaccugaaagaggaacgaggaggccaggcccagucggcggcaucaggugccgagcaaacagaaaaggcugaugccccucgugagccacccccuguagagcuuaagccagaccccaccagcgggauggcagcugccgaagcggaggccgcacugagugaauccucugagcaggaaauggagguggagccugcuagaaaaggagaagaggaacagaaggagcaggaggaacaagaggaagagggcgccggcccagcugaagucaaagaggaagggagccaguuggagaacggagaggccccggaagagaaugaaaacgaggaguccgcagguacugauucaggccaggaacucgggagugaggccaggggacugcggagcggcacauauggugaccgcaccgaaucuaaggcuuacggguccgugauccauaaaugugaggauugcggaaaggaauuuacgcacacuggcaauuucaagagacauauuaggauccacaccggcgagaaacccuuuucaugucgggagugcagcaaggcguucagugacccugcagccuguaaagcucaugaaaagacacacucuccacugaaacccuaugggugcgaggaauguggaaaguccuaccgccucauuagcuuacugaaccuucacaaaaagcgacauucgggugaggccagauauaggugcgaagauuguggcaaguuguuuacuaccucugggaaucugaaacggcaccagcuaguucauuccggagagaagccuuaccaaugcgacuauuguggccguucauucagugauccaacaagcaaaaugcgccaccucgagacccacgacacggacaaggaacauaaaugcccccacugcgauaagaaguuuaaccagguggguaaucugaaagcacaucuuaagauccacauagccgacgggccgcugaaauguagagagugcggcaagcaguucacuacauccggaaacuugaaaaggcaucuccggauccacucuggcgaaaagccuuacgucuguauucacugccaacgacaguuugcugaucccggggcccugcagcgccaugugagaauccacaccggagagaagccaugucagugcguaaugugugguaaagcauucacucaagcgagcucauuaauugcucauguuaggcagcacacaggcgaaaagccuuacgugugcgagcggugugggaaacgcuuuguccagaguucccagcuggccaaucacaucagacaucacgacaacauaaggccccauaagugcagcguguguucuaaagcauucgugaaugucggagaucucucaaagcacauuaucauucauaccggcgagaagccauaucuuugcgacaaaugcggucguggguuuaaccggguugauaaucugcgaagucacgugaagacgguacaccaaggcaaagccggaaucaagaucuuggaacccgaggaaggcagcgagguguccgucgugaccguugacgauauggugacacuagcuacugaggcccuggcagcuaccgccgucacacagcucacugggccugcgacccugccagccgugguaccgguuggagcugcagugacagccgacgaaaccgagguccuuaaagcugaaauuucuaaggccgugaaacagguccaggaggaagaucccaacacucauauacuguacgcaugugacucgugcggugacaaguucuuggaugcgaacagccucgcccaacacgugagaauccauacggcucaggcccugguuauguuccagacagacgcagauuuuuaucagcaauacggcccugggggaaccuggccagcuggccagguguuacaggccggugagcugguauucaggccccgcgacggggcagagggccaaccugcccuagcugaaacuuccccaaccgcgcccgaguguccgccuccagccgaauga

SEQ ID NO: 64969 - RNA, 1596 nt, Artificial Sequence
  derived and/or modified sequence opt3 from ZBTB18__Homo_sapiens__NP_991331
augugccccaagggcuacgaggacagcauggaguucccugaucacuccagacaucugcuccagugucuuucugaacaaaggcaccagggguuucugugcgacuguaccguguuggucggagaugcccaguuccgggcucaucgcgcaguuuuagccucaugcaguauguauuuucaccuguucuacaaagaccagcuagauaagcgagacaucgugcaucucaacagcgauauuguaacagcgccagcuuuugcccugcuucuggaguucauguaugaagguaaauugcaauuuaaggaccucccgauagaagaugugcuggcagccgcuuccuaccugcacauguaugacaucgucaaaguguguaagaagaaacucaaggagaaagcaacuacggaggccgauucuaccaagaaagaagaggacgcuucgucaugcagcgauaagguugaaaguuuauccgacggcucuagccacauugccggggaccugcccuccgaugaggacgagggagaagaugagaaacuuaauaucuugccuucaaagcgugaccuggcggcagaaccaggcaacauguggaugagacuacccagugauagcgccgguauuccucaggcugggggagaggccgaaccacaugcaacagcugccggcaagacuguggcgucucccuguuccucaaccgagagccucagucagaggucugucacauccgugcgggacagcgccgauguagacugcguucuggaucuuucggugaaaucuucccugucaggcgucgagaauuugaacaguagcuacuucuccucucaggacgugcuccgcagcaaucuggugcaagucaagguugaaaaagaggcaucaugugaugaaagugacguggggaccaacgacuaugauauggagcacuccacuguaaaggaaagcgugucuacaaauaacagaguccaguacgagccugcucauuuagccccacugagggaggacucagugcuccgggaacuugaucgcgaggacaaagcuagugaugacgaaaugaugaccccggagagcgaacgaguucagguggagggagguauggaguccucucuguugcccuacgucucgaauauccuaagcccugccggccagauauuuaugugcccacuguguaacaagguguuccccuccccucacauccuccaaauucaccugucaacgcauuuuagagaacaggaugggaucaggaguaagccagcagccgacguaaauguucccacuugcucucuuugcggaaaaaccuucagcuguauguauacacugaagcggcacgagcguacucauuccggcgaaaaaccguauaccugcacacagugugguaagucauuucaauacagccacaacuugucucgccaugcugugguccacaccagagagaaaccucacgcgugcaaguggugugagaggcgguucacgcaguccggggaucucuaccgacauauucgcaaguuccacugcgaacuggugaauaguuuaagcgucaaaucugaggcacugucccuacccacugugagagacuggacacucgaagauucaagucaggagcuguggaaguga

SEQ ID NO: 64970 - RNA, 2226 nt, Artificial Sequence
  derived and/or modified sequence opt3 from ZBTB20__Homo_sapiens__NP_001157814
augcuggagagaaagaaacccaagaccgccgaaaaccagaaagcuagcgaggaaaaugagaucacacaaccuggcggguccucugcaaagccaggacucccgugccuuaacuucgaagccgugcugucacccgacccugcguugauucacaguacucauagcuuaaccaauucccacgcucauacggguucuucggauugugacauaucaugcaaaggcaugacagagaggauccacagcauuaaccugcauaauuuuaguaacuccguccuagagacucucaaugaacagcggaaccgcgggcacuucugugauguuaccgugcgaauccacggaucuaugcugcgugcccauagaugcguacuugcagccggcagcccauuuuuccaggacaagcuguugcucgguuacuccgauauugagauccccucaguggucagugugcagagcguucaaaagcugauagacuuuauguauucuggggugcugagggucucccagucagaagcucuccagaucuuaacagcagccagcauucugcagaucaaaaccgugauugaugaguguacucggaucguaagucaaaauguuggagacguguucccuggcauacaggauucuggccaggacacaccacgcgggacccccgaguccggaacgagcggucagucgucugauacugaauccggcuaccuucaaucacacccucagcauagugucgacagaauuuauagcgcuuuguacgccugcuccaugcagaacgggucuggagagaggagcuuuuauucaggcgcgguggugagucaccacgaaaccgcacugggucuaccacgggaucaucacauggaggacccguccuggaucacacgcauucaugaacgaagccaacagauggagagauaccucucuacuacccccgagacaacccacuguaggaagcagccucggccaguccguauccagacgcugguugggaauauccauauuaaacaagaaauggaggacgauuaugacuacuacggacagcagcgcgugcagauacuugaaagaaacgagucagaagagugcacugaggauacagaccaagccgaaggcaccgagagugaacccaagggcgagagcuucgauuccgggguaucuucgagcaucggaacugaaccugacuccguggagcagcaguuugguccaggcgcugccagggauucacaggcagagcccacacaaccggaacaggcugccgaggcgccugccgaagggggaccccagaccaaucagcuggagacgggcgcaaguucuccagagcggagcaacgaagucgagauggacuccaccgugauuacaguuucaaauagcucugauaaauccguguugcaacagccuagugucaacacuagcaucggucagccccucccaucuacccaacuguauuuacgacagacagaaacucugaccuccaaccuccgcaugccccuuacacugaccucaaauacucaggugauagggacggcuggcaacacauacuugccugcccuauucaccacucagccagcuggaaguggcccgaagcccuuucuguucagccucccucaaccacuggccgggcagcagacccaguuuguaacaguuucgcaacccggacuuuccaccuucacugcacagcugccugccccacagcccuuggcuucuagcgcgggucacucaacagcaaguggccagggggagaagaaaccguaugaauguacgcucugcaauaagaccuucacugccaaacaaaacuacgugaagcacauguuuguccauacaggagagaaaccucaccaguguuccauuugcuggagaucuuucagccugaaggacuauuuaaucaaacauauggugacccacacaggcgucagggcuuaccagugcuccaucuguaauaagcgguuuacucaaaagucaagccugaacgugcacaugcgccuacauagaggugagaaaaguuaugaaugcuacauuuguaagaaaaaguucucucacaaaacccuccuggagaggcauguugcccuucacuccgcaagcaaugggacgccacccgccggcaccccucccggagcucgugccggcccaccuggggugguagcaugcacagaaggaacuaccuacgucuguucggugugccccgcgaaguuugaucagaucgagcaguucaacgaccauaugcggaugcacguuucagacgguuga

SEQ ID NO: 64971 - RNA, 3201 nt, Artificial Sequence
  derived and/or modified sequence opt3 from ZBTB21__Homo_sapiens__NP_001091872
auggagggccugcuccacuacaucaaccccgcccaugcuauuagccuucuguccgcauugaaugaagagagauuaaaggggcagcugugcgacgugcuacucauagucggagaucaaaaauucagggcccacaagaacguucuggcggcuucuucagaauauuuucagagucuuuucaccaauaaagagaacgaaagccagacaguguuucagcuggacuucugugagccugaugccuuugacaauguauugaacuacaucuauuccucuucacucuucguggagaagucaagccuggcagccguccaagaacuggguuacagucucggcauuuccuuuuuaacuaauaucgugucuaaaacgccacaggcuccguucccuaccugccccaaccggaagaagguuuuuguggaggaugacgaaaauagcucccagaaacgcucagucauugugugucagagucgaaacgaggcacaagggaagacaguaagccagaaucagccagauguuucucauacuucccgucccucaccuagcaucgccgugaaagcuaacaccaauaagccacacguccccaaaccuauagagccacugcauaaccuuaguuugacagaaaagucuuggccgaaggacuccagcgugguguaugccaaaucgcuggagcacucuggaucccuagaugaccccaauagaaucucacucgucaagaggaacgcgguucugccuaguaaaccacuucaggaucgggaagcaauggacgauaagcccggcgugagcggucaacugccuaaagggaaggccuuggagcucgcucugaaacgcccaagacccccgguauuauccgugugcucuagcucagaaaccccuuaccugcucaaggagacuaacaagggaaauggccagggcgaggacaggaaccuucuguauuacaguaaauuggggcuagucauucccuccagcggaucugguucaggcaaucagaguaucgaccggagcgggccacuggugaagucccuccugcgccgaucucuuucgauggauagccaaguuccuguguacucccccucaauugaccugaaaaguucucagggaagcuccucagucagcucugaugccccaggcaacguguugugugcacucucccagaagaguagccugaaagacugcucugaaaagacagcuuuagaugacagaccccagguacugcaaccucacaggcuacgguccuucucagccagucagagcaccgaucgugagggugcgucgccaguuacggaagugcgcaucaagacugagccguccucuccccucagcgacccuucagauauaauuagagucaccgugggggacgccgcaacaacugcugccgcuaguuccucuagcgucaccagggaucugucccuuaaaacagaagacgaccagaaggauaugucacgguugccagccaaacgacgcuuucaggcagacagaaggcugcccuucaagaaacucaaggugaaugagcauggaagcccuguuagugaggauaacuuugaagaggggucuuccccaacccugcuugacgccgauuuccccgacagcgaucugaauaaggacgaauuuggcgaguuggaaggcacgcggccgaacaaaaaguuuaaauguaagcacugccucaaaaucuuccgcucgacugcuggacugcauagacacgugaauauguaucacaacccugagaagccauacgcgugugauauuugccauaagagguuucacacaaauuucaaaguauggacccauugucaaacucagcacgguaucgucaagaaccccucgccugcaucuaguucccaugccguguuagacgagaaauuucagcguaagcugaucgauauuguucgggaacgagagauaaagaaggcucuaaucauuaaacucagaaggggcaagcccggguuccagggacaaagcucuagccaggcccaacaggugaucaagcgcaaucugcgguccagagcaaaaggcgccuauauaugcacauacugcgguaaggcuuauagguuucuuucacaauucaaacagcacauuaagaugcacccaggggaaaaaccuuugggcgucaacaagguggccaagcccaaagagcaugcaccacuggcgaguccgguagagaauaaggaaguguaccagugucgccucugcaacgcuaaacugagcucuuuacuggagcaaggaucccacgaacgacuuugucggaacgccgcaguuugcccuuauuguucauugcguuucuucagucccgagcucaagcaggaacaugagagcaaaugcgaguacaagaagcugaccugucuagaaugcaugagaacguuuaaauccucuuucucgaucuggaggcaccaggucgaggugcacaaucagaacaauauggccccaaccgaaaacuuuagccugcccgugcucgaccauaauggcgaugucacagggucaucccgcccucaaagucagccagagcccaacaagguuaaucacaucgugacuaccaaagacgacaacguguucucugauagcuccgaacagguaaauuucgacucagaggauucuagcugucugccugaggaccuuaguuuguccaagcagcugaaaauucaagucaaggaggaaccgguggaagaggcugaagaggaggccccagaagcaagcacagcucccaaggaggccggaccuucuaaagaagcgucauuauggccaugcgagaagugugguaaaauguuuacuguucauaagcagcucgagcggcaccaggaacugcuuugcuccgugaaacccuucaucugccaugucuguaacaaggccuuuagaaccaauuucaggcuguggagucacuuucagagccacaugucgcaggcuucugaggaauccgcacauaaagagagcgaagugugcccuguuccgacaaacucacccaguccaccucccuugccaccucccccaccgcucccuaagauucagccccuggagccagauucucccaccggccuauccgagaauccuacuccagccacggaaaagcuguucgugccccaggagagcgacacacucuuuuaccacgcuccuccgcugucagccauaaccuucaaacgacaauuuauguguaaacuuugccaucgcacuuucaaaaccgcauuuaguuuguggagccacgaacagacacauaacuga

SEQ ID NO: 64972 - RNA, 1905 nt, Artificial Sequence
  derived and/or modified sequence opt3 from ZBTB22__Homo_sapiens__NP_001138810
auggagcccagcccucuguccccaucuggcgccgcucucccgcuuccccugucauuggcaccuccacccuuaccucugccagccgcggcugugguccacguuaguuuccccgaagugaccagcgcccuacucgagucccugaaccagcaaagacuucaggggcagcugugcgacguaucuaucagggugcagggacgggaauuucgcgcacaucgagccgucuuggcugcaucgucaccuuacuuccacgaucaagugcuccugaaggguaugaccagcauuagucugccauccguuauggacccgggcgccuuugagacugugcucgcuucugccuauacggggcguuuaagcauggcggcagccgauauagucaauuuccugaccgugggauccguacuucagauguggcauaucguugacaaauguacagaauugcugagagagggcagggcuucagccacuaccacaauuaccacugcagcugccacaagugugaccguccccggugcgggggugccuagcggaucuggcggcacgguggccccagcaacuaugggguccgcucggucacacgccagcagucgcgcuucugagaaccagucccccagcucgucuaauuacuuuuccccuagagaaucaaccgauuucaguagcuccucucaggaggccuuugcagccagcgcugucggaucaggugaaaggcggggcgggggaccaguuuuccccgcgccggugguaggcagugguggggcaacauccggaaagcuacuccuggaggccgacgagcuuugcgaugacggcggcgaugggcgcggagcuguggucccuggugccggccugcgaagacccacuuauaccccaccuagcaucaugccccaaaaacauuggguguacguuaagaggggagggaacuguccagcacccacaccuuuggugccacaggacccggaucucgaagaggaagaggaagaggaggaccuggucuuaaccugcgaagaugacgaggacgaggaacugggcgguucuucacgggugcccguagggggcggaccugaagccacgcucaguauuagcgauguucguacucuuuccgagccacccgacaaaggcgaggaacaggugaauuuuugugagucuucgaacgauuucgggccuuaugaaggagguggcccagucgcugggcuggacgauagcggaggccccacaccguccucauacgccccuagucacccaccccgcccuuugcuaccccuggacaugcaggguaaucaaauccucguguuuccaucuagcuccucaucuagcuccagucaggcaccugggcagcccccaggcaaccaagcggagcacggagcugucaccgugggcgggacuagcguuggaucucugggugugccgggcuccguagggggagucccuggcgguacagggucaggcgauggaaauaagauauuccuuugccauuguggcaaggccuuuagucacaaaagcaugagagacaggcaugugaacaugcaccugaauuugcggcccuucgauugcccaguuuguaacaagaaauucaagaugaaacaccaucucaccgaacacaugaagacgcauaccgggcugaagcccuaugagugcggagugugugccaaaaaguuuauguggcgagacucguucaugcgccacagaggccauugcgagaggcggcaccgcuuagguggggucggagcagugccuggcccagguacacccacuggcccuucccugccgucuaaaagagaaagcccagggguaggaggcgggucaggagaugaggcuagugccgcaacacccccuuccucuaggcguguguggagcccaccccggguucacaaggucgaaaugggcuuuggugggggaggcggugcuaauuga

SEQ ID NO: 64973 - RNA, 2094 nt, Artificial Sequence
  derived and/or modified sequence opt3 from ZBTB24__Homo_sapiens__NP_055612
auggccgagaccagccccgaaccuuccggccagcuggugguccacucugacgcucauucagauaccguucucgcaaguuucgaggaccaaagaaagaaaggguuucuuugcgauaucacucugauuguggaaaacguacacuucagggcccauaaggcguuguuagcugccagcuccgaguacuuuucuaugauguucgcagaagagggagagauaggucagucgaucuauaugcuggaaggcaugguggccgacacguuugggauucuacucgaguucaucuacaccggauaucugcacgcuucagagaaaagcacagaacagauucuugcaacugcccaguuucugaaggucuacgauuuggugaaggcuuauaccgacuuccaaaauaaccauaguuccccaaagccgacaacccucaauacugccggcgcgcccguuguggucaucucuaacaagaaaaaugauccuccaaagcggaaacgcggucgacccaagaaagugaacacacugcaggaggaaaagagcgagcuggcagccgaagaggaaauacagcuccguguaaauaacuccguucagaauagacaaaacuuuguggucaagggggacucaggaguguuaaaugagcagaucgcugccaaagagaaggaagagagugaaccuaccugugagccaagcagggaagaggagaugcccguggaaaaagaugagaacuacgacccuaagacggaagauggccaggcaucucagucccgguauucaaaacgcagaauuuggaggagcgucaagcugaaagacuacaaacuuguuggcgaucaagaggaccacgggagugcuaagcggaucugcggacgccgaaaaagaccagguggcccggaagccagguguaaggacugcgggaaaguguucaaguacaaucacuuuuuggcgauucaucagcggucucacacuggagagcgucccuucaaauguaacgagugcggcaaggguuuugcccagaagcauucccugcaaguacacacccgcaugcacacaggggaaagaccuuauacuuguaccgugugcagcaaagcacuaacaaccaagcauucgcuccuggagcacaugucucuucauuccggacagaaaucauucacgugugaucagugcggcaaguacuucagucagaauaggcaacugaaaagccacuaucggguccauacuggccacuccuugccagaauguaaggacugccaccgaaaguuuauggaugugucucagcucaaaaagcaucugcgcacacacaccggggagaaacccuucacuugcgagaucuguggaaagagcuuuacagcuaaaucaaguuuacagacccauauaaggauucacagaggugaaaagccuuacuccugcggcaucuguggaaagagcuucucugacucaagugccaaacggcgccacugcauucugcauacggggaagaaaccauuuagcugucccgagugcaaccuccaguucgcuagacuugauaaccugaaggcccacuugaaaauccauuccaaggaaaaacacgcaucugacgccucgagcaucuccggcucaaguaauaccgaggaaguuaggaacauucuacaacugcagccguaucagcucucuacaagcggugagcaggagauacaacugcuugugacugauuccguccauaauaucaacuuuaugccugggcccucacagggcauuagcaucgugaccgcugaaucuucccagaauaugacagcggaccaggcagccaaccugacuuugcucacccaacagccagagcagcugcaaaauuuaauacugagugcucagcaggaacagacagagcacauucaaagccuaaacaugaucgaaucucagaugggaccuucccagaccgagcccguacacguuaucacucucucaaaggagacgcuggaacaucuucacgcccaucaggagcaaacagaagaguugcaccuggcaaccaguacuagcgauccagcccagcaucuccagcugacccaggaacccggcccuccaccgcccacacaccacgugccucaaccaacaccccuugggcaggagcagucguga

SEQ ID NO: 64974 - RNA, 1545 nt, Artificial Sequence
  derived and/or modified sequence opt3 from ZBTB2__Homo_sapiens__NP_065912
auggaccuggccaaccacggccucauacuucugcagcaauugaaugcucagagagaguucggguuuuuaugcgauuguaccguggcaauuggagacgucuacuucaaggcccauaaaagcguucuggcguccuuuucuaacuauuucaagaugcuauuugugcaccagacaucagaaugcguaaggcucaaacccacugauauacagccugacaucuucaguuaccugcuucaucugauguauacggguaagauggcuccacaauugauugauccggugcggcucgagcagggcaucaaauuucugcacgccuacccccugauucaggaagcaagccucgccucccagggggcuuucucucauccugaccaagucuuuccauuagcaucgucacuguauggaauccagauagccgaucaccagcuucgccaggcuaccaagaucgccagcgcgcccgagaaguugggccgagacccucguccacaaacaaguagaauuucccaggaacaggugcccgaggcaucucaacugagccagcuaacuuccaaucucgcccagguuaacaggaccaauaugacaccuucagauccacugcagaccagucuuagcccggagcuggugucuacucccgucccuccacccccuccaggugaagagacaaacuuggaggcuuccucaagcgacgaacaacccgccagucucaccaucgcacacgugaaaccgucuauuaugaagcggaauggguccuucccuaaauacuaugcuugucaucugugcggacgcagauuuacguuaaggagcucgcugcgggagcaccuccagauccauacuggcguacccuucaccucuucccagcagggcgaaucacgcguuccacuuacacuguguaguaacgccgcggauuuggggaaggacgccauggaggugccugaagcaggaaugauaagcgauuccgagcuacaacacauuucugacagccccaucauugacggucagcagcagucagaaacuccacccccuagugauaucgcugacaucgauaaucuggagcaagccgaccaggagcgagaagucaaaagaaggaaguacgagugcaccauuuguggccggaaguuuauacagaaaucccacuggcgugaacauauguacauccacacagggaagccauucaaaugcagcaccugugauaagucuuucugccgcgcuaaccaggccgcaagacaugugugucucaaucaaucaauugacacguauacuaugguggauaaacagacacuggagcuuugcaccuuugaagagggaagucagauggacaacaugcugguccaaacuaauaagccguacaaaugcaacuugugugauaagacauucagcacccccaaugagguugugaagcacuccugccagaaccagaacucugacguauuugcccucgaugaaggcaggucgauccuguuagguagcggggacuccgaggugacggaaccugaccauccaguccuggcuucaaucaaaaaggagcaggaaaccgugcuacucgauuga

SEQ ID NO: 64975 - RNA, 1464 nt, Artificial Sequence
  derived and/or modified sequence opt3 from ZBTB32__Homo_sapiens__NP_055198
augagccugcccccuaucagacucccauccccguacggcucugacaggcuugugcagcuggccgcucgguugcgccccgcauuaugcgauacccugauuacagucgggucacaagaguucccugcccacagucuaguucucgcgggagugagccagcagcugggucgacguggccagugggcucuuggggaaggaauauccccaucuacuuuugcccaacuguugaacuucguauauggcgagucgguggaacuccagcccggugagcugagaccucugcaggaagcagccagggcucucgggguccagucauuagaggaggcauguuggcgggcccgcggagacagagcuaagaaaccagaucccggccugaagaaacaucaagaggagccugaaaagccaagcaggaauccggagcgggagcuuggcgaccccggggaaaaacagaagccugaacaggugagucgcacgggaggucgagaacaggagauguugcacaagcauuccccacccagaggcaggccugaaauggccggggcgacccaagaggcacagcaggagcaaacacggucuaaagaaaagcgucugcaggccccaguuggacagcgcggcgcugaugguaaacacggggugcuaacuuggcucagagagaaccccggaggcagcgaagagucccugaggaagcugccgggcccucugcccccagccgggucauugcagaccagugucacaccucggcccagcugggcagaagcuccauggcucgugggaggucaacccgcccuguggucuaucuuacugaugccuccacgauacggcauuccguuuuaucauuccacccccacuacaggggcguggcaggagguauggcgcgagcagagaaucccucucucacuuaaugccccaaaaggacuguggagccagaaccaauuggcaaguucuucccccaccccuggcagccuaccacagggucccgcucagcugucgccgggggaaauggaggaaucugaccagggccacacgggagcccucgcuacuugcgccggccacgaggauaaggcaggguguccuccaaggccccauccucccccagccccucccgcucggucccgcccauacgcgugcucaguuuguggaaagagauucagucugaaacaccaaauggaaacccauuauagggugcacacaggugagaagccguuuagcugcucccuuuguccucagcguucucgggacuucagcgcaaugacuaaacaccuucgaacccauggcgccgcucccuacagaugcucauuguguggggccggaugcccaagucucgcauccaugcaggcccacaugaggggccauagccccucucagcugccuccagguuggacaauucgcucaaccuuuuuauauaguagcucccggcccucuagaccuucgacgagcccguguugcccauccucaaguacuacauga

SEQ ID NO: 64976 - RNA, 2019 nt, Artificial Sequence
  derived and/or modified sequence opt3 from ZBTB33__Homo_sapiens__NP_006768
auggagagcagaaagcugaucuccgccaccgacauucaguacucuggcucacuccuuaacagucugaaugaacaaagggggcacggauuguucugcgaugugacagucauaguugaggaccggaaauuucgcgcucauaagaacaucuuaagcgcauccucuacuuauuuccaccagcuguuuucgguggccggucagguaguggaacuaucauucauucgagcggagaucuuugcugaaauucucaauuacaucuauagcaguaaaauaguccgugugagauccgaucugcuugacgagcugaucaagucuggccaguugcucgggguuaaauucauugccgagcugggagugccccugagccaagucaaguccaucucaggcacggcacaggaugguaacaccgaaccucucccaccggacaguggggauaagaauuuagugauucagaaaagcaaggacgaggcccaggauaacggagcuacaaucaugcccauaauuacugaaucuuuuucccugucagcagaggacuacgagaugaaaaagaucauuguaaccgauagcgacgaugacgacgaugacguuaucuucuguagugaaauccuuccuacaaaagagaccuugccaucuaauaacacuguggcccaaguccaguccaaucccggcccuguggcuauuagcgauguggccccaucggcgucuaacaauucacccccucugacaaacauaaccccaacgcagaagcuaccgacucccgucaaucaggcaacccucucccaaacacagggcagugaaaagcugcuuguuagcuccgccccuacucaucugaccccaaacaucauuuugcucaaucagacaccccugucuaccccuccaaacgugagcucaaguuuacccaaccacaugccguccagcaucaaucugcucguacaaaaccagcagacgccuaauucugcuauacuuacugggaacaaagccaaugaggaagaggaggaagagauuaucgacgaugacgaugacacaaucucaaguagccccgauuccgcagugucuaacaccucgcuggucccacaggcugacacuagccaaaauacauccuuugauggaucauugauucagaagaugcagaucccuacccuacugcaggaaccccucaguaacucucugaaaauuagcgacauaaucacgaggaauaccaacgacccaggugugggcuccaagcaucuuauggaggggcagaaaauuaucacacuggauacugccaccgaaaucgagggauugucaacaggcugcaagguuuaugcgaauauuggugaggacacuuacgauauagugauccccgucaaagacgauccugacgaaggggaggcccggcucgaaaacgagauuccaaagaccagcggaucugaaauggcaaauaagcgcaugaaagugaagcacgaugaccacuaugagcugaucguagauggcagaguuuacuacauuuguaucgugugcaaaagguccuaugucuguuuaacaagucugcggcgccauuucaacauacacagcugggagaagaaauacccgugccgauauugugaaaagguguuuccccuagcugaguacagaaccaagcaugaaauccaccacacuggcgagaggcgguaucaaugccucgccugugggaaaucuuucauuaauuaccaguuuauguccucacauaucaagaguguccacagccaggacccuucgggagauuccaaacuguaucgucuucauccaugccgcucuuugcaaauuagacaguacgcuuaccugagcgacaggucaaguacgauccccgccaugaaggaugacgguauaggcuauaaaguggacacagggaaggagccuccaguuggaaccacuaccuccacacagaacaagcccaugaccugggaagauauuuucauccagcaagagaacgacucuauuuucaaacagaaugugacugauggcagcacagaauuugaguucaucauaccggaauccuacuga

SEQ ID NO: 64977 - RNA, 1503 nt, Artificial Sequence
  derived and/or modified sequence opt3 from ZBTB34__Homo_sapiens__NP_001092740
auggacagcuccucuuucauccaguuugaugugcccgaguacucaaguaccguccugagccaacucaacgaacuuagacugcagggcaaguugugcgacauuauaguucacauccaggggcagccuuucagggcccauaaagcuguguuagcagccuccucuccauauuuucgggaucacucggcgcugucaacaaugagcggacuaaguauuuccguaaucaagaauccgaacguguucgagcaacuccugucuuuuuguuacacuggucgcaugagccuucagcugaaagacgucguguccuucuugacggcugccucauuucuccagaugcagugcguuauugauaaguguacccaaauccuggaaaguauacauagcaaaaucucugugggcgacgucgauuccgugacaguaggggcagaggaaaaucccgagucacgaaacggaguuaaggacagcaguuucuuugccaauccuguggagauuucuccacccuauugcucccagggccgucagccuacugcuagcucggaucugagaauggaaaccacaccaucuaaggcacucaggucccgguuacaggaggaaggucacucagaccgcgggaguagcggauccgucucugaguacgagauccaaauugaaggcgaucaugagcagggcgaccugcuugugagagaaagccagaucaccgaggugaaagucaagauggaaaaaucagauaggcccaguuguuccgacucuagcucauugggggacgauggauaucacacugagaugguugacggugagcaagugguagccgugaacgucggcaguuacgggagcgugcugcagcacgcuuauuccuacucucaggccgcgucgcagccuacaaauguuagcgaagcauucggaucccuaucaaacaguucuccaagccgguccaugcucucaugcuuucgcggcggucgagccagacaaaagagggcucugagcgugcaucuucacucugaucugcagggguugguccagggauccgacagugaggccaugaugaauaacccgggcuacgaaagcucuccccgggagcguuccgcacgcggccauugguauccuuacaaugaaagacucauauguauuuauugcgggaaaucauucaaccagaagggaagucuggauaggcacaugcgguuacacauggguaucaccccauuuguguguaaguucugcggcaaaaaguacacgcgaaaagaccaacuggaguaucauauucgcgggcacacugaugacaagcccuucagaugugagaucugcggaaaaugcuuuccuuuccagggcacccucaaucagcaucuuaggaagaaccacccagguguagcugaaguucggagccgcaucgagucgcccgaaagaacagauguguacgucgagcagaaacuggaaaaugacgccuccgcgucugagaugggguuggauagcaggauggagauucauacugugucagacgccccggacuga

SEQ ID NO: 64978 - RNA, 3588 nt, Artificial Sequence
  derived and/or modified sequence opt3 from ZBTB38__Homo_sapiens__NP_001073881
augaccgugaugagccuguccagagaccucaaggaugacuuccacucugauacaguccuuucaauccugaacgagcagaggauucggggcauauugugcgacguuacuaucauuguggaagauacgaaauuuaaggcccauaguaauguauuagcugcaagcucccuguacuucaaaaacaucuuuuggucucacaccauuuguaucucgucacaugugcuagagcucgacgaucugaaggccgaagucuucacagagauacuuaauuauaucuacagcaguacugugguugugaaacgccaagaaaccgucacagaccuggcggcugccgggaagaaguugggaauuuccuuucucgaggaucugaccgaccgaaacuucucuaauagccccgguccuuauguguuuugcaucacugagaaaggcguaguuaaggaagagaaaaacgaaaagcgucacgaggagccagcaauuacaaaugggccgagaaucaccaacgccuucuccauaauugaaacggaaaauucaaacaauauguuuaguccccuggaucucagggcuagcuucaaaaaggugucugacuccaugcggacugcaucauuaugucuggaacgcaccgaugucugccaugaggccgaaccugugagaacacuugcugagcacagcuacgccgugaguucugucgcggaggcauauaggucccagccaguucgggaacacgacggaagcucgcccggcaacacugguaaggagaauugugaagccuuggcugccaaaccuaagaccugccgcaaaccaaagacauuuucuaucccccaggacuccgauucagcaaccgagaacauuccuccaccgcccgugaguaaucuggaaguaaaccaggagcgaagcccucaaccagcugccgugcuaacgagauccaaaucucccaacaaugagggggacguccauuucagcagggaagaugagaaccagucaagugacgugccuggaccacccgcggccgaaguuccgccucucguguacaauuguuccugcuguagcaaggcauuugauucuucaacucugcuuagugcucacaugcagcugcauaaacccacacaggagccauuggucugcaaguauuguaacaagcaauucaccacucucaaucggcuggaccgucacgaacagaucugcaugcgcagcucccacaugccuauccccggcggcaaccagagauucuuagagaauuacccaacaauugggcagaacggagguucuuuuaccggccccgagccucugcucucggaaaauaggauaggggaguucagcuccacgggaucaacccuuccagauacagaccauauggugaaauuuguaaacggccaaaugcuguacaguugcguuguguguaagcggucuuaugucacuuugagcucccuacgacgccacgccaaugugcauucauggagaaggaccuacccgugccacuauuguaacaaagucuucgcucuggccgaauaccggacacgccaugagaucuggcacacuggugagagaagguaucagugcaucuuuugucucgaaaccuucaugacauacuauauucugaagaaucaccagaaaucuuuucaugcaauagaucaccgucuuagcauuuccaagaagaccgccaacgggggacugaaacccaguguguacccuuacaaguuguaucggcuccugccaaugaaaugcaagcgagcucccuacaaaagcuauagaaauucuuccuacgagaacgcgagggaaaacucacaaaugaaugagagugcaccuggcacuuauguugugcagaacccacauagcucggaauuacccacgcugaauuuccaggacacaguaaacacccuaacuaauuccccggccaucccucucgagaccucugcuugucaggauaucccaacaagcgccaacguccaaaaugcagagggcaccaaguggggcgaagaggcccugaagauggaccuugacaacaauuuuuacucaacugaagugaguguuuccucuacagagaacgcugugagcuccgauuugcgcgccggagacguccccgugcugucacucagcaauaguucugaaaacgcagcguccguaauuagcuauucggguucagcuccuucugugaucguucacaguucccaguucagcucugucauuaugcacagcaaugccauagcagccaugacguccucaaaccaucgggcuuuuagugaucccgccgugagccagucucugaaagacgauuccaagccagagccugacaaagugggcagauucgcaucaaggcccaagaguaucaaagagaagaagaaaaccacuagccacacacgcggggaaauuccagaggaauccaauuacgucgcugauccgggaggcucucuuucgaagaccacaaacaucgccgaggaaacuagcaaaaucgagaccuacauugcgaagccugcccugcccgguacgucaaccaacuccaauguugcuccauugugccagauaacagugaaaaucgggaacgaggcaauugugaagcgacauauccucggcaguaaacuguuuuauaagcggggacguagacccaaguaccaaaugcaggaggagccuuuaccacagggcaaugaccccgaaccuucuggggauagcccgcugggacuaugucaguccgagugcauggagaugucagaaguauucgacgaugccucugaccaagauagcacugacaaaccauggaggcccuauuacaacuauaagccuaaaaagaaaagucgccagcucaagaagaugcggaaagucaauuggagaaaggagcacgguaacagguccccaagccauaaauguaaguaccccgcugaacuggacugcgccgugggcaaagcaccucaggauaagccguucgaggaagaggagaccaaggaaaugcccaaacuucagugcgaguugugugacggggauaaggcgguuggagccggcaaucaaggucgaccacaccgccaccugacaucucggccuuaugcuugcgaacucugugccaaacaguuucagucacccuccacucugaagaugcauaugagaugccacaccggggagaaaccauaccaauguaagacgugcgggagguguuucagugugcagggaaacuuacagaagcaugaacguauucaccugggccuuaaagaguuugucugccaguacuguaauaaggcauucacauugaacgagacccucaaaauccaugaacgcauacacacuggggagaagcgguaucacugccaauuuuguuuccagagauuucuguaccuaagcacaaaaaggaaucaugaacagcgacacauccgggagcauaacggaaaggguuaugcuugcuuccagugcccuaaaauuuguaagaccgccgcagcccugggcaugcaccaaaagaaacaccucuuuaagucgcccucucagcaggagaaaaucggggacgugugccaugaaaauuccaacccacuggagaaucagcacuucauuggaagcgaagauaacgaccaaaaggauaacauccagacuggcguugagaaugugguacuuuga

SEQ ID NO: 64979 - RNA, 2730 nt, Artificial Sequence
  derived and/or modified sequence opt3 from ZBTB41__Homo_sapiens__NP_919290
augaagaaaagaaggaaggugaccagcaaccuggagaaaauccaccucggcuaccauaaggacuccucugaagggaaugucgccguugagugcgaucaggugacauauacucacucagcuggacggcccacgccugaagcacuucauuguuaccaagagcugccaccgagucccgaccagcgcaaauuguuaagcucccugcaguauaacaagaaucuacucaaguaccugaacgaugaccgacagaaacaaccuucuuucugcgaucuucugauuauaguagaagguaaggaguuuucggcccacaaaguggucguggcgguuggcucaagcuauuuccaugcuuguuugaguaagaauccauccaccgacguggucacacucgaucacgugacucacucuguauuucagcaucugcuggaguuccucuacaccagcgaauuuuucguuuauaaauacgagauccccuuagugcuggaagccgcaaaguuucuugacauuaucgaugccgucaaguugcugaacaaugagaacguggcuccuuuccacuccgagcuaacagaaaaaucaaguccagaggaaacccucaaugagcugacugggcgucuuagcaacaaucaucagugcaaguuuuguucuagacacuucugcuacaaaaagucccuggaaaaccacuuggcaaaaacacauaggucacuccuguuaggaaagaaacacggccugaagaugcucgagcggagcuuuagugcccgcagaucuaagaggaaucggaaaugucccgugaaguucgacgauaccuccgacgaugagcaggaaagcggugacgggucggacaaccuuaaucaagagaacuuugauaaagaaaagucugaccgcaacgauuccgaggacccuggaucagaauauaaugcugaggaggaugaacuggaggaagagaugagugacgaauacagcgauauugaggagcaguccgaaaaagaccauaacgaugccgaggaggaaccagaggcgggcgacucugucggcaauguucacgaaggguugacgccggugguaauccagaacagcaauaagaagauacuacagugccccaaaugugauaagacuuucgaccgaaucggaaaauaugagucacauaccagagugcacacaggugaaaagccuuucgagugcgacauuugucaccaaagguacaguacuaaauccaaccugaccguccaucggaagaagcacagcaaugaaacagaguuucauaaaaaggagcacaaaugcccauauugcaacaagcuccacgcaucuaaaaagacccuggccaagcaugugaaacguuuccaccccgaaaaugcucaggaguuuaucucaauuaagaaaacgaagagugaaagcuggaaaugugauaucugcaagaaauccuucacucgcagaccucaucuugaggaacacaugauacugcauucucaggacaagccauuuaaguguacauacugcgaggagcacuucaaaucgagguuugcccgguugaagcaccaagaaaaauuccaucucggccccuuuccgugugauauuugcgggcgacaguucaacgacaccggaaaucugaagcgccacaucgaguguacucauggcgguaaaagaaaguggacaugcuuuauuugugggaaguccguuagggaacggaccacguuaaaagagcacuugcgcauccauuccggagaaaagccucaccuaugcucaaucuguggccagaguuucagacacggcucuagcuauaggcuccaucugcgugugcaccaugaugacaaacgguacgagugcgaugagugcgggaagaccuuuauucgacacgaccaccuuacaaaacauaagaagauacacuccggagaaaaagcacaucagugugaggaaugcgguaaguguuucggcagaagggaucacuugacuguccauuacaaaucagugcaccugggggagaagguauggcaaaaauauaaggcuaccuuccaccagugcgacguuuguaagaaaaucuuuaagggaaaaagcucucucgagaugcauuuccgcacacacuccggcgaaaagcccuacaaaugccagauuuguaaccagaguuuucggaucaagaaaacucugaccaagcaucuugugauacacagcgaugccagaccauucaauugccaacacuguaacgcgacauuuaagaggaaagacaagcugaaauaucauauugaucacguccaugagaucaagucuccugacgaccccuuguccaccucagaagagaaacucgugagucugccagucgaauacagcucggaugacaagaucuuccagacugagacgaagcaguauauggaucagcccaaaguguaccaauccgaggccaagacaauguuacagaauguuucugcagaagugugcguaccugucacccuggugccaguucagaugccggacacucccagcgaucuagugcgccacaccacaacccucccuccaucaagucaugagauucugagcccccagccucaaucuacugacuauccacgagcugccgaucuugcuuuucuggaaaaauacacacugacgccccagccggccaacaucguccacccugugcggccagagcagaugcucgacccccgugaacaaagcuaccuggguaccuuacuggggcuugauuccacuacaggcguacagaacauuucaaccaaugagcaccauagcuga

SEQ ID NO: 64980 - RNA, 1770 nt, Artificial Sequence
  derived and/or modified sequence opt3 from ZBTB46__Homo_sapiens__XP_005260254
augaacaauagaaaggaggacauggaaaucaccagccacuacaggcaucugcuccgggagcuuaacgaacagcgccaacacggcgugcugugcgaugucuguguugugguagaggggaaaguguucaaggcccauaaaaaugucuuguuaggauccucucgauauuuuaagacacuguacugccaggugcagaaaacuucagaacaggcuacgguuacccaccuagacauugugacagcacaagguuucaaggccauaaucgauuuuauguauagugcgcaucucgcucugacuagccguaacgucauugaggugauguccgccgcaucuuuccuucagaugaccgacaucguacaggccugucacgauuuuauuaaggcugcacuggacaucucgauaaaaucagaugccagcgacgaguuggcugaguucgagaucggcgccaguuccucuagcuccacagaagcgcucauuucagcaguuauggccgggagaaguaucagccccuggcuggcuaggcggaccucuccugccaauuccucaggagauagcgcaauugcuaguugccacgacggcgguucuuccuacgggaaggaggaucaggagccaaaagccgacggaccggaugacgugagcucgcaaccccuguggccuggcgacgucggcuaugggccacuccgcaucaaggaagaacaggugucucccucccaguacggagguucagaauuaccuagugcgaaagauggcgccgugcagaacagcuuuuccgagcaaucugcaggggacgcuuggcagccaacuggaagaaggaagaaucggaagaacaaagaaacaguccgccauauaacccagcaaguugaggaugacagccgagccucaagucccgugccuuccuuccugccaacgagcggcuggccguuuucuucaagagauaguaaugcugaccuuagcguaacugaggccuccucuucggauagcaggggugaacgggcagaguuguaugcccagguggaagaggggcugcuaggaggcgaggcuuccuaccucgggcccccucugaccccagaaaaggacgaugcgcuucaccaggcaacagccgucgcuaaccugcgugccgcauugaugaguaaaaauucacuccugucuuuaaaggccgacgugcugggcgaugacggaagccuccuuuucgaguaccugccccgcggugcucauuccuugucacuaaacgaauuuacuguuauuaggaaaaaguucaaauguccuuauugcagcuuuucugccaugcaccaguguauccugaagagacacaugcggucccauaccggcgagcgaccauaccccugcgaaauuugugggaagaaauucacacgcagagagcacaugaagaggcauacccucgugcacaguaaagacaagaaauaugucugcaagguguguagccggguauucaugucugcagcguccguuggaauccgccauggcucaagaaggcacggugugugcacggauugcgcugggcguggcauggccggaccgcuggaccacggcgggggagguggcgaagggaguccugaggcacuuuuucccggagauggcccauaccuggaggacccugaagauccccggggugaggccgaagaguugggggaggacgaugaaggccucgcuccagaggacgcccuguuagcagaugacaaggaugaagaggacagcccccgaccuagaucgccaccgggaggccccgauaaagacuucgcuuggcuguccuga

SEQ ID NO: 64981 - RNA, 1140 nt, Artificial Sequence
  derived and/or modified sequence opt3 from ZBTB48__Homo_sapiens__XP_011539612
augagaaagcacaccggcgagaaacccuucgaaugcccuaagugugggaaaugcuacuuuaggaaggagaaccugcucgaacaugaggcccggaauuguaugaaccgcagcgaacagguguucacaugcuccgucugucaagagacuuuucgacguagaauggagcuuaggguucacauggugucucauacgggagaaaugccauauaaaugcucaaguuguagccagcaguucaugcagaagaaggaccugcaaucccacaugaucaaauugcauggugcuccgaagccccacgcaugcccuaccugugccaaaugcuuuuuaucucggacagagcugcagcuacacgaagcguucaagcaucgcggcgagaaacucuuuguaugugaggaaugcgggcacagagcuucgucaaggaauggacugcagaugcauauuaaggccaagcaccggaacgagcgcccacacgugugcgaguucuguagccaugcauuuacucagaaagccaaucuuaacaugcacuugcgaacccauacaggcgaaaagcccuuccaaugccacuugugugguaaaaccuuuagaacucaggcuagucucgauaagcauaauaggacacacaccggggaacggccuuucuccugcgaguuuugugagcagcguuucacggaaaaaggaccacugcugcgccacgucgcaucuagacaucaggagggcaggccccacuucugccaaauauguggcaagacuuuuaaagccguggaacagcuccggguucaugugcgacgccacaagggggucagaaaguucgagugcaccgaauguggauacaaauuuacaaggcaggcucacuuacggcgccauauggagauccacgacagaguggagaacuauaauccuaggcaacguaagcugcggaaccuuauuaucgaagaugagaaaaugguaguuguggccuugcagccaccggcggaacuggaggucgguagcgcagaagugauuguggagucccuagcccagggcgggcucgcuucacagcugcccggacaacgacuuugcgccgaggaaaguuucacuggcccugguguccuggagccaagccugaucauaaccgcagcuguucccgaagacugugauacauga

SEQ ID NO: 64982 - RNA, 2298 nt, Artificial Sequence
  derived and/or modified sequence opt3 from ZBTB49__Homo_sapiens__NP_660334
auggaccccguggccacccacagcugccaucugcuccagcaacuucacgagcagagaauccagggccuguugugugauugcauguuagucguuaaggggguguguuucaaagcucauaagaacguacuggcagccuuuucccaguacuucaggucucuauuucaaaauucaaguagccagaaaaacgacguguuccaccucgaugucaagaauguguccggaauuggucagauacuggacuuuauguauacaucucaucuugaucugaaccaggacaauauccaaguuauguuggauacugcgcagugccuccaggugcagaacguccugucgcugugucacacguuccucaaaucagcuaccgugguacaaccuccaggcaugccgugcaauagcacauuaagucugcaguccacucuuacccccgacgccacauguguuauuucugaaaacuacccuccacacuugcugcaggagugcagcgcagaugcccaacagaauaagacccuagacgaaucccauccccacgcuucaccuagugugaaccggcaucacagcgcaggggagaucucuaagcaggccccagauacuuccgacggaucauguacagaacuccccuuuaaacagccuaauuauuacuauaagcugcgcaacuucuacagcaaacaauaucacaagcaugcugccggcccaagucaggagcgagucguggagcagccguuugcguucucuaccuccacggaucuuacuaccguggaaagccagcccugcgcagucucgcacucugaguguauucuggaauccccugagcauuugccaucaaauuuucucgcccaacccguuaacgacagugcuccucacccagagagcgacgccacaugccagcagcccgugaaacagaugcgucugaagaaggcaauccaucugaaaaaguuaaauuuccucaaaucccaaaaguacgcugaacagguaucugagccgaaaagcgaugacggucuuacuaagagacuggaaucagccaguaaaaacaccuuggagaaggcguccagccagucugccgaagagaaggagucagaagagguggucaguugcgaaaacuuuaauuguauaagcgagacagaaaggccugaggaucccgcagcucuagaggaccagucccaaacccugcagucucagcggcaauacgccugcgaacucugugggaaaccauucaagcacccuucgaaccuggagcuucacaaacgcagccauacgggagaaaagcccuucgagugcaauaucuguggcaaacacuuuucccaggcuggcaaccugcagacucauuugagaaggcacucaggggaaaagccauauauuugcgagaucuguggaaagcgguucgccgcaaguggugaugugcagcgccacauuaucauacauucuggcgagaaaccccaccucugcgacauuugugggcgaggauuuagcaauuucuccaaccugaaggaacauaaaaagacacacaccgccgauaaaguuuuuacuugcgacgaguguggcaagucauucaauaugcaaagaaaguuagugaaacauaggauccggcacacaggugaacguccuuacagcugcucugcuugcgggaaguguuuuggaggcuccggcgaucugcgcagacacgucaggacccauacgggggagaaaccauauaccugcgagauuuguaacaagugcuucacacggagugcggugcuacgacgccacaaaaagaugcauuguaaggcaggagacgaaagcccggauguacucgaggaacugucucaggccaucgagacuuccgaccuugaaaaaucacagaguagcgacucguuuucccaggauaccucuguuacauugaugcccgugagcgucaagcugccugugcacccagucgaaaauucaguggcugaguucgacagucauuccgguggcucuuacugcaaacucagaagcaugauccaaccccacgggguuuccgaucaggagaagcugucacuugacccuggaaaacuggccaagccacagaugcagcaaacucagccccaggcauaugccuacagcgauguggacaccccggcuggcggugagccuuugcaagccgaugggauggcaaugauuaggaguucucucgcggcucuggacaaccacggcggagauccauuaggcucccgggccagcucgacaaccuaucgcaauucagaagggcaguuuuucucuaguaugacucuguggggacuagcaaugaaaacgcuccagaacgagaaugaacuggaccaguga

SEQ ID NO: 64983 - RNA, 3042 nt, Artificial Sequence
  derived and/or modified sequence opt3 from ZBTB4__Homo_sapiens__NP_065950
augcccccuccagccgaggugaccgacccgagccacgcucccgcaguccugagacagcucaacgaacaaaggcuucggggccuguucugcgauguuacauugaucgccggggacacuaaguuuccugcgcaucgcuccguguuagcugccucuucaccauucuuucgagaggcacugcuaacgagugcgccccucccucugccacccgcuaccggaggugcagccccuaauccagcuacaacuaccgccgcgagcuccucuucgucaagcaguuccucuagcuccucaaguucuucuuccgcaucaagcaguucuuccagcucgucuuccucaccgcccccugccaguccacccgcuagcuccccuccacguguacuugaacugcccggcgugccggccgcagcuuucucugaugucuugaacuuuauuuacagcgccagacucgcgcugccugggggaggcggugacggggccgcaguggcugagauaggagcccugggcaggcggcucggcaucucacgcuuacaggggcugggagaagguggcgaugcuuggguucccccaaccccugcccccauggcaacaagucagccagaggaggacuccuucgggcccggaccuagaccagccggcgaaugggagggugauagggcugaagcgcaggcaccggaccuucaauguagcuugccccggcgcccucugccaugcccccagugugggaaaucuuuuauucacccuaagcgacuacagacucaugaggcccagugcagaaggggagcuucaacacggggcaguaccggccucggggccggaggugcaggcccagggggacccgccggcguggaugcuagcgcccugccgccuccagucgguuuccgugggggccccgagcacgugguaaaaguugugggaggccauguccuuuaugugugugcagcgugcgaacgcuccuacgugacgcugucuucguugaagagacacagcaauguccacuccuggaggcggaaauauccuugucgauacugcgagaagguuuuugcucucgccgaauaucgcacuaagcaugagguguggcacaccggggaaagaagguaccaauguaucuucugcugggagacauuuguaacuuauuacaaccugaaaacccaucagcgggcauuccacggaauuucacccgguuuacuggccagugagaagacaccaaauggcggguacaaaccuaagcucaacacccuuaaacuguaucgcuugcuacccaugagagcugccaagaggccauacaagacguauucucagggagcaccggaagcuccucugagccccacucucaauacaccagcccccguggcgaugccugccuccccacccccuggcccgccacccgcuccugagccaggucccccuccgucagucaucaccuuugcacaccccgccccaagcgugauaguucaugggggcagcuccaguggaggcgggggaagcgguacugcuucuacaggcgggucccaggccgcaucagugaucaccuacacggcgccuccccguccaccuaaaaagcgggaauaucccccaccgccucccgagccagccgcuacccccacaaguccugccacugcagucagcccagcuaccgccgcaggacccgccauggcuacaacuaccgaagaggcgaaaggccgaaacccuagagccgguaggacacugaccuacacugcaaagccgguagggggcauuggaggcgggggaggcccacccacgggugcugggcgcggaccuucgcaacuucaggcucccccaccucugugucagaucacagugcggauuggcgaggaagccaucguuaaaagaaggauauccgagaccgacuugcgccccggugaacucucuggcgaggaaauggaggagagcgaagaggaugaagaggaggaagacgaggaagaggaagaggaggaugaagaggaaucaaaggcugggggagaggaccaacuguggcgaccauauuacaguuacaaaccuaagcggaaggcaggcgccgccgggggagcuuccgugggcgguucuggguuaccgcguggaagaaggcccccacgcuggcggcagaaacuggaaagaaggagcugggaggagacuccugccgcagaaucccccgccggccgagcucgcaccgagcggagacacaggugcggugacugcgcacagacauucaccacucuacguaagcuccgcaaacaucaggaagcccacggcgggggaucacauagcagucgggcgggcagaaggccaucuacacgauucacguguccucacugcgcuaaggucuguaaaaccgccgcagcccugucccggcacgggcaacgccaugcugccgagagacccggaggcacuccgacaccagugauugcauauagcaaggguucggcugggaccaggccuggagaugucaaggaagaggcgccccaggagaugcaagugucaucuaguuccggcgaagccgguggcgggagcacagccgcagaggaagccucugagacugccagccuucaggacccaaucauuuccggaggcgaggaacccccuguuguggcuucagggggaaguuacguauauccgcccguccaggaguuuccauuggcacugaucggcggugggcgggaaccuggaggcggccgagggaaaagcggaucugagggucccgugggcgccggggaaggagauagaauggagggcaucggugccgcuaagguuaccuucuacccugagccauauccccucguguacgggccucagcugcuugcggcauauccauacaauuuuuccaaccuggccgcuuugcccgucgcccucaauauggugcugccggacgaaaaaggagcaggcgccuuaccuuuccugccaggcguauuuggguacgcugugaacccccaggcggccccuccagcacccccgacgccucccccaccuacccuacccccacccauuccuccaaagggagagggugaacgcgcuggcguugagaggacacagaaaggggaugucggauga

SEQ ID NO: 64984 - RNA, 2034 nt, Artificial Sequence
  derived and/or modified sequence opt3 from ZBTB5__Homo_sapiens__NP_055687
auggacuuccccggccacuuugagcagaucuuccaacagcugaacuaccagagacuccaugggcagcuuugcgauugugugauugucguuggaaauaggcacuuuaaggcccaucggagcgugcuggcugcaugcuccacccacuuccgcgccuuguuuucuguagcggaaggugaccaaacaaugaacaugauacaguuagauucagagguggucacugcugaagccuucgcagcccugaucgacaugauguauacgaguacccuaaugcucggcgagagcaaugugauggauguucugcuugcugcaucccaucugcacuugaacucuguggucaaagccuguaagcacuaccucacaacucgaacccugccuaugucgccaccgucagaacgugugcaggagcagagcgcuagaaugcaaaggaguuuuaugcugcagcagcucggguuauccauuguaucuagcgcccuuaauuccucacagaacggagaggaacaacccgcgccuaugaguagcucuaugcgguccaaucuggaccagcgcacaccauuccccaugagaagguugcauaaacggaagcagucagcagaggaacgcgcccgacaaagacugaggccuagcaucgaugagagugcuauuucugacguuaccccagagaacggccccuccggugugcacagccgggaagaguuuuucucgccugauucucuaaaaaucgucgacaauccaaaggccgaugggaugacugacaaccaggaagauuccgcaauaauguuugaccagucauucggaacacaggaggacgcucaagugccgagucagagcgauaauuccgccggcaacauggcgcagcucucuauggccagccgugcaacccagguggaaacgucauuugaccaagaggcugcccccgagaagaguuccuuccagugcgaaaauccugaggucggccugggggaaaaagagcauaugcgcguugugguaaagagcgaaccacuuucuucacccgagccucaggaugaggugagugacgucacuagccaggcugaaggauccgagucuguggaaguugaggguguggucgugucggccgagaaaaucgaucugagcccagaauccucagacagaaguuucucugauccccaaagcuccaccgacaggguaggcgauauucacaucuuggagguuacaaacaaucucgaacacaagucaacuuuuagcauuucuaacuuccugaacaaaucccgggggaauaacuuuaccgcaaaucagaacaaugacgauaacaucccgaauacaaccagugacugucgauuagagagcgaagccccuuaucugcucucucccgaggcuggaccagcgggcgguccuuccucagcacccgggagucauguggagaacccauucagcgaacccgccgacucgcacuuuguccgcccuaugcaggaggugaugggacuuccaugcguccagacguccggcuaccaaggcggggaacaguucggaauggauuuuucuagaagcggucugggcuugcauucaaguuucuccagggugaugauagggucuccgcggggaggcgcuagcaauuuucccuauuaccgcagaauugccccuaagaugccaguugugacuuccguaaggucaagccagauccccgagaacaguacaucuucccaacuaaugaugaauggugcaaccagcucguucgaaaacgggcacccuucacagccaggacccccgcagcugacucgugccucugcugacguccucaguaaguguaaaaaggcccuguccgagcauaaugugcuuguuguggagggcgcacggaaauaugcgugcaagauuuguugcaaaacauuucugaccuugacggauuguaagaaacacauccgaguccacaccggcgaaaagccuuacgcuugccucaagugcgggaaaagauucagccagucuagccaucuguacaagcacuccaaaacaacuuguuuaagguggcaaucaaguaaccugccaagcacccuacucuga

SEQ ID NO: 64985 - RNA, 1860 nt, Artificial Sequence
  derived and/or modified sequence opt3 from ZBTB7C__Homo_sapiens__NP_001034449
auggccaacgacaucgaugagcugauuggcauacccuucccuaaucacagcuccgaagugcucugcucucuuaacgagcagagacaugacgggcuguugugugaugucuuacugguugugcaagaacaggaguacaggacccaccggucaguacuagcugcaugcaguaaguauuuuaaaaagcuguucacagccggaacucucgcgagccagccauacguguaugaaaucgacuuuguccagccggaggcucuugccgcaauucuggaguucgccuacacguccaccuugacaaucacugcugguaaugugaaacauauucucaacgcagcccgcaugcuggaaauccaauguauaguuaaugugugccuggagaucauggaacccggcggggauggaggcgaggaggacgauaaggaagacgaugacgaugacgaggaugacgacgaugaagaggacgaagaggaggaagaggaagaggaagaggaugacgaugacgauaccgaggacuuugcugaucaggaaaaccucccugacccacaggauauuucuugucaccagucgcccucaaaaacagaccauuuaaccgagaaggccuauagcgacacuccucgagauuucccagacaguuuucaagcggguucccccgggcaccugggagucauccgugauuucucuauugaaagccuuuugagagagaaucuguacccuaaggcaaacaucccagacaggcggccgucccuaucacccuuugccccugauuucuuuccacaccucuggcccggcgacuucggcgcuuuugcccagcugccugaacagccaauggauagugggccccuugaccuggugauuaaaaaucgcaagauaaaagaggaggaaaaggaggaauugccgccucccccaccucccccauuccccaacgauuucuuuaaagacauguucccugaucucccaggagguccgcugggccccaucaaggcagagaaugacuauggggcuuacuuaaacuuucugagcgccacacaucucggaggccuuuucccuccauggccccugguagaggaaagaaaguugaaaccuaaggcgucucagcaaugcccaauuugucacaaaguuaucaugggugccgggaagcuacccaggcauaugcggacccacacgggagagaaaccguacaugugcacuaucugugaagugcgcuuuacccgacaggauaagcugaaaauucacaugagaaagcauacaggcgagaggccuuaucucugcauacacuguaaugcaaaguucguccauaacuacgaccugaaaaaucacaugcggauccauacuggcgugcguccauaucagugcgaauuuugcuacaaguccuucacccgcucagaccaccuucacagacauauuaaaaggcaaagcugucggauggcucgaccccgcagagggaggaagccugccgcuuggcgggccgcaagucuguuguuuggacccgguggcccagccccugauaaagcugcguucgugaugcccccagcacucggggaggucggaggccaccuggguggggccgcuguuugcuuaccgggcccuucucccgccaagcauuuucuggcagccccaaagggagcucuaucccuccaggagcuggaacgccaguucgaggaaacacagaugaaacuuuuuggcagagcccaauuggaggcagaaaggaacgcugggggacugcucgcguucgcccuggcagagaacguggccgcugcccgucccuauuucccucuuccagaccccugggcagcuggucuggccggcuugccugggcucgcgggacugaaucacguagccagcaugucggaggcuaacaauuga

SEQ ID NO: 64986 - RNA, 1422 nt, Artificial Sequence
  derived and/or modified sequence opt3 from ZBTB9__Homo_sapiens__NP_689948
auggagacccccacaccucugccaccggugcccgccagcccuacuugcaacccagcucccagaacgauccagauugaguucccucaacacuccucuucacuccuugaaagucugaauaggcaucgguuggaaggcaaguuuugugacgucagcuuacugguucaggggcgcgagcuacgagcacacaaagccgugcucgcggcugccuccccauacuuccaugauaagcugcuucugggagacgcaccccguuugacccucccuucuguaauagaagccgaugcuuuugagggucugcugcagcucaucuauucgggcagauuaaggcugccacuugacgcauugccggcccaucugcuaguggcuucagggcuccagauguggcaagucguggaucagugcagcgagauucugcgggaacuugagacaaguggaggcgguaucuccgcccgcgggggaaacucuuaccacgcgcuguugagcacuaccuccucaacaggcggcugguguauuagaaguagccccuuccagaccccuguucagucuuccgcaucaacugaaagcccagccaguacagagucucccgucgggggagaggguuccgaacucggcgaggugcugcaaauccagguggaagaggaagaggaggaagaggaagacgaugacgaugaggaccaggggagcgcuaccuuaucgcagacgccucaaccacagaggguaucuggaguuuuuccccggccgcacggcccucacccccugccaaugacugccaccccucgcaaacuccccgaaggugaguccgcaccacuugagcugcccgcuccuccagccuugccgcccaagauauucuauaucaaacaggaaccuuuugagccaaaggaagagauuucagggaguggaacacaacccggcggcgcgaaggaagagacuaaaguguucagcgggggagauaccgaggguaauggcgaacuaggguuucugcucccuuccggaccaggccccacaucuggugggggcggaccgagcuggaagccugucgaccugcauggcaacgagauccuuucagggggagguggcccagggggagccggccaggcagugcacggucccgugaaacugggcgggaccccucccgcugauggaaagcgauucggcugcuugugugggaaaagauuugccgucaagccaaagagggaccggcauauuaugcucacguucagucugcguccuuuuggaugcgguaucuguaauaaacgcuucaaguuaaaacaccaccugacugaacauaugaagacacacgcuggcgcccuacaugcaugcccccacugugggagaagguuccggguucaugccugcuuucuccgacaccgcgaccuguguaaaggacagggcugggcuaccgcgcacuggacuuacaaguga

SEQ ID NO: 64987 - RNA, 669 nt, Artificial Sequence
  derived and/or modified sequence opt3 from ZC2HC1B__Homo_sapiens__NP_001013645
auggccggcgcugagcccuuccuggcagacgggaaccaggaacucuuuccuugcgagguguguggaagaagguucgccgcggauguccuugaacggcacgguccaaucugcaagaaacuguuuaaucgcaagcgaaaaccguucagcuccuugaagcaacguuuacagggcaccgacauucccacaguuaaaaagacuccucagucuaagucaccacccgugagaaaaaguaacuggaggcagcaacaugaggauuuuauaaaugcuauccggagcgccaagcaguguaugcuggcaauuaaagaagggcgcccucuaccacccccuccaccgcccucccucaacccugacuacauccagagaccauauugcaugaggcgguucaaugagucugccgcugagcgccacacgaacuuuuguaaggaucagucgucacgaagaguauucaaucccgcacaaaccgccgcuaaacuggccagcagggcgcagggacgggcacagaugggcccuaagaaggaaccaacagugaccagugccgucggugcccuucugcagaaccguguguugguugcuacuaaugaggugcccacaaaauccgggcucgcaauggacccggcuucuggagccaagcugcgccaaggcuuuagcaaauccucaaagaaagauuga

SEQ ID NO: 64988 - RNA, 1305 nt, Artificial Sequence
  derived and/or modified sequence opt3 from ZC3H10__Homo_sapiens__NP_116175
augcccgacagagauagcuacgccaacggcaccggguccucuggagguggcccugggggaggcgguucagaggaagcuaguggggcaggagugggcagcggcggggccuccucugacgcgaucugcagggauuuccugcggaaugucuguaagcgcggaaaacgaugccguuauagacacccagacaugucggagguuucaaaccucggugugagcaagaaugaauuuauuuucugucaugauuuucagaacaaagagugcaguaggccgaauugucgguucauacacggcuccaaggaagacgaggauggguacaaaaagacaggagagcuucccccucgccugagacaaaagguagcugccggcuuggguuuaucuccagcagaccugcccaacgggaaagaagaggugccuaucugcagggauuuucuaaagggagacugucagcggggcgccaaaugcaaguuccgccaucuccagcgagauuuugaguucgacgcuagaggcgggggagguacuggcgggggaagcacgggcuccguccugccagguaggcggcacgaucuuuaugacauuuacgaccugcccgaucguggguuugaagaccaugagccuggcccaaaacgcagaaggggaggcuguugcccgcccgaugggccucacuucgaaucauaugaguacaguuuggcaccaccccggggaguggaaugucgacuccuggaggaagagaaugccaugcugcgcaagagaguugaggaacucaagaaacaggugagcaacuuacuggcuaccaaugagguccuuuuggaacaaaacgcccaguuuaggaaucaggcgaaggugaucacacugucuuccacugccccugcaaccgagcagacacuagcuccaaccguagguacuguugccacauucaaccacggcauugcacaaacccauacgacucucucaagccaggcucugcagccccggccggugagucagcaagaacuugucgccccugcgggggcccccgcagcuccaccuaccaaugccgcucccccagccgcacccccuccaccgcccccucaccugacaccagagaucacucccuugucugccgcucucgcgcagaccauagcacagggaauggccccuccacccguguccauggcuccgguggccgucagcguugcaccuguggccccaguagcugugucgauggcccaaccccuggcaggcaucacaaugucucauaccacgacuccuauggucacauaucccauugcgucccagucaaugcgcaucaccgcuaugccacacuga

SEQ ID NO: 64989 - RNA, 2433 nt, Artificial Sequence
  derived and/or modified sequence opt3 from ZC3H11A__Homo_sapiens__NP_055642
augcccaaccagggcgaggacugcuacuucuuuuucuauagcaccuguacaaagggggauuccugcccuuuuagacacugugaagccgcuaucggaaaugagacugugugcacgcuguggcaagaagguagguguuuccggcaggucugccgcuuucgacauauggagauugacaaaaagcguucugaaauaccauguuacugggagaaccagccgaccggcugccagaaacucaauugugcauuccaccauaacagagggagguauguugauggacuuuuucugcccccuucaaagacaguguugccaacuguacccgagaguccugaagaggaagugaaagccagccaauuauccguccagcagaauaagcugucugugcagucgaacccaucaccccaacuacggagcguuaugaagguggagaguuccgagaaugucccuucuccaacccacccgcccgugguaaucaacgcggcugacgaugacgaagaugacgaugaccaguucagcgaggaaggcgaugagacaaaaaccccuacucuccagccaacacccgaaguucauaauggucugcgcgugaccuccgucagaaagccugccgugaacauuaaacagggggagugccuuaauuuuggaaucaagacgcuggaggaaauuaaaucaaagaagaugaaagagaagaguaaaaagcaaggcgaaggcagcucugggguguccucauugcuccugcacccagagcccgucccgggaccugaaaaagagaacguuaggacugugguacggaccgugacacugagcacuaagcagggugaggaaccccucguccgcuuaagucugaccgagcgacuuggcaaaagaaaguucucugcagggggagacuccgauccaccuuugaagaggagccuggcccagcggcuaggcaaaaagguggaagcucccgagacaaauaucgacaaaaccccaaagaaagcacaaguuucgaagucucucaaggaacgucuggguauguccgccgaccccgauaacgaggacgcuacggauaaagugaauaaggucggggagauacacgugaaaacucuugaagagauccuguuggaacgcgccucacagaagagaggagagcuccagacaaaacugaagaccgagggcccuaguaagacugacgauagcacauccggcgcgaggucuagcucaaccauucggaucaaaacguuuagugaaguauuagcagagaagaaacaucgacagcaagaagccgagcgccagaaguccaaaaaggacaccacauguauuaagcugaaaaucgauagcgaaauaaagaaaacuguugugcucccaccgauugucgcuucuagagggcagucagaggagcccgccggaaagaccaaaaguaugcaggaagugcacaucaagacacuugaggaaauuaaacuggagaaggcauugaggguccaacagagcuccgaaucuucgacuagcuccccuucacagcaugaggcuaccccaggugcccggcgccuacugagaaucacaaagaggaccggcaugaaagaggaaaagaaccuccaggaggggaacgaaguggacagucaaucuagcauccguacugaggcgaaagaagccuccggagagacgacaggcguugauauuaccaagauacaggugaaacggugcgagacuaugcgagaaaagcacaugcagaagcagcaagagagagaaaaaucaguacugacaccccuuaggggugacgucgcaagcugcaauacccagguggcugagaagccuguucugaccgccgugccagggaucacucgccacuugacaaaacggcuccccacgaagucuucccagaaagucgagguggaaaccaguggcauuggagauagccuguuaaacguaaagugugcugcccaaacucuggagaagagaggcaaagcaaagccgaaagugaauguuaagccuucugucgugaaaguggucuccucaccaaagcuagcccccaagaggaaagcuguugaaaugcaugcggcagugaucgccgcugugaagccucucaguagcucguccguacugcaggagcccccagccaaaaaggcagccgucgcugugguuccucuugugucugaagacaaaagcgucacagugcccgaggccgagaacccacgcgacucauugguucugccgccuacccagaguuccucugauagcucacccccagaaguguccgggcccagcaguucucagauguccaugaagacacgacggcucagcucggcaucaacuggaaaaccuccacugucuguagaggacgauuucgaaaaacuuauaugggagauuagugguggcaagcuggaagcggagaucgacuuggaucccgggaaggacgaggaugaccuccuguuagaacuguccgagaugaucgauagcuga

SEQ ID NO: 64990 - RNA, 2652 nt, Artificial Sequence
  derived and/or modified sequence opt3 from ZC3H12C__Homo_sapiens__NP_203748
augcccggcgggggaagccaggaauacggugugcugugcauccaagaauauagaaagaacuccaaagucgagucuucaaccaggaauaacuucaugggccucaaggaccaccuugggcaugaucugggacacuuguacguugaaaguacagacccucaguuaagcccagccgugccgugguccacuguagagaaucccucuauggauacggugaacgucggcaaagacgaaaaggaggcuucggaggaaaaugcaucaagcggugauagugaggaaaacaccaauuccgaccaugagucugagcagcuggggagcauuuccguggaaccuggacuaauaacaaaaacucaccggcagcucugucgcucaccaugccuggagccccauauccuuaagcgaaacgaaauucugcaagauuuuaagccugaggaaagucagaccacaagcaaagaggccaagaaaccacccgacguugugcgugaguaucagaccaaguuggaguucgcgcucaaacugggcuacucugaagaacagguccaacuggugcucaauaaguuaggcacugaugcucugaucaacgacauucuuggggaguugguaaagcugggaaauaaauccgaagccgaucagacaguuucaaccaucaacacgauaacuagagagaccagcagucuagagucucagagguccgaaagcccuaugcaggagaucgugacagacgauggugaaaaucuccggccaauugucaucgacggcucgaacguggcaaugucucacgggaauaaggagguguuuuccugucgcggaauuaaacuggccgucgacugguuccuugaaagaggccacaaggauaucacuguuuuugugccggcuuggaggaaagagcaaucacggcccgacgcacugauaaccgaucaggagauuuugcgcaagcucgaaaaagagaagauccugguauucacaccuagucgaagagugcaggguaggcgggucgugugcuaugacgaucguuuuauuguuaaguuagccuucgaaagcgacgggaucaucguguccaacgauaacuaccgcgaccuggcuaaugagaaaccagaguggaagaaauuuauugaugaaagacuccuuauguauucuuucgucaacgacaaguuuaugcccccugaugacccacugggaaggcauggccccagcuuggacaauuuccuacggaaaaagccgauagugccugagcacaagaaacaacccuguccauacggcaagaaaugcaccuacgggcauaaguguaaauauuaccacccugaacgaggaucacagccccagcgcaguguagccgaugagcugagagcgauguccaggaacacggcagccaagacugcuaaugaagguggccucguuaagagcaacucugugccaugcucaacaaaagccgacaguaccagcgaugucaagagaggggcacccaaacgccaguccgacccuucuaucagaacucaaguguaucaggaucuggaggagaaacuuccaacaaagaauaagcuggaaaccaggucggucccgagcuugguguccauucccgcuacgucaaccgccaagccucagaguacaacuucucucagcaacggacugccauccggcguucacuuucccccucaggaccaacguccacagggucaguaccccucaaugaugauggcgaccaaaaaucaugggacaccgaugccuuaugagcaguacccaaagugugauagccccguggacaucggcuauuacucuauguuaaacgccuacuccaaucugagucuaagcggaccucggucucccgaacgaagauucucccucgauacugacuauaggauaucaaguguagcaagcgauugcucguccgagggcucuaugagcugugggucaagugacuccuacgucggauauaacgaucgcucuuacgugagcuccccagacccucaacuggaagagaaucuuaaaugccagcacaugcauccccacucacgguugaacccacagccguuccugcagaauuuucaugacccucucaccagaggucaaagcuauagucacgaggaacccaaguuccaccauaaaccaccccugccucaccuugcucugcauuugccacacucugccguuggcgcuagguccagcugccccggggauuacccuucgccgccaucaucugcccacaguaaggcaccccaucucggacgcucccugguggccacacgaauugacagcaucucugauagccgguuauaugacuccucaccuagucgucagagaaaaccauacagcaggcaggagggccuggguucuugggaacgccccggguacggcaucgaugcuuauggauaccggcaaaccuauucccuaccugacaacucaacucagccguguuacgagcaguuuacguuccagagucuccccgaacaacaggagccagcguggcggauuccuuauugcggcaugccccaggauccaccuagguaccaggacaaccgagagaagaucuauauuaaucuguguaacauauuucccccagaucuuguccgcaucgugaugaagcggaauccgcacaugacagacgcacaacaguuggccgcugccauucugguagagaaaagccagcucggguacuga

SEQ ID NO: 64991 - RNA, 1584 nt, Artificial Sequence
  derived and/or modified sequence opt3 from ZC3H12D__Homo_sapiens__NP_997243
auggagcaccccagcaagauggaguucuuucagaaacugggcuacgacagagaagaugugcucaggguccuugggaagcugggagaaggugccuugguuaacgacguguuacaagagcugauccggaccggcucccgcccuggggcucuagaacauccagcagccccgcgacucguaccccguggaucuugcggcgugccugauucagcgcagagagguccagggacagcucuggaggaggacuucaggacucuugccaguagccugcggcccauugucauagauggauccaauguggcaaugucucacggcaacaaagaaacguuuucgugucgcggcaucaaguuggccguugacugguucagagauagggggcauaccuauauuaaaguguuugucccuucauggcggaaggacccaccccgcgcugauacaccuauccgagagcagcacgugcucgcagaacuggagagacaggccguacugguuuacacuccaagcaggaaggugcauggaaaacggcucgucugcuaugacgaucguuacauugugaagguggcuuaugagcaagacggugucaucguuaguaaugauaacuaccgcgacuuacaguccgaaaauccggaguggaaaugguucauagaacagagacugcuuauguuuucuuucgugaacgacagguuuaugcccccugaugacccauugggccggcacgggcccagccuguccaauuuccuaucacgaaagccuaaaccacccgagccgaguuggcagcacuguccuuauggaaagaagugcaccuacggcaucaaauguaaguuuuaccaucccgaacgcccacaccaugcccaacucgcgguagcagaugagcugagagccaaaacaggugcuaggccuggggccggagcagaggaacagcggcccccacgcgcucccggcggcagcgccggggcgagagccgcaccuagggagccauucgcucacucucuuccgcccgcccguggauccccugaccuggcugccuugcgggguucauuuagccgacucgcauucagugaugaccugggcccauuagggcccccucugccagugcccgccugcucucucaccccgagacuuggaggcccugauugggucuccgcuggugggagggugccaggcccccugagcuugccuucgcccgaaucucaguucuccccaggagaccuaccucccccaccgggccugcagcuccaaccucgcggggagcaccggcccagagaucugcauggagaccuucugucaccaaggcgcccucccgaugacccaugggcgcgacccccucggagugaccguuuuccggguagaagcguuugggcagaaccagccuggggcgauggggcuacuggaggcuuguccguguaugccacagaggacgaugagggugacgcaagggcccgcgcucggauugcccucuacucugucuuccccagagaucagguggacaggguaauggcagcguuuccugaacugagcgauuuagcucgacugauccuacucguucagcgcugucaaucagccggggcaccacugggcaagcccuga

SEQ ID NO: 64992 - RNA, 2208 nt, Artificial Sequence
  derived and/or modified sequence opt3 from ZC3H14__Homo_sapiens__NP_001153575
auggagaucggcaccgaaauuagcagaaagauaagguccgccaucaaagggaagcugcaggagcucggagcuuacguggacgaagaacuucccgauuauauuauggucaugguugcaaacaaaaagucucaagaccagaugacagaagaucugucauuguucuuagguaauaacacuauccgguuuacgguguggcugcacggcguacuagacaaacuccgcagugugaccacagagccuagcucccugaagucuucggauacuaauauuuucgacucaaacgucccaagcaauaagaguaacuuuucccgaggggaugagcguagacaugaagccgcggugccgccccuugcuaucccuucugccaggccagagaaacgggacagccgcguuuccaccucaagucaggaaagcaagacaaccaaugugagacagacuuacgaugacggagcagccacaaggcugaugucuaccgucaaacccuugcgggagccugcuccauccgaggaugugauagacaucaagcccgaaccugaugaccucauugacgaggaucugaacuucguacaagaaaauccacugucacagaaaaagccgacgguuacucucaccuauggcagcagucgccccucuaucgagauuuaccgaccuccagcauccagaaacgccgacagcggugugcacuuaaauaggcugcaguuucagcaacagcagaacucgauccaugcugccaagcagcuugauaugcaaucuuccugggucuaugaaacagggcgguugugcgagcccgaggugcuaaauucacuggaagagacuuacaguccuuucuuucguaacaauagcgagaaaauguccauggaggacgaaaacuuccgcaagagaaaacucccaguggucucuagcguugugaaggugaaaaaguuuaaccacgauggagaggaggaagaggaagacgaugacuauggcucaaggaccggcaguauauccagcucuguaucaguccccgcgaaaccggagcggcgaccuagucugcccccaagcaagcaggcaaauaagaaccuuauucugaaagccaucuccgaagcucaggagucugugacaaagaccacgaauuacucgacuguuccucaaaaacagacauugcccguggccccacgcaccagaacuagccaggaggaacuccuggcagaggucgugcaggggcaauccaggacaccccggauuucaccuccaaucaaggaagaggagaccaaaggagauaguguagaaaagaaccaggguacgcagcagcgccaauuacugucuagacuccagaucgacccgguuauggcugagacccuucagaugagccaggauuacuaugacauggaauccauggugcaugccgacacaaggucauucauucugaagaaacccaaguugagcgaggaagucguggucgcgccuaaucaagagucuggcaugaaaacugccgauucccuacgugugcugagugggcaccucaugcagacccgggaccugguucagccagauaagcccgcaagcccuaaauuuauagugacacuugacggaguaccaucucccccgggcuacauguccgaucaggaggaagacauguguuucgaggguaugaagccugucaaccaaacugcugccucaaauaaggggcugcgaggauugcuccacccacagcagcugcauuuacugaguagacaacuagaagaucccaacggcagcuuuucgaaugcugagauguccgaacucucuguggcccagaaaccugagaagcugcuugagaggugcaaauauuggcccgcauguaagaacggcgacgaaugcgccuaccaccauccaaucagcccuuguaaggcuuuccccaauugcaaauucgcggagaaguguuuguuuguucacccaaacugcaaauaugaugcaaaguguaccaaaccggacugcccuuucacacacgugucacgccggauucccguccugaguccaaagcccguggccccuccagcucccccuuccucuagccagcucuguagauacuuuccggccugcaaaaagauggaaugcccauucuaucaucccaaacacuguagguuuaauacccagugcacucgcccugauuguacguucuaccauccaacaaucaacguacccccucgacacgcacugaaguggauacggccgcaaaccuccgaguga

SEQ ID NO: 64993 - RNA, 1281 nt, Artificial Sequence
  derived and/or modified sequence opt3 from ZC3H15__Homo_sapiens__NP_060941
augcccccuaagaaacaggcccaagcuggcgggagcaagaaagcagagcagaagaaaaaggaaaagaucauugaggacaaaaccuucggacugaagaacaaaaagggugccaaacagcagaaguuuauaaaggcggugacacaccaagucaaauucggccagcagaauccaagacagguugcucaauccgaagccgagaagaaacucaagaaagaugacaagaaaaaggaacuucaggagcugaacgaguuguuuaagccggugguagcagcccagaaaaucucuaagggggcugaucccaaaucaguggucugcgcauucuuuaagcagggacaauguacuaaaggcgacaagugcaaguucagucaugauuuaacgcuggaaaggaaaugugagaagcggagcguguacauugacgcccgcgaugaagaacuagagaaagacaccauggauaauugggacgaaaagaaacucgaggaaguugugaacaagaagcacggugaggcugagaaaaagaaaccuaagacacagaucgucugcaaacauuuucuggaggccauugagaauaacaaguaugggugguucuggguguguccaggaggcggcgauaucugcauguaccgacacgcgcuucccccuggguuuguacugaagaaagacaagaaaaaggaagagaaagaagaugagauauccuuggaagaccucaucgagcgugagagaucugcacugggaccaaauguuacuaagauuacccuggaaucguuccucgccuggaaaaagaggaagcggcaggagaaaaucgacaaguuagaacaagauauggagcgcagaaaagcugacuuuaaggccgguaaagcacuggugauuucaggcagggaagucuucgaguuucggcccgagcuugugaacgaugacgaugaagaggcugacgauacacgcuauacccaggggacuggaggcgacgaaguggaugacagcgucaguguuaaugauaucgacuugucccuguacauaccucgagacguggaugagacagguauuaccguagccucucuagagagauucagcacguauacuuccgacaaggaugaaaacaagcucucagaggcgagugggggaagggccgaaaauggcgagcggagcgaccuggaagaggauaacgagcgugaaggcaccgagaauggggcaaucgacgcugugccagucgaugaaaaccuuuucacaggagaggaccuggaugaauuggaggaggaacucaauacucuggacuuagaggaauga

SEQ ID NO: 64994 - RNA, 2847 nt, Artificial Sequence
  derived and/or modified sequence opt3 from ZC3H3__Homo_sapiens__NP_055932
auggaggaaaaggagauccugagaaggcagauucggcuccuucaaggccugauagacgauuacaaaaccuugcacgggaacgcccccgcuccuggaacaccagcagccagcgguuggcagccgcccacuuaucauuccggccgcgcguucucugcucgauacccucguccaucaagaaggggguauaguagccaccauggacccuccuggcggaagaaauacucuuuagugaaucgcccuccaggccccucggacccuccagccgaucacgcagucagaccgcugcauggugccaggggagggcagcccccuguuccacagcaacacgugcuagaacggcagguacagcucucacagggccaaaacguggucaucaaggugaaacccccuagcaagaguggcuccgcuucugcaagcggggcccagcgcggaucccuggaggaauuugaggagacgccauggucagaccagcgacccagagaaggugagggcgaaccgccuagggggcagcuucaacccagucggccaacccgugcucgcggaacaugcagcguugaggauccucuguuggugugucagaaggagcccggcaaaccaagaauggucaagucuguggguuccguaggggacucacccagggaaccucggcgaacuguuagcgagagugugauugccgucaaagcgucuuucccauccagcgcacucccgccccgcaccggaguggcccugggcagaaagcugggcucgcacucuguggcuuccugcgccccucagcucuuaggggauaggcgggucgacgcaggacauacagaucaaccaguucccucagguagugugggcgggccugcucgcccagccagcggacccagacaggcgagggaagccucccugguagugaccugucguacuaauaaauuucggaagaacaauuauaagugggucgcagcuucuagcaaaucaccgcgaguggccagaagggcucuuaguccucgcguugccgcagagaacgugugcaaggccuccgcuggcauggcgaauaaagucgaaaagccacaguugaucgcagaccccgagccuaaaccccggaagccagccacaagcucuaaaccugguucagcucccaguaaguacaaguggaaagccagcuccccaucugcaucgagcuccucaaguuucagauggcagucugaggccagcuccaaggaucacgcuucacaacugagcccggugcuaucuagguccccuaguggggaccgccccgccguaggccauagcggacucaaaccacugucuggcgaaacgccccuuuccgcauauaagguuaaaucacgaaccaagauuauccggcguagaaguagcacuucgcugccuggggauaagaaauccggaaccucuccagcggcuacagccaagagccacuugucacucaggcgccggcaggcacugagagguaaaaguucccccguguuaaagaaaacuccuaacaagggccugguccaggugaccacacacaggcucugucgacuuccgccaucucgcgcccaucugcccaccaaggaggcuagcuccuugcacgccguccggacggcaccuacuucaaaagugauaaagacaagauacaggaucguuaaaaagaccccagcuagcccccuaagugccccuccguuuccccugucucucccauccuggcgugcgcgccggcugagccuuucgagaucacugguguugaauaggcuccgaccuguagccucugggggaggcaaagcucagcccgguaguccaugguggcgguccaagggguaccgcugcauuggcggaguccuguauaaggugagcgcaaacaaauuaucuaagacuagcggccaaccuuccgacgccgggucaagaccccugcuaaggacaggacggcucgacccagcugguaguuguagccgaucucuggccuccagagcaguucagcgcucacuugcgaucauuaggcaggcccgucagcggagagagaaaaggaaggaauacugcauguauuacaaucgcuucggccgauguaacagaggggaacggugcccguauauccaugauccugagaaaguggcugucuguaccagguuugugcgcggaacgugcaagaaaaccgacggcacaugccccuucagucaccauguaagcaaggagaagaugccaguguguuccuacuuuuugaaagguauaugcucuaauucgaacugucccuauagccacguuuacgucucacguaaggccgaagugugcuccgauuuccugaaaggguacuguccucucggcgcaaagugcaaaaagaagcacacucugcuuuguccagacuuugcuagacggggagccugccccaggggcgcacaaugucagcuguugcaucgcacccagaaacgacacaguagacgggccgcuacaucuccugcgccggggccaagcgaugccacugcaaggucccgcgugucagcuucucauggacccagaaagccuagcgccagucagaggcccacccggcaaacaccauccagcgccgcucucaccgcagccgcggucgcugccccuccccacugcccaggcgguucugcaucaccuuccaguagcaaagccucgucuuccagcucaaguucuuccagcccgcccgcuucacuggaccacgaggcaccaaguuuacaggaagccgcgcuggcugccgcauguagcaaucgucuaugcaagcucccuuccuucauuucucugcagagcucccccucaccaggggcccaaccucgcguucgagcucccagagccccgcuuacuaaagauucuggaaagccauugcauaucaagccuaggcuguga

SEQ ID NO: 64995 - RNA, 3912 nt, Artificial Sequence
  derived and/or modified sequence opt3 from ZC3H4__Homo_sapiens__NP_055983
auggaggccgcucccggcaccccuccaccgcccccuagcgaauccccacccccuccaucucccccuccaccgucaacacccaguccuccacccugcagcccugacgcaagaccagccacuccccaucugcuccaccacaggcuuccgcugccugaugaccgggaggauggggaauuggaggaaggagaguuagaggacgauggugcggaagagacgcaggacaccuccggcgggcccgaacgcucucgaaaggagaaaggagagaagcaucacucggauucagacgaagagaaaagccaucguagacugaagaggaaacggaagaaggaacgcgagaaagaaaagagaaggaguaaaaagcggcgcaaauccaagcacaagcgacacgcuucuagcuccgaugacuucucagauuuuagugacgauagcgacuucucuccauccgagaaaggccauagaaaguacagggaguauucaccucccuacgccccaagccaccaacaguaucccccuagucaugcaacaccacuaccgaaaaaggccuacucuaaaauggacuccaagagcuaugguauguacgaagauuaugagaacgaacaguacggggaguacgaaggagacgaggaggaagauaugggcaaagaggacuaugaugacuuuacuaaggaacucaaucaguaccggcgugcuaaggagggcucgucucgcgggagaggauccaggggucggggccgaggguaucgcggaagaggcucaaggggugggagucggggacgcggcaugggcagagggagcaggggacguggucggggcuccaugggcggagaucaccccgaagacgaggaggauuucuacgaagaggaaauggacuauggcgagucugaggaaccuaugggugaugacgacuacgaugaguauagcaaagaacugaaccaauaccgaagaucaaaggacaguagggggcgcggccuuucccggggaagaggcagggggagccgcggacgagguaaaggcauggggcggggacguggcagaggugggucuaggggcggaaugaauaagggcgggaugaacgaugacgaggauuuuuacgacgaagauaugggagacgguggcgggggaucauaucgcagucgggaucacgacaaaccacaucagcagagcgauaagaagggcaaagugaucuguaaguacuucgucgaggguagaugcaccuggggcgaccacuguaauuuuucccaugauauugagcugcccaaaaagagggaauugugcaaauucuauauaacaggcuuuugugcacgagccgagaacugcccuuacaugcacggagacuucccauguaagcucuaucauaccacuggcaauugcaucaacggggacgauuguauguuuucucacgacccccugacagaagagacccgcgaacugcucgauaagauguuagcugacgaugccgaggcgggagcagaggacgaaaaagagguugaagaacugaagaaacagggcauuaauccgcuuccuaagccacccccuggugugggguugcugcccacgccaccucggcccccaggaccgcaagccccuacuucgcccaacggcagaccaaugcagggugggcccccuccacccccuccgccacccccuccacccccugggccgccccagaugccaaugccuguacacgaaccccuaagcccacagcaacuccagcagcaagauauguacaauaaaaagaucccuucccuguucgagauuguggucaggcccaccggacagcuugcugagaagcugggcgugcguuuuccagggccgggaggcccucccgguccaauggggcccggaccuaacaugggcccacccgguccuaugggcgggccgaugcauccagacaugcaccccgauaugcauccugacaugcaccccgauaugcacgccgacaugcaugcagauaugccaaugggaccuggcaugaaucccgggccaccuaugggaccgggcggucccccaaugaugccuuaugggcccggagacucaccacacaguggcaugaugccucccaucccgccagcucagaacuucuacgaaaauuucuaccagcaacaggaggguauggaaauggagccuggcuugcucggggacgccgaggauuauggacauuacgaggagcugcccggcgaaccaggggagcacuuauuucccgaacauccucuggagccggacucuuucagcgagggagggcccccaggucgcccuaaacccggggcgggaguuccugauuuucucccauccgcccagcgggcacuuuaucugagaauacagcaaaagcagcaggaagaggaagagagggcucgacgguuggccgaaucaagcaaacaggaccgcgagaacgaggaaggcgauacaggcaacugguacucuuccgacgaggaugaagggggaaguagcgugacuucuauccuaaagacccugagacaacagacauccucaaggcccccugcuagugucggugagcucagcucguccggccugggggacccacggcuucagaaaggacaccccaccggcucucgacuggccgauccgagauugagccgcgacccuaggcucacgcgucacguggaagcaucaggugggaguggaccaggcgauuccggccccucugacccucggcuggccagagcuuuaccaacuagcaagcccgaggggucccugcauucaagcccgguaggaccuaguucuuccaaagguagcgggcccccaccuacagaggaagaggaaggcgagagggcgcuacgcgagaaggcaguuaauauuccccucgacccacugcccggacacccucuucgagauccaagaucgcaguugcaacaguucucacauaucaagaaagacgugacccugucuaagccgaguuuugcccggacuguccucuggaaccccgaagaucugauuccucuuccaauccccaaacaggacgcugugccuccagugcccgccgcacugcaauccaugccuacauuggauccgaggcuccaccgcgccgcuaccgccggcccacccaaugcacgucagagaccuggugcgagcacggacucuagcacccagggggcuaaccugcccgauuucgaguuacugucccggauacuaaagacagucaaugccacuggaucaagugcagccccaggcagcucugacaaaccuuccgaucccaggguucgcaaggcuccaaccgacccgcgacuccagaagccuacagauucaacugccaguagcagagcagcuaaacccggcccagccgaagcgcccuccccuaccgccucuccaucgggggacgcuucacccccugcaacagccccguaugauccacgggugcuggcugccggaggucuuggccaagggggaggcggugggcagagcuccguauugaguggaauuucucuguacgaccccaggaccccuaacgcaggcggcaaggcgacugagccagccgcugacacgggggcccagcccaaaggagcagaagguaauggcaagagcuccgcuucaaaagccaaggagccucccuuugugcgcaagucugcacucgagcagccagaaacagggaaagccggagcugauggcgguaccccgacugacagauauaacagcuacaauaggccucggcccaaggcggccgcagcuccagccgccaccacagcuaccccucccccagagggggcaccuccccaaccgggaguccauaaccugccagugccuacuuuauucggcacaguuaaacagacgcccaagaccggcaguggguccccauuugccggaaauagccccgcgcgugaaggugagcaggaugcugccucucugaaagacguguucaagggcuuugauccuacugcaucaccguucugccaguga

SEQ ID NO: 64996 - RNA, 2916 nt, Artificial Sequence
  derived and/or modified sequence opt3 from ZC3H7A__Homo_sapiens__NP_054872
augagcaacguguccgaggaaagaaggaagcggcagcaaaauaucaaagagggccugcaguucauucagucuccccucucauacccugggacccaggaacaauaugccgucuaccuucgcgcucugguucgaaacuuguuuaaugagggaaacgacguguaucgugaacacgauuggaauaacaguauaagccaguacacagaggcauuaaauaucgccgacuaugcgaaguccgaggaaauucugaucccaaaagagauuaucgaaaagcuauacauaaacagaaucgcuugcuauucuaauauggguuuccaugauaaaguacucgaggacuguaacauugugcugucgcuuaaugccucaaacugcaaggcacuguacaggaaaagcaaagccuugagugaucucggccgguacaagaaggcuuaugacgcagucgccaaguguucccuggcugugccgcaggaugagcacguuaucaaacugacucaggaacucgcccaaaaguuaggguuuaagauucgcaaagcguacgugagagcagagcugucucuuaagagcguccccggagacggcgccacgaaggcuuugaaucauuccguggaagauaucgagccugaccugcuaaccccaaggcaggaagccguacccguugugucacucccugcaccaaguuucagccacgaggucgguucugagcuggcuuccgugcccgugaugccucuuacaucaauacugccauugcaggucgaagagagcgcccucccgagugcgguucuggccaacgggggaaaaaugcccuuuacuaugccugaagcauucuuagaugacggcgauauggugcugggcgacgagcucgacgaucuucuggacucugcuccagaaaccaaugagacaguaaugcccuccgccuuggugcgggggccucuacagaccgcuagcgucucgccaucuaugcccuuuuccgccucacugcucggaacucugccgauuggugcacgcuaugccccucccccaaguuucagcgaguuuuacccuccccuuacauccucucuggaagauuucugcagcucauugaacaguuuuuccaugagcgagucuaaacgagaccucucaaccaguacgagcagagaaggcacuccacugaacaauuccaacucuucguuacugcuaaugaaugggcccggaagccucuucgcuuccgagaacuuucugggcaucucaagucaaccuaggaaugauuucgguaacuucuuugggucugcggugaccaagccaagcuccucaguuacaccgcggcauccccuugaaggaacucacgaguugcgucaggcaugucagauuugcuucgugaaaagcggcccuaagcugauggacuuuaccuaucacgccaauaucgaucauaaguguaaaaaggacauccucauuggccgcaucaaaaacgucgaggauaagucuuggaaaaagauaagaccaaggcccacaaagaccaauuacgaagggccuuauuacauuugcaaagacguggcugccgaggaagagugucgguacuccggacacugcacguucgcauauugucaagaggaaaucgauguauggacucuggagcgaaagggugccuuuagucgcgaggcuuucuuuggcgggaacggaaaaauaaaucuuacaguuuucaagcuguugcaggagcaucucggcgaauuuauuuuccugugcgagaaaugcuuugaccacaagccaagaaugaucagcaagaggaacaaagacaauucuaccgccuguucccaccccgugacuaagcaugaguucgaagauaacaaaugcuuaguccacauccugcgggagacaaccgugaaguacucaaaaauucgcaguuuucauggucagugucagcuagaccucugcagacacgaagucagguaugggugucugcgugaggaugaaugcuucuacgcacauagccuuguggaguugaagguuuggaucaugcaaaaugagacgggcauuucgcacgacgcgauagcucaggaauccaagcgguauuggcagaaccuggaggccaacgugccgggagcacagguacucggcaaucaaaucaugccuggguuccugaacaugaaaauuaaguuugucugugcccagugcuuacgaaauggacaggugaucgaaccagauaaaaacagaaaguacuguucugcuaaagccaggcacagcuggaccaaggaccgccgggcaaugagaguuaugucaaucgagaggaaaaaguggaugaauauucgcccccugccuacaaagaaacagaugccccuucaauucgauuugugcaaccauauagcuagugguaagaaaugucaguaugugggcaauugcuccuuugcccacucuccagaagaacgagaggucuggacuuacaugaaggaaaacgggauccaggacauggagcaguucuacgaacucuggcugaaaagccaaaagaaugagaaguccgaggauauugcgucacagagcaacaaagaaaauggaaagcagauccauaugccuaccgacuaugccgaggugacaguagauuuucacugcuggauguguggcaaaaacugcaauagugaaaagcaauggcagggucacauuucuuccgagaaacauaaggaaaagguguuccacacugaggacgaucaguacuguuggcagcaucgguuucccaccggguauuucagcaucugcgaccguuacaugaacggcacauguccagagggaaauucgugcaaauuugcucacggcaacgcagaacuacaugagugggaagagagaagggacgcccugaagaugaaacucaacaaggcucgcaaagaucaccugauagggccgaaugacaacgauuucggaaaguauucauuucuuuucaaggacuugaauuga

SEQ ID NO: 64997 - RNA, 2934 nt, Artificial Sequence
  derived and/or modified sequence opt3 from ZC3H7B__Homo_sapiens__NP_060060
auggagagacagaagaggaaagccgacaucgaaaagggccugcaauucauucagagcacccucccccuuaaacaggaggaauacgaggcuuuucuguugaaguuagugcagaaccuguucgcagaagggaaugaucuauuucgggagaaagacuauaagcaagcccucguccaguacauggagggacugaacguugcggauuaugcugccuccgaccagguggcacuuccucgcgaacuguugugcaagcuccacguaaaucgagccgcuuguuacuucacaaugggucuguaugagaaagcacuggaagauucugagaaggcccucggcuuagacucagagaguauacgugcucuguuuagaaaagccagggcgcuuaacgaauuggggcggcauaaggaggcauacgaaugcagcucccgcuguucucuggcccuaccacacgaugagucggugacucagcucggacaagaacuggcucagaaacuuggccugagagucaggaaggccuauaagcggccgcaggaguuggagacguucucacuccugagcaaugguaccgcagcugggguggccgaccagggaacaaguaacggcuuaggcuccaucgaugacauugaaacugauugcuacguugacccccgcgggucuccugcgcugcucccaagcacccccacaaugccucuuuuuccacaugugcuggauuugcuagcaccccuggacuccucacgaacccucccuaguacugacagccuggaugacuucucugauggagacgucuuugguccagagcuugauacacuguuggacucccucucacuggugcaaggcggguuaagcggaaguggcguaccgucugaacugccccagcuaaucccuguuuucccaggugggacgccccuccugccuccaguggucggaggcuccauucccgugagcucgccgcuuccucccgcaucuuuuggcuuggugauggauccauccaaaaagcuggcugccucaguccucgacgcucuggauccucccgggccaacccuugacccccuggauuugcucccuuacagugagacuagacuggacgccuuagacagcuucggauccaccagggguucucuggauaaaccagacagcuuuauggaagagacaaauucacaggaucaccggccgcccaguggcgcacaaaagccugccccaucccccgagccuuguaugccaaacacugcucuacucaucaaaaauccccuggcggcaacccaugaguucaagcaggccugccagcuuuguuauccgaaaacagggccucgugcuggagacuacaccuaucgcgagggcuuggaacacaagugcaagagagauauacugcucgguaggcugcggagcucugaggaccagacguggaaacgaauccgcccaagacccacuaagacaucauucguugggaguuacuauuuauguaaagauaugauuaacaagcaagacugcaaauacggcgauaauuguaccuuugccuaucaccaggaagagaucgacguguggacugaggaaaggaagggaacacugaaccgggaucuuuuguucgacccucucggcgggguaaagcgcggaagccugaccauugcaaaacuacugaaggagcaucaggguaucuuuacguuccucugcgaaauaugcuuugauuccaaacccagaauuaucucuaagggcaccaaagacucgccaagcguguguuccaaucuggccgcuaagcacucauucuacaacaauaagugccuuguccauauugugaggaguacaucuuugaaauacagcaagauccgucaguuucaagagcacuuccaguuugacguuugucggcacgaggugcgauaugggugccugagagaagauuccugucauuucgcccacucauuuaucgaguuaaaagucuggcuccugcagcaguacagcggaaugacucaugaagacauugugcaagagucuaagaaauauuggcagcagauggaagcacacgcgggcaaggcuuccaguagcaugggugccccuaggacccaugggcccucuacauucgaucuucagaugaaguuuguaugcggccaauguuggcgcaacggacagguuguggagccagacaaagaucugaaguacugcuccgcaaaagcccggcacuguuggacuaaggagagaagggucuugcucgugaugucaaaagcuaagcgcaaaugggucagugugcgaccgcugccuagcauacggaacuucccccagcaauaugaccuaugcauccacgcccagaauggccguaagugucaguacguugggaacugcucguucgcacauuccccagaagagagagauauguggaccuuuaugaaggaaaauaaaauucuggacaugcagcaaacauaugauauguggcucaagaaacacaaccccggaaagccuggugagggcaccccaaucucuagcagggaaggggagaaacagauacagaugcccacugacuacgcugauauuaugaugggauaccauugcuggcuguguggcaaaaauucaaacaguaagaagcaguggcaacagcacauccaguccgagaagcacaaagaaaagguguucacgucugacagcgaugccuccgguugggcguuucgcuucccuaugggggaguuucggcuuugcgacagauugcagaaaggcaaggccuguccggacggagauaaguguaggugcgcucauggccaagaagaacugaaugaaugguuagaccgacgcgagguacucaaacagaagcuggcaaaagcccggaaggauaugcuucugugcccaagagacgaugacuucgggaaauauaacuuucuacuccaggaggauggagaccuggcuggcgccacacccgaagccccugcggccgcugccaccgcaacuaccggugaguga

SEQ ID NO: 64998 - RNA, 2709 nt, Artificial Sequence
  derived and/or modified sequence opt3 from ZC3HAV1__Homo_sapiens__NP_064504
auggccgaccccgaggugugcuguuucaucaccaagauucugugcgcucacggcgggagaauggcacucgaugcccuucugcaggaaauagcguugagcgagccucaauuaugugaaguccugcagguugcuggaccagacagguuugugguacuagagacagguggcgaagccgggaucacucgguccguggucgcaacgacccgcgcccgagugugccguagaaaauacugucagaggccgugcgauaaccuccaucuguguaaacuuaaucuguugggacggugcaacuauucucagucagagcgcaaucucuguaaguacagucacgagguucugagcgaagagaacuucaaggugcugaaaaaucaugaacucuccggcuuaaacaaggaggagcuggcuguccuuuugcugcaaucugaccccuuuuucaugccugaaauuugcaagucguauaaaggugaggggagacagcagaucuguaaucagcaaccacccugcucaaggcuacacauuugcgaucauuuuacacggggaaacugucgcuucccuaauugccuccgaagccacaaccugauggacagaaaggugcuugcaaucaugagggaacacggccugaauccagauguaguucagaacauacaggacaucuguaauaguaaacauaugcagaagaaucccccuggcccacgggccccguccucucaccgucgcaauauggcuuacagagccaggagcaaaucccgggaucgauuuuuccaagggucacaggaguuuuuggcgagugcaagcgccucugcugaacgcuccugcacucccucaccugaccagauuagccauagagccagucucgaggaugcaccaguggacgaucugaccaggaaguucacauauuuaggaucucaagaccgggcucggcccccuuccgguagcucgaaggccaccgaccugggcgggacuucucaggcgggaacaucccagagauuucucgagaacggcucacaggaagaucuucugcacgguaacccagggaguaccuacuuggccagcaauuccacgucugcacccaacuggaaaagccuaacuucauggaccaaugaccaaggagcuaggcguaagacagucuucaguccgacucugccugccgcucgguccagccucggcucucugcagacccccgaggccgugacaacccgaaaaggcacggggcuucugucaagugauuauagaaucauuaacggaaagagcgguacucaggacauccagccaggcccuuuguuuaauaacaaugcagaugggguggccacagacauaaccuccacuaggucucucaacuacaaaucgacaagcuccggacaccgcgaaauuucaaguccccggauccaagaugcuggcccagcgucuagagacguccaggcaaccgguaggauugccgaugacgcugauccccgcguugcccuggugaaugacagcuuauccgacguaacgucaaccacaagcucucgaguggaugaccaugauuccgaggaaaucugucuggaccaccuaugcaagggguguccucucaacggcaguugcagcaaaguccauuuccaucugccauaccgguggcagaugcuuaucggaaagacuuggaccgauuucgagcacauggagacaauugaaaagggcuauuguaauccggggauacacuugugcucugugggauccuacacuaucaacuuucguguuaugucaugugacaguuuccccauuagaaggcugagcaccccuucguccgugacaaaaccagcaaauucugucuuuaccacuaaguggaucugguauuggaaaaacgagagcgguacguggauacaguacggcgaagagaaggauaaacgcaagaauagcaacguggacaguuccuaucucgaaucucuguaccaaagcugcccccgcgggguaguuccuuuccaggccggauccagaaacuaugagcuuucauuucagggcaugauucagacaaauaucgcuagcaagacccaaaaagaugugaucaggcgaccaacuuucgucccccagugguacgugcagcaaaugaagcgcgguccggaccaccagccugccaaaaccaguucugucucccugacagcaaccuuucggccacaggaggauuucugcuuuuugagcucgaagaaauacaagcucucagaaauucaucaucugcaccccgaguaugugagaguuucugaacacuucaaggcgaguaugaaaaacuuuaagaucgagaaaauuaagaaaauagagaacuccgaauuacuggacaaguucacuuggaagaaaagccagaugaaggaggaagggaaacuacucuuuuacgcuacaucuagggccuauguggagagcaucuguuccaacaauuucgauucauuccugcacgaaacgcaugagaacaaguacggcaaaggaauuuauuuugcaaaggacgccaucuacagucacaaaaauugcccuuaugacgcuaagaacguagucauguucguggcccaaguucuugugggcaaguuuaccgaggggaauaucacuuacacaucacccccaccucaguucgauucuugugucgacacccguuccaaccccucaguguuuguaauuuuccagaaagaucagguguacccacaauauguuauagaauacacagaggacaaggcaugcgucaucaguuga

SEQ ID NO: 64999 - RNA, 1446 nt, Artificial Sequence
  derived and/or modified sequence opt3 from ZC3HC1__Homo_sapiens__NP_001269119
augagaggccugcccaggaagcgggaggccuggacccagccucacccacucgaagcucuuuacgagagccugcgcguguuggaaaaagacacauccgcaacuucucaaucagucaacgggaguccgcaggccgagcagcccagcuuagaauccacgucuaaggaggcguucuuuucgcgaguugagaccuucucaagccugaaaugggcuggaaagccuuuugaacuaaguccacucgugugcgccaaauaugguuggguaacaguggagugugauaugcugaagugcuccucuugucaggcauuccuuugcgccagccugcaacccgcuuuugacuucgaucguuacaagcagagaugugcagaauugaaaaaggcccucugcacugcucaugagaaauuuuguuucuggccugacuccccaucacccgauagguuuggcaugcugccucuggacgagccagccauccucgucagugaguucuuagaucgguuucagagccugugccaccuugacuugcagcugccgucucuacgccccgaagaucucaagaccaugugucugacagaagacaaaauuucccuucuguugcaucuccuggaggaugaauuagaccacagaaccgaugagaggaagacuacaauaaagcuggggucagacauccaagugcauguuaccgcgugcauucucagcguguguggaugggcaugcaguucuucccuugagagcaugcagcugucguugaucacgugcucucaguguaugcggaaagucggccuaugggguuuccagcaaauugaauccucaaugacugaccuggaugccaguuuugggcucaccagcuccccuaucccaggacuggagggccgccccgaacgacuuccucuggugccagagucucccagaaggaugaugacacggagccaggacgcuacuuucucaccgggcagugaacaggccgagaaguccccugggcccauaguaagccguacccgcucuugggauucaaguagcccaguugacagaccugagcccgaagcagcuuccccaacaaccaggacgcggcccgugacucgaucuaugggaacaggugauaccccuggcuuggaggucccaucgagcccgcuccgcaaagccaagagagcgaggcugugcuccucaaguucuagcgacacuuccucacggagcuucuuugaucccacaucucaacaccgcgacugguguccuugggugaauaucaccuuagggaaagaauccagagagaacggaggcacggaaccagaugccagugcacccgcugagccugguuggaaggccgugcugaccauucuacucgcucacaaacagagcucucagccagccgagacagacuccaugucacugagugaaaagagcaggaaggucuuccguaucuuucggcagugggagucgcuuugcuccuguuga

SEQ ID NO: 65000 - RNA, 531 nt, Artificial Sequence
  derived and/or modified sequence opt3 from ZC4H2__Homo_sapiens__NP_001171504
auggccgacgagcaggaaaucaugugcaagcuggagagcauuaaagaaauaagaaacaagacccuccaaauggagaaaaucaaggcuaggcuuaaagcagaguucgaggcccuggaguccgaagaacggcacuugaaggaauacaagcaggagauggauuuacugcuacaggagaaaauggcgcauguggaggaacuccgccugauucacgcugacaucaaugucauggaaaacacaauuaagcagucugagaaugaucuuaacaaacuguuggaaucaacucgacgucuccaugacgaguauaagccccugaaagagcacguugaugcccugagaaugacgcucggcuuacaaaggcugccugaccuuugugaagaggaagagaaguugagucuggaaccagcaugccaugugaccagcaaguuuacagggaugcaccuauacgcccucuucgcucggccgcgcguaggacccgguacuccuaaauccagaaauggcucuaggaugaacaaggagcgggagucgaccuga

SEQ ID NO: 65001 - RNA, 3915 nt, Artificial Sequence
  derived and/or modified sequence opt3 from ZCCHC11__Homo_sapiens__XP_011539402
auggaggaaagcaagacccugaaauccgagaaccacgaacccaagaaaaaugugaucugcgaggaaucuaaggccguccagguuauuggcaaccaaacacucaaagcuagaaaugacaagucagugaaggagauagagaacaguagcccuaauaggaacuccucuaaaaagaauaaacagaacgauaucuguauugaaaagacugagguaaaaucgugcaaggugaaugcagccaaccuuccagggccgaaggaccugggauuggucuuacgggaucagucacauuguaaagcgaagaaauuccccaauagcccugugaaggcugaaaaagccacgaucagucaggcaaaguccgagaaagccaccucucugcaagcuaaggcagaaaagagcccaaaaucccccaacucaguuaaggccgaaaaagcuaguagcuaccagaugaagucugagaaagugccuuccucaccagccgaagcggagaagggucccagccuacuccugaaggacaugcgccagaaaacagaacuucagcaaauuggcaagaaaaucccuaguucuuuuacuuccgucgauaaggugaauauagaggcaguagggggagagaaaugcgcccugcagaacagcccacgaucgcagaagcagcaaaccuguacagacaauaccggcgauucugacgauuccgcuucagguaucgaagacguuagugaugacuugagcaagaugaaaaacgaugaguccaacaaggaaaauucuagcgagauggacuaucucgaaaacgccacugugauugacgagucagcacugacaccggagcagcgucuggggcucaaacaggcugaagagagauuagaaagggaucacaucuuccggcuggagaagcgcagucccgaauacaccaauugcagauaucuuuguaaauugugccugauucauaucgagaacauacaaggagcccacaagcauauuaaggagaaaaggcacaagaaaaauauccuagaaaagcaggaggaauccgagcuccggagccugccuccacccucuccugcgcaccuugccgcacugucagucgcugugauugaguuggccaaagaacauggcaucacggacgaugaccuccgcgugcgacaggagaucgucgaagagaugaguaagguuauuacuaccuuucugccagaauguagcuuaagacuguacggcuccucucucacaagguucgcucuuaaaucgagcgaugugaacauagacaucaaguuucccccgaagaugaaucacccugaucuguugauuaaaguacuagggauccugaagaaaaacgugcucuaugucgacguggaguccgauuuccaugccaagguucccguggucgugugccgggaccguaaaucaggacugcuuugucgcguaagugcagguaaugauauggccugccugacuaccgacuugcucacagcucugggcaagauagagccaguuuuuauuccuuuagugcuggcguucagauacugggcaaagcuaugcuauaucgacucucagaccgaugggggaauccccagcuacuguuuugcccucauggucauguucuuucugcaacagaggaaaccaccccuuuugccuugccugcucggcuccuggauugaagguuucgacccaaagcggauggaugacuuucagcugaaagggaucguggaggaaaaguucgucaaaugggaguguaacucaagcucugcuacggaaaagaauaguauugccgaggagaacaaggcaaaagccgaucagccgaaggacgauacuaaaaagacagaaaccgacaaucaaaguaacgcuaugaaagagaagcacggaaagagcccccuugcccuggaaacuccuaaucgagugucuuugggccagcucuggcuggaguuacugaaauucuacacacuagauuuugcacucgaagaguauguuauaugcgugcgcauccaggacauucugaccagagagaacaagaacuggccaaaaaggcggaucgcgaucgaagaucccuucuccguaaagcgcaaugucgcuagaucacuuaacagucaguugguguacgaguauguuguggaaagguuucgugccgcauaccgguauuucgccuguccucaaacgaaaggcgggaauaagagcaccgucgacuuuaaaaagcgagagaagggaaaaauuucgaacaagaaaccagugaaguccaauaacauggcuacaaaugguugcauacugcucggcgagacuaccgagaaaaucaacgccgagagagaacagcccguacagugugaugagauggacugcacaucucagagguguauuaucgacaauaacaaucuguuagugaacgaacuggauuucgcagaccacgggcaagauagcucaagucuuuccacuucuaagagcuccgagauugagccgaaguuggacaaaaagcaggaugaccucgcuccuucagaaaccugccugaaaaaggagcuaagccaguguaauugcaucgaucugaguaaaucuccagaccccgauaaguccacaggaaccgacugccgcagcaaccucgaaacugagucgucacaucaaucuguuuguacggauacaagugccaccuccugcaauuguaaggcgacugaagacgccagcgaucugaacgacgacgauaaccuuccuacccaggaguuguacuaugucuuugacaaauucauacugacaucuggcaagcccccaaccaucgugugcagcauuuguaaaaaggauggucacuccaaaaaugacugcccugaggauuuucggaagaucgacuuaaagccccucccaccgaugacuaacagauucagggaaauucuggaucuuguguguaaacgcugcuuugacgagcugucaccucccuguagugaacagcauaaucgagagcagaucuugauagggcucgaaaaguucauucaaaaagaguacgaugagaaggcucggcugugccuauuuggcagcucuaaaaacggauucggcuuccgugacuccgaucuggacaucuguaugacacucgaagggcacgagaaugcagaaaagcugaacugcaaggagauuaucgagaaucuugccaaaauauugaagagacauccaggacugaggaacaucuuacccauuacgaccgcuaaagucccuaucguuaaguuugaacaccgccggucaggucucgagggcgacauuagucuguacaauacucuugcccagcacaacacaagaaugcuggcaaccuaugcggccaucgauccaagggugcaguaccuaggguauacaaugaaaguguucgcuaagcgaugcgacauaggagaugccagccgcggcucccucucuucguacgcauauauucugaugguauuguacuuucugcagcaacggaaacccccugucaucccgguguuacaggaaaucuucgacgguaagcagauuccacagagaaugguugauggguggaaugccuuuuucuuugacaagacugaggaacucaaaaagaggcugcccagccuuggcaaaaacaccgagucacugggagaguuguggcucggccugcuacguuucuauacggaagaguuugauuucaaggaauacgugaucuccauucgccagaaaaagcugcuuaccacauuugagaagcaauggacuuccaaauguauagcuaucgaagacccuuucgaucucaaucauaaccugggggcaggagucucucggaagaugaccaauuuuauuaugaaagccuucaucaacgguagaaaguuguucggcacaccauuuuacccccugauugggagggaggcuacuaucagcccuaccaaaacgggauucauguccgugcgauuuacauauuuccaguacauacacucaguuuggcggaucggcugcaccaaguga

SEQ ID NO: 65002 - RNA, 1209 nt, Artificial Sequence
  derived and/or modified sequence opt3 from ZCCHC12__Homo_sapiens__NP_776159
auggccagcaucauugcuagagugggcaacuccaggcggcugaaugcaccccucccuccaugggcccacucuaugcuucgcucacuggggcgaaguuugggaccgauaauggcgagcauggcugaccguaacaugaaguuauucuccgguagagucguucccgcccagggcgaggaaaccuuugagaauuggcugacacaagugaacgggguacuaccugauuggaauaugucugaagaggaaaaacucaagaggcugaugaaaacucuucggggaccagcacgcgaggugaugagaguccugcaggccacgaaccccaauuugucgguggcugacuuccucagggcaaugaagcugguuuuuggcgagucagaaagcagugugaccgcccaugguaaauucuuuaacacacugcaggcucagggggagaaggccucccucuacgucauccgguuagaagugcaacugcagaaugcgauucaggcaggaaucauugccgagaaggaugcuaaccgcacucgacuucagcaauugcugcuaggcggcgagcucucuagagaccugaggcuucggcugaaagauuucuugcguauguaugccaaugaacaggagcgccucccuaacuuucuggaauuaaucagaaugguaagggaggaagaggacugggaugacgcauucauaaagcggaaacgaccaaagcgcagcgaguccaugguugaaagagcugugucacccgucgccuuucaggggaguccuccaaucgugauuggaagcgcggauugcaaugugaucgagauugacgauacccuggacgauucugacgaagacgucauccucguugagucccaggauccgccccuuccuucauggggugccccaccccugagggaccgggcacgcccucaagaugaaguguugguaauagacagcccacacaacaguagagcucaguuccccucuacauccggcgggagcggauacaaaaauaacggcccgggugagaugaggcgugcccggaagcgaaagcauaccauuagauguucguauugcggggaggaaggacacucuaaagagacuugugauaacgaauccgacaaggcucagguguuugagaaucuaaucauuacacugcaagaacucacccauacggagauggagaggucacgcgucgccccuggcgaauacaacgauuucagugagccccuguga

SEQ ID NO: 65003 - RNA, 2850 nt, Artificial Sequence
  derived and/or modified sequence opt3 from ZCCHC14__Homo_sapiens__NP_055959
auggccagcaaccaccccgcuuucuccuuucaucagaagcaagugcugagacaggagcucacccagauccagucuucacuuaauggcgggggaggucacggcgggaaaggagcaccuggcccagguggggcccugccgacaugccccgcgugucauaagauuacuccuaggacggaagcuccagucaguagcguuuccaacucuuuggagaaugccuuacacaccucggcacauucaacagaagagagccugcccaaacggccucuaggaaagcacaguaaaguguccguagaaaagauagaccucaagggccugucucacacuaaaaacgaucgcaauguggagugcagcuucgagguccuuugguccgacucaaguaucaccagcgugacaaagucuuccucagaaguuaccgaguuuauuagcaaacugugucaauuguacccagaagagaaccucgagaagcugauccccugccuggccggcccugaugcuuucuauguggaacgaaaucaugucgaccucgauaguggguuacguuaccuggcaucucuuccaucccacguguugaaaaacgaccauguaagaagguuucugagcacuucgucuccgccccagcagcuacaguccccuucaccaggaaaucccagucucagcaagguugguacagugaugggcgucuccgggcggccuguguguggaguggccggcauuccaucuagccaaucaggugcucagcaccacgggcagcaucccgccggaagugcggcaccgcugccucacugcucccaugccggcagcgcuggcucugcccuugcauaucgcacccagauggauacgucacccgcuauccugaugccaaguagcuugcaaacuccucagacccaggagcaaaacgggauacucgacuggcugagaaaguuaaggcugcacaaauacuaucccgucuucaagcagcucuccauggaaaaauuucuuucucugacagaggaagauuugaauaaguucgagucgcuaacuaugggagccaaaaagaaacugaagacccagcucgagcuggaaaaggagaaaagcgaacggcgcugucuuaacccauccgcgcccccucugguuacaucaagugguguggcccgaguaccaccgaccucucaugugggccccguccagagcgggagaggaucccacgcagcugaguugaggguggaaguugagcaaccucaccaucagcucccacgggagggcucaagcucugaauacuccaguagcagcuccucacccaugggugugcaggcccgugaggaaaguagcgacucggcugaggaaaaugaucgcagagucgagauccaccuggaguccucugacaaggaaaaaccugugauguuacugaaccauuuuacgagcucaagugccaggccaacugcacagguacuacccguucaaaaugaggccuccucuaacccgagcgggcaccacccucucccaccccagaugcuguccgcugcgucacauauuacaccuauccggaugcuuaacagcgugcacaagcccgaacgaggcagugcagauaugaaauugcugucuuccagcguccauucgcuccugucacuugaggagcgcaauaagggaucuggcccaagaaguuccaugaagguggacaaaucuuucgggucugccaugauggacguccugccugcuagcgcaccccaccagccagugcagguuuuguccggacucucagaaaguagcucuauguccccgaccgugucauuugguccuaggacuaagguaguccaugccaguacacuggaucggguguuaaaaaccgcccaacagcccgcucugguuguggagacgagcaccgccgcaacaggcacuccauccaccguccuacacgcggcuagacccccuauuaagcuccugcuuucuucgagcgugccagccgacucagcaaucuccgggcagacaaguugccccaacaauguacagauaucugugccuccggccauuaucaacccacgcacugcuuuguauaccgccaauacaaaaguugcauucagcgcuauguccucaaugcccgucggaccucugcaaggcgguuuuugugccaacucuaauaccgcgagcccaaguucccaccccagcacuucuuucgccaacauggcuacgcucccuucaugcccggcacccuccaguagcccagcccugucgucugugccugaauccagcuucuacucaaguucugggggcggaggcuccacagggaauauucccgcuagcaacccaaaucaucaccaucaccaucaccaccagcagccucccgccccaccgcaaccugcacccccacccccuggauguaucgugugcaccucaugcgguuguaguggcagcugcggguccucuggauuaacugucagcuacgcgaacuauuuucagcauccauucuccggccccucaguuuuuaccuucccuuuucugccguucucuccaauguguaguucggguuacgugagcgcccagcaguaugggggcggauccacauuucccgugguacacgcuccuuacucuucaagcggcacccccgauccaguccuuuccgggcaaaguacuuucgccgugccucccaugcagaauuuuauggcaggaacagcuggcguuuaucagacgcaggguuugguggggucuagcaacggaucaucccauaagaagaguggcaaucucagcugcuacaacuguggugccaccggccacagggcacaagacugcaaacagccaucuauggauuucaaccguccugggacuuuucggcugaaguaugccccgcccgcugagucccuagacucaacagauuga

SEQ ID NO: 65004 - RNA, 3537 nt, Artificial Sequence
  derived and/or modified sequence opt3 from ZCCHC2__Homo_sapiens__NP_060212
augcugagaaugaagcucccccuuaaaccuacccacccagccgagccgcccccugaagcugaggaaccagaggcagacgccaggcccggcgcgaaggcuccuagccggcgccgacgugauugcagaccacccccuccaccgcccccuccagccgggcccuccaggggaccucugccacccccgccucccccacgggguuugggcccucccguggcagggggagccgcugcaggcgccgguaugccagggggaggcggcgggcccucugcugccuuacgcgaacaggagagagucuacgagugguucggacugguucuagguucagcgcaaaggcucgaauuuauguguggccugcuugaccugugcaacccuuuggagcuccgguuccuggggaguugucuggaagaucucgcacgcaaagacuaucauuacuuacgagauagcgaggccaaggcuaauggacuguccgacccaggcccgcuugccgauuuuagagagcccgcagugaggucucgguugaucguauaucuggcucuacucgguucggaaaaccgugaggccgcggggcgccugcacagacuucugccucagguggacucagucuugaaaagccucagggccgcacggggagaaggcagucgaggcggggcugaggaugaacgcggagaggacggugauggcgagcaggacgccgaaaaggauggguccggaccagagggcgguauuguggaacccagaguugggggcggacugggcucuagggcucaggaggaauuacugcuccuuuucacaauggccagccugcauccugcauuuuccuuccaccaacgggugacuuugcgcgagcaucuagagagacugagggccgcucuccgugggggaccagaagacgcggaggucgaaguggagcccugcaaguuugcagguccgcgggcccagaauaacucagcucacggcgacuacaugcagaauaacgaaaguagccugauagagcaggccccuaucccacaagaugggcuuacgguagcaccccaccgagcccagagagaggcuguucauauugagaaaaucaugcugaagggagugcagaggaaacgcgccgacaaguauugggaauacaccuucaaagucaauuggucugauuuguccgugacaacugugaccaagacacaccaggaacuccaagaguuucuguuaaagcugccuaaagagcuaucaagcgaaaccuucgacaagacuauucuccgggcacugaaccagggcagucuuaaaagagaggaaaggcgccaucccgauuuggagccaauccugcgacagcucuuuucuuccagcucgcaagcguuccugcagucucagaagguccacuccuuuuuccagucaauaaguagcgacucccuucacucuaucaauaaccugcaaagcucauugaaaacaaguaagauucucgaacaucugaaagaggauuccagcgaggcuucuucacaggaagaggacguuuuacagcacgccaucauucauaagaagcacaccgguaaaaguccuaucgugaauaacauagggacgagcuguagcccccuggauggccuaacuaugcaguauucugaacaaaauggaauuguagacuggcggaagcagucgugcaccacaauccagcauccagagcacugugugacuagcgcagaucagcacuccgccgaaaaacguucacucaguucuauuaacaagaaaaagggcaagccgcaaaccgagaaagagaagaucaaaaagacagacaauagacugaacagcaggaucaacgggauucgccuuuccaccccucagcaugcucacggagguacggucaaagacgugaauuuggauauaggcucagggcaugacacuugcggagaaacaagcucugaguccuacaguagccccucuuccccacggcacgauggcagagaaucauucgagagugaagaggagaaggacagggauaccgacagcaacucggaagauuccgguaaucccucuacuacacgauuuaccggguacggcagcguuaaccagacggugaccgucaagccuccagugcagaucgccucacugggaaaugagaacggcaaucuccuggaagaccccuuaaacaguccuaaauaucaacacauuuccuucaugccgacacugcauuguguaaugcacaauggggcacagaagucugagguuguggucccagcucccaaaccugccgauggaaagacuaucggcaugcuugugccaagccccgucgcgauauccgccauucgcgagucagcuaacagcaccccuguggguaucuuggggccgacagcaugcacuggagaaagugagaaacaucucgaacugcuagccucuccccugccaaucccuuccaccuuucucccccacagcucgacaccagcucugcaucuuaccguucagcgguugaagcugccucccccacaaggcucaucugagaguuguacugugaauauuccgcagcagccucccgguuccuuaagcaucgccucuccaaacacggcauucauucccauacacaauccuggcagcuuuccagggucccccguagcgacaaccgacccuaucacuaagucagccagucaggucgugggacucaaccaaaugguuccgcagauugaaggcaauaccgggacagugccacagcccaccaacgucaaagugguacugccugcugccggacuuagcgcagcucagcccccagccucuuacccucugcccggcuccccauuggcagccggugugcucccuucacaaaacaguagcguucuguccacugcugcgacaucuccgcagcccgccucggcagggaucagccaggcucaggccacggucccuccagccgugcccacccacacuccaggaccugcucccucaccguccccagcacuaacacauaguaccgcccaaucugauagcacauccuauaucucagcggugggcaauacuaacgcuaaugguaccgucguuccuccccagcagaugggcucugggccaugcggaagcugcggcagaagguguaguugcgggacgaacggaaaucugcaacucaacuccuacuauuaccccaauccuaugccgggccccauguaucgugugccauccuucuuuacccugccuucuauuuguaacgguucauaccuuaaucaggcccaccaguccaacgggaaucaguugcccuucuuucugccucaaacaccauacgcaaacggauuagugcaugaccccguaaugggcagucaggccaauuaugguaugcagcagauggcuggcuucgggcgcuuuuacccugucuauccagcacccaacgugguugccaauacuagcggaucgggcccgaagaaaaacgggaacgugucuugcuacaauuguggagucuccggccacuaugcgcaagauugcaagcagagcucaauggaggcuaaccagcaggguaccuaccggcucagauaugccccuccacugcccccuaguaaugacacacuugacucugcagauuga

SEQ ID NO: 65005 - RNA, 1212 nt, Artificial Sequence
  derived and/or modified sequence opt3 from ZCCHC3__Homo_sapiens__NP_149080
auggccaccggcgggggagcugaggaagagagaaagaggggucggccccagcugcucccuccagcacgcccggccgcgcgaggcgaagaggcugacgggggacgugaaaagaugggcugggcccaaguggucaaaaaccuugcagagaaaaagggugaguucagagaacccaggccuccacggcgcgaggaagagagcgggggaggcggcggguccgccggacuggguggccccgcuggguuggcagccccugauuuaggagacuuuccacccgcuggcagaggugauccuaaagggaggcggcgcgacccagccggagaggcgguugauccgcgaaagaagaaaggcgcagccgaagcuggcagaaggaagaaagccgaggcagcugccgcggccauggcaacacccgcucggccuggggaagccgaggacgcugccgaacguccacugcaggaugagcccgcagccgcugcgggaccugguaagggccgcuuccuagugagaaucugcuuucagggggacgagggagcauguccaacuagggauuucguagugggcgcccucauucugcggucuauagguauggaccccucagauaucuacgcugucauucagaucccggggagucgagaauuugacgugagcuuccgcuccgccgagaaacuugcacuguuuuugagaguuuaugaagagaagagggaacaagaggauugcugggagaauuucgugguccucggccggucuaagucgucacugaaaacgcuguuuauucucuuccgcaacgaaaccguggacguagaggacaucguuacaugguuaaagagacacugugaugugcuggccgucccugugaaagugacugacagguuuggaauauggaccggcgaauacaagugcgagaucgaacuucgucagggggagggagguguccggcauuugcccggcgcuuucuuucugggggccgagcgaggauauagcugguacaaaggccagccaaagacauguuucaaaugcgguaguagaacccacauguccgggucuuguacucaggauaggugcuuccgcuguggcgaagagggacaucuaagcccuuauugccggaagggcauuguuuguaaucucugcgggaagagaggacacgcauuugcgcaaugccccaaagcugugcauaacuccguagccgcacagcugacagguguggccggccacuga

SEQ ID NO: 65006 - RNA, 4488 nt, Artificial Sequence
  derived and/or modified sequence opt3 from ZCCHC6__Homo_sapiens__NP_001171988
augggcgacaccgccaagcccuacuucgugaaaagaacaaaggauagggggacuauggacgaugacgauuuucggcgcggacacccucagcaagacuaucugaucauugaugaccaugcuaaaggucacggcagcaagauggagaaagggcuccagaagaagaaaauaacgccaggaaacuacggcaauaccccgcgaaagggucccugcgcagucuccucuaacccuuaugccuucaaaaauccaaucuacucacagcccgcguggaugaacgauagucauaaggaccagagcaaacguuggcuuuccgaugaacacacagggaauagcgacaacuggagagaguuuaagccuggaccaaggauucccguuaucaaucggcaacgcaaggauucguuccaggaaaacgaggacggcuauagauggcaggacacuaggggcugucggaccgugcgccgacuguuucauaaagauuugacaucauuagaaaccacuagcgagauggaggcugggaguccugaaaauaagaaacagagauccaggccacggaagccgcguaaaacacgcaacgaggaaaaugagcaagacggagaucuggagggucccguaauugacgaaucugugcuaagcaccaaggagcuccugggccuucagcaggccgaagagagacugaaaagggauugcaucgaccgguugaagcgacgcccuagaaacuacccaacggcaaaguauacuuguaggcucugcgauguccugauagaauccaucgccuucgcucacaaacacauuaaggagaaacggcauaagaaaaauaucaaggagaagcaggaagaggaacugcucaccacauuacccccuccaacucccucacaaauuaacgcaguggggaucgccauagacaaaguugugcaggaguuuggacugcacaaugaaaaccuugagcagcgcuuggagauuaagagaaucauggaaaacgucuuccaacauaaacugccggauuguagucuaaggcucuacggcagcucuugcucccgucuggguuuuaaaaauucagacgugaacauugauauccaguucccugcuaucaugagccagcccgacguacuucuguugguucaggagugucucaaaaauagugacucuuuuauugauguggacgccgauuuccacgcgcgggucccagugguggucugccgagaaaagcaauccgggcuguuauguaagguuagcgcaggaaacgagaaugccugccugaccacaaaacaccucaccgcucuuggcaagcuggaaccuaaauuggugccccuaguaauagccuuuagauacugggcaaagcuguguucgaucgacaggccagaggagggcgggcugcccccuuauguguucgcucucauggccauuuucuuucuucagcagcgcaaagaaccacuguugccggucuaccucggaucuuggaucgaggguuucucccugucaaaguuaggcaacuuuaaucugcaggauauagaaaaggacgugguuauuugggagcauacggauagugcggccggggacacuggaaucacaaaagaggaagcaccccgggagaccccuaucaagagaggccaagugagccuaauucucgaugucaaacaccagccauccgugcccguaggucagcuguggguugaacuuuugagguucuaugcucuggaguuuaaccucgccgaccuggugaucucuauucgcgucaaggaacuugugagccgagagcugaaagauuggccuaagaaacggauagcuaucgaggacccauacucagucaagcguaauguggccagaacuuugaacagucagcccguuuucgaauauauucuccauugccugaggacaaccuacaaguauuuugcauuaccgcacaaaaucacgaaguccagccugcuaaaaccucucaaugccauuaccugcaucucugagcauucaaaggaagugauaaaccaccacccagauguacaaacaaaagacgacaagcugaagaauaguguccuugcucaggggcccggcgcgacuagcuccgcagccaacaccuguaaagugcagccuuugacacugaaggagacugcugaaucuuucggaucgcccccaaaagaggagaugggcaaugaacauaucagcguucacccugagaacuccgauugcauucaggccgacgugaacucagaugacuacaagggggauaaagucuaccaucccgaaaccggacgcaagaaugagaaggaaaaagugggucggaagggcaaacaccuccugacaguagaccaaaagagaggggagcacgugguuuguggaaguaccaggaacaaugagucugaaagcacuuuagaucuggagggcuuucagaacccaacggcaaaagaaugcgagggucuugccacauuggacaauaaggcugaucucgacggggaguccaccgaaggcacugaggaacuggaggauucacuaaaccauuucacccacagcguccagggacaaacaucugaaaugaucccguccgacgaggaggaagaggaugacgaagaggaagaggaggaagaggaaccucgacugaccauuaaucagcgcgaggacgaagauggcauggccaacgaggacgagcucgauaauacuuauacagggaguggagacgaagaugcacugagcgaggaagacgaugagcuuggugaggcggcuaaguacgaagacgugaaagaguguggcaagcauguggaacgggccuugcuggucgaguuaaacaaaaucucucucaaggaagagaauguuugcgaggaaaagaacucccccguggaucagucagacuuuuucuaugaguuuaguaagcugauauucacgaaagggaagucuccaaccgugguauguucgcuuugcaagagagaaggacaccugaaaaaggauugucccgaggacuucaaaaggauccaguuggaaccucucccaccccugacuccuaaguuucuaaauauucuggaccaagucugcauccaguguuacaaagauuucuccccgacaauuaucgaggaccaggcacgugagcauauacgccagaaccucgaaucuuuuauucggcaagauuucccaggcaccaagcugagccuuuuugguucaaguaagaauggguucggcuuuaaacaguccgacuuggaugugugcaugacaaucaacggacuggagacugccgaaggcuuagacugcguuagaaccauugaggaacucgcuagggugcugcgaaagcacucugggcuucggaacauccugcccauaacgaccgccaaagucccuaucgugaaguucuuucaccuacgcagcggacucgagguugauauuucccuguauaauacauuggcacugcauaacacuagauuacucucagcuuacagcgccaucgacccaagggugaaauaucuguguuacaccaugaagguauucacaaagaugugcgauauuggcgacgcgagucgggguucucuuuccagcuacgccuauacucugauggucuuguacuuucuccagcagcgaaaucccccugugaucccggugcugcaagagauauauaaaggggaaaagaaacccgagauuuucgucgauggauggaacaucuacuuuuucgaccagaucgaugaacuaccaaccuauuggucggaguguggcaagaauacggagucaguuggucagcuguggcuuggccuccugagauucuacacagaagaguuugacuucaaagaacacgugauuucuauccgcaggaagaguuugcugaccacuuuuaagaaacaauggacauccaaguauauuguaauagaggacccuuucgauuuaaaccauaaucucggggcuggacugagccguaaaaugaccaacuuuaucaugaaggcauucauuaauggccggagaguguuugggauccccgucaaaggauucccaaaggacuacccuucuaagauggaauacuuuuucgaucccgacgugcuuacugagggcgagcuggccccaaacgauaggugcugucgcauuugcgguaaaaucgggcacuuuaugaaggacuguccgaugcgaagaaaaguucggaggcgccgugaucaggaagacgcuuugaaucagagauauccugagaacaaggaaaaacggagcaaggaggauaaagaaauacauaauaaguacaccgagagggagguguccacaaaggaagacaaacccauccagugcacgccacaaaaggccaaacccaugcgcgcagcggccgaucucggacgagagaagauucugagaccuccagucgaaaaauggaagcggcaggacgauaaggaccuaagggagaaacgcuguuucaucugcggcagagaaggucacauuaagaaagaguguccccaguucaagggcucaagugggagccugucuuccaaauauaugacccagggaaaggcuucagccaagaggacucaacaggagaguuga

SEQ ID NO: 65007 - RNA, 2124 nt, Artificial Sequence
  derived and/or modified sequence opt3 from ZCCHC8__Homo_sapiens__NP_060082
auggccgcugagguguacuucggcgaccuggaacucuuugagcccuucgaucacccugaagagagcaucccaaagccgguccauaccagauuuaaagacgaugacggggaugaagaggacgagaacggaguuggugaugcagaacuuagggagcggcugcgccagugcgaagagacaauugagcaauugcgagccgaaaaucaggaguuaaagcguaaacugaacauacuaacuagacccuccggcauccucgugaaugacacgaagcuggaugggccuauucuucagauccuguucaugaacaaugcgauuucuaaacaguaucaccaagaaaucgaggaauuuguaucaaacuuggugaagagguucgaggagcagcagaagaaugacgucgagaaaaccaguuuuaaccuccugccacagcccagcuccauagugcuggaggaagaucauaagguugaggaaucuugugcuaucaaaaauaacaaggaggccuucucgguggucggaucagugcucuacuuuacaaauuucugcuuagacaaacugggccaaccucuuuugaacgagaauccacagcugagcgaagguugggagauucccaaguaucaccagguauuuagucauaucguuucccuagaagggcaggagauucaagugaaggcaaaacggccuaagccacacuguuucaacugcggaucugaagaacaccagaugaaagauuguccgaugccccgcaaugccgcuagaaucagcgagaagaggaaagaauacauggacgcaugcggcgaggccaacaaccagaauuuucaacagcgguaucaugcugaagaggucgaggaacgcuucggccgauucaagccuggggugauauccgaggaacuccaggacgcccugggagugacugauaaaucacuuccacccuuuauuuacagaaugaggcagcuggguuauccuccaggcugguugaaggaggcggaacucgagaacagugggcuggcauuauacgacggaaaggauggcaccgacggugagacagaagucggggagauccaacagaauaaaagcguuaccuacgaucugucuaagcucgugaacuaucccggauucaauauuuccacuccgcggggcaucccugacgaauggcguaucuuuggcucaauucccaugcaggccugucagcaaaaagauguauucgcuaacuaccuuacaagcaauuuucaggccccaggggugaagaguggaaacaaaagaucuuccagccacucgucuccugguucccccaagaagcagaaaaaugagucaaacagugcaggcagcccagcugacauggaacuggauuccgacauggaggucccccaugggucucagagcucagagaguuuccaauuucagccuccauugccgcccgauaccccuccacuaccccgcggaacgccuccacccguguucacuccgccucugccaaagggcacacccccucucacccccuccgacagcccacagacuaggaccgccucuggugcgguugacgaagaugcccugacacuugaggaacuggaggaacagcaacggcgaauaugggcagcuuuggagcaggccgagucagugaauagugacagcgaugucccuguggacacgccccucaccgggaacuccguagcuucuucgccaugcccgaaugaacuggauuuaccuguucccgagggcaaaacuagcgaaaagcagacacuggacgagccagaggugcccgaaaucuuuaccaaaaaguccgaggccggacacgcaucaaguccugauucugaagucacuagccuaugucaaaaggagaaagccgaacucgcuccagugaacacagagggcgcgcugcuugacaauggguccgucgugcccaacugcgauauuucaaacggagguagccagaaguuguucccugcagacaccucuccguccacggccaccaaaauccacaguccaauacccgauaugagcaaguuugcuacaggcauuacuccuuucgaguuugaaaauauggccgagucuaccgggauguaucugcgcaucagaucccuccugaaaaacucaccaaggaaucagcagaagaacaagaaagcaagugaauga

SEQ ID NO: 65008 - RNA, 654 nt, Artificial Sequence
  derived and/or modified sequence opt3 from ZCRB1__Homo_sapiens__NP_149105
augagcggcgggcuggcccccuccaagucuaccguguacgucucaaaccucccuuucagucuuacaaauaacgaccuguauagaaucuuuagcaaauacggaaagguugugaaaguaacuauuaugaaggauaaagacacgaggaaguccaaggguguggcuuucauauuguuuuuagauaaagacucugcacaaaauugcacccgggccaucaacaauaagcaacuguucggccgcgucauuaaagcgucgaucgcuauugauaacgggcgagccgcagaguuuauccguagaaggaauuauuucgacaagucaaaauguuacgaaugcggagagagcggccaccuaaguuaugccuguccaaagaacaugcucggugaacgggagccgcccaagaaaaaggagaaaaagaaaaagaaaaaggcuccugaaccagaggaagagauagaagagguggaggaauccgaggaugaaggggaggaccccgcacuggauucucuuagccaggccaucgcuuuucagcaggccaagauugaagaggagcagaaaaaguggaaaccuuccucaggaguuccaaguacaagcgacgauucucgcagacccaggaucaagaaauccacuuacuucucagacgaagaggaacugagcgauuga

SEQ ID NO: 65009 - RNA, 1575 nt, Artificial Sequence
  derived and/or modified sequence opt3 from ZCWPW1__Homo_sapiens__NP_001244937
augaugaccacacugcagaacaaggaggaaugcggcaaagggcccaagagaaucuucgccccuccagcccagaaaagcuacucccuccuuccguguucucccaauucaccuaaggaggaaacuccaggaauuaguagccccgagacggaagcaaggauaucccugccuaaagccucuuugaagaagaaagaggagaaggcgaccaugaaaaacgugccaucgcgggaacaagagaagaaacgcaaggcucagaucaauaagcaggccgagaaaaaggaaaaagagaagucaagccugacaaacgcagaauuugaggaaauuguccaaaucguucugcagaaaagucuacaggagugccucgguaugggcuccgggcuggacuucgccgaaacuucuugugcucagcccgugguaagcacccaauccgauaaggagccuggaauuacagcaucagccaccgacacugauaaugcuaacggcgaggaagugccacacacacaggagaucagugucagcugggaaggugaggccgcgccggaaauacgaaccucuaaacuugggcagcccgacccugcaccauccaagaagaaaucaaaucgucugacguugagcaagaggaaaaaggaggcccaggaugagaaaguggaaaagacucaaggaggccaugagcacagacaggaagaccggcucaagaaaaccguucaggaucauagucaaauccgcgaccagcagaagggcgagauuucuggguuuggacagugccugguguggguccaauguuccuuccccaacugcgguaaauggagaaggcuguguggcaauaucgauccuagcgugcucccagacaacuggucgugcgaucagaauacagacguacaguauaaccggugugauauucccgaagagacuuggaccggguuagagucugacguugcuuacgccuccuauaucccgggaucaauaauuugggcaaagcaguacggcuauccuugguggcccgguaugaucgaaagugacccagaucugggggaguacuuucuuuucacaagccacuuggacucccugccuucuaaauaucaugugaccuuuuucggagaaacggucagccgcgcuuggauucccgugaauaugcuaaagaacuuucaagagcucucacuggagcuuagugugaugaagaaacgaagaaaugauugcucccagaagcugggcgucgccuugaugauggcgcaggaagccgagcagaucagcauccaagaaaggguuaaccucuucggcuuuuggucucgguucaacgggucaaauaguaacggagagcguaaagaccugcaguuaagcgguuuaaauuccccaggcucuugucucgaaaagaaagagaaggaggaggaacuugaaaaggaggaaggggagaaaacugcacugcgcaagaacuugaaacuacccagagcuaggccuuggcagccagccuuucagcgggagaagaaacuggaacaaugccagcgaacaugggcuuaccagcgcgugagaggaccggcuccccaccucaggaagaaaucgccugauaccggcaauccauga

SEQ ID NO: 65010 - RNA, 7065 nt, Artificial Sequence
  derived and/or modified sequence opt3 from ZDBF2__Homo_sapiens__NP_065974
augcagaagagacagggcuacugcuccuauuguagggugcaguacaauaaucuggagcagcaccucuucuccgcccagcaucggucucuuacccgccaaucacgacgucagaucugcacaaguagccugauggaaagauuuuugcaggacgucuuacagcaccaucccuaucacugucaagaguccucuucgacucaggacgaaacgcauguuaacaccgggucaagcagugaggugguacaccuggacgaugcuuucuccgaagaggaggaagaggacgaagauaagguggaggacgaggaugcaacagaagagaggccuucugaagucagcgagccaauugaagaacuacacucccggccgcauaagucacaggagggaacucaggaagugaguguucgccccagcgugauacaaaaacucgagaagggucagcagcaaccucuggaauuuguccacaaaaucggcgccucugugagaaagugcaaucuuguagacauugggcaggcgaccaacaauagguccaaccugguucggccacccgugaucuguaaugcuccugccucaugcuugccagagagcaguaacgaucgccccgucacagcaaauaccacuucucucccuccagccgcucaucuggacuccgugagcaagugugauccgaacaaaguggaaaaguaccuggagcagcccgacggagcaucgcgaaauccugucccaucuucccacguugagacaaccucauucaguuaucagaaacacaaggaaagcaacagaaaaucccucaggaugaacucugauaaguuagugcuguggaaggacguaaaaagccaaggcaagacgcuuucagccgguuugaaauuucaugagcggauggggacuaagggaagucugcgugugaaaucccccagcaagcuagcugucaacccuaauaaaaccgacaugccaucuaacaagggcauuuucgaagauacaaucgccaagaaccacgaggaauuuuucucaaauauggacugcacucaggaggagaaacaucucguguuuaacaagaccgcguucugggaacagaaauguaguguuagcuccgagaugaaguuugauugcauaucucugcagucggcaagcgaccaaccccaggaaacagcccaggaucuuucccuguggaaagaggagcagaucgaccaagaagauaauuacgagucacgcggcagugaaaugucuuucgacuguagcuccucauuucacagcuugaccgaucagucuaagguguccgcuaaggaggucaaccucaguaaagaagugagaacggacguacaguauaagaauaacaaaagcuacguuucuaagauuuccucagauugcgacgacauccugcauuuagugacuaaucagagucaaaugauugucaaagagaucagccugcagaacgccaggcacauaucgcucguggaucaguccuacgagucuagcucaagugaaacaaauuucgacugcgaugcauccccgcaaucuaccagcgacuauccucagcaguccgucacugaggugaaccuucccaaggaaguucacauugggcugguggauaagaauuacggaucaagcaguucugagguauccgcugacagcgucuucccauugcagucggugguugaucggccucccguggccgucacagaaaccaaacuacgaaagaaagcgcauacgucacugguggacaacuaugguucuaguuguuccgagaccagcuuugauugcgacguaucucucgagagcgugguugaucacccacaacugacagucaagggccgcaaucuuaaagggagacaggugcaucugaagcacaagaaaaggaagcccuccucagccaaagcacacuuggacugugaugugagucucggaacugucgcugacgaaagccagcgggccguugagaagaucaaccuguuaaaagaaaagaaugcugaccugauggauaugaacugcgagucucauggcccugaaauggguuuccaggccgacgcacaacuagccgaucagucccagguggcugagauugagcgccagaaaguggacguagaucucgaaaacaagucaguccaaaguagcagauccucucugucgagcgacucaccagcgucccuuuaccacagugcacaugaugagccgcaggaagccuuggacgaggugaaucugaaggagcucaacaucgauauggaaguuaggucuuaugacuguagcuccucagagcugaccuuugauucugaucccccucuucugagcgugacagaacagagucacuuggaugcugaggggaaagaacgucauaucgaccucgaggacgaguccugcgaaagcgauucuucagagauuacuuucgacuccgauauaccacuguacagugucaucgaccaacccgaaguggccguuuaugaggaagagaccguggauuuagagagcaagucgaaugaaucuuguguauccgagauuacauuugacagcgauaucccucugcacucaggaaacgaccacccagaagucgcagugaaagaggugauacagaaggaagaguacauucaucuagagcggaaaaaugaugaacccaguggcucugagaucuccagcgacucacacgccccgcuccauagugucaccaacagcccugaaguugcugugaagaagcugaauccacagaaagaggagcagguacaccuugaaaacaaggagaaugaacccaucgauuccgaggugucuuuggacuacaacauuaucuuccauagcgucacuggccgauccgaagacccuauuaaagagauaucacugcacacgaaggagcacauguaucucgaaaauaaaucuguguuugagacaagucuggauucggacguucccuuacaagccgcaacccauaagccagaagugaucgucaaggagacuuggcugcagagagaaaaacacgcggaguuccaggggaggagcaccgaguuuuccggaucuaagacaucacuugauagcggugugccucauuacuccguuaccgaaccccagguggcugucaacaaaauuaaucgcaagaaacaauauguauuggagaacaagaaugacaagugcaguggcucugaaaucauccucgauagcaacgugccaccgcagucaaugacugaccagccucagcuggccuuccuaaaagagaagcacguuaaccugaaagauaaaaauuccaaaaguggggacagcaagauuacauuugauucugaacaacuccaggaggcagugaaaaagauagaccaguggaaggaggaagucaucggacugaaaaacaagauuaaugagcccuccacguacaaacuuauccaccauccagaugugucaguacagagcguggccgaccaacccaaggucgcuauuaaacacguuaacuugggcaaugaaaaccauauguaucuggaggugaaaaauucgcaguacucuuguagugagaugaacuuagauuccgguuuccucgggcagagcaucgugaaucggccucaaauaaccauccuggaacaggagcacauugaacuugagggcaagcauaaccagugcuguggaucagaagucuccuuugacucugacgauccacugcagagcguggccgacagauugagggagacuguuaaagagaucagucucuggaaggaugaagagguagacacagaagaucgccgaaaugaggcaaaaggcuucgaaauuauguaugacuccgaugugcugcaacccgucgcugggcagccugaggaggugguuaaggaagugagccuauggaaagagcacgucgaccuggaaaacaagaucgugaagccgaccgauucucggauaaauuucgacucacacgagccacuccagaguguaacaaacaaaauucccggagccaauaaggaaaucaaccugcuucgugaggagcaugucugcuuggaugacaaagguuacgugccuuccgauagcgaaauuaucuacguuucuaacauaccacugcagucggugaucaagcaaccccacauuuuagaggaggaacacgcgucacucgaggacaaaagcuccaauaguuauucuccugaagagagcuccgacucaaacgauaguuuucaggccgcugcagacgaacugcagaagccggucaaggagaucaaucuuuggaaagaagaucacauuuaccuggaggacaagucuuauaaacuaggcgauuucgacgugagcuacgccucccacauccccguucaguuugugacugaucaaucaagcgucccagugaaggagauaaaccuccagaaaaaggaccauaaugaucuggaaaacaagaauugcgagguaugugggucugaaauuaaaugccacuccugugugcauuugcagagugagguugaccaaccucaggucagcuauaaggaagcugaucugcagaaagaggagcacguggugauggaagagaagaccgaccagcccucggacuccgaaaugauguacgauucugacgucccauuccaaaucguagugaaccaguuuccuggaucaguuaaagagacgcauuuacccaaggugguccucguggaucugguuccaggcgacagcgauuaugaagugaucagugacgauauuccgcuucagcuggucaccgacccuccccaguugacagugaaagauaucuccugcauuaauacugaguguauagacaucgaggauaagucuugcgacuucuuugguagcgaaguaagauguaacugcaaggccucaaccccauccaugacaaaucaauguaaagagacuuucaagauuaucaacaggaaaaaggauuacauuauccucggggaacccaguugccagagcuguggcucugagaugaauuuuaacguggacgcaucagaccaguccaugaccuacgagagccagggaccugaugagaagaugguuaaguauauagacucugaggauaagaguugcggcuacaaugggucgaaaggaaaguucaaccuggaagacacgucccaccgcacaacccaccggcuacaaaaagcgcauaaggaggccagccugagaaaagauccaaggaaugcuggucuuaagggcaagucaugccagucuagcgccuccgcagucgacuuuggggcuaguucaaaaucugcccuccaccgacgcgcagauaagaaaaagcggagcaaacugaagcauagagacuuggaaguguccugugagcccgauggauucgagaugaacuuucagugcgccccuccgcugccaagugacacugaucagccccaagaaacagugaagaaaaggcacccuuguaagaaagucagcuccgacuuaaaggagaaaaaccacgacucucagucaagcucgguucucaagguggauuccguacguaaucugaaaaaggcuaaggacgugaucgaagauaaccccgacgagccaguccuugaagcgcugccucaugugcccccaaguuucguuggcaaaaccuggucucagauuaugcgcgaggaugacaucaagauuaaugccuuggugaaagaguuccgggaagguagauuucacugcuauuucgaugacgauugugagacuaagaaagucagcucaaaggggaagaaaaagguaaccugggcagaccuccaaggcaaagaagauacagcuccuacgcaggccguguccgagucugacgauaucguuugcggaauaagugacauugacgaucugagcguggcccuagacaagccgugucauaggcaucccccagcugaacgaccucccaaacagaagggccgggucgcaucccagugccaaaccgccaagaucucacauagcacucagacaucuuguaaaaacuacccagugaugaagcgcaaaaucauuagacaggaggaggauccucccaagaguaaaugcuccaggcugcaggacgaucggaagaccaagaaaaaggucaaaauagggacaguggaauuuccggcgagcuguacuaagguucuuaaaccaaugcaaccuaaggcucucgugugcguacugucaucuuugaauaucaaauuaaaggagggagaaggccugcccuucccaaagaugcgacaccacuccugggacaacgauauuagauuuaucugcaaauauaagcgcaauauuuucgacuacuaugagccccucaucaaacagauagugaucucgccuccgcugagcgucauuguucccgaguuugaaaggcguaacugggugaagauccauuucaaucggaguaaccaaaauucuuccgccggugauaacgacgcagaugggcagggaagcgccucagcuccacuuauggcagucccugccagauacggcuuuaauagucaccaagguaccuccgacagcucucuguucuuggaggaaucaaaagugcuacaugcgagggagcugcccaagaagcgcaacuuucagcucacguuccugaaucacgauguagugaaaauuagcccuaaguccguucgaaacaaacuuuuagaaucucagaguaagaaaaagauccauggcaagagagugacaaccucgagcaacaaacugggguucccaaagaaagucuacaagcccauaauucuccaacagaaaccucggaaggcuuccgagaagcagucaaucuggaucaggacuaaaccaucugacauuauccgcaaguauauaagcaaauacaguguguuuuugcgucacagauaucagucccggucagccuuccugggaagguaccucaagaaaaagaagucugucgugagccgccugaaaaaggcaaaacgaaccgccaagguucuucugaauagcaguguacccccggcuggcgccgaggaauugagcucugcaauggcuaacccuccacccaaaagaccugugcgggccucauguagggucgcgcgcagaaggaagaaaacagacgaguccuaucacgggcggcaaaagggaccaagcacucccgugcgugccuacgaucuacgcaguucuuccugccugcagcagcgagaaagaaugaugaccaggcucgcaaauaaguuacggggcaacgagguuaaauga

SEQ ID NO: 65011 - RNA, 1239 nt, Artificial Sequence
  derived and/or modified sequence opt3 from ZDHHC11__Homo_sapiens__NP_079062
auggacaccagaagcggcucccagugcucugugacacccgaggccauccugaacaaugaaaagcucguccuuccuccaaggauuucacggguuaacggguggagucugccguugcacuacuuccaagugguaacuugggcuguguuugucggauuaagcuccgcaacguucgguauauuuauccccuuccugccucaugccuggaaauauauugcguacgugguuaccggcgggaucuuuucuuuccaccuagugguccaucucauugcuucguguaucgauccagccgacucaaaugugcgccugaugaagaacuauagccagcccaugccucuuuuugaucgaaguaaacacgcacauguaauacagaaucaguucugccaccuguguaagguuacagugaacaaaaagacuaagcacugcaucuccuguaauaaaugcgucucuggauuugaccaucacuguaaguggauuaacaauugcgugggcagccguaacuacugguucuuuuucuccaccguggccucagcuacagcagguauguugugucucaucgccauucugcuguauguccucguucaauacuuagugaauccagggguacugagaaccgaucccagguaugaggacgugaaaaacaugaauacuuggcuuuuguuucugccucuauucccaguccaggugcagacacucaucguugugauaauuggaaugcugguccuucuguuggauuuccucggccuggugcauuuaggccagcugcucaucuuucacauuuaccuuaaggcuaaaaagaugaccacguucgaauaccugaucaacaaucggaaggaggaaaguagcaaacaccaagccguacgcaaggacccguauguucagauggauaaagggguguugcagcagggagcgggugcacuaggcaguuccgcccaaggggucaaggcuaaaucaagccugcucauccauaagcaccugugccauuuuuguacuucugugaaccaggacggagauucuaccgccagagagggcgacgaggaucccugcccuuccgcacuuggugcuaaagccaggaacagccggcugauuugccgccgauugugucaguucucgacaagaguccacccagacgggggaucuauggcgcaagaagccgacgaugcacccuccauaucaacucucggccugcagcaggagaccacagaaccuaugaagaccgacagugcugagagcgaggauuga

SEQ ID NO: 65012 - RNA, 804 nt, Artificial Sequence
  derived and/or modified sequence opt3 from ZDHHC12__Homo_sapiens__NP_116188
auggcccccugggcucugcucagcccuggcgugcuugucagaaccgggcacacaguucugacuuggggaaucacguugguguuauuccugcaugacaccgagcuaaggcagugggaggaacaaggugaacuccugcuuccacugacauuuuugcuccugguacugggcucccucuuacuguaccuugcagugucuuugauggauccgggguaugucaacgugcagccccagccucaggaggaacugaaggaggagcaaacugccaugguuccacccgcgauuccucuacggcgcugccgauacugucucgugcugcagccacuucgugcuagacacugcagggaaugucggcgcugcgucagaagguaugaccaucacugucccuggauggagaauugcgugggagaacggaaccauccucuguucguaguuuacuuggcccuccagcugguggucuuacuguggggccucuaucuugcauggucaggucugcgcuuuuuccagccauggggguuguggcuacgaaguagcggacugcucuuugccaccuuccugcuucuguccuuguuuucucucguggcuucgcuguuacuggugucacaccuauaccucgucgcaagcaauacaaccacuugggaguucauaaguucccacagaaucgccuaucugaggcaacggccgucuaaccccuuugaucguggccuuacacgcaauuuggcucauuucuuuuguggcuggccuagcggguccugggagacccugugggccgaagaggaagaggaaggaucaaguccagcgguuuga

SEQ ID NO: 65013 - RNA, 1479 nt, Artificial Sequence
  derived and/or modified sequence opt3 from ZDHHC13__Homo_sapiens__NP_001001483
auggugauccugcuccuucagcacggcgccgaccccacccugauugauggggagggauucagcuccauacauuuggcugucuuauuucaacacaugccuaucauugcauaccugaucucuaagggucagucaguuaacaugacagacgugaauggccagacuccacuaaugcucagugcccauaaaguaauugggccggaacccacgggauuccugcuuaaguuuaacccuagccugaauguggucgauaaaauccaccagaacaccccauugcauugggcgguggcugccggcaauguuaacgcaguggacaagcuccuggaggccgguuccucucuggauauacaaaaugucaaaggggaaacaccccucgacauggcuuuacagaacaagaaucagcugaucauucacaugcuuaagacugaggcaaaaaugagagccaaccagaaguucagguuguggcgguggcugcaaaaaugcgaacuauuucuccugcuuaugcugucggugaucaccaugugggcuauuggauauaucuuggauuucaauucagacagcuggcuccugaagggcuguuuacugguaacacucuuuuuccuuaccagucuguuuccucgcuucuugguuggcuacaaaaaccuaguguaucugccaacugccuuucuccuguccucugucuucuggauauuuaugacaugguucauucuuuucuuucccgaucuggcgggggcaccuuucuacuuuagcuucaucuuuuccauuguggccuucuuguacuuuuucuauaagaccugggcuacggacccaggauuuacuaaggccucagaggaggagaaaaaggugaauaucaucacccucgcagaaacagguagucuggauuuccgaacuuuuugcaccagcuguuuaauucguaaaccgcugagaucucuacacugccaugucuguaacugcuguguugcuagguaugaccagcacugccucuggacaggccgguguauaggguucggaaaucaucacuacuacaucuuuuuccuguucuuucuuuccauggugugcggcuggauuaucuaugguucauucauauacuugagcagucacugugccaccacguuuaaggaagaugggcuguggacuuaucucaaccagauuguagcgugcucucccugggugcuguacauccuuaugcuggccacauuccauuuuuccuggagcaccuucuugcuccugaaccaguuauuucaaaucgcauuccugggacuaacuucgcacgagcgcauuucucuccagaaacaguccaagcauaugaaacaaacacugucacuuagaaagaccccuuauaauuugggcuuuaugcagaaccuggcugacuucuuucagugcggcuguuucgggcucgucaagccaugcgugguugacuggacgagucaguacaccaugguguuucaccccgccagggagaaaguccugcggagcguguga

SEQ ID NO: 65014 - RNA, 1467 nt, Artificial Sequence
  derived and/or modified sequence opt3 from ZDHHC14__Homo_sapiens__NP_078906
augcccccuggcgggggagguccaaugaaggacugcgaguacagccagaucuccacccacucuucaaguccgauggaaagcccccauaaaaagaaaaagauugccgcuagaaggaaaugggagguguucccuggccggaacaaguuuuucuguaaugggcgcauaaugauggcacgacaaacaggagucuuuuaucugacucucguucuuauccuggugacguccggcuuguucuuugccuucgauugcccauacuuagcgguaaagauuacccccgcuaucccugccguggcagguauucuguuuuucuuugucauggggacacuacuccguacuucuuucucggacccaggagugcugcccagagccaccccugaugaagcugcagaccuugagaggcagaucgauauagccaacggcacaucaagcggcggguaucggccaccgccccgcaccaaagaaguuaucauuaauggacagacugugaagcugaaauacuguuuuacaugcaagaucuucagaccuccaagggcuagucacuguuccuugugcgacaacugugucgagcgguuugaucaucacugccccuggguggguaauuguguaggcaaacgcaacuaucgauucuucuacauguuuauucucucucugagcuuccugaccguuuuuaucuucgccuuugugauaacgcaugucauucucagaucccagcaaacuggguucuuaaaugcgcugaaggacaguccugcaucagugcuugaggccguggucugcuuuuucagcguuuggucuaucgugggauuguccggcuuucacaccuaucugauuucaagcaaccagacaacuaaugaagauaucaaggguaguuggucuaacaaaagggggaaggagaauuacaacccauacuccuauggaaauaucuucaccaacuguugcguagcucuaugcggccccauuagcccgucgcucauagaccggcguggcuacauccagccugauacaccccagccagccgcaccuucuaaugggauuaccauguauggagcuacgcaaucccagucagacaugugugaucaggaccagugcauccaaaguacuaaauuugugcugcaggccgcggccacaccccuucugcagagcgaaccauccuugaccucugacgagcuccaucugcccgguaagccuggcuuagggacuccaugugcaagccugacacucggaccgcccaccccuccagcuucaaugcccaaccuugccgaggcuacgcuggccgaugucaugccucgcaaagacgaacacaugggccaccaauucuugaccccagaugaggcacccaguccgccuagacuacuggccgcugguuccccacucgcgcauagcaggacaaugcacgugcuggggcuugcaucucaggacucacugcacgaagauaguguucggggcuuggugaagcucagcuccgucuga

SEQ ID NO: 65015 - RNA, 987 nt, Artificial Sequence
  derived and/or modified sequence opt3 from ZDHHC15__Homo_sapiens__NP_001139728
augagaaggggcuggaagauggcccugagcgggggacuccggugcugucgccgagugcuuuccuggguccccguucuggugaucguauugguggucuuauggucuuacuaugcuuacguguucgagcugugccuaguuauuuaucucauacuguaccacgcaaucuuuguguucuuuaccuggacauauuggaaaucaauuuucacucuuccucagcaaccaaaccagaaguuucaucugaguuacacggacaaagaacguuaugagaaugaagagagaccggaaguccagaagcagauguugguggauauggccaaaaagcuccccguauacaccaggacagguagcggcgcgguucgguucugugaccgcugccaccugaucaagccugauagaugucaucacugcuccgugugugcuaugugcguccugaaaauggaccaucacuguccaugggugaacaauugcauuggguuuucuaacuacaaguucuuucuccaauucuuagccuauucggugcuguacugucuuuauaucgcaacuaccgucuuuucauacuucauaaaauauuggaggggagaguugcccagcguucggaguaaguuucacgugcuguuccuacucuucguagccugcauguuuuucgugucccuggucauccuuuuuggcuaccauugcuggcuggugucucgcaauaaaacaaccuuggaggcuuucuguacuccuguuuuuacaagcgguccagaaaagaacggguucaaucucggauuuauuaagaacauccaacagguguucggcgauaaaaagaaauuuuggcugauucccaucggcuccucaccuggggacggacacaguuucccaaugcgaagcaugaaugagucucagaacccguuacuggcaaaugaagagaccugggaggauaacgaagacgauaaucaggacuaucccgaggguuccucaagccucgccgucgaaacggagacuuga

SEQ ID NO: 65016 - RNA, 1899 nt, Artificial Sequence
  derived and/or modified sequence opt3 from ZDHHC17__Homo_sapiens__NP_056151
augcagagagaggaaggcuucaacaccaagauggccgacgggcccgaugaguacgacacagaagcuggaugcgugccucugcuccacccagaggaaaucaaaccgcaaagccauuauaaucacgguuacggcgagccccuugggaggaagacucauauugaugacuauuccacgugggauauagucaaagcaacccaguacggaaucuaugagcggugucgcgaacugguugaggccggcuacgacgugcgacagccugauaaggaaaacguaacauuguuacacugggcggcuauuaauaaccguaucgaccuggugaaauauuacauuucuaagggugccaucgucgaucagcuagggggagaccucaauucaacuccacugcauugggcaaccagacaaggccaccuuaguauggugguucagcugaugaaguacggcgccgaucccagcuugauagacggggagggaugcuccuguauccaccucgcugcacaguuuggucauacaucuauuguggccuaucugaucgcuaaaggccaggaugucgacaugauggaccaaaacgggaugaccccucugaugugggccgcguacaggacucacucgguggauccaacacggcucuuacugaccuucaauguaucaguuaaccuuggagacaaguaucauaaaaauacggcauugcacugggccgugcuggcuggcaacacuaccgucauuagccuacuccuggaggccggugcaaauguggaugcucagaacaucaagggggaaagugcccuugaccuggcgaaacagcgcaagaauguguggaugauaaaccacuugcaggaggccagacaagcaaagggauacgauaaucccuccuuucucaggaaacugaaggcugacaaagaguuccggcagaaggucauguuaggcacaccuuuucugguuauuuggcucgugggcuucaucgccgaucuuaacauugacucuuggcugaucaaaggguugauguauggagguguaugggcuacugugcaguuucuaagcaaguccuucuuugaucauucaaugcacagugcccugccacucggcaucuaccuggcaaccaaauucuggauguaugucacaugguuuuucugguuuuggaacgaccuuaauuuccuguucauucauuugccguuucucgccaacagcguggcucuguucuacaauuuugggaagucuuggaaguccgaucccggaauaaucaaagcgaccgaagaacaaaagaaaaagacgauuguugaguuagcagagacuggcucacuggaccuaagcaucuucugcaguacaugucucauacgcaaaccugugcgaucuaagcacugcggugucuguaacagaugcauugccaaguuugaccaucacuguccauggguggggaauugcguaggcgcuggaaaccacagguacuucaugggcuaucuguuuuuccuuuuguuuaugaucuguuggaugaucuacgggugcauuuccuauuggggacugcauugcgaaaccacuuacacaaaagaugguuucuggaccuauaucacgcagauugccaccuguagccccuggauguuuuggauguuccucaauucgguuuuucacuucauguggguggcaguccugcuuaugugccagauguaccagauaucuugucugggcaucacaacuaacgagcggaugaaugcccgucgcuauaagcauuucaaagugaccacaacuuccauugaaucaccuuuuaaccacgggugcgucagaaauaucaucgacuucuuugaguucagguguugcggauuguuucggccagugauuguugauuggacccgacaauacacaauagaauacgaccagaucaguggcagcgguuaucagcucguguga

SEQ ID NO: 65017 - RNA, 1458 nt, Artificial Sequence
  derived and/or modified sequence opt3 from ZDHHC1__Homo_sapiens__NP_037436
auguacaagaugaacauuugcaauaaacccagcaacaagaccgccccugagaaauccguguggacagcuccagcacagccgucuggccccucaccugaacugcaagggcagagaaguaggcggaauggauggagcuggccaccccacccucuccagauugucgccuggcuucuguauuuguucuuugcgguuauagguuucggcaucuuagugccacugcuaccccaucacuggguaccugcuggguacgccuguaugggagcaauuuuugccggccaucucgugguccaccugacugcuguguccaucgacccagcagaugccaacguucgcgacaagucuuaugcugguccgcuucccauuuucaaucgaucgcagcaugcccacgugaucgaggaucugcacugcaacuuguguaaugucgacgugucagcgcguagcaaacauugcagugcauguaacaagugcguauguggguuugaucaccauugcaaguggcucaauaacuguguuggagaaagaaauuacaggcuguuccugcacuccguggccucugcucucuuaggcguccugcuuuuggugcugguggccacguaugucuuuguugaguucuuugugaacccuaugcggcuacgcaccaauagacacuucgaaguacucaaaaaccauacagacgugugguuugucuuccugccagcagcucccguggagacucaagccccugcgauacuugcccuggcagcuuugcucauccuguuaggccugcucagcaccgcccuucuggggcacuugcuaugcuuucauauuuaccugauguggcacaagcucacaaccuaugaguacaucguucagcauaggccaccccaggaagcuaaaggagugcaccgggagcuggaauccuguccgccuaagaugcgccccauucaggagauggaguucuacaugcgaacuuucagacacaugaggccagaaccucccggucaagccggcccagcagccgucaaugcuaaacauucacggcccgcgaguccugauccaacaccggggcgucgcgacugcgcaggacccccugugcagguagagugggauagaaagaagccacuucccuggaggagcccucuguugcuccuggccauguggggcccacaggcucccccgugcuuaugucggaaacgaggucgcggggccugcaucaagugugaaagacugaggccucggauacgcagaaggggacuaggcccacccgcagccgcuccugcccgucggcgaauccccagaaccccagcacucugcacgccucuggcgcuucccgcuccaacuaccaggcgccggcagucuccguggacaagauuucaauggaggcgccgagccugggcagccccuuuguggcccccacggggcgcuggggccgacucaccccguuggagaggaaggcgcguucggccuccauucuccuga

SEQ ID NO: 65018 - RNA, 1104 nt, Artificial Sequence
  derived and/or modified sequence opt3 from ZDHHC2__Homo_sapiens__NP_057437
auggcccccagcggcccuggguccucugcuagaaggcggugccgccgagugcuguacuggaucccagucguuuucauuacccuccuucugggauggucauauuacgcauaugccauacaguuguguaucgugaguauggagaacacaggugaacaaguagugugcuuaauggcguaccaucugcuauuugcuauguucgucuggagcuauuggaagacuauuuuuacgcucccgaugaaucccuccaaagaguuccaccugucuuacgccgaaaaggaccuucuggagcgugaaccuagaggcgaggcacaccaggagguguugaggcgggccgcuaaagaucucccaaucuauacccgcacaaugucgggggcaauuagauacugugacaggugccagcugaucaagcccgaucggugucaccacugcucaguuugugacaaaugcauacugaagauggaucaucacuguccuugggugaacaauugcgucggauuuagcaacuacaaguucuuucucuuauuccuggccuauagucuuuuguacugucuguuuaucgcugccacugaccuacaguauuucauuaaauuuuggaccaauggccucccagauacacaagcgaaguuccacaucauguuucuguucuucgcagccgcuauguuuuccgugucucuuagcucccuguucgguuaccauugcugguugguaaguaaaaacaagucaacccucgaagccuuucgcagccccguuuuccgacacgggacugacaaaaauggauuuucucugggcuucuccaagaacaugagacagguguuuggcgaugagaagaaauauugguuacugccuauuuucucaagccucggggacggaugcaguuuuccaacaugucuugucaaucaggauccggaacaggcaucuacccccgcuggucugaacuccacggccaagaauuuggagaaccaucaauucccugcgaaaccacuaagggagagccagucgcaucugcucacugacucucaguccuggaccgaaucaaguaucaaucccggcaagugcaaagccgggaugagcaacccugcacugacaauggagaaugaaacuuga

SEQ ID NO: 65019 - RNA, 1038 nt, Artificial Sequence
  derived and/or modified sequence opt3 from ZDHHC7__Homo_sapiens__NP_001139020
augcagcccagcggccacagacugagggacguggagcaucacccucuccuugccgaaaacgauaauuacgacuccucuucaaguagcuccucugaggcugaugucgcagaccggguuugguucauccgcgaugggugcggaaugauuugugccgugaugaccuggcuguugguagcguaugcugacuuuguggucacauucgugauguuacugccaucgaaggauuuuugguacucaguugugaacggugucauauucaauugccuagccgugcucgcacugagcagucaucuucgaacuaugcugacggacccggaaaaauccucugauugucgucccagcgccugcaccguaaagacaggcuuggacccuacucucguugggaucuguggagagggcaccgaauccgugcaaucacugcugcucggugcugucccaaaagggaacgcaacaaaggaguauauggagaguuuacagcugaaacccggagaagugauuuacaagugcccuaaguguugcuguaucaaaccagagagagcccaccauugcagcauuuguaagaggugcauccggaaaauggaucaccacugccccugggugaauaacugugucggcgaaaagaaucagcgcuuuuucguucuuuuuaccauguauauagcuuugucuuccgugcaugcccugauccuaugcggcuuccaguuuauuucauguguaagagggcaauggacugagugcagcgacuucaguccuccaaucacagugauucuccugaucuuucuuugucuggagggacucuuguucuuuaccuucacggcggucauguucgguacucagauacacucuauuugcaacgaugaaaccgagaucgaaaggcugaaauccgagaagccgacaugggaacggcgcuuacgaugggagggcaugaaaagcguguuugggggacccccuucgcugcucuggaugaauccauucguuggcuuuagauucaggcggcuucccacucguccucgcaagggugggccagaguuuucuguguga

SEQ ID NO: 65020 - RNA, 2298 nt, Artificial Sequence
  derived and/or modified sequence opt3 from ZDHHC8__Homo_sapiens__NP_037505
augcccagaagcccuggcaccaggcugaagccagccaaauacaucccgguggcuacagcagccgcgcuccuugucggguccucuacucuguucuuuguuuucacgugccccugguugacccgggcugugucacccgccguaccaguguauaacggaauuauauuuuuauucguccuggcaaauuuuaguauggccacauucauggaccccgguguguuuccucgcgcugaugaggacgaagauaaggaggacgauuuccgagcaccacuauacaaaaacguugacgugcguggcauccaggucagaaugaaguggugugccacuugccacuuuuauaggcccccucgguguagccauugcuccgugugugauaauugcguagaagacuucgaucaccauuguccauggguuaacaauugcauugggcgcagaaacuacagguacuuuuuccucuuucugcuuucucugucggcucacauggugggagucguggccuucggcuugguguauguccucaaucaugcggagggucugggggcagcccacaccacaaucaccauggcuguuauguguguggccggacuguucuuuauuccgguaaucggccucacuggcuuccacguggucuuagugacacgggggcgcaccacgaacgaacaaguuacuggaaaauuucgagguggcgugaaucccuucaccagagggugcuguggaaacgucgagcaugugcugugcucaccucuugcaccaagguauguaguugagcccccucgguugccacuggcugugagccuaaagcccccguuucuccguccugaacugcuugaccgcgccgcgccccugaaggucaaauugagugauaauggccucaaggccggucuggggagauccaaaucuaaggggagcuuagacaggcuggaugagaaaccacucgaccuuggcccuccccugccacccaagauagaagcaggcacauucuccucagacuugcagacuccucggccagggagugcugagagcgcccuaucugugcagcgaaccuccccgcccaccccugcuauguacaaguuucgcccagccuuccccacaggaccuaaagucccauuuugcggucccggcgaacaggugccggggccugauucacugacgcucggagacgauagcaucagaagucuggacuucguuucugaaccaucccuugaucugcccgacuacggcccugguggguugcacgcagccuaucccccaagcccuccccucucggcuucugaugcguuuuccggcgcacugaggucauuaagucugaaggccagcucccggcgcggaggcgaccauguggcucuacaaccacucagaucugagggaggaccgccuacuccccacaggagcauuuucgccccacacgcacugcccaaccguaaugguucacuuaguuacgauuccuugcugaacccuggcagcccagggggacaugccugucccgcucacccugccguaggcgucgcagguuaucauucuccguaccuccacccaggggcgacaggcgacccuccucggccacugccccgaucauuuaguccugugcuuggaccgagacccagggaaccaagcccuguucgcuaugauaaucugucccggaccaucauggcuucuauucaggagagaaaagacagggaggagcgcgagcgauugcuccggucgcaggccgacagccuguucggcgauuccgggguguacgacgcacccucaaguuauucuuuacagcaagccagcguccuguccgaaggaccacgugguccugcucuaagauacggcucaagggaugaccucguggccgggcccggauucggcggugcacgcaacccagcucugcagacuagccuuucuuccuugaguagcucuguaucccgggccccgagaacaucaaguagcucgcugcaggcggaucaggccuccucuaacgcuccugggcccaggccaagcucaggcagucaucgaucccccgcacgccaaggacucccuucuccacccggcaccccucacagcccguccuacgccgggccaaaggcuguggccuuuauccacacggaccugcccgagccucccccaucauuaaccguucagcgggaucauccucagcugaaaacacccccaagcaaacuuaauggacaaaguccuggcuuggcaagacucgguccggcgacugggcccccaggaccuucugccucccccaccaggcacacacuggucaagaaggugagcggcguggguggcacuaccuaugaaauaucggucuga

SEQ ID NO: 65021 - RNA, 1095 nt, Artificial Sequence
  derived and/or modified sequence opt3 from ZDHHC9__Homo_sapiens__NP_001008223
augagcgugauggucguuagaaagaaagugaccaggaagugggagaaacugcccggccggaacacauucugcugugacgggcgcguaaugauggcccgacagaagggaaucuuuuaccucacucuuuuccugauuuuggguacgugcaccuuauuuuucgcuuuugaaugucguuaucuggcagugcaacuauccccugccauaccagucuucgcggcuaugcucuuucuguucucuauggccacacuucugagaacuucauuuagugauccgggcgugauccccagggcauugccugacgaggccgcuuucauugaaauggagaucgaagcaaccaauggggccguuccacagggacagcggcccccuccacgcauuaaaaacuuucagaucaauaaccaaauagugaagcucaaguacugcuauacauguaaaaucuucagacccccuagggcuagccacugcuccauuugugauaauugcgucgagcgguuugaccaucacuguccaugggugggcaacugcguagguaagcgcaauuaccgauauuucuaccuguucauccugucucucucguuacugaccauuuauguuuuugccuucaacaucguguacgucgcgcuuaaaucauugaagauaggguuucuggagacucuaaaagaaacaccgggaaccgugcucgaggugcugauuuguuucuuuacgcuuuggagcgucguuggccugacuggcuuccauaccuuuuugguggcacucaaucagacaacuaacgaagauaucaaggggaguuggaccggaaagaauagaguacagaaccccuacucccacgguaauauugugaaaaacugcugcgagguccuguguggcccuuuaccacccucugugcuggacaggcgggggauccucccucuugaggaaagcggaucccguccacccucaacacaggagaccaguagcucucuguugccgcaauccccugcccccacggaacaucuaaauucaaacgagaugccagaagauagcaguacuccugaggagaugcccccacccgaaccuccagagccgccccaggaagcugccgaggcagaaaaguga

SEQ ID NO: 65022 - RNA, 3327 nt, Artificial Sequence
  derived and/or modified sequence opt3 from ZEB1__Homo_sapiens__NP_001121600
augaaggugaccaacuacaauacagucguugagacuaacagcgacuccgaugacgaagauaaacugcacaucguggaggaagagucuguaacggacgccgcugauugcgaaggcgugcccgaggacgaucucccuaccgaccagacaguccuuccagggagaucaagugagagggaaggaaaugcaaagaacuguugggaggaugacacugguaaagaaggccaagagauucuggggccggaggcccaggcggaugaagcuggaugcaccgugaaggacgaugagugugaaagcgacgccgagaaugaacagaaccaugaccccaauguugaggaguucuugcagcaacaggauacagcagugauauuuccugaagccccagaggaagaccagcggcagggcacccccgaggcuuccggucacgaugaaaacgggacuccugacgcauucucucaauuacugacaugcccauauugugaucgcggauacaaacgauuuaccucgcuaaaggagcauaucaaguaucgucacgagaaaaaugaagacaacuucucaugcagccucuguaguuacacguuugccuauagaacucagcuggagaggcauaugaccucccacaagucuggccgggaucagcgccacgucacacagagcggcugcaauagaaaauucaaguguacugaaugcgggaaggcuuuuaaauacaagcaucaccuuaaagagcaucugaggauucacuccggagaaaagcccuaugaguguccuaacugcaaaaagcgguucucacacagugguagcuacucuucccauaucucaagcaaaaagugcauuaguuugaucccagugaauggccgcccgcgaaccgggcucaaaacaucucaauguuccagccccucgcugucugccuccccuggaucaccaaccagaccccagauaaggcagaagaucgagaacaagccucugcaagaacagcucaguguaaaucagauuaaaacggagccaguugacuacgaauuuaagcccaucguggucgcgagcggcauuaacugcuccacuccguuacagaacgguguguucacagggggaggcccucugcaagcaaccucuagcccccagggcauggugcaggccgucguucuuccaacugugggguugguaucaccuaucaguauaaaucuguccgauauucagaacgugcuaaaagucgcuguggacggaaauguuauccggcaagugcucgagaacaaucaggccaaccuggcaagcaaggagcaggaaacaauuaaugcuucucccauccagcaagguggccacucagucaucagugccauuagccuuccacugguggaucaggacgggaccacgaaaauaaucauuaacuauuccuuggagcagcccucucagcuccaaguaguuccucagaaucugaagaaggaaaacccaguggcgaccaauucguguaaaagcgagaaguuaccggaagaccugacagucaaauccgagaaggauaaaucauuugagggaggcgugaacgacaguacuugccuccuuugugaugacugccccggugauaucaaugcccugccugaauugaagcauuacgaccuaaagcagccaacccaacccccuccacugcccgcagcugaggccgaaaaaccggagucuagcgucuccucagcuacaggggauggcaaccucagcccuucucagccaccccugaagaaucuucuguccuugcucaaagccuauuacgcacugaacgcccagccuagugcugaagaguuaagcaagauagcggacucugugaaccugccccuagauguugugaaaaagugguucgagaagaugcaggcaggacaaauuuccguacagucaagugaaccaagcucgccugagcccggcaaagucaauaucccagccaagaacaaugaccagccgcaguccgcuaacgccaaugaaccucaagauucuacugugaaccuccagagcccccugaaaaugaccaauucaccaguucuucccguggggaguacaaccaacggaucccguucuagcacuccuuccccaucacccuugaaucugagcaguucucgcaacacgcaggguuaucucuacacagcagagggcgcccaggaagaaccucaagucgagccgcuggaccuuucccugccaaagcagcagggggaauugcucgagagaagcaccaucacuucgguguaucaaaauucaguauacucugugcaggaggagccccugaacuuaaguugugcuaaaaaggagccucagaaagauuccugcguuaccgacagcgaaccagucgugaaugugauucccccuucugccaacccgaucaauauugcaauacccacagucaccgcgcagcugccaacuaucguugcuauugccgaccaaaacagcgugccuugucuaagggcacucgccgcuaacaagcagacaauccugaucccccagguggccuacacguauuccaccacuguaucaccagcaguccaggagccuccccuuaaggugauucaaccaaauggaaaccaggaugaacggcaggacacaaguagcgagggcguuucuaauguggaagaucagaacgacuccgauucaaccccgccuaaaaagaaaaugcgaaagacagagaaugguauguacgcuugcgacuugugugauaaaauauuucaaaagaguagcucccugcuccgccacaaguaugagcauacugggaaaagaccccacgaaugcggcaucugcaagaaagccuucaagcacaaacaucaccugauugagcauaugagguuacacucuggagaaaagccauaccagugugacaagugcggcaaacgguucucgcacagcgggucauauucccagcauaugaaccaccgcuacaguuauuguaagagagaggcggaagagagggauucuaccgagcaggaagaggccggacccgaaauccugagcaaugagcaugucggugcucgugcauccccuucacaaggcgacucugaugaacgggagagccuuacgcgagaggaagacgaggauagugaaaaagaggaggaagaggaagacaaggagauggaagaguugcaggaggaaaaagagugcgaaaagccacagggggacgaggaagaggaggaagaggaagaggaaguggaggaggaagagguugaagaggccgagaacgaaggagaggaagcuaagaccgagggccucaugaaagaugacagagccgaaucccaagcaagcucucugggucagaaggugggggagucauccgagcagguaagugaagagaaaacaaaugaagcguga

SEQ ID NO: 65023 - RNA, 3573 nt, Artificial Sequence
  derived and/or modified sequence opt3 from ZEB2__Homo_sapiens__NP_001165124
augaagcagcccaucauggccgacggcccuagaugcaaaaggcggaagcaagcuaacccacgccguaaaaauguggucaacuacgauaauguuguggacaccgggagcgagacagaugaagaggacaagcugcacauugcagaagaugacggaauagccaacccgcucgaucaggagacuucccccgcgucuguaccuaaucaugaaucaaguccacacgugagccaggcccuucugccccgagaggaggaagaggacgaaaucagagaggguggcgucgagcauccuuggcacaacaaugaaauuuugcaggcuuccguggaugggccaguuaaaaacgcaaauuguacgucugacuucgaggaauauuuugccaagaggaaguuagaggaacgggauggacaugcugugucgaucgaggaguaccugcaacgcucagacaccgcaauuaucuaucccgaagccccugaggaacuaagcagacucggcacaccagaggcuaacggucaggaagagaaugaucugccgcccgggacuccugacgccuucgcgcagcuucugaccugcccauacugugacaggggauauaaacgguugacaagucucaaggagcacauaaaauaccgccacgaaaagaacgaggaaaauuuuuccugcccccuguguucuuauaccuucgcauaccgaacucagcuggagagacauauggucacacacaaaccuggcaccgaucaacaucagaugcucacgcagggcgccgggaacaggaaguuuaagugcacugaauguggaaaggcuuucaaguacaaacaccacuuaaaggagcaucugcggauccacagcggugagaaaccauaugaaugccccaauuguaagaaacguuuuucccauucaggcaguuacagcucucacauuuccucaaagaagugcaucgggcuuauuagcgugaacggacgcaugagaaacaauaucaaaaccggcaguucuccgaacuccguaagcucgucuccuacaaauuccgccauaacucaguugaggaacaagcuggagaaugguaaaccccuaucaaugagugaacaaaccgggcuccugaagauuaaaacagagccacuugacuucaacgauuauaagguucugauggcaacccauggauuuagcggcacguccccuuucaugaauggcggguugggagcuacuucuccccucggugugcacccaagcgcccagucacccaugcagcaccugggcgucgggauggaggcgccuuuacugggauuuccaacaaugaacaguaaucucuccgaagugcaaaaggugcuucagaucgucgacaacaccguuagccggcagaaaauggauuguaaggccgaggaaauuucuaaacugaagggcuaccauaugaaagacccgugcucacagcccgaggaacaaggugugacuagcccuaauaucccacccguaggguugccuguggucagccacaacggcgcaacaaaguccaucauugauuauacccuagagaaggugaaugaggcuaaagccugccugcagucucucacgaccgacucgcgacgccagauaagcaacaucaagaaagaaaagcugagaacacuuauugaucugguuacugacgauaaaaugaucgagaaucauaacauauccaccccauucucaugucaguuuugcaaggaaaguuuccccggaccgauuccuuugcaccaacacgagagguaccucuguaagaugaacgaagagaucaaagcugugcugcagccacaugagaauaucguccccaacaaggccggcguguucguagacaauaaagcauuacugcuaucuagcguucucuccgaaaaggggaugacaucaccuauuaaccccuauaaagaccacaugagcgugcugaaggccuacuacgcuaugaauauggagccaaacucugaugaacuuuugaaaaucuccauugcggucggacugccucaggaguuugugaaggaaugguucgagcagcggaaggucuaucaauacaguaauagccgcucucccucccucgagagaucaaguaaaccacuggcaccgaacagcaauccucccacuaaggacucgcuucugccaaggucccccgugaaaccuauggauucuauaaccagcccaucaaucgccgaauugcauaacaguguuacaaauugcgaucccccucuccgucugaccaagccgucccacuuuacuaacauuaaaccaguggagaaguuagaccauucucggagcaauacgcccuccccucugaaccuaucaagcacaaguucuaaaaauucccacagcucgucauauaccccaaacucuuucaguuccgaggaacuccaggcugagccccuggaccuuagcuugccuaaacagaugaaggaaccgaaaucuaucaucgccacuaagaacaaaaccaaggcaagcuccauuucacuggaucacaauaguguaaguucuuccucagagaacagugacgaaccccucaaucugacauuuauaaagaaagaguucagcaacuccaauaacuuagauaauaagucuaccaacccagucuuuucgaugaauccuuucagcgccaaaccccuguacacugcccuuccaccucagucagcuuuucccccagcaacauucaugccgccugugcaaacguccauccccgguuugcgaccauaucccggccucgaccagaugaguuuucugccucauauggcguacaccuauccaacuggggcugccacauucgcagauaugcagcaaagaaggaaguaccagcgcaaacagggauuucagggcgaacuacuggacggugcccaagauuacaugucugggcucgacgacaugaccgauagcgacuccugucugucacggaagaagauuaaaaagacagagucuggcauguaugcuugcgaucuuugugacaaaacuuuccaaaagagcaguuccuugcugagacacaaauacgagcauaccggaaagaggccccaccagugccagaucuguaaaaaggccuucaagcauaaacaccacuuaauugaacauagccgccuccacucuggcgagaagccuuaucagugcgauaaaugugggaagcgauuuucacauuccggaaguuacagccagcacaugaaccaccgguauucguacugcaaacgugaagcagaggaaagagaggcugccgagagggaagcgcgcgagaagggucaucuggaaccgacggagcuucugaugaaucgggccuauuugcagucuaucaccccacagggcuacuccgacagcgaagagagagagucaaugcccagggauggggaaagugagaaggaacacgagaaagagggagaagacggcuacgguaagcucgggcgacaagauggcgacgaggaguucgaagaagaggaggaagagucugaaaacaaauccauggauacagacccugagacuauacgcgaugaagaggagaccggagaccauagcauggacgauucaagugaagacggcaagauggagacaaaaagcgaucacgaagaggacaauauggaagaugggauguga

SEQ ID NO: 65024 - RNA, 684 nt, Artificial Sequence
  derived and/or modified sequence opt3 from ZFAND3__Homo_sapiens__NP_068762
augggcgacgccgggagcgagagauccaaggcucccucucugccuccaaggugcccguguggauucugggguucaaguaaaaccaugaaccucugcagcaaguguuuugcagauuuccagaaaaagcaacccgacgaugacuccgccccuucuacaagcaauucacagagcgaucuuuuuagugaagagacuacguccgacaacaauaacaccucuaucacaacuccaacccugagccccucccagcagccuuugccaacagaauuaaaugugaccucacccaguaaagaggaaugcggcccuuguacugauacagcgcacgucagccugauuaccccaacgaagcggucuugcgggacugacucccaaucagagaacgaggcuagcccgguuaagcgcccccgacuacucgaaaauaccgagcguagugaagagacaucuagauccaaacagaagucgaggcggcgcuguuuccagugccagacuaaacuggagcuugugcaacaggaacugggaucguguagaugcggcuacguauuuuguauguugcauaggcucccugagcagcacgauugcaccuucgaccauaugggucgggggcgcgaagaggccauaaugaagauggugaaacuggaucgaaaggucggaagaucuugccagaggaucggcgaaggcuguuccuga

SEQ ID NO: 65025 - RNA, 642 nt, Artificial Sequence
  derived and/or modified sequence opt3 from ZFAND5__Homo_sapiens__NP_001095891
auggcccaggagaccaaccaaacacccggcccuaugcugugcagcacuggguguggauucuacgguaauccaagaacgaacggcaugugcuccguguguuauaaggaacaccuccagaggcagcaaaauucugggcggaugucaccgaugggaaccgcuaguggcagcaacucccccacaucugacucggcaucaguccagcgcgccgauacuagccuuaauaacugcgagggugcggcugggaguaccuccgaaaaaucucgaaauguuccuguggccgcacugccaguaacacagcagaugaccgagaugagcaucucccgugaagacaagauuacuacacccaaaaccgaggugucagagccugucgugacgcagccaagucccagcguuucucaaccuuccacuucacagagcgaagagaaggccccagaauugccgaaacccaagaagaacagauguuuuaugugcaggaaaaaggugggauuaaccggcuucgauugucggugcggcaaucuguuuugugggcuacaucgcuacagugacaaacacaacugcccuuaugauuacaaggcugaggcagccgcuaaaauaagaaaggagaauccagucgugguagccgaaaagauccagaggauuuga

SEQ ID NO: 65026 - RNA, 591 nt, Artificial Sequence
  derived and/or modified sequence opt3 from ZFAND6__Homo_sapiens__NP_001229846
auggcccaggagaccaaccacagccaagugcccaugcugugcuccacaggcuguggguucuacggaaauccuagaacuaacgguaugugcucugucuguuauaaggaacaucuccagaggcaaaauucaaguaacggccggaucagcccaccgguucagugcacggacggguccgugcccgaggcucaaucugcacuugauucgaccucaagcaguaugcagccuuccccaguaucuaaucagagccuguuguccgaaucaguggccaguagccaguuagacucuacauccgucgauaaagcggugcccgagacugaagacguucaggcuucagugagcgauaccgcccagcagccuagugaggagcagucuaagucccuggaaaaaccaaagcagaaaaagaaccgcuguuuuaugugccgaaagaaagucggacuaacaggcuucgagugucguugcgguaauguguacugugggguacacagauauagcgacguucauaacugcucguacaauuauaaggcagaugccgcugagaaaauuaggaaggaaaaccccguggucgugggagagaaaauacaaaagaucuga

SEQ ID NO: 65027 - RNA, 3696 nt, Artificial Sequence
  derived and/or modified sequence opt3 from ZFAT__Homo_sapiens__NP_001025110
augugcaaguguugcaaccuguucagccccaaucaguccgagcuccuuucucacgugucagaaaaacauauggaggaaggcgucaacguugacgagaucauuauaccucugagaccauugaguaccccggaacccccuaauagcuccaagacaggggaugaguuuuuagugaugaaaaggaagcggggacgcccaaaagguucuacuaagaagucgucaacggaggaagaacuggccgaaaacaucguaagccccaccgaggacaguccucuagcuccagaggaaggcaauucccuucccccuucuagccuggaguguuccaaaugcugucgaaaguucucaaacacacgucaacuuagaaaacacauuugcaucauugugcugaauuugggggaagaggaaggagaggcaggcaacgagagugaucucgaacuggagaagaaauguaaggaagacgauagggagaaggccagcaaacggccacgcucucagaagacugaaaaaguccagaagaucuccgguaaagaggcgagacagcugucaggggcuaagaaaccgauaaucagcgugguucucaccgcccaugaggcaauucccggagccacaaagaucgugccugucgaagcuggcccacccgagaccggcgcaacuaauagugaaacaaccucugccgacuuagugccuaggcggggguaccaagaguaugcuauucagcagacgccauacgaacagcccaugaaguccagccgccugggaccgacucaacuuaaaaucuuuaccugcgaguauuguaacaagguauucaaauuuaagcacucguugcaggcccaucugcgaauacacacaaaugagaaaccuuacaagugcccccaguguucuuaugcguccgcaauuaaggccaaccuaaauguucaccucagaaaacauacuggugaaaaguucgcuugcgauuacugcucauuuaccugucugaguaaaggccaccuuaaggugcauaucgagaggguccacaaaaagauuaagcagcacugccgguucuguaaaaagaaauauagcgacgugaagaaccugaucaaacauauccgugaugcccacgacccacaagauaagaaggugaaagaagcauuggacgagcucugccugaugacacgcgaggggaagagacaguuacuguacgauugucauauuugcgaaaggaaauuuaagaaugagcucgaccgggaccgacacaugcuuguccauggagauaaauggccuuucgcuugugaacugugcggccacggugccaccaaguaccaggcguuggagcuacacguucgcaaacaucccuuuguguauguaugugccgugugcagaaagaaguucgucuccucuauaaggcugcggacgcacaucaaagaagugcauggggcagcucaagaggcccucguuuuuacuagcucaauuaaccagaguuucugucugcuugagccaggaggcgacauccagcaggaagcucugggcgaucaauugcagcucguggaggaagaguucgcccugcagggggucaacgcauuaaaggaagaggccugccccggagacacacagcuggaggaaggucgcaaagagccugaagcuccaggcgagaugccggcgcccgcagugcaccuagccuccccucaagcugaaagcaccgcccucccacccugcgagcuggagacuacaguaguuucuucaagugaucuucacagccaggaaguggucuccgacgauuucuugcugaagaaugacaccucuucggcagaggcccaugcugccccugaaaaaccacccgauaugcagcacagaagcuccgugcagacgcaaggggaggucauaacccuccugcuuucaaaggcacagagugcgggaucugaccaggagagccauggcgcucaguccccgcugggugaagggcaaaacauggccguguugucagcaggcgauccugacccaucuaggugucuccguagcaaucccgccgaggcuuccgaccuguuaccucccguugccggaggcggggauacaauuacucaccagccagacaguugcaaggcagcuccugaacaucggagcggaaucaccgccuucaugaaagugcugaacucucuacagaagaaacaaaugaauacaucccucugugagcgaaucagaaagguauacggugaucuggaaugcgaguauuguggcaaacucuuuugguaccagguccacuucgacaugcacgugaggacucauacccgcgagcacuuguauuacugcucacagugucauuauaguagcauuacaaagaacugccugaagcggcacguuauccagaaacauucgaauauucuccugaagugucccaccgaugggugcgacuacuccacuccagauaaauacaaguuacaagcgcaccugaaagugcacacggcccuugacaagagaucuuauagcuguccggucugcgaaaagucauuuagugaggauagguugauaaaaucccauaucaagacaaaccacccugaagugucuaugagcaccauuuccgagguacucggacgccgagugcagcugaaaggccuaaucgguaagcgggcuaugaaaugccccuacugugacuucuauuuuaugaagaaugggucagaucugcagcgucauaucugggcacacgaaggcguuaaaccauucaagugcagccucugugaguacgccacuagaaguaagucuaaccugaaagcucacaugaauaggcauuccaccgagaagacacaccuuugcgacauguguggcaaaaaguuuaaaagcaagggaaccuugaagucgcauaaacuguuacacacugccgaugggaagcaguucaaaugcacagucugugacuauacggcagcgcaaaagccccagcuccugcgccauauggaacagcacgugucauuuaaaccuuuccggugcgcccacugucauuacucuugcaacauuaguggaucccuuaagagacacuauaauaggaagcauccaaacgaggaauacgcuaauguggguaccggcgagcuggccgcagaagucuugauacagcaagggggacucaaaugucccguuugcagcuuuguguacggcacuaagugggaguucaaccgacaccugaaaaacaagcacggucuaaaagugguagagaucgacggggauccuaagugggaaacagcuaccgaggccccggaggagccaucuacacaguaucugcauauuacugaggcagaagaggacguccagggcacccaagccgcuguggcggcccuccaggaucugcgcuacacgagcgaauccggagaccggcuugaucccaccgcaguuaauaucuugcagcagauuaucgagcugggcgcugaaacacacgacgccacugccuuagcuucaguggucgcaauggccccugggaccgugacaguugugaagcaaguaacugaggaggaaccaaguagcaaccauaccgucaugauacaggagacggugcagcaggcgucuguggaacucgcugagcaacaccaucuggucguuuccucagaugacguggaaggaaucgagacaguaaccguguauacucagggcggugaggccagugaauuuauugucuacgugcaggaggcaaugcagcccguugaggaacaagccguggaacagccugcucaggagcuuuga

SEQ ID NO: 65028 - RNA, 5970 nt, Artificial Sequence
  derived and/or modified sequence opt3 from ZFC3H1__Homo_sapiens__NP_659419
auggccaccgcugacacacccgccccugcaagcuccggccugucuccaaaggaggaaggggagcucgaagauggagagaucucagacgaugacaacaauagucagauuagaagcagguccucuucgucaagcagugguggcgggcuucugccguacccccggcgccgaccuccacacuccgcgcguggaggcgguucugggggaggcggcgggagcuccucaaguagcagcuccucacaacagcaguugagaaacuucagcaggagucggcaugcuucugaacgcggacacuuaagaggucccuccagcuauaggccuaaagaaccauuucggucgcaucccccuucugugcgcaugccauccucaagucugagcgaauccucuccgcgacccagcuucugggaaagaucacaccuggcccucgauagguuucgguuccguggccgcccuuacagagggggaaguagguggucccggggccgaggugucggggaacgcggaggcaagccaggcugcagacccccucuagggggaggugcaggcagcggguuuucuucaagucagagcuggagggaaccaucucccccgcggaaaucuucgaaauccuucggacgcuccccuucaagaaaacaaaauuauaguucuaagaacgaaaauuguguugaggaaacuuuugaggaccuucuguugaaguacaaacagauacagcucgaacuggaaugcaucaacaaggaugaaaaacuggcccucagcuccaaggaggagaaugugcaggaagaccccaaaacguuaaacuucgaggaucaaaccucaacagacaauguaagcauuacuaaggauucuuccaaggaaguggcuccagaggagaagacccaggucaagacauuucaggcauucgagcugaaaccucuuaggcagaaguugacccugcccggcgacaaaaaccgucuaaagaaagugaaggauggugccaagccacucagucugaaaagcgacacuacagacucuucccaagggcuucaggauaaggagcagaaucugacccggcgaaucucaacgagugacauuuugagcgagaaaaagcucggcgaggaugaagaggaacugucggaguuacaacugagacuccuugcucugcaguccgccucuaaaaaguggcagcagaaggagcaacagguuaugaaagaaagcaaggagaaauugacuaagaccaaaacagugcagcagaaggucaagacuucaaccaaaacacauagugcgaagaaaguguccaccacggcaaagcaagcccuaaggaaacagcagacuaaggcuuggaagaaacugcagcaacagaaggaacaggagcgccagaaagaggaagaccaacggaagcaggccgaggaagaggaaagaaggaaacgcgaggaggaaauccgaaagauacgggaucucucuaaccaggaggaacaauauaaucguuuuaugaaacugguaggaggcaagagaaggagccgcuccaagucaagcgaccccgaucuucggagaagucuggacaaacagccuacagauucugggggagguaucuaccaguaugacaacuacgaggaaguugcaauggauaccgacuccgagacuagcucgccagcuccgucacccgugcagccuccauucuuuucugaguguaguuugggcuacuucucccccgccccuagccucucucugccacccccgccucaagucagcuccuuaccaccccugucacagccuuauguggaagggcuaugcgugagucucgagccccugccaccucuucccccauugccgccucugcccccagaagaccccgagcagccuccaaagcccccuuucgcggaugaagaggaggaagaggaaaugcuccugagggaggagcuucugaagucuuuggccaauaagcgagcauuuaaaccggaagagacaagcuccaacucagacccacccaguccuccaguccucaacaauagccaccccguuccucgcuccaaccugucuauugugucgaucaauaccguaagccagccgcggauucaaaaccccaaguuccacagaggaccaagguuaccucguacggugaucucacugcccaagcauaaauccgucgugguuacccuaaaugauagugacgauucugaaagcgacggcgaggcuuccaagucaacaaacucuguguuuggugggcucgaaagcaugauaaaagaggcccgccggacugcugagcaggccaguaagccaaaagucccucccaaguccgaaaaggagaaugauccacugagaaccccggaagcacuuccugaggagaaaaagauugaguacagguugcugaaagaggaaaucgccaaccgagagaagcagcggcucauuaaaagcgaccagcugaagacaucuucauccagucccgcuaauagcgauguggaaaucgacggcaucggacgcauugcgaugguaacuaagcaaguuaccgaugcagagucgaaauuaaagaaacacagaauacugcuuaugaaggacgaaucuguguugaaaaaccucguccagcaggaggccaagaaaaaggaguccgugaggaaugcugaagccaagaucacaaaacugaccgagcaacuacaggcaacugaaaagauucugaacgucaaucggauguuccucaaaaagcugcaggagcagauccaucgagugcaacagagaguuacgaucaaaaaggcccuuacauugaaguauggcgaggaacuggcucgcgccaaagcaguggcgagcaaggagauugggaaaaggaaguuagaacaggaucguuuuggaccaaacaaaaugaugcggcucgacucaagucccguaucuuccccuagaaagcacagcgcugagcugaucgccauggaaaagaggcgccuucagaaacuggaguacgaguaugcauugaagauccaaaaacucaaggaagcccgagcucugaaagccaaggagcagcagaauauuucaccagucguggaagaggaacccgaguucagucuaccucagccgagccugcacgaccucacccaagauaagcugacucuugacaccgaggaaaacgauguugacgaugagaucuuguccgguucuagcagagaacggaggcgcuccuuucuggagucaaacuacuucacaaaaccaaauuuaaagcauaccgacacugcaaacaaagaauguauuaauaagcucaacaaaaauacaguggagaagcccgagcuguuucuuggccugaagauaggggaacuacagaaacucuauucuaaggcugauagucugaaacaguugauccugaagacgaccacuggaauuacagagaaagucuuacacggccaggaaaucucgguggacguagauuucgugaccgcccaaagcaagacaauggagguuaaaccuugccccuuucguccauaccauuccccucuccuggucuucaagucuuacagauuuucacccuauuaccggacuaaggagaaacuuccacugagcuccgugaguuauucuaacaugaucgaaccugaccaguguuucugcagguucgauuugaccgguacguguaaugacgaugacugccaguggcaacacauucaggacuacacccucagccgcaagcagcuguuucaggauauacuaucauauaaccugucccuuaucgggugugcggagacaaguacuaaugaagagauuaccgccagcgcugaaaaauacguggagaaacucuucggcgucaacaaagaccgaaugucuauggaucaaauggcaguucuguugguguccaauaucaacgagucaaagggacauacaccgcccuuuacuaccuauaaggacaaaagaaaguggaaaccaaaguucuggcggaaaccuauuagcgauaauucguuuucuagugacgaagaacaguccacgggccccaucaaguacgccuuccagccagaaaaccagauaaaugugccugcucuggauacaguagucacccccgacgaugugagguacuuuacuaacgagacagacgauaucgccaacuuagaagcaagcguucucgagaauccgucacacgugcaacuguggcuuaagcuggcguauaaauacuugaaccagaaugagggggaaugcuccgagucucucgacagcgcccugaacguccuagcucgcgcccuggaaaauaacaaggacaauccagagauuuggugccacuaucuuagacucuucaguaaaaggggaaccaaggaugaagugcaggagaugugugagacugcaguugaauacgcuccugacuaucaguccuuuuggaccuuccugcauuuggagagcacauuugaagagaaagauuacgugugcgagcggauguuagaguuccugaugggcgccgcaaagcaagagacgucuaacauccucucauuucagcugcuugaagcccuguuguuccguguacagcuacacauuuucaccggucgcugucaaagugcucuggcgauccuccagaaugcccugaaguccgcaaacgacgggauagucgcugaguaucuuaaaacuagcgaucgaugcuuagccuggcuggccuacauucaucucaucgaauuuaauauuuugcccucuaaguucuacgacccaucgaacgauaaucccucaagaaucgugaacacagagagcuuugugaugccuuggcaggcuguccaggacguuaaaaccaauccggauaugcugcucgcaguguucgaggacgccguaaaggcguguacagaugaaucccuggcuguggaggaaaggauagaggccugccuuccccuguauacuaacaugaucgcauugcaccaacuacuggaacgguacgaggccgcuauggagcucuguaaaaguuuacuggaaucuugcccaauuaacugucagcuucuggaggcacucgucgccuuguaucugcagaccaaucagcacgacaaggcgcgcgcuguguggcucacggccuuugagaaaaacccucaaaaugcagagguuuucuaccauaugugcaaguuuuucauccugcagaacagaggagauaaucuucuacccuuucugaggaaguucauugccagcuuuuucaaaccuggcuucgaaaaguauaacaauuuggacuuauuucgguaccugcucaacaucccaggucccauagacauuccuucccgacuguguaaaggcaauuucgaugacgauauguuuaaccaccaggugccauaucuuuggcugaucuacugccucugccaucccuugcagucaaguaucaaggagacagucgaggcuuacgaagccgcacuggggguggcuaugagaugugacauuguucagaaaauauggauggauuaucuaguguucgccaauaaccgcgcggccggaucuaggaauaagguccaagaguuuaaguucuuuaccgaccugguaaaccggugccucgugacuguuccggcacguuacccuauuccauucagcuccgcugauuauuggucaaauuacgaauuucacaacagagugauauucuuuuaucuuagcuguguccccaaaacccagcauucuaagacacuggagagguucugcuccgugaugccugccaauaguggcuuagcuuugcgccugcuccagcacgagugggaagagagcaacguacaaauccugaaacuucaggcaaagauguuuacuuacaacauuccaaccugucuggccacauggaaaaucgccauugcugcggaaaucgugcucaaggggcagcgggagguccaccgauuguaucaaagagcacugcagaaguuaccccuaugcgccucgcuguggaaagaccagcuccuuuucgaggcuuccgagggaggcaagacggauaaucugaggaaauugguuucuaagugucaggagauaggugugucacugaacgaacuccugaaucuuaacagcaauaaaaccgagaguaagaaccauuga

SEQ ID NO: 65029 - RNA, 4569 nt, Artificial Sequence
  derived and/or modified sequence opt3 from ZFHX2__Homo_sapiens__XP_006720345
augaccuucacaacuaaggugcugagcgcccccacgcucuccccucuugacaacggccaggagccaccgacccacgggcccgaaccuacaccaucuagagaucaagcugcagagggacccaaucugacuccugaagccucaccagaccccuugccugagccaccguuagcgagugucgaaguucccgauaaaccuagcgguuccccaggccagcccccuucuccagcucccucgccggugccugagcccgacgcccaggcagaggauguagccccaccucccaccauggcugaagaggaagaggggacaaccggagagcugaggucagcagaaccagcccccgcugacagccggcauccucuaacuuaccgcaagacaaccaacuuugcccucgauaaauuccuggacccagcgcgaccguauaagugcacgguguguaaagagaguuuuacucagaagaauauccuucugguccacuacaacuccgugucucauuugcacaagaugaaaaaggcagccauugaucccagcgcuccugcccguggcgaagccggugcuccacccaccacaacugccgcgaccgacaaaccuuucaagugcacaguuuguagaguguccuauaaucaaucaaguacccucgagauacauaugaggagcguccugcaccagacgcggucucgcgggacuaaaacagauuccaagaucgaaggaccagagagaucacaggaggaacccaaggagggcgaaaccgagggcgaaguggggacugagaaaaagggaccggacacaagcgguuuuauuaguggccugccuuuccucucuccacccccucccccauuagaucugcacagguuuccugcaccccuuuucaccccaccgguauugccucccuuuccacugguucccgagucccuacucaaacugcagcaacagcagcuucuguugccuuucuaccuccaugaccugaagguggggccaaaauuaacgcuggcaggacccgcuccuguccucagccuuccggccgcuaccccacccccuccaccccagccuccgaaggccgaacuggcagagcgggaaugggagcgacccccaauggccaaagaaggcaacgaggcugguccuucgucucccccagacccuuugcccaaugaggcggcacgcacagccgcuaaggcccuacuggaaaacuuuggguucgagcucgugauccaauauaaugaaggaaagcaggcagugccaccgccucccacuccacccccuccagaggcccugggcggcggggauaaacuugcuugcggagccugugguaagcuguuuuccaacauguugauucucaaaacccacgaggaacauguccacagaagguuccugcccuucgaggcauuaucacgguacgcggcucaguuucguaagaguuaugacagccuguacccuccgcuagccgaaccacccaaaccucccgauggcucccucgacucuccaguuccucaccuggggcccccauuccuugugccugagccggaagcaggaggcacacgcgcccccgaggagagaagcagggcuggugggcauuggccaaucgaagaggaagagucaagucggggcaauuugccuccccugguaccagccggacgacgcuuuuccagaacuaaguucaccgaauuucaaacacaggcacuccagagcuucuuugagaccucugcuuacccuaaggauggcgagguggaaaggcuggccucacuucugggguuggcgagucgggucgugguugugugguuccagaacgcccgccaaaaagcuagaaagaaugcaugcgagggagguagcaugcccacuggcgggggaacgggcggugccuccggguguaggcguugccacgcuacauuuucuugugucuucgaacucgugcggcaucugaaaaagugcuaugacgaucagaccuuagaggaagaggaggaagaggccgaacgaggcgaggaggaagaggaaguagaggaagaggagguugaagaggaacagggacuggagccgccagcaggcccugaagggccccuaccagagcccccugacggagaggaacucucgcaggcggaggccacuaaagcugguggcaaggaaccggaggaaaaggccacccccagcccauccccugcacacacaugugaucaaugcgcuauaucauuuaguucucaggaccugcuuaccagccauagaagguugcacuuccugcccucccuccagccuucagccccaccccagcuguuagaucugccucuuuugguguuuggggagcgcaacccacucgucgcagccacuagccccaugccgggaccuccacugaaacggaagcacgaggacggcucucuaucccccacagguagugaagcugggggcggaggcgagggggaaccuccaagagacaaaaggcugcgcacgaccauccuccccgagcaacuggagauucuuuaccgaugguauaugcaggauagcaauccgacucggaagauguuggacugcaucucugaagaggugggacugaaaaagcgugucgugcagguuugguuccagaacacaagagcgagggaacgcaagggccaauuccgguccaccccugguggggugcccucaccagccguaaaaccucccgcaacagcuacuccagccaguuuacccaaguuuaaccuccugcuuggaaaagucgaugacggcaccgguagagaggccccuaagagggaagcuccagcauucccguaccccacggccacccuggcgagcggcccucagccauuuuugcccccugggaaagaggcuacaacuccaacccccgagccuccgcucccacugcuacccccucccccaccuucggaagaggaaggacccgaggaaccaccgaaggccuccccugagucugaggcauguagccugucagccggcgaucucagugacuccucugcuagcucccuggcagaacccgagucaccaggggccggaggcacaagcggugggcccggaggcgguacuggcgugccugaugggaugggacagcgacgcuaucggacccaaaugaguucucuucaguugaaaauuaugaaggcgugcuacgaagccuauagaacgccaacaaugcaggagugugaaguucugggcgaggagaucggguuacccaagagggugauacaggucugguuccaaaaugcccgugcaaaagaaaagaaagccaagcuccagggaaccgcugccggcuccacuggugggagcucggagggacugcuugcagcucagcgcacagacugcccuuacugugaugugaaauacgacuuuuauguaucaugccggggccaucuguucucuagacagcaccuagccaagcucaaggaagcggugagggcccaacugaaaagugaguccaaguguuacgauuuggcaccggcuccagaggcucccccugcucugaaagcaccacccgccaccacuccugccagcaugcccuuaggugcugcgccaacccucccgcgacuggcaccuguucuucugucuggccccgccuuggcucagccaccucucgggaaccuggcccccuuuaauagcggaccagcagccuccucaggccuacuggggcuugcuacaaguguccucccuacgaccacuguggugcagacagcgggacccggccggccgcugccacagcgcccuaugcccgaccaaaccaacacaagcacugccgguaccacggauccaguccccgggccuccgacagaaccauugggagacaagguuucuuccgagagaaaacccguggcaggcccuaccucaaguagcaaugacgcucugaagaacuuaaaggcccucaaaacuaccgugcccgcacugcuuggcgggcaguuccugccauuuccuuugcccccagccggagguacagcuccuccggccguauucggcccccagcuccaaggggcguauuuucagcagcuguacggaaugaagaaaggccuauucccaaugaauccuaugauuccccagacucugaucggucuucucccaaacgcacuguugcaaccucccccgcagccaccugaacccaccgccacagcuccacccaagccucccgaguuaccagccccuggggaaggagaggcuggcgaggucgaugaacugcucacgggcuccaccgggauuucuacuguggacguuacacauagguaucugugccggcaguguaaaauggcauuugauggagaggccccggcuaccgcccaccagcgaucguucugcuucuuugguagaggcagcgggggaucaaugcccccaccucuucgcgugcccaucuguacuuaccacugccuggcaugcgaagucuugcuauccggcagggaggcgcuggccagucaucuccguucuagcgcucaccggagaaaggccgcaccaccucaaggugggcccccgaucuccauuacaaaugcugccaccgcagccucagcugcgguggccuucgcaaaggaagaggcuaggcugccucauacggacucuaacccaaaaacuaccacaaccagcacucuuuuagcccuguga

SEQ ID NO: 65030 - RNA, 8370 nt, Artificial Sequence
  derived and/or modified sequence opt3 from ZFHX3__Homo_sapiens__NP_001158238
augcggcugggcgggggacagcucgugagcgaggaacuuaugaaccugggugaguccuucauacagaccaaugaccccucuuugaaguuauuucagugugccgucuguaacaaauucacaacugauaaucuggacaugcuaggccuccacaugaacguugaaaggucacugagcgaggaugaauggaaggcugugaugggggacagcuaccagugcaaacuuugucgguauaauacgcagcugaaggcaaacuuucaauugcacugcaaaaccgauaagcacguacagaaguaccagcucguggcccauauuaaagagggaggcaaggcgaaugaguggcgccugaaaugugucgcuauagguaacccugugcaccugaagugcaaugccugugacuauuacacaaacucccucgaaaaauuacgacugcauacuguuaauucucgucacgaggcaucgcuuaaguuguauaagcaucugcaacaacacgaaucagggguggagggagagagcugcuacuaucacuguguccuaugcaacuacaguaccaaagccaagcucaaucugauccagcaugugagauccaugaaacaccagaggucugaaagccuucggaagcugcagcgcuugcaaaaaggccucccagaggaagaugaggaccugggccagauuuucacaaucagaagguguccguccaccgaucccgaagaggcuauugaggacguagaagggccuucagagacugcagccgauccagaagaguuagcuaaggaccaggaaggaggugccaguagcucucaagcggagaaagagcugacagauucccccgcaaccucaaagcggaucagcuuuccuggcaguucugaauccccacucagcucgaagcgccccaaaacggccgaggaaauaaagccugagcagauguaccagugcccauauugcaaauacucuaacgcugacguuaaucgacuuagagugcacgccaugacucagcauuccguccaaccgaugcugaggugucccuugugccaggacaugcuaaacaacaagauccaucugcagcuccaucugacccaccuucauucaguggcaccugauuguguggaaaaacugauuaugacagucacuaccccagagaugguuaugcccaguagcauguucuugccugcugccgugccagaccgggaugggaacuccaaccucgaggaagcgggaaagcagcccgagacaucugaagaccugggcaagaauaucuuaccgagcgccucaaccgagcaaaguggugaucugaaaccuucccccgcagacccagggagcguacgugaggauucuggauuuauuugcuggaagaaaggcuguaaccagguguucaagacgucagcugcccuacagacucacuuuaaugaaguccacgcuaaacgcccucagcuccccgugagugacagacauguuuauaaguacaggugcaaccaauguagccuggccuucaagacaaucgagaaacuucaguugcacucccaguaucaugugauacgggcagccaccaugugcugucugugccagcgaucuuuucgcacuuuccaagcucucaagaaacaccuggaaacaucgcaccuugagcugagcgaagcggauauucagcaguuguacggcgggcuccuggcaaauggagacuuacuggccaugggugauccaacccuagcugaggaccauacgaucauugucgaggaagacaaggaggaagaguccgaucucgaagacaaacaaucacccaccggcagugauucugggagcgugcaggaggacuccggaucagagccuaagagagcccugccauuuaggaagggcccgaacuucacaauggaaaaauuccuugaucccagccggccuuauaaguguacuguaugcaaagagucuuuuacccagaagaauaucuugcugguucacuacaacuccgugagucaucuccacaaacugaagcgcgcauuacaggaaagcgccacaggucaaccagagcccacuucuuccccugacaauaaaccauucaagugcaacaccuguaaugucgcuuacucacagaguagcacacuggaaauccauaugagaucggugcuucaccagaccaaggccagggcagcgaaauuggaggcugccuccgggucuagcaacggcacuggaaauucaaguuccauuucucucagcuccucaacgcccagcccggucaguacaucuggcuccaacaccuuuacuaccagcaacccuucgucagcagggauagccccaucuaguaaucugcuaucccaggugcccacagagagcguuggaaugccuccccuggguaacccaaucggcgcuaauauugccucuccuagcgaacccaaggaggcaaaccguaaaaagcucgcugauaugaucgccucccggcaacagcagcagcaacagcagcaacagcagcagcaacagcagcagcaacagcagcaggcgcaaacccuggcccaggcucaggcacaggugcaagcccaccuucagcaggaauugcaacagcaggcugcccugauacagucacaauuauucaauccaacucuccugccgcauuuuccuaugacaacggagacccuucugcaguugcagcagcaacagcaccuccuguuccccuuuuauauuccaagugcagaguuccagcuaaaccccgaaguaagccugccugucacuucuggggcgcucacacugaccggaacaggcccaggucuuuuggaggaccugaaagcccaggugcaaguuccccagcagucccaucaacagaucuuaccucagcagcaacagaaucagcucucaaucgcucagagucacagcgcccugcuucaaccgucccagcauccagaaaagaagaacaaacuggugauuaaggagaaagaaaaggagucucagcgagagagagauucggcagaagggggcgagggaaauacuggccccaaagaaacccuaccugacgcucucaaggccaaggagaaaaaggaacuggcaccagggggagguagcgagcccucaauguugccuccgaggaucgccuccgaugcucgcggcaacgcgacgaaagcccuguuagagaauuuuggguucgaacucgucauucaguacaacgagaauaagcaaaaagugcagaagaagaacggaaaaaccgaccagggcgaaaaucuggagaaacuugaaugcgauaguugugguaaacuguuuucuaacauauugauccucaagagccaccaggagcacguacaucaaaacuauuuccccuuuaaacagcuggagcgguucgcaaagcaguacagagaccacuaugacaaacuauacccacugaggccucaaacacccgaaccaccucccccaccgccucccccacccccuccaccccuuccugcugccccgccacagcccgccuccacuccugcuauucccgcaucagccccaccuaucaccucucccacaaucgcgccagcucagccuagcgugccgcucacucagcugaguaugcccauggaguugccaauuuucuccccucugaugaugcaaaccaugcccuuacagacgcucccagcccagcugccuccccagcuugggccgguugaaccacugccugcagauuuggcccaacucuaucagcaucagcugaaucccacacuacugcagcaacagaacaagcgcccacgaacccggauaacugacgaucagcuucguguccucagacaauacuuugacaucaauaacagccccucugaggagcagauuaaggaaauggcugauaaaucaggccugccucagaaggugaucaaacacugguucaggaauacauuguuuaaggagcgccagcggaacaaagacuccccguacaauuucaguaaucccccaauuaccagcuuagaggaacugaagaucgauucgagaccucccucuccugaaccacccaagcaagaguauuggggauccaaaaggagcucacgaacucgcuuuaccgacuaccagcuccgggugcugcaggauuucuuugacgcaaaugccuauccuaaggaugacgaguucgaacagcuuaguaaccuguugaaucuaccaacaagagucauaguugugugguuucaaaacgcgaggcagaaagcucguaagaauuacgagaaccagggcgaagggaaagauggagagcgccgggaacugacgaaugacagauauaucaggaccucuaaccucaacuaccagugcaagaaguguucccugguguuccaacgaauuuuugaccuuaucaaacaccagaagaaauuaugcuauaaggaugaggacgaggaaggccaggaugacagccaaaaugaggauucaauggacgccauggaaauucugacucccacaaguagcuccuguucuaccccgaugccuagccaggcauacuccgccccagcucccucagccaacaauacagcaucuagugcuuuccuccaguugacugccgaggcggaggaacuggccaccuuuaacucgaaaacggaggcuggugaugaaaagccuaagcucgcugaggccccaagcgcucagcccaaucaaacacaggaaaaacaggggcagccgaagccugagcugcaacagcaggagcagcccgaacagaagaccaacacuccacagcagaaacuuccucagcugguauccuugcccucucuaccacaacccccuccacaggcaccgcccccucagugcccacugccccaaucaagcccuuccccaagucagcucucucauuuaccccugaaaccucuucacaccagcacaccgcagcagcuggccaaucucccaccccaauugaucccuuaccagugugaccagugcaagcuggccuuccccucauucgagcauuggcaggaacaccaacagcuccauuuucuguccgcucagaaccaguucauacacccacaauuucuugaucggagucuagacaugccuuucaugcuguuugaucccagcaauccauuguuagcgucucagcugcucuccggagcaauuccgcagaucccugccucaagcgcuacuucgcccucuaccccaacaaguacgaugaacacccugaagcgcaaacuugaggaaaaggccuccgcaagccccggcgagaaugacucagguacuggcggggaggaaccucaaagagacaaaaggcugcggacaaccauuacuccagagcagcucgaaaucuuguaucagaaguaccugcuagauuccaaccccacacgaaaaaugcuggaccacauagcccaugaggucggacucaagaaaagagugguucaggugugguuccaaaauacccgcgcuagggaacguaagggccaguuucgggcggucgggccugcccaggcacacagaagguguccguucugccgcgcucuuuuuaaggccaaaacggcacuggaggcccauauccgaucuagacacuggcacgaggcuaagcgggccggauauaacuuaacuuugagcgcgaugcugcucgauugcgacggcggucugcagaugaaaggggauauuuucgacggaaccaguuuuucccaucuuccacccaguucuucagauggccaaggugugccucugaguccaguuuccaagacaauggaacucagccccaggaccuugcugucuccuucgucaaucaaaguggagggcauugaagacuucgagagccccuccaugaguucuguaaauuuaaacuucgaucagacuaagcuagacaaugaugacuguagcuccgucaacacagcaaucaccgauacaacuaccggggacgaaggaaacgccgacaaugauucagcuacgggcauagccacagagaccaagaguucuagcgcuccaaacgaggggcugacuaaagcagccaugauggcuauguccgaauacgaggaccgccucucaagcggacuugugucuccggccccuuccuuuuauaguaaggaauacgauaaugagggcaccguggacuauagcgagacaucgucccuggcagaucccugcucuccaucaccuggugcgagcgggagugccggaaaauccggcgacucuggugaucgucccggccagaagagauuccggacucagaugaccaacuugcaacugaaaguccucaagagcuguuuuaaugacuacaggacgccaacaaugcuggaaugcgagguucuugggaacgauauuggacucccuaagcgcgugguacaggugugguuccagaaugcucgagccaaagaaaagaaaucaaagcuguccauggcaaaacacuuuggcaucaaccagaccaguuacgaggggcccaagacugaauguacauugugcggaaucaaguauagcgcuagacugucuguccgggaccauauuuucucacaacagcacaucuccaaagugaaggauaccauuggcagccaguuagacaaagagaaggaguacuuugauccggccacuguuaggcaacuaauggcacagcaggaacuggaccgcaucaagaaggccaaugaggugcucggucuugcugcgcagcaacaggggauguucgacaacacaccacugcaggccuugaaucugccuaccgcauaucccgcucuccagggaaucccacccguccugcuuccuggcuuaaacucuccgagucugccaggcuuuacgcccucgaauacugcccucaccuccccuaaacccaacuugauggggcugccaagcacaaccgugccuucacccggacuaccaacaucuggucugccuaauaagccgagcuccgccagucucucaucucccacuccagcacaagcuaccauggccaugggcccucagcagcccccacagcaacagcagcaacagcagcagccucaaguucagcagcccccgccaccucccgcggcucagccacccccuacgccccaacuuccacugcagcagcagcaacagagaaaggauaaagacagcgaaaaggugaaagagaaggaaaaagcccauaaggggaagggagagccuuugccgguccccaaaaaggagaaaggcgaagcaccaacagccacugcugcaaccauuuccgccccucugcccacaauggaguacgcgguagauccagcucagcuccaagcccugcaggcagccuuaaccagugacccuacugcacuucugaccagccaguuccuccccuauuuugugccggguuucuccccuuacuaugccccacagauccccggggcacuacaaucuggauaccugcagccuauguacggcauggaaggcuuguuuccauauucacccgcucugagccaggcccucauggggcuuucgccuggaucccuguugcagcaauaccagcaguaucagcaaagucugcaggaggcgauucagcagcaacagcagaggcaacuccagcagcagcaacagcagaagguucagcaacagcagccaaaagccucucagacacccgugccgccuggugcacccagcccagauaaggaccccgcuaaggaaucaccuaaaccagaggagcaaaagaacacgccccgggaagucuccccuuuacugccaaaacuuccggaggaacccgaggccgagucuaagagugcagauagccuguacgacccuuucaucgugccaaaaguacaguauaagcuagugugucguaagugccaggcuggcuucuccgaugaagaggccgcccgcucacaccucaaaagccugugcuuuuucgggcaaucugucguuaacuugcaggaaauggugcugcacgugcccacuggaggcggugggggaggcaguggcgggggagguggcgggggaggcggugggggaggcggcggguccuaccauugccucgcgugugagagcgcucuuugcggagaagaggcacugucacagcacuuagagucugcccugcauaagcaccgaaccauaacaagagcugccaggaaugcaaaagaacacccuuccuugcucccacauucggccugcuuucccgacccgagcaccgcuaguacuucucaguccgcggcccacagcaacgauucaccuccacccccuagugcagcugcccccuccagcgcaucuccacaugccucaagaaagagcuggccgcaagucgugucccgcgcuucugccgcgaaaccucccaguuucccaccccugucgagcuccucaacaguuaccucuagcaguuguuccacgucagguguacagccuucuaugccaacugacgacuauagcgaggaauccgauacagaccuaagucaaaagagcgauggccccgcaucuccuguggaggggccaaaagacccgucaugccccaaggauuccggacuuaccagcgucggcaccgacacuuuuagacuguga

SEQ ID NO: 65031 - RNA, 10851 nt, Artificial Sequence
  derived and/or modified sequence opt3 from ZFHX4__Homo_sapiens__XP_011515897
auggagaccugcgacagucccccuaucuccagacaggaaaacggccaaucuacaucaaagcugugugggacuacgcagcucgacaaugaggugccagaaaaagucgccggaauggagccggacagggaaaacagcagcaccgaugacaaucuuaagaccgaugagcggaaauccgaggcucuguuggguuucucuguugaaaacgcagccgcgacucaggugaccucggcuaaggagauucccugcaaugaaugcgccacaucauuuccuagcuuacagaaauacauggagcaccauugcccaaacgcacgccugcccguauuaaaggacgauaaugagagcgaaauauccgagcucgaagacucugauguggagaaccugaccggcgaaaucgucuaucagccugacgggagcgccuacauuaucgaggauuccaaggagucaggacagaaugcucagacuggcgcaaacaguaaacuuuucagcacagccauguuucuggacucuuuggcuuccgccggugaaaagucagaucagagcgcgagugcaccaaugucuuucuauccccaaauuaucaauaccuuucacauagccuccagccucgggaaaccuuucacggcugaccaggccuuuccaaacacuucggcacuggcuggagugggcccgguucugcauucuuuccgaguguacgaccuccgucacaagcgcgagaaagauuauuuaaccuccgacggcucagccaagaauaguugugucagcaaggaugugcccaacaauguagaccuguccaaauuugaugggugcguuucugacggaaagaggaaaccugugcuuauguguuucuugugcaagcugagcuuugguuacauccggucauucgucacacaugcggugcacgaucaccgcaugacucuuaacgacgaagaacagaaacuccugaguaacaaguguguguccgccauuauccagggcauugggaaagauaaggaaccacuuaucagcuuucuggagcccaagaaaucuaccucagucuauccucauuucaguacaaccaauuugauaggaccagaccccacguuccggggccucuggagcgcauuucacguugagaacggugauucccugccggcuggguucgccuuuuuaaagggaucugcuucgacuagcuccucagccgaacaaccucugggcauuacacagaugcccaaagcagaggugaaucucggcgggcuuaguucucugguagugaacaccccaaucacuagcgucuccuugucacauaguucuuccgaaaguagcaagaugucugaguccaaagaccaggaaaauaacugcgagaggccuaaggagucaaaugugcugcaccccaacggagaauguccaguuaagagugagcccacagaaccuggugacgaggaugaggaagacgccuacagcaaugagcuggaugacgaagaggugcucggcgaacugaccgauucgauugggaacaaagacuucccacuucugaaucaauccaucucuccguugagcucaaguguccucaaguuuaucgagaaaggaacguccucuagcuccgcuaccgugucagaugacacagagaagaaaaagcagacugcggcaguacgggccagcggcaguguugcuucuaacuacgguauuuccgggaaggauuucgccgacgcaagcgccucgaaagauucagcuaccgccgcacaccccucugaaauagcgcgcggcgacgaggauaguuccgcuacaccucaucagcacggauuuacuccaagcacccccggcacaccugggccaggaggugacggcucucccgggagcggaaucgaaugcccgaagugcgacaccgugcugggcuccucacgaaguuuaggugggcauaugacuaugaugcacagcagaaauucuuguaaaacgcugaagugcccuaaauguaacuggcauuauaaguaccagcaaacacuagaggcccacaugaaggaaaaacacccagagcccggcggauccugcgucuauuguaagaccggccagccucaucccaggcucgcaagaggggaaucauacacuugcggauauaaaccauuccguugugaagugugcaauuacaguaccacaaccaaggguaaccugagcauucacaugcaguccgauaaacaucuuaacaauguccagaacuugcaaaauggcaacggggaacagguguuuggacacucugccccugcucccaauacuucgcugagcggcugugguacaccaucaccguccaagccuaaacagaagcccacguggcgcugcgaaguuugugacuaugagaccaacguggccagaaaucucaggauccacaugacaagcgaaaagcauaugcacaacaugaugcugcuucagcaaaauaugaaacagauacagcauaaccugcacuuggggcucgcaccagcugaggccgagcuguaccaguacuauuuagcgcaaaauauuggccugacaggaaugaagcuagaaaaccccgccgauccucagcucaugaucaauccauuccagcuggaccccgcuaccgcagccgcucuugccccuggcuugguaaacaaugagcugccgccagaaauccggcucgcaucugggcaacugaugggagaugacuuaagccugcuuacagcgggcgaguugucccccuacauuucagauccugcccucaaacuguuucagugcgcugucugcaacaaguucacuucugacagccuagaggcccugagugugcauguuuccagcgaacgaucucucccagaggaagaguggcgcgcagugaucggugauauuuaucaguguaaacugugcaacuacaauacccagcuuaaggcuaacuuucaauugcacuguaagacggacaaacacaugcagaaguaucagcuggucgcccauauaaaagaagggggaaagucaaaugaguggagauuaaaaugcaucgcaauuggcaaccccgugcaccucaaguguaaugccugcgauuacuauaccaacuccguagacaagcugaggcuucauacaacuaaucaccggcaugaggcugcgcugaaauuguacaagcaccuccagaaacaagaaggugccgugaacccugagaguuguuacuauuacugcgcaguuugugauuauaccacaaaggucaaacugaaucuagugcagcacgugcgcagcgucaagcaucagcagacugaaggccugagaaagcuccaacugcaccagcaggggcuugcuccggaggaagacaacuugucggagaucuucuucguuaaagacugucccccaaaugagcuggaaaccgccucuuuaggagccaggacgugugaugacgaucucacagagcaacagcugcguuccaccagcgaggaacagucagaagaggcugagggcgcaaucaagccuacugccguggcggaagacgaugagaaagacacaagugaacgggauaacucugaggggaaaaauuccaacaaagacagcggaauuauaacccccgagaaggaacuuaaagugucaguagcuggcgguacucagccacugcuacucgccaaggaggaagaugucgcaaccaagcgaaguaaaccuacagaggacaauaaguuuugccaugaacaauucuaccagugccccuauuguaacuacaacagcagagaucaguccaggauccagaugcacgugcugucucaacacagcguucagccagugauuugcuguccguugugccaggacguccuguccaauaaaaugcauuuacagcuccaccugacgcaucuucacucagugucuccugacuguguugagaagcuguugaugaccgugcccguaccagaugucaugaugcccaacaguaugcuccugccugccgcugcaucggagaaaagcgaacgcgacacuccagccgcggugacagcugagggguccggaaaguauucuggcgaaucacccauggaugacaagagcauggccggucuagaggauuccaaagcaaauguggaagucaagaacgaggagcaaaaaccuaccaaggaaccgcuggagguuagugaauggaauaaaaacucuagcaaggacgugaagaucccagauacacuucaggaccagcucaaugagcagcaaaaacggcagccccugucaguauccgauagacauguguacaaguacaggugcaaccacuguaguuuggccuuuaaaacuaugcagaagcugcaaauucacagccaguaucaugcuauccgcgccgcaaccaugugcaauuuaugucagcgaucuuuccggacguuucaggcucucaaaaagcaccuggaagccggccauccugagcuuuccgaggcggaacugcaacaguuguacgccucacuccccgucaacggggagcugugggcagaaagcgagacaaugucgcaggacgaucacggacuagagcaggaaauggagcgugaauaugagguggaccacgaaggcaaggcuucuccaguugggagugauuccagcucaauaccugacgacaugggauccgagcccaaaagaacccugccauucaggaagggcccuaauuuuacuauggagaaauuccuugauccgucucgccccuacaagugcaccguguguaaagagagcuucacacaaaagaacauccuccugguccauuauaauagugugucccacuugcauaagcuaaagaagguucugcaggaagccagcucuccagugccucaggaaacuaacucaaauaccgacaacaaacccuacaagugcaguauuugcaaugucgcuuauucccagagcucuacacucgagauccacaugcggucgguacugcaucaaacgaaagcaagagccgccaaacuugaaccaucaggucacguggcugggggacacagcauugcggcaaacguuaacuccccuggccaggguaugcuggauaguaugucuuuggccgcugugaauagcaaagacacccaucuagaugccaaggagcugaacaagaaacagacucccgaccucaucuccgcacaaccggcccaccauccaccucagucacccgcucagauacagaugcaacugcagcacgagcuucagcagcaagcggccuucuuucagccacaguucuuaaaucccgcauuucugccucacuucccgaugacacccgaagcucucuugcaguuccaacagccacaguuucuguucccuuuuuacauucccggcaccgaguucagucucgggccugaucugggacuuccaggcucugccacuuuugggaugcccggaaugacaggcauggcagguagccuguuggaagaccuaaagcagcaaauccagacccagcaucacgucgggcaaacgcagcugcagauucuccagcaacaggcccagcaguaccaagcuacucagccucaguuacagccacaaaaacagcagcaacagcccccgccuccacagcagcaacagcagcagcaagccuccaagcugcuuaaacaggagcagucaaacaucgugagcgcggauugucagauaaugaaggacguacccucuuauaaggaagcagaggauaucuccgagaaaccugaaaagccaaaacaagaguucauuagugaaggagagggccugaaggagggcaaagacaccaagaagcagaaaagccucgaacccucgaucccgccucccaggauugccuccggggcucgaggaaaugccgcuaaggcauugcuggagaacuuugguuucgaacucgugauccaguacaaugagaaccgccaaaaaguccagaagaaaggcaagucuggggaaggagagaauacagauaagcuggagugcggcaccugugguaaacuauuuucaaacguucuaauacuaaagagccaucaggaacacgugcaugggcaguucuuuccauaugccgcuuuggagaaauucgcccggcaauacagagaagcauaugacaaguuauacccuauuagucccuccucuccagagacucccccuccaccgcccccuccacccccucugccacccgcgccuccgcagccaagcucaaugggacccgugaaaaucccuaauacagucuccacaccccuccaggccccaccucccacaccaccgccucccccacccccuccacccccuccgccacccccuccacccccucccccaccgagugcuccuccccaggugcaacugccaguuagccuugaccugccucucuuccccucuaucaugaugcagccaguacagcacccugccuugcccccgcagcuggcacuacaacugccacagauggaugcucucucagccgaccuuacucagcugugccagcaacaguuaggcuuggauccuaacuuucugaggcacucccaguucaagcguccccgcacccggauuacggacgaucaacucaaaauccugagagcauauuuugacauuaauaacagcccaucugaggaacagauacaggagauggccgaaaagaguggccuuucgcagaaggugaucaaacauugguucaggaauacacuguuuaaggagcgacaacggaacaaagauucccccuacaacuucagcaauccuccgauuaccguccucgaagacauccgcauugauccacagcccacuucauuggagcacuacaagucugacgcuagcuuuuccaaaagaaguucaaggacccgguucacagauuaucagcugcgaguguuacaggacuuuuucgacacuaacgcguacccuaaggaugacgaaaucgagcaacuaucuaccguucugaaucuccccacgagagugauagucgugugguuucagaacgcccgccagaaggcaaggaaaagcuaugagaaucaggcugaaacaaaggauaacgagaaacgugaacuuaccaaugagcgguacaucagaacuuccaacaugcaauaucaguguaagaaaugcaauguagucuucccaaggauuuuugaccugaucacacaucagaagaagcaauguuacaaagaugaggacgaugacgcccaggaugaaagucagaccgaggacagcauggaugccacugaccaggugguuuauaagcacugcacaguguccgggcaaaccgaugcagcuaaaaacgccgcggcuccugccgcaucuucaggaagcgguacgucgacucccuugauuccauccccuaagccggaacccgagaaaaccaguccaaagccugaauaccccgccgagaagccaaaacagucugacccuagucccccgucacagggcacaaagccagcucugccucucgcauccaccucuagugaucccccacaggccagcacagcgcaaccccagccucagccccagccaccuaaacaaccgcagcugaucgggagacccccauccgcuucacagacuccuguccccagcucuccacuucagauaaguaugaccucccuccaaaauagccugccuccccaguugcugcaguaccaaugugaucagugcacgguggccuucccgacauuagagcuauggcaggaacaucagcacaugcacuuccuggcagcccaaaaccaguuucuccauucaccuuuccuugagcgaccaauggacaugcccuauaugauuuuugauccuaauaacccacugaugacuggacaguugcugggaucuucccucacccagaugcccccucaggcuucgagcagucacacaaccgccccaacuaccguugcagcuucucugaagagaaaacuugacgauaaggaagacaauaacuguuccgagaaagaaggugggaacagcggagaggaucagcaucgggacaagagguuacgcacaacgaucacucccgagcagcuggaaauccucuacgagaaguauuugcuggauucaaauccgacccguaaaaugcuagaccacauugccagagaagugggccugaagaaacgggucgugcagguaugguuccaaaacacaagggcgcgcgagcgaaagggccaguuuagagccguggggccugcacagagucacaaacggugccccuucugcagggcucucuuuaaggccaaguccgcacuugaaagccauauacgcucuagacacuggaaugagggaaaacaagcugguuacucacugccacccagcccuuugaucuccaccgaggauggcggggaaucuccacagaaguauauuuacuucgacuaucccagucugccucucacuaaaaucgaccugucgagcgagaacgaauuagccuccacaguuucaaccccagucucuaagacggccgagcuuagcccgaaaaaucugcucagucccuccucauuuaaggcggaguguucugaagauguggagaaccuaaaugcuccuccagcagaagccggauacgaccagaacaagacugauuucgacgagacaagcuccauuaauaccgcuaucagugaugccaccacuggcgacgaagguaacacagagauggagagcaccacagggucuucaggagaugugaaacccgcacuguccccuaaggaaccaaaaacuuuggacacgcugcccaagccggccaccacaccuacuaccgaggucugcgaugacaaauuucucuucagccuuacaaguccaucuauacauuuuaaugauaaggacggcgaucacgaccaguccuucuacaucaccgacgaucccgacgauaacgcugacaggucggaaacuagcucaauugcggauccuuccucucccaauccauucggcaguagcaacccguuuaagucaaaauccaaugaccggccugggcauaagcguuuccgcacgcaaaugagcaaccugcaguugaaaguacugaaggccuguuuuucugauuaucgaacccccacaaugcaggagugcgaaaugcucggaaacgagaucgguuuaccaaaaagagugguucaggugugguuccaaaaugcaagggcuaaggagaagaaauuuaagauuaacaucggcaaacccuucaugauaaaucaagggggcacugaaggcaccaagccugaguguacacugugcggugucaaauacagugcccggcuuuccauucgcgaccacaucuuuagcaagcagcacaucucaaaagugagagaaaccguugggucucagcuggauagggagaaggacuaucuagcaccaacuacagugcggcaacucauggcccagcaggaacuggaucgaauuaagaaggcuucggacgucuugggacugacggugcaacagcccggcaugauggauagcuccagucuccauggcaucucucuuccuaccgccuacccagggcugccgggauuacccccuguacuguugccagguaugaacggccccucaagccucccuggguucccacaaaauuccaacacucugacacccccuggagcgggcaugcuagguuuuccgaccagugcaaccucuagccccgcccuuucccugucaagcgcuccaacaaagccucuccugcagacucccccaccucccccaccgccucccccacccccuccaucuuccaguuugucagggcaacagacggagcagcagaauaaagagagcgaaaagaaacaaaccaagcccaacaaggugaaaaagauaaaagaggaggaacuggaggccacaaagccugaaaaacacccgaagaaggaggagaagauuucguccgcacucucuguucuuggcaaggucgugggagagacucauguggaccccauccagcugcaggcuuuacagaaugccauugcuggcgacccagccaguuucaucgggggacaauuucugccuuauuucauacccgguuuugcaagcuacuucaccccacaguugccuggcacaguccaagggggauauuuucccccaguuuguggcauggaaucacucuuuccguacgguccuaccaugccccagacucuggcggggcuauccccaggcgcccuucugcaacaguaccagcaauaucagcagaaccuccaggagucucugcaaaaacagcagaagcagcaacaggagcagcagcaaaaaccugugcaggcuaagacgagcaagguagaaagugaucagccccaaaauuccaacgacgccagcgagacaaaagaagauaagucuaccgcaacugagucaaccaaagaggagccacaguuggaguccaagagcgcugacuucagugauacauacguggucccuuuugugaaauaugaguucauuugcagaaagugucagaugauguuuacugacgaggaugccgcaguuaaucaccagaaaucuuucugcuacuuuggacaacccuuaaucgacccgcaggaaaccgugcugcgcgucccaguaucaaaguaucagugucucgccugcgauguggcgaucuccggcaacgaggcucuuagccagcaucugcagucgucucuacacaaggagaaaacuauuaagcaggccaugaggaaugcaaaagaacacguucggcugcucccccauagugugugcuccccuaacccaaacacgaccagcacuucacagucugccgcuagcuccaauaacacauacccccacuugaguuguuucucaaugaaaagcuggccuaauauccuguuucaggccuccgcacguagagcugccucuccgcccaguagcccaccuucccuuucacugcccucuaccgucacuucgagccucugcuccacaaguggggugcaaaccucuuuaccaacggagagcuguucagacgaauccgauagcgagcugucucagaaauuggaagaccuggacaacagucucgaggucaaggcgaagccugcuuccggacuugaugguaauuucaacucaauuaggauggacauguuuagcguguga

SEQ ID NO: 65032 - RNA, 1302 nt, Artificial Sequence
  derived and/or modified sequence opt3 from ZFP1__Homo_sapiens__XP_011521223
augcacugcuacggcgccuucaagauguggcugagcuccgcuuuuaucgugcucugucuuugccccaaacugcagaagaugaacaaaucucaagggucagucaguuucaccgacguuacaguggauuuuacucaggaggaaugggagcaguuggacccuagccagagaauuuuauauauggauguaaugcuggaaaauuacuccaaccuacucucuguggaggucuggaaggcagacgaucaaauggaaagggaccaucggaauccagaugagcaggcccgccaguuccugauacuuaaaaaccagacgccgaucgaggaacgaggagaccuguuugguaaggcguugaaucucaacaccgauuucgugucgcugcgucaaguucccuauaaguacgaccuguaugagaaaacacucaaguacaauucagauuuacugaacagcaauagaaguuaugcuggcaaacagacugacgaauguaacgaguuugggaaggcccuuuuguaccugaaacaggagaagacccacuccggaguggaauacucugaguauaauaagagcggcaaagcacuaucccauaaggccgcuauuuucaaacaccagaagaucaaaaaccucguccaaccuuuuauuugcacauacugugauaaggcauucucauuuaaaagucugcuuaucagccauaagaggauacacaccggugaaaagccauaugagugcaauguguguaaaaagacuuucucucacaaagccaaccugaucaagcaucagcggauucacacaggggaaaaacccuuugagugcccugaguguggaaaggcuuucacccaucaguccaauuugaucguacaccaacgcgcccacauggaaaagaaaccauacgagugcucagaauguggcaagacguucgcgcagaaauuugagcucacuacccaucagaggauucacacaggcgaaagacccuaugagugcaacgagugcgcaaagacuuucuuuaaaaagagcaaccugaucauacaucagaagauucacaccggggaaaaacgguacgaguguagugaaugcggaaagucuuucauccaaaauucccaguuaauuauccauaugcgcacacacaccggugagaaaccuuaugaauguacggagugcggcaagacuuuuagccagcgaucgacacugagacuccaccuuaggauccauaccggggagaaaccauacgaauguucugagugcggaaaggccuucucccggaagucacgucugaguguucaccagcgcgugcauauuggcgaaaaaccguga

SEQ ID NO: 65033 - RNA, 1560 nt, Artificial Sequence
  derived and/or modified sequence opt3 from ZFP30__Homo_sapiens__NP_055713
auggccagagaccuggugauguucagggaugucgcuguugacuuuagccaggaggaaugggagugccucaacuccuaccaacggaaucuuuaucgcgaugugauccuggaaaacuacucuaauuugguaucauuagcaggcuguaguauuagcaagcccgacgugauaacccugcuagagcaggggaaagaaccuuggauggucgugcgagaugagaagcguagauggacacucgaccuggaguccagguaugauacuaaaaagcuguuccagggaaaagacaucuacgaaaugaaccuuucucaguggaagguuauggagcggauuaagucgugcgguuuggaggaacaagagucaccacacgaaguguguuuucgccaggucacgaaaaccacaagcgagaagaugccgacuuauagaaaacucaccagucugccccuguaccagaagucccauaauagggaaaaaccuuaugagugcggcgaaugugggaaggccuuccgggugcgccagcaacucacauuucaccagcgaauccauaccggagagaagccauacgagugcaaagaauguggcaaggcguucagacagugcgcucacuuaucuaggcaucagcggauucacacuagcgauaaacuguacgaguguaagaaaugcgguaagaucuuuacauguggguccgaccuucguguacaccaacgcauacauaucggagaaaaacccuaugagugcaaggaaugcggcaaggccuucagaguuaggggccaguugaaccugcaccagcggauucauaccggggagaaaccuuacgaguguaaggaaugcggaaaagcauuucgacaauaugcccaccuaacgcgccaccagagacucaauaucgcugagaaguguuacgaaugcaaagaguguggucaggcauuccugugcucaacuggccuuaggcugcaucacaaguugcauaccggggaaaagccauaugaguguaaagagugcggaaaggccuuucgggugcgccagcaacucacacugcaccagaggauucauacuggcgaaaaacccuacgauuguaaggagugcgguaaaaccuucaguagaggguaucacuuaacacugcaccagcguauccauaccggagaaaagccuuacgaguguaaggagugccagaaauuuuuccggcgauacagcgaacucauaucucaccaaggcauucauaucggcgagaagccauaugaaugcaaagagugugggaaggcuuucagacuguuuucccagcuuacgcagcaccagucaauucacuucggagaaaaaccguuuaagugcaaggagugugagaaaacuuucagguugcuaagccaacugacacagcaucagaguauccacaccggugaaaagcccuacgacugcaaagaguguggcaaggccuuucgccuccauucuucccugauccagcaccaacggauucauagcggggaaaaaccuuauaagugcaaagaguguaagaaggcguucagacagcacucgcaccuuacuuaccaucagaggauacacaacgucacauga

SEQ ID NO: 65034 - RNA, 999 nt, Artificial Sequence
  derived and/or modified sequence opt3 from ZFP36__Homo_sapiens__NP_003398
auggccaacagauacaccauggaccugacagcuaucuaugagagccuccuuucccugucucccgaugugccugucccaucagaccacggcgggacugaaaguagcccgggaugggguuccucuggccccuggucguugucaccuagcgauaguuccccaucugggguuacgagcagguuacccggacgguccaccucacugguggagggccgcaguugcgguuggguaccuccacccccuggguucgcaccacuagccccgcgacucggacccgaacugagcccuucuccaacaucccccacugcgaccucaacaaccccuagccguuacaagacugagcuuuguagaacauuuagugaaucugggaggugccgguauggcgcuaaaugucaguucgcccacgggcugggagaguugcgccaagcaaauagacacccaaaguacaaaaccgagcucugccauaaguuuuaucugcaggguaggugucccuacggcucccggugccacuucauucauaacccgagcgaagaccuggccgcuccugggcaucccccagugcuccgccagucgauaucuuuuuccggauuaccuucaggccgaagaacgagucccccacccccuggucuggcagggccaagccuuuccucuagcucauucaguccguccagcucucccccuccacccggagauuugccucugucaccaagugccuuuagcgcugcccccggcacuccgcuagcgaggcgggacccuaccccagucuguugccccuccugucgucgcgcaacaccuaucucuguguggggcccccucgggggacugguuagaacuccaucggugcagagccuugguuccgauccugacgaguaugccucaaguggcucuagccugggcggauccgauucacccgucuucgaagcuggcguguuugccccaccgcaaccuguagcagcucccaggcgguugccaauuuucaaucgaaucagcguuucugaguga

SEQ ID NO: 65035 - RNA, 1224 nt, Artificial Sequence
  derived and/or modified sequence opt3 from ZFP36L1__Homo_sapiens__NP_001231630
augggcagagccaggaaguccgggcugggacagcggucccgccccaccgcuucucgaucagaggcagccgugcaaccugguguccguaaagcgagaggcgcugggaacuggaggguuggacuccagacaggcgaagccgcaccaaguccgcaccgggaccuucgcgauacucccgacccuagaccauggcuggccaggacgcaucggaugaccacaacuuuggugagcgcuaccaucuucgauuuauccgagguacugugcaaggguaauaaaaugcuaaacuacucugcacccucggccgggggaugucuccuggaccgcaaggcugugggcaccccugccggcgggggauuuccacgaagacacucagucacacuucccagcaguaaauuccaucagaaucagcuguuguccucucucaagggugaaccugcgccagcacugagcuccagggauucacgguuucgugaccgcaguuucagcgagggcggggaaagacugcucccgacucaaaagcagcccggaggcggucaggugaacucuuccagguauaaaacagaguuaugccggccuuuugaggaaaauggggccuguaaguacggagauaaaugccaguucgcucacggcauucaugagcugcgaucacuuacccgccacccaaaguauaaaacggaauuguguagaacuuuucacaccauaggcuucugccccuacgggccuaggugucauuuuauccacaacgccgaggagcggcgcgcacuggcuggagccagagaccuaagcgcggauaggccacgucuccaacauaguuucucuuuugccgguuuccccuccgcagcugccacagcugccgcaacuggccugcuugacagcccgaccucgauuacaccucccccaauccugucugccgaugacuugcucggguccccuacccugcccgauggaacgaauaacccauuugcuuucucaagucaggaauuagcgagccuguucgcacccuccaugggccucccuggugggggcucuccaacuacauuucuuuuccggccgaugagcgagucaccccacauguuugacaguccuccaagcccccaggacagccugucugaucaggaaggauauuugucaaguagcuccucuucgcacagcggcuccgacucaccuacccuagauaauagucgaagacugccaauuuucucuaggcucagcaucuccgacgauuga

SEQ ID NO: 65036 - RNA, 1485 nt, Artificial Sequence
  derived and/or modified sequence opt3 from ZFP36L2__Homo_sapiens__NP_008818
augagcaccacacugcucuccgccuucuacgacguggauuuucuuugcaagacugagaaaucucuggcuaacuugaauuuaaacaauaugcuggacaagaaagcagucggcacgcccguugccgcggcuccuucaaguggguucgccccaggauuucuaagaaggcacagcgcauccaaccuccaugcccuggcucacccggcacccucuccugguucguguucaccaaaguuccccggcgccgcuaaugggagcaguugcggauccgccgcggcaggcgguccuaccucuuaugggacacuuaaagaaccaagcggaggcggcgggacugcccuguugaacaaggagaauaaguuucgggaucgcuccuucucagaaaacggagaccgaagucagcaucuccugcaucugcaacagcagcagaaagguggcgggggaagccaaaucaauucuacccguuacaagacagagcucuguagacccuuugaagaguccgguaccugcaaauauggcgagaagugucaguucgcucacggguuucacgaauuaaggucacugacucggcacccuaaauacaagacagagcuuugccgcaccuuccauacgauuggauuuuguccauauggcccgagaugccacuucauacauaacgccgaugaaaggcggcccgcaccuagcggcggggcuaguggagacuugcgcgccuuugguacucgagaugcgcugcaccuaggcuucccaagagagcccaggccuaagcuccaccauucucuguccuucagcggguuuccaucgggacaccaucagcccccgggcggucuugagucuccucuguugcucgacucccccaccucacggacaccaccucccccaaguuguagcuccgccucuagcugcucaaguuccgcaagcucuuguucaagugcuagcgccgcuuccacucccucuggggccccuaccugcugcgcaucggccgcugcggcagccgcugccgcacuguuauacggcacaggaggcgccgaagaucugcucgcuccaggggccccgugugcagcgugcagcuccgcuucaugugccaauaacgcauucgccuuuggacccgagcuuaguucucugaucaccccuuuggcuauucagacgcacaauuucgccgcaguggcugccgcggccuauuaccguagccaacagcagcagcaacagcagggucuagcuccacccgcacaaccuccagcucccccguccgccacucugccugccggcgcagcggccccacccucaccucccuuuagcuuccagcucccacgcagacugucugacuccccuguauuugaugcucccccaaguccgccugacagccuuucugauagggacuccuaccugucagggaguuugagcucgggaucccucucuggcagcgaaucacccagucuggacccaggucggcgauuacccaucuucucccgccugucuauuagcgaugacuga

SEQ ID NO: 65037 - RNA, 1938 nt, Artificial Sequence
  derived and/or modified sequence opt3 from ZFP37__Homo_sapiens__NP_001269444
augagcguguccucuggcguccagauccugaccaagcccgagacaguugacagaaggcggucagccgaaacuacgaaagaggcugggcgcccucucgaaauggcagugagugagccagaagccagcgcggcuguauccgugaccuucaagcacgucacaauggccuuuacucaaaaagaguggaagcagcuugauccggcacagucuaaccuguacaaugacgugauguuggagaacuauugcaaucaggccucgaugggaugucaagcucccaaaccugauaugauuucaaaguuagaaaagggugaggcaccauggcugggcaaagggaagcgacccagccagggaugcccuaguaaaauagcccguccaaagcagaaagaaaccgacggcaagguucagaaggaugacgaucaacuagagaacauccagaaaucccagaauaagcuccugagagagguggcugucaaaaagaaaacacaggccaagaaaaacgguucugacugugggagccuuggaaagaagaauaaccugcauaaaaagcacgugcccuccaaaaagagguugcucaaauucgaaucaugcggcaagauucugaagcaaaaucuggaucucccugaccauagucggaacuguguaaaacgcaagagcgaugcggcaaaagagcacaagaaaucuuuuaaucauuccuuaucagacaccagaaagggcaagaaacagacugggaagaaacacgaaaagcugagcagucacucuuccagcgauaaaugcaacaagacaggaaagaaacaugacaaacuuuguugccacucgucuucccauaucaagcaggacaagauucaaaccggugagaaacacgaaaagucaccaaguuugagcuccucuacgaaacacgagaagccgcaggccuguguuaagcccuacgagugcaaucaguguggcaaagugcugagccauaagcaggggcuaaucgaucaccaaaggguccauacuggagaaaaaccuuaugagugcaacgaaugcggcauagcuuucucacagaagagucaccucguggugcaucagcggacccacacaggugagaaaccauacgaauguauccagugcgggaaggcccacggacauaagcacgcacugacugaccaucuucgcauucacaccggcgagaaacccuaugagugugcugaaugcggcaagacauuucgacacuccagcaaucugauccaacaugucagaucucacaccggggagaaaccuuacgaauguaaggagugcggaaaaucauucagguauaacaguagcuugacggaacauguucggacucacacaggugagauuccauacgaguguaacgaaugcggcaaggccuuuaaguacuccucuucgcucaccaaacauaugcguauccacacuggggagaagcccuucgaauguaaugagugcggaaaagcguuuagcaagaaaucccaccugauaauucaucagcgcacacacaccaaggagaagccguauaaauguaacgaaugcggcaaggccuucggucauucaaguucuuuaacguaccacaugagaacccauacaggggagagcccuuuugaaugcaaucaguguggcaaaggauucaagcagaucgagggccugacucaacaccagagggugcacaccggggaaaaacccuaugagugcaacgaguguggaaaggcauuuucccagaaaucacaucucauuguacaccagcggacacauacuggugaaaagccauacgagugcaaugaaugugagaaggcuuucaacgccaaaagccaacuugugauccaccagcgaucucacaccggcgaaaagccuuaugagugcaaugagugugggaaaacauucaagcagaacgcuucccugaccaaacaugucaagacucacagugaagauaagagccaugaguga

SEQ ID NO: 65038 - RNA, 933 nt, Artificial Sequence
  derived and/or modified sequence opt3 from ZFP42__Homo_sapiens__NP_001291287
augagccagcaacugaagaaaagagccaagaccaggcaccagaaaggccucgggggacgggcucccuccggugcaaagccucgccagggcaaaucuucacaggaccuucaagccgagaucgaaccagugagugcggucugggcucugugcgauggguacguuuguuaugagccgggaccccaggccuugggcggugacgauuucagcgacugcuacauugaaugugugauacgaggggaguuuucccagccuaucuuagaagaggauucucuguucgagucgcuagaauaucucaagaagggaucagagcagcaacugagccagaaaguauuugaagcaaguucccuugagugcucucuggaguacaugaagaaaggcgugaagaaagaauugccacagaagauugucggcgagaacagccucgaauauuccgaguacaugacagggaagaaacugcccccuggagguaucccaggcauugaccugucagaucccaagcagcucgccgaguucgcucguaaaaagccuccaaucaauaaagaauaugacaguuuaagcgcaauagccuguccgcaaucugggugcacuagaaagcugaggaaccgggcugcccuucgcaaacauuugcugauccacggacccagagaucaugugugugcggagugcggcaaggcauuuguugaauccucaaagcuaaaaaggcacuuccucgugcauacgggugagaagccuuuucgguguaccuucgaagggugcggaaaacgcuuuagccuggacuucaaucuucgaacacacgucaggauucacacuggcgagaagagauuuguguguccauuccagggcugcaaccggcguuuuauccagaguaauaaccugaaagcccauauuuugacccacgcuaauacaaacaagaaugaacaagaggggaaguga

SEQ ID NO: 65039 - RNA, 1395 nt, Artificial Sequence
  derived and/or modified sequence opt3 from ZFP57__Homo_sapiens__XP_006715150
augagcgagaccuucaagaaccugacauccguggccagaaucuuucuccacaaacccgaacuuauuacuaagcuggagcaggaagaggaacaauggagggaguucguccauuugccuaauacggagggcuuaucugaagggaaaaagaaagagcugcgggaacagcacccaucacuacgcgacgagggaaccagugaugacaagguuuuucucgcuugccgaggugcaggccaguguccgcugagcgcccccgcggggacaauggaucguacuagagugcuucaggcuucccaagccggaccuccauucuuuugcuacaccuguggcaagugcuucucuaggcggucguaucuguacucacaucaguuuguacacaaccccaaauugacaaauagcuguagucagugcgguaagcucuuucgcuccccuaaaucucugagcuaucauagaaggaugcaccugggggagcggccauuuuguugcacccucugugacaagacuuacugcgaugcauccggauuaucacgccaccgaagagugcaucugggcuauaggccccacaguuguagcgucugcggcaaaucuuuccgggaccaguccgaacuuaagcgucaucaaaagauacaccagaaccaggagccuguggaugggaaucaggaaugcacauugcgcaucccaggaacccaagccgaguuucagacgccgauugcuagaucacagaggagcauccaaggucugcuagacguuaaccacgcacccguggcccggagucaggaaccuauuuuccgaacugagggcccaauggcucagaaucaggccucuguccucaaaaaccaagcgcccgugacccgcacacaggcaccuaucacugggacccugugucaggaugccagauccaauagccauccaguaaagcccucgaggcuuaacguuuucugcuguccgcacugcucucugacauucuccaaaaagucauacuugagucggcaucagaaagcucaccucaccgagccucccaauuauuguuuccauugcagcaaguccuuuucuagcuucucacgccuggugagacaccaacagacgcacuggaaacagaagaguuacuuauguccaauaugcgaccuguccuuuggagaaaaggagggccucauggaucauuggagggguuacaaagggaaggaccuuugucagagcucucaccauaaaugccgugucauccugggacaaugguugggcuucucacacgaugugccuacuauggccggcgaagaguggaagcacgggggagaccagagucccccacggauucauacaccccgaagaaggggucuacgcgaaaaagcauguaagggcgacaagaccaaagaggcugugagcauccugaagcacaaauga

SEQ ID NO: 65040 - RNA, 2046 nt, Artificial Sequence
  derived and/or modified sequence opt3 from ZFP64__Homo_sapiens__NP_060667
augaacgccagcuccgagggcgaaucuuucgcugggucagugcagauccccggagguaccacaguccugguugagcucacuccugacauucacauaugcggcaucuguaagcaacaguuuaauaaccuugaugcauucguggcccauaaacagagugggugccagcugacgggaaccagcgcggcugccccauccacaguacaauuugugucugaagagacugucccggcaacccagacacagaccacuacaagaaccauuacgucggaaacucagaccaucacagugucagcccccgaguucguuuuugagcacggcuaccaaacuuauuugccuaccgaaagcaaugagaaccagacagcuaccgugauuaguuuaccagcaaaguccaggacgaaaaagcccacuacaccuccagcccagaaacggcugaauuguugcuaccccgguugucaguucaagaccgcuuaugggaugaaggacauggaacgccaucuaaaaauccacacuggagauaagccucauaaaugcgaggucuguggcaagugcuuuucucgaaaagacaagcucaagacacacaugcguugucacaccggcgugaaaccauacaagugcaaaacgugugauuaugccgcggcagacagcuccucacugaacaagcaucuuagaauacacagugaugagaggccguucaaaugccaaaucugccccuacgccagccgcaauucuucccagcugaccguacauuugcggucacacacaggggacgcuccuuuucaguguuggcucugcagcgccaaguucaaaauuaguucugaucugaagagacacaugaggguucauuccggagaaaagccauuuaaaugugaguucugcaacgugcgguguacuaugaaggguaaucugaaaagccacauccgcauuaagcauucgggcaacaauuuuaaaugcccccacugugacuuccucggggauucuaaggcaaccuuacgaaagcauuccagaguccaccaaucagaacacccugagaaaugcagugaauguagcuauuccugcucuagcaaggcugcccugaggauccaugagcggauacacuguacagaccguccauucaaaugcaacuacugcucauuugauacuaagcagcccaguaaucuuuccaaacauaugaagaaguuccacggagacauggugaaaaccgaggcguuggaacgcaaggacacaggcagacagagcucuaggcagguugccaaacuggaugcaaagaaaucauuucacugugacauuugcgaugcuaguuucaugcgggaggacagccuacgaucccauaagcgccaacacucugaauacucggagagcaagaacuccgaugucaccguucuccaguuucagaucgacccgucaaaacagccugccacuccccugacggugggucaucuucaaguaccacugcagccuagucaggugccccaguucucugaagggagagucaagauuaucgugggacaccaaguuccacaggcuaauacaaucgugcaggccgcagccgcugcggucaacauugugcccccugcauugguagcccagaacccagaggagcucccgggcaauagcaggcugcaaauauuacggcagguuucccugaucgcucccccucagucaagccgcuguccaucugaagccggcgcaaugacccaacccgccgugcuccuuacuacccaugagcagacagauggggcuacccugcaccagacuuugauuccuacagccuccggagguccacaggaaggcagugggaaccaaacguuuaucaccagcucuggaauaacuugcacagacuucgagggccuaaaugcacugauucaggaagguaccgcggaggucacaguggucuccgaugggggccagaacaucgcuguggccacuaccgcacccccgguguuuucaaguagcucgcagcaagagcucccuaaacagacguauuccaucauucagggagccgcucacccagcccugcuuugucccgcagacucuaucccugauuga

SEQ ID NO: 65041 - RNA, 1599 nt, Artificial Sequence
  derived and/or modified sequence opt3 from ZFP82__Homo_sapiens__NP_597723
auggcccugagaagcgugauguucuccgacgucucuaucgauuuuucacccgaggaaugggaguaccucgaccuugaacagaaggaucuguauagggacguuauguuggagaacuacaguaauuuagugagccugggcugcuucauuuccaaaccugauguaauaucuucgcuagaacaagggaaggagccauggaaagugguccggaagggacgccgacaguauccggaccucgagaccaaauacgaaacaaagaagcugucacuugagaacgauaucuaugaaauuaaucugagccaguggaaaaucauggagcguauugagaaccacgguuugaagggccucauccugaaaaaugacugggaaaguacugggaagauagagggacaggaaagaccccaagagggcuacuuuuccucugugaaaaugccuagcgaaaagguuuccucauaucagaagaggacgagugugaccccacaucagcggcugcacuucgucgauaaacccuacgaguguaaggagugcgguaaggcuuuucgcgugagacagcaacucacauuccaucacaggauccauacuggggaaaagccuuacgaguguaaagaaugcggaauggcauuucggcagaccgcccacuuaacacgccaccagcgacugcauagcggcgagaaacuuuaugaauguaaagagugcggcgaggcguucauuuguggggcugacuugagaguacaccagaagaugcauaucggagaaaagccauacgagugcaaagaaugugguaaggccuuuaggguucggggccaacugacccuacaccagcguauucacacuggggagaaacccuaugugugcaaggaauguggaaaagcauuccgccaguacgcccaucucacaagacaccaaaagcugaacucugcugauaggcuuuaugagugcaaggagugcggcaaagcauuucugugugguuccggguugcggguccaucacaagcuccauaccggagaaaaaccuuacgagugcaaggaauguggcaaagccuuccgagugcgccagcagcugacguuacaccagagaauccacacuggcgagaagccauaugagugcaaggaaugugggaaaaccuuuucaaggggauaccaucugauacuccaccaucggauucacacaggugagaagccguacgaaugcaaagaguguuggaaggcuuucagccgcuauagucaacuuaucucucaccaguccauucauaucggcgugaaacccuacgacugcaaggaaugugggaaggccuucagacuguugagccagcuaacucagcaccaaucgauccauauuggagagaaaccuuauaagugcaaagaguguggcaaggcguuuaggcugcgucagaaacucacccugcaccagucuauacauacaggugaaaagccauucgagugcaaagaaugccggaaggcauuucgacuuaauuccucacugauccagcacuugaggauucacaguggggagaagcccuacgaauguaaagagugcaagaaagccuucagacaacauagccaccucacccaucaccugaagauccauaacgucaaaauauga

SEQ ID NO: 65042 - RNA, 1713 nt, Artificial Sequence
  derived and/or modified sequence opt3 from ZFP91__Homo_sapiens__NP_444251
augcccggcgagaccgaagaaccuagaccaccggaacagcaagaccaggagggaggagaagccgcuaaggcagcccccgaggagccucagcagaggccacccgaagcgguggcugccgccccugcagguacaacuagcucccggguccugcgcggcgggcgagaucgugggagagcugcagccgcugccgcggcagccgcuguuucuaggcggcgcaaagccgaguacccaagaaggcggcgcucaagucccagcgcacgaccuccagacgugccgggccaacagccccaggcugccaaguccccuucuccaguacaggguaaaaagucgcccagacuccuuugcaucgaaaaagugacgaccgauaaggacccuaaggaggagaaagaagaggaagaugacucagcgcugccacaagaggucagcauugccgcaaguaggcccucccggggguggcguucuagccgcacauccgugucaagacacagggauacugaaaacacccggaguagccgaucuaagacaggauccuugcaguuaauauguaaaucagagccgaauaccgaccagcuggauuaugacguuggcgaggaacaucagagcccuggcgggaucaguucugaggaagaggaagaggaggaagaggaaaugcuaauuuccgaggaagagauccccuucaaggaugacccacgcgaugagacuuacaaaccucaccucgaaagagagacacccaagccaaggcggaaguccggaaaagugaaggaagagaaagagaagaaagaaauuaaggucgagguggaaguagagguuaaagaagaggagaacgaaauccgcgaggacgaggagcccccuagaaagaggggucgucggcgaaaggacgauaaaucgccaagacugccgaagaggcgcaaaaagcccccuauacaauaugugcggugcgaaauggagggcugugggaccguccuugcucauccaagauaccugcagcaccauaucaaauaucagcacuugcucaagaagaaauacgugugcccccacccuucuuguggaaggcuguuucgccugcaaaagcagcucuuacgacaugccaaacaccauacggaccagcgggauuauauuugcgaguacugugcucgugccuucaaguccucacacaaucuggcagugcacagaaugauccauacuggcgaaaaaccacuucagugcgagauuugugguuuuaccugcaggcaaaaggccaguuugaacuggcacaugaagaaacaugacgcugauagcuucuaccaguuuuccuguaauaucugcgggaagaaauucgaaaagaaagacucugucguugcgcacaaggcaaagagccaucccgaggugcugauagccgaagcucuagccgcaaacgccggagcucucauuacaucaacugauauccugggcaccaauccggagagucuuacacagccuuccgacggccaggggcugccauugcuccccgagccucugggaaacagcaccucuggugaaugcuuacugcucgaggccgaaggcaugucaaaaaguuauuguagcgggacggagcgcguaucccuuauggcagauggaaagauuuuugugggcucugguucgagcgggggcacugagggacuggucaugaauagcgacaucuugggcgcgacaaccgaagugcuaaucgaggauucagacagugcugggcccuga

SEQ ID NO: 65043 - RNA, 3021 nt, Artificial Sequence
  derived and/or modified sequence opt3 from ZFPM1__Homo_sapiens__NP_722520
augagcagaaggaagcaguccaacccccggcaaaucaaacgcucucugggcgacauggaggcccgagaagaggugcagcucgucggggcuucacacauggaacagaaggcaaccgccccugaggcgccaaguccgcccagcgcugauguuaauuccccuccaccccuuccuccacccacaucuccuggagguccaaaagaacuggagggccaggagccggaaccccguccuacugaggaggaaccagggucgcccuggucaggaccugacgaguuggaaccagugguacaagauggccagagaaggauucgggcccgcuuaagccuggcaacgggucuaaguugggggcccuuccauggauccgugcagaccagagccucuagcccgaggcaggcugagccuucccccgcacucacacugcuucuggucgacgaagccugcugguugcggacucucccacaagcucugaccgaggccgaagcgaacacagagauacaccgcaaggaugacgcacuguggugucgagugaccaaaccuguucccgccggcggccucuuaucagugcugcuuacugcugagccacauaguacacccgggcacccugucaagaaggaaccagccgagccgaccugccccgccccugcucaugauuugcagcugcuaccacagcaggccggaauggcgagcauccucgccacggcagugauuaauaaagacguauuucccuguaaggauugcgguaucugguacagaucugaaaggaaccugcaagcucaccuucuguauuacugugccucccggcagggcacugggagcccugcugccgcagccaccgacgagaaaccaaaggaaacauaucccaaugagcguguuugcccguucccucagugucgcaaaucaugcccaagugcuucuuccuuggagauucacaugagaagccauucgggagaaaggcccuuugugugucucaucugccugucugcguucacuaccaaggcaaacugugagcggcacuuaaagguccauacagauacccuguccggcgugugccacucaugcgguuuuauaaguacgacucgagacauccucuacagccaccuugugacaaaucauauggucugucaaccuggguccaaaggagaaauuuauucucccggcgccggccacccagcuaccaagcugccucccgauagcuuggggucauuccagcagcagcauacugcccuacaaggaccacuggcaagugccgaccucggucuggcuccgacaccuucccccggccuugaccgcaaagcccuggcagaggcgaccaacggggaagcuagagccgagccauuggcacagaauggaggcagcucugagcccccugccgcuccaaggucaaucaagguugaagccguggaggaacccgaggcagcuccuauucucgguccgggggagccaggcccccaggccccuagucggacgccaagcccccgcuccccugcgccggccagaguaaaagcugaacugucuucgcccaccccaggaagcuccccugugcccggcgaguuagggcuggcaggagcccuauuucucccacaguacgucuucgguccugaugcugcacccccagcaucagaaauccuggcgaagaugagugagcuugugcacucuagguugcaacagggcgccggggcuggagccggcggugcacagacagggcuguuuccgggcgcuccuaaaggagccacuugcuucgaaugugagauaaccuuuagcaacguuaauaacuauuacgugcauaagcgucucuacugcuccggccggcgagcacccgaggacgccccagcugcgagaaggcccaaggccccuccagggcccgcacgcgcuccuccgggacagccagccgaacccgaugccccucggucaagccccgguccaggcgcuagagaggaaggggcaggaggcgccgcgacaccugaggacggugcugggggcaggggaucugaaggcucccaaagucccgggagcucugucgaugacgccgaggaugacccaucccgcacucugugugaggcaugcaauauucgauucucacggcacgaaaccuauacagugcacaaacguuacuauugugccaguagacaugauccuccgcccaggcgcccagcugcaccucccggaccaccuggccccgccgcgccgccagcuccuagccccgccgcaccaguacggaccagaaggcgacgcaaacuuuacgagcugcacgccgcuggugcacccccuccgcccccaccugggcaugcccccgcuccugaaucgccacggcccggauccggcucugguagcggcccuggguuggccccagcgagaucacccggaccggccgcagacggcccuaucgaucucaguaagaagccaaggcguccccugccuggggcuccagcccccgcuuuagcagacuaucacgagugcacugccugucgcguuuccuuucacucucuggaagccuaccuagcucauaaaaaguauagcugcccggcggcaccucccccaggagcccucggccugccugcugccgcaugucccuacugcccacccaacgguccugugagaggggaccuuuuggagcacuuccggcuggcccauggacuccuguuaggcgcuccacuggcggguccgggcgucgaggccaggacgcccgcagaucgagggccuuccccagcucccgccccugcagccucaccacagcccggaagccggggcccucgcgacgggcuuggaccggaaccacaggagcccccucccggcccaccucccaguccagcugccgcgccggaagcagugccucccccacccgccccuccaucuuacuccgauaaggguguccagacacccagcaaagggaccccugcuccguugccaaauggaaaccacagauauugcaggcucuguaacauuaaguucucgucacugucuacuuuuaucgcccauaaaaaguacuauugcaguucccacgcugcagagcacgugaaauga

SEQ ID NO: 65044 - RNA, 3456 nt, Artificial Sequence
  derived and/or modified sequence opt3 from ZFPM2__Homo_sapiens__NP_036214
augagcagaaggaagcaguccaaaccccggcaaaucaagcgcccucuggaggacgccauugaagaugaggaagaggaaugcccaucugaggagaccgacauaaucucaaaaggcgauuucccgcucgaagagaguuuuagcacagaguucgggcccgaaaaccuuuccugugaggaaguggaguacuuuugcaauaagggagacgaugaagguauucaggagacugcugaaucugacggcgauacgcagucggagaaaccugggcagccaggagucgagaccgacgauugggacggccccggugaacuggagguuuuccaaaaggauggggaacgaaagauccagucacgucagcaguugccugugggaacaacuuggggcccauuucccggcaaaauggacuuaaacaauaacagccugaagaccaaagcacaaguaccuauggugcuaacagccgggccaaaguggcuccuggaugucaccuggcagggaguggaggacaauaaaaacaauuguauuguuuauaguaaggguggccagcuuuggugcacuacaaccaaggcgaucuccgaaggggaggagcugauagcuuucguggucgacuuugauucuagauugcaggccgcaagccaaaugacgcucacugaaggaauguacccggccaggcugcuggacuccauccagcucuuaccccagcaagcugcaauggccucaauucugccuaccgcuaucgugaacaaagauauuuucccauguaagaguugcggcaucugguaucggagcgagcgcaaucuucaggcccacuugauguacuauuguucugguagacagagggaagcggcacccguauccgaggaaaacgaggacucagcccaucagauaagcagucugugcccuuuuccacaauguacaaaaucuuucuccaaugcucgggcccuagagaugcaccucaacagccauucggggguuaagauggaagaguuucugcccccgggagcaucucuuaaaugcacuguguguuccuacaccgcugauucagucauuaauuuccaccagcaucuguuuagucacuugacacaggccgcguuccgcugcaaccacugccauuucggcuuucagacccaacgagaacuccugcagcaccaggaguuacaugugccuagcggcaagcugcccagagaguccgacauggaacacucuccaagcgccacggaggauucacuccagccugcaacugaccuucugacaaggagugaauugccccaaucccagaaagcuaugcagaccaaggaugccagcucugacacugagcuagauaagugugagaaaaagacacagcuguuccucaccaaucaacggccagaaauccagcccacgaccaacaaacagucauuuaguuauacaaagauuaaaagcgagccuuccucuccacgucuggcuucgagcccggugcaacccaacaucgggccuuccuucccagucggacccuuucuuucacaguucaguuuuccucaggacaucacuaugguuccacaggccucugaaauucuggcaaagaugagcgaguuggugcaccgcagacucaggcaugguuccucaagcuaucccccgguaauauacucuccucugaugccaaagggcgcuaccugcuucgaauguaauaucacauuuaacaauuuagacaacuaccuggugcacaaaaagcauuacugcuccagucgguggcaacagauggccaaaagccccgaguucccuucugucuccgaaaagaugcccgaggcgcuaucaccaaauacugggcagaccaguauuaaccuccugaauccugcagcccacagcgcugaucccgagaacccacuuuugcagacaucguguaucaauuccucuaccgugcuggaccucauaggaccgaacggcaaaggucaugauaaggacuuuagcacucaaacgaagaaacugucaacaaguuccaauaacgaugacaagauuaaugggaaaccuguugaugugaagaaccccucugucccacuuguggacggcgaaagcgaucccaauaaaaccacuugcgaggccuguaacaucaccuucucccgacacgaaacauauaugguacacaagcaguacuauugcgcaacccgccaugacccuccacugaagagaucagccagcaacaaaguucccgcuaugcagaggacuaugcggacacgcaagagaaggaaaauguacgagauguguuugccugaacaggagcaacguccgccacucgugcagcagcgguuucuggaugucgccaauuuaaacaaucccugcacgaguacccaagagccuacugaaggacugggcgaguguuaucacccacgaugcgacaucuuccccgggauugugucuaagcaucuagaaacaucccucaccaucaacaaaugcgucccugugagcaagugugauacaacucacucgucaguuucuugccuggagauggacgugccgauugaccuuaguaaaaaguguuugucccagagcgagagaaccacgaccucucccaagaggcugcucgauuaccacgaaugcacaguauguaaaaucagcuucaauaaggucgagaacuaccuggcacauaaacagaauuuuugcccagugacugcgcaccagcgcaacgacuuaggacaacuggaugguaagguuuucccuaaucccgaauccgagcggaacucaccagacgugaguuaugaaagaagcauaauuaaaugugagaagaauggcaaccuuaagcagccuucucccaaugggaacuuguuuuccucacaucucgcuacccugcagggacuaaaagucuucagugaggccgcacagcugaucgccacaaaggaagagaauaggcaccucuuucugccacaaugccuuuacccgggcgcuaucaaaaaggccaaaggugcagaucaguugagcccuuauuacgggauuaagcccuccgacuauauaucuggcucgcuggugauccauaacacugauauugaacagagccgcaacgcugagaaugaaucaccaaagggacaggccuccaguaacggcugugcggcccucaaaaaggacucuuuaccccugcuuccuaaaaaucgagggaugguaaucgugaacggaggucugaagcaagaugagcggccagcugcaaauccccagcaggagaacauuagccagaauccucaacacgaagacgaucacaaauccccgucauggaucucugagaacccauuggccgcuaaugaaaacguuagccccggcauaccuagugccgaggaacagcucuccagcaucgcaaagggggucaauggaucuucacaggcgcccaccuccggcaaguacugccgucugugugacauucaauucaacaaucuaaguaacuuuaucacgcauaaaaaguucuauugcagcucgcacgccgcugagcaugugaaauga

SEQ ID NO: 65045 - RNA, 213 nt, Artificial Sequence
  derived and/or modified sequence opt3 from ZFR2__Homo_sapiens__NP_001139112
auggccaccagccaguacuucgacuuugcucaaggcgggggaccccaguauuccccugagguggaaacaacuccaccggcacuggccucuggucuccccugcgcgcuuccuuggacggucggcuguucagggagugaugcuguuaccgcccugugccccagcuugagaggauuagcauguaucugcuccauucugugggacccagccugguga

SEQ ID NO: 65046 - RNA, 3225 nt, Artificial Sequence
  derived and/or modified sequence opt3 from ZFR__Homo_sapiens__NP_057191
augauccccauuugcccuguggucagcuucaccuacguuccauccagacugggcgaggacgccaagauggcuacagggaacuauuuuggauucacucacucuggugcagccgcggcugccgcagccgcucaguacucacaacagccggcaaguggcguggccuauagccaucccacgaccguagcuuccuacacagugcaccaggccccugucgcggcacauacugugaccgccgcuuaugccccagcagcugccacaguugcgguggccaggcccgcaccugucgcuguggccgcugccgcaaccgccgcugcguacgggggauauccaacugcacacacagccaccgauuacggcuacacgcagcggcaacaggaagcucccccuccaccgcccccugccacuacccagaauuaucaggacucuuacucguauguacgcucaacagcaccagccguugcuuacgauagcaaacaauauuaccagcagcccacugccaccgcagcggcuguggccgcagccgcucagccucaaccaagugucgccgagacauauuaccagaccgcacccaaggcugguuacucccagggggccacgcaauauacucaggcgcagcagacacgacaagugaccgccauaaaaccggcuacuccuucucccgcaacaaccacguuuagcaucuacccaguguccucaaccguccagccuguugccgcugccgcaacagugguacccaguuauacucagagcgcgaccuacucuacaacugccgugaccuauuccggaacaucauacagcggcuaugaagcugccgucuacagugcagcuucuuccuacuaucagcaacagcagcagcaacagaagcaggccgcagccgcugcggccgcagcugccgccaccgcugcauggacuggcacgacauucaccaaaaaggccccauuucagaacaagcaacucaaacccaagcagccuccaaaaccgccccagauucauuacugugacgugugcaagaucagcugugcggggccucaaacuuauaaagagcaccuugaaggacagaagcacaagaaaaaggaggcugcccugaaagcaucgcagaauaccucuuccucaaacaguagcacacgugguacccagaaucaauugagaugcgaguuaugugauguuuccugcacuggcgccgacgcuuacgcagcccauauuaggggagcgaagcaccagaaaguggucaagcugcauacaaaacuagggaagccaauccccucuacggaaccuaacgugguaagccaggcuaccucaaguacugccguuuccgcaagcaagccaacagccucucccucaaguauagcugccaauaacuguaccgugaauacaagcuccgucgcaacuucuucgaugaaaggccucaccacgaccgguaacagcucccuuaauucaacaaguaacacuaaggugucugcugucccgaccaauauggccgcgaaaaagacaagcacuccuaaaaucaacuucguugggggaaauaagcugcaguccaccggcaacaaggccgaggauauuaaaggcacggaaugcgugaagucaacaccagugaccagcgcaguacaaauccccgaggucaaacaggacacugugucugagccuguuacacccgcuucccuggccgcuuugcagagugaugugcagccagucgggcacgacuauguggaagagguacggaacgaugaaggaaaggugauucgcuuucacuguaaacucugcgaguguagcuucaaugacccuaacgcaaaggaaaugcaucugaaggguagaaggcaccggcugcaauacaaaaagaaaguuaaucccgaucuccaggucgaggugaagccaucuauccgcgcccgaaaaauacaggaggaaaagaugagaaagcaaaugcagaaagaggaauauuggaggcggcgugaggaagaggagcgcuggagaauggaaaugaggcgguacgaggaagacauguacuggcgacgcauggaggaggagcagcaucacugggacgauagaaggcggaugccggacggcggguauccucauggacccccaggccccuuaggucugcuuggggugcgcccuggcaugccaccccagccucaaggaccggccccauugagaaggcccgauuccucagacgaucguuacgucaugaccaagcacgcuacuauuuauccuaccgaggaggaacugcaggcgguucagaaaaucgugaguauuacagaacgggcacuaaagcucgugagcgacucgcuguccgagcacgagaaaaacaagaauaaagaaggcgaugacaagaaggaagggggaaaagaucgagcccuuaaggguguacugagagucggcguguuggcuaaagggcuccuguuaaggggagaccgcaacguuaaucuggugcuccuuugcucugaaaagccaagcaaaacgcuguugucacggaucgccgagaaccuacccaagcagcuggcagucaucaguccugaaaaguacgauauuaaaugcgccguguccgaggcugcgauaauccucaauucuuguguugagccgaagaugcaagugaccauuacucugacaagccccaucauaagagaagagaacaugagggaaggcgacguaaccuccgguauggucaaagacccaccugaugugcuugaccgccagaagugccuggaugccuuggcagcucuccgacaugccaaaugguuucaggcacgggccaaugggcugcagucaugugugauuaucauccguauuuuaagagaccugugccaaaggguccccacauggagcgauuucccaaguugggcuauggagcuacucguugaaaaggccaucucuuccgcgagcucgccucagucacccggcgacgcacugcgccggguguuugaguguauuucuaguggaauaauccuuaagggcuccccaggguugcuggauccgugcgagaaagacccuuucgauacucucgccaccaugacggaccagcagagagaagauauuacaagcucugcucaauuugcccugaggcuucuggcuuuccgacagauccacaagguauugggaauggacccccucccacagaugagccaacgcuucaacauccauaauaaccggaaaagaaggcgugauuccgacgguguggacggcuuugaggcagaagggaagaaagauaagaaggacuaugauaauuucuga

SEQ ID NO: 65047 - RNA, 1731 nt, Artificial Sequence
  derived and/or modified sequence opt3 from ZFX__Homo_sapiens__NP_001171557
augaccauggacacagagagcgaaaucgaucccugcaagguggacggcacuuguccugaggucauuaaaguuuacauauucaaggccgauccaggggaagacgaucugggagguacgguggacaucguagaguccgaaccggagaacgaucacggcguggagcuccuugaccaaaauucuucaauuagaguccccagggagaaaaugguguauaugaccguuaacgauagucagccugaagacgaagaucugaauguggcugagaucgcagacgaggucuacauggaagugauuguaggggaggaagaugccgcggcugccgcagccgcugcagccguucaugagcagcagauggacgacaacgaaaucaagacauuuaugccaauagcuugggccgcggcauauggaaauaacagcgauggcaucgagaaucggaacgguacugccuccgcuuuguuacacauugacgagucugccgggcugggacgccuagcaaaacagaagcccaagaaacgacguagaccugauucgaggcaauaccagaccgcuaucauuaucggcccagacggccauccccucacaguguauccuugcaugauaugugggaagaaauucaagucacggggauuucugaaacgccacaugaagaaucauccagaacaccuugccaagaaaaaguacagaugcaccgauugugacuauacuacaaacaaaaagauuagccugcacaaucauuuggagagucacaaacucaccuccaaggcggaaaaagccaucgagugcgaugaaugugguaagcauuucucucacgcaggcgcucuguuuacgcacaagaugguccauaaagagaagggggccaacaaaaugcacaagugcaaauucugugaguacgaaacugcugagcagggacugcucaauaggcauuuacuggccgugcacagcaagaacuuuccgcauauuugcguggaauguggcaaggguuuccggcaccccuccgagcuuaaaaagcacaugcgcauccauaccggggaaaaaccuuaccagugccaauauugcgaguaccgaucagcagacaguagcaauuugaagacacacgucaaaacuaagcauucuaaggagaugccauuuaaaugugauaucugccugcuaaccuucuccgacacaaaggaaguucagcagcacgcccucauucaccaggagucaaaaacccaucaaugucugcacugcgaucauaagagcaguaacucuuccgaccuuaaaagacacauaaucagcgugcauacgaaggacuauccccacaagugugauaugugcgacaaaggauuucacaggccuucggaacugaagaaacauguagcugcgcacaagggcaaaaagaugcaucagugucggcacugcgauuucaaaauugcagacccauuuguguugucucgucauauccucuccguccacacuaaggaucugcccuuccgcuguaagagaugcaggaaaggcuuccggcagcaaucagaguuaaagaaacacaugaagacacauagugggcgaaaaguguaccagugugaguauugcgaauacagcaccacugacgccuccggauuuaagcgccacguuauaucuauucauacaaaggauuauccgcacagaugcgaguacuguaaaaaggguuucaggcggccuagcgagaaaaaccagcacaucaugcgccaucacaaggaagugggccugcccuga

SEQ ID NO: 65048 - RNA, 2175 nt, Artificial Sequence
  derived and/or modified sequence opt3 from ZFY__Homo_sapiens__NP_001138747
auggacggcgaucagaucguggucgagauucaagaagccguuuucgugagcaacauaguagacuccgauaucaccgugcacaauuuuguccccgacgauccugacucugugguuauucaggauguggucgaggacgugguaaucgaagaggauguucagugcucagacauucuggaagaggcugaugugagugagaacgucaucauaccagaacaggugcucgacagcgaugugacagaggaagucucccuuccgcauuguacuguucccgacgacgugcuggcaucugauaucacgucgaccucaaugagcaugccugagcacguauugacaagugaguccaugcaugugugcgacauugggcacgucgaacauauggugcacgauucuguuguggaggccgaaaucauuacugacccauuaaccagcgauaucgucuccgaggaagugcugguagcggacugugcucccgaggccguuauagaugcaucaggaauuaguguggaccaacaggauaaugacaaggccagcugcgaggauuaccuaaugaucucucucgacgacgcugguaaaauugaacacgauggcuccacaggggucaccaucgacgcagagucagaaauggauccuuguaagguggacagcacuugcccagaggucaucaaaguguauauuuucaaggccgaucccggagaagacgaucugggcgguacaguugacauaguggagagugagccugaaaacgaucaugggguagagcuucuggaccaaaauucuuccaucagagucccaagggagaaaaugguguacaugaccguuaacgauagccagcaggaagacgaagauuugucgaauaacucugacggaauugagaaucggaacggcacggcuuccgcccuccugcacaucgacgagucagcgggccuggggcgccucgcaaagcagaagccgaaaaagaaacgacgucccgauaguagacaguaucagacugccauaauuaucggaccugacggucauccauuaaccguguaccccuguaugaucugcggcaagaaauuuaagagcaggggguuccugaagcggcacaugaaaaaucacccugaacaucuugcuaagaaaaaguaucacuguacagauugcgacuacacuaccaacaaaaagauuuccuugcauaaucaccuggagucucauaaacuaacaagcaaggccgaaaaggcaaucgagugugaugagugcggaaaacacuuuucacacgcuggcgcccucuucacccauaagaugguccacaaagaaaagggugcgaacaaaaugcauaagugcaaguuuugugaguaugaaacggccgagcaagggcugcuuaaucgccaccuguuggcagugcacaguaaaaacuucccacauauuugcguagaauguggaaagggcuuuagacaccccuccgagcucaggaaacauaugcggauacacacuggcgagaagccguaccagugccaguacugugaauaucgcagcgcugacucuucaaaccugaaaacacauaucaagaccaagcacaguaaagagaugccuuucaagugcgauauuuguuuacugacuuuuagcgacacaaaagaagugcaacagcacacccucguucaucaggaguccaagacgcaccagugccuucauugugaucacaaaucuucgaauagcuccgaccugaagcgacaugucaucucagugcacaccaaggauuacccccacaaaugcgaaaugugugagaagggguuccauagaccaagugaguugaaaaagcacguggccguccauaaaggaaagaaaaugcaccaaugcaggcacugcgacuuuaagaucgcugauccuuucguucuaucucggcauauucugagcgugcacacaaaggaccuccccuuccguuguaaacgcugcagaaaggguuuuaggcagcagaacgaacugaaaaagcauaugaaaacucacuccggccggaagguguaucagugugaguacugcgaauauucaaccacagacgccagcggguucaagcgacauguaauaucuauccacacuaaagauuacccacaccgcugugaguauugcaagaaaggauuuagaaggcccuccgaaaagaaucaacauauuaugcggcaccauaaagaggucggccuuccuuga

SEQ ID NO: 65049 - RNA, 1416 nt, Artificial Sequence
  derived and/or modified sequence opt3 from ZFYVE19__Homo_sapiens__NP_001070736
augaacuacgacagccagcaacccccucugccaccgcuccccuaugccggcugcagaagggcuuccggguucccugcacuuggacgggguggcaccgugccagucgggguuuggggaggcgccggucaggggcgcgagggacgaucuuggggcgaaggcccccgugggccuggacuggguagaagggauuugucaagugcggacccagcuguguuaggcgccacaauggagagccgguguuacgggugcgcaguaaaguuuacucuguucaaaaaggaauauggauguaaaaauugcggccgcgccuuuuguuccgguugccuaucuuucucggcugcagugcccagaacggggaacacccagcagaaggucuguaaacaaugccacgaggugcucacaaggggaucaagcgccaaugcuaguaagugguccccuccacagaacuacaagaaacggguugccgcgcuggaagcaaagcagaaaccgucuacuagccagucccaaggccuuacccgccaggaucagaugaucgccgagcgacuggcuagauugaggcaggagaauaagcccaaacucgugccuucacaagccgaaauugaggcacggcuggcugcccugaaggacgaacgucagggcaguauaccaagcacacaggagauggaggcgcgccucgccgcauuacaagggagaguccugcccucucagaccccucagccagcucaucacacucccgauacaaggacccaggcccaacagacgcaggaccuuuugacucagcuggcugccgaaguggcaaucgaugaguccuggaagggagguggcccggccgcuucacuacaaaacgaccucaaucaagggggaccuggcagcaccaacaguaaacggcaggcgaauuggucucuggaagaggaaaagucccgacuucuggcagaggccgcuuuggagcuccgcgaagagaacacaagacaggaaaggauucuggccuuagcaaaacggcuggccaugcuccgcggucaggaucccgagagaguaacucuucaggacuauaggcugccagauagcgacgaugacgaagacgaggagaccgcuauccagcguguuuugcagcaacuaacagaagaggccucgcuggaugaagcaucuggguuuaauauuccugcggagcaggcuucccggcccuggacccagccacgaggcgccgaacccgaggcacaagacguggauccuagaccagaggccgaagaggaggaacucccgugguguugcaucuguaacgaggacgcuacgcugaggugcgccggaugcgauggcgaccuuuucugugcacgcugcuuucgggaagggcaugaugcuuucgagcugaaggaacaccagacuucagccuacagucccccuagagcgggacaggagcauuga

SEQ ID NO: 65050 - RNA, 759 nt, Artificial Sequence
  derived and/or modified sequence opt3 from ZFYVE21__Homo_sapiens__NP_001185882
augagcuccgaggugucugccagaagggacgcuaagaaacugguccggucacccaguggccuccgcaugguuccugaacaccgagcauucgggagcccauuuggacuugaggaaccgcagugggugcccgauaaggagugccguagauguaugcaaugcgacgccaaauucgauuuucugaccaggaagcaucacugucggcgcugcgguaaauguuucugcgacagauguugcucccagaagguaccuuugaggcggauguguuuuguggauccaguccgccagugcgcggaaugugcuuuagugucucugaaggaggccgaguucuacgacaaacagcuaaagguucuccugucgggcgcaacauuucuugugacuuucgggaacucagaaaaacccgagacgaugaccugccgacugagcaauaaccaaagauauuuguuucucgauggagacagucauuacgaaaucgagauuguccacauauccacagugcagauccugacugagggcuucccuccaggugaaaaggauauucaugccuauaccucucugagggggagccagcccgcuuccgagggaggcaaugcacgggccacaggcauguuucuccaguacaccguaccugggacugaaggaguuacacaauuaaaacugaccguggucgaggacgugacggugggucgucgccaggcugucgccuggcuuguugcgaugcacaaggcagccaaguugcuguaugaaucaagagaucaguga

SEQ ID NO: 65051 - RNA, 7620 nt, Artificial Sequence
  derived and/or modified sequence opt3 from ZFYVE26__Homo_sapiens__NP_056161
augaaccaccccuucggcaaggaggaagccgcuagccagaaacagcuguuuggguucuuuugcgagugucuccgcaggggagaaugggagcuugcucaggccugcgugccucagcugcaggaaggucagggcgacaucccaaagcgggucgaggauauuuugcaggcguuaguuguguguccgaaucugcuacgcugcgggcaggacaucaacccccagcgaguagcuuggguguggcuccugguccuugagaaauggcuggcccgugaaaagaaauugcucccugugguuuuccggaggaagcuggaguuucugcucuuauccgaagaucugcaaggagacaucccagagaauauucuugaggaauuguacgagacccugacucagggcgcagugggucacguccccgaugggaacccucggcgcgaaucuuggacuccaagacuaucaagugaggccguguccguacucugggaccugcuuaggcagagcccccagccugcucaagcacuguuggaacuccuguuagaggaggaugacggaacgggccugugucacuggccacuccagaaugcccuuguugaucugauccggaaggcuuugcgcgcccuacagggcccggacucugugcccccuggggucguggaugcgauuuauggagcacugcgaacccucagaugcccagccgaaccccuggguguggagcuucaccuguugugugaagaacuccuggaggcuugcaggaccgagggcucgccuuuacgggaggaacgucugcuaucaugucuccugcacaaagccagccgcgggcuuuugagucuguacggacauacuuaugcagagaaggucaccgaaaaaccacccagagcuacagccuccggcaagguuucuccggaccaccucgauccugagagggcgaugcuggcccuuuucagcaaccccaauccagcagaggcuuggaaaguggccuacuuuuauugccuguccaacaauaagcacuucuuggagcaaauccucguaaccgcucugacuuuacugaaggaggaagacuuuccuaaccuagguugucuccuggaccgggaguuccgaccccuuucaugcuugcuggugcuccugggguggacacauugccagaguuuagaaagcgccaaacgccugcuucagaccuugcacagaacgcagggaccaggcugugaugagcuccugagggacgcaugcgauggccuaugggcccaucuggagguccucgaaugguguauacaacagucuuccaaucccaucccuaagcgggaccugcuuuaccacuugcacgggggagauucacauagcgugcuguauacuuuacaccaucucaccaaccugccagcacuucgcgaggaagacguucugaaauugcuccagaaggugccggcgaaagauccccagcaagagccugacgcagucgaugccccagugcccgaacaccugagucagugccagaaucuaacacuguaccaggguuuuugugcuaugaaguacgccauuuaugcacucugcguaaacucucaucaacacucccagugucaggacugcaaagauagccugucggaggaccuugccucugcuacugagccugccaaugacuccuugucaaguccaggcgcagcgaaccuguucagcaccuacuuagcuagaugucagcaauaucucugcuccauccccgauucucugugucuugaacugcuagagaacauuuuuagccuccuguugaucacaucagccgaccugcacccggaaccucauuuaccagaggauuacgcagaagacgaugacauagaggggaagagucccuccggacucaggagcccuucugagucaccccagcacauugcccauccagaacguaagagugagcggggcagccuggguguuccuaaaacccuugcuuauacgaugcccucccacgugaaggccgaaccaaaagauucuuacccggggccucaccgacauucguuccuggacuugaagcacuucacuagcggcaucuccggauuucucgcagaugaguucgcuauuggcgccuuucugagacuacugcaggaacaacuugacgagaucucaaguaggucucccccagagaaacccaagcaggaaagccaguccugcucagggagccgcgauggacuccagucucggcugcauagauuguccaaggucgugagugaggcgcaauggaggcacaaagucgugacaagcaaucaucgcucugaagaacagccuucccgacgguaucagccagccacccgucaccccucacugagaaggggucgccggacuagaaggagucaggcugacggccgagaucgcgggagcaacccuucguuagaguccacaucuagcgaacucucaaccaguacguccgagggaucucugagcgcaauguccggccggaaugaacuucacucaagacugcauccgcacccacaaagcaguuugauccccaugauguucucuccuccagagucccuccuggccagcugcauucuaagggguaacuuugcugaagcccaucagguucuguucaccuuuaaucuuaagucgucacccucuaguggggagcucauguucauggagcguuaccaggaagugauacaggagcuggcacaaguagaacacaaaaucgagaaccaaaauuccgacgcgggcagcucuacaauucgccggacuggaagcggcagauccaccuugcaggccaucgggucagcugccgcagcuggaauggucuuuuacaguauaagcgacgugacagauaaguuacugaacacuucuggugacccuauuccgaugcuccaagaagauuucuggaucuccaccgcccugguugagcccacagcaccacuuagggaggugcuggaagacuugucaccucccgccauggcugcguuugaucuagccuguagucagugccagcuguggaaaaccuguaagcagcuccuggagacugcagaacgacggcuuaauagcuccuuagagcgcagaggcaggcggaucgaccauguccugcucaacgcugaugggauucgaggauucccagugguauugcaacagaucucuaagucgcugaauuaucuccugaugagcgccucacagacgaaauccgaaaguguggaggagaagggcggugggccucccagaugcucuauuacagaacuucugcagauguguuggccauccuuguccgaggacugcguugccucacacaccacucuaucucaacagcuggaucagguccuccagagcuuacgcgaagcucuggagcuuccggagccuaggacacccccacugaguucccucguggaacaagcagcccagaaagcgcccgaggcugaagcccacccugugcagauacagacacaauugcugcagaagaaccucggcaaacagaccccaagcggaucucgucaaauggacuaccugggcacauuuuucucauauuguuccacacuugcagccguccuacugcagaguuugagcucggagcccgaucauguugaagugaagguggggaauccuuucguauuacugcagcagucuuccagccaacucgucucacaucugcuuuuugagagacaggugccgccagagagacuggcugcacucuuggcccaggaaaaccugagucuaucuguuccccaggugaucgucuccugcuguugcgagccucuggcgcucuguagcucaaggcaaagucagcagacgagcucccuucugacccgcuuaggaacuuuggcucagcugcaugccucucacugccucgacgaucugccccuuagcacaccauccucaccucgaaccacagaaaaucccacucuggagagaaagccauacucuaguccucgggacucgagccucccggcauugaccuccucugcccuggcuuucuuaaaaucaaggagcaagcuacuggccacgguggcaugccucggcgcuagcccccgccuuaaaguuaguaagccaucucugagcuggaaagaauugcgugguagacgggaggugccucuggccgcggagcaaguagccagggaaugugagcgccuccuggaacaguuuccccuuuucgaggcauuucuccuggcugccugggaaccauugcgagggucacugcagcaaggacaguccuuagcugucaaccuaugcggcugggcaagucugagcaccgugcuccuuggucugcacucuccuauugccuuggacgugcuguccgaggccuucgaggaaucacucgucgcuagagauuggagccgggcgcugcagcuuacagagguuuauggcagggacguggaugacuuaucgucuaucaaggaugcaguacugaguugugccguggcuugcgacaaagaaggguggcaguaccucuuucccgucaaggaugccuccuugcgcagcagacuggcacuacaauucguggacagguggccgcuggagucaugucucgagauccuugccuauugcauuuccgauacugcuguucaggaaggacugaagugugaguugcagcggaaacuggcggaacuccagguguaccaaaagauacugggcuuacagucuccaccugucuggugcgacuggcagacccuucguagcuguugcguggaggaucccaguacaguuaugaacaugauccuggaagcccaggaguacgagcucugugaagagugggggugccuauauccaauuccccgcgaacaucugaucuccuugcaccaaaaacaucugcuccaccuucuggagcgaagagaccaugacaaggcauugcagcugcucaggcggauuccugauccgacuaugugcuuagaagugaccgagcagagccuggaccagcacacgucucuugcuacaucacacuuucuggccaauuaccuaaccacucauuucuauggacaacucacagcaguccgccacagagagauccaggcccuguacguaggcaguaaaauauugcugacccuccccgaacagcauagggcuuccuauagccaccuuucuucgaacccacuguuuauguuagagcaacuguugaugaauaugaagguggauugggccacuguugcggugcagacccuccagcagcugcuagucggucaagaaaucggguucacaauggacgagguggauucacuucugagccgguacgcagaaaaggcccucgacuuuccuuauccccagcgagagaaaagauccgauaguguaauucaucugcaggagaucgugcaucaggcugccgacccugaaacguugccacgcucucccagcgcugaguucuccccugcagccccacccggaauuucaaguauccacucuccgagccugagggaacgguccuucccuccaacccaacccucacaggaguuugucccuccagcuacucccccggcccgucaucaguggguuccugaugagacagaaagcauauguauggugugcuguagagagcacuucaccauguuuaacaggcgccaucacugccggcgauguggcagacucguguguucuuccuguaguacaaagaaaauggucguggaagguugcagggagaaucccgcacgcguuugugaccagugcuacagcuacuguaacaaggauguaccagaggaaccuucggagaaacccgaagcgcuugacuccucuaagaaugagucaccacccuauagcuucgugguccgggugccuaaggccgaugaaguugaguggauucuggacuuaaaagaagaggagaacgaacuggugagaagugaguuuuacuaugaacaagcuccauccgccucuuugugcaucgcaauucucaaucugcaccgugacagcaucgcuugcggccaucagcuaauagagcacuguugcaggcuuucaaaggggcugacuaacccggaagucgaugccggacuccugaccgacaucaugaaacaguuguuauucuccgcaaagaugauguuugugaaagccggccaaagucaggaucuggcucucugugacagcuacauuucuaagguagauguccuuaauauccugguggcggccgcauaucggcauguucccucacuagaccagauucugcagccugcugccgugacgcgccuccgaaaccaauugcuggaggccgaguacuaucagcuuggggucgaaguguccacaaagaccggacuggauacuaccggcgcauggcacgcuugggguauggccugccucaaagcggggaauuuaacagcugccagagagaaguucuccaggugccugaaaccacccuuugacuugaaccagcugaaucacggaucucggcucguucaggauguggucgaauaccuugagaguacugugcgcccuuucguaucgcugcaagacgaugacuacuuugcaacccuaagagagcuggaagccacacucaggacgcaguccuugagccuggcugugaucccagagggcaagauaaugaacaacaccuauuaccaggaaugccuuuucuaucugcauaauuacucaacuaacuuagcaauuaucucuuucuauguucgacacagcugucuccgggaggcccuguugcaucugcucaauaaagaaagucccccugaggucuuuaucgaggguauuuuccagccgagcuacaagucaggcaaacuucacacacuggaaaaccuacuggagucuaucgauccaacccucgaaagcugggggaaguauuugauugcggcuugccaacaucugcagaagaaaaauuacuaccacauauuauaugagcuucagcaauuuaugaaggaccaggugcgugccgcaaugacuuguaucagauucuuuucccacaaagccaagaguuacacagaacugggagagaaacucagcuggcuguugaaggcuaaggaccaucugaaaauuuaucuccaggagaccuccagaucuucaggcaggaagaaaacgacuuucuuucggaagaaaaugaccgccgcagaugugagcagacacaugaacacacuucagcugcaaauggaagucacccgcuuccuacauaggugcgagucggcugggacuucccagaucacaacccugcccuuaccuacacucuuuggaaauaaccacaugaagauggacguagccuguaaggugaugcugggcgguaaaaauguugaagauggguucggaauugcguuucgaguguugcaggacuuccagcuugaugccgcaaugacuuacugccgggcugccagacaacuggucgagaaggaaaaauauagugagauccagcagcuccugaagugcgugucugagagcggcauggcagcuaaaucagacggcgauaccauauugcugaacugucuagaagccuuuaagaggauacccccacaggagcucgaagggcuuauucaagccauccauaaugacgauaacaagguucgcgcguaccugauuugcuguaaauuacguuccgcuuaucugaucgcagugaagcaggagcacucucgggccacggcucucguccaacaggugcaacaggccgcaaaaaguagcggagacgccguagugcaggauauaugcgcucaauggcuguugacaucccacccuagaggugcgcauggccccgggucaaggaaguga

SEQ ID NO: 65052 - RNA, 1251 nt, Artificial Sequence
  derived and/or modified sequence opt3 from ZFYVE27__Homo_sapiens__NP_001002261
augcagaccagcgagagagaaggcuccgggcccgagcugucuccuucagugaugccagaagccccgcucgagagucccccuuucccaacaaagagccccgcuuuugaccuuuucaaccuggucuuguccuacaaaagguuagaaaucuaucuggagccucuaaaggaugcaggagacgguguucgguaccuccugcgcuggcaaaugccacuuugcucucuguugacuugucucggccugaaugugcuguuucucacguuaaacgagggggccugguauucgguaggagcgcugaugauuucagugcccgcucuuuugggcuaccugcaggaagucugccgagcccgucuaccugauagcgagcucaugagaaggaaauaucacagugugcggcaggaagaccugcagcgcgguagacuuuccaggccagaggcaguugccgaggugaagucuuuccugauacaauuggaggcuuuucucagccggcuguguugcaccugugaagcagccuaccgcgucuuacauugggaaaauccggugguauccucacaguucuauggggcucugcucggaacaguuugcaugcuuuaccuguugccccuauguugggugcugacucuccugaacaguacccuuuuucugggcaaugucgaguucuuucgaguggugagcgaauacagagccucuuugcagcagaggaugaacccuaaacaagaggagcacgcguucgaauccccacccccuccagaugucggcgggaaggacggacucauggauucaacacccgcacugaccccgacugagagcuuaaguucucaggaccugacaccugguuccguugaagaggccgaagaggcugagcccgaugaagaguuuaaggacgccaucgaagagacccaucuagugguacucgaagaugacgagggcgcaccaugcccugcugaggaugaacuggcccuucaggacaauggguucuugagcaaaaacgaggugcugcggucgaaggucucucgucucacggaacgccugagaaaaagguaucccacuaauaacuuuggaaauuguaccggcugcuccgcgacauucucagugcuuaagaaacggcgaaguuguagcaacugcgguaauuccuucugcucucgcuguugcagcuuuaagguuccaaagucaaguaugggggccacugcacccgaggcucagagagagaccguguucgucugugccuccugcaaccaaacacugagcaaauga

SEQ ID NO: 65053 - RNA, 2574 nt, Artificial Sequence
  derived and/or modified sequence opt3 from ZFYVE28__Homo_sapiens__NP_001166127
augaugaacagauucaggaaguggcuguacaaacccaagcggagcgacccucagcuccuugcccgcuuuuauuacgcugaugaggaacugaaucaaguggcagccgaguuggacuccuuagauggccgaaaagacccacagcguugcacccugcuagucucucaguucagaucaugucaggauaacguucucaauaucauuaaccaaauaauggacgaaugcaucccgcaggauagggcgccccgggacuuuugugugaaguucccugaggaaauucgccacgauaaucuggcugggcagcuuugguuuggagccgagugccuggcagccgguaguaucauuaugaacagagaguuggaaagcauggcuaugaggccacucgcaaaagagcugacacggucccuggaagacguacgcggcgcccuccgagaucaggcuuuaagagaccugaauacuuauacggagaagaugagggaggcccuucggcauuucgauguguuguuugcggaguucgaacugucuuacgucucggcaauggugcccguuaagucaccucgugaauauuacgugcaacaggaggucaucgugcuauuuugugaaaccguagagagcgggcucguuguguaugccgacggaccacugaaccuugaccgcaaagucgaggauaugagugaacuguucagacccuuucacacauugcucaggaagauacgggaccuguuacagacucugaccgaggaggaacuccauacacuugaacgaaaucugugcaucucccaggauguggaguucccuauucgcgcugacgugcaaggcccagccgcauuggcuccggcccuaucugcgccccugccuccagaggguccccucagcgccaaagcaaaggauccugacgcugaacuggccuguuccaugcaguacgaugaccaggagcuugaacaacugucaagaaugguccacagggcuggggaugagaugaguagcuugcucucuccacccaucgccugccaguccccggcacaucggccuggagccgaaggcucacccggcggggaggcuagcccaggacgcccuagacugaggagugguucugacgaggaggaacguguguuuuucauggaugacguugaaggcaccgcggaggcauuagcccggcccgaguccccagcugggcccuucggaugggccggcagcacuugggcagacccucaggaaaaaggucaagggggaccaggcggcgccgcugggauuucgcugccggccucugagaaggaagaggaucuauccaacaauaaccucgaagcagagggaacagacggugcgucacuggcuggcaccaguagcuguuccugccuugauucucgauugcaccuggacgggugggagguaggagccgaugacgcagaaacggccgagaugaucgcucacagaacuggcgguaugaagcucagcgccaccgugauauuuaaucccaaaucaccuacaagucuggauuccgcagucgcuacucaggaagccgcgagcgagccaguggccgaagggauggacggcggaccccauaaacuuucuaccggcgcuacaaacugucuguugcacucaugcguuugcugugggaguugcggagauagcagggaggacguggucgagcgccuccgggaaaaguguuccccugguggcgugauuggggcaucuuacgccgcuggacuggccaaggcaucggauagagcgccagagaggcaggaagaggcucccccgccuagcgaagacgcuuccaauggccgcgagccaaaagcccccaccucagauaagugcuuaccucauacgagugguucucagguagacacugcaagcgggcugcagggcgaggcuggaguugccggccaacaggaacccgaggcacgagaacuacacgccggguccccaucagcucacgaggcgccucaggcccucagcggaucuuccaguagcacagcagguucuuguuccucagacaaaaugggccccgaggcugccccagccgcuacccaugcagccccgcaggcgacucgggaaaagauccguaguagauuccacgggagccaugaucugauucacaggcuuuuugugugcaucucgggagucgcugaccaauugcagacaaacuaugccuccgaucugcgcucuauccucaagacccuguucgaggugauggcaacgaaaccugaaaccgacgauaaggagaaauuacggaaggucacacagacucugagaagcgccgcucuugaagacugugcauugugccaggagacccucucaaguuccgagcuggccgcgaaaacaagggauggcgacuuugaagaucccccagagugggugcccgacgaagccugugguuucugcacugccuguaaggcaccuuuuaccguuauucgacgcaagcaucacugccggucuugcgggaaaauauucuguagcagaugcuccucacacagcgccccacuacccagguacggccaagugaagccuguacgugucuguacacauugcuauauguuucacgugaccccguucuacagugauaaagcuggacuguga

SEQ ID NO: 65054 - RNA, 4278 nt, Artificial Sequence
  derived and/or modified sequence opt3 from ZFYVE9__Homo_sapiens__XP_011540739
auggagaacuacuuccaggccgaggcuuauaaucuggacaaggugcucgaugaauuugaacaaaacgaggacgaaaccgucagcuccacacuucuggauacuaaauggaauaagaucuuggaucccccuucucacagauuaucauucaacccaacgcuggcaaguguuaaugagagcgccguguccaacgagucucagccgcagcuaaaaguauuuucgcucgcgcauucagcuccccugaccacagaagaggaagaccacugcgccaauggccaggacuguaaccuuaauccugagauugcaacuauguggauagaugagaacgccguggcugaagaccaacugaucaagaggaauuacagcugggaugaccagugcagugcagucgaggugggggaaaagaaguguggaaacuuggccugccucccagaugagaagaauguucugguggucgcugugaugcauaacugugacaaacggacccugcagaaugaucuccaggacugcaacaacuauaauucccaaucuuuaauggacgccuucagcuguucccuggauaacgaaaaucgccagacagaccaguuuucauucaguauuaacgagagcaccgagaaggauaugaacucugaaaaacagauggacccccuuaaucgaccuaagacugagggucguuccguaaaucacuugugcccaacaucaagcgauagucuggcgucuguuuguucccccagccaacuaaaagacgauggcucgaucgggagagacccuucuauguccgcaauuaccucacucacgguggauagugucaucagcucccagggaacugacggcugcccagccgugaagaagcaggaaaacuacauaccggaugaggaccugaccgguaaaaucucuagccccaggacagaccuugggucaccuaauaguuuuucccauaugagcgaaggcauucugaugaagaaagagccagcugaggaaucuacuaccgaggaaucauugcggaguggacucccccuguuacugaagccugauaugccaaacggcagcgggcgcaauaacgacugugagagaugcuccgauugccucgugcccaaugaagucagggccgacgagaacgagggauaugaacacgaggaaacacuugguaccacggaguuccugaauaugacugagcacuuuucugaaucgcaagauaugacaaacuggaaauugaccaagcuaaacgagaugaaugacagccagguuaacgaagagaaagaaaaguuccugcagaucucccagccggaggauacuaauggcgacucagggggacaaugugugggccucgcagaugcuggucuggaccuuaaggggacaugcauuagugagucugaagagugugauuuuagcaccguaaucgacacgccugccgcgaacuaccuguccaauggaugcgauucauauggcaugcaggaccccggcgugagcuucgucccaaaaaccuugccuucuaaggaagacuccgugacagaggaaaaagagauagaggaaaguaagagcgaguguuacucuaacauuuacgaacagcgggggaaugaggccacugaaggauccggucuccuguuaaacucaaccggcgaucugaugaaaaagaauuaucuacauaacuuuugcagucagguucccagcgugcucgggcaaucguccccaaaggucguggcaucucugcccagcaucucaguaccuuucggaggcgcucgcccaaaacagccgaguaaucuuaaguugcagauucccaaaccucuguccgaccaccuccagaacgauuucccagccaauucugguaacaauacaaagaacaaaaacgacauccuggggaaggcuaaacuuggcgagaauagcgccacuaacguuuguucccccucacugggaaauaucagcaacguggauaccaauggcgagcauuuggaaaguuacgaggcagaaauuucuacacgaccuugccucgcccuggcuccagacucccccgauaacgacuuaagagcggggcaauuuggaauaagcgcaaggaaaccguucaccacucugggugaggucgccccugugugggucccagauucgcaggcucccaauuguaugaagugcgaggcccgguuuacguucacaaaacgucgccaccacuguagagcaugcggcaagguguuuugcgccucauguugcucucuaaaauguaagcuccuguauauggacaggaaggaagcucggguuugcgugaucugucauaguguacuuaugaacgcccaggcaugggagaauaugauguccgcgagcucucagagcccuaaccccaauaacccagcugaauacugcuccaccauuccucccuugcaacaggcccaggcaucaggggcccugaguagcccaccgccuacugucauggugcccguuggagugcucaaacacccaggcgcugaggucgcccaaccccgagaacagcgcagagugugguucgcagaugguauccugccuaauggggagguagcugacgccgcgaaguuaaccaugaacggcacaucuuccgccggaacccuggcugugucacaugauccaguuaaacccgucacuacaaguccucuuccggcagagacggacauauguuuguuuagcggcuccauuacccagguggggucuccagugggaucggccaugaaucucauccccgaagacggucugccuccaauccuaauuagcacuggcgucaagggggauuaugcuguugaggaaaaacccucacagaucuccgugaugcaacagcuggaggacggaggcccugauccgcucguguucguacugaacgccaaccuuuugaguauggucaagauugugaauuacguuaacaggaaaugcugguguuuuacaaccaaggguaugcacgcaguggggcagucugaaauagucauccuguuacagugccuccccgacgagaagugucugccaaaagauauuuucaaucauuuugugcaacuuuaucgggacgcgcuggccggcaacguugugagcaauuugggacacuccuucuuuucacagucuuuccucggcagcaaggagcacgggggauuccuguacguaacaaguacuuaccagucccuacaggaucugguccucccuacgcccccauaucuguuuggcauccuuauccaaaaaugggaaaccccuugggcuaagguguuccccauucgcuugaugcugagauuaggugccgaguacaggcucuauccaugcccgcuguuuagcgugcguuuccggaaaccucuuuuuggggaaaccggacauacaauaaugaaccugcuagcagacuuccgaaauuaccaguauacucuccccgucguucagggccuggugguagauauggaggugagaaagaccucuaucaagauuccaucaaacagguacaaugaaaugaugaaagcuaugaacaaguccaaugagcacgucuuggccgguggcgcaugcuuuaacgagaaagccgacagucaucugguguguguucaaaaugaugacgggaacuaucagacacaggcuaucagcauucacaaucagccccgcaaggugacuggagcgucguucuuugucuucucuggcgccuuaaaauccagcucaggguaccucgcaaagaguucuaucguggaagacggaguuauggugcaaauaaccgcugagaacauggauucccugcggcaggcccuuagagaaaugaaggacuuuacgaucacaugcggcaaagccgaugcugaggagccucaggaacacauucauauccagugggucgacgaugacaagaauguaagcaaaggugugguuucaccaauugaugggaagaguauggagaccaucacuaacgugaaaauauuccacggaagcgaauacaaggcaaacggcaaggucauuagguggacagagguguuuuuccuggaaaaugacgaucaacauaacuguuuguccgaccccgccgaucacucucgccucaccgagcauguagcgaaggcuuucugccuggcccuauguccucaccugaaacuucucaaagaggacgguaugacuaagcugggcuugcgagugacccuggauagcgaccaggucggguaucaggcaggauccaauggccagccguuaccaucacaauacaugaacgaccucgauucugcccugguucccgugauccacgggggagcuugccagcuuagugaaggcccuguggucauggagcugaucuuuuauauuuuggaaaauauaguguga

SEQ ID NO: 65055 - RNA, 627 nt, Artificial Sequence
  derived and/or modified sequence opt3 from ZG16B__Homo_sapiens__NP_660295
augggcgcccagggggcucaagagagcaucaaggcaauguggagagugcccggaaccacaaggcggccugucacuggugaauccccaggcaugcaccgcccggaggccaugcugcuccuucugacguuggcguuacuagggggacccaccugggcuggcaaaauguacgguccugggggaggcaaguauuucucuacaacugaagacuacgaucaugagauuaccggccugcgaguuucaguggggcuccugcuuguaaaaagugugcaggucaagcugggagacagcugggaugugaaauugggugcccucggcgggaacacacaggaaguuacccugcagccaggagaguauauaacuaagguguuugucgcauuccaagccuuucugcguggcauggugauguacacauccaaggacagauauuucuacuuugguaaacucgaugggcagaucucuucggcuuaucccucacaggagggacagguauuaguuggcauuuacggccaauaccagcugcuugggaucaagagcauuggauucgaauggaauuauccuuuggaggaaccaaccacggagcccccugugaaccugacuuacagugcaaauuccccagucgguagguga

SEQ ID NO: 65056 - RNA, 816 nt, Artificial Sequence
  derived and/or modified sequence opt3 from ZGLP1__Homo_sapiens__NP_001096637
augaccgagccccaggugggcugcgucgccuguccuagaguucacaaggaaccagcucaaguggggacaccguggcccgcaaaaccuaggagccauccacggaagcgcgaccccacugcccugcucccucgaucccuuuggccagcgugccaggagucuguaacggcucuguguuucuugcaggaaaccguggagcguuuaggacagucacccgcccaagauacaccuguccuggguccaugcugggacccgauggcacuaggcacucaggggagacuccugcuugauagggacaguaaagauacccagacacggaucagccagaagggacgcagacugcaacccccuggcaccccauccgcucccccucagaggcggccacgcaaacaguugaaccccugucgagguacugaaagaguggacccgggguuugagggaguuacacucaaguuccagauuaagccugauucuucgcugcaaauaauccccaccuacucacugccaugcagcaguaggucccaggagucuccugccgacgcagugggcggccccgccgcucacccagggggaacggaagcccauagcgcggguuccgaggcacucgaaccccggcguugugccucaugccgcacucagagaaccccuuuauggagggaugcugaggacggcacaccacuguguaaugccugcgggauucgguauaaaaaguacggaacucgauguaguagcugcuggcuugucccgcgcaaaaacgugcaacccaagagauugugcgguagguguggcguaucucuggauccuauccaggagggguga

SEQ ID NO: 65057 - RNA, 1536 nt, Artificial Sequence
  derived and/or modified sequence opt3 from ZGPAT__Homo_sapiens__NP_001076582
auggacgaggaaagccuggaguccgcccuccagaccuacagagcucaacuucaacagguggaacuggcauugggcgccggguuagauucuucagagcaggcggaccugaggcagcuacagggagaucucaaggaacugaucgagcuuacagaggcuagucuggucagcguucggaaauccucuuugcucgccgcacuggacgaagaacgccccggucgacaggaagaugccgaguaucaggcuuuccgugaggcaauuacugaagccguggaggcuccugccgcggcaagaggcucggggucagaaacgguaccaaaggccgaggcuggaccggaaagcgccgcaggcggucaagaggaggaagagggggaagacgaggaggagcugaguggaaccaaaguguccgcucccuacuauucuagcuggggcacacucgaguaccacaacgccauggucgugggcacugaagaggcggaagauggguccgccggaguuaggguguuauaucuguacccuacccauaagucacuuaaaccaugccccuuuuucuuggaggguaagugucgguuuaaggaaaauugccgcuucagucacggccaggucgugagccuggacgagcuaagaccuuuucaggauccagaccucucuucccugcaggcagggucagcuugucuugccaaacaucaagauggacuguggcacgcugccaggauaacagacguagauaacggcuauuacaccguuaaguucgacagcuugcuccugcgggaggcaguggucgaaggugacgggaucuuacccccucugcgcacugaggccacagaaagugauucugacuccgauggaaccggcgacagcucguacgcucgaguggugggcucugaugcggucgacuccgggacgugcucaagugcauuugccggaugggagguucauacuagagguauuggcagcaggcuccuuaccaaaaugggguaugaguucggaaagggccugggucggcacgcugaagggcguguggagccaauccacgccguaguguugccgcgcggcaaaucccuagaucagugugucgaaacacugcagaagcaaacuagagugggaaaggcaggcaccaauaaacccccuaggugccgggggcgaggagcccgcccagguggcagacccgcuccuaggaacguuuuugacuuccucaaugagaagcugcaggggcaggccccaggagcacuugaagcgggcgcugcccccgcaggucggcgcucuaaagauauguaccaugccagcaagucagcuaaaagagcccugaguuugaggcucuuucagacagaggagaagauugaacguacccaacgggacauccgauccauacaggaggcacuggcuagaaacgccgggaggcacagcguggcgucugcccaguuacaggaaaaacuggcuggcgcacaacgccagcuaggacagcuccgggcccaggaggcuggccugcaacaggaacagagaaaggccgauacgcauaagaaaaugacugaguucuga

SEQ ID NO: 65058 - RNA, 2622 nt, Artificial Sequence
  derived and/or modified sequence opt3 from ZHX1__Homo_sapiens__NP_009153
auggccagcagaaggaaguccaccacacccugcauggugcuggcuucugagcaggacccugaucucgaacuuaucucagaccuggaugagggcccaccggucuugacucccguugaaaacacgcgggcagagaguauuagcuccgacgaagaggugcacgagucuguagauucggacaaucaacagaacaaaaagguggaagggggauacgaguguaaauauugcaccuuccagacaccugauuuaaauauguuuacuuuccaugucgacucagaacacccaaacgugguucugaauagcaguuacgugugugucgagugcaacuuucuaaccaagcgcuaugaugcccucuccgagcauaaucugaaauaccaccccggugaagagaacuucaaacuuacaauggugaagcgaaauaaccagaccauauuugaacaaacuaucaaugaccugacauucgauggcucuuuuguaaaagaggaaaacgcggagcaggcugagagcaccgaaguuuccucaagugggauuagcaucucuaagacgccuauuaugaaaaugaugaagaauaaaguggagaacaagcguaucgccguccaucacaauuccguggaagacgugccagaggaaaaggagaacgagauaaaacccgauagagaagagaucgucgaaaacccuucaagcagugcaucugaguccaauacuagcaccucgauuguuaacaggauccacccaucuacagccuccacugugguaaccccggcugcaguguugcccggacucgcccaggucauuacagcugugucagcccagcaaaauaguaaccugaucccuaagguucugauaccagugaauagcauucccaccuauaacgcggcacucgacaauaacccuuuacugcuuaauacguacaacaaauucccauaucccacuauguccgaaaucacagucuugucugcccaggcuaaguacaccgaggagcagauuaaaaucugguuuagcgcccagcggcugaagcauggcgugucauggacuccggaagagguagaagaggcacgcagaaaacaauucaaugguacaguucacaccgugccucagacgaucaccgucauucccacacauauaaguacuggguccaacggacuaccaagcauccuccagaccugucaaauugugggccagccuggccugguccuuacacagguggcugggacuaauacccugcccguuacagccccaaucgcguugaccguggccggaguacccucucagaacaauauacaaaagucacaggucccugcagcucagccaacugccgagacgaagccggcuacagccgcagugcccaccagucagagcguuaaacacgaaacugcccucgugaacccugacuccuuugguauuagggcuaagaaaaccaaggagcaacuggcggaauuaaaagucucuuaccugaagaaccaguucccacacgauucggagaucauccggcucaugaagauuacaggccuuaccaaaggggaaaucaagaaaugguuuagcgacacucgcuauaaucagcgaaacuccaagucaaaucagugccugcauuugaacaaugauaguucuacaacgauuauaaucgacagcuccgaugagaccacugagucacccacagugggaaccgcacaaccuaaacagagcuggaacccauuccccgacuucacaccgcagaaguuuaaggaaaagacugccgagcagcuaagaguacugcaagcuaguuuccucaauuccagugugcugaccgaugaggagcuuaacaggcugcgggcccagacgaaguugacccgucgcgaaauugacgcaugguuuacagagaaaaagaaaagcaaggcccucaaggaggagaaaauggaaaucgaugaaucuaaugcuggcuccucaaaggaggaagccggugagacuucuccugcagacgagagcggggcgccaaaaucgggauccaccggcaagaucuguaaaaagacacccgaacagcugcacauguuaaaaucugcuuucguuagaacucaauggccuagccccgaggaauacgauaagcuggccaaggagucaggccuagcaaggaccgacauugucaguugguuuggggacacgcgguaugccuggaaaaacggaaaucucaagugguacuauuacuaucaguccgcuaacucuagcuccaugaauggucugucaagccuucgaaaacgcggcagagggaggccaaagggacggggccgcgguagaccuagggggcguccccggggcaguaaacgaauaaacaauugggauagaggaccaucuuugaucaaguucaagacaggcaccgccauucugaaagacuacuaccucaagcauaaauuucugaacgagcaggaucuugacgaacuggugaacaagucccacaugggguaugaacaggugagggaaugguucgcagagcgccaacggagaagcgaauugggaaucgagcucuuugaggaaaaugaggaagaggaugaagucauugacgaucaggaggaggacgaagaggaaacugaugacucggauacaugggagccgccuaggcauguuaaacgcaagcugucaaagucugacgauuga

SEQ ID NO: 65059 - RNA, 2514 nt, Artificial Sequence
  derived and/or modified sequence opt3 from ZHX2__Homo_sapiens__XP_011515234
auggccagcaagagaaaauccaccacacccugcauggugaggacuucucaggucguugagcaagacgugccugaagagguagaucgggcuaaggaaaaaggcaucgggacgccacagccggacguggcaaaggauucaugggccgcggagcuggaaaacaguagcaaagagaaugaggucauugaagugaaguccaugggagagucucagucgaagaaacuccaggguggcuacgaauguaaguauugccccuacucaacccaaaaccuuaaugaguucacagagcacguugacaugcagcauccuaacgugauacugaauccauuguaugucugugcugaaugcaacuuuacuaccaaaaaguacgauagcuuaagugaccacaauuccaaauuccaucccggggaggccaacuuuaagcugaagcuaaucaaacgcaauaaccagacagugcucgaacagucuauugagaccacuaaucacguaguuagcaucacaaccuccggaccuggcacgggugauucagacagugggauuagcgugucuaagacuccaaucaugaaacccggaaagccuaaagcagaugccaagaaagucccaaagaagccggaagagauaacccccgagaaccauguggaaggcacagcucgacuggugacugacaccgcagagauccuuucccgucugggcggggucgaauugcuccaagauacacugggacacguuaugccuucagugcagcugccacccaauauuaaccucguaccuaaagugccaguccccuuaaauaccacgaaguauaacagcgcccuggacacuaacgcuacaaugaucaauaguuucaacaaauuuccguacccuacccaggccgagcuuucuugguugacugcggcauccaagcaccccgaggaacauauuagaaucugguucgccacacagaggcugaaacacgguauaagcuggucgccagaggaaguggaggaagcucggaagaagauguuuaauggcaccauucaaucuguuccucccacgaucaccgugcuaccagcccagcucgcacccacaaaagucacucagccuauucugcaaaccgcacuuccaugucagauccuggggcagacauccuuggugcucacucagguaaccucaggaaguacaaccguuagcugcuccccgaucacucuggccguggcgggcgucacgaaccauggucaaaagcgccccuuagugacaccucaggccgcaccagagcccaaaagaccucacauugcucaggucccagaacccccgccuaagguggccaauccaccccugaccccugcuucugauaggaaaaagacuaaggagcagauagcccaccucaaagcuagcuuccuucaaucacaguuucccgacgacgccgagguuuaucggcugaucgaagugaccggguuggcucgcagugagauuaagaaaugguucuccgaucaucgauacagaugucagaggggaaucguacacauaacaagcgaaucucuagcgaaggaccagcuggcaauugccgcuucacggcauggccguaccuaccacgccuauccagauuuugcaccucaaaaauucaaggagaagacucagggccaggucaaaauccucgaggacaguuuucugaaaagcuccuuccccacacaggccgaacuugaucgccugagaguggagacgaaauugucuaggcgggaaaucgacucgugguucagcgagcgacgcaagcucagagauuccauggaacaagcuguucuggacucaauggggaguggaaagaagggucaggaugugggcgccccaaacggggcauuaucuaggcuggaccagcuaagcggagcgcaacucaccuccucacugccgagcccuucucccgcuauugccaaaucccaggagcagguccaucuuuugcggaguacuuuugcacgcacacaguggccaacaccccaagaguacgaucagcuggccgcuaagaccggccucgugagaacugaaaucguaaggugguucaaggagaaucguugccugcuuaaaaccgguacggugaaguggauggaacaguaucagcaccaaccuauggccgacgaccacggguacgaugcaguugcucggaaagccaccaagccaauggcggagagccccaaaaacggcggagacgucgugccucaguauuacaaggauccgaagaaacugugugaagaggacuuggagaagcucgugacacgagucaaaguuggcucugaaccagccaaggauugccugcccgcuaaaccuuccgaggcaacuucagacagaagugaagggagcucgagggauggacaggguuccgacgagaaugaagagucuagcgugguggauuauguagaggucaccgugggcgaagaggacgccauuucagaucgcagugacuccuggucucaggcugccgcagaagggguuagcgaguuagcggaguccgauucagacugugugccagccgaagcuggacaagccuga

SEQ ID NO: 65060 - RNA, 1344 nt, Artificial Sequence
  derived and/or modified sequence opt3 from ZIC1__Homo_sapiens__NP_003403
augcugcucgacgccggcccccaguacccugcuaucggggugaccacauucggagcaagcagacaccauuccgccggugaugucgcggagagggacguuggccuugggauuaacccauuugcugauggaaugggcgccuucaagcugaauccgucuucacacgaauuggcaagugccggucaaacugcuuuuacgagccaggcacccggguaugccgcugccgcggcauuaggacaucaccaucacccuggccacgugggcuccuacucuucggccgcuuucaacucaacccgggacuuucuguuccgcaaucgaggguuuggagaugccgcagcugccgcgagcgcccagcauagucuauucgcagcuuccgccgguggcuuugggggaccacacggccauacagacgcugccggucaccuccuguuccccgggcuucacgagcaggcagccggacaugcuucuccuaacguagugaauggccaaaugcgucugggcuuuagcggggauauguauccaagacccgaacaguacggacaggucacuuccccuaggucagagcacuaugcggcaccacaguugcaugguuacggcccgaugaacgugaauauggccgcucaccauggggccggagcauucuuucgguauaugcgccaacccauaaaacaggaacucaucugcaaguggauugagccugagcagcuggccaaccccaaaaagaguuguaauaaaaccuucagcacaaugcacgaacugguuacccacgugacugucgagcaugugggcgguccagaacagucuaaccacaucugcuucugggaggaguguccuagagaagggaagccauuuaaggcuaaauacaagcucguaaaucauauuaggguucacacaggcgagaaacccuucccgugcccuuuucccggauguggcaagguguucgcccgguccgaaaacuuaaaaauccacaagcgcacccauacgggggagaagccauuuaaaugcgaguucgaaggaugugaccgaagauuugcaaauucaagcgauaggaagaaacacaugcauguccacaccagugacaagccuuaccugugcaaaaugugugauaagucuuauacucaucccuccagccuucggaaacacaugaaggugcacgagucgucuucccaagguucacagccaagucccgcggcuagcuccggcuacgaaucuagcacaccuccaacuauagugucaccgaguaccgacaaccccacaaccuccagcuugucuccuucaaguagcgccguccaucacacggcagggcauuccgcccugucuucgaauuucaacgagugguauguuuga

SEQ ID NO: 65061 - RNA, 1599 nt, Artificial Sequence
  derived and/or modified sequence opt3 from ZIC2__Homo_sapiens__NP_009060
augcugcucgacgccggcccccaguucccugcuaucggggugggcagcuuugcaagacaccaucaccauuccgccgcggcugccgcagccgcugcagccgagaugcaagauagggaacuuucucuggcugccgcgcagaacgguuucgucgacucagcagccgcucacaugggcgccuuuaaguugaauccaggggcacaugaguuaaguccgggacagagcuccgcuuucaccucucagggccccggugccuacccugggucggcggccgcagcugccgcugccgcagcccugggaccacacgcugcgcacguuggcucauauagcggacccccuuuuaacaguacacgggauuuccuauuucgcucccgaggguucggagacucugcaccagguggcgggcaacauggacucuuuggccccggugccgggggacugcaccaugcucacagcgaugcccagggccaccuucuguucccuggcuugccagaacagcaugggccgcacggaucccagaaugugcucaacggucaaaugcgucugggccugcccggggagguauuuggaagaucagaacaguacaggcaaguggcaaguccucggacugacccauauagcgccgcucagcuccauaaucaguacggccccaugaacaugaauauggguaugaacauggccgcagcggcugcccaccaucaccaccaucaccaucaccacccuggggcauucuuucgcuauaugagacagcagugcauuaaacaagaguuaauauguaaguggaucgauccagagcagcugucuaaucccaaaaaguccugcaacaaaacguucucaaccaugcaugaacuugucacacacgugagcguugagcaugugggcggaccggaacagaguaaucacgucuguuucugggaggagugcccuagggaaggcaagcccuuuaaggccaaauacaaguuggugaaccauauucggguacacacuggggagaaaccauucccuugucccuuuccaggaugcgguaagguuuucgcucgcucugaaaaucugaaaauccacaagcgaacccauacaggcgagaagcccuuucagugugaguucgaagggugcgacagaagguuugccaacuccagcgaucggaaaaagcacaugcaugugcacaccucggacaaaccuuaucuauguaagaugugcgauaaaucuuacacucauccauccucacuccguaagcacaugaaaguccacgagaguagcccgcaaggauccgaaucuagccccgcagcuucaaguggcuacgaguccagcacaccuccaggucuggugucucccucagccgaaccucagaguagcuccaaucuuucuccagcggccgcugcagccgcugccgcagcggccgcugccgcagcugccgugucggcaguccaucgcgggggcggaagcggcuccgggggagccgguggcgggucaggaggcgguagugggucuggcggaggcgggggaggcgcuggugggggaggcgguggcagcuccgggggaggcucagggaccgcgggaggccacagcggucugucuuccaacuucaacgagugguauguuuga

SEQ ID NO: 65062 - RNA, 1404 nt, Artificial Sequence
  derived and/or modified sequence opt3 from ZIC3__Homo_sapiens__NP_003404
augaccaugcugcucgacggcgggccccaguucccuggacuuggugugggcagcuuuggggccccaagacaccaugagaugccgaacagggaacccgcuggaaugggccugaauccuuucggugauuccacacacgcagccgcggcugccgcagccgcugcagccuuuaaguugucuccagcugccgcgcaugacuuaucaagugggcaaagcuccgcauucacuccccagggaucuggcuacgccaacgcucugggccaccaucaccaccaucaccaucaccaccaucacacgucgcaggucccuucauaugggggagccgcaagcgcugccuuuaauaguacccgggaguuccuauuucgccagcgauccucuggucucagcgaagcggccuccggcgggggacaacauggccuguucgcagguucagcuaguagccuucacgccccagcugggauccccgagccuccaucuuaccuguuguuuccgggacuccaugaacagggcgccggccaccccuccccuacagggcacguugauaacaaucaggugcaucugggacugcguggugaacucuucggcagagcagacccauauaggcccguagccucaccucggacugauccauacgcugcgggggcacaguuucccaacuauagcccgaugaauaugaacaugggagugaaugucgccgcucaccauggcccuggugccuucuuucgcuacaugagacaacccauuaaacaggaguuaaguugcaaguggauagacgaggcacagcugucuaggccuaaaaaguccugugaucggaccuucagcacaaugcacgagcuugugacccacguuacuauggaacaugucgggggcccagagcagaacaaucacgugugcuauugggaggaauguccccgcgagggaaaaucguucaaggccaaguacaaauuggugaaccauauccgaguacacacaggcgaaaagccauuucccugcccuuucccaggguguggaaaaauuuuugcuagaucugagaaucugaagauccauaaaaggacccacacgggugaaaagccguucaagugcgaguuugagggcugugaccggcguuucgccaacuccucagaucgcaaaaagcacaugcauguucacaccagugacaaacccuacauuugcaaggugugugauaaaagcuauacucauccuuccucucuaagaaagcacaugaaaguccaugaaagccaagggucagacaguuccccagcagcgagcucuggauacgagucaaguacacccccugcuaucgccagcgcaaauuccaaggauacuaccaagacaccaucugccgugcagaccucgacgagccacaaccccggccucccgccuaacuuuaaugaaugguauguguga

SEQ ID NO: 65063 - RNA, 1155 nt, Artificial Sequence
  derived and/or modified sequence opt3 from ZIC4__Homo_sapiens__NP_001161850
augcccccuuucugcagaaacgccaagcugggccuccuuagcuuucugaucugugcugggagguccuuguuaccacuggguaaaaaugcauucuggcuagagcggauugaaaacaauaacacccucugggagaaggcccagucucagaaaaugcgcuacaagacaucacuggugaugcgaaaacgucuuagacuguauaggaauacuuugaaggaaaguagcuccucuucgggacaccauggcccgcaacucacggcggcuucaagccccagugucuuuccugggcugcacgaggaaccaccccaggccuccccuucucggccacugaacggacucuuacgccugggccuucccggugacauguacgcaagaccugagccauucccgcccgggccugccgcuaggagcgaugcauuggccgcugccgcggcacugcauggauauggcggcaugaaucuaaccguuaaccucgccgcuccacacgggcccggagccuuuuuccgguacaugcgccagccuauaaagcaagagcugaucugcaaauggcuugcagcugacgguacagccacuccaucccuguguucaaagaccuuuaguacaaugcaugaauuggugacccacguaacuguggagcacgucggcgggcccgaacaggcgaaucauauuugcuucugggaggaguguccgcgacagggaaaaccuuuuaaggccaaauauaagcucgugaaccacaucagaguucauacaggcgaaaagcccuucccaugcccuuuucccgguugugggaaaguguucgcaaggagcgagaaucugaagauucacaaacggacccacacgggagaaaagccauuucguugcgaguucgaaggcugugagcgcagauucgcuaacucuuccgauaggaaaaagcauucacacguccauacuagcgacaaacccuauaccugcaaggugcggggcugugauaagugcuacacacacccuaguucuuuacgaaaacauaugaagguacacgggcgcuccccaccgcccagcucgggauacgacucugccacuccuuccgcucugguuucaccaaguagcgauugcggucacaaaucccagguggccucuagcgcagccgucgcugcgagaaccgcagaccucucagaguga

SEQ ID NO: 65064 - RNA, 1992 nt, Artificial Sequence
  derived and/or modified sequence opt3 from ZIC5__Homo_sapiens__NP_149123
auguuccugaaggccggcagagggaacaaagugcccccugucaggguuuacggaccagacugcgugguacucauggagccgccccuuagcaagcggaauccuccagcucugcgcuuggcagauuuagccaccgcucaggugcaaccccugcagaacaugacagguuuuccugcgcuagccggcccacccgcacacucccagcuccgagccgcugucgcacaucugcgucuuagagaccugggggccgauccuggaguggcuacuacgccauugggcccggaacacauggcccaggcgucuacccucggucugucacccccuagucaagcauucccagcccaucccgaggcuccugccgcagcugccagggcggccgcacugguugcucacccaggggccggaagcuaucccuguggcggcggguccucuggagcucagccgucggccccucccccaccagcacccccacugcccccuacaccaucaccgcccccuccacccccuccacccccgccuccagccuuaagcgguuacacuaccacaaauaguggcgggggaggcuccucugguaaagggcauagccgggacuuugugcugcgcagagaucuuuccgcuaccgcgcccgcagccgcuaugcacggagccccuuugggcggcgaacagaggucagggacuggaaguccccagcacccagcaccucccccacauagcgccgguauguucaucucugcuuccggcacauaugccgggccggacggaucaggcgguccugcacuguuucccgcgcuacacgauaccccaggggcucccggcggacauccucacccacucaacggccaaaugcggcuggggcuugccgcagccgcugccgcagcugccgcggagcuguacggacgcgccgaacccccuuucgcuccgcgaagcggugacgcacacuauggcgccgucgcugccgcagcggccgcugccuugcauggguacggagcagugaaucucaaccugaauuuagcugccgcagccgcugcggccgcagcuggcccagguccccaccuccagcaucacgccccuccacccgccccuccgcccccuccugcucccgcacagcauccacaccagcaccauccucaccuccccggggccgcgggcgcuuuucuuagauauaugaggcaaccaauuaagcaggagcugauaugcaaauggaucgauccggacgaguuggccggacuaccucccccacccccuccacccccuccgccacccccucccccuccagcaggcggggccaagcccuguaguaagacguucggaacuaugcaugaacugguaaaccacguuaccguggagcacgucgguggcccagaacagucuucccaugugugcuuuugggaggauuguccucgggaggggaaaccguucaaggcuaaauacaagcucauuaaucacauccgugugcauacaggagaaaaacccuuuccaugcccuuuccccggcugugguaaggucuuugcacgcagcgagaaccugaagauucacaaaagaacucauaccggggaaaagccauucaaaugcgaguucgacggcugugauaggaaguuugccaauucgucugaccggaaaaagcacucccacguucauacaucagacaaaccuuacuauugcaagauccgaggaugugauaagaguuacacccaccccagcucccuucgcaaacauaugaagauacacugcaaaucuccgccaccuagccccggcccacugggguauucaagugugggaacgcccguaggcgcgccuuuguccccggugcucgaccccgcuagaagccauucuucaacucugaguccacaagucacaaacuuaaaugaaugguacgugugccaggccagcggugcaccuucccaucugcacacccccucuucgaacgggacuacaagcgagaccgaggaugaagagaucuauggaaauccugaaguugugaggacgauucacuga

SEQ ID NO: 65065 - RNA, 1464 nt, Artificial Sequence
  derived and/or modified sequence opt3 from ZIK1__Homo_sapiens__NP_001010879
auggccgcugcagcccugagagcgcccacccaggugacagucagcccugagacucacauggaccucacgaagggcugcguuaccuucgaagauaucgcuauuuacuuuucccaagacgagugggggcuucuggaugaagcccagagguuguuauaucuggaggugaugcuagaaaacuucgcacucguagccucucugggauguggucauggcacagaggacgaggaaacuccaucagaucagaaugugagugucggggugagccaguccaaagcuggaucuucgacccaaaagacacagucaugcgagauguguguuccggugcuuaaagacauacugcacuuggcagaucuccccggccagaagccuuaccuggucggugaaugcaccaaccaucaccagcaucaaaaacaccacagcgccaagaagagucugaaacgggacauggaucgcgcuuccuaugugaaguguugccucuuuuguaugucuuuaaaaccauuccgaaagugggagguagggaaagaccugcccgccaugcuucguuugcugagaagccuaguuuuuccuggaggcaagaagccaggcacuaucacagagugcggggaagauauuaggucccagaaaucacauuacaagaguggagagugugguaaagcgagccggcacaagcauacccccguguaucacccucgcgucuacacgggcaaaaagcucuaugaaugcucuaaaugugggaaggcauucagaggaaaguacucccuggugcagcaccagagggugcauacuggcgagcggccaugggaaugcaaugagugcgguaaauuuuucucacaaaccagccaccuuaacgaccaucgccgaauccacacaggggagagaccguacgaauguagugagugcggaaagcuguuuaggcaaaauucuuccuuggucgaucaucagaaaauucacacuggcgcccggcccuaugaauguagccagugcggcaagucguucucucagaaagcuacccucguuaagcaccagcgugugcauacaggggagcgcccuuacaaguguggagaaugcgguaacuccuuuucacagagugccauccugaaucaacacagaaggauacauaccggcgcaaaaccauaugagugugggcagugcggaaagagcuucucccagaaagcuacguuaaucaagcaccagcggguacacacuggcgagcgacccuacaaauguggugacugcgggaagucuuuuagccaaucaaguauucugauccagcaucgcaggauucacacaggcgccagaccuuaugaauguggacagugcggcaaguccuucagccagaaaucugggcucauccaacaucaggugguccacaccggagagcggccauacgaaugcaacaagugugguaauucauucagucagugcagcucccuuauacaucaccagaaaugucacaacacuuga

SEQ ID NO: 65066 - RNA, 1584 nt, Artificial Sequence
  derived and/or modified sequence opt3 from ZIM2__Homo_sapiens__NP_001139799
auguaccagcccgaggacgauaacaauagcgacgugaccuccgaugacgauaugacaagaaacaggcgggaaucuucaccuccacacaguguccauagcuucuccggcgaccgcgauugggaccgacgugggagaucuagggauauggagccgcgggaccgcuggucgcacacuagaaaucccaggucacggaugccuccacgcgaucugagccuccccguuguggccaagacgaguuuugaaauggaccgagaggaugacagagacuccagggcuuaugaaucucggagccaagaugcagaguccuaccagaacguaguggaccuugccgaggaucguaaaccucauaauaccauccaggacaacauggaaaauuaucgcaagcuguugucauuaggauuccuggcgcaggauagugucccagcugagaaaagaaacacagaaaugcuagacaaucuccccagcgccgguucucaauuuccugauuucaagcaccugggcacuuuucuuguguucgaggagcugguuaccuuugaagacguguuggucgauuucuccccagaggaacucucaagccugagugcagcccagaggaaccuguaccgggaggugaugcucgaaaauuaucgaaacuuaguaucucuggggcaucaguuuuccaaaccggacauuauaagccgccuugaggaggaagagucguacgcuauggaaacagauucuagacacaccguuaucugccagggagagucccacgacgaccccuuggaaccucaucaaggcaaucaggagaagcugcuaacuccaauuacaaugaacgaucccaagacccucacgccugagaggucauaugguagugacgaguucgaacggagcuccaaucugucuaaacagagcaaggauccacuugggaaagacccccaggaaggaacugcaccgggcaucuguaccucaccucaaagugccucccaggagaacaagcacaaccgcugcgaauuuuguaaaagaacauucagcacucagguggcucugaggcgucaugagcggauucacaccggcaagaagcccuacgagugcaaacaaugugccgaagcguuuuacuugaugccacaccucaaucgacaucagaagacacacucugggagaaaaaccucaggaugcaacgaggguaggaagccuaguguccagugugcaaaucugugcgaacgcgugcggauccauagccaggaggauuauuucgaguguuuccaaugcggcaaagccuuuuuacagaacgugcaucugcuccagcaccuuaaggcucacgaagccgcaagaguccugcccccaggguugucccacucuaaaacguaccuaauaagguaucagcgcaagcaugacuacguuggagagcgagcuugucaaugcugcgauuguggccggguguucucgcguaauagcuaucugauccagcacuacagaacucauacacaggaaaggcccuaucagugccaacucugugguaagugcuuugggcgcccuuccuaccugacccagcacuaccagcuucacucacaggagaaaacuguagaaugugaccauugcuga

SEQ ID NO: 65067 - RNA, 1584 nt, Artificial Sequence
  derived and/or modified sequence opt3 from ZKSCAN1__Homo_sapiens__NP_001273983
auguggggccaggacagcacccugcaagauacacccccuccagacccggagaucuucagacagagguuucggcgcuucugcuaccagaacacuuuugggccccgagaagcccucucccgucuuaaggagcugugucaccagugguugagaccugaaauuaauacgaaagagcaaauauuagaacugcuagugcucgagcaguuccugucuauccuuccaaaggagcugcaggucugguugcaggaauauaggcccgauucaggagaggaagcuguuacccuccuggaggaccuggagcucgauuuaaguggucaacaggugccuggccagguacaugggccagaaaugcuggcacggggaauggugccccuugacccuguccaggagagcuccucuuuugauuugcaccaugaagccacacaaucgcacuucaaacauucaagccgcaagccaagacugcuacagaguagggcgcucccggcugcccacauucccgcaccuccacacgagggcucccccagagaccaggccauggcuucugcacuguuuacugccgauagccaagcuauggugaaaaucgaagacauggccguuucccuuauucuggaggagugggguugccagaacuuggcgcgccgaaaucucucaagagauaacaggcaggaaaauuacgggagugcauucccucagggaggcgagaaccggaaugaaaacgaggaaagcaccucuaaggccgagacauccgaggacucagcuagccguggcgaaaccacugggcgcagucaaaaggaguuuggagaaaaacgggaucaggaggguaagacaggcgaaaggcagcagaaaaauccagaggagaagacccggaaagaaaagcgagacucugggcccgccaucggaaaggacaaaaagacgauaacuggcgagcgcgguccgagagaaaaagggaagggacugggcagguccuucagcuuaucgucuaacuuuaccacaccugaggaggugcccacuggcaccaaaucccaucggugugaugaaugcgggaaguguuucacacgcucaaguagccugaucagacacaaaauuauccauaccggagagaagccauaugaaugcuccgagugugguaaggcauuuucucucaauagcaaccuuguccugcaccaaaggauucacacgggcgaaaaaccucaugagugcaaugagugugggaaggcuuucucacacaguuccaacuugauccuacaucagcguauacacagcggagaaaaacccuacgagugcaaugaauguggcaaggccuucucucagucaagugaccugacuaaacaucagcggauucacacaggugagaagccauaugaaugcagcgagugcgggaaggcguuuaaccgaaacuccuaccucauccugcacagaaggauucauacccgcgagaaacccuauaaguguacuaaaugcggcaaggccuucacacggucuucgacccuuacgcugcaccauagaauccacgcaagggaacgcgcuagcgaguacuccccugccucauuggaugcuuuuggagccuuccucaaaaguuguguguga

SEQ ID NO: 65068 - RNA, 1173 nt, Artificial Sequence
  derived and/or modified sequence opt3 from ZKSCAN3__Homo_sapiens__NP_001229824
auggcccugcucacccccgcuccuggaagccaguccucucaauuccagcuuaugaaggcacuguugaaacacgagucaguggggagucagccauuacaggacagaguccugcaaguuccggugcuagcccauggagguugcuguagggaagauaagguaguggcgagccggcucacacccgagucccagggccugcuuaaagucgaagacguggcucugacuuugacgccugaguggacccagcaggauucuucgcaagggaaccucugccgcgacgaaaagcaggagaaucacggaucacugguuagccugggcgaugagaaacagacaaagagucgagaccucccacccgccgaagaguuaccugaaaaggagcaugguaaaaucuccugucaucugcgugaggauauugcacagauaccaacuugcgccgaagcuggggagcaagaaggaagacuucagaggaagcagaaaaacgcaaccggcggccggcgccacaucugucacgagugcgggaagucuuuugcccaaagcuccggauugucaaaacacagaaggauucauacaggugaaaagcccuacgagugugaggaaugcggcaaggcuuucaucgggaguagcgcccuggugauucaccagcggguccauaccggagagaaaccuuaugaaugugaggaaugcggcaaggcguuuucucacuccucagaccuaaucaaacaccagcgcacucauacaggugagaagccauacgagugugaugacugcgggaaaaccuucagccagaguugcucucuccuggaacaccaucgaauacacacgggagagaagccguaucaauguuccaugugcggcaaagcauuuagaaggagcucgcaucuucugcggcaccagcguauccacacuggcgauaagaaugugcaggaacccgagcagggggaagccuggaagucucgcauggagucccaauuggagaacguagaaaccccuaugucauacaaauguaaugagugcgaaagaaguuucacacagaacacuggacucauugagcaucagaagauccacaccggugagaaaccauaucaguguaaugcuugcggcaagggguuuacaaggauuagcuaccugguucaacaucagcggucccacgugggcaaaaacaucuuaucucaguga

SEQ ID NO: 65069 - RNA, 831 nt, Artificial Sequence
  derived and/or modified sequence opt3 from ZKSCAN7__Homo_sapiens__NP_001275520
augaccacagccggcagagggaaccugggacucauccccaggagcacugcuuuccagaagcaagagggucggcuuacggugaaacaggaaccugcaaaucagaccuggggccagggguccucucugcaaaagaacuacccaccggucugcgagauuuuucgcuugcacuuccgacaguuauguuaucaugaaaugucaggaccccaggaggcccugagucgucuaagagaacucuguaggugguggcugaugccugagguucacacaaaagagcagauacuugaacuguuggugcucgagcaauuucugagcauccugccaggcgaacuccggacuuggguacaguuacaucaccccgaguccggugaggaagcgguggcugucguggaggacuuccagcgccaucugucugggucggaagagguuucagccccugcacagaagcaagaaaugcacuuugaggagaccacagcccuuggaaccacuaaagaaagcccacccacaaguccuuuguccggcggcucugcuccaggggcacaccuggagccgcccuacgauccuggaacccaucaccuaccaagcggugacuucgcccagugcacgucccccgugccuacucucccacaggucggcaauucaggggaucaagcuggagccaccgugcugagaaugguaaggccccaggacacaguugcguaugaagaucuuaguguggacuacacucagaagaaguggaaaagccugaccuugucucagcgggcacuccaauggaacaugaugccggagaaucaucacuccauggccucacugggcuggagcacaauggcuuga

SEQ ID NO: 65070 - RNA, 867 nt, Artificial Sequence
  derived and/or modified sequence opt3 from ZMAT3__Homo_sapiens__XP_005247763
augauccugcuccagcacgccgugcuucccccuccaaagcaaccgagccccuccccuccaaugucugucgcuaccagaucaacaggcacucugcaguugcccccucagaaaccauucgggcaggaggcaaguuuaccccuggccggagaagaggaacuaagcaaggguggcgagcaagacugcgcgcucgaagaacuguguaaaccucuuuacugcaagcuguguaacguuacgcucaauuccgcucagcaggcccaggcacauuaucaagggaaaaaccacggaaagaaguugaggaauuacuaugccgcuaacucuugcccaccgcccgcacggaugucgaaugugguagagccugccgcuaccccagugguccccgugccuccacagaugggcucauuuaaacccggugggcgcguuauucuggccacagaaaacgauuacuguaagcugugcgacgcgagcuucaguuccccggcaguggcccaggcucauuaucagggcaaaaaucacgccaagcgacuccguuuagcagaggcucaaucuaacagcuuuuccgaaucaagugagcugggacagagaagggcccggaaagagggcaaugaguucaagaugaugccuaaccgcagaaauauguacacuguccagaacaauagcgggcccuauuuuaacccaaggucucggcaacgcauaccucgagaucuugcgaugugugugacccccuccggacaguucuacugcucaauguguaauguaggugccggcgaggaaauggaguuuagacagcauuuggaaagcaagcagcacaaaaguaagguuucugagcaaagguaccggaacgagauggaaaaccugggguauguguga

SEQ ID NO: 65071 - RNA, 462 nt, Artificial Sequence
  derived and/or modified sequence opt3 from ZMAT4__Homo_sapiens__NP_001129203
augaaaagcuccgacaucgaucaggaccuguucaccgauucuuacugcaaaguguguucagcccaacucauuagugagagccagagagucgcucacuaugaauccaggaagcaugcaucuaaaguucggcuuuacuauaugcugcacccccgcgacggcgggugcccugccaagcgauugcguucggagaacggaucagaugcggacaugguggauaaaaauaaguguugcacauuauguaacaugagcuuuacgagugcuguaguggccgacucccauuaccaggguaagauacacgcaaaaagacugaagcuacuccugggcgaaaagacuccacuuaagaccacagggcugaggcggaauuaucgcugcacuaucuguucugucagcuugaacuccauugagcaguaccaugcccaccucaaaggaucaaagcaccaaaccaaucugaagaacaaauga

SEQ ID NO: 65072 - RNA, 3204 nt, Artificial Sequence
  derived and/or modified sequence opt3 from ZMIZ1__Homo_sapiens__NP_065071
augaacagcauggacagacacauccagcaaaccaaugauaggcugcagugcauuaagcagcaucuccagaaccccgccaauuuccacaacgcugcaacagagcuucuggacugguguggcgauccucgggccuuucaacgcccauucgaacaguccuugauggggugcuuaacuguggucucucgaguugcggcucagcagggauuugaccuggaucuagguuaccgucuccuggccgugugugcagccaauagagacaaauucacgccgaagucagcugcacuucugaguagcuggugcgaggaauugggcaggcuccugcugcuccggcaucaaaaaucccgccagucugaucccccugggaaguuaccaaugcagcccccucugucgucaaugagcaguaugaaaccaacccuuucccacucugacgggagcuuucccuaugauuccguaccuuggcagcaaaacacaaaucagccaccgggcucauugaguguggucacuaccgugugggguguuacaaacaccagccagucucaagugcuggggaaucccauggccaacgcuaauaacccuaugaauccaggaggcaaccccauggccuccggcaugacuacaucaaauccugggcuaaacagcccacaguucgcgggacagcagcaacaguuuagugcaaaggccggucccgcucagccguacauacagcaaucuauguauggcagaccuaacuaccccggguccggaggcuucggugccagcuauccagggggaccuaaugcacccgcuggcaugggcaucccaccccauaccaggccuccagccgacuuuacgcagccggcggccgcagcugccgcugccgcagucgccgcugcggcagccacugcuaccgccacagcaacugccaccguggcugcccuccaggagacacagaacaaggauauuaaucaauacgggcccaugggaccuacccaggcauauaacucgcaguucaugaaucagccagguccccggggcccugcgucuaugggaggauccaugaacccagcuucaauggccgcaggcaugacgcccagugguaugagcgggccgccuaugggcaugaaucaaccaagacccccuggaaucucccccuuuggcacucacgggcagcgaaugccacagcaaacauacccuggacccagaccacagucucugccgauucagaacaucaaaaggccuuaccccggugaaccaaauuauggcaaccagcaauacgggcccaauagccaguucccuacccagccaggacaguaucccgccccuaacccgccacggccccuuacuucaccuaauuacccaggccaacguaugcccagucagccuuccagcggucaguauccgcccccaacaguaaacauggggcaguacuauaagccugagcaauuuaauggccagaacaacaccuucucuggaucaaguuacagcaauuacucccagggcaacguuaauagacccccacgcccugugcccgucgcuaacuauccacacucuccggugccugggaaucccacgccacccaugaccccuggaucgagcauaccacccuaccuguccccuucacaagacgugaaaccgccauuucccccugauaucaagcccaacaugagugccuugccaccucccccagcaaaucauaacgacgagcucaggcugacauucccuguccgggacgguguuguguuagaaccguuccgacuggagcacaaucucgcuguaucuaaccauguguuucaccuucgccccacuguccaccagacccugauguggagaagcgauuuggaacuacaguucaaauguuaucaucacgaggacaggcagaugaauacaaacuggccagccuccgugcaaguuucagugaaugcgacuccucugaccauugagcggggcgauaacaagacaagccauaagccccuccaccugaaacaugucugccagccagggcgcaauaccauccagauuacugugacggccuguugcuguucucaccuuuuuguacugcaguugguucacagaccuuccgugaggaguguccuccaaggacuguuaaagaaacgucugcuacccgcugaacauugcaucacaaagauaaaacggaacuucagcucuguggcagccuccucaggcaacaccacucucaauggugaggacggggucgaacagaccgcuauuaaggugagucugaaauguccgaucacauuucgacgcauucagcuuccagccaggggccacgauugcaagcauguucagugcuucgacuuggagagcuaccugcaacucaacugugaacgcggaaccuggcggugcccuguguguaauaagacugcacugcuugagggccuggagguagaucaguauaugugggggaucuugaacgcgauccagcacucggaauuugaggaagucacaauugaccccacgugcuccuggagaccagugcccauaaaaucugaucuccacaucaaggacgauccugacggcauuccgagcaaaagguucaagaccaugucacccagucagaugaucaugccaaauguuauggagaugauagccgcucugggaccuggucccuccccuuacccauuacccccuccacccgggggaacuaacucuaaugacuauagcucccaaggcaacaauuaccagggucauggcaacuuugauuucccgcacgggaauccuggaggcacaucaaugaacgacuuuaugcaugggccaccccagcugagccacccuccagauaugcccaauaacauggccgcacuagaaaaaccgcucagucauccuaugcaagagaccaugccccacgcuggaucuuccgaccagccacacccuagcauucagcagggccugcaugugccccacccaucgucacaaucuggucccccucuucaucacaguggggccccaccgcccccuccaucccagcccccucgccagccaccccaggcagccccuagcucucauccgcacagcgauuugacauucaauccauccucagcucuggagggacaagcgggcgcccagggugcaagugacaugcccgaaccuagccucgaucuguuacccgagcugacuaacccagacgaacuuuugucuuaccucgauccucccgaccugccauccaacucaaaugaugaccuacugagucucuucgagaacaauuga

SEQ ID NO: 65073 - RNA, 4200 nt, Artificial Sequence
  derived and/or modified sequence opt3 from ZMYM2__Homo_sapiens__XP_011533519
augugcauccugcucagcgccguggucaccuggauucccucccuugaccuguugguuuucuuuggcauggauacaucuucaguagggggauuagagcugacugaccagacgccugugcuacucgguaguaccgcuauggcaacaagccugacuaacgugggcaauuccuucucugggccagccaacccgcuugucucgagaucaaauaaguuucaaaacagcaguguggaagaugacgaugacguuguguucauagagcccguccagccuccacccccuuccgugccaguaguugcggaucagaggaccaucacauuuaccucuagcaaaaaugaagaacugcagggaaacgacuccaagauuacucccucaaguaaagaauuggcuagccaaaagggcucuguguccgagacaaucgucauugaugacgaggaagauauggagaccaaucagggucaggaaaagaacucaagcaauuucaucgagcggcgcccuccagagacgaagaaccgaacuaaugacguggauuuuaguaccucuuccuucagccguucgaaggugaacgccgggaugggaaauucuggcauaacaacugaaccggacuccgagauccagauugcaaacgucaccacacucgaaaccggcguuucaagugugaaugacgggcaacuggagaacacggauggaagagacaugaaccugaugaucacucacguaacaagccuccagaauaccaacuuaggugauguguccaauggccugcagucuagcaacuuuggggucaauauucagacuuacacacccucacuuaccagucaaacgaaaaccggagugggcccuuucaacccagguaggaugaauguugccggggacguguuucagaacggagaauccgcuacacaucacaaucccgauagcuggaucucucagucagcaaguuucccucggaaccaaaagcagccaggcgucgacagcuugucccccguggccucucugccgaaacagauauuucagccuucgguacaacagcagcccacuaagccaguuaaagugaccugugcuaauugcaagaagccucuacagaaaggccaaacagccuaucagcgcaaggggagcgcgcaucucuucuguuccacuaccugccugucaaguuucucucacaaacccgcaccaaagaaacuuugugucaugugcaagaaagauauuacaaccaugaagggaacuaucguggcccaggucgacagcuccgagucauuucaggaguucuguagcacgucuugccuguccuuguacgaagauaagcaaaaccccacaaaaggugcucucaauaagaguagauguaccauuugcggcaaacugacugagaucaggcaugaagugagcuuuaagaacaugacccacaaauuauguucugaccacugcuucaaucgguaucgcauggccaacgggcugaucaugaacugcugugagcagugcggagaauaccucccuuccaagggcgcagguaauaacguucuugugauugaugggcagcagaagcgauuuuguugccaaucauguguaagugaguauaaacaggucggcagccauccaucguuccugaaggaggugagagaccacaugcaggacuccuuuuugaugcaaccggaaaaauacggaaagcuaacaaccugcacuggcuguaggacacagugccgguucuuugauaugacgcaguguauagggcccaauggauauauggagccuuacugcucuaccgcuuguaugaacagccauaaaacuaaguacgccaagucacagagucuggguaucauuugccacuucugcaaacguaauucccucccacaauaucaggcgacaaugcccgacggcaagcuguacaacuuuuguaauucuagcugcguugccaaauuccaggcacuuuccaugcagucaagcccuaacgggcaauuuguggcuccaagugauauccagcugaaguguaauuauugcaaaaacucuuucuguuccaagcccgaaauauuggagugggaaaauaagguccaccaguucugcagcaaaaccuguucggacgauuacaagaaacuccauugcauugugacauauugugaguacugccaggaggaaaagacucugcacgagaccguaaacuuuucaggagugaaacgcccguucuguucugaaggcugcaaguuacuguauaaacaagacuuugccagaaggcuaggucuccggugcguuacguguaauuacugcagucagcuguguaagaagggggcuaccaaagagcuugauggcgucgugcgagacuucugcuccgaggauuguugcaagaaauuucaggacugguacuauaaggccgcacgcugugauugcuguaaaagccaaggaacauugaaggaaagagugcaguggaggggcgagaugaagcauuucugcgaccagcacugucugcuccgguuuuacugccagcaaaacgaaccuaauaugacuacccagaaagggccagagaaccugcauuaugaucagggaugccagacaucucgcacuaagaugaccgguagcgcucccccucccuccccaacgccuaacaaagaaaugaagaauaaagccguccuuuguaagccccugacaaugaccaaggcgacuuacugcaaaccacacaugcaaacaaagucaugucagaccgacgacacuuggagaaccgaguauguuccggugccuauccccgugccaguauacauccccgucccuaugcacauguauagucagaacauuccagugcccacaacgguuccugugccggucccagugcccguuuucuugccugcaccacucgauagcucugagaaaauccccgccgcuauugaggagcugaaguccaaagugucaagugacgccuuagauaccgaacugcuaacuaugacagacaugaugagcgaggaugaaggcaagaccgagacaacuaauauaaacuccguaaucauugagaccgacaucaucgggucugaucuccugaaaaauucggacccugaaacgcagagcucaaugccggauguccccuacgagccagaccuugauauugaaauagacuuuccuagggcagccgaggaauuggauauggagaacgaguuccuguugcccccaguguuuggagaagaguacgaggaacaaccucguccccgguccaaaaagaaaggcgcuaagcgaaaagccgugagugguuaucagucucaugacgacagcuccgauaauucagagugcucuuucccauuuaaguacacauauggggucaacgcauggaaacacuggguuaagaccagacagcuggacgaagauuuacuggugcuugacgagcucaagagcaguaaauccguaaagcucaaagaagaucugcuaagccauacuaccgcggagcugaauuacggccucgcucacuucgugaacgaaaucaggcgcccgaauggagagaacuaugccccugacucuauuuacuaucugugucuuggcauccaggaguacuugugcgggucaaaucggaaggauaacauuuucaucgaccccggauaccaaacauuugaacaggagcugaauaaaauauuaagauccuggcagccaaguauccuccccgauggcagcauuuucucgagggucgaagaggacuaucuguggcgcaucaagcaacuugguucucacuccccuguggcacuguugaacacucucuuuuacuucaacaccaaguauuuugggcugaaaacaguugaacagcaucuacgacugagcuucggaacgguguuucggcacuggaagaaaaauccacucaccauggagaacaaggccugucugcguuaccaggucucaagucuuugcggcacugauaaugaggacaaaauuacaaccgguaagagaaagcaugaagacgaugagcccguguucgaacagaucgagaacacugcuaauccuucuagguguccgguuaaaauguuugaaugcuauuuguccaagagcccacaaaaccugaaucagcgcauggacguguucuacuuacagcccgaguguucaaguagcacagauuccccugucugguauaccucuacgagccucgaccggaacacucuggagaauaugcuuguaagagugcugcuaguuaaagauauauacgacaaggauaacuacgaacucgacgaggauaccgacuga

SEQ ID NO: 65074 - RNA, 4077 nt, Artificial Sequence
  derived and/or modified sequence opt3 from ZMYM3__Homo_sapiens__NP_001164633
auggaccccagcgauuucccuuccccauuugacccgcugacccuccccgagaagccucuugccggcgaucugccaguggacauggaguucggggaggauuuguuagaaucucagacagcucccacuagaggaugggcaccuccaggucccucaccuaguagcggcgcccuggaccuacucgauacgccagcggggcuggagaaagacccgggaguccuugauggcgcuaccgaacuguugggucucgggggacugcuguacaaggcccccuccccuccagagguugaccacggccccgagggcacacucgcaugggaugccggggaccaaacuuuagaaccuggaccagguggccagacccccgaggugguaccgccugaucccggggcuggagcaaacucuugcucgccagaaggccugcuugagccuuuggcccccgacucaccaaucacacugcagagcccccauauugaggaagaggaaaccacaaguauagcuacugccaggcgggguuccccugggcaggaggaagaacuaccacaaggacagccgcagucucccaaugcgccuccaagccccuccgugggcgagacccucggcgacgggaucaacucaagucagacgaaaccuggagguagcucuccacccgcacacccgucccugccuggcgaugggcuuacugccaaggcuucagaaaaaccacccgagcgcaagcgaagcgaacgugucagaagggccgagccucccaagccagaagugguugacaguaccgagucuauuccuguguccgaugaggacagcgaugcaauggucgacgaucccaaugacgaagauuuugugccauuccggccgcgcagaucgccuaggaugucucugcgguccucaguaagucaacgcgcuggacgaagcgccguuggcacaaaaaugacuugugcgcauugcagaacccccuugcagaagggucagacagccuaucagaggaaagggcucccacaacuguuuuguuccucuagcugcuuaaccacguucucaaagaaacccaguggcaagaagacuuguacauuuugcaaaaaggagaucuggaacaccaaagacuccguggucgcacagacuggaagcggcgggucuuuccacgaauuuuguacaucagugugccugagucucuacgaggcucagcaacagcggccuauuccacagagcggagaucccgccgacgcuacccguuguuccaucugccagaagacgggugaagugcuucaugaggucucuaauggcucgguugugcaccgccuguguagcgacuccugcuucucaaaauuuagagccaacaagggguugaaaaccaauugcugugaucaaugcggagcauauauauacacaaagacuggcaguccugguccggagcuacuguuccacgaagggcagcagaagagguuuuguaacaccacaugccucggcgccuauaaaaagaaaaauacucggguauacccauguguguggugcaagacccuguguaaaaacuucgagaugcuuucucaugucgaccgaaauggaaagacaagccuguucugcuccuuguguugcaccacuucauauaaggugaaacaggcuggccucacggggcccccucgcccauguagcuuuugcagaaggucucuguccgaucccugcuacuacaacaagguugaccggacaguguaucaauucuguaguccuagcugcuggaccaaauuucagcgcacuucuccggaaggagguauccacuuauccugucauuacugccacucacuguucaguggcaagcccgagguccuagauuggcaggaccagguguuucaauucuguugcagagauuguugcgaggacuuuaaaaggcuccgugggguaguuagccagugugaacacugccggcaggagaagcugcuucaugaaaaguugcgauucucgggaguggagaaauccuuuuguucugaaggcugcguccugcucuauaagcaggauuucaccaaaaagcugggucuuugcuguauuacaugcaccuacuguagccaaacuugccagagaggggugacagagcagcuggacggcucaacgugggauuuuuguagugaggacugcaaauccaaguauuugcucugguacuguaaggcggcaaggugccacgccuguaaacgccaaggaaagcuguuagaaaccauccauuggcggggccagauuagacacuucugcaaucagcagugucugcuaagguuuuauucucaacagaaccagccaaaucucgauacucagagcgggccugagucccugcuuaacucacaaagccccgaaaguaaaccacagacaccuucucagaccaaggucgagaacuccaauacaauccccgugaaaacucgcagcgcuccaaccgccccgacgccucccccacccccuccacccgcaaccccucgaaagaacaaagccgcuaugugcaagccguugaugcagaaucggggaguuucgugcaagguggaaaugaaaucaaagggcucucaaacagaggaguggaaaccacagguaauaguccugcccauuccugugcccaucuucguuccagugccuaugcaucucuacugucagaagguccccgugccauucaguaugccuauuccgguacccgugccaauguuucugccuacuaccuuagaauccacagacaaaaucguugagacuaucgaagaacugaaggucaagauucccagcaacccacuugaagccgacauauuggcaauggcggagaugaucgcugaggccgaggagcucgauaaagcaucuagcgaccugugcgaucuaguguccaaucaaucagccgaaggucugcucgaggacugugaucuguucgggccugcucgugacgaugugcuugccauggcagucaagauggcuaacguuuuggacgagcccggacaggaucuggaagccgacuuuccgaaaaauccauuagauauuaacccuaguguggacuuccucuuugauugcggccuggugggucccgaggacguaagcaccgaacaggaccuuccaagaacgaugaggaagggccagaaacgccuggucuugucugaguccuguucacgggauaguaugagcucccaacccucuugcacagggcucaauuacucguauggagugaacgcguggaaguguuggguucagagcaaguacgccaauggcgaaaccucaaaaggggacgagcugagauucggaccuaagccgaugaggaucaaagaggauauacuagcuugcuccgcagccgaacugaacuauggccucgcucaguuugugcgagagauuacucgccccaauggugaacgguacgagccagacaguaucuauuaccugugucuugggauccagcaauauuugcuggaaaacaauagaauggucaacauuuucacagauuuauacuaccucaccuuugugcaggagcugaacaagucucuuagcacuuggcagccuacccugcuacccaauaacacaguuuucuccaggguggaggaggaacaccucugggaaugcaaacagcugggaguauauucaccuuuugucuugcugaauacguuaauguucuuuaacaccaaguucuucggccuccaaacugccgaggaacacaugcagcugucuuuuacaaauguggugcgucagagccgcaaguguaccacaccacgggguacuaccaaagucguuaguaucagauacuaugcacccgugaggcagcgaaagggccgggacacggggccuggaaaacgcaagagagaggaugaggcgccaauucuugaacaaagggagaaccggaugaauccccugcgaugcccgguaaaauucuacgaauuuuauuuguccaagugcccugagagccucagaacacgcaacgacguguucuaccugcagccagagaggucuuguauagccgaaucaccccuaugguauuccgucaucccuauggaucguaguaugcuggagagcaugcuuaaucggauucucgcugugagagaaaucuacgaggaacugggcaggccaggggaggaggacuuggauuga

SEQ ID NO: 65075 - RNA, 4551 nt, Artificial Sequence
  derived and/or modified sequence opt3 from ZMYM4__Homo_sapiens__XP_011540726
auggacaccgagaugagcgaagauaucgaccacaaccugacacccacucucgauuccaugucuuacggcaugccuaaucagacggggucagagaacagucuucuggacgaagaugacuauuucuugaauagcggagauuuagccgguauuccaguggucggcuccgacaacgaggaugaacaagacuuuucuucgaaggauaaucugguuucaagcauacauaccgacgauagucuagagguggagagaaggguaacacagcacgaauccgacaacgagaaugaaauccagauucagaacaaacucaagaaagacuucccgaagcaauuugaucaggugucugucuucaaaagcauccggaaggacuuuucccuggugcgcgaaaauucaaaggagacuuucagugggaaagaaaagaaccgagaucuuaccuacgagcgugaaaagagacuggacaagccccauaaagauuuggacagcaggcucaagucuuccuuuuucgauaaggcugcaaaucagguugaggaaacacugcacacccaucugccucagacuccagagacaaacuuucgggacucaagcuaucccuucgccaauaaagagaguauuggaucugaacucggcaacuccuuugcgagcaauauccgcauaaaggaggaaccuuuagaugacgaguacgauaaagcuauggccccacaacagggucugcuugacaagaucaaagacgaacccgauaacgcacaggaguauucgcacgggcagcaacagaagacccaggagggagaauugaaaauuucugccguguucuccgucucaggcaguccucuggcuccacaacuaacgacuggcuuucagccgagccucgcauccucugggaugaacaagaugcugcccagcgugccugccaccgcuguaagaguuucaugcaguggauguaagaaaauccuucagaagggucagacagccuaccaaaggaaaggcuccacucagcuguucugcagcaccuugugucucacaggguauaccgugccacccgcgcggccuccacccccgcugacgaagaaaacuuguucuucaugcaguaaggacauuuuaaauccuaaggaugucaucagcgcacaguucgagaacacaaccacuuccaaagacuuuugcucucagucgugucugagcacauacgaacucaagaaaaagcccauagugaccauuaauacgaacuccaucucaaccaaaugcaguaugugucaaaagaaugccgugauucgccacgaggucaacuaccagaauguugugcauaaacuuugcucugaugcuuguuucagcaaauuucgauccgccaacaaucugacaaugaacugcugcgaaaauuguggaggcuauugcuacucagguagcgggcagugucacauguugcagaucgagggacaaucuaagaaauucugcuccaguagcuguaucacugcauauaagcagaaaucugcuaagauuaccccaugcgcccuauguaagucccugagaucaagugcggagaugauagaaaacacaaauagccucggcaaaacugagcuguuuugcucgguaaacugucuuuccgccuacagggugaagauggucaccucugcaggcgugcagguucagugcaauagcuguaaaacaucagcuaucccucaauaucaucuggccaugagugacggguccauucggaacuucugcucuuacagcugcguggucgcuuuucagaacuuguucaauaagcccaccggaaugaacuccucagugguaccacucagccagggucaaguuaucgugaguauacccacuggcucuacggucuccgccgggggaggcagcacaucggcagugucaccuaccucuauuaguuccagcgccgcugcgggucugcagcguuuagcagcccagucucagcacgucggguuugcucgcagcgugguuaaacugaagugucaacacugcaauagacuauucgccacuaaaccagaacuccuggauuauaagggcaagauguuucaguucuguggaaagaacugcuccgacgaguacaagaaaaucaauaacgugauggcaaugugugaguacugcaagaucgagaaaauuguaaaggagaccgucagguuuucaggcgccgauaagaguuucuguagcgaagggugcaaacuuuuguauaagcaugaccuggcuaaacgguggggaaaucacuguaagaugugcucuuacugucuccagacauccccgaaacuggugcagaacaaucuugguggcaagguugaggaguucugcugcgaagaguguaugucaaaguauaccgugcuguuuuaccaaauggccaaaugcgaugcauguaagcgacaggggaaauugagugaaagccucaaguggcgcggagagaugaaacauuucugcaaccuguuauguauccugauguuuugcaaucagcaguccgucugugaucccccuucucaaaacaaugcggcuaacauuucgauggugcaggccgcaagcgccggcccacccucacuaagaaaggacuccacuccuguaauagcuaaugugguuagucucgccucugcaccagcugcccagcccacagucaacagcaacuccgugcugcaaggugcggugccgacggucaccgccaagaucauuggggacgcuucaacucagacagacgcacuuaaauugccuccaucucagcccccuaggcugcucaagaauaaagcccuguuaugcaagcccaucacccagacaaaagcuacuagcuguaagccacacacccaaaacaaagaaugccagacggaggauaccccuagucagccccagaucauuguugugccagugccgguaccugucuucgugcccauaccacugcaucuuuauacacaauacgcccccguuccuuuuggcaucccagugcccaugccugucccgauguugauuccauccagcauggacucugaagauaaggugacugagucaaucgaggacauuaaggaaaaacuccccacccacccuuucgaggcagaucugcuagaaauggcggagaugaucgccgaagacgaggagaagaaaacacugucccagggagaaagucagacuagcgagcacgaacucuuucuggauaccaagauauucgagaaagaccagggcucgacguauucuggggaucuugaguccgaagcuguuagcacaccacauucaugggaggaagaguugaaucacuacgcccugaagaguaacgcagugcaagaagcugacucugaguuaaagcaguuuuccaaaggagagaccgaacaggaucucgaggccgacuuccccagcgauucauuugacccucugaauaagggucagggcauccaagcacggagucgcacuagaaggcgucaucgggacggguucccgcagccccgaagaaggggacgcaaaaagagcauuguagccgucgaaccacggucccuuauccagggcgcuuuucaagguuguucugugagcgggaugacacugaaauacauguauggcgugaacgcguggaagaauuggguccaguggaagaacgccaaagaggaacagggagauuugaagugcggcgggguugagcaggcauccucaucuccuagaagugacccccucggaucgacccaagaucacgcucugagccaggaguccucugaaccaggcugcagggugcgcucaauuaaacuaaaggaggacauccugagcuguacuuucgccgaacucucccugggucuuugccaguucauacaggagguacgacggccuaauggggaaaaauacgaucccgacaguauuuuguaucuguguuuaggaauccaacaguaccucuuugagaacggccguauugauaauaucuucaccgagccauauucuagauuuaugauagaacugacaaaacuucugaagaucugggagccgacgauucuaccuaacgguuacauguucagcaggaucgaagaggagcaccucugggaaugcaaacagcugggcgccuauucacccauuguguugcugaauaccuuacucuuuuucaacacuaaguacuuucagcugaaaaaugucacagagcaucuuaagcuguccuucgcucacgugaugcgccggaccagaacauugaaauacaguacuaagaugaccuaucucagguuuuucccaccccugcaaaagcaggaaagcgagccugacaaacuaacgguugggaagcgaaaacgcaacgaagaugacgaggugccagucggaguggagauggcagaaaacacagauaauccccugcgguguccuguuagacuuuacgaguuuuaucucucuaagugcuccgaaucagugaaacagaggaacgacgucuucuaccugcaaccggagcguagcuguguaccaaauucgcccaugugguauucuaccuucccuaucgaccccggcacuuuggauaccaugcugacacgcauauuaauggugcgggaaguucaugaggagcucgccaaggcgaaaagugaagacuccgauguggagcugagcgacuga

SEQ ID NO: 65076 - RNA, 627 nt, Artificial Sequence
  derived and/or modified sequence opt3 from ZMYM5__Homo_sapiens__NP_001034738
auggagaagugcucugugggcgggcuggaacucaccgagcagacacccgcccuucugggaaacauggcuauggcaacuuccuugauggacaucggugauucuuucggccacccugccuguccauuagucucaagaaguaggaauagcccgguugaagacgaugacgaugacgaugacgugguauuuauugaguccauacaacccccuucuaucucggcgccagcuauugccgaucagcggaacuucaucuuugcaucaagcaaaaaugaaaagccccaggggaacuacagugugauuccuccauccucucgcgaccuggccagccagaaaggaaauaucuccgagacgauagucaucgaugacgaggaagauauugagaccaacggcggugcugaaaagaaaucaaguugcuucaucgagugggggcuacccggaacaaagaauaagacuaacgaccucgacuuuagcaccucuucccugucacgaagcaaaacaaagaccggcgugcguccuuucaauccaggcagaaugaacguugcaggggaucuuuuucaaaauggagaguucgccacucaucacaguccggaaaugcaucugcagaggcgguugaugagcuuuuuccaguga

SEQ ID NO: 65077 - RNA, 1323 nt, Artificial Sequence
  derived and/or modified sequence opt3 from ZMYND10__Homo_sapiens__NP_056980
augggcgaccuggagcuccuucugcccggggaagccgagguguuggucagaggauuaaggagcuucccucugcgggaaauggguuccgagggcuggaaccagcaacacgaaaaucuagagaagcucaacaugcaggcuauccuggaugcaaccguuucucagggggagccaauucaggaacuucuggugacacauggaaaaguaccgacuuugguggaggaacucauagccgucgagauguggaagcaaaaaguguuucccguuuucugccgcguggaggacuuuaagccucagaauacguucccaaucuacauggucgugcaccaugaagcgucaauuaucaaccugcuggagaccguauuuuuccacaaagaaguuugugagagugcugaagauacagugcucgacuuagucgauuauugccaucgaaagcugacucuuuugguggcccagagcggcuguggugggcccccugagggagagggcucccaggacucuaauccaaugcaagaacugcagaagcaggcagagcuaauggaauuugagauugcccucaaagcucugucggugcuucguuacaucaccgauugcgucgacucacugagcuugaguacacucuccagaaugcugucuacccacaacuuacccugucugcucguugaacuucuggagcacagcccuugguccaggcgggagggcgggaaguugcagcaauucgaaggaucacgcuggcauacuguggcaccaagugagcagcagaaacuaagcaagcuggauggucaaguauggauagcccucuauaaucugcuucugucuccggaagcucaggccagauacugcuugacauccuuugcgaaaggcaggcuccugaaguuacgggcauuccugaccgacacgcuacucgaucagcugcccaaccuugcccacuugcagucauuucuggcucaucucacucugaccgagacacaaccuccaaagaaagaccuugugcuggaacagauccccgagauuugggagcgcuuggaacgagagaauagagggaaguggcaggccaucgcaaaacaccagcuccaacacgucuucagcccuagugaacaggaucugagguuacaggcucggcguugggccgagacuuaucgccuggacgugcuagaggcgguugccccagaaagacccaggugugcauacugcucugcugaggccuccaagcgguguagccgaugccagaacgaaugguauuguugccgcgagugccaagugaaacauugggaaaagcacggaaaaaccuguguccucgcugcccagggcgacagagcaaaguga

SEQ ID NO: 65078 - RNA, 1554 nt, Artificial Sequence
  derived and/or modified sequence opt3 from ZMYND11__Homo_sapiens__NP_001189394
auggccagacugaccaagaggcggcaggcugacacaaaagcaauccaacaccucugggccgcgauugagauaauccgcaaccagaagcagauugcuaauaucgaucgaauuacuaaauacaugagccgugugcauggcaugcaccccaaggaaacgaccagacagcuuucccuggccgucaaagacggguugaucguugagacauuaacugugggaugcaaggguucuaaggcaggcauagaacaagagggguauuggcugccuggagaugaaaucucaauuaaaaagaaaaacaccaauaagcaggagaugggcacauaccuaagguucaucguaagucggaugaaagagcgcaaggugaacgaagguaaguauagaagcuacgaggaauuuaaagccgacgcucagcuccugcuucauaauaccgucauuuucuauggggcagauuccgagcaggccgacaucgcuaggaugcuguacaaggauacuugucacgaguuggacgaacuccaacugugcaaaaacuguuuuuaucugucuaaugcccggccagauaacugguucugcuacccguguauacccaaucaugagcucgugugggcgaagaugaaaggauuuggcuucuggccugcaaagguuaugcagaaagaagacaaccagguggauguccgcuuuuucggccaccaccaucagcgagccuggauuccaucggagaauauccaagacauuacagugaacauccacagauuacauguaaagaggucaaugggguggaagaaggcuugcgaugaacuggagcuucaccagcgguuuuugcgugagggacgcuucuggaaaagcaaaaaugaagacagaggugaggaagaggccgaaaguuccaucucuagcaccuccaacgagcagcugaagguuacgcaagagcccagggcuaaaaagggccggcgaaaucagucaguggaaccuaagaaagaggaaccagagcccgaaacugaggcagucaguagcucucaggagauuccuaccaugccacagccgauagaaaagguguccgugucaacacaaacuaaaaagcuaagcgccaguucuccccgcaugcuccacagauccacccagacaaccaacgacggggucugucagagcaugugccaugauaaauacacgaagaucuuuaacgacuucaaggauaggaugaaaucggaccacaagcgggagacugaacgcguugugagagaggcgcuggagaaacuuaggucugaaauggaggaagagaagcgucaggccguaaauaaagcaguggcuaacaugcaaggagaaauggaucggaaguguaagcaggucaaagagaagugcaaagaggaauuuguggaggaaauuaagaaacuggccacacagcauaagcaguugaucucccaaaccaaaaagaagcagugguguuauaauugcgaggaagaggcuauguaccacugcuguuggaacacuucauauugcaguauaaaaugucagcaggagcauuggcacgccgaacacaagcgaacaugcagaaggaaacgcuga

SEQ ID NO: 65079 - RNA, 465 nt, Artificial Sequence
  derived and/or modified sequence opt3 from ZMYND8__Homo_sapiens__NP_001268698
augcacccccagagccuggccgaggaagagaucaagaccgaacaagagguggucgaaggcauggacauuuccacaagaucuaaagauccugggucagcugagaggacugcacagaagcggaaauucccaaguccgccccauagcuccaacggacacucuccucaggacacgucgaccucaccaauaaagaaaaagaagaaacccggucuccuuaauagcaacaauaaggagcagagugaacugcgccauggcccuuuuuacuauaugaaacaaccauugacaacugaucccguugacgugguaccucaggaugggcgaaacgacuucuacugcugggugugucaccgugagggacaggucuuaugcugugaacugugcccaagaguguaucaugccaagugucuaaggcucaccuccgagccggagggcgauugguuuugccccgaaugugagguuucuagcuga

SEQ ID NO: 65080 - RNA, 3336 nt, Artificial Sequence
  derived and/or modified sequence opt3 from ZNF106__Homo_sapiens__NP_001271236
auggugagagagaggaagugcauccugugccacauugucuacagcuccaaaaaggaaauggacgagcauaugcggucuaugcuccaccaucgcgaacuugagaaccugaaaggccgauucgggauagaaaugguucccuuggugcagaaugagcaagaggccuuagaucuggacggagaaccugaucuaucaagucucgaggguuuucagugggaaggcguaagcaucuccucuucgccagggcuggcucguaagagaucacuuagcgagaguuccgugauuauggacagggcaccgucugucuauagcuucuuuuccgaggaaggaaccggcaaagagaacgaaccccagcagauggugucaccuaguaauagccugcgggccggucaaucucagaaggcgacaaugcacuugaagcaggagguuacuccacgcgcugccucccucagaacgggggaaagggcagagaacguggccacccagcggcgccauucagcucaacugagcagugaucacaucauuccccugaugcaccucgcaaaagacuuaaauucucaggagcgauccaucccuccaagcgaaaaccagaauagucaggagucuaacggagaaggcaauugccuguccucaagugccagcuccgcucuugccauaucuagcuuggcggaugcagccacagacucaaguuguacuuccggcgcugagcaaaacgaugggcagagcaucagaaagaaaaggcgggccaccggagacgguucuucacccgaacugccuagucuagagcguaagaauaaacgcagaaagauuaagggcaaaaaggagaggagccaggucgaucaacuccugaacaucucccuucgggaagaggaacugucuaaaucguugcagugcauggacaauaaccuccugcaggcacgagcugccuuacagacagcguacguggagguacaacgccugcucaugcuuaagcagcagauuaccauggaaaugagcgcccugagaacucauaggauccagauauugcaagggcuacaggagacauaugagccauccgaacacccggaucagguucccuguucacugacccgggagcgcagaaauaguaggucucagacgagcauugacgcagcucuccugccuacuccauucuuuccccuuuuccuggaaccuccauccucacaugugagccccucuccgaccggagccuccuugcaaaucacaacuucgccuaccuuucagacacacggcagcguccccgcuccagacucuuccgugcagauuaaacaggagccuaugucacccgagcaagaugaaaacgugaacgccgucccacccaguagcgcaugcaauguuucgaaggagcuccuggaagccaaccgugagaucuccgacucuuguccuguguacccaguaaucaccgcucgguuaagccugccggaaucaacggagaguuuccacgagcccucccaggaacuaaaauuuucuguggagcagcgaaauacuagaaacagggaaaauagcccuuccucacaaagcgcgggucucaguucuauuaacaaggagggggaggaaccaacaaagggaaauuccggcagcgaggcaugcaccucgucauuccugcgccuuucuuuugccagugaaacucccuuggagaaagaaccucauuccccagcugaucagcccgagcagcaggccgaaagcacacugaccucugcagagacgcggggcagcaagaaaaagaaaaagcucagaaagaaaaagucccugagggccgcucacgucccggagaacucagacaccgaacaagaugugcuuacaguuaaaccugugcgcaaggucaaagccgggaagcugauaaagggagguaaagugacuaccaguacaugggaggacagccgaacuggccgggaacaggagucuguacgugaugagccagacuccgauucaaguuuggaaguucucgagauccccaauccucagcuggaaguggucgcaauugacagcuccgagucuggggaagagaagcccgauucgccaagcaaaaaggacaucuggaacucaaccgagcagaauccuuuagaaacauccagaaguggaugugacgaggugucuagcaccuccgaaauaggcacuagguauaaagaugguauucccgucucaguggcggagacgcaaacaguuaucucuagcaucaaggggaguaagaacuccagcgaaauuucuucagagccaggcgacgaugacgagccgaccgaaggauccuucgagggccaucaggcugccgugaaugcaauccagauuuuugggaaccugcuauacacuugcagugccgauaaaaccguacgcgucuauaaucucgugagccggaaguguauaggaguuuucgaaggucacacaucgaaagugaacugccugcuugucacccagacuucuggcaagaacgcugccuuguacacaggguccagcgaccauacgaucagaugcuacaaugugaaaucaagggaguguguagaacaacugcagcucgaggaucgagugcugugcuuacacagucgcuggcggauucuguaugcaggacuugcuaacggcaccguugucacuuucaauaucaagaacaauaaaagauuggagaucuuugaaugucacgguccuagggccgugucuugccucgcgacagcccaggagggggcucguaagcugcuaguggucggcuccuacgacuguaccauuagcguucgcgaugcacggaacggacugcuccugagaacacuugaaggccauucaaagacuauauugugcaugaaaguggugaaugaccugguauucagugggagcuccgaucaaucuguccacgcccauaacauccacaccggagaguuagugaggauuuauaagggucacaaucaugcuguuacgguggucaacauccucggcaaagugaugguuaccgccugucuggacaaguuugugcgaguauacgagcuucagagccacgaucggcugcaggucuaugggggacauaaagacaugauuaugugcaugacaauccacaaguccaugauauacacuggcuguuaugacgguucaauccaggcagugcgcuugaaucucaugcaaaacuacagaugcugguggcauggguguucucugauuuucggcguggucgaucaccuaaagcagcaucugcucaccgaccacacaaaucccaacuuucagacucugaaauguagguggaagaauugcgaugcguucuuuaccgcccggaaaggaaguaagcaggacgcugccggccacaucgaacgacaugcagaggaugacucgaaaauugauagcuga

SEQ ID NO: 65081 - RNA, 2352 nt, Artificial Sequence
  derived and/or modified sequence opt3 from ZNF107__Homo_sapiens__NP_001013768
augguggccaagcccccugucaugagcuuccacuuugcucaggaccuguggccagagcaaaacaucaaagauuccuuccagaagguuacccucagaagguacggcaaaugcgaauaugagaaucuucagcugcggaagggguguaaacauguggacgaaugcacaggacacaaggguggccauaacacuguaaaucaguguuugacggcaaccccgucuaagauuuuucaaugcaacaaauacgugaaggucuucgauaaauuuucaaauaguaaccgcuauaagcgacgucacacagggaauaaacauuucaaguguaaggagugcagcaaauccuuuuguguguuaucucagcugacucagcacagaaggauacacacccggguuaacucguacaagugcgaagaguguggaaaagccuucaauugguuuucaacacuaaccaagcauaaacgcauccacacuggcgagaagcccuauaaaugcgaagagugugguaaggcguucaaccagagcagucaacucacaagacauaagauuauccacaccgaagagaaaccuaauaagugcgaggaaugcgggaaggcuuuuaaacaggccucccaccugacgauucauaaaaucauacacacuggagagaagccauacaaguaugaagaguguggcaaaguguucucucagagcucccaucuuaccacacagaagauccugcacacuggcgaaaacuuguacaaaugcaaggagugugggaaagcauuuaaucucuucucaaaccugaccaaucauaagaggauucacgccggagagaagcccuacaaaugcaaggaauguggucgggcuuucaacaucaguagcaaccugaauaaacaagagaagauucacacaggcgggaaacucaacaagugcgaagagugugacaaggcauuuaaucgcucuuuaaaacugaccgcccauaagaaaauccuuauggaagagaagccuuauaaaugcgaggaauguggaaaggucuucaaccaguuuuccacguugacucgacacaaaauaauucauacaggcgagaagccauacaagugcaaagaaugugguaaggcuuucaaucagucaagcaaccugaccgagcacaaaaagauccacacugccgagaaaaguuauaagugcgaagagugcgggaaggcguuuaaucaacauucuaaccuaauuaaucacagaaaaaucuacuccggagaaaagcccuauaaaugugaggaaugcggcaaggcauucaacaggagcucgacacucacccggcauaaaaagauccacacgggcgagaagccuuacaaaugugaggaaugcgaucgugccuuuucucaguccucaaaucugaccgagcauaagaaaauucacacaggggaaaagccauauaaaugugaggaaugcggaaaggcuuucaaccgcuuuaguacucuuaccaagcacaaaagaauacauacaggugagaagccguacaaaugugaggaaugcggcaaggccuucaaucagagcuaccagcugacuaggcacaaaaucgugcauaccaaggagaaauugaacaagugugaagaguuugggaaggcauucaaacaauccucucaccggacaauucauaagaucauacacaccggagaaaaacccuauaagugcgaggagcacggcaaaguauuuaaucagagcucaaaccucacuacgcagaagauuauccauacaggugaaaaccuguacaaguucgaggaacacgggaaggcuuucaauuuauuuaguaacaucaccaaucauaaaauuaucuauacuggcgagaaaccucacaagugugaagagugcggaaaagccuacaaccgauucuccaaucugaccauucacaagcgcauacauacaggcgagaagccauaucagugcgcggaaugugggaaagccuuuaacugcagcucuacccucaauagacacaagaucauucauacuggagagaaacccuacaaguguaaagaaugcgguaaggcauucaaccuuucaaguacacugacggcucacaagaaaauccauaccggcgagaagccuuauaaaugugaggaaugcgggaaggccuuuaaucaaagcuccaacuugacuacacacaaaaagauccacaccucugagaagccauacaaaugugaagagugcggaaagucguucaaucaguuuagcucccuaaacauucauaaaauaauccacacaggcgaaaagcccuacaaauguggugacuaugggagggcuuucaaucugucaaguaaccucacuacccauaagaaaauucacacgggcgagaagccguacaagugcgaguauggaaaaaccuga

SEQ ID NO: 65082 - RNA, 1722 nt, Artificial Sequence
  derived and/or modified sequence opt3 from ZNF10__Homo_sapiens__NP_056209
auggacgccaagagccugaccgcuugguccagaacacucgugacuuucaaagaugucuuuguugacuucacgagggaggaauggaaacuucuggauaccgcacagcaaaucguguaccggaacguaauguuggagaauuauaaaaacuuagugucucugggcuaccagcuaacaaagcccgacgucauucuccgccuggaaaaaggggaggaaccuuggcuuguggagcgagagauacaccaggaaacucauccagauucagagaccgccuuugaaaucaagaguagcguuuccucucguucgauuuucaaggacaaacagucaugcgauaucaagauggagggaauggcgagaaaugaccugugguauuugagccucgaggaaguguggaaauguagggaucaacuggacaaguaccaggagaacccggaacggcaucugcgccaggucgcuuuuacacagaaaaaggugcucacccaagagagaguaagugaauccgguaaguauggcgggaauugcuuacugcccgcccagcuuguuuugagggaguacuuccacaaacgggauucucacacuaagagccugaaacaugaccuagugcucaacggacaccaggauuccugugcaucaaauaguaacgagugcggccagacauuuugucaaaauauucaccugauccaguucgcccgcacccauacgggugacaagagcuauaaaugcccugacaacgauaauucucuuacucacggguccucacugggaauaagcaagggcauccaucgagaaaaaccauacgaguguaaggaaugcggcaaguuuuucaguuggagaucuaacuugaccaggcaccagcucauucacacaggggagaaacccuacgaauguaaggagugcggaaaauccuuuagccggucgucucaucugaucggucaccaaaagacucauaccggcgaggaaccuuaugaguguaaagaaugcgggaaguccuucucaugguuuagucacuuagucacacaucagcguacccacacgggagacaagcuguacacuugcaaucaguguggcaagagcuucgugcacuccucucgccucauuagacaucagaggacacacaccggugagaagccauaugaaugccccgagugugggaaaucauuccggcaaagcacucaucuuauccugcaccagcgaacacacgugcgcgucagaccuuacgagugcaacgaauguggaaagaguuauucccagaggagccauuugguugugcaccaucggauacacaccggccuaaaaccauuugagugcaaggauuguggcaagugcuucucucgcucaagucaucuguacagccaccagagaacgcacaccggggaaaaaccguaugagugucaugacugcggaaaguccuuuucucaaucgagcgcucucauuguacaccagaggauccauacaggugagaaacccuacgaauguugccagugcggcaaggcauucauucguaaaaaugaucugaucaagcaccagcggauccaugugggggaggaaacuuacaaguguaaccaaugcggaauuauauuuucccagaacucaccuuucaucguccaccagauugcccacaccggcgagcaguuucuuacauguaaucaaugcgguacugcucuggugaacaccaguaauuugaucggguaucagacaaaccauauacgagaaaaugccuacuga

SEQ ID NO: 65083 - RNA, 2742 nt, Artificial Sequence
  derived and/or modified sequence opt3 from ZNF112__Homo_sapiens__NP_001076804
augaccaaguuccaggagauggugacauuuaaagacgucgccguuguguucacugaagaggaacugggccuccuugauagcguacaaagaaagcuguacagggacgugauguuggagaacuuucggaauuuacugcuagucgcucaccagcccuucaaaccugaucucaucucccagcuggaacgcgaggagaaacuucugaugguggaaacggagaccccacgagacgggugcucuggacguaagaaccagcaaaagauggaaucaauucaggagguuacagugaguuauuuuagcccgaaggaguuguccucuagacagacuuggcagcaaucggccgguggccucauaaggugucaggauuuccugaaagucuuucaggggaaaaauucacagcugcaagaacagggaaacagccucggccaggugugggcagguauccccguacaaauuagugaggacaagaauuacaucuucacccauauugggaacggauccaauuauaucaagucucagggcuacccuagcuggcgggcgcaccauuccuggcgcaaaauguauuuaaaggaaucacacaacuaccagugcagaugucagcaaauaaguaugaagaaucauuuuugcaaaugugauagcguuucuuggcugucccaccacaacgacaaacuugaggugcauaggaaggaaaauuauucaugccacgauuguggcgaggacaucaugaaggucagcuugcugaaccaggagaguauucagacagaagagaaaccauaccccugcaccggguaccggaaggcuuucucuaaugauuccagcucggaagugcaucagcaauuucaccuagagggaaaaccuuauacuuacucuuccugugguaagggcugcaacuauucaagucuccugcacauccaucagaauauugaacgcgaggacgauaucgagaacagccaccuuaaguccuaccagcgagugcauacagaagagaaaccauguaagugcggggaauauggagagaacuucaaucacugcucuccccugaacaccuacgaauugauacauacgggcgagaugagcuauagacacaauauuuacgagaaagccuuuucacacagucucgaccugaacuccaucuucaggguccauacucgggacgaaccucacgaguacgaagagaaugagaacguuuucaaucagagcucuuguuuacaagugcaucagaagauucacaccgaagagaaacuguauacagauaucgaauacgguaagucauuuaucugcaguagcaaccucgacauucagcaccguguacauauggaggaaaauuccuauaacucugaggagugugggaauggauucucgcuugcaagccacuuucaggaucugcaaauagugcauacuaaggaacagccauacaaacgcuaugucugcuccaacucauucagucacaauuuguaccuacagggccauccgaagauccacauuggcgagaaacccagaaaggaacacgggaacggauuuaauuggucuagcaaacugaaggaccaucaaagggugcacaccggucagaagccuuauaaauguaacaucugcggcaagggguucaaccaucgguccguucucaaugugcaccagcgaguccauacaggagagaaaccauacaagugugaagagugcgauaaaggcuuuucacgcagcucuuaccugcaggcccaccaaagagugcacaccggugagaagcccuauaagugugaagagugcgggaaaggcuucuccaggaacaguuaccuucagggacaucagcggguacacacgggcgaaaagccuuauaaaugugaggaaugcgggaagggauuuagcagaucuucccaucugcagggucaccaacgcguucacacuggcgagaaaccauucaagugcgaggaaugugggaaaggauuuucauggaguuucaauuugcagauacaucagagggugcacacaggcgagaagcccuacaagugcgaagagugugguaaaggguuuagcaaggcuucgacccuccuggcacaucagcguguccacacuggcgagaaaccguaucaaugcgacgaauguggaaaguccuucucucagcggagcuacuuacagucacaucaaagugugcacuccggcgagcgaccuuauauuugcgaagucugugggaaaggauucucucagagagccuaccugcagggucaccagagggugcauacacgcguuaagcccuacaagugcgagauguguggcaaaggguuuagccaauccucacggcuagaagcucacagaagggugcauaccggaggcaagccauauaaaugcgagguauguacgaaggguuucagcgagaguucucgccuccaggcccaccagcgaguccacguggaagggcggccuuacaaaugcgagcagugcggcaagggauuuuccggcuauagcucgcugcaagcgcaucaccguguucauaccggggaaaagcccuacaaaugugaggugugcggaaagggcuucucacagagaucuaaccuucaggcacaccagaggguccauacaggugaaaaaccauauaagugugaugccugcgggaaaggauuucgcuggaguuccggcuugcugauccaccaacgggugcacagcucugacaaguucuacaagagcgaggauuaugguaaagacuaccccuccucagagaaucuccauagaaacgaagauaguguacuguuuuga

SEQ ID NO: 65084 - RNA, 1299 nt, Artificial Sequence
  derived and/or modified sequence opt3 from ZNF121__Homo_sapiens__XP_011526569
auguacuucgugaccgagcacggcgccaucgggcuggguagcuuuagaaacggaaagcucaaacccaagugccagcaucuuaauaacauuuucuuuuggcugaauaaaacauccaacggcauacaaauggcugaaauccacaaugggggagaguugugugacuucauggaaaacggcgagauuuuuagugaacauucaugcuuaaaugcacacauggguacugagaacacgggggauaccuaugacugugaugaguacggagaaaauuucccuaugcugcauaacagugccccagcgggcgagacacuaagcguccucaaucagugcaggaaggcuuuuucccugccgcccaacguucaccagcggacuuggaucggcgacaaaucuuucgaauauucggauugugaggaggccuuuguggaccagucacaccuucaagcaaaucgcauuacccauaacggggaaacacuguacgagcagaagcagugcggacgagccuucaccuauagcacuucucacgcuguauccgugaagaugcauacagucgaaaaaccuuacgaguguaaggaaugcgguaaauuuuuccguuauucuagcuaccucaauucccacaugagaacccacacgggcgagaagccauacgaguguaaagaaugcgggaaguguuuuacugugucaagucauuugguugagcacgugaggauccauaccggagaaaagcccuaucagugcaaagagugcggccgggcauucgccggucgcagcgggcugacaaagcacgucagaauacauacuggagaaaaaccuuacgaguguaacgagugcggcaaggcuuauaacagguucuaccugcucaccgaacacuuuaaaacacacaccgaggaaaagccauucgaguguaaagugugcggcaagucuuuucgguccucaagcuguuuaaagaaucauuuccgcauccacacggggauuaaacccuauaagugcaaagaauguggaaaggccuuuacuguaaguucuucccugcauaaccacguuaaaauccacacaggugagaagccuuacgagugcaaggauuguggcaaagcguucgcaaccagcucgcaacuuauugaacauauccgaacucacacaggggagaagccauauauaugcaaagaauguggaaagaccuuuagagccucuucccauuugcagaaacacgugaggauucauacgggcgagaagccguacaucugcaaugagugcgguaaggcuuacaaccgguucuaucugcuaaccaaacaccucaagacacacuga

SEQ ID NO: 65085 - RNA, 1872 nt, Artificial Sequence
  derived and/or modified sequence opt3 from ZNF131__Homo_sapiens__NP_001284477
auggaggccgaagagaccauggaaugccugcaggaguuccccgaacaccauaagaugauccucgacagacuuaacgagcaaagggagcaggaucgguuuacagacauuacucugauaguggauggccaccauuucaaagcucacaaggcagucuuggccgcguguagcaaauuuuucuacaaguuuuuccaggaauuuacgcaggagccuuuaguugaaaucgaggggguguccaaaauggcuuuccgccaucugauugaguuuaccuauacagccaagcuaaugauccaaggagaagaggaagcaaaugacguauggaaggccgcugaguuccuccagaugcuggaagcaauuaaagcccuugaggugcgaaacaaggaaaauucugcuccacuggaggagaacacuaccgguaaaaaugaagccaagaaacguaagaucgcggagacaucaaacgucauaaccgaaaguuugccgagcgcagaguccgagcccguggaaaucgagguugaaauugccgagggcacuaucgaaguggaggaugaggggauugaaacacucgaggaagucgcuucugccaagcagucggugaaauacauccagucaaccggaagcagugacgauuccgcacuggcucugcucgccgacauaacgucuaaguauagacaaggcgauaggaaaggucagauuaaggaggacgggugcccuagcgauccaacuuccaaacagguagagggaaucgaaauuguugaguuacagcugucacacgugaaggaccuuuuucacugugaaaaaugcaaucggaguuucaaguuguuuuaccauuucaaggagcacaugaaaagccauucuaccgaauccuucaagugugagaucugcaacaaacgcuaucugagagagucagcguggaagcaacaccuaaauuguuaccaccucgaagagggcggcgucagcaaaaagcagaggacagggaagaaaauccaugugugccaguauugugaaaagcaauuugaucacuucggacauuuuaaagagcaucugcggaagcacacuggugaaaaacccuucgagugcccuaacugucacgagcgcuuugcccgaaauaguacccuuaagugccaccugacagcaugccagaccggcgugggggcuaagaaaggaagaaagaaauuguacgaaugucaggucugcaacucuguuuucaauuccugggaccaguuuaaggaccaucucgugauucacacgggcgauaaaccaaaccauuguacucugugcgacuuaugguucaugcaagguaaugagcugaggcggcaccucagcgaugcccacaacauaucggaacgucuuguaacagaggaagugcugucugucgagacccgcgugcagacugagcccguuacauccaugaccaucauugaacagguggggaagguccauguguugccucuacugcagguacaaguugacucagcucaggugacggucgaacaggugcacccagaucuccugcaggacagucaaguccaugauagccacauguccgagcuuccggaacaggugcagguuucuuaccuggaggugggaagaauccagaccgaggagggcacagaaguacaugucgaggaauugcacguggagaggguuaaccaaaugcccguggagguccagacugaacuccuggaggccgacuuagaucacgugaccccugaaauaaugaaucaggaggaacgggagagcucacaagcagacgccgcugaggcggcacgagaagaucaugaggacgccgaagaccuggagacaaagccaacuguagauagugaagcugagaaagccgagaacgaagaccgcaccgcacuacccgugcucgaguga

SEQ ID NO: 65086 - RNA, 2121 nt, Artificial Sequence
  derived and/or modified sequence opt3 from ZNF132__Homo_sapiens__NP_003424
auggcccugcccagcccucaggugcucaugggccuuccagcucuguugauggggccggcacaacacaccuccuggcccugcggaucugccgucccuacauuaaagucaaugguuacuuucgaggacguggcgguauacuuuagucaggaagagugggaacugcuagaugcugcccagagacaucucuaucacagcgugaugcuggagaaccuugaacuggucacguccuuggguucuuggcauggcguggagggggagggagcacacccaaaacagaauguuucgguggaaguccuccaagugaggauccccaacgccgacccuucaaccaagaaagcuaauagcugugauaugugcggcccauuccugaaggacauucugcaucucgcagagcaccaggguacacagagugaagagaaacccuacacuuguggggccugcggacgggauuuuugguuaaacgcuaaucugcaccagcaucaaaaggagcacuccggcggcaagccuuuccgcugguauaaagaccgagaugcccuuaugaagucuagcaaaguacauuuguccgaaaacccauuuaccugucgugaagggggaaagguuauacuggguucaugcgaccuacuccagcugcaggcgguggauaguggccagaaaccguacagcaaucuugggcaacugcccgaggucuguacaacccagaaguuguucgagugcucuaacuguggaaaggcauuucucaaauccucaacucugccuaaucacuuaagaacacacagcgaagagaucccauuuaccugccccacgggcgguaacuuccuggaggaaaagaguauucucgggaauaaaaaguuccauacuggagagaucccucacguguguaaagaaugcggcaaggccuuuucucauuccagcaaacuuaggaagcaccagaaguuccauaccgaggugaaauauuacgaaugcauugcuuguggcaagacauuuaaccacaaacugacuuucguccaccaucaacggauccacucgggggagcgcccauaugagugcgacgaauguggaaaggccuucucuaauagaucccauuugauaaggcacgagaaaguucacaccggugaacggcccuuugagugccuaaaguguggccgcgcauucucacagaguagcaacuuucugcgacaucagaaggugcacacacagguaagaccguacgaaugcucccaaugugggaaaucuuucagcaggucaagugcucucauccagcauuggcgggugcacaccggagagcguccuuacgagugcuccgaauguggccgcgccuuuaauaacaacagcaaucuggcgcagcaucagaagguccacacgggugagagacccuucgaaugcucugagugugggagggauuuuucacaaaguagccaccuucugcggcaucagaaagugcacacuggcgagcgaccauucgaaugcugcgacuguggaaaggccuuuuccaacucuucgacauugauucagcaucagaaaguucacaccggccaacgcccuuaugagugcagcgaauguagaaaguccuucucaaggaguucuagccucauccagcauuggcggauucacacuggggagaagcccuacgaaugcuccgaguguggaaaagcauuugcucacucaagcacacugaucgagcauuggcgcgugcacaccaaggaaagaccauaugagugcaaugaaugugguaaauucuuuucucagaacuccauauuaauuaagcaucagaaaguccacacgggcgagaagcccuacaagugcagugaaugugggaaauucuucagcaggaagucuucccugaucugccacuggcgugugcauaccggagagcggccuuaugaguguucagaaugcggccgagccuuuaguagcaauucgcaccuaguaagacaucaaaggguucacacacaggagcgcccauacgaaugcauucagugugguaaggcuuucuccgagcggucuacucucgugagacaucaaaaaguccacaccagggaacgcacauaugagugcagccagugugggaaacuguuuucacaccuuugcaacuuggcccagcauaagaaaauccacacuuga

SEQ ID NO: 65087 - RNA, 2016 nt, Artificial Sequence
  derived and/or modified sequence opt3 from ZNF133__Homo_sapiens__NP_001269925
auggcccacauggcuuucagagacguggcagucgauuuuacccaggacgaguggaggcugcucagccccgcccaacggacacuuuaccgcgaaguuaugcuggagaacuauuccaauuuggugucuuuaggcaucucauucaguaagccugaacugauuacucagcuagagcaggggaaagaaacguggcgagaggagaagaaaugcagcccagcgaccuguccggaucaucaggaauacggaaacaauugcgaccuccaaaaggaggcugaucccgaaccugagcuguaucuugacccauuuugucccccugguuucuccucucagaaauuuccaaugcagcacguacugugcaaccaucccccuuggauauucacauguuugugcgccgagggcaauauccagccaggggauccgggacccggcgaccaagaaaagcagcagcaggcaucggagggucguccuuggucagaucaagccgaagggccagagggagaaggcgcuaugccccucuuuggcagaacuaagaaaaggacccugggggcauucagccggccuccacagcgccagcccgugaguuccagaaacggacugaggggugucgagcucgaggccucuccggcucaaacaggcaauccugaagagaccgacaaguuacugaaacggauugaagugcuuggguuuggaacuguuaacuguggcgagugcgguuugagcuucuccaagaugacaaaucugcuaucacaccagcgcauccauaguggggaaaaacccuacguguguggagucugcgagaagggcuuuagccucaagaaaucucuggcccgacaccagaaggcgcacuccggcgagaaaccaauuguguguagagaaugcgggaggggauucaaccggaagucaacccuuaucauacaugagcguacgcacagcggugaaaaaccuuauaugugcagugaguguggccgcggguuuucucagaaguccaaucugaucauucaucaaagaacucacagcggagaaaaacccuacguaugcagggaguguggcaaggguuucucgcagaagucugcaguugugcggcaccagcgaacccauuuggaggaaaagacaaucgucugcuccgauugugggcucggcuucucagaccgcaguaaccugauuagccaccagagaacucauuccggagagaagccauaugccugcaaagaaugugggaggugcuuucggcaacgcaccacauuagugaaucaccagagaacccauucuaaggagaaacccuacguguguggcgucugcggacacagcuucucacagaacaguacgcugaucucccacaggcguacucauacaggugagaagccuuacguuuguggcgugugcgggcggggauuuagccucaagucucaccuuaaucgacaucagaacauacacucaggcgaaaaaccaauuguaugcaaggauugugguagaggguucagucaacagagcaaccugaucaggcaccagcgcacccauuccggcgagaaaccgauggugugcggagaauguggccggggguuuucucagaagucgaauuuggucgcucaccaaagaacucauagcggagagaggcccuaugugugccgcgaauguggucgaggcuucucccaccaggccgggcuaauucggcauaaacguaagcacucaagagagaagccuuacaugugcaggcaguguggacugggcuuugguaacaaaagugcacucaucacacacaagcgcgcucauucugaggaaaaaccaugcguuugucgggagugcgggcaaggcuuccugcagaaaagccaccuuacccugcaucagaugacgcacaccggagaaaaacccuauguguguaagacaugcggcagaggguuuuccuugaagucacaucucagcaggcaccgaaaaacuaccucuguccaccaucgccugccugugcagccagaccccgagccgugcgccggacaaccuuccgacaguuuauacagccuguga

SEQ ID NO: 65088 - RNA, 1425 nt, Artificial Sequence
  derived and/or modified sequence opt3 from ZNF141__Homo_sapiens__NP_003432
auggagcugcucaccuucagagacguggccaucgaauuuagccccgaggaauggaagugccuugauccugaccagcaaaaccuguacagggaugucauguuggagaauuaucggaacuuaguuucccugggcguggcuauuucuaauccagaccuaguaacaugucucgaacagcgcaaagagccguacaacgugaagauacacaaaaucgucgcacgacccccugccaugugcucacauuucacucaggaucacuggccagugcaggggauugaggacaguuuucauaagcugauccuucguagauaugaaaaauguggacacgauaaucugcaauugaggaaggguugcaagagccucaacgaguguaaacugcagaagggcggguacaaugaguucaacgaaugccuguccacgacccagucuaaaauucuccaguguaaggcgucgguuaaaguggucucaaaguuuagcaauaguaacaagcggaaaacacgccauacuggagagaagcacuucaaagaaugcggcaaguccuuucaaaaauucucucacuuaacccagcauaaggugauccacgcuggugagaaacccuauacaugugaagagugcgggaaggccuuuaaguggagccugauauucaaugaacauaaaagaauccacaccggagagaagccuuuuacuugugaggaaugcggcuccauuuucacaaccucaagucacuuugcaaaacauaagaucauucacacgggcgagaaaccauacaagugcgaagagugugggaaggccuucaacagguucacuacccuuacaaaacauaagcggauccacgcuggagaaaaacccauaacuugcgaggagugucgcaagauuuuuaccucuagcuccaauuucgcaaaacauaagcgaauccacacaggugaaaagccuuauaaaugcgaggaauguggcaaggccuuuaacagaucaaccacguugacuaaacacaagaggauucauacaggggagaaaccauauaccugcgaagaguguggaaaggcuuuccggcagagcaguaagcugaaugagcacaaaaagguacauacuggcgaacguccguacaaaugcgacgagugugguaaggccuuugggcgcucuagaguucuaaacgaacacaaaaagauccacacaggagagaaacccuacaagugcgaggaauguggcaaggcguucaggcgguccaccgaucgaagccagcauaaaaagauccacucggcagacaaaccuuacaagugcaaagagugcgauaaggccuuuaagcaauucucucuccugucccagcauaaaaagauucacacgguggacaaaccauauaaguguaaagauugcgacaaggcuuuuaagcgcuucucacaucuuaacaaacacaagaaaauacacaccuga

SEQ ID NO: 65089 - RNA, 1914 nt, Artificial Sequence
  derived and/or modified sequence opt3 from ZNF143__Homo_sapiens__NP_001269585
augcugcucgcccagaucaacagagacagccaaggcaugaccgaguuccccgggggagguauggaagcucagcacgugacacuuugccugacugaggcagucacgguugccgauggcgacaauuuggaaaacauggaggggguguccuuacaggcgguaacccuggcugauggaucuacagccuacauucagcauaauucaaaggacgcaaaacuaauagauggccaagugauccagcucgaagacgguagugccgcuuauguccagcacgugccuauuccaaagagcagggauucccugcggcuugaggacgggcaggcaguucaacuggaggauggaacuaccgccuuuauccaucacacaucuaaagacucguacgaucagucagcuuugcaggccgugcagcucgaagacggcaccacugcguauauucaucacgcaguccaagugccgcagagcgauacaauccuggccauacaggcugacggcaccguagccgggcugcacacgggagacgcaacuaucgaucccgacaccauuagugcucucgagcaauacgccgcgaagguuuccaucgaugguucugaaagcguggccggcacagggaugauuggagagaacgagcaggagaaaaagaugcagaucgucuuacagggccaugcaacucgcgugaccgcuaagucccaacagucaggugaaaaagccuuccgaugugaauaugacgggugcggaaagcuguacacaaccgcucaccaucuuaaagugcacgagcguagucacacgggcgauagaccuuaucagugugaacaugccggcugcgggaaggcauuugccacuggauacgguuugaaaagccacgucaggacacauaccggcgagaagccauaccgguguucugaggacaauugcacuaaguccuucaaaacaucaggggaucugcagaagcacauacgcacccauacgggagaaagacccuuuaaauguccuuucgagggcugcgguaggagcuuuaccacaaguaacauucggaagguucacgugcgcacucacaccggggaacgaccauauuacuguacagagcccggcugcggcagagcuuucgcgucugcaacuaauuauaaaaaccauguaaggauccacaccggagaaaagccuuacguguguacagucccagggugcgacaaacgguuuaccgaguauuccagccuauacaagcaucacgugguucacacucauucgaagccguauaauugcaaccacuguggaaaaacguacaagcaaauuucuacacucgccaugcauaaacguaccgcucacaaugauacugagcccaucgaagaggaacaggaggccuucuuugaaccuccacccggucagggcgaggacgugcugaaggggucccagaucaccuacgucacaggaguggagggcgaugacguaguuucaacccaaguggcaacugucacacagaguggucuuagccaacaggugacgcugauuucccaggacgggacccagcaugucaacauaucucaggccgauaugcaagcuaucggcaauacuauuacaauggugacccaggacggaacaccuaucacuguuccagcccacgaugcagugauaagcucagcgggcacccacaguguagcuauggucacggccgaagggaccgagggagaacagguggcaauuguugcccaggacuuggcugccuuccauacagcauccagcgagaugggucaccaacagcauucucaccaucucgugacuaccgagacacgcccccugacuuuagucgcuaccucaaacggcacgcagaucgccgugcagcugggggaacaaccgagucucgaggaagcgaucagaauugccagcaggauccagcagggagagacaccuggccuugaugacuga

SEQ ID NO: 65090 - RNA, 879 nt, Artificial Sequence
  derived and/or modified sequence opt3 from ZNF146__Homo_sapiens__XP_005259271
augagccaccugucccaacaaagaaucuacucuggcgagaaccccuucgccugcaaggugugugggaaagucuuuucacauaagaguaaucucaccgaacacgagcauuuccacacaagggaaaaaccuuuugagugcaacgaauguggaaaggcuuucagccagaaacaguauguuauuaagcaucagaauacucacacgggugagaaacuuuuugagugcaacgaauguggcaaauccuucucucaaaaggagaaucuguugacccaccagaaaauacauacaggggaaaagccauuugagugcaaagacuguggaaaggcauucauccagaagucgaacuuaauucggcaccagcgcacucauaccggcgagaaaccguuugugugcaaggaaugugguaaaacauucucagggaaaagcaaucugaccgagcacgaaaagauccacauuggagagaagcccuuuaaaugcagugaauguggcacugccuucggccaaaagaaguaccuaaucaaacaucagaacauacacacaggggagaagccuuaugagugcaaugaaugcggaaaagcguuuucccagcgaaccucucucaucguacaugugcguauucacagcggugauaagccauacgaguguaacgucugcggcaaggcuuucucccagucaaguagccugacggugcauguuagaucucacacuggggaaaagcccuauggauguaaugagugcggcaaggccuucucccaauuuucaacccuugcacugcacuugaggauccauacagguaaaaagccuuaccaguguagcgaaugcgggaaagccuucagucagaagucucaccauauucggcaccagaaaauccacacucauuga

SEQ ID NO: 65091 - RNA, 2385 nt, Artificial Sequence
  derived and/or modified sequence opt3 from ZNF148__Homo_sapiens__NP_068799
augaacaucgacgauaagcuggaaggccucuuccuuaaaugcgggggaauugacgaaaugcagagcuccagaaccaugguggucauggguggcguuucugggcaaucaacagugaguggagagcugcaggauagcguauugcaggacagguccaugccccaccaggaaauauuagccgcugaugaggugcugcaagaaucugagaugcggcagcaggacaugaucucgcaugaugagcuaaugguccacgaagagacugugaagaaugacgaagaacagauggagacgcaugaacgccucccucaaggccugcaguacgcacuuaacguuccaauuucagugaaacaggagaucaccuuuacagaugucagcgaacagcugaugcgagacaagaaacaaauucgugagccgguggauuugcagaagaagaaaaagagaaaacagaggagucccgccaagauccucacuauaaaugaagacgguucccuggggcugaaaaccccuaagucucacguaugugagcauugcaacgcggcuuuccggacaaauuaucaccuccaacgccacguuuuuauccauaccggagagaagccauuccaguguagccagugcgauaugagauuuauucagaaauacuuacugcaaaggcacgaaaagauccauacuggcgagaaacccuuccggugugacgaaugcggcaugcgcuuuauucagaaguaucacauggagcgacacaaaagaacacauuccggggaaaagccuuaccagugugaguauugccuucaguacuucucaaggaccgaccggguguugaaacacaagcguaugugucaugagaaccacgauaagaaacugaaucgcugcgccaucaagggaggucuacucacgagugaagaggacagcggcuuuucuacuuccccaaaagauaacucacugcccaagaaaaagagacaaaagaccgagaaaaagagcagugggauggacaaagagucugcacuugauaaguccgaccugaaaaaggauaagaaugacuauuugccucucuacagcucgucuacaaaagucaaggaugaauacaugguggccgaguaugcuguggagaugccacauuccucagucggaggcagucaccuggaagacgcaagcggugagauacacccgcccaaauuaguucugaagaaaauuaacuccaagaggucucucaagcagccucuugaacagaaucagacuaucagcccacugucaaccuacgaggagaguaaaguguccaaguaugccuucgaauugguagauaaacaagcucuacuggacagcgaggggaacgccgacauugaucagguggacaaucuccaggaaggacccucuaagccuguccauucaaguacaaacuacgaugacgcgaugcaguuucugaaaaagaaacgguaucuucaagcagccagcaauaacucccgagaguacgcucugaacgugggcaccaucgccucucagccaucgguuacgcaggcagcuguggccagcgucaucgaugaauccacuacagcgucaauuuuggagagucaagcccucaauguggagauaaagucuaaccacgacaagaauguaauccccgaugaaguucugcagaccuuacuggaccauuauagccacaaagcaaacggccagcacgagauuuccuucucaguggcugauacugaagucacaagcucuaucuccauaaauaguagcgaggugccggaagucaccccuucugagaacgugggguccucaagucaggccagcucguccgacaaggcuaauaugcuacaagaguacucuaaauuucuccagcaggcccuggaucgcacgagccagaacgacgcauaccuuaauucacccaguuugaacuucguuaccgauaaucaaacacugccaaaccagccugccuucuccucuauugacaaacagguguaugcuacuaugcccaucaauagcuuuagauccggaaugaacucaccacucaggaccacacccgacaagagccauuucggucugaucguaggcgauagucagcacucuuuuccuuucuccggggacgaaacuaaucaugcgagcgcaaccucgacacaagauuuucuugaccaggucaccucacagaagaaggccgaggcucaaccagugcaccaggccuaccagaugucuaguuucgaacagccguuucgggcacccuaucauggaucccgcgccggcauugcuacucaauucagcacggccaacggucagguuaaccugagagggccuggcacaucugcagaguuuagcgaguucccauuggugaaugucaacgauaauagggcgggaaugaccuccucacccgacgcuacuaccggccagacauuuggguga

SEQ ID NO: 65092 - RNA, 1314 nt, Artificial Sequence
  derived and/or modified sequence opt3 from ZNF154__Homo_sapiens__NP_001078853
auggccgcugcaacccugagaacacccacucagggcacggugaccuucgaggacgucgccguucacuuuagcugggaagagugggggcuccuugaugaagcgcaaaggugccuguaccgggacgugauguuggagaacuuagcucugcuaacaucccucgauguacaucaccagaagcagcaucugggagaaaaacacuuccgcucuaaugugggucgagcccuuuuugucaagacuuguaccuuccaugugucaggcgagccuaguacaugccgugagguugggaaagacuuucuggcaaaguugggauuccuccaccagcaagccgcucacaccggcgaacagagcaacuccaaaucugaugguggggcaaucucgcauagaggaaagacucacuauaauuguggcgagcauacaaaggccuuuucaggcaaacacacccuggugcagcagcaaaggacgcugacuaccgaacggugcuacauuuguagcgagugcgggaagaguuucuccaaaucuuauagccucaacgaccacuggcgcuuacauacaggagagaagccauacgaauguagagagugcgguaaauccuuuaggcagucaaguagccugauacagcaccggcgcguccauacugcugugcgaccgcacgaaugugaugagugcggcaaacuuuucucuaauaaguccaacuugaucaagcauagaaggguacacaccggggaacggcccuaugaguguucagagugcggaaagagcuuuagucagcguucugcccugcuacaacaccgcggcguucauacaggugaaagaccuuacgagugcuccgaaugugggaaauucuuuaccuaucacagcucgcucauuaagcaucagaaagugcacucuggauccaggccauacgagugcucagaauguggcaagaguuucagccagaauagcucucugaucgagcaccaucggguccacacgggcgagcgacccuacaaaugcagcgaaugugggaagucauucagucaacgcuccgcgcuucugcagcauagaggagugcacacuggugagaggccuuaugaaugcagcgaguguggcaaguuuuucccauacucuucaaguuugcggaaacaucagcgcgugcacacagggagcagacccuaugaaugcuccgaguguggaaagucuuuuacccagaacucgggccucauuaaacacaggcguguccauacuggugagaagccuuacgaaugcacagagugugggaaauccuucucccacaauucaagucugaucaagcaucaacggauacacucucgauga

SEQ ID NO: 65093 - RNA, 2349 nt, Artificial Sequence
  derived and/or modified sequence opt3 from ZNF160__Homo_sapiens__XP_005259436
augcuggagaacuacuggaaucucgugagccuuggccugugccacuucgacaugaacaucauuuccauguuggaagaggggaaggaacccuggaccgucaaaucuuguguuaagauagccagaaaaccuaggacaccagagugcgugaagggaguagugacugauaucccgcccaaauguacgauuaaggacuuacugccuaaggaaaaaucaaguaccgaggcugucuuucauacagugguucuagagcggcacgaaagcccagauaucgaggacuucuccuuuaaggaaccccagaaaaaugugcaugauuucgagugccaauggcgcgacgauacugguaacuauaagggcguccucauggcacagaaagaggggaagcgagaccagcgugauagaagggacauugaaaauaagcugaugaacaaucagcuuggagugucuuuucacucgcaucugccugaguugcaacucuuccagggcgaagguaaaauguacgaguguaaccagguagaaaagucaaccaauaacgggagcaguguuuccccacugcagcaaauccccucuagcgugcagacacaccgguccaaaaaguaucacgagcugaaucauuuuucacucuuaacccagcgcagaaaagccaacaguugcggaaagccuuacaaauguaaugagugcggcaaggcguucacucagaacagcaaucugacaucucacaggcggauacauuccggcgaaaagccauauaaauguucagagugcgggaagaccuuuacgguccgcagcaaccuuacuauccaccaagugauucacaccggagaaaaaccguacaagugucaugagugcgguaaaguguuccgacacaacaguuauuuggcuacacauagaaggauccacacuggcgaaaagcccuacaagugcaaugagugugggaaagccuuucggggacauucuaaccugaccacacaccagcuaauucacaccggcgagaagccuuucaaaugcaaugaaugugguaagcucuuuacgcagaacucccaucugaucagccacuggcguauacauacuggggagaaaccauacaagugcaaugaauguggaaaggcauucucggucagaucuucccuugccauucaccaaacaauccacaccggcgagaaacccuauaagugcaacgaauguggcaaaguuuuccgcuacaauucauaucuggggaggcaucggcgagugcacacuggagagaagccuuacaaaugcaacgagugugguaaggcuuuuaguaugcauagcaauuuggcaacacaccagguaauucauaccggcacgaagccauucaaaugcaacgaauguuccaagguguuuacccaaaauucucagcucgccaaccaccgcagaauccacacaggggagaaacccuauaagugcaaugaaugcggaaaggcuuucagcgucaggucaagucugacuacccaucaggccauccacuccggcgagaaaccguacaaauguauugagugcgguaagagcuuuacacagaagucucauuuacggucacaccgcgggauacauaguggcgaaaaaccuuauaaguguaacgagugcggaaaaguguucgcgcagacuagccagcuggcaagacacuggaggguucacaccggcgaaaagcccuacaaauguaaugauugcgggcgugccuuuuccgaccggucuucgcucacauuccaucaagcuauccacaccggagagaagccauacaagugucaugaaugcgguaaaguguuucgacacaacagcuaucuugccacucacagaaggauucauacgggcgagaagccuuacaaauguaacgagugcgggaaggcauucuccaugcacucaaaucugacaacccauaaagucauccacacuggagaaaagcccuauaaguguaaccagugcggcaaaguguuuacccagaauagucauuuggcuaaccaccagcgcacacacaccggugagaagccauaccggugcaaugaaugugggaaagccuucucuguaagaagcucccuaacuacacaucaagcgauacacacgggcaagaaacccuauaagugcaacgaguguggaaagguuuuuacccagaaugcccaucuggcaaaccacaggcgcauucacacuggcgaaaaaccuuaccgaugcacagagugugggaaggcuuuccgggugcguucaagccucaccacacauauggccauccacacuggagagaaaagauauaagugcaaugaaugugguaaagucuucaggcagucuuccaaccuggcuagucaucaccgcaugcauaccggcgagaagccauacaaauga

SEQ ID NO: 65094 - RNA, 1815 nt, Artificial Sequence
  derived and/or modified sequence opt3 from ZNF169__Homo_sapiens__NP_003439
augagccccggccugcucaccacaagaaaggaggcccuuauggcuuucagggacguggcagucgccuuuacucagaaagaauggaagcuguuguccucugcgcaacggacguuauaccgcgagguuaugcuggaaaacuauucacaccuagugagucucgggaucgcuuucagcaaaccuaagcugauugagcagcuugaacagggagaugagccauggcgagaggaaaaugagcaucuguuggaccucugcccggccgaaccccguaccgaguuucagccuuccuucccacaccugguagcauuuucuucgucacaacugcucagacaguacgccuuaagcggucaucccacacagauauucccuaguuccucugcuggcggggauuuucagcuggaggcaccaagguguagcuccgaaaaaggagagucaggcgaaacugagggucccgacaguagccuucggaagcgcccuucuagaaucuccaggaccuucuuuucaccacaccaaggggauccgguggaaugggucgagggaaaccgggagggcggcacagacuugcgccuggcccagcgaaugagccuagggggaagugauaccaugcucaagggugcugacacuucugaauccggcgccgugauuagagggaauuauaggcugggacuuagcaaaaagucgucucuguucucccaucagaaacaccacguuugccccgaguguggccgggguuuuugccagcguucagauuugaucaagcaucaacgcacacacaccggggaaaaaccuuaccucuguccagagugcggaagaagguucagucagaaggcgagccuguccauucaucagcggaagcacucuggcgaaaaacccuaugugugucgagagugcggccgccacuuuagauacacgagcucauuaacuaaccauaagaggauccacaguggggagcggccuuucgucugucaagaaugcggacgcgguuucagacagaaaauagcacugcuccuucaucagaggacccaccuggaggaaaagccauuugugugucccgagugcggccguggguucugccagaaagccuccuugcuacaacaucagagcucucacacaggagaacggccguuucugugucucgagugcggccgaucauucagacagcagagucugcuucugagccaccaaguaacucauuccggugagaagccuuauguuugugcugaaugcgggcacucuuuuaggcagaaagugaccuugauccgccaucagcggacacacaccggcgagaagcccuaccucuguccacagugcggaagaggcuucucgcaaaaggucacgcugauugggcaccagaggacucauacaggagaaaaaccuuacuuaugucccgacugcggucgcggcuuugggcagaaggugacccugauccgacaccagcggacucauacaggagagaaaccauaucuaugucccaagugcggccgugccuucgguuuuaaaagccuccugaccagacaccaaaggacgcauuccgaggaggaacuuuacguggaucgcgucugugggcagggcuugggacagaagucacaccugauuagugaccaacggacccacucuggcgaaaagccuugcaucugcgaugagugugggagaggauucgguuuuaaaagcgcacucauaaggcaucagcgaacacacuccggcgaaaagccauauguuugccgcgagugugggcggggauucucacagaaaagccaucugcacagacauaggcguacuaagucuggccaccagcuucugccgcaagagguguuuuga

SEQ ID NO: 65095 - RNA, 2136 nt, Artificial Sequence
  derived and/or modified sequence opt3 from ZNF175__Homo_sapiens__NP_009078
augcccgccgacgugaaccugagccagaagccucaaguccucggcccagagaaacaggauggguccugcgaagcuagcguuucauucgaggacgugaccguagauuuuaguagagaagaguggcagcagcuugacccggcacaaaggugucuguaccgggaugugauguuggaauuauauagccaccuguucgccgucggauaccauauccccaauccugaggugauuuuucgcaugcuaaaggagaaagaaccacgaguugaggaagcggaggugucccaccagcguugccaggagagagaauuuggucucgagauaccccagaaggaaaucucuaaaaaggcuucguuucaaaaggacauggucggcgaguucacaagggaugggucaugguguagcauucuggaggaacuucggcuggacgccgaucgcacuaaaaaggacgagcagaaccagauccagccuaugagucauuccgcauuuuucaauaaaaagacguugaacaccgaaucuaauugcgaguauaaagauccaggaaagaugauuagaacaaggccccaccucgccagcucccaaaagcagccucagaaauguugccuguuuacugaaucacugaagcucaacuuagaggugaauggccaaaacgaaaguaaugacaccgagcagcuggaugacguaguugguagcgggcagcuuuucucucauuccucaagcgacgcuuguaguaaaaacauccacacaggagagaccuuuugcaagggcaaucagugucggaaagugugcggccacaagcaaucuuugaaacagcaucagauacacacucagaagaagccagauggguguuccgaaugcggagguagcuucacacaaaaaucgcaucuguuugcacagcagcgcauccacucugucggcaaccuacacgagugcgggaaguguggaaaagccuucaugccgcagcucaagcuguccguguaccuuaccgaccauacgggcgauauucccugcaucuguaaagaaugcgguaagguguucauucaacgaucagagcuguugacucaccagaagacccauacaaggaaaaagccuuauaaaugucacgacugcgggaaggcuuucuuccagaugcucagucuguuuagacaucagcggacucacagccgugaaaaauuauacgaguguuccgagugcggaaagggcuucucucaaaauagcacccugaucauacaccagaagauucauacaggcgaacgccaguaugccuguucagagugcgggaaagcguuuacccaaaagaguacgcucucccuucaccagagaauccauagcggacagaaaucuuacgucuguauugaaugcggucaggcauucauccaaaaggcccaccugaucguucaccagaggucacauacuggcgagaaaccauaccagugccacaacugugggaagaguuuuauuagcaagucccaguuggauauacaucaccggauccauacaggagagaaacccuaugaaugcucugacuguggcaagaccuucacucaaaaaucgcaccuaaauauucaccagaagauccauacaggugagcgacaccaugugugcagcgaaugugggaaggcuuuuaaccagaaauccauacugucaaugcaccagcgcauucauaccggcgagaaaccuuacaagugcagugaauguggaaaggccuucacgucuaaaagccaauuuaaggagcaccagagaauccacaccggcgagaaaccauauguaugcacagaaugugggaaggcauucaacggaagguccaauuuucauaaacaccagaucacucauacccgggagcgccccuucgugugcuacaagugugguaaggcuuucguccaaaaaucagaacucauuacacaccagagaacucacaugggcgagaagccguaugaaugccuggauugcgggaaaucuuuuucuaagaaaccucagcuuaaggugcaucagaggauccacaccggagagcgucccuacguuuguuccgagugcggcaaggccuucaacaaucggaguaacuuuaauaaacaucaaacaacccacacucgagacaagagcuauaaauguucuuacuccgugaaggguuucacgaaacaguga

SEQ ID NO: 65096 - RNA, 1446 nt, Artificial Sequence
  derived and/or modified sequence opt3 from ZNF177__Homo_sapiens__NP_001166122
auggccgcuggcuggcugaccacauggagccagaacuccgugacuuuccaagaggucgcaguugacuuuucucaggaagagugggcccuccuugaucccgcgcagaagaaucuguacaaagacgugauguuggaaaacuucagaaauuuagcuucaguaggguaucagcugugcaggcacagucuaaucagcaagguggaucaagagcagcucaaaacggacgaacgggguauucugcagggagauugugccgacugggagacccagcuuaagccuaaagauacaauagcaaugcaaaacaucccaggcgggaagacuuccaauggaauuaacaccgccgagaaucagccgggcgaacauucucuggagugcaaccacugugguaaguuucgcaaaaauacacgauucaucugcacccguuacuguaagggggaaaaaugcuauaaguacauuaaauauucgaaggucuuuaaccaucccucaacuuugagaagccacgugaguauccauauaggagagaagacacucgaguucaccgacuguaggaaggcuuuuaaucaggaauccucucugcggaaacaucugcgcacgccuacuggccagaaauuccaagaguacgaacagugcgauaugagcuuuucccuccacucaaguuguagcguuagagagcagaucccaaccggcgaaaagggggacgagugcucugauuauggaaaaauuucccccuuaucagugcacacaaagacugguagcgucgaggaaggccuggaguguaacgaacacgagaaaaccuucacagacccucuuaguuugcaaaauugcgugaggacccauucuggggaaaugccauacgagugcuccgauuguggaaaggcauuuaucuuccagagcucgcugaagaaacacaugcggucucacacgggcgagaagcccuacgaaugcgaccauugugguaaauccuuuucacagaguagccaccuaaacguacauaagcgcacucacacaggggagaaaccuuaugacugcaaggaauguggaaaggccuucaccguuccauccucucuccagaaacaugugcgaacucacacaggcgagaagccguacgaaugcagcgauuguggcaaagccuucauugaccaaucaagucugaagaaacacaccagaucccauacgggggagaagcccuaugagugcaaucaguguggaaagagcuuuucuaccgguucauaccuuaucguccacaaaaggacacauacuggcgaaaagaccuaugagugcaaagaaugugggaaggcuuuccggaacaguagcugccugcgugugcacgugcgcacacacacuggagagaaaccuuacaagugcauacagugugagaaggcguuuuccaccucuacaaacuugauuaugcauaaaagaauccacaauggccagaagcuccaugaauga

SEQ ID NO: 65097 - RNA, 1863 nt, Artificial Sequence
  derived and/or modified sequence opt3 from ZNF182__Homo_sapiens__NP_001007089
auggccaagccccagggccuggugaccuucgaggacgucgcuguugauuuuacacaagaagaguggcaguaccucaacccuccacagagaacucuuuauagggacgugaugcuggaaacguacagcaauuugguauucguggggcagcaagucaccaaaccgaacuuaauccugaagcuagagguggaagagugccccgcagagggaaaaauuccuuuuuggaauuucccagaaguuugucagguggaugagcagauagaacggcagcaccaagacgaucaggacaagugccuccugaugcaggucgguuuuuccgauaaaaagacaaucauuacuaagucugcccgcgacugucaugaguucggcaacauccuucaccugucaaccaauuugguggcgaguauucagcgacccgauaaacaugagagcuuugggaacaauaugguagacaaccucgaucuguucucccguucuucggcugaaaauaaguaugacaacggaugcgccaaacuguuuuuccacacagaguacgaaaagaccaauccuggcaugaaaccauaugguuacaaggagugugggaagggacucagaaggaaaaagggcuuaucacugcaucaacggaucaaaaacggcgaaaagcccuuugagugcacugcaugucgcaaaacauucagcaagaaaagucaccuuauaguucacuggagaacccauacgggggagaagccuuuuggaugcacugaaugugguaaggccuucucccagaaaucucaguugaucauucaccugaggacccauacaggcgagcggccauucgaaugcccggagugugggaaggcuuuucgcgagaaaagcacugugaucauucacuaucgaacccacacaggagaaaagcccuacgagugcaaugaaugcggcaaagcauucacccaaaaguccaaccuaaucguccaucagaagacgcacacuggugagaaaacauacgaauguaccaagugcggggagucauuuauacagaaacucgaucugauuauccaucacaguacucauacaggaaagaaaccucacgaauguaaugagugcaagaagaccuucagcgacaaaucuacgcuuauuauccaccagagaacccauacaggcgagaagccacacaaauguacugaaugcggcaaguccuuuaacgagaaaucaacccugaucgugcaucaaaggacacacacuggggaaaagcccuaugagugugacgugugcggaaagaccuucacacagaaaagcaacuuggguguccaccagcggacccauaguggcgagaagccuuuugaauguaaugagugcgaaaaagccuucucucagaaguccuaccucaugcugcaccaacgugggcauacuggagagaaaccauaugaauguaacgagugcgagaaggcuuuuagccagaaaucguacuuaauuauacaccagcgcacgcauacagaagagaagcccuauaagugcaaugaauguggcaaagccuucagagagaagucuaaacugaucauucaccagaggauccacaccggugaaaagccguacgagugcccuguuuguuggaaagcguuuucccaaaagucacagcucauaauucaucagcggacucacaccggggagaagcccuaugcaugcacagaauguggcaaagccuuccgagagaagaguaccuuuacugugcaucagcgcacacacacgggagaaaaaccauacaagugcaccgaguguggcaaagccuucacucaaaagagcaaccuuaucguacaucagagaacacacgcugggaagaaagcacacggaaggggucauacccggaaguccaaauucauggcucacuga

SEQ ID NO: 65098 - RNA, 2256 nt, Artificial Sequence
  derived and/or modified sequence opt3 from ZNF184__Homo_sapiens__NP_009080
auggaggaccugagcucccccgauucuacccuccuucagggcgggcacaaccuguugucaagugccagcuuccaagaagcugugacauuuaaggacgucaucguugauuucacucaggaggaauggaaacaguuagacccuggacagagagaucuguuuagggacgugacgcuagagaauuacacccaucucguauccauuggucugcaagugucuaagccagaugucauaucgcagcuugaacagggcacagagccguggaucauggagcccucaauuccuguggggacuugcgcagacugggaaacccggcuggagaacagcguuagugccccagaacccgauaucuccgaggaggaauugucuccugaggugauugucgaaaaacacaagcgcgacgauagcugguccucaaaucuccuggagaguugggaauaugagggaagccuggagcgacagcaagcgaaccagcagacacucccaaaagaaaucaaggugaccgagaagacuauacccucuugggaaaaaggcccuguaaauaacgaguucgguaaguccguuaaugugucaagcaacuuagucacacaggaaccaaguccggaggagaccucuacgaaacguuccaucaagcaaaauagcaaccccgugaaaaaggaaaagucguguaaaugcaaugagugugggaaggcuuuuucuuacugcuccgcccugauuagacaucagaggacucacaccggagaaaaaccuuauaaguguaacgagugcgaaaaagcauucucacggagugagaaucuuaucaaccaucagcgcauucacacaggcgacaagccauacaaaugugaucaaugcggcaagggguuuaucgagggacccagcuugacucagcaccagagaauacauaccggugaaaagccuuauaaaugugacgagugcggcaaggccuucucccagaggacacaccuggugcaacaucagcggauucacaccggggaaaaaccauacacguguaaugagugcggaaaggcuuuuucucagcgcggccacuucauggagcaucagaaaauccacacuggugaaaagcccuuuaagugcgacgagugugauaaaacauucacccgaagcacucaucuaacacaacaccagaagauucauaccggggagaaaacguauaagugcaacgaauguggaaaagcauuuaacggcccgucaaccuucaucagacaccacaugauccauacaggcgaaaagccuuacgagugcaaugagugugggaaggccuucagucagcacuccaaccucacucagcaucagaaaacccacacaggagaaaagcccuacgacugcgcugagugugguaagagcuuuucuuauuggucaagucuggcccaacaccuuaaaauucauacuggcgaaaaaccauacaagugcaaugagugugggaaggcguucagcuauugcuccucucugacccagcacaggcggauacauacacgugaaaaaccuuuugaguguucggagugcggaaaggcauucagcuacuuguccaaccucaaucagcaccagaaaacccauacucaagaaaaggccuaugagugcaaagaauguggcaaggcuuuuauccgcucaaguucucuggccaaacacgagaggauucacacgggugaaaagcccuaccagugccaugagugugggaagacauucagcuauggcuccucauuaauccaacacagaaaaauacauaccggagagcggccauacaagugcaacgaauguggccgagcauuuaaucagaacauucaccugacucagcauaaacgcauccacaccggggcuaagcccuacgagugcgccgaauguggaaaagcguucagacacugcagcucucucgcccagcaucaaaagacacacaccgaggagaagccuuaucaguguaauaaaugcgaaaagacuuuuucccagaguagccaucuuacacagcaccaaaggauccacacgggugagaaaccauacaaguguaacgaaugcgauaaagcauucucucgguccacccaucugacugagcaccagaauacacauaccggcgaaaagccguauaacugcaaugagugucgcaagacauuuucacagaguacuuacuugauucagcaccaaagaauccauagcggggagaaacccuucggaugcaacgacuguggcaagucguuuagguaucguuccgcucuaaauaaacaccagcggcugcacccugguauuuga

SEQ ID NO: 65099 - RNA, 984 nt, Artificial Sequence
  derived and/or modified sequence opt3 from ZNF185__Homo_sapiens__NP_001171586
auggccgcuagagacgagcugggccucgggggagauagccuugaagcaaugcccgugccugccgcgaggggucggccacgcaucaccaacggcccggaggaacuggcugcccccuccccugcagccuuggcugacuacgaggggaaggaugucgcaacacgaguuggagaagccuggcaggagcguccaggcgcucccagaggugggcaaggagacccugccgugccagcgcagcagcccgcagauccuucuacuccagagaggcagucaaguccgagcggcuccgaacaauuaguacggcgcgagucuugcggcucgucagugcugacggacuucgaagggaaagaugucgccaccaaggugggagaggcuuggcaggacagacccggugccccuaggggcgggcagggagauccagcaguucccacacagcaaccugcugacccaagcacucccgagcagcagaauaguccguccggcucugaacaguuugugcggcgcgagagcuguaccucccgagucagaucaccuaguagcugcauggugacaguaaccguuacugccacaucugaacaaccccacauuuauauaccagcgccugccuccgagcuagauucaagcaguaccacgaaagguauccucuucgugaaggaauacgucaacgcaucugagguguccagcgggaaacccgugucggcuagguauucuaaugucuccucaauugaggacaguuuugccauggaaaagaagccacccuguggaagcacuccuuacuccgagcggaccacaggcggcaucugcacuuauuguaaccgugaaauucgcgauugcccaaaaaucacccuggagcaucuugggauauguugccacgaauacuguuucaagugcggaaucuguucuaaaccgaugggugaccuguuggaccagauuuuuauccauagagauacaauucacugcggcaagugcuaugagaaacucuucuga

SEQ ID NO: 65100 - RNA, 1839 nt, Artificial Sequence
  derived and/or modified sequence opt3 from ZNF189__Homo_sapiens__NP_001265160
auggccagccccuccccuccaccggagucuaaggaagagugggacuaccuggaucccgcucagagaucacucuauaaagacgugaugauggaaaacuacggcaaucuugucagucuggauguuuugaacagggacaaggaugaggaaccuaccgugaaacaagagaucgaggaaauugaggaagagguagagccacagggggugauagucacacggaucaagagcgaaauugaccaggaucccaugggacgcgagacuuucgaauuagugggucgacuggacaaacagcguggcaucuuucuaugggagauuccuagagaaucccucacgcaagagcagaggauguuccgggagaauaccaacaucauacgcaagagaccaaauucugaagagaagugccacaaaugugaagagugcgggaagggauuuguuaggaaagcacauuucauccagcaccagcgggugcauacaggcgaaaagcccuuucaauguaacgagugcgguaaaucguucucacgcagcaguuuugucauugagcaccagcgaauccauacuggggaaagaccuuaugaguguaauuacugcggaaagaccuucuccgugucuagcacacugauuaggcaccagcggauccacaccggcgaacguccauaucaguguaaccaaugcaagcaguccuuuucacagcgcagaagucuuguaaaacaucaaaggauacacacuggcgagaagccgcauaaauguagcgauugcgggaaggccuucucuuggaaaucccaccugauugaacaccagcggacacauaccggagagaagcccuaccacuguacgaaaugcaagaagucauuuagccgaaauaguuugcucguugagcaucagcgcauccacacuggugaaagaccucauaaaugcggcgagugugggaaggcguucaggcugucuaccuaucugauucagcaccagaaaauccacacaggagaaaagccauuucucugcaucgaguguggcaaauccuucagccggucgucuuucuuaauugagcaucaacgcauacacacuggugaaagacccuaccagugcaaggagugugggaaguccuuuucacagcugugcaaccuuaccaggcaucaacguauccacacaggagacaaaccucacaagugugaagagugcggcaaagccuucagucggagcuccggcuugauucagcaucagcgaauccacaccagagaaaagacguacccauauaaugagacuaaagagucuuuugaucccaacuguagccuggugauacagcaagaagucuacccgaaggagaagucauauaaaugcgacgaaugugggaagacauucaguguguccgcucaucuagugcagcaccagaggauucauaccggagagaaaccuuaccucugcacugucugcgguaagagcuuuucucgcucaaguuuccugaucgaacaccagcggauccacacaggcgagagacccuaucuuuguaggcaaugcgggaaauccuuuagccagcuguguaauuugauucgccaucagggaguucacaccggcaacaagccacauaagugcgaugagugugguaaagcauucucucgaaauucggggcucauccaacaccagcggauucauacgggcgaaaagccuuacaaaugcgagaagugugacaaauccuuuagccagcagcguucacuggugaaccaccaaaagauacacgccgaaguaaaaacccaggagacacaugaaugcgacgcuuguggagaggcauucaacugcagaaucaguuuaauucagcaccagaagcugcauacugccuggaugcaauga

SEQ ID NO: 65101 - RNA, 804 nt, Artificial Sequence
  derived and/or modified sequence opt3 from ZNF197__Homo_sapiens__NP_001020026
augaccagagagaacguggcccacaaugcucugaggcaggaaggccucgucaaggggaaagacgauacauggaaguggggaacuagcuuccaagguuccucuucaaguguuugggagacgagccaucuucacuuucggcagcugcgcuaccaugaaaccuccggcccccaggaggcauugucucgauuacgugaacugugcagaagguggcuacggccugaggcccgcacaaaagcgcagauccucgagcugcuugugcuggaacaauucuugucgauucucccaggggagauaagaacuuggguacagcugcaccauccgggaucaggcgaagaggcuguggcccuggucgaggaacuccagaaggacuuagauggucccgcaauccaggugccuguucuggugaaagaccaagauacccuucagaaggucgugagcgccccagggacaaccuugcccccuguacugccaggaagucacauugcugcagagaucuguccccacccuccaacugaccuaguugccuuuaaccuccaggauccgcagcaugacucccccgcuccugaagccucugcgcugagccaagaggaaaauccaaggaaccagcuuauggcacugauguugcucacagcccagccccaagagcuggugauguucgaggaagucuccgugugcuuuaccucagaggaaugggcuuguuuaggcccuauucagcgggcccuguauugggaugugaugcucgagaauuacggcaacgucacgagucuuggguaucgcaaguaccgaagacagaggaauaaauga

SEQ ID NO: 65102 - RNA, 1947 nt, Artificial Sequence
  derived and/or modified sequence opt3 from ZNF202__Homo_sapiens__NP_001288709
auggccaccgcuguggagcccgaagaccaggaucugugggaggaagagggcauccucauggucaaacuugaagacgauuucacaugcagaccugagagcguucugcaaagggacgauccaguguuggagacuucccaccagaacuuucggcgcuuccgauaccaggaagcagccucuccgcgugaggcguuaauuagacugagggaacuaugucaucaguggcuccggcccgagcgcagaacgaaagagcaaauacuggaacuucugguauuggagcaguuucucaccgugcugccuggggaacugcagucaugggucaggggacagcggccagagaguggugaagaggcugugacacucguugagggcuuacaaaagcagccccgccgaccuagaaggugggugacuguccacgugcaugggcaggaaguacugagcgaggaaaccguucaccuuggaguggagccagaaucccccaaugaguugcaggacccuguccaaucuucgacaccagagcagucaccggaagagaccacucagagccccgaucugggcgccccugcagaacaacggccacaucaggaggaggaacuacagacacuccaggagagugaagugcccgugccugaggacccagaucugcccgccgaacguuccucuggugacagcgagauggucgcacuucugaccgcuuugucccaagggcucguuacguucaaagauguggccguaugcuuuucacaggaccaguggagugaucuggacccgacucagaaggaguucuauggagaauacguguuagaggaagacuguggcaucgucgugagccugucuuuuccuauuccccgcccagaugagaucucccaaguuagagaagaggagccuugggugcccgacauucaggaaccacaggagacccaggaacccgagauccucucauucacauauacuggcgauaggagcaaagacgaagaggagugccuugaacaagaggaucugaguuuggaagacauacaccggccuguccuaggggagccagaaauccaccagaccccggauugggagauuguguuugaggacaaccccggacgacugaaugaacgcagauucgguacaaacaucucucagguaaauuccuuuguuaaccucagggagaccacgccugugcauccacugcuuggccggcaccaugauuguagcgucugcgggaagucguucacuuguaauucucaccuggugcgccacuugagaacacauaccggagaaaagcccuacaaaugcauggaguguggcaaguccuauacuaggucaagucaccucgcucgucaucagaaaguccacaagaugaacgccccuuacaaauauccacugaaucggaagaacuuagaggaaacaagccccgugacccaagcggagcgaacgccguccguugaaaagccuuacagaugcgacgauugugguaaacauuuuagguggaccucugaccuggugcgccaccagcggacacacacuggggagaagccauucuucugcaccauuugcggaaagagcuuuucacagaagaguguacuaacaacucaucaaagaauccaccucggcggcaaacccuaccuguguggggaaugcggagaggacuucuccgagcauaggcgcuaucuugcacaccgaaagacccacgccgcugaagaguuguaccuguguagcgaaugcggucgguguuuuacacauucugccgcauucgcuaaacaccuccguggccaugccucagucagaccuuguaggugcaaugagugcgggaagaguuuuagccgccgggaucaccuggugagacaucagaggacccacacuggagaaaagcccuucacguguccaacaugcggcaaauccuuuucucgagguuaucaccuuauacgccaucagcggacccacucggagaagacuagcuga

SEQ ID NO: 65103 - RNA, 1665 nt, Artificial Sequence
  derived and/or modified sequence opt3 from ZNF205__Homo_sapiens__XP_005255615
augagcgccgacggcgggggaauccaggauacccaagacaaggagacacccccugaagugccagauagaggucacccgcaucaggagaugcccuccaaacugggcgaagcugucccuucuggggacacucaggagucacuccacauuaagauggaaccagaggagccccauagugaaggagcaagccaggaggauggcgcccaaggugcgugggggugggcuccucuuucccacggaucuaaagaaaaggcccuguucuugccaggcggcgcauuacccucgccuaggauaccaguucugucacgggaggggcgcacgcgagaccgucagauggccgcugcacuacucaccgccuggagccagaugccggugacauuugaggauguagcucuguaccuuaguagagaagaguggggaaggcuggaccauacucagcaaaacuucuaucgggauguguugcagaaaaagaauggucucucccugggcuuucccuucucucgcccuuuuugggccccacaggcgcacgggaagggagaagcaagcggcuccucaagacaggccggugacgagaaagaauggcgcggggcuugcaccggagccgucgaggugggccaacggguucagacaaguagcguggcagcucugggcaacgucaagcccuuccgcacccgagccgggagagugcaguggggaguaccucaaugugcgcaggaggccgcaugcgguaggucuuccggcccagcuaaagauucagggcagcccgccgaaccggaccggacuccugaugcugcacccccagacccuagccccacagagccacaggaauaccguguucccgagaagccuaaugaagaggagaaaggagcaccagaaaguggcgaggaaggucucgccccggacucugagguggggcgcaaguccuauagaugugaacaaugcggcaagggauuuagcuggcacucgcauuuagucacccacaggcggacgcauacuggcgagaaacccuacgcuuguaccgauugcgggaagcgauucggaaggucuucccaccugauccagcaccagauuauccauacaggugagaaaccuuauacuuguccagcgugcagaaagucauuuagucaccauagcacccuuauucagcaccaaaggauccauacaggcgaaaaacccuacgugugugaccggugcgcaaagcgcuucaccagaagguccgauuuggugacgcaccaggggacucacacaggagccaaaccucauaaguguccaauaugcgcuaagugcuuuacccagucuagcgcccuggucacucaccagcguacacauaccggcguuaaacccuauccguguccugagugcgguaaguguuucucacaacggaguaaccuaaucgcacacaaucgaacgcacaccggggaaaaaccauaccauugccucgacuguggcaaguccuuuagccacucuucacaucugacagcccaccagagaacucauaggggagugcgccccuacgcuugcccucuuuguggcaaaaguuucagccggagauccaaccugcacaggcacgagaagauucauaccacagggcccaaggccuuggcaaugcucaugcugggagcggcugccgccggugccuuagcuacuccaccucccgccccaaccuga

SEQ ID NO: 65104 - RNA, 1599 nt, Artificial Sequence
  derived and/or modified sequence opt3 from ZNF20__Homo_sapiens__NP_066966
augauguuccaggacagcguggccuuugaggaugucgcuguuuccuucacccaagaagagugggcacugcucgaccccucucagaaaaaccuuuacagagaugugaugcaggaaacauuuaaaaaucugacuucaguaggcaagacguggaaagugcagaacaucgaggacgaauauaagaauccuaggcggaacuugaguuuaaugcgcgagaaacugugcgagagcaaggaaucccaccauuguggggagucuuucaaucaaauugccgaugacaugcuaaaccgaaagacccucccaggaauaacaccgugcgaaucgucagucuguggugaggugggcacugggcacagcagucugaauacccauauccgugcggauacaggacacaaauccucugaguaccaggaauauggcgagaaccccuacagaaauaaggaaugcaaaaaggcuuuuagcuaucuugacuccuuccagucacaugauaaagccuguaccaaggagaagccuuacgacgguaaagaaugcacugagacauuuauuagucacagcuguauccagaggcaccggguuaugcauucuggggauggaccauauaagugcaaauucuguggcaaggcauuuuacuuccugaacuugugccucauucacgagcgcauccauaccggcgugaaacccuacaaguguaaacaaugcgggaaggccuuuacgagauccacuacccugccuguccacgaaaggacacacacuggagugaaugcugacgagugcaaggaaugugguaacgcauucucauuuccaagcgagauacggcgccauaaacgaagucacaccggcgaaaagcccuaugagugcaaacagugugggaagguauucaucucuuucuccagcauucaguaccauaaaaugacacacaccggagagaagccuuaugaaugcaagcaguguggcaaagccuuuagaugcgguucgcaucugcaaaagcacgggaggacgcacacuggagagaaaccauacgaaugucggcagugcggcaaggcuuuccguuguacaucugaucuccagcgccaugagaaaacccacacugaagacaagccguauggcugcaagcaaugugggaaaggauuuagaugcgccucccaguuacagauccaugagaggacacacucaggugagaagccccacgaaugcaaagaguguggcaagguuuucaaauacuuuaguagccugcggauucaugaacgaacccacacgggggagaagccucaugagugcaagcaguguggaaaagcguuccgcuauuuuuccucucuucacauccaugaaagaacccacacaggcgacaagccauacgagugcaaagugugugguaaggcauucacuugcagcucaaguauaagguaccacgaacggacccauacaggggagaaacccuaugaauguaagcacugcggcaaagccuuuauuuccaauuacauccgcuaucaugagagaacucacaccggagagaagccuuaccaauguaagcagugcggcaaggcuuucauuagggccagcucuugucgugaacaugagcggacacacaccaucaaccgauga

SEQ ID NO: 65105 - RNA, 1488 nt, Artificial Sequence
  derived and/or modified sequence opt3 from ZNF212__Homo_sapiens__NP_036388
auggccgagagcgcucccgcaagacacaggcggaagcgccgauccaccccucugacaucuucaacucucccaagucaggccacggaaaagagcuccuacuuccaaaccacagagaucucucuuuggacuguggucgcggcuauucaggccguugaaaagaaaauggagucgcaggcagcccgucugcagucauuggaaggcagaaccgggacagcugagaagaaauuagcagacugcgagaagauggccguggaauuuggaaaccaacuggaggguaagugggcuguacuaggcacccuccugcaggaauaugggcuucugcagaggcgguuggagaauguggagaaccuccugcgcaauagaaacuucuggauacugaggcucccgcccggaagcaaaggcgaagccccuaaggucagucgguccuuagagaaugaugguguguguuuuacugaacaggagugggaaaaccuggaggacuggcaaaaagagcuuuaccgcaauguuauggaaucuaacuaugagacauuggugagccugaagguccuagggcagaccgaaggagaggcggaacucggcacggagaugcugggcgaucuugaggaagaggggccaggaggugcacaucccgccggcggggugaugaucaaacaggaacugcaguacacucaagagggaccugcugacuugccaggcgaguucuccugcauugccgaggagcaggcauuucucucacccgaacagaccgagcuguggggugggcaaggaaguagcguauuacuggaaacaggcccuggcgauucuacucucgaggagccaguugggucccgagugccgucaagcaguagaaccgucggaugucccaagcagaagucucacaggcaagugcagcuugaccaggaaugcggucagggccugaaauugaagaaagauacaucccggccuuaugaguguagcgaaugcgagaucaccuuccguuacaagcagcagcuagcuacgcaucugcgcucgcacucuggguggggauccuguacuccagaagaacccgaggaaucacucagaccuaggccacggcugaaaccccaaacaaagaaagccaaacuucaucagugcgacgugugucugcgaaguuuuagcugcaaggucuccuugguuacccaccagcgcugucaccuccaggagggcccgucugcgggucaacaugugcaggaaagauucagcccuaauucacugguagccuuacccgggcacauuccauggaggaaaagucgguccagccugaucugcggcuauugcggaaagucuuuuucacauccuagugaucuagugcgccaccagagaauacacacuggcgagaggcccuacagcuguacagaaugcgagaaauccuucguccagaagcaacaucuccugcagcaccagaaaauccaucaacgugagcgagggggacuugcauuggaaccaggucggcccaacggccugcucuga

SEQ ID NO: 65106 - RNA, 1821 nt, Artificial Sequence
  derived and/or modified sequence opt3 from ZNF214__Homo_sapiens__XP_006718371
auggccgugaccuucgaggacgucacaaucauuuuuacuugggaagaguggaaguuccuggauagcucccagaaaagacucuacagggaaguuaugugggagaacuauacgaaugugaugucuguagaaaacuggaaugagucauacaagagucaagaggaaaaauuucgguaucuugaguacgaaaacuucagcuauuggcagggcugguggaaugcuggggcacagauguacgagaaccagaauuauggagagaccgugcaagguacagacuccaaggaucugacucagcaggaccgcucucagugccaagaaugguugauauuaucgacccagguccccggcuacgggaacuacgagcugacauuugaaucaaaaagccuacgaaaucucaaguauaagaacuucaugccuuggcagagucuggagaccaaaacuacacaggauuacggacgugaaaucuauauguccggcucucacgguuuucaagggggaagauacaggcuuggcauuagccggaagaaucuguccauggagaaagagcagaaguugaucgugcagcauucauauauuccaguugaagaggcccucccgcaauacgugggcgucaucugucaggaagaccugcugcgcgauaguauggaggaaaaauauugcggguguaacaagugcaagggaauauacuacuggaauagcagauguguguuccacaaaaggaaccagcccggugagaaucucugccaguguucuaucugcaaggcguguuuuucccaacggucagacuuauaucgccauccucgaaaccacauuggcaaaaagcuguacgggugcgaugagguagacggaaacuuccaucagagcaguggcguucacuuucaccagagagugcauaucggugaagucccauauucuuguaaugcuugcgggaaauccuucagccagauuucgucucuucacaaccaucaaagggugcacaccgaggaaaaguuuuacaaaaucgagugcgauaaggacuugucccguaauucacugcuacacauacaucagcggcuccacauuggagaaaagcccuucaaauguaaccagugcggcaagaguuucaaucgcagcuccgugcugcauguccaccagagaguucauacgggcgagaaaccuuauaagugugaugagugcgggaaaggauuuucucaaagcucaaaccuuaggauccaccagcuggugcacacuggugaaaagaguuacaagugugaggacugcggcaaaggguucacccagcgguccaauuugcagauucaucaacgaguacacacaggagaaaagccauauaaaugugacgauugcggcaaggacuuuagccauucuucagaucuccgcauccaccagagagugcacacuggugagaaacccuacaccuguccugagugcgggaagggcuucaguaagagcuccaaacugcauacacaccagaggguccauaccggagaaaagccauacaaaugugaggaaugcggcaagggguuuucucaacggucgcacuuacugauccaucagcgcgugcacacgggagagaaaccguauaagugccacgacugugguaagggcuucagccauuccucaaaccuccacauucaucagagaguucacacuggggaaaaacccuaccagugcgccaaguguggaaaaggcuuuagucauucuagcgcacuuaggauacaccaacgugugcacgccggugagaagccuuauaaaugccgggaguacuauaagggguucgaucauaauucccaucugcacaacaaucaccgaagaggcaacuuguga

SEQ ID NO: 65107 - RNA, 1554 nt, Artificial Sequence
  derived and/or modified sequence opt3 from ZNF215__Homo_sapiens__NP_037382
augcagccccugagcaagcucauggccaucuccaaaccuagaaaccuuucucugagggagcaacgggaaguguugcgcgcugacaugucauggcagcaggagaccaauccagucguugaaacacacgauagugaggcaagccgacagaaguuccgucauuuucaauacuuaaaaguguccggcccgcacgaagcccugucucagcuaugggagcucugccugcaguggcuuagacccgagauucauacuaagaaacagauaaucgaacuguugguacucgagcaauuccuggcgauucugccugaagaggugaggacgugggucaaccuccagcacccaaauaacucgaaggacauggugaccuuaaucgaggauguuauugaaaugcuggaggacgaagauaugcccuguaaggacucagcccuucagauggggagcaucaaagagaagaugaaagcuggaagucggacagguaagccucaggaaccagugacuuuuaaagaugucgugguagaguucuccaaggaggaauggggccaauuggacucugcaguuaagaaucuguaucgcaacgugaugcuagagaauuuuagaaaccucaauagccugaggaaagcccaucuucuguccaagcccuucgaaucauugaaacucgagaguaagaaaaagcgguggauaauggaaaaagagaucccucgcaagaccauuuuugauaugaaaagcaucucuggggaggaauccucacacggagucauuaugacacgacugaccgagagcggccacccaaguucugacgcuuggaaaggugaaaacugguuauacagaaaucagaagaaaugggauaucaaccugccgcaggaggcauucauacccgaaacuauuuauacagaggaggaagacuuugagugcuccgaaaauaagaaaucguucgauaucaacagcgugucuuccauuugugccauccaaguggggaucccuucaaggaagggaaguccaaagugcgacaaauuuaagaccuacuucaaauuuaaucucgacagcgucggcaagcagcauuccgaguaugaguacggcaacgaucuuucucugagcacggacauucggcaccagaaaucacauacuaccaugaacaguuaugaauguuaccagugcgggaaggcuuucugucguuccagcucuuugauacgccaccaaaucauucacacaggagagaagcccuacaaaugcucagaaugugguagauucuuuaauaggcggacuaaccuaaccaagcaucagaaacugcacgccgaggcgaaggcaugcacaaguaauaaauguggcaaggccuucagcaaguccgaagauucuaacaauccuacccuccauuuugggaacaauuucuaucagugcguuaacugcggaaaaucguuuaaucgaagcuccucacugauccgccaccagaugauacauacgggcgagaagccauucaaauguaaggagugcaguaaggcuuuuaacagaucuagcaaucuugugaagcaccaaaaacugcacacuagggacaaguccuga

SEQ ID NO: 65108 - RNA, 3147 nt, Artificial Sequence
  derived and/or modified sequence opt3 from ZNF217__Homo_sapiens__NP_006517
augcagagcaaggugaccggcaacaugcccacacaaucccugcucauguacauggacgggccugaggucaucggaucuucacuugguaguccaauggaaauggaggaugcccugagcaugaaaggcacugcuguugugccguucagagcaacgcaggaaaagaauguaauucagauagagggguauaugcccuuggacugcauguuuuguucccagaccuucacacacucugaagauuuaaacaaacaugugcugaugcaacacaggccuacucuaugcgagccagccguccuccggguggaggcggaauaccugucgccccuugacaagucacagguucgcaccgagccuccaaaagaaaagaauuguaaggagaacgaguuuagcugcgaaguguguggacagacauuccgagucgcuuuugauguggagauccauaugcguacccacaaagacaguuucacuuauggcugcaauaugugugguagaagguuuaaggaacccugguuccugaaaaaccauaugcggacacacaaugggaaguccggagcccgcucuaaauugcagcaaggccucgagagcuccccugcaaccauuaacgaaguaguucaggugcacgccgcugagucaaucaguagcccauacaagauuugcauggucuguggcuuucuguucccgaauaaggagucucugaucgaacauagaaaagugcacacgaagaaaacugcauuugggaccuccucagcccagacagauagcccccagggagguaugccuaguucuagggaggacuuccuccaauuauuuaaccugcggccaaagucccaucccgaaacuggcaaaaagccugugcgcugcauaccacagcuugaucccuucaccacauuccaggcuuggcaauuggccaccaaagggaaggucgcgaucugucaggagguuaaggaaagcggacaggagggcucgacggacaaugaugacucuuccucagagaaagaacugggugagacuaacaaggggaguugcgcaggacuaagccaggaaaaagagaagugcaaacacucccacggcgaagccccgucuguggaugcugacccuaagcuccccagcucaaaggagaaaccaacacauuguagugagugcggcaaggccuuucgaaccuaucaccaacugguacuucauuccagagugcacaaaaaggacaggcgggcaggggcugaaagcccuacuaugucugucgauggacgucagcccgguacauguucaccagaccuggccgcgcccuuggaugagaauggcgccguggaccgcggggaaggaggcagugaggaugguagcgaggacgggcucccugaaggcauucaucuggauaaaaacgacgauggaggcaagaucaagcacuuaaccuccucuagagagugcucguacugugggaaauucuuuaggagcaauuauuaccugaacauucaccuccggacgcauaccggagaaaagccauacaaaugcgaguucugugaauaugcagcugcccagaagacaucccuucgauaccaccuggagcgccaucacaaagagaagcagacugacguugcugccgaagugaagaacgaugguaaaaaucaagacaccgaggacgcauugcuaacagccgauucagcucagacuaagaaccugaaaagauuuuucgacggcgcgaaggaugucaccgggaguccgcccgcaaaacagcucaaggaaaugccuucuguguuucagaauguacugggaagcgccguucuuuccccagcucacaaagacacacaagauuuccauaagaacgccgcagacgauucagccgacaaggugaauaaaaaccccaccccugcuuaucuggauuugcucaagaaaaggagcgccgucgagacucaggcaaauaaccugaucugccggacgaaggcggacgugacaccacccccggauggcucuaccacucacaauuuagaagucuccccuaaagagaagcagaccgagacagcugccgacugucgcuacagaccaaguguggauugccaugaaaagccccugaaccuaagcguuggugcacuccacaauuguccugccauaucucuguccaaaucacuuauucccaguauuaccugcccauuuugcacuuucaagacauuuuauccugagguguugaugaugcaucagaggcuggaacacaaauacaaccccgacguacacaagaauugucguaacaaaagccuccugcggucgcgaagaacggggugcccaccggcccuucugggcaaggacgucccucccuuguccucuuucuguaagccaaaacccaagagcgccuuuccugcacaaucaaaaagucucccauccgcuaagggaaaacagucucccccuggcccggggaaggccccacugaccagcggaaucgauuccucaacuuuagcgcccagcaaucugaagagucauaggccucagcaaaacguggguguucagggcgccgcuacacgccagcagcaaucugagauguucccaaaaaccuccgugagccccgcaccugacaagacaaaacggccggaaacuaagcuaaaaccccucccagucgccccuucgcagcccacccuggggucaucuaacaucaauggaaguaucgauuauccagcuaagaacgacuccccuugggcucccccaggcagagauuacuucugcaauaggagcgcaucuaacacggcggccgaguuuggugagccgcuuccuaaacgcuugaagucuuccgugguagcucuggacguggaucagcccggggccaauuaccgacggggcuaugaccucccaaaguaccacaugguucguggaauuaccucacuguuaccccaggauugugucuauccuagucaagcacugccacccaaaccuagauuccuuagcagcuccgaaguggacucaccgaacguguugacaguccagaagccauacggcgggaguggaccccucuauacuugcguuccugcuggcagccccgccuccucuucgacccuggaggguaaaaggccagugagcuaccagcaucuaucaaauuccauggcacagaagcgcaacuaugaaaauuuuauagggaacgcccacuaccggccuaaugauaaaaagacauga

SEQ ID NO: 65109 - RNA, 2124 nt, Artificial Sequence
  derived and/or modified sequence opt3 from ZNF224__Homo_sapiens__XP_005259278
augaccacauucaaggaggccaugacuuuuaaagacguggcugucguuuucacggaagaggaacugggccuccuugaucuggcacagagaaaguuguacagggacgugauguuagagaacuuucggaaucugcuaagcguagggcaccaagccuuccaucgcgauaccuuucacuuccuccgagaagagaaaaucuggaugaugaagacagcgauucagcgugagggaaacuccggugacaaaauacagacugaaauggagaccgugucugaagcuggcacacaucaggaguggucauuucaacagaucugggagaagauugccagugaucugaccagaagccaggaccuuaugaucaauuccucucaguucucgaaggaaggggauuuucccugccaaacugaggcaggacugucagucauucacacaaggcagaaaagcagucagggcaacgguuauaagccuuccuucucugacgugagccauuuugauuuccaccagcaauugcacuccggggaaaaaucacauaccugugacgagugcggaaagaauuuuuguuacaucagugcccuccggauacaccagcgcguucauaugggcgaaaaaugcuauaagugugaugugugcggcaaggaguucagccagucuucccaucugcaaacgcaccagagaguccacacuggggagaaaccauucaaguguguggaaugcggaaaagguuuuucaaggcggagcgcucugaacguacaccauaagcuccacaccggcgagaaaccguacaauugugaagagugcgggaaggcauucauccaugacagucaguuacaggaacaccaacgcauucacacaggagagaaacccuuuaagugugauaucugcggcaagucuuucugcggucgauccagacugaacaggcauagcaugguucacacugccgagaaaccuuuucggugugauaccugcgacaagucguuccgucagcgcucugcucuuaauucccauagaaugauucacacaggggaaaaaccauauaagugugaggaaugcggaaaaggcuuuaucuguaggcgggacuuguacacccaccauauggugcacacgggcgagaagcccuauaacugcaaggaaugugggaaaucauuccgaugggccaguugccugcuaaagcaucagcgcguccacagcggagagaaaccuuuuaagugugaggaaugcgguaaaggcuucuacacuaauucccaguguuacucucaucaaagaagccacucaggggagaagccauauaagugcguggaaugcggaaaaggcuacaagaggcggcucgaccuggauuuucaccagcgcgugcauacaggugagaaacuuuauaacuguaaggagugcgggaaaaguuucuccagagcgcccugucuguugaagcacgaaaggcuccauagcggcgagaagccuuuucagugcgaagaguguggaaaacguuucacccaaaauucucaucugcacucacaccagcggguccacacuggcgaaaagccauacaaaugcgagaagugugggaaaggauauaacaguaaguucaauuuagacaugcaucagaaaguucacacaggugagcgaccguacaacugcaaggaauguggcaagagcuuugggugggcauccugccugcucaaacaucagagacuucacucuggagagaagcccuucaaaugugaagagugcggcaagagguuuacccagaacucgcaacugcacagccaucagcgcgugcacacgggugaaaaaccuuauaagugcgaugagugugggaagggcuucuccuggucaaguacccgguugacacaucagagaaggcacucucgcgagacuccacuaaaaugcgaacaacauggaaagaauauaguacagaacagcuuuuccaaagugcaggagaagguccacucaguggaaaaacccuacaagugugaggacugcggcaagggguacaaucgacggcugaaccucgauaugcaccagcguguucauaugggagagaaaaccuggaaguguagagaaugcgacauguguuucagccaagccucuucccugaggcuucaccagaaugugcaugucggugagaaaccuuga

SEQ ID NO: 65110 - RNA, 675 nt, Artificial Sequence
  derived and/or modified sequence opt3 from ZNF22__Homo_sapiens__NP_008894
augagacuggccaagcccaaagcuggcaucagcagguccucuucacaggggaaggcauacgagaacaaacggaagaccggacgccaacgacagaaaugggguaugacaauucguuucgacaguagcuuuuccagacucaggcggucucuugaugacaagccuuauaagugcacugaaugugagaaaucguucucacagagcaguacgcuguuucagcaccaaaagauacauaccggcaaaaagucccacaaaugcgccgauugugggaagucuuucuuucagagcuccaauuugauccagcaucgcagaauccacacaggagaaaagccauacaaaugcgacgaguguggcgaaucauucaagcagaguagcaacuuaauucaacaucagaggauucacacuggugagaaaccguaucagugcgaugagugugggcggugcuuuucucaguccucacaccugauccaacaucagcgcacccacacaggagaaaagcccuaccaguguagcgagugcggcaaauguuucagucaaucuucccaucuacgacagcacaugaaggugcacaaagaagagaagccuagaaagaccaggggcaaaaauauacgggucaagacucaucucccaagcuggaaagcggggacaggacguaagucgguugcuggucugcgcuga

SEQ ID NO: 65111 - RNA, 1425 nt, Artificial Sequence
  derived and/or modified sequence opt3 from ZNF230__Homo_sapiens__XP_011525595
augaccacauucaaggaggccgugacuuuuaaagacgucgcuguuuucuuuacggaagaggaacugggccuccuugaucccgcacagagaaagcuguaccaagacgugauguuggagaacuucaccaauuuacugagcguagggcaccagccuuuucauccauuccacuuucuaagggaagagaaauucuggaugauggagacagccacucagcgggaaggaaacuccgguggcaagaccaucgcggaggcugggccgcaugaagauugccccugucagcaaauuugggagcagacagccucugaccucacccagucacaggauaguauaaucaauaacagccacuuuuucgagcaaggagacgugccuucccaggucgaagcaggccugucuauuauccauacuggucagaaaccaucgcagaaugggaagugcaagcaaucauuuagcgauguggccauuuucgaucccccucagcaguuucacaguggagagaaaucccacacauguaacgaaugcggcaagucuuucuguuauaucagcgcacuucgcauacaucaacgaguucaccuucgugagaaauuguccaagugcgacaugagaggcaaagaguucucacagaguagcugucuccagaccagggaacgggugcauacgggggagaagccauuuaagugcgaacaguguggaaaagguuuccgcugcagagcuauccugcaaguccacuguaagcugcacacuggcgagaaacccuacauuugcgaaaagugcgggagggccuuuauccaugacuuccagcuccagaaacaccagauuauccauaccggagagaagccuuuuaaaugugaaauaugcggcaagucuuucuguuuacgguccucacugaaucgccacugcauggugcauacagcugagaagcuguauaaaagcgaggaaugugguaagggguuuacugauaguuuggaccugcacaaacaccaaauuauccauaccggacagaagccauacaacugcaaagaguguggcaagucuuuccgaugguccagcuaucuacucauucaccagagaauccauucgggcgaaaagccguacaggugcgaggaaugugggaaaggauauaucucuaaguccggucugaaucuucaccagcggguacacacaggcgagcgucccuacaacugcaaagagugugggaagucauuuagucgcgccagcuccauucugaaucauaaaaaguugcacugcagaaagaaaccuuucaagugcgaagauuguggaaaaaggcucguucaucggucuuuuugcaaggaccaacagggcgaccacaacggugagaauagcucaaaaugugaagauugcgggaagcgauacaagcgcagacugaacuuagacauaauccugagucucuuccuuaaugauauguga

SEQ ID NO: 65112 - RNA, 5538 nt, Artificial Sequence
  derived and/or modified sequence opt3 from ZNF236__Homo_sapiens__NP_031371
augggccugugcgggcuccuugaaagauguuggcugcaccaugaccccgauggaguguugaccuuaaacgcagaaaauacuaacuacgcuuaucaggucccuaauuuccacaagugcgagaucugucugcuuagcuuuccaaaggaaucccaguuccagagacauaugcgggaccacgagcgcaacgauaagccgcaucgaugcgaccaguguccccagacuuuuaauguugaguucaaccucacgcugcacaaaugcacccacucuggugaggauccuacauguccagugugcaauaagaaauuuucacguguugcaagucuuaaggcccauauuaugcugcacgagaaggaagagaacuugauauguagcgaaugcggcgacgaguucacucuccaaucccagcuggcggugcauauggaggaacacagacaggagcuggcugggaccaggcagcacgccuguaaagcaugcaagaaagaauuugagacaucuucggaacucaaggagcauaugaaaacccacuacaagauccgggucucaagcacucgcaguuauaauagaaacauugauagguccggauucacauacucuugcccccauuguggcaagaccuuucagaaaccuagccaguuaacgcggcacauccgcauucauacuggugagcgaccauucaagugcuccgaaugugggaaagccuuuaaucagaagggagcucugcagacccacaugaucaaacacacaggcgagaagccccaugcaugcgccuucuguccugcugccuuuucacagaaaggcaaccuucagagucacgugcagagaguucauagcgaagugaagaaugggccaacuuauaacugcaccgaguguucuugcgucuucaaguccuugggaucacugaauacacacauaagcaaaaugcacauggguggcccgcagaacaguaccucuuccacggaaacugcgcaugugcuaacagcaacccucuuccagacucugccccuucagcagacagaggcccaagcuaccagcgccucgucucagccuuccucacaggcaguaagugacguuauccagcaacuguuggagcucagcgaaccagcucccguggaguccgggcagucuccucagccaggacagcaacugagcauuacggucggcaucaaccaggauauuuuacagcaggcccuggaaaauucaggucucaguuccauccccgcggccgcacacccgaacgacagcugucaugcuaagaccucugccccucacgcucaaaaucccgaugugucaagugugagcaacgagcagacagacccaacugaugccgaacaggagaaagagcaagaauccccugagaaacuugacaaaaaggaaaagaaaaugauaaagaaaaagucucccuuucugccagggucgauuagggaggagaauggaguccgguggcauguuugccccuacugugcaaaagaguuccguaagccuagcgacuuggugcgccacaucaggauucacacccaugagaagccauuuaaaugcccgcagugcuucagggccuuugcuguaaaguccacacuaacugcgcacaucaaaacccauacaggcaucaaggcauucaaaugucaguauugcaugaagucauuuaguaccucuggcagccugaaggugcacauucggcuccauacugggguccgacccuucgccuguccucacugcgauaaaaaguuucgcacguccggacacagaaaaacacauauagcuucacacuucaagcauaccgaacugaggaaaaugcggcaccagcgcaagccagccaaagugagaguugguaagacuaacauccccgugccugacauuccacuucaagagcccauccugauaaccgauuugggccucauucagccgaucccuaagaaucaguuuuuccagagcuacuuuaacaauaacuucgucaaugaagcagacaggccauacaaauguuucuauugccaccgugccuacaagaaaucuugucaucugaagcaacacauccggucccauacaggggagaaacccuuuaagugcagucaguguggacgaggcuucgugagcgcugguguauuaaaggcccacauuagaacccauacugggcugaaaucuuuuaagugccuaaucuguaacggcgcauucacaacgggaggcucccucaggcgccacauggggauucacaaugaucugcggccuuauaugugccccuacugccagaaaaccuuuaagacuucacuuaacuguaaaaagcauaugaagacacacagauaugaguuggcgcagcaacugcagcagcaucaacaggcugccaguauagacgauagcaccguugaccagcagucgaugcaagcauccacacagaugcaaguggaaaucgagucugaugaacucccacagacugccgaggucguggcugccaauccugaagcaaugcuggaccuugagccccaacacgucgugggaaccgaggaagcuggucugggccagcaguuggccgaucagccacucgaggcggacgaagacggguucguugccccgcaagauccucugaggggacacguggaccaguuugaggaacagagccccgcucagcaaucauucgagccagcaggcuuaccccaggguuuuacgguaaccgauacauaccaucagcaaccucaguucccacccguccagcagcugcaagacaguuccacucuagagucucaggcccucagcaccuccuuucaccagcagucacugcuucaagcuccuagcagugaugggaugaacgugacaacucgcuugauucaggaaucuucccaggaggaacuggaccuccaggcccaaggcagccaguuccuggaggauaacgaggaccagucgcgacggucauaucguugcgauuacuguaauaaaggauuuaagaaaucuagucauuuaaagcaacacguuagaucccauaccggcgaaaaaccguacaagugcaagcugugugggaggggauucgugagcucugguguccuuaaaagccacgagaagacgcacacaggcgugaaagcauucuccugcucaguauguaacgcgaguuuuaccacuaaugggagcuugacacgccauauggccacccacaugucuaugaagccauauaaaugccccuucugugaagagggauuucggacuaccgugcauugcaagaaacacaugaagagacaccagacaguuccuuccgcugucucagccacgggcgaaaccgaggguggggacaucuguauggaggaagaggaagaacauagugauaggaacgcaagccgaaagucccgcccagaagugaucacuuucacagaggaggaaaccgcucagcucgccaaaauucggccccaggagucugcaacagugucggaaaagguccugguucaaagcgccgcugagaaagacagaauaucagaacuaagggauaagcaggcggagcugcaggacgagccuaaacacgccaauugcugcacuuacuguccgaaguccuuuaagaaacccagugaccucgugcgucaugugcgcauccacaccggcgaaaagccauauaaaugcgaugaguguggaaagucuuucacgguaaaaagcacacuggacugccaugucaagacccacacuggccagaaacuauuuuccugucacgugugcucaaacgcauucucuaccaaagggagcuugaagguucauaugcggcugcacacaggagcuaaaccuuuuaaguguccccauugcgaauuaagauucaggacaaguggccgacggaaaacccacaugcaauuucauuacaagccagauccuaagaaagcccgcaagcccaugacaagauccagcucugagggucuccagccagugaaucugcuuaacucauccaguacggacccgaaugucuucauuaugaacaauagcgugcugaccgggcaguucgaucagaacuugcuccaaccuggacugguuggccaggccauccuacccgcuucggugucugccgguggcgaccugacuguaucccucacagaugggagccuggccacccuugagggcauucaguugcagcuggcggcuaauuuagucggaccaaacgugcaaaucucagggauagacgccgcaaguaucaauaacauuacucuccagaucgaucccucuauucugcagcaaacacuucagcagggaaaccugcuagcccagcaacucaccggcgaaccuggucuggcuccacaaaauuccagcuugcagacgucagacaguacugugcccgcaagcgucguuauccagccuauauccgggcugucuuuacaaccgaccgugacaagcgccaaccucaccauuggaccacuguccgagcaggauucaguacuuacuacaaauucuaguggcacccaggaccugacacaggugaugacuucgcaagguuuggucagccccuccggcgggccucacgaaaucacccucacgauuaacaauucuucacugagccaggugcuagcgcaggcugccggacccacagcaaccuccaguucuggcagcccacaagagaucacucugaccauaucagaacuuaacacaacuuccgggagucucccuagcaccacgcccaugucuccauccgccaucucaacacagaaucugguuaugagcucgucuggagugggcggugaugcuagugucaccuugacucuggccgacacacaggggauguuauccggaggccucgacaccgugacucugaacauuacaagccagggucaacaguuuccugcacuucugaccgauccgucauuguccggccaagggggagcuggcucuccccagguuauccucgugagccacacgccacaaagugccuccgcggccugugaggagauugcauaucaggucgcugggguaagcggaaaucuggccccuggcaaccagcccgaaaaagaggguagggcucaucagugccuagaaugugaccgggcauucucuucagccgccgugcugaugcaccauaguaaggagguucacgggcgagaaagaauccacggaugcccagugugccgcaaggcuuuuaagagggcgacucaucuuaaggagcacaugcaaacccaucaggcaggcccuucccucagcucucagaaaccccgugucuucaagugugauacaugcgagaaagccuuugcuaagccgucgcaacuggaacggcacucaagaauacauaccggcgagaggccauuccacuguacauugugcgaaaaagccuuuaaucaaaagagcgcauuacaggugcacaugaaaaagcauacuggggagcgcccuuacaagugugccuauugcguaaugggauucacccagaaauccaacaugaagcugcacaugaaacgagcucauaguuacgcgggugcccuccaagaaucugcaggccaccccgagcaggacggggaggaacugagcagaacgcuucaccuggaggaagugguccaggaggcugccggagaguggcaggcauugacacauguauuuuga

SEQ ID NO: 65113 - RNA, 1809 nt, Artificial Sequence
  derived and/or modified sequence opt3 from ZNF239__Homo_sapiens__XP_011538534
augggccacgcccugcucaaggacguggucauggagcuugaagggagcaaccugugcuucuguuuguuuguucccccuuuacugagaggacuaucccuccuguuccagccaucuucaagugaguggaggccggugacccuuaaucggaaacugggucgccaacaucccagcuugccuuccucucucccaucgucauuucccacaggcgauaagcuggggacuagcuacauccagggaugccuguguggccuccaccgaggugggguacguaguccuggauuaugcucccaggaagcugugagaucuugugacgcaggccagcugcaaaaacuuggcuugggggaucugaacgagaauagcgucgaaaaccuacagcagaagacgcuccaggaccugcuucaugagcuguccucaugguuggugcucgagggaauggccaguaccauuacagguagccaagauugcauaguuaaucacaggggcgaaguggacggggagccagaacuggauaucucucccugucagcaguggggagaggcguccucaccuauuagccggaaccgcgacagugucaugacuuuacagucuggcugcuucgagaauaucgaauccgagaccuaucugccacucaaagugagcucgcaaauugauacacaggacucuuccguaaaguuuuguaagaacgaaccgcaggaucaucaagagucaagaaggcuuuucguuauggaagagaguaccgagcggaaagugaucaagggugaaagcugcuccgagaaucugcaggucaaauuggugucugacgggcaggaacuagcuagcccccugcucaacggagaggccacuugucagaauggccaacugaaggaaucacuugauccuauagacugcaacugcaaagacauccacggcuggaagagucagguggucuccuguagccagcagcgcgcacacacagaggagaagccaugcgaucauaauaacugugggaaaauucugaauaccucucccgacggacacccuuacgaaaagauccauacggccgagaaacaauaugaaugcucacagugugguaagaacuuuagucagagcuccgaguugcuccugcaccagcgagaucacacugaagagaaaccauacaagugcgagcaauguggcaaaggguucaccagaucuucgagcuuacugauucaucaggcuguucacacagacgaaaagcccuauaagugcgauaaauguggaaagggcuuuacuagguccucaagucuacucauccaucacgcagugcauaccggugagaaaccguacaagugcgacaaaugugggaagggcuucucucagagcuccaagcugcacauacaccagcggguacauacaggagaaaaaccuuaugagugcgaggaaugcggcaugucauuuagccaacguucuaaccuucacauucaucagcgcgugcacaccggggagagacccuacaaguguggagaaugcgguaaaggcuucucccagaguagcaauuugcacauccauagguguauucacacgggggagaagccauaccaaugcuaugaauguggaaaaggcuuuucucaguccucagaucugcggauccaucuccgaguccacacuggugagaagccuuaccauugcgggaaguguggcaaaggauucagucagagcucgaagcugcuuauccaccagcgcgugcacacaggcgagaaacccuaugaaugcuccaagugugggaaaggauucucucaaagcucaaaccugcauauucaccagagaguucauaagaaggacccaagguga

SEQ ID NO: 65114 - RNA, 1932 nt, Artificial Sequence
  derived and/or modified sequence opt3 from ZNF23__Homo_sapiens__NP_001291421
augcuggagaacuacggcaauguggccagccucggguucccccuucugaagccugcugucaucucccaguuggaaggagguucugaguuaggcgggucaaguccacuggcagccggaaccggccuacaaggucuccagacagacauucagacugauaacgaccugacgaaagaaauguaugaggggaaggaaaauguuagcuuugagcuucagagagauuucucccaagagaccgacuuuucugaagcgucgcuguuggagaaacagcaggaagugcacucagcuggaaacauaaagaaagagaaaagcaauacaaucgauggcacuguaaaggacgagaccaguccgguggaagagugcuucuuuucccagucuagcaacuccuaccaaugucauacaauuaccggcgaacagcccucagggugcacuggacucgguaaaaguaucagcuucgauacaaagcuggucaaacacgagauuaucaauucugaagagaggccuuuuaagugugaggaacugguggagccauuccggugcgacucccagcucauacagcaucaagaaaacaauaccgaggaaaaacccuaucaguguucagagugcggcaaggccuuuagcaucaacgagaaguuaauuuggcaccagcgccugcauaguggggaaaaaccuuucaaguguguugagugcggaaaaucuuuuuccuacagcucgcacuauaucacgcaccaaacuauucauucuggcgaaaagccauaccaguguaaaaugugcgguaaggcauucuccgugaaugggucacuuagucgacaccagcguauccauaccggagagaaacccuaucaguguaaggaaugcggcaacggcuuuagcugcuccucugccuacauaacacaccaaagaguccacacuggggagaagccuuacgaguguaaugauugcggaaaggcuuucaacgugaaugcaaaguugauucagcaucagaggauccacaccggugaaaaaccauaugaguguaacgaaugcggcaagggguuccgguguagcucacagcugcgccaacaucagaguauucacacaggagagaaaccguaccagugcaaggaguguggcaaggguuuuaacaauaacaccaaacuaauccagcaucaaagaauccacacgggggaaaagcccuaugagugcacugaauguggcaaagccuucuccguaaagggaaaacucauucagcaccagaggauacauacaggcgagaagccuuacgaaugcaaugagugugggaaggcuuuucggugcaacagccaguuccgccaacaucugcgaauccacaccggagagaaaccauaugaaugcaaugagugugguaaggccuuuucuguuaacggcaaacuuaugagacaccagaggauucacacuggggaaaagcccuucgagugcaaugaauguggacggugcuuuacaucaaaacguaaccuguuggaccaucaccgcauccauaccggcgagaagccuuaccaguguaaggagugcgguaaagcguucaguauaaaugcaaagcucacgagacaccaaaggauucauaccggggaaaaaccauuuaaguguauggagugcgaaaaagccuucagcuguuccucuaacuauaucgugcaccagcggauccacacaggcgagaagcccuuucagugcaaagaauguggaaaggcuuuccaugucaaugcccaccugauucgacaucagcgcucgcacacuggcgagaagccguuuagaugcguggagugcgggaaaggauucagcuucuccucagauuacaucauucaucaaaccgugcacacauggaagaaaccuuacauguguagugucugcgguaaggcauuuagguucucuuuucaguuaagccagcaccaguccguucauucagaaggcaaaagcuga

SEQ ID NO: 65115 - RNA, 1740 nt, Artificial Sequence
  derived and/or modified sequence opt3 from ZNF248__Homo_sapiens__XP_011517899
augaacaagagccaggagcaaguguccuucaaagacgucugcguugauuuuacccaggaagagugguaccugcucgaccccgcccagaagauccuuuauagagaugugauucuggaaaauuacucuaacuugguaucagugggcuauuguauaacaaaaccugaggucaucuucaagauugaacagggggaggagccauggaucuuagaaaaaggauuuccgagucaaugccaccccgagaggaaguggaagguggacgauguucuggaaagcucccaggagaaugaggacgaucauuucugggaacuacucuuucacaacaauaaaacugugucugucgagaacggugaccggggcucgaagacguucaaucuggggaccgauccugugucacuucgcaacuacccauauaaaauuugugacagcugcgaaaugaaucugaagaacaucaguggauugauaaucuccaaaaagaauuguucucgaaagaaacccgaugaguuuaacguaugcgaaaagcuccugcuggacauucgucaugagaaaaucccuauuggcgaaaagagcuacaaauaugaucagaagagaaaugcuaucaacuaccaccaggaccucucccaaccaucauucggucagaguuuugaguacagcaaaaaugggcagggauuccaugacgaggcagccuuuuucacaaacaagaggucucagauaggcgaaacuguuuguaaguauaacgagugcggccggaccuuuauugaauccuuaaaacugaauaucucacaacgcccccaccuugagauggagccuuacggguguagcauuugcggaaagaguuucuguaugaacuugagauucggucaccagagggcgcugacaaaagauaauccauaugaauacaacgaguauggcgaaaucuuuugcgacaauucugcuuucaucauucaucagggggccuacacccggaagauacuacgcgaguauaaaguguccgauaagacuugggaaaagagcgcacuccugaaacaccaaaucguccauaugggaggcaagucguacgacuacaacgagaaugguucuaacuuuuccaaaaagucacaccuuacacagcugagacgagcccacaccggggagaaaacguucgaaugcggagaguguggcaagacuuuuugggaaaagaguaauuugacccagcaucagaggacacacacuggcgagaaaccguaugagugcaccgaaugugggaaggcuuucugccaaaaaccccaucucacaaaccaccagcggacccauacgggagagaagccuuacgaauguaaacagugcgguaagacuuuuugugucaagagcaaucugacagagcaccagcguacccacacuggcgaaaaaccauaugagugcaacgcaugugggaaguccuucugccaucgcucugccuuaacagugcaccaaagaacccauacgggagagaaacccuuuauuuguaaugaaugcggcaagagcuucugcgugaaaucaaaccugaucguucaccagaggacccacacaggugagaagccuuacaaauguaaugaaugcgggaagacuuuuugugagaagagugcucucaccaaacaucagcggacacacacuggcgaaaagccauaugagugcaacgccuguggaaaaaccuucucccagcgaagcgugcuuacaaagcaucaacgcauacacaccagaguaaaagcgcugucuacuucauga

SEQ ID NO: 65116 - RNA, 1107 nt, Artificial Sequence
  derived and/or modified sequence opt3 from ZNF24__Homo_sapiens__NP_008896
augagcgcccaguccguggaggaagacucuauccugauuauacccaccccugaugaggaagagaagauccucagagucaaacuugaagaggacccagauggcgaggaagggucaaguauuccguggaaccaucugcccgacccugagaucuucaggcaacgguuucgccaguucggauaccaggauagcccagguccccgagaagcuguuucccaguugcgugaguuaugcagacuguggcuaaggccugagacacacacuaaggaacaaauucucgagcuggugguacuugaacaguuuguggcaauccugccaaaagaguugcagacguggguccgggaccaccaucccgaaaauggcgaggaggccgugaccguucucgaagaucuggagucugaacuggacgauccugggcagccagugucgcuccgcagaaggaagcgggaggucuuaguggaagacaugguaucacaagaggaggcgcagggacugccgagcagugaacuugaugcuguugagaaccaguugaaaugggccuccugggaacugcacucucuacgccauugugacgaugacggccgaacagagaauggugcacucgcccccaagcaggaacugccuagcgcucuugagucccacgaggugccagggacucugaacaugggagucccccaaauauucaaguauggcgaaaccugcuuuccuaaaggcagauucgagaggaagcggaauccaucacguaaaaagcagcacaucugugacgaaugcgggaaacauuuuagucagggaagcgcauugauucuccaccaacgcauccauucuggugagaagcccuacggcuguguggagugcgggaaggccuucuccagaucaagcauucuggugcagcaccagaggguccacacaggagaaaaaccguauaaguguuuagagugcggcaaggcuuuuagucagaacucuggucugaucaaucaucaacggauacacaccggggaaaagccuuacgaguguguucagugcggaaaauccuauagccagucgucuaaccucuuccgacaucagcgcagacacaaugccgaaaaacuucugaacgugguaaaaguguga

SEQ ID NO: 65117 - RNA, 1500 nt, Artificial Sequence
  derived and/or modified sequence opt3 from ZNF253__Homo_sapiens__NP_066385
augggcccccugcaguucagagacguggccaucgaguuuagccucgaagaguggcacugccuugauaccgcucaaaggaaccuguaccgggacgucauguuggaaaauuaucgcaacuuaguuuuccuggggauugugguauccaagccugaucuagugacaugucucgagcaggguaaaaagccacugacuauggaacgacaugagaugauagcaaaaccgcccgucaugucuucacacuuugcccaggaccuuuggccugagaauauccagaacaguuuccaaauuggaaugcugcguagauacgaagagugcaggcaugauaauuugcagcucaagaaaggcuguaagagcgugggggaacacaagguucauaaaggaggcuauaacggucugaaucagugccugacgaccacacagaaggagaucuuucaaugugacaaauacgggaagguguuccacaaauuuuccaacucuaauacuuauaagacccggcacacaggaauuaaccucuucaagugcaucauauguggcaaagcguuuaagcgcucgucaaccuuaacuacacauaaaaagauccacaccggcgagaaaccauacagaugcgaagagugugggaaggcuuucaaucagagcgccaaccugacgacucauaaaaggauucacaccggagaaaagcccuaucggugcgaggaaugugguaaggcauuuaaacagaguuccaaucuuacaacucacaagaaaauccauaccggcgagaagccuuacaaaugcgaggaaugcgggaaggccuucaaccgcucuacagauuugaccacgcacaagauuguccauacuggagagaaaccauacaagugugaagagugcggcaaggcuuuuaaacaccccagccaugugacaacccacaaaaagauccacacucgagguaagccuuauaauugugaagagugcgggaaauccuucaagcauuguucaaaccugacaauacacaaaaggauucauaccggagagaagccauacaaaugcgaagaguguggcaaggcauuccaccuaaguagccaccucacgacccauaagauccugcacacaggcgaaaaaccguauagaugccgggagugugggaaggccuuuaaccauucuacuacccuuuucucccacgagaaaauucauacaggagaaaagcccuacaaaugcgacgagugugguaagacuuuuaccuggccuucaauccugagcaaacacaagcguacacacaccggcgaaaagccauauaaaugcgaggaaugcgggaagaguuucacugcuucuuccacguugacaacccauaaacgcauccacacuggagagaagcccuacaaaugugaggaaugcggcaaggccuuuaauuggagcucggaucucaacaagcauaaaaagauucacauagagagaaaaccuuauaucguaaagaauguuaccgaccuguuaaacgugccaccccugcucauuucuaucagguga

SEQ ID NO: 65118 - RNA, 1239 nt, Artificial Sequence
  derived and/or modified sequence opt3 from ZNF260__Homo_sapiens__NP_001012774
augauuggcaugcuggagagccuccagcacgaauccgaccuucugcaacaugaucagauucacaccggggagaagcccuacgaaugcaacgaguguagaaaaacauucucuuugaagcagaauuuaguggaacauaaaaagaugcacacuggagagaaaucacaugagugcacggaaugugguaaggucugcaguaggguuagcucccugacccuacaccuccggucucacacaggcaagaaagccuauaaguguaacaaaugcgggaaggcuuuuucgcagaaagagaauuuccugucacaucaaaagcaccauacuggagaaaagccuuacgagugugagaaagugagcauacagaugccaaccaucauucgccaccagaagaaccacacaggcaccaaaccguaugcaugcaaggaaugugguaaagccuuuaaugggaaggcguaccuuacugagcaugagaaaauccacacaggagaaaagcccuucgaaugcaaccaguguggccgagcuuuuagucaaaagcaguaucugauuaaacaucagaauauccacaccggcaagaaaccuuucaagugcuccgagugcgggaaagccuuuucucagaaggagaacuugauaauccaucaacguauucacacgggagaaaagccauacgaguguaaagguugcggcaaggcauucauccagaaaagcucccucauuagacaccagaggucacauacuggggaaaagcccuauaccuguaaagagugcggaaaggccuuuaguggcaagagcaaucugacagaacacgagaaaauccauauaggugagaagccuuacaaauguaacgaaugcgggacuauuuuccggcaaaagcaguaccugaucaaacaccacaauauucauaccggagagaagccauaugaauguaacaagugcggcaaggcuuuuucucgcaucacaucccucaucguacacgugaggauucauaccggcgacaaacccuacgaguguaaagucugcgggaaggcauucugucagucaagcaguuuaacggugcacaugagaucucauacuggagaaaaaccuuaugguugcaaugagugcggcaaggccuuuucccaguucagcacacuggcccuucacaugcggauacacaccggggagaaaccauaccaauguucggaaugcggaaaggcuuucucucagaagucccaucacauccgccaucagcgaauccacacucauuga

SEQ ID NO: 65119 - RNA, 2052 nt, Artificial Sequence
  derived and/or modified sequence opt3 from ZNF263__Homo_sapiens__NP_005732
auggccagcggccccgggucccaggagagagaaggacugcucaucgugaaacuugaggaagacugcgcuuggucucaagagcugccuccaccggaucccgguccuucaccagaagcaagucacuugagguuccggcgcuuucgauuccaggaggccgcgggcccccgugaggcuuuaagcagacugcaggaacuaugucauggguggcucaggccugagaugcggaccaaggaacagauucuggagcuucuggucuuggagcaauuucucacaauacugccacaggaaauccagucccgcguucaggagcugcaccccgaaucuggagaggaagccgugacucucguagaggacaugcaaagagaguuaggcaggcugcggcaacaggugacgaaccauggucgcgggaccgaaguccuuuuggaggaaccucugccacuagagacagcacgagaaucgccgucauucaagcucgagcccauggagacugaaagaagcccuggaccaaggcugcaggagcuucugggccccaguccucagcgggauccacaggccgugaaagaacgugcuuuguccgcacccuggcucucucuguuuccgccugagggcaauauggaagacaaggagaugaccgggccccaguuaccagagagccuggaagauguugccauguacauuucccaagaggaauggggacaccaggacccuucaaaacgcgcucucaguagagauacagugcaggagagcuaugagaacgucgacucucuugaaucccauauccccucacaggaggugccagguacccaaguaggccaagggggaaagcugugggaucccagcguucagaguugcaaggaaggcuugucuccuagggguccagccccgggggaggaaaaauucgagaaucuagagggagugcccuccgucuguagcgaaaacauucacccucaggugcugcucccagaccaggcgcggggcgaggugcccuggucgccugaacugggccgaccacacgaucgcucucagggggacugggcacccccgccugagggagguauggaacaggcccuugcuggcgccuccucagggagagagcugggaaggccaaaggaguugcagcccaaaaagcuccaucugugcccuuuauguggcaaaaauuuuaguaacaauagcaaccugauccggcaccaacgcauacaugcagcugaaagacuaugcaugggugucgauuguacugagaucuucgggggcaaucccagguuucucucccugcaccgugcccaccuuggagaagaggcgcauaagugcuuggaauguggcaagugcuucucucagaacacacaccugacccggcaucagcgaacgcacacuggggagaaaccauaccaguguaauauuugcggaaagugcuuuagcuguaacucaaaucuccauagacaccaaaggacccacacaggugagaaaccuuauaagugccccgaauguggcgagaucuucgcccauaguuccaaccugcuucgccaccagcggauucauacuggggaaagaccauacaaaugcccggaguguggaaagagcuuuucuaggucaagucaccugguuauccacgagcgcacccaugaacgagagcgguuguauccuuucagcgaaugcggcgaggcaguguccgacucuacacccuuccucaccaaucacggugcucauaaagccgaaaagaagcuguuugaguguuuaacgugcgggaaaucguuccgucagggcaugcaccugacuagacaucaaaggacacacaccggagagaagccauacaaauguacucuaugcggcgaaaacuuuagccaccgcuccaaccucauacggcaucagaggauucacacaggggagaagcccuauaccugucaugaaugcggagacucauucagucacucuagcaauagaauccgacaucugcgcacgcacaccggugagcggccuuacaaaugcuccgaauguggcgagucauuuagcagaucuuccaggcuuaugagucaccagcguacacauacuggguga

SEQ ID NO: 65120 - RNA, 1884 nt, Artificial Sequence
  derived and/or modified sequence opt3 from ZNF264__Homo_sapiens__NP_003408
auggccgcugcagugcugaccgacagagcccaggucagcguuacauucgaugacguggcgguaacuuuuacgaaggaggaauggggccaacucgaucuugcucagaggacccuguaccaggaggugauguuggaaaacugcggguuacuggucucccuaggaugucccgugccuaaagccgagcucaucugccaccuggaacauggucaggagccauggacacggaaggaggaccuuucucaagauacuuguccgggcgacaaagggaagcccaaaaccacagaaccuaccacuugcgagccagcacugucagaaggaauuaguuugcagggccagguuacacaggguaauagcguggauucccaacucgggcaggccgaggaccaggauggacugucugagaugcaggaaggccacuuccgccccggcauagacccucaagagaagucgccagggaagaugucacccgaaugugauggacuggguaccgcugacggcgucugcagccgaaucgggcaggaacaggugaguccuggagaucguguaagaucccauaacucuugugagagcggcaaagacccaaugauucaagaggaggaaaauaacuuuaagugcuccgagugugguaaaguuuucaauaagaaacaccucuuagcagggcaugaaaagauccacucaggagugaagccguaugagugcacggaauguggcaaaacuuuuauuaagaguacccaucugcuucagcaccacaugauccauacaggcgagaggcccuacgagugcauggaaugcgggaaagccuucaacagaaagagcuauuugacucagcaccagcgcauacacucuggagagaaaccuuacaaguguaaugaaugcgguaaggcuuuuacccauagauccaacuucguccugcacaauaggcggcauacaggcgagaaaucauuuguguguaccgaaugcgggcaaguguuccgccaccgaccaggauuucuaagacauuaugucguucacagcggcgagaaccccuacgagugucucgaaugcgguaagguguucaaacacaggaguuaucugauguggcaucagcagacgcacacuggggagaagccuuacgaauguucugagugcggcaaaguauuucuugaguccgccgcgcugauccaucacuacgugauucacacaggagaaaagccauucgaguguuuggaaugcggcaaagcauucaaucaucggagcuaucucaagcgucaccagcgcauccauaccggggagaagcccuuugucuguucggaaugcggaaaagccuucacucacugcucuacauuuauucugcauaagagagcucacaccggugagaaaccguucgaguguaaggaaugcggcaaagccuuuuccaacaggaaggacuuaauccggcacuucucaauacauacgggggagaagccuuacgaauguguggagugcggaaaagcauuuacccgaaugaguggccugacacgccacaagcggauucauagcggugaaaaacccuaugaguguguugagugcgggaaguccuucuguuggucuacuaaucucaucaggcacgcuauuauccauaccggcgaaaaaccauacaagugcagcgaguguggaaaggccuuuucacggaguuccagccuuacacaacaccagcgcaugcacacuggcaaaaacccuaucucugugaccgaugucgggagacccuucacaucaggacagaccagugugacucugagggaauugcuacuggguaaggacuuucucaauguaacgacagaggcgaacauucugccagaagagaccagcuccucugccucggaucagcccuaucaacgugagacuccucagguuagcucccuuuga

SEQ ID NO: 65121 - RNA, 1650 nt, Artificial Sequence
  derived and/or modified sequence opt3 from ZNF266__Homo_sapiens__NP_006622
augcuggagaacuacaagaaucucgccaccgugggcuaucagcuuuucaaacccagccugaucuccugguuggaacaagaggaaucuagaacaguccagagaggggacuuucaggcuucagaguggaagguucaguuaaaaacuaaggaacuggcacuacaacaggaugugcucggagagccuacgaguagcgguauucagaugauaggcucccacaacgggggagagguaucugacgugaaacagugcggcgaugucucgucagaacauagcugucugaagacccacgugcggacacaaaauagugagaacacuuucgaaugcuaccuuuaugguguugacuuucugaccuugcauaagaaaacauccaccggggagcagcgcucuguguucagccaguguggaaaggccuuuucccucaauccagaugucgugugccagcgaacuuguacaggcgagaaagcguucgacugcucagauaguggcaagagcuuuaucaaccacucucaucugcaagggcaucugcguacccacaauggagaaucccuccacgaguggaaagaaugugguagaggcuucauucacucaacggacuuagcuguaaggauccagacucaucggagcgagaagccguacaagugcaaagaaugugggaagggauuucgcuauagugccuaccugaacauucacaugggcacccacacaggugauaaucccuaugagugcaaagagugugggaaggcauucacuagaucuugccagcuuacccaacauaggaaaacacacaccggagaaaagccuuacaaaugcaaggacuguggccgggccuuuacgguuuccagcugcuugucgcagcauaugaagauccacgugggcgagaaaccauacgaauguaaggagugcgggauagcuuucacucgaucuucccagcugacagaacaucuaaaaacccacacugcaaaggaucccuuugaguguaaaaucugcggaaagucauuccgcaacaguagcugucucuccgaccacuucaggauucauacagguaucaagccuuauaaaugcaaggauuguggcaaagccuuuacccaaaauucugaccugacgaagcacgcuaggacccauagcggggagcggccauacgaaugcaaagaguguggaaaggccuucgcgcguucaagucgccuuuccgaacacacaagaacucacaccggcgagaagcccuuugaaugcgucaaaugcgguaaggcauucgccauuagcucuaaccugucagggcauuugaggauccacacaggcgagaaaccuuuugagugucucgaaugcggaaaggcuuucacucauaguagcucccugaauaaccacaugcggacccauucugccaaaaagccauuuacauguauggagugcggcaaggcauucaaauuuccgaccugugugaauuuacacaugcgaauacacacuggggaaaagcccuauaaaugcaagcaguguggaaaaucguucagcuacuccaacucauuucagcugcaugagcgcacgcacacaggugagaagccuuaugaaugcaaagaguguggcaaggcuuucaguucuagcuccucauuuagaaaccaugaaaggcggcacgccgacgagcgccucagcgcguga

SEQ ID NO: 65122 - RNA, 2136 nt, Artificial Sequence
  derived and/or modified sequence opt3 from ZNF267__Homo_sapiens__NP_001252517
augcuggagaacuacagaaaucucgugagccuuggccuggucguuuccaagcccgacuugaucaccuucuuagaacagaggaaagagccuuggaacgugaagucugaagagacaguagccauucaaccagauguguuuucacacuauaauaaagaccugcuaacugaacauugcacggaggcuaguuuccagaaggucauaagccggcgccacggguccugugaucucgagaaccugcaucuucgaaaacguuggaagagagaagagugcgaaggacacaaugguuguuacgacgagaagaccuuuaaauaugaucaguucgacgagucuucgguggaaucacuguuucaucagcaaaucuugagcaguugcgcaaaguccuacaacuucgaucaguauaggaaaguuuuuacacacucuagccuccugaaucagcaggaggaaauugacaucuggggcaagcaccauauuuacgauaaaacuuccgugcuguuccggcaagucucaacccucaacaguuaucgcaauguguuuaucggggagaagaacuaccacuguaauaacagcgaaaagacauuaaaucagucuuccucaccgaaaaaccaucaggagaauuacuuccuggagaagcaguauaaaugcaaggaauuugaggaaguauuccuucaaagcaugcacggacaggagaaacaggaacaaaguuacaaguguaacaaaugcguugagguguguacccagucuuugaagcacauacagcaucagacuauccacauuagagagaacuccuauagcuacaauaaguaugacaaagaucugucgcaaucuuccaaccuaaggaagcagaucauucauaaugaagagaaacccuacaagugcgaaaaauguggcgacucacucaaccacagucugcaucuuacacagcaccagaucauaccuaccgaggaaaagccauauaaguggaaagagugcgguaaggucuuuaaucugaacugcagcuuguaccucacgaaacaacagcagauugauacuggggagaaucuguacaaguguaaagccugcuccaagucuuucacccggagcucaaacuuaaucgugcaccagcgcauucauacaggagaaaagcccuauaaauguaaggagugcggcaaagcguuccgauguaguuccuaccugacuaagcacaaaagaauccauaccggcgaaaagccuuauaagugcaaagagugugggaaggcuuuuaauaggagcucuugccucacacaacaccagaccacgcacacuggagagaaacuuuacaaguguaaagugugcucaaagaguuaugcccggagcuccaaccugaucaugcaucagcguguccacacaggugaaaaaccauacaaguguaaggagugcggcaaaguuuucucucgcucgagcugcuugacccagcauagaaagauucacacuggggaaaaucuauauaaauguaaggugugcgcaaaacccuuuacauguuucuccaaccugauaguacaugagaggauccacaccggagaaaagccuuacaagugcaaagaguguggcaaggccuuuccauacucaagucaccucauucggcaucaccgaauccauacgggugagaaaccguauaagugcaaagcauguucuaagagcuucuccgacucaagcgggcugaccgugcaccgcagaacacauacuggagaaaagcccuauaccugcaaagaguguggcaaggcuuuuucuuacuccagugacgucauacaacacaggcggauucacacaggccagcgcccuuacaaaugcgaagagugugggaaggccuucaauuauagaagcuaccuuacuacccaucagaggucucacacaggagaacguccauauaaaugcgaggagugcgguaaggcuuuuaacucccggucauaccugaccacucaucgaagaaggcacacgggcgaacgccccuacaagugugaugagugcgggaaagccuucaguuaucggagcuacuugacaacccacagaaggucgcauuccggagaacgcccuuauaagugugaggaaugcggcaaagcguuuaauucucgaagcuaccucaucgcacaccaacggucacauacucgugagaagcuguga

SEQ ID NO: 65123 - RNA, 2844 nt, Artificial Sequence
  derived and/or modified sequence opt3 from ZNF268__Homo_sapiens__NP_001159353
auggccaccagagugaggacagcuagcaucuggguucccccucugcaggagcggaacuccucuugggaccgcauucgaaagcuccaaggccaggaaucaauacuugggcagggaacuccaggucugcagccguugcccggcacgccucgucaaaaacagaagaguagaaggaucgagaaagucuuagaauggcuguucauuagccaggagcagccaaagaucaccaaauccugggggccccuaucuuuuauggauguguucguagacuuuacaugggaagaguggcaacuccuggauccugcacagaagugccuuuaccggucggugaugcuggagaauuauucaaacuuggucagccucggauaccagcacacuaagccagacauuaucuucaaacuggaacagggcgaggaacuguguauggugcaagcccagguucccaaucagaccugcccuaacacaguguggaagauagaugaccucauggauuggcaucaagagaauaaagacaaguuagguaguaccgcgaaauccuuugaguguacuacauucgggaagcugugccuuuugucuaccaaguaucugagccgccagaaaccacacaaguguggaacgcauggcaaaucccuaaaguacaucgauuuuacuucagacuaugcuagaaacaauccgaacggcuuccagguccacgggaaaucauuuuuccauagcaagcacgaacagaccgugauuggaaucaaauacugcgagucuauugaauccgguaagacaguaaauaagaaaucacaacucaugugucagcagauguauaugggcgagaagcccuuugggugcagcuguugcgaaaaagccuucaguucuaaguccuaccugcuuguucaccagcaaacucaugcagaggagaaaccuuacggauguaacgaaugcggcaaggauuuuagcucgaagucuuaucugaucgugcaccagaggauacauaccggugagaaauugcacgaaugcuccgagugucggaagacauucucauuccacagucagcucgucauucaucagcgcauccacaccggggaaaauccauacgagugcugugagugcggaaaaguguuuagccgaaaggaccaacuggugucccaucagaaaacgcacucuggccagaagcccuaugucuguaacgaaugcggcaaggccuucggguuaaaaagccagcugauuauccaugagagaauccacacuggagaaaagccuuacgaguguaaugaaugccaaaaggcuuuuaacacaaaaucaaaucucaugguucaccagaggacccauacuggugagaaaccauauguguguagugauugcggcaaggcauucacauuuaagucccagcuuauuguacaccaagggauacauaccggagugaaacccuacggcuguauccagugcgguaagggguucagccugaaaucucaguugauuguccaccagcggucacacacgggcaugaagccguaugugugcaacgaguguggaaaagccuuucguaguaagagcuaccuaaucauacauacccgcacacacacuggcgaaaaacugcaugagugcaacaauugugggaaggcuuucuccuuuaagucucaacucauuauccaccagagaauccauaccggagaaaacccuuacgagugccacgagugugguaaagccuucucgaggaaguaucagcugauuagccaccagcggacacaugcgggcgaaaaacccuacgagugcacugacugugggaaggcauuuggacuuaaaucccaacugaucauucaccagcgaacccauacaggcgaaaagccauucgagugcucagaaugucagaaggccuuuaauaccaaaaguaacuugauaguucaccagcgcacucauacgggugagaagccuuauucuugcaaugagugugggaaggcuuucacauucaaaagccaacucaucgugcacaaaggcguccacaccggagugaagcccuacggcugcucccagugcgccaagacuuuuucacugaaaagccaguuaauuguacaucaaagaucucacaccgggguuaagccauauggauguuccgaaugcgguaaagcauucaggaguaagagcuaccugaucauccauaugcggacacacaccggcgagaaaccccacgaaugucgcgagugcgggaagucuuuuuccuucaacucacagcuaauugugcaucagagaauacacacuggagaaaauccuuaugaguguagugagugcggcaaggcuuuuaacaggaaagaccagcucaucagccaucaacguacacacgccggugaaaagccauacggguguucggagugcggcaaagcguucuccucuaagagcuaccugauuauccauaugcggacgcacucaggagaaaaaccguaugaguguaaugaaugcggcaaggccuuuauuuggaaaagucuuuugaucguccacgagcgaacccaugcaggggugaaccccuacaaguguucccagugcgagaagucuuucagcggaaaacugagacuccugguccaccagaggaugcauacucgcgaaaagccuuaugagugcuccgaauguggcaaggcuuuuauacggaauagucagcuuaucgugcaccaaagaacacacagcggugagaaaccauacgggugcaacgaguguggaaaaaccuucagucagaagucuauucuguccgcccaucagaggacacacacuggcgaaaagcccugcaaauguaccgagugcgguaaggcuuuuuguuggaaaagccaguugaucaugcaucaacgcacgcacguugaugacaagcauuga

SEQ ID NO: 65124 - RNA, 1710 nt, Artificial Sequence
  derived and/or modified sequence opt3 from ZNF273__Homo_sapiens__NP_066971
augagcuccgcccccagaggcccuccaucuguggcuccgcugcccgcagggaucggaaggucaaccgccaagacaccuggucucccaggcagucuugagauggggccccugacuuuccgggacgucgcgauugaauuuagcuuggaggaauggcagugcuuagauacgucccaacagaaccuguaccgcaauguuaugcuagacaacuaucgaaaucucguguuccugggaauagcuguaucuaaaccugaucuuaucaccugucuggagcagggcaaggaaccaugcaacaugaaacgucacgccaugguggcaaagcccccugucguguguucgcauuuugcccaggacuuguggccaaaacaaggucucaaggauucauuccagaagguuauucugagaagguacgggaaauauggacacgagaaucugcagcuccggaagggcugcaaaagcgcugacgagcauaaggugcacaaacgcggcuacaacggguuaaaucagugucugacaacuacccaaaguaagaucuuucagugcgauaaguaugucaaagugcuucauaaguucuccaacucuaauauucacaaaaagagacagacagguaaaaagccguuuaaauguaaggaaugcggaaagagcuguugcaucuugucccagcugacccaacacaaaaagacugcaacaaggguaaacuucuacaaauguaagaccugcggcaaagccuuuaaucaguucucaaaccuaacgaagcauaagauaauccaccccgagguuaauccuuauaaaugcgaagagugugggaaggcuuuuaaccagagucucacucugaccaaacauaagaaaauucacacagaggaaaagccauacaagugcgaggacuguggaaaaguguucagcgucuuuucugugcuuacuaagcacaaaaucauucauaccggcacaaagcccuacaauugcgaagagugugguaaaggguucuccaucuucucaacccugacgaagcacaagauaauucauacuggagaaaaaccuuauaagugcaacgaguguggcaaagccuuuaacuggagcaguacauugaccaagcacaaacggauccauacuggcgagaagccauacaaaugcgaagagugugggaaggcguucaaucaaucuuccacacucacccgccacaagauugugcacacgggagaaaaacccuauaagugcgaggaaugugguaaagcauuuaagcgaagcaccacacugacuaaacauaagagaaucuacaccaaggagaaaccguauaagugcgaggaaugcggcaaagccuucucggucuuuucuacauuaacuaagcacaaaaucauucauaccggggcuaagccuuacaagugugaggaaugcggauccgccuucagggcauuuucaacacugaccgagcacaaacggguucacacuggcgaaaagcccuauaaauguaacgagugcgguaaggcuuucaauuggaguagcacgcucacaaaacauaagcguauacacaccggggagaagccauacaaaugugaagagugcggcaaggccuuuaaccgcuccucuaaucuuacuagacauaaaaagauccacaccggagaaaaaccuuacaagcccaaaaggugugauagcgcguucgacaacacaccaaauuuuucacggcauaagcgaaaccacaugggcgagaagaguuga

SEQ ID NO: 65125 - RNA, 1866 nt, Artificial Sequence
  derived and/or modified sequence opt3 from ZNF274__Homo_sapiens__NP_057409
auggccagcagacugcccaccgcuugguccugcgagccugugacauucgaagacgucacucucggcuuuacgccagaggaaugggggcuucuggauuugaagcagaaaucuuuauacagggagguuaugcuggaaaacuaucggaaucuagugucaguagaguacccggagcuccaacuggaccccaaacuugauccucugccagcagaaagucccuugaugaacaucgagguggucgaagugcucacccugaaucaggagguugccggaccucgcaacgcgcagauucaggcucuguaugccgaggacgguagccucuccgcagaugccccaucugaacaagugcagcagcagggcaaacaccccggggacccugaggcugcacgacaacguuucagacaguuuagguacaaggauaugacaggaccacgggaagccuuagaccagcugcgcgagcuuugucaucagugguugcaaccgaaagcuagaucgaaggaacagauacuggagcuacucguccuggagcaguuccuuggcgcccugcccgugaaguugaggacuuggguagaaucacaacacccugagaauugccaggaaguuguggcgcucgucgagggugugaccuggaugagcgaagaggaggugcugccagcagggcagcccgccgaaggaacaaccuguugcuuagaggucacugcucagcaagaagagaaacaggaagaugccgcaaucuguccuguuacagugcugccagaggagcccguaaccuuucaggacguggcugucgauuucagucgggaagaguggggccuccuuggcccgacgcagcgcacugaauaucgagacgugaugcuggagaccuuugggcauuugguuuccgugggaugggagacaacucuagaaaacaaggagcuggccccuaauucugauauucccgaagaggaaccagcgccuagccucaaaguccaagaguccucaagagacugcgcccugaguagcacccuugaggacacacugcaggguggcgugcaggaaguacaggauaccguuuugaagcaaauggagucugcacaggaaaaagaccucccccagaagaagcacuucgauaacagggagucccaggcuaauucaggggcccuggacacgaaccaagugagcuuacagaaaaucgauaauccagaaagucaggcuaacucuggagcccuggacacuaaucaaguccuacuccauaagauucccccucggaaacgucugcgcaagagagauucccaggugaaaagcaugaagcacaacucgagggucaaaauccaccagaagucuugugagcggcagaaggcaaaagagggcaaugguugccgaaagacauuuucccgcucaaccaaacaaauaacuuucaucaggauucauaaggggagucagguguguagaugcagcgaauguggaaaaaucuuucggaacccacgcuacuucuccguucacaagaagauucauacaggcgagagaccguaugugugccaggacugcggcaaaggguuuguacagucuagcucacuuacccaacaccagaggguccacaguggagaacgucccuucgagugucaggaaugcggucggacguucaacgaucgauccgccaucagccagcauuugagaacccacacaggcgcuaagccuuacaaaugucaagacugcgggaaggcguuuaggcagucuucacaucugauacgccaccagcggacucauaccggagagagaccauacgcauguaauaaaugcggcaaggccuucacacaaaguagccaccucauuggucaccagaggacucauaaccgcaccaagcgaaagaagaaacagcccacauccuga

SEQ ID NO: 65126 - RNA, 1845 nt, Artificial Sequence
  derived and/or modified sequence opt3 from ZNF276__Homo_sapiens__NP_001106997
augaagagagacaggcugggccgguuccucagccccggguccucucgccagugcggagccucagaugguggcgggggagugagucgaacccguggcagaccuagccuuuccggugggccaagggucgacggagcuacagcacggcgcgccuggggcccgguuggcucuuguggggaugcgggagaggacggugcugaugaagccggcgcagggagagcccuggcuaugggacacugcagguugugucauggcaaauuuucgucacggagcuuacgcaguaucuccgagcgagcacccggugccucuauggaaagaccuagcgcugaggaaagggugcugguacgggacuuccaacgucuacucgggguggccguccgccaggauccaacucugucccccuuugugugcaagucaugucacgcgcaguucuaccagugccauagucuuuuaaagagcuuuuugcaaagaguuaacgcaucuccugccggaaggcggaaaccaugugcuaaagugggcgcccagcccccuacgggcgcagaggagggggcuugccucgucgaccugauuaccuccucaccacagugucugcacggacucguggguuggguacauggccacgccgcgagcugcggggcccugccgcaucugcagcgaacacuuaguucugaauauuguggaguuauacaaguggucuggggcugcgaucagggucacgacuacacuauggauaccuccagcucgugcaaggcauucuugcuggacucugcucuagccgugaaguggcccugggauaaagagacagcuccucgccucccacagcacagaggguggaaucccggcgacgccccucagaccucccaaggaaggggcacugggacaccagugggagcagaaaccaagacgcugcccucaacugacgucgcccagccgccuagugauagcgacgcuguugguccccgguccggcuuuccaccucagcccucucuuccacugugucgcgcgcccgggcaauugggagagaaacagcucccuagcucaaccagugaugacagagugaaggaugaguucuccgaccugagcgaaggcgauguauuaucugaggacgaaaacgauaaaaagcagaaugcacagucaagugacgagagcuuugaaccauauccggagaggaagguguccgguaaaaagucugagucgaaagaagccaagaaaagcgaggaaccccguauccggaagaaaccugggccaaagcccggcuggaagaaaaagcugcgaugcgagagagaggaacucccuacaauuuacaaauguccauaucaaggaugcacugcugucuacaggggcgccgaugggaugaagaaacauaucaaggagcaccacgaagaggugcgcgaacggcccuguccgcauccuggaugcaacaagguuuucaugauugacagauaucuucagaggcacgugaaacugauccauaccgagguccgcaauuacauaugugacgaaugcggucagacauuuaagcagcgaaaacacuugcuagugcaucaaaugcggcacuccggcgcaaagccacugcagugugagguaugcggguuccagugucgucagagagccucacucaaauaccacaugaccaagcauaaggcugagacggaacuggauuuugccugcgaccaaugcggaaggcgcuucgagaaagcacacaaccuuaauguucauaugaguauggugcacccccugacucagacacaggauaaggcguugccucucgaagcugagcccccaccuggucccccaucuccgagcgucaccacugagggccaggccgugaaaccugaacccacauga

SEQ ID NO: 65127 - RNA, 1353 nt, Artificial Sequence
  derived and/or modified sequence opt3 from ZNF277__Homo_sapiens__NP_068834
auggccgcuagcaagacccagggcgcaguggccagaaugcaagaggacagggauggguccugcucuacagucggagguguuggcuacggggacucaaaagauuguauccuggaaccccucagucuuccugagagcccaggaggcacuacgacccuggaagguuccccgucugugcccugcauuuucugugaggaacacuuuccuguagcggagcaggacaaguuguuaaaacauaugauaaucgagcacaagauugugaucgcugaugucaaacugguggccgacuuccagcgguauauucuauacuggcgcaagcgauuuacagaacagccaaucacugauuucugcucgguuauacguaucaacucaaccgcacccuuugaggaacaagagaauuauuuccuccugugugacgugcuuccugaggauaggauucugagagaagaguugcagaagcagcggcuccgcgaaauccuggagcagcaacagcaggaaagaaacgacacaaauuuucauggggucugcauguucuguaacgaggaguuucugggaaauaggagcgugauucucaaccacauggcccgggaacaugcuuucaauaucggcuuaccagauaacauaguaaauugcaacgaguuucuguguacccuucagaaaaaguuggacaaucugcaaugccuauacugugagaaaacuuuccgcgauaagaacacacucaaagaccacaugcgaaagaagcagcacagaaaaauuaaucccaagaacagggaauaugaccgguuuuacguuaucaauuaucuggaacuuggcaaaaguugggaggaggugcagcuggaagaugaccgugaguugcucgaucaucaagaagacgauugguccgacugggaggaacacccugcaucugccgucugccuguucugcgagaagcaggcugagaccauugaaaaauuauacgugcauauggaggaugcccacgaguucgaccugcucaagaucaaaagcgaacuugggcugaacuuuuaccaacaggugaaguuggucaacuucauccgcagacagguucaccaguguaggugcuauggaugucaugugaaguuuaaauccaaggcggaucuacggacgcacauggaggaaacuaaacauaccucacugcucccagaccgaaagacaugggaucagcuggaguacuauuucccgacuuacgaaaaugacacccuucugugcacauugagugacagcgagucugaucucaccgcacaggaacaaaacgagaauguacccauuauauccgaggacacgucaaaacuguaugccuuaaagcagagcaguauccugaaccagcuacuccuguga

SEQ ID NO: 65128 - RNA, 1632 nt, Artificial Sequence
  derived and/or modified sequence opt3 from ZNF280B__Homo_sapiens__XP_011545198
auggagcagagcugcgaagaggaaaaggagcccgaaccucaaaagaacauccaggagaccaaacagguggacgaugaggacgccgaacugauuuucgucggcguugagcacgugaaugaagaugcugagcucauauuuguaggggugacauccaacucuaaaccagucgugucaaauauccuuaacagaguuacuccgggaaguuggagcaggcggaagaaauacgaccaucugcgcaaggauacggcacgaaaguugcagcccaaaucccacgagaccgugacaucugaagccgucacuguguuaccugcgucgcaacuggagucacguagcaccgacaguccaauuaucauugaaccccuauccaagccugauuauagaaauucuagcccacagguaguucccaacaauuccucagagcucccuaguccacugaucacauucaccgacagccuucaucacccggugucuacugcucuguccgucgguggcauaaacgaaucacccagggugagcaaacaguugaguacauuugaggucaauucuaucaacccuaagcgggccaaacuccgcgaugggauuaucgagggaaauuccagcgcaucguucccaucugacaccuuucauacgaugaacacucagcaauccacccccucaaauaacgugcacacaagucugagccacguucagaauggcgccccuuucccagcugcauuucccaaggauaacauucauuucaagccgaucaacacuaaucuggacagagccaacgaacucgcuaaaaccgauauauuaucccugacaucucagaauaagaccuuugacccuaaaaaggagaaccccauugugcuuuugagcgacuucuacuauggucagcacaaaggggaaggacaaccagagcagaagacgcauacuacauuuaaaugucugucaugcguaaaggugcuaaagaaugucaaauucaugaaccacgugaagcaccaucucgaauuugagaaacagaggaaugauaguugggagaaccacaccacuugucaacauugccaccggcaguucccuacacccuuccagcugcagugucauaucgaaaauguucacaccgcccaagagccauccacggugugcaagauuugugaacuuagcuuugagaccgaccagguccuguugcagcacaugaaagaucaucacaagcccggcgaaaugccuuacgugugccagguaugucauuaucgaucuucaguuuucgcggacguggagacacacuuucgcacuugccacgagaacaccaagaaucuccuguguccauucugcuuaaaaaucuuuaagacagcaacuccguacaugugccauuauagaggccacugggggaaaagugcccaucaauguagcaagugcaggcugcaguuccucaccuuuaaagaaaagauggagcacaagacacagugucaucagauguucaaaaagcccaaacaacuugaaggacugccuccagagaccaaggucacuauccagguguccuuggagccccuacagccugguucugucgauguggcuucgauuacgguuagcacauccgacucagaaccaagucugccccggucuaaaagcaagauauccaagaaaucacacuga

SEQ ID NO: 65129 - RNA, 2901 nt, Artificial Sequence
  derived and/or modified sequence opt3 from ZNF280D__Homo_sapiens__NP_001002843
auggccgagcuguucauggaaugcgaggaagaggaacucgagcccuggcagaagaaagugaaggaggucgaagacgaugacgaugacgagccuaucuuuguuggcgaaauuagcuccucuaaaccagcuauaucaaacauccuuaauagagugaacccgaguagcuacuccagggggcugaagaauggagcauugucucgggguauuaccgccgcguucaaacccacaucgcaacacuauacuaacccuacgucaaauccaguacccgcuagcccuaucaacuuucauccagagagucgcuccucugauagcuccgugauuguccagcccuucucaaagccuggcuacaucaccaauaguagccgagugguuucuaacaaguccucagaguuacuguuugaccuaacacaggauacugggcucagccacuaucagggaggcccaacccugaguauggccgguaugucugaauccagcuuccuuucgaaacguccgucuacauccgaggugaauaacgucaaucccaagaaaccuaagccaucagaaagugugagcggggcaaacuccucugccguacugcccagcguuaaaucaccuagugugaccuccagccaagcuauguuggcaaagggaacuaauacaucuucaaaccagaguaagaauggcaccccauuucccagagccuguccgaaaugcaacauacauuucaaccuccuggacccucugaagaaucacaugaaauacuguugccccgauaugaucaacaauuuucucggcuuagcuaagacggaguucagcuccacugucaacaaaaauaccacaauugacucugaaaaggggaaacugaucaugcuugugaacgauuuuuauuacggaaagcaugagggugacgugcaggaggaacagaagacucacaccacauucaaauguuuuucgugcuugaagauucugaaaaauaacaucagguucaugaaucacaugaagcaucaccuagagcucgaaaaacaaagcuccgagucaugggaaaaccauaccacgugucagcacugcuaucggcaguucccaacuccuuuucagcugcaaugucacauagagaguacacauacuccccacgaguucucuaccauuugcaagaucugugaacuuagcuuugagacagaacauguccuguugcagcacaugaaggauaaucauaaaccaggcgagaugcccuacguuugccaggugugcaacuaccgcuccucauccuucucugacguagaaacccacuuuagaacgucccacgagaauaccaagaaccuccuguguccuuucugcuuaaaagugauuaagaucgccacaccauauaugcaucacuacaugaaacaucaaaagaaggggauccacagguguacuaaaugccggcugcaguuucucaccuguaaggagaaaauggaccacaagacacagcaucaccgcacuuucauuaaaccgaagcagcuugaaggacugcccccuggcaccaaggucacaauacgagcgaguguggguccauugcaaagcggggcaucucccaccccuuccaucucagccagugcuagcacucuacagcugucgccacccagaacgaaaaauauuacagccaagaacccggcaaaauccaacaccucuaagccuaauacuguuaaaagcaacgcuucaaagccaaauaccaguaaacccaacggauccaagucuaaguauaaaccuaagaucagcaauaugcagaaaaagcaguccacacucgccucaagcaacaaaaagaguaaggugaauaccgcgcugaggaaccuucgguaccgucgcggcauacauaaaugcauugaguguugcucugaaaucaaggauuuugccaaucacuuccccacuuauguccauuguuccuuuugcagauacaacacaagcuguucgaaagcauaugugaaucacaugaugucauuccacucuaacaggccaaguaagcgguuuugcaucuucaaaaagcauuccgagaaucugcgaggcauuacguugguaugccucaacugugacuuccugagcgauguuucuggguuagacaauauggcuacccaccugagccaacauaagacucacacaugccagguggucaugcagaaaguguccgucuguaucccuaccucagagcaucuaagugaacucaagaaagaggcccccgcuaaggaacaggagccagugagcaaagaaauugcccgcccgaacauggcagagagagagacagaaacuucuaacuccgagucaaagcaagauaaggccgcuaguagcaaagaaaagaauggaugcaacgcgaauagcuuugaggguucuucgaccacgaaaagcgaagagucaauaaccguuuccgacaaggagaacgaaacaugucuggcagaucaggagacuggcaguaaaaauaucgugucuugcgacagcaacauuggggccgauaagguagagaaaaagaagcagauccagcacgucugucaagaaauggaacuuaaaaugugccaguccucagagaauaucauuuugucugaccagauaaaggaucacaacagcagugaggcuagguucuccagcaaaaauaucaaggaccugcggcucgccucugacaacgugucaauugaucaauuucugcgcaaaagacaugaaccugaguccguuaguagcgacgugucggaacagggaucuauccaccuugagccccugaccccauccgaggucuuggaauacgaggcaacagaaauucuccagaagggcagcggugaucccucagccaagacugacgaggugguaagugaucagaccgacgauaucccugggggcaauaacccaucuacgacagaagcuaccguggaccuggaggaugagaaagaaagguccuga

SEQ ID NO: 65130 - RNA, 2688 nt, Artificial Sequence
  derived and/or modified sequence opt3 from ZNF281__Homo_sapiens__NP_001268222
augaagaucggcagcggguuccuguccggagguggcgggaccggaucuucaggcgguagugggagcggaggcggcggguccggagguggcgggggaggcgguucuucggggagaagggccgagauggaacccacauuuccucagggaauggugauguucaaccaccggcucccaccggucacuucauuuacgcgccccgcuggcagcgcagccccuccaccccaaugcguucuuaguuccucuaccagcgcggcuccugccgcagagccacccccuccaccggcccccgacaugacauucaaaaaggaaccugcugcauccgccgcugccuuuccaucacagcgaaccaguuggggcuuccugcagagcuuggugucuauuaaacaggagaagcccgcggauccugaagaacaacagucccaucaccaucaccaucaccaccauuacgggggauuauuugccggugcagaggaacguucaccaggccugggcggaggcgagggugggagccacggcguaauacaggaccuaaguauccuccaucagcacgugcaacagcagcccgcucagcaccauagagauguccugcuuucuuccagcucgaggaccgacgaucaccauggaacagaggagccgaaacaagacaccaaugugaagaaggccaaacggccuaagcccgagucucagggcauuaaagcaaagcgcaaaccauccgcuucaaguaagccuagccugguuggggauggagaaggugccaucuugucccccucucagaagccacacauuugugaccauugcagcgcggccuucagaucaaguuaucaccucaggcggcacgugcugauccauacuggcgagcgccccuuucaauguucccagugcagcaugggguucauacagaaauaccugcuccagcgacacgaaaagauccauucuagagagaaaccuuuuggaugugaucaaugcucaaugaaguucauucagaaauaucacauggaaaggcacaagcggacacauaguggcgagaaaccauacaagugugacacuugccagcaguauuuuagccguacggaucgcuuacugaagcacagaaggacuuguggugaggucaucgugaaaggggcaaccuccgcugaaccggggucuucgaaccauacaaauaugggaaaccuugccguauugagccaaggcaauacuuccucaagucggcgaaagaccaaaucuaagagcauugcuaucgagaacaaagaacagaagacagggaagaccaaugagucccagauaucaaacaauauuaacaugcagagcuacucuguugaaaugcccacgguguccaguagcggagguaucauuggcacugggaucgacgagcugcaaaaacgcgucccuaagcuaaucuucaaaaagggaucuaggaaaaauacagauaagaacuaucucaauuucguguccccacugcccgacauugugggccagaagucacuuagugguaaaccuagcgggucgcugggcauagucuccaacaauucuguugagaccaucggauugcuccagagcacuucaggcaagcaggggcaaauuaguuccaacuacgacgaugccaugcaguuuucuaaaaagagacgguaccugccaacagcaagcuccaacucagccuucagcaucaaugugggacacaugguaagucagcaaucugugauacaguccgcuggcgucagcguguuagacaacgaagcgccccugucgcucauugauucaucugcacuuaaugccgagaucaaaaguugccaugacaaguccgguaucccggaugaaguucugcagagcauuuuggaccaguauucuaacaagagcgagucccaaaaagaagauccuuuuaauaucgcugagccacgcguggaccuacacaccucaggggagcacagugaacugguccaggaggaaaaccucagccccggaacgcagaccccuucuaaugauaaggccuccaugcugcaggaguacucaaaauaucuucaacaggcauucgagaagaguacaaacgccagcuuuacucugggccaugguuuccaguuuguguccuugucuucgccccuccacaaucauacccuguucccagaaaaacagauuuacacaacuagcccuuuagaguguggcuuugggcaaucaguaaccuccguucugcccaguucucuaccaaagccgccuuucggaaugcucuuuggcagccagcccgggcuguaucuuuccgcuuuggacgccacacaccagcaacugaccccaucacaggaacucgaugaccugauagacucucagaaaaaccuugagacuagcagugcauuccaguccagcucucaaaagcugacgucacagaaggaacagaaaaauuuggaguccaguacaggauuucagauccccagccaagagcucgcgucgcagauugauccucagaaggacaucgaaccaagaaccacuuaccagaucgagaacuucgcucaagccuucggcucucaguuuaaauccgguagcagggugcccaugaccuucauuacaaauucaaacggggaagucgaucaucgugugcggaccagugucucugacuuuuccggauauacuaauaugaugagcgaugugucagagccuugcaguacacgaguuaagacgccgaccagccaguccuacagauga

SEQ ID NO: 65131 - RNA, 1392 nt, Artificial Sequence
  derived and/or modified sequence opt3 from ZNF282__Homo_sapiens__NP_001290410
augcaguucgugagcaccagaccccaaccucagcagcugggcauccaggggcucggacuugacuccgguucuuggucaugggcccaagcucugccaccggaggaagucugccaccaggagcccgcauugaggggcgaaauggccgaggggaugccuccaaugcaggcgcaggaaugggauauggacgcucggcgccccaugccuuuucaauucccacccuuuccugaucgagccccaguuuucccggaccguaugaugagagagccccaguuaccuacagcagagauuagucuguggacugugguagccgcuauacaggcaguggaaaggaaggucgaugcccaggcuagccaacuacucaaccuggagggacggacgggcaccgccgaaaagaaacuugcggacugugagaaaacagcaguggaguuugguaaucauauggaauccaagugggccguucuggggacuuugcuccaggaguacggacugcugcagcgcagacucgaaaacuuagagaaucugcuuaggaaccggaauuucuggguguugcgccugccacccggcucuaaaggcgaagcuccuaaggucccagugaccuuuguagauaucgccguuuauuucucggaggacgaguggaagaaccuagaugaauggcaaaaagagcucuacaauaaccuggugaaggaaaauuauaaaacacuuaugucacuggacgcagaggggagcguccccaagccggaugcuccugugcaggccgaaccccgagaggagccaugcgugugggaacagagacacccugaggaaagggagauucccauggacccagaagcgggagccgagcccuuggucccugcacaggaugcuaguucccaaguuaaacgggaggacacccucugugugcguggucagcgcggccuggaagagagagccaucccaacugaaucuauuacagacagcccgaucuccgcucaggauuuacugucaaggauaaagcaggaggagcaucaaugcguaugggaccagcaggaucucgccgaccgggauauccccaccgacccuaacagugaaagccuuauuucugcacacgauauccuguccuggauuaagcaggaggaacaaccauaccccugggggccucgagacucaauggauggagaguugggccuagacagcgguccaagugauucucugcucauggugaaaaaucccccgccugccccaccccagccucagccccagccacaaccuccccagccacagcugcaaucccagccgcagccucagagccuucccccaaucgcugucgcggaaaaccccgggggaccuccaucgcgcggccuguuggacgacggcuuucaaccccaucagggggcagcccucagagugagguga

SEQ ID NO: 65132 - RNA, 1569 nt, Artificial Sequence
  derived and/or modified sequence opt3 from ZNF286B__Homo_sapiens__NP_001138517
auggagaccgaccuggccgaaaugcccgagaagggcgugcucagcucccaggauucuccucacuuccaagaaaaaucaacagaggaaggggaggucgcugcacuuagacugacugccaggagucaggcggcugccgcagccgcugcaccaggaagccgguccuugcgcgguguucaugugccgcccccuuuacacccagcccccgcucgagaggaaaucaagucuacgugcucgcugaaagccuguuuuucacuaagccucacccugacauacuaucguacugcguuccuucugaguaccgagaacgaaggcaauuugcauuuucagugcccuuccgacguagagacaagaccacagucuaaggauagcaccuccgugcaagacuucucaaaagcagagaguuguaaggucgccauuauagauaggcucacucggaacagcguguacgacucuaaucuggaagcugcccuggagugcgaaaacuggcucgagaagcagcaggggaaucaggaacgccacuuaagagagauguuuacacauaugaacucccugucagaggaaaccgaucacgagcacgacguuuauuggaaaaguuucaaucaaaagagcgugcuuaucacggaagauaggguccccaaaggaucuuacgcauuucauacuuuggagaagucccugaaacaaaagagcaaccuaaugaagaaacagcggaccuauaaggagaaaaagccucacaaauguaaugacugcggcgaacucuucacaugucauucggugcacauucagcaccagcgcguacauacuggugagaagccauauaccugcaacgaaugugggaaaucuuuuucccaccgagcuaaucugacaaagcaucagagaacccacacgaggauccuuuucgagugccgggaauguaagaaaacuuuuacagagucaaguagccuggccacccaucagcguauucacguuggagaacgcccguacgagugcaacgagugcggcaagggcuucaauagauccacucacuuggugcaacaucagcucauccacacaggggucaggcccuacgaauguaacgagugcgauaaagcguuuauacauucuagcgcccugaucaagcaccagcggacccacacgggagaaaaaccuuacaagugucaggagugcgguaaggcauucucacauuguaguuccuuaaccaaacaccaacgagugcauacaggcgagaagccauaugaaugcagcgagugugggaaaacuuucucucagucaacccaccuggugcagcaucagcgcauucacacaggagaaaagcccuacgagugcagugaauguggcaaaacuuuuagccaauccucuaauuucgcuaagcaccagagaauccauauugguaagaaaccuuauaagugcucggagugugggaaagccuuuauccacagcuccgcucucauacagcaucagaggacccacacaggagagaagccauuccggugcaacgaaugcggcaaaucauuuaaguguaguucuagccuuauucgccaucaaagaguccacaccgaggaacagcccuga

SEQ ID NO: 65133 - RNA, 1428 nt, Artificial Sequence
  derived and/or modified sequence opt3 from ZNF296__Homo_sapiens__NP_660331
augagcagaaggaaggccggcuccgcuccccggcgcguggagccugcaccagccgcgaacccggacgaugaaauggagaugcaggaccuggucaucgaacucaaacccgagccugaugcucaaccacagcaggcaccccgacuugggccuuucucuccaaaggaaguuucaagugccggacguuuugguggcgagccccaccauagcccugggccaaugccggccggagcugcacuguuggccuuaggccccagaaauccuuggacccuguggacaccacuaacucccaacuacccugacaggcagccauggacggauaaacaccccgaccuccugaccugcggucggugucuucaaacauucccgcuggaggcuauuacugccuuuauggaucauaagaaauuggggugccaacucuuccgcggaccuuccagaggccagggcucugaaagggaggaacugaaggcgcugucgugucuccggugcgggaagcaguuuaccguggcauggaaauuacugcgccacgcccagugggaccauggacuuucaauauaucagacagagagcgaggcucccgaagccccauugcugggucuagcagagguagcugccgcggugagugccgucgugggcccugcagcugaagccaagaguccccgagcuucugggagcggacucaccagaagguccccaacuugucccguuugcaaaaagacacugucaaguuucagcaaucuuaaagugcacaugcggucucacaccggcgagcguccuuacgccugugaucagugcccauaugcaugugcccaguccucaaagcugaaccgccauaagaaaacgcacagacaagucccgccccagagcccuuugauggcugacacuucccaggaacaagcgucugcagccccacccgagccugcugugcaugccgcagccccaaccuccacacuccccugcagcgguggggagggagcuggcgccgcagcgacugcuggcguacaggaaccgggggccccuggaucgggugcacaggccggcccagggggagauaccuggggcgcuaucacaaccgagcagaggacggaccccgccaauucucaaaaggcauccccuaaaaagaugcccaaaucaggugggaagagucggggcccaggaggcagcugugaauuuugcgggaaacacuucacuaacuccucuaaucugacaguucaccgacgcagccauaccggagagagaccuuacacuugcgaauuuuguaacuaugcuugcgcccagucaaguaaguuaaauaggcaccggcgcaugcaugguaugacacccggcuccaccagauucgaguguccacacugccaugugccguuugggcugagggcgacgcucgauaagcaccuucgucagaaacacccugaggccgcuggagaagcauga

SEQ ID NO: 65134 - RNA, 1152 nt, Artificial Sequence
  derived and/or modified sequence opt3 from ZNF2__Homo_sapiens__NP_001017396
augcuggagaacuacaauagcaucgugucccucggccuucccgucccucagccagacguuauuuuccaacugaagagaggggauaaaccguggaugguggacuugcacggaucugaagagagggaauggcccgagucaguaaguuuagauugggaaaccaagccugagauacaugacgccagcgauaaaaaguccgaggguucucugcgggaaugccuaggccgccagucgccacucugucccaaauuugaggugcacacaccuaacgggcgaaugggaacugaaaagcagucaccaagcggcgagacgcguaagaaaagucuguccagagacaagggucuuaggcggcgcucugcucugagcagagagaucuugaccaaagaaaggcaucaggagugcuccgauugugggaagacauucuuugaccacucaagucucacucggcaucaacgcacccacacaggagaaaaacccuaugauugccgagaguguggcaaggcauucagccacagaucuucccugucaaggcaucugaugagccacaccggcgaaaguccuuacgagugcucugucuguuccaaggccuuuuucgaccggagcucgcucacugugcaucagcguauucacacaggggagaaaccauuucagugcaaugaauguggaaaggcguucuuugauagaucuuccuuaacccgccaccagaggauccauacgggugagucaccguaugaaugccaccaauguggcaaggcuuucagucagaaaagcauucugacucggcaucagcuuauccacaccgggcgaaaacccuacgagugcaacgaaugcggaaaggccuuuuauggcguuuccucuuugaaucgccaucagaaagcacacgccggugacccuagauaccaauguaacgagugcgggaaggcuuucuuugauaggagcucacugacacagcaccagaagauacauacuggagacaaaccauaugaguguagugaaugcggcaaggcauucucccaacggugucgccuaaccagacaccagagggugcauacaggcgagaaacccuucgaaugcaccgucugugggaagguguuuagcucuaaaucaaguguaauccagcaccagcgucgguacgccaagcaaggaauugacuga

SEQ ID NO: 65135 - RNA, 1863 nt, Artificial Sequence
  derived and/or modified sequence opt3 from ZNF300__Homo_sapiens__NP_001166302
auggugcccgccgagaccagcuccucuggccugcucgaggaacagaagaugaugaaaucacaagggcuugucaguuucaaggacguugcuguggauuuuacacaggaagaguggcagcagcuggacccuagccaaagaacuuuguacagggauguaauguuagaaaacuauucccaccuggugucuaugggauacccagucucgaaaccggacgugaucucaaagcuagagcagggugaggaacccuggauuauaaaaggcgauaucagcaauuggauuuauccugacgaguaccaggcagaugggcggcaggaccgcaagaguaaccuccauaauucccaaucuugcauccugggaacgguuagcuuccaccauaagauucuuaaaggcgugacccgagaugguucccuguguucaaucuugaaggucugccagggggacggacagcuccagcguuuucuggaaaaccaagauaaacuguucagacaggugacauuuguaaauaguaagacuguuaccgaggccagcggccacaaauauaacccacucggcaagauauuccaggaguguaucgaaacagacauuucuauccaaagguuucauaaguacgaugcguucaaaaagaauuuaaaacccaacauugaccugccuuccugcuauaagucaaauagccggaaaaagccagaccagaguuuugggggagguaaaucuuccagccagucggagcccaacucuaaucuugaaaagauccacaacggcgugauaccuuucgaugacaaucagugugggaacgucuuucgcaauacccaauccuugauucaguaccagaacguggagacuaaggaaaaaucaugcgugugugucacaugcggaaaggcuuucgccaaaaagagucagcugaucguucaccaaaggauucauaccggcaaaaagccauacgauuguggugcaugcgggaaggccuuuagcgagaaauuccaccuagugguacaucagagaacgcacacuggagagaagccguaugacuguuccgaaugcggcaaggcuuucucucagaaaagcucacucaucauccaccagcgggugcauaccggcgagaaacccuacgaaugcagugagugugggaaggcauuuucccaaaagagcccucugauuauacaccagcgcauccauacaggagaaaaaccauaugagugccgagagugugguaaggccuucucucagaaaucacagcuuauuauccaccauagagcucacacuggcgaaaagcccuacgagugcaccgaaugugggaaagccuuuugcgagaagagucaccugauaauucauaagaggauccacacaggagaaaaaccuuauaagugugcgcaaugcgaggaggcauucagccggaaaaccgaauugaucacgcaucagcucguccacacuggcgagaagccauacgaauguacagagugcgguaaaaccuuuucccguaagucucagcugauuauccaccaacgcacucauacaggggagaaacccuauaaguguucggaaugcggcaaggccuucugccagaaaagccacuuaauuggacaucagagaauacacaccggcgagaagccguacaucuguacggaaugcgggaaggcuuuuucccagaaaucacaucugccuggacaccaaaggauucacaccggugagaaacccuacaucugugccgaaugcggcaaggcauucagucagaagucugaucucgugcuucaucagcggauccacacaggggagcgaccauaucagugugcuauuugcggaaaagccuuuauacaaaagagccagcugacuguucaucagcgcauccacaccguggucaaauccuga

SEQ ID NO: 65136 - RNA, 2001 nt, Artificial Sequence
  derived and/or modified sequence opt3 from ZNF311__Homo_sapiens__NP_001010877
augcaggaggugguccugcucgacgaaagcuccggacccccuucucaacuucuguggaccagacaggauacacaguugccacaggagucagccuuacugccggcucccuacccugcauucacuaaggacgggagucaaggaaaccuaccacaggccgauaucacgcucaugagccaggcgcaggaauccguuaccuuugaggacguggcuguaaauuucacaaacagggaauggcaaugccugacuuaugcccagcggcaccuuuacaaagaugugaugcuggagaauuaugguaacauggucucuuugggcuuucccuucccuaagccaccccucauuucgcaucuggagcgcgaaguggacccuuguguucaggauccacaggaccgagagucacugagcugcaguuacccgguguccgcagauaaaauguggcccgaaaaugagaaggccucuagccaacaggagauauuugaaaacggggaggcuuauuggaugaaauucaauucccucuuaaaggucgacucacgugauccuaaggugagagaaguauguguucaggacgugaaacuggagaaccaaugggaaaccaguaucagggagaaacuucgggaggaaaaagagggaagcgaagaggucacaugcaagaaaggcaagaaucagaagguguugucuaaaaaccugaauccaaacuccaagcacucacaguguaauaaagugcuaauugcacagaagcuccaugaaugcgcccgcugugguaaaaacuuuagcuggcacagugaucugauccuucaugagcaaauucacucuggggagaagccccacgucugcaaugaauguggaaaggcuuucaagaccagaaaccagcuguccaugcauaggaucauacacacuggcgagaagccuuuuaacugcacacaguguggcaaagccuucaauagccggucggcguugugccgccauaagaaaacccacucuggggaaaagccacacgagugccgagacuguggaaaagcauuuaagacgagaaacaggcucugcaugcaucagcugauccacacuggugaaaagcccuacaaauguaauugcuguggcaaggccuuccaauuuaaacauuccuuaaccauucacgggcggauccauacaggagagaagccguaugagugcgaagaguguggcaaggcuuucucagguaguagcgaccugacuaaacacauucguauccacaccggggaacgcccuuacgagugcuccaaguguggcagagccuucucuaggagcucagaucucaguaaacauaagcggauacacacacgagagaaacauuacggcugcccccaguguggcaaggacuuuuccauuaaagcagaacuuaccaagcaccgcagaauccacacggaggaaaagagguaucggugcgaggaaugcgggaaggcuuuccgccauaacuguaaaagaagggcccacgagcgugagcauacuggagaaaaaccauaccagugccgggauugugguaagacauuucaggacaaacacugccugaccauucaucaacgaauccacacuggcgagaagccuuauaaauguuuggaaugcgggaaggcguucagcggaaagucuaaucuaacaaaccacagaaggauccauaccggcgagaaaccccacaagugugaaguuugcgguauggccuuucaucacucaagugugcugcgccagcauaaacggauucacacgggggagaagccauacaccuguagcgagugcggcacauccuucagacagggaucugcacucauaggccacaaaaggguacauacuggggaaaagcccuaugagugugaagagugcggaaaggcuuuucgcgugucgagcaaucugaccggucacaaaaagcgaaaacaucaggucugguccacacacgaacuugauggcucacggaagagucugucuccugugacuguuagccaaaccuccguggucucaaucuugacaagcgccuga

SEQ ID NO: 65137 - RNA, 6840 nt, Artificial Sequence
  derived and/or modified sequence opt3 from ZNF318__Homo_sapiens__NP_055160
auguacagaagcuccgccaggucuucagugaguagccaccggcccaaggacgauggcgggggagguccucgcuccggccgaucuucggggucaagcaguggaccagcucguagauccucuccgcccccuccacccagcggcuccucaaguaggaccccugcacggcgcccaagaagccccucuggucauagggggcggcgcgccuccccuucaccaccgcgaggaagaagggucagccccaguccuccacgggcgcgucgcggcucucccuccccuccaagaggcaggcggcuguuccccccggggccugcuggauuucgagguagcucgcgcggcgagucuagagccgacuaugcaagggaugggcggggagaccaccccggcgauuccgguucacgcagaaggaguccagggcucugcagcgacucccuugaaaaaucucugcguaucacaguuggaaacgaucauuucugugugagcacuccugagcggcgaagauugucagacagguuaggcagucccguagauaaucuggaagacauggaucgcgacgaucuaacggacgacuccguguuuacccggagcucucagugcucaagaggccucgagagguacauuagucaagaagaggggccacugagccccuuccuuggacagcuggaugaggacuaucgcacaaaggaaacuuuuuugcaccgauccgauuacucuccucauauaucgugucacgacgagcuccugcgggguaccgaacguaacagagagaaacugaagggcuauagcaucagguccgaggaacgcucacgggaggccaaaagaccaagguacgaugacacagucaagauuaauaguauggggggagaucacccgucuuucaccagcggcacucgaaacuaucgccagcggagaaggucccccucaccucguuuucucgacccagaauuccgcgaguuagaucuggcucggagaaagagggaagaggaggaagagcgaagccggucucuuucccaggaauugguggguguugacgggggcggaacaggcugcaguauccccgggcugagcggagugcuaaccgcaucugagccugguuacucccuccaucgcccagaagaggucucagugaugcccaaaaagaguauucugaaaaagagaaucgagguagauauaauggaaccgagcaugcaacuugagucguuuuccucuagcacgucaaguucccaggaccacccucuguacucuggccauccaagcuugccccucuccggggccaucgcugccuucgcgucagaaauugagaauaaaggaacuaugguugaaaccgcacugaaggagccucagggcaacuuauaucagugggguccccugccagggaucccuaaggacaauagcccccucagggagaaauuuggcaguuuccuuugucacaaggauaaccuggacuugaaagccgaaggaccagagcggcacacagauuuucuacugccgcaugaacgagcuucucaagacggcuccggguucagcagaauucucucgaugcuggccgauucaacuucuacccaggagaagcgcaggcguaguuucccugacaucgaggaugaagagaaauuucuuuacggagacgaagaggaagaucugaaggcagaguccgugcccaaaccauuggguagcucugagagcgaagucaugcggcagaaggcuuccucacuccccaguagcgccccugcggugaagcuggagucuuuagaagagacaaauccagaauaugccaaaauacacgaccugcuaaagaccauuggccucgauaucgggguggcagagauuucccagcuggcugccagaacgcaagagaggcuucauggaaaaaagcccucauugcgcaguagcgcugaccgaagauccucugucgaucgguacuucucggccgaccacugcagcucaguugaccauagguuuuccgcagaucgcuguaguucuguggaccacugcuucagcgccgaucguagauccucagacccucaccggcuggaaucuagggaggcucaucacagcaacacucauaguccggaaguaucccacccacaccccccuagcccaguggaucccuaucuccugacaaaaaauucuccuccguuucuuaagucagaccaucccgucggccacaucuccgguccagaggugguugggaguggcuuccagagcucgguggcgguccgcuguaugcugccuucugcacccuccgccccaauccgauugccucauaccgcugcccucagccaguuucacaugcccagagcaucacaauucgccgcugcccggauuccaccgaacuaccagggaccugcaauacccccagcgaguuuugaugcuuauaggcauuacauggccuacgcagccucucgcuggcccauguauccuacuucccagccaagcaaucaccccgugccugaaccgcacagaaucaugccaauuacaaagcaggcuaccaggucacggcccaaccugcguguaaucccuacgguuacccccgacaaaccaaagcaaaaagagaguuuacgcggcagcauaccugccgcacaggugcccguccagguguccauuccaucucugauccgauacaauccugagaagaucagcgaugaaaaaaacagagcuucccagaagcaaaaggucauugaggaaagggagaaacuaaagaacgaccgggaggcccgccagaaaaagauguauuaccucagaacagaacuggagaggcuucauaaacagcagggggaaauguugcggaagaagcgaagagagaaagauggacacaaggacccgcugcucguggaaguuucacgccugcaagauaauaucaugaaagacauugcggaguuaaggcaggaggccgaagaggcugaaaagaaacagucugagcuggacaagguggcacagauacuuggcaucaacauuuucgauaaaagucaaaagucguugagcgacucccgggaacccacugagaagccagguaaagccgagaagucuaaaucaccugaaaagguaagcuccuuuaguaauucuagcucaaacaaagaguccaaggucaauaacgaaaaguuccguaccaaaagucccaagccagcugagagcccucagucugccacaaaacagcucgaucaacccacugcagcguaugaauacuaugacgccgggaaucauuggugcaaggauuguaacaccaucugcggaacaauguuugacuucuucacccacaugcauaauaaaaagcacacucagacgcuggauccguacaacagaccaugggcuuccaagacacagucagaggccaaacaggacgcaaucaagaggaccgauaaaauuacugugccugcuaagggcagcgaguuucuaguucccauaucggguuucuacugccaacugugugaagaguuucucggcgacccaaucucuggggaacagcacgugaaaggacaucagcacaaugagaaguauaagaaauacgucgaugagaacccccuguaugaagagcgccggaaucuugaccgacaggccggcuuggcagugguacuggaaaccgagagaaggcgccaaagugaauuaaagcggaaacucuccgagaagccuaaagaggaaaagaaagagaagaaggccaaagcugugaaggaaguuaaagaggacgauaaggucagcgaaaaacuggaggaccagcuuucagaggggagaaacuccccggaaaaggcggagaauaagcguaacacaggaauuaaacugcaguugaaggaagaggugaaaaaggaaucucccaccagcaguuccuucggcaaauuuagcuggaagaagccagagaaagaggaagagaagucuucacucgugacuccuaguaucuccaaagaagagauucuggagagcucuaaggauaaagaagacgguaagacagaggccgggaaggcaaaacccaucaagauaaaacuaucgggaaagacggucguugcucauaccucaccuuggaugccaguggugacuacaagcacccagacaaaaaucaggcccaaccugccuauuccauccacuguacuccggaagaguugcucugccaccaugagcaagcccgccccgcugaauacguuccuuuccaucaaaucaaguggcaccacagcuaagccuuugccagucgugaaagaaucuagcgcagaucuguuacuccccccugacauuaucuccaaggccuuugguggcgaggaaguuauacugaaagggucaccagaggagaaggugguccuugcggaaaaaagcgagcccucucaccugccggaacaaauucuaccucccccaccucccccacccccuccaccgcccccuccacccccugugaucccacaccccgcugccccuuccgcagcccaggcuaacgcaauucucgccccgguuaagaguaauccagugguaagccagacucugucgcccggauucgucggcccuaacaucuugaaucccgugcugccaguggcgauaauggcuuccgcccaaccugcagccauccccucugaugagaccgcuccaggggucucagaaagcgaccgcgaucagacauuauuuaguguucucgugcgaccgccucccccacuguccucuguauucagcgagcaggccaagaaacuugagaagagaaacucaugucuggcaacugcuaaugccaaagacuuguacgauauuuuuuauuccaguggaggcaagggugcgcccgaaaccaaaggggccccugagacgaagcucagcggaggcccacuggcaaacggugaaaauucuaaccuaucaaggacaaaguccagcgacaccucuaguacuucgccccugaauuccagcgcuucacaggaggaacuucaucaagaugagggccucguggccgcuccuaucgucucuaacagcgagaaaccgauugcaaagacacugguggccuuggggaaaugguccguuguggaacacgucggaccaaagaguaccggcucaacuuacggguuccugcagcccuuaacccggcucugccagucucgcccuuaugagacaaucacgccaaaaaccgacacucuggccauauggacaagcuccaguuuucagagcgacaccuccagagauauuucucccgaaaagucagagcuugaccugggagagccuggccccccagguguggaaccgccuccccaauugcucgauauccaguguaaggagagccagaaacugguugaaauccaucuaagggagucggugaaucaggacaaggaaucccaagagcugcgaaaaagugaggauugccgggaaucugagauugaaacaaacacugagcuuaaggaacgugucaaagagcucagcgaggggaucguagacgaaggagugucaaccuccauuggcccacacucuauagaugacaguaaucugaaccauggcaacagauacaugugggagggggaaguuaagcagccuaauuuguuaaugaucgauaaggaggcugaacagagcaacaaacugaugacgggauccgagacacccucaaagguggucauuaaacucagcccacaggcguguucuuucaccaaggcaaaacuggacaguuuccuuuccgaggcccgcagccuguugaauccucaagauacucccgugaagaucucagcuccggaacuacugcuccacucuccagccagguccgcaaugugccugaccgguucgccucaggagcagggcguaagcguggucagugaagaggggcuugagaacucugcccccgaauccgcuagccggacaucaagauaccgcaguuuaaaacugaagagggagcgauccaaggacuuucaaguuaaaaagauuuaugaacucgcggugugggaugagaauaaaaagcggccagaaacuugggagagccccgagaaaccuaagaccgaagccuuggagcugcaggacgugcacccggaacucacagucacgaucgagucuaaggcacuggaagacuucgaggcuaccgaucuuaaaguggaggaacugacugccuugggaaaccuaggcgacaugccaguugauuuuuguacaaccagaguaucacccgcacauaggagcccuacugugcugugccagaaggucugugaggaaaauuccgugucucccauagguugcaacaguucggacccagccgauuucgagccuauccccagcuuuuccggguucccacucgacucaccuaaaacauuaguucuggauuuugaaaccgagggagagcgcaauucuccgaacccccguagcgugcggauuccaaguccuaauauccuuaagacgggccugacugaaaacgucgacagaggccucgggggauuggaggguacccaccaggcucuggaucuccuggccggcgggaugaugcccgaagaggugaaagaguccucacaacuugacaagcaggaaucucuaggacuggaguugaagacaauuaauagcgcgggcuuagguccauccccuugccugcccgaucucguagacuucgucaccaggacuaguggggugcagaaagacaagcuguguagcccgcuuucugaaccaggagauccuucaaaaugcuccagccuggagcucggccccuugcagcuggaaaucaguaacgcaucuacaaccgagguugccauacuacaaguggacgaugacuccggcgauccacugaaucucgucaaggcucccgugucgcgcagcccuccccgagagcagguuauugaagacaacauggugccacaggggaugccugagcaggaaacaacugucggagccauccaagaucauaccgagucauccgugcacaacuga

SEQ ID NO: 65138 - RNA, 1530 nt, Artificial Sequence
  derived and/or modified sequence opt3 from ZNF320__Homo_sapiens__NP_997216
auggcccugagccagggccuccuuaccuucagagacguugcuaucgaguuuucccaagaagaguggaagugccuggaucccgcacagaggacauuguaccgggacgucauguuagaaaacuaucgcaaucugguuucucuagauauuucaaguaaauguaugaugaacacucucagcuccacggggcagggaaauaccgaggugauacacacagguacucugcagcgacaagccucuuaccauaucggcgcguucugcucgcaggaaauugagaaggacauccacgauuuuguauuccaguggcaggaggacgaaaccaacgaucaugaggcuccuaugacagaaauuaaaaagcugaccucaagcacugaccguuaugaucaaagacacgccgggaauaaaccaaucaagggacagcuugagaguagguuucauuugcaccuccggcgccacagaaggauacauacaggcgagaagccguacaaaugugaagagugcgaaaagguguucuccuguaaaucucaccuggagauccaucggauuauccacaccggugaaaagcccuauaaaugcaaggucugugacaaggcauuuaaacacgauagccaucuggccaagcacacgcgcauucaucgaggggacaaacacuacacuugcaacgaguguggaaagguguucgaucagaaagcuacccucgcaugccaucacagaucccacacaggcgagaagccuuauaaauguaaugaaugcggcaagacuuuuucacagaccagucauuuaguuuaccaccauaggcugcacacaggggagaagccauacaaaugcaacgaauguggaaagaccuucgcccggaauagcgugcuugucauccacaaagcugugcauacggccgagaagcccuauaaaugcaacgaaugugguaagguauuuaagcaacgugcgacuuuggcaggccaccgcagaguucauacaggggagaaaccuuacaggugcgaggaaugugacaagguguucucucggaaaucccaccuggagcgacaucgcagaauacacaccggagaaaagccauauaaaugcaaggucugugacaaggccuuuaggucagauagccggcuagcugagcaccagcgcgugcauacuggcgaaagacccuacacaugcaaugagugugguaaaguguucaguaccaaggccuaucucgcaugccaccagaaacugcauacgggggagaaacuuuacgaaugugaggaaugcgacaaggucuauauuaggaagucucaccuggagcgucaucggcgaauccacaccggagagaagccucacaaaugcggcgauuguggcaaggcuuucaacuccccaagccauuugauuagacaccaaaggauccauacagggcagaaaucguacaagugccaccaguguggaaaaguguuuucucuccgcucccuguuagccgaacaccagaagaucccguucggugacaauugcuuuaaauguaacgaguacucaaagcccaguagcauuaauuga

SEQ ID NO: 65139 - RNA, 1209 nt, Artificial Sequence
  derived and/or modified sequence opt3 from ZNF322__Homo_sapiens__NP_001229728
auguacaccagcgaggaaaagugcaaccagagaacacagaaaaggaagaucuauaauguguguccccggaaaggcaagaaaauuuucauacacaugcaugagaucauucagaucgacgggcacauuuaccagugccuggaauguaagcagaacuuuugcgagaaucucgcccuuaucaugugugaacgcacucauacgggagagaagccuuauaaaugcgauaugugugagaagaccuucguccaauccucugaccugacaucacaccagcgaauacauaacuacgaaaaaccauauaagugcaguaaaugugaaaagagcuuuuggcaccacuuggcuuuauccggucaucagcguacucacgcaggcaagaaauucuauaccugcgauaucugugggaagaauuuuggacagucuucggaccugcuaguucaucaaagaucacacacaggcgagaaaccguaccucugcagcgagugcgauaaguguuucaguagguccaccaaccugauucggcaccgcagaacucauacaggugagaaacccuuuaagugccuugaaugugagaaagccuucucugggaaaagcgaccugaucucccaccagaggacccauacgggagaacggccuuacaagugcaauaaaugugagaagucauaccgccaccgaagugcguuuauugugcauaaaagaguacacacuggcgaaaagccauauaaaugcggcgcuugugagaagugcuucgggcaaaagagcgauuugaucgugcaccagaggguccauaccggagagaaacccuacaagugucucgaaugcaugcggucuuuuacacguuccgccaaccugauacgccaccaagcaacucauacccacacauucaaaugucuggaguaugaaaagucauuuaauugcagcagugaccucauugugcaccagagaauccauauggaggaaaaaccucaccaguggucugccugcgaguccgguuucuuacugggcauggauuucguugcucaacagaagaugaggacccagacggaggaacuucauuacaaguauacugugugugacaagagcuuucaccagucgucugcauugcugcaacaucagacaguccacauuggggagaagccauucgugugcaacguauccgaaaaaggacuagagcucucacccccucacgccagugaagcuagccagauguccuga

SEQ ID NO: 65140 - RNA, 822 nt, Artificial Sequence
  derived and/or modified sequence opt3 from ZNF32__Homo_sapiens__NP_001005368
auguucggcuuucccaccgccacacugcucgacugccacgggagauacgcucagaacguggcauucuuuaaugucaugacugaggcccaucacaaguaugaucauagcgaagcgacgggauccucuucaugggacauccaaaacaguuucaggcgggagaaacuugaacaaaagagcccugauuccaaaacccugcaggaggacucuccagguguucgccagcgaguguacgaaugucaggagugcggcaagucguuucgucagaaagggucauugacauuacacgagaggauucauacuggacagaagccguucgaauguacccacugcggcaagagcuuuagagcuaaagguaaucugguaacacaccagcggauacauaccggggagaagcccuaucaauguaaagaaugcggaaagaguuucucccagcgcggcucucuagccgugcacgagagacuccauacuggccagaaaccuuacgagugugcaaucugccagaggagcuuucggaaccaauccaaucuggccguccaccgccgagugcacucaggggaaaagccauauagaugugaucagugcggaaaggcuuucagucagaaagguagccuuauuguucauaucagggugcacacaggccugaagcccuacgcauguacccaaugccggaaaucuuuucauacgcgugggaacugcauuuugcacggaaagauccauacuggcgagaccccuuaucucuguggucagugcgggaaauccuucacacagcgcggaucacuggccguccaccagagaagcuguagucaaaggcugacucucuga

SEQ ID NO: 65141 - RNA, 783 nt, Artificial Sequence
  derived and/or modified sequence opt3 from ZNF330__Homo_sapiens__NP_001278931
augccccaguggaacgugaccagcgucagaggcaagacaaaaugcaugaugaaguccucugacuguguuaucaaacacgccgggguguacucaacuggacuggcuaugguaggugcaauuugcgauuucugugaggccugggugugccauggcaggaagugucucaguacgcacgcgugcgcuuguccucuuaccgacgccgaaugcgucgagugugaacgcggggugugggaucauggaggccggauauuuagcugcuccuucugucacaauuuucugugcgaggacgaucaauucgaacaucaggcaucuugccagguuuuggaggccgagacauuuaaaugugugucgugcaaccgauuaggucagcacucaugucugcguugcaaggcuuguuucugcgacgaucacacuagaagcaaggucuuuaaacaagaaaaggggaaacagccaccgugucccaagugcggacaugagacccaggaaacaaaagaccuaaguauguccaccaggucucucaaguucggccggcagacuggcggggaggagggagauggugcaagcggcuaugacgccuacuggaagaaucuguccucagauaaauauggggacacaaguuaccacgaugaagaggaagacgaguaugaagcugaggacgaugaggaagaggaagacgagggacgcaaggauagcgacaccgaaucuuccgaucuuuuuacgaaccugaauuugggcagaacuuacgccucagguuaugcgcauuacgaggagcaagaaaacuga

SEQ ID NO: 65142 - RNA, 1392 nt, Artificial Sequence
  derived and/or modified sequence opt3 from ZNF331__Homo_sapiens__NP_061025
auggcccagggccuggugaccuucgcugacgucgcaaucgauuuuagccaagaggaaugggccugccucaacuccgcgcagagagaccuuuacugggauguuaugcuggagaauuauucuaacuuggugucauuagaccuggaaagugcuuacgagaauaagagccuacccacagagaaaaacauucacgaaauaagggccuccaagcgcaauucugaucggcgaucgaaaucacucgggcguaacuggaucugugagggaacucuggaaagaccucagaggagccggggucgcuauguaaaucagaugauuaucaacuacgugaagagaccagcaacgagggagggcaccccgccccggacacaucaacgccaccauaaagaaaauaguuucgagugcaaggacugugggaaggccuuuucccgaggauaucagcuuucucagcaccagaaaauucauacuggcgagaagccuuacgaaugcaaagaguguaagaaggcuuucagaugggguaaccaacugacccagcaccagaaaauccacacaggggaaaagccauaugagugcaaagauuguggaaaggcauuuagguggggcagcuccuuggucauacauaaacggauccacaccggcgaaaagcccuacgagugcaaagacugugggaaggccuuccgucgcggagaugagcucacucagcaucaaagauuucacacaggugaaaaagacuacgagugcaaggauuguggcaagaccuucucaaggguguauaaacugauucagcacaagcggauccauaguggggaaaaaccuuacgagugcaaggacugcggaaaggcuuuuauuuguggcagcucucugauccagcacaaacgaauacauacgggugaaaagccauaugagugccaagagugugggaaagccuucacucgcguuaauuaccucacccagcaccagaagauucauacaggagaaaaaccccacgagugcaaggaauguggcaaagcguuuagauggggcuccucauuagugaagcacgagaggauccauacuggggaaaagccuuauaaaugcaccgaguguggaaaggcauucaacugcgguuaccaccugacacagcaugagcggauucacaccggcgaaacgccauauaaauguaaggagugcgggaaagccuuuaucuacggaagcagucuugucaagcacgaacgcauccauacuggcgugaagccguacgguuguacagagugcgggaaaucuuucucccacggccaucaauugacccagcaccagaagacucauagcggagcuaaaucguaugagugcaaggaauguggcaaagccugcaaucaccugaaccaccuaagagagcaucagaggauucacaauucuuga

SEQ ID NO: 65143 - RNA, 2112 nt, Artificial Sequence
  derived and/or modified sequence opt3 from ZNF334__Homo_sapiens__XP_011527196
augugcguguuccugcaccuccuuagcuacaucaaggacaccuccuuuauucccggcccugauugugagcugcauccaagagggauggccgcuacaggaccgugcucugaagcacccguccaggguugugacgccggcgaguugcaacaguuagggcugugcggaguuucagaugugcagaggaguuggagcaaauucuguaacuuuccucuaacuggcuaucacguauccaagccagacgugauauucaaacucgaacagggugaggaacccuggaucgucgaggaguuuucuaaucaaaacuacccugauauugacgaugcgcuggaaaagaauaaagagauccaggacaagcaucuuacgcagaccguguucuuuucgaacaagacacugauuacugaacgggagaauguuuucgggaaaaccuugaaccucggaaugaauagcgugccaagccgcaagaugcccuauaaaugcaacccuggcggcaauagucugaagacaaacuccgaggucaucguggcuaaaaagucuaaggaaaaucgaaaaauaccagauggguacagcggauuugguaagcacgagaaaucccaucugggcaugaagaaauaucguuacaacccgaugagaaaggccucaaaucagaacgaaaaucucaucuuacaccaaaacauucagauccugaaacagcccuucgacuauaacaagugugggaagaccuuuuucaaaagggcaauucuuaucacucagaagggacggcaaacagagcgcaaaccuaaugaaugcaacgaguguagaaagaccuuuaguaaaaggagcacguugauaguacaccagcggauucauacuggcgagaagccauacguuugcucugauugucgcaagaccuuccgagugaaaacaucccugacuagacacaggcggauccauaccggugaacgucccuacgagugcucagaaugccgcaagacauucauugacaaaagcgcccuaaucguccaccagaagauccacgggggagagaaaaguuaugaauguaaugagugcggcaagaccuuuuucagaaagucugcucucgcagagcauuuuaggucccacacgggcgaaaaaccuuacgaguguaaggaaugcgggaacgccuucagcaaaaagucguaucugguggugcaucaacggacucaccgaggagagaaaccaaaugaauguaaggagugcgguaagacauuuuucugucagucugcucuuaccgcccaucagcgcauucacacuggcgagaaacccuacgaaugcuccgagugugaaaagacauuuuucugccagucagcgcugaacguccacagaaggagucauaccggggagaaaccguaugaguguagccaaugcggaaaguuuuugugcacgaaauccgcacucauagcccaccagaucacccaucggggcaagaaaucuuacgaauguaaugagugcgguaaguucuuuugucacaagagcacacugacuauucaccagcgcacccauacaggggaaaaacacggcguuuucaacaagugcggaagaaucucaauagugaaaaguaauuguucccagugcaagaggaugaacacuaaagagaauuuauaugaauguagcgagcauggccacgcuguaucuaagaacucacaucugauugugcaccaacguaccaucugggagcggccuuacgaaugcaaugagugugggcgaacauacugcagaaagagugcccucacccaccaucagaggacucacacgggacagcgccccuaugaauguaacgagugcgguaaaacauuuugccagaaguucagcuucgucgaacaucaacggacccacacuggcgagaaaccauacgaguguaaugaaugcgggaaguccuuuugucauaaaucugcauucagagugcacaggcgcauccacaccggagagaagccuuaugaaugcaaccaguguggcaagacauaccgacggcuuuggacccugacugagcaucagaaaauucacacaggugaaaagcccuaugagugcaacaaaugugagaagacguuucgucauaaaucgaauuucuugcuacaccagaagucacacaaggaauga

SEQ ID NO: 65144 - RNA, 4029 nt, Artificial Sequence
  derived and/or modified sequence opt3 from ZNF335__Homo_sapiens__NP_071378
auggaggaaaacgagguggaaagcuccucugacgccgcucccggcccugggagaccagaggaaccgucagagaguggacugggugucggcaccagcgaggcaguuuccgccgauucuucggacgcggcugccgcacccgggcaggccgaagcugaugacucaggagugggccaaagcagugauagggguucccggucucaggaggaaguaagcgaguccucaaguagcgcagacccucucccaaauucuuaccuucccgauuccucaagcgugagucacgggccugucgccggagugacaggcggcccacccgcucugguucauucuuccgccuugccugacccaaacauguuagugagcgauugcacugcgucgucuuccgaccuggggucagcaaucgauaagauuauagagaguacgaucggaccggaccuaauucagaauuguaucaccgucacaagcgccgaagaugguggcgcugagacuacccgcuaucucauucugcaggggcccgacgacggagccccuaugacauccccaaugucuagcucaacccuugcacacagucuggcugccaucgaagcguuggccgauggccccacuuccacaucuaccugccucgaggcacaaggugggccuagcucaccagugcagcugcccccggcuaguggagccgaagaaccugaccugcagagccucgaggcuaugauggaaguaguugugguccagcaauucaaauguaagaugugccaguaccgauccucuacgaaagccacuuuacugcgucauaugagagagaggcacuuucggcccguggcagccgcugcggcagccgcuggcaagaaaggccgccuuagaaaguggucgaccagcacaaagucccaggaagaggaagggccagaggaggaagaugacgaugacauaguggaugccggagcaaucgacgauuuggaggaagacucagauuauaacccugccgaggacgaacccaggggucggcagcugcgccuacaacgaccaacucccaguaccccuagaccaaggcggcguccgggccgccccagaaaacucccuaggcuggagauuucugaccuuccagauggggucgagggagaaccccugguuagcucccagucaggccagagcccuccagagccccaagacccggaagcuccuucuuccagugguccagggcauuugguggccaugggcaagguaagccggacacccguggaggcaggagucucucaguccgaugcggagaaugcugccccuucaugucccgacgaacacgauacccucccacgacgcagaggcaggccuagucggcgcuuccuggggaaaaaguacagaaaauauuacuauaagagccccaagccauuacugaggccguuucucugccguaucuguggaucgcgguuccuuucccacgaggaccugcgauuucaugugaacucucacgaagcuggugauccucaguuguucaaaugccuacaguguagcuacagaucaaggcgcuggaguucccugaaggagcauauguuuaaucacguuggcucuaaacccuacaagugcgacgaauguagcuauacguccguguaccggaaagaugucauuagacacgccgcugugcauucaagggaccgcaagaaacgaccagaucccacuccuaagcucagcaguuucccaugccccguaugcgggcggguuuauccuaugcaaaagcgucugacacagcacaugaaaacccauucuacugagaagccgcacaugugugacaaaugcggaaaguccuuuaaaaagagauacacauucaagaugcaucuucugacccacauccaggccguggcaaacaggcgcuuuaaaugugaguucugcgaauuugucugugaggauaagaaagcauugcucaaucaccagcugagccaugugucggacaagccauucaaaugcucauucugucccuaucggacguuuagagaagacuucuuacugucucacgucgccgugaagcauaccggcgcgaagccuuuugccugcgaguacugucacuucaguacaaggcacaaaaagaaccuacgacuccauguucgcugccggcacgcuuccagcuuugaagagugggguagaaggcauccagaggaacccccuucucgucgccggccguucuuuagccugcaacagauagaggaacuuaaacagcagcacuccgcagcccccgggccaccucccucaaguccaggcccucccgagauuccaccggaagcuacuaccuuccaaagcucugaggccccuuccuugcuguguucagauacacucggaggcgcaacuaucauuuaucagcagggggcggaggaaaguaccgccauggcuacacagaccgcccuggaccuucuguugaauaugagcgcacaaagagagcucggagguacugcuuuacagguggccguagucaaguccgaagauguggaggcaggccuggccucucccgggggacagccaucgcccgagggcgcuacgccucaaguugugacacugcaugucgcggaaccaggugggggcgccgcagcugagagccagcuaggacccccugaccucccgcagaucacccuggccccaggccccuuugggggaacuggcuacucagugaucaccgccccucccauggaagaggguacauccgcuccagggaccccuuacagugaggagcccgcaggagaggccgcgcaggcuguagugguuucugauacucuuaaagaagccggcacacacuauauuauggcaacggacgguacccaauugcaccauauagagcugacugccgauggcagcaucuccuucccaucaccugacgcucucgcaucuggggccaaguggccgcuguuacagugcggaggccugcccagggaugggccagaaccucccagcccagcgaagacacacugcgucggagacagucaguccagcgcuucuucaccucccgccaccuccaaagcacuuggcuuggccgugccgccaaguccucccagcgcugccacagcagcuucgaagaaauuuucuuguaagauuugcgccgaggcguucccaggucgagccgaaauggagucccauaaacgggcacacgcugggcccggagccuuuaaguguccugauugcccguucagcgcucgccaguggcccgaggugagagcacauauggcccaacacucaagucucaggccacaccaguguucucagugcuccuucgccagcaaaaacaagaaggaccugcggcgacauaugcuaacucacaccaaagaaaagccuuuugcuugucaucugugcggccagagauucaaucgcaacggucaccucaaauuucacauccaaaggcugcauucacccgauggccguaagagugggacgccuaccgcgcgggcaccaacacagacucccacccagacaauaauucuuaauagcgacgacgagacuuuggccacccugcacacggcuuuacaauccucucauggaguccucggcccugaaagacugcagcaggcccuuagccaggagcacaucaucguugcacaagaacagacagugaccaaccaggaggaggccgcuuacauucaggaaaucacuacagcggaugggcaaaccgugcagcaucugguaacuuccgacaaccagguccaguauauuauaucacaagauggagugcagcacuugcucccacaggaguacguugugguccccgaaggccaccauauccaggugcaagagggucagauuacccacauccaguaugagcaaggggccccguuccugcaggaaucucagauccaguacguuccugugaguccaggacaacagcuaguaacacaggcacagcuggaggcugccgcacauucggccgucacggcuguggccgacgcggcaauggcccaagcucagggccucuuugguaccgaugaaacugugcccgagcacauucagcagcugcaacaccagggcauagaauaugacgucaucacacuugccgaugacuga

SEQ ID NO: 65145 - RNA, 1800 nt, Artificial Sequence
  derived and/or modified sequence opt3 from ZNF343__Homo_sapiens__NP_001269424
augaugcugcccuacccuagcgcccucggcgaccaguauugggaggaaauccuucugccaaagaacggggagaauguggaaaccaugaaaaaguugacacaaaaccacaaagcuaagggauuaccguccaaugauacugacugcccccagaaaaaggaggguaaggcacagauugucguuccugugacguucagagauguaaccgugauauuuacagaagccgaguggaaaaggcugucuccagagcagcggaaccuauacaaggaagucaugcucgagaauuaucgcaaccugcuuucacuggcggaacccaaaccugagaucuacacuuguaguagcugcuugcucgcuuucuccugucaacaguuucugucucagcaugugcugcagauuuuccucggcuuaugcgccgagaaucacuuucauccagggaacucgucacccggacacuggaagcaacagggccagcaguauagccauguuaguuguugguucgaaaaugcagagggucaagaacgagggggaggcuccaaaccuuggucugcccguaccgaggaaagagagacaagcagggcuuuuccauccccgcugcagcggcagucagcaaguccccgcaagggcaacaugguggucgagaccgaaccuagcucugcccaaagaccaaaucccgugcagcuugacaagggguugaaagagcuggaaacucuaagguucggagcuaucaacugccgggaguacgaaccugaucacaaucucgaguccaacuuuauuacaaauccacgcacccugcuugguaagaaacccuauaucuguucagacugcggccgaaguuucaaggauagaagcacgcugauaaggcaccaucggauccacucuauggagaaaccguacguauguuccgaaugcgggcguggauuuagccagaagucgaacuugucucgccaucagagaacucacuccgaggaaaaaccuuaccucuguagggagugcggccaaucauuccggaguaagagcauucugaaccgacaccaguggacccauuccgaagagaagcccuauguuugcucugaguguggucgcggguuuagcgaaaaaucaaguuucaucagacaccagaggacacauuccggagagaagccauacgugugcuuagaauguggccggagcuucugcgacaaaucuacucugcgcaagcaccagaggauucauucaggcgagaaaccuuaugucuguagagagugcgggcguggauuuagucaaaauagcgaucucaucaagcaccagcggacccaccuugacgaaaagcccuacgugugucgagagugcgguagaggcuucugugauaaauccacacugauaauucaugaaaggacccacucuggggagaagccauaugugugcggagaauguggccgcgguuuuucgcggaaauccuugcuacugguccaucagagaacgcacagcggggagaagcacuacguuugcagggagugccgccgaggcuucucacagaaaaguaaccucauccggcaucaacguacucacucuaaugaaaagcccuauauuuguagagagugcggaaggggcuuuugugacaagagcacacugaucgugcaugaacgcacccacuccggggagaaaccuuacguaugcucagaauguggacgggguuucagcagaaagucucuucuguuggugcaucagaggacucacuccggcgagaaacacuacgucugccgagagugugggcgcggauuuagucauaagagcaaccucauccggcaccagagaacacauuga

SEQ ID NO: 65146 - RNA, 1599 nt, Artificial Sequence
  derived and/or modified sequence opt3 from ZNF350__Homo_sapiens__NP_067645
augauccaggcccaagagagcauuacccuggaagacguggcugucgauuucacaugggaggaauggcagcuccuuggcgcagcccagaaggaccuguacagagauguuauguuggagaacuauuccaauuuaguggcgguaggguaccaggcuucuaaacccgacgcccuguuuaagcuagaacaaggagagcagcucuggacuauagaggaugguauccacucaggcgcaugcagugacauuuggaaaguggaucauguccuggaaaggcuucagagcgagucccuggugaaccggcgcaagccuugucacgaacaugacgccuucgagaauaucguucacugcucuaaaucgcaguuuuugcucgggcaaaaccaugauauuuucgaccugcgaggaaagucacugaaaagcaaucucacguuagugaaccagaguaaaggcuaugagaucaaaaauuccgucgaauuuaccgguaacggggauucuuuccugcacgcuaaucacgagcgucuucauacagcaauaaaauuuccagccagccagaaguugaucuccacuaaaucacaguucauuaguccgaagcaccaaaagaccagaaaacuggaaaagcaucacguguguagcgagugcggaaaggcuuuuaucaagaaaucuuggcuaacagaccaccagguaaugcauaccggcgaaaagccccacagguguucccucugcgagaaagccuucucacggaaguuuaugcugacugagcaucagcgcacacacaccggcgaaaagccuuacgaguguccagaaugcgggaaagcguuccuuaagaaaagcagacugaacauucaucaaaagacgcacacuggagagaaacccuauaucuguagugaaugcgguaagggcuuuauacagaaggggaauuugauuguucaccagaggauccauaccggagagaaaccuuacauuuguaacgagugcggcaaggguuucauccagaaaacaugccucaucgcacaccaacgguuccauacugggaagaccccauuuguguguucugaaugcggaaaauccuguagccagaagucgggccugauuaagcaccagcgcauacacacaggcgagaaacccuucgaaugcucugagugugggaaggccuuuuccaccaaacagaaguuaaucguccaucaacgaacgcacacuggagaaagaccuuaugguugcaaugaguguggcaaggcuuucgccuacaugucaugccuggugaagcauaagaggauucacacacgggagaaacaggaagcagcuaagguggagaacccaccggccgaacgucauaguagccuccacaccuccgaugucaugcaggagaaaaauucugcgaacggggccacuacacagguucccagcguggcaccucaaaccucacuuaacaucaguggacuguuggcuaaucgcaacguagugcuagucggccagccagugguuagaugugccgcuuccggugacaauaggggguuugcccaggaccggaaccuggugaaugcagucaacgugguaguucccagcgugauaaauuacguccucuucuaugugacggagaacccuuga

SEQ ID NO: 65147 - RNA, 1818 nt, Artificial Sequence
  derived and/or modified sequence opt3 from ZNF354A__Homo_sapiens__NP_005640
auggccgcuggccagagagaggcaaggccccaagugagccugaccuucgaagacgucgccguucucuuuacacgggaugaguggcgcaaacuugcgccuucccagcgaaaccuguaccgugacgugauguuggaaaauuauagaaacuuaguaucucuggggcuaccauucacuaaaccgaaggugaucucacuccugcagcagggagaggaucccugggaagucgagaaagacgguaguggcgugagcucccuugggucuaagucgucacacaaaacgaccaagagcacacaaacucaggauaguuccuuucagggacugauuuugaagaggucuaaucggaacguuccuugggaccucaaacuggagaagccauacauauaugaaggccgccuggagaaaaagcaggauaaaaaggguagcuuccaaaucguguccgcuacccauaagaaaauucccacaaucgaaagaucacacaagaauaccgagcucagucagaacuuuagcccuaaaucugucuuaauuaggcagcagauccugccacgggagaagacucccccuaaaugcgaaauacaagggaauagucuuaagcagaacucacaguugcugaaucaaccaaaaaucacagccgacaagcgcuacaaguguagccuaugcgagaaaaccuucauuaacacgaguucucuccgaaagcaugagaaaaaucacuccggagaaaagcuguuuaaauguaaggaaugcagcaaggcauucucgcagucuuccgcccuuauccagcaucagauuacucacaccggcgagaaaccguauaucuguaaggagugcggcaaggcuuuuacacugucaacuuccuuguacaagcaccucagaacccauacaguggagaaaagcuauagguguaaggaaugcgggaaguccuucucucggcguagcggacuguuuauacaccagaaaauucaugcagaagagaaccccuguaaguacaauccuggucgcaaagccucaaguugcuccaccagcuuaucuggcugucaaagaauccacucaaggaagaaaaguuaccugugcaacgaaugcgggaauacguucaagagcuccucuucgcuccgguaucaccagcgcauucauacuggagagaagccauuuaaauguagcgagugcggccgagcuuucucccagucagccagucuuauccaacacgaaagaauccauacaggugagaagcccuacagguguaacgaaugcgggaaaggauucaccucuauuagccggcugaaccgccacagaauaauccauacuggcgagaaguuuuauaauuguaacgaaugcggcaaagcguuguccucacacagcacacuaauuauccacgagaggauacauaccggggagaagccuuguaaaugcaagguauguggaaaggcauuccgucagucuuccgcccugauucagcaccagcggaugcauacgggugaacgaccauacaaaugcaaugaguguggcaagaccuuuagaugcaacaguagccucucuaaucaccaaaggauccacacaggggaaaaacccuaucgcugcgaggaguguggaaucuccuucggccagucaagugcucugauucagcaucggagaauccacacuggugaaaagccguuuaaaugcaacaccugugggaagacauucaggcagagcucgucccgcauugcccaucaacgaauacacacuggcgagaagccuuacgaaugcaauaccuguggaaaacuuuuuaaccaucggucuagccugacaaaucacuauaagauccacauugaggaagaucccuga

SEQ ID NO: 65148 - RNA, 1584 nt, Artificial Sequence
  derived and/or modified sequence opt3 from ZNF35__Homo_sapiens__NP_003411
augaccgccgagcugagagaagcuauggcacucgcccccuggggcccugugaaggucaaaaaggaggaagaggaagaggagaacuucccagggcaggcgagcucccaacagguucacucugaaaauaucaaagugugggcuccgguacagggacuucagacaggucuggacggcucagaggaagaggagaaggggcaaaacauuaguugggauauggccguggucuugaaagcaacucaggaagcccccgcugcaagcacguuaggauccuacucucugccuggcacccuagccaagucggagauacucgaaacacaugguacuaugaauuuucugggggcugagaccaagaaccuucagcuguuggugccaaaaacagaaaucugcgaggaggccgaaaagccccucauuaucucagagaggauucagaaagcggacccucaaggaccagaacugggcgaggcaugugaaaagggcaauaugcugaaacggcagcgcaucaagcgagagaagaaagauuuccgucagguuauagugaacgacugccaccuccccgagagcuuuaaggaagaggaaaaucagaaauguaagaaaagugggggaaaguauuccuuaaacucuggugccgucaaaaauccuaagacccaacugggccagaagccauucacuugcagcgugugugggaaaggauuuucccagucagcuaaccuuguaguucaucaaagaauccacacaggcgagaagccguucgaaugccaugagugugguaaagccuuuauucagagugcaaauuuggugguccaccagaggauccacaccgggcagaagcccuacgugugcagcaaauguggaaaggcuuucacgcaaucuuccaaccugacugugcaucagaagauucacucacuagagaaaaccuuuaagugcaaugaaugugagaaagccuucagcuauaguucucagcucgcgcggcaucagaagguccacaucacagaaaaaugcuacgagugcaacgaguguggcaagacuuuuacccgcuccagcaaucugauaguucaccaaaggauucauacaggcgaaaagccuuucgccugcaacgauugugggaaagcauuuacccagucggcuaaccuuaucgugcaccagagaucucauacgggagagaagccauaugaaugcaaagagugugguaaggccuucuccugcuucucacaccugauuguacaucagcggauccacacugcugaaaaacccuacgacuguagugagugcggcaaggccuuuagccaauuguccugucucaucgugcaccagcgcauucauucuggggaucugccuuaugucugcaaugaguguggaaaggcauucacaugcagcucauacuuacugauacaccagcgaauccauaacggcgaaaaaccauauaccugcaaugagugugguaaggccuuuagacagaggaguucccucacugugcaccaacggacacacaccggggaaaaacccuacgagugcgaaaaguguggcgcugcguucauuagcaacucucaucuuaugcgucaccaucgcacgcaccugguugaguga

SEQ ID NO: 65149 - RNA, 1224 nt, Artificial Sequence
  derived and/or modified sequence opt3 from ZNF365__Homo_sapiens__NP_055766
augcagcaaaaggccuucgaggaaagcagauaccccuggcaggaguccuuugaaaacguggcugucugccugccucucagguguccacggugcggcgaccacacccgcuuccgaucucuuucaagucugcgugcacauuuggaguuuagccacuccuaugaagagagaacauuacugacuaaauguucucuauucccgucgcucaaggauacggaccugguuaccucaagcgagcuucugaaacccgggaaguugcagaguuccggaaaugugguaaaacagaagccuucuuacgugaaccucuauagcaucucccaugaacacucaaaggauaggaaaccauuugaggucguggccgaacggcccguuaguuacgugcaaacauauacugcgauggaccugcaugcugauagccuggacgguacccgcucuggcccugggcucccaacauccgauaccaaggccucauucgaggcacacgucagagagaaauuuaauaggaugguggaagccguagaccggacuauugagaagcgcauagauaaauuaacaaaggaacuggcucagaagaccgcagagcuuuuggaaguucgagccgcuuucgugcagcugacgcagaaaaagcaagagguccagagaagggagcgggcccuaaaccgucagguggacguggcggucgaaaugaucgcaguucuccgccagagacugacugagagcgaagaggaacuucugaggaaagaggaggaagugguaaccuuuaaucacuucuuggaggccgcugccgaaaaggaggugcaaggaaaagcacggcuccaggauuuuauugaaaaccuguuacagcgagucgagcuggcugagaagcaacucgaauacuaucagagucagcaggccucuggcuucgugcgcgaccuuuccggucauguucugacagauaucagcucgaauagaaaacccaagugcuugucuagggggcacccucauuccguguguaaccacccagaccuaaaggcgcacuuucauccgaaaggacggaaucaccugaagaaagccaaggacgaucgcgcaucaaugcaacccgcuaaagccauucaugagcaggcugaaaguagcagagaccucugcaggccuccaaagaagggcgagcugcuuggcuucgggcguaaaggaaacauccggcccaagauggccaaaaagaaaccuacugcaauagucaauaucauuuga

SEQ ID NO: 65150 - RNA, 2235 nt, Artificial Sequence
  derived and/or modified sequence opt3 from ZNF366__Homo_sapiens__NP_689838
augcagaaggagaugaaaaugaucaaggacgaagaugugcacuucgaccuggccgucaaaaagacccccagcuuuccucauugccuccaaccaguugcuuccagaggcaaagcaccgcagaggcaccccuucccugaggcccuucgggggccauuuucucaguuccgcuacgaacccccuccaggagaucuggacgguuuucccggcguguucgagggggcgggaucacgaaagcguaagaguaugccuacaaaaaugccauauaaccauccggcugaagagguaacuuuggccuuacacagcgaggaaaauaagaaccauggccugcccaaucuaccucuccuguuuccacagcccccuagaccaaaauacgauucccaaaugauugaccuuuguaacguggguuuccaguuuuauaggucucuggagcacuucgggggaaagcccgucaaacaggaaccgauaaagccuucggcaguguggccccagccaacgccuacccccuuuuugccaacacccuacccuuauuacccaaagguucacccgggccucauguuccccuuuuucgugccuucaagcaguccauuccccuuuucccggcauacuuuccugccuaaacaaccacccgagccgcugcucccucgcaaggccgagccacaggaaucugaggaaaccaaacagaaggucgagagaguggauguaaauguucagaucgacgauagcuauuacguggacgucggcgggucccaaaagagguggcagugccccacaugugaaaagucauacaccaguaaauauaacuuagugacucacauucugggacauagcgguaucaagccucacgcuugcacacacuguggcaaacuuuuuaaacaguugucucaucugcacacccauaugcuaacgcaccaagggacucggccccauaagugccaggugugucacaaagcauucacccagacaucccaccucaagcgccauaugaugcagcacucagaggucaaaccacauaauugccgaguuuguggaagaggcuuugccuacccuagcgagcugaaggcucacgaagccaagcacgcgagugguagggagaacauuugcguggaaugugggcuugauuuccccacucuggcacaauugaaacggcaucucaccacacaccguggaccaauccaguauaauugcucugagugcgacaagaccuuucaguacccgucccagcugcaaaaccauaugaugaaacacaaggauauacgcccuuauaucuguagcgaaugcggcauggaguucguacagccccaucacuuaaaacagcacucgcugacgcauaagggcgugaaggagcacaaaugugggauuugcggaagagaauuuacucuccuugccaauaugaagaggcauguccugauccacacaaacauucgggcuuaccagugucauuugugcuauaaaucuuucgugcaaaagcagacccuaaaagcccacaugaucguucacuccgacgugaagccauuuaaguguaaacugugcgguaaggaguucaaucgaaugcauaaccucaugggccacaugcaucugcacucagacaguaaacccuuuaagugucuuuacugcccuagcaaauucacucugaaggggaauuugacacgccacaugaaagucaagcauggagugauggaaagaggccuccacucccagggucuggggaggggccggauagcauuagcucagaccgccggaguacugcgcucucuagagcaagaggaaccauucgaucucagccagaagagaagggcgaaaguucccguguuucagucagacggcgagagugcccaagggucccauugucacgaagaggaagaggaggauaacugcuacgaagucgagccuuauagcccgggacuggcaccacagucucagcagcuuugcacgcccgaagacuugucaaccaagagugagcaugcuccugaagugcuggaggaggccuguaaagaagagaaggaagaugcuagcaaaggugagugggaaaagcguuccaagggcgaccucggggccgagggaggccaagagcgggauugcgcaggucgagacgaaugucugucucuuagagccuuccagucgacaaggcgcgggccauccuuuagcgauuaccuguauuucaaacaccgggacgagucauugaaggaacuccuggagagaaaaauggaaaagcaggcugucuuacugggcauuuga

SEQ ID NO: 65151 - RNA, 1053 nt, Artificial Sequence
  derived and/or modified sequence opt3 from ZNF367__Homo_sapiens__NP_710162
augaucagaggcuucgaggcccccauggcugaaaacccuccaccgcccccuccacccgugauauuuugccacgacagcccuaagaggguccugguuuccgugauucggaccacaccaaucaaacccacuugugggggagguggcgagccugaaccaccgcccccucucauuccaacgucucccggguucucagauuuuaugguauacccuuggcgcuggggagagaaugcacauaacgugacccuuaguccaggcgccgcgggugcugccgcaagcgccgcucugcccgcagccgcugccgcggaacacuccggguugcgaggacguggcgcaccgccucccgccgcuucugccucggcagcugccucaggcggggaggacgaggaagaggcgagcaguccagauuccggacauuuaaaggacgguaucagaaggggccggccucgcgccgauacagucagagaccugauuaaugaaggggagcacucuagcuccaggauccggugcaacauauguaaucgcguguucccccgagagaaaucacuacaggcacauaagagaacucacaccggagaaaggccauaucucugcgauuaccccgacuguggcaaggcuuuuguucaaaguggucagcugaaaacacaccagcggcuucauaccggggagaagccuuucgugugcagcgaaaacggaugucugucucguuuuacucacgccaaucgccauugcccaaaacacccguaugcuagauugaagagggaggaacccacagauacccucuccaaacaccaggccgcagacaacaaggccgcugcggaguggcuggcacgguacugggagaugcgagaacaacgcacgccuacucugaaaggcaagcucguccagaaggccgaucaggagcagcaagacccauuagaauaucugcagucagaugaggaagacgacgagaaaagaggcgcucagaggcggcuucaggagcaacgcgaaagauugcauggggcccuggcacuaaucgagcucgccaaucugaccggagcuccccuuaggcaguga

SEQ ID NO: 65152 - RNA, 1650 nt, Artificial Sequence
  derived and/or modified sequence opt3 from ZNF382__Homo_sapiens__NP_001243767
augagccagggcuccgugucuuucaaggacgucaccguugauuuuacacaagaggaauggcagcagcuggaccccgcccagaaagcucucuacagagaugugaugcuugagaacuauugccacuucguaucagugggguuucauauggcaaagccugacaugaucaggaaacuggaacaaggagaggaauuguggacucagcggauuuucccaaguuacagcuauuuagaggaggaugguaagacggaagacguccuggugaaauuuaaggaguaccaggaucgccacucccgaccgcuaauauucaucaaucauaagaaacucauuaaggaacguucuaacaucuauggcaaaaccuuuacacuggggaagaauagaauuucgaaaacuauccuuugugaguacaagcccgacggaaagguucugaaaaacauaucagaguuggugaucaggaauauuagcccuaucaaggaaaaauucggcgauaguaccgguugggagaagucccuccugaacacaaaacacgaaaagauucauccagccgucaaucugcacaaacagaccgagcgggugcucucugggaagcaagaauuaauccagcaccagaagguacaggcgcccgagcaaccuuuugaccauaacgagugcgaaaagagcuuccugaugaaaggaaugcuuuuuacucacacacgcgcucauagaggcgagaggaccuucgaauauaauaaagauggcauagccuuuauugagaaguccucauugaguguucacccaagcaaccugauggagaaaaagcccucugcauacaauaaguacgggaaauuccuaugucggaagccuguguucaucaugccacagcgcccgcagacggaagagaaacccuuucacugcccuuauuguggaaacaauuuccgaagaaaguccuaccucauugaacaucaaaggauccacacuggugagaaaccauaugucugcaaccaguguggcaaggccuuucggcagaagaccgcucugacacuucaugagaaaacucacaucgaagggaagcccuucauuugcauagacuguggaaaaucauuucgucagaaggcaacccugacacgccaucacaaaacccacacgggcgaaaaggccuacgagugcccucaaugugguagcgcuuucagaaagaaaaguuauuugaucgaucaucagaggacucacacaggggagaagccauaccagugcaaugaaugcggaaaagccuuuauucagaagaccacucucacagugcaucaacggacccacacgggcgagaaacccuauaucuguaacgaaugcggcaagucuuucugucagaaaaccacacugacuuuacaccagcgaauacauaccggggagaagccguacauuugcaacgaguguggaaaguccuuucgccagaaagcgauccugacagugcaccauagaauccacacuggugaaaagagcaauggcugcccucaaugugggaaagcauucucgaggaagucuaaccucauucggcaucagaaaacccacacaggagagaagcccuacgaaugcaagcaguguggcaaauuuuucuccugcaagucaaaucuuaucguccaccagaaaacccauaagguugagacuacggguauucaauga

SEQ ID NO: 65153 - RNA, 1428 nt, Artificial Sequence
  derived and/or modified sequence opt3 from ZNF383__Homo_sapiens__XP_011524892
auggccgagggcagcgugauguucuccgacgucucuaucgauuuuucacaggaagagugggacugccuggaucccguucaaagagaccucuacagggaugugaugcuugaaaacuaugggaaucugguaaguaugggauuguacaccccuaagccacaggugauuagcuuacuggagcaggguaaagaaccguggauggucggccgggagcuaacacgcgggcucuguuccgaccuggagucuaugugcgaaacuaagcugcugucguugaaaaaggagguguaugaaauagagcucugucagcgagagaucaugggacugacgaaacacggccuggaauacagcucauucggugauguucucgaguaucguagucauuuagcuaagcaacugggguaccccaacggacacuuuucccaggaaauuuucaccccugaguauaugccaacauuuauccagcagacuuuccuuaccuugcaucaaauuaucaauaacgaagacagacccuacgagugcaagaaauguggcaaggcauuuucucagaauagccaguucauacagcaccaaaggauccauauuggcgagaaauccuacgaaugcaaggagugugggaaauuuuucucaugcggaagucacgugacacggcaccugaagauccauaccggugaaaagccuuuugaguguaaagaaugcggcaaggccuucagcuguucuuccuaucuaucacagcaccagcgcauucauacugggaaaaagccauacgagugcaaagagugcggaaaggcguuuagcuauuguaguaaccucaucgaucaccaaagaauacacacaggcgaaaaacccuacgagugcaaggucugugguaaggcuuucaccaaaucuucccagcuguuccagcaugccaggauucacacgggggaaaagccuuaugagugcaaagaauguggaaaggcauuuacucagagcucgaaacuugugcaacaucagcggauccacaccggcgagaagccauacgagugcaaggaauguggcaaagccuucucuuccgggucagcucugacaaaucaucagcgcauucacacuggagagaagccguaugacugcaaagaaugugguaaggcauuuacccagaguagccaauugcgacagcaccagagaauccaugccggcgagaaacccuucgagugccucgaaugugggaaggcuuuuacacagaacucccaacuguuccagcaccagaggauccauaccgaugagaagccuuacgaaugcaaugagugcggaaaagccuuuaacaaguguucuaauuuaacgcggcaccuucguauucacacuggcgaaaaaccauacaacugcaaggagugugguaaagcguucagcucagggagugaccucauacgccaucagggcauccacacaaauaaguga

SEQ ID NO: 65154 - RNA, 1386 nt, Artificial Sequence
  derived and/or modified sequence opt3 from ZNF384__Homo_sapiens__NP_001035009
auggaggaaagccacuucaacuccaaucccuacuuuuggccuucuaucccaaccgugucaggccagauugagaacacaauguucauaaauaagaugaaagaccaacugcucccggaaaaggggugcggacuugcucccccucauuauccaacucuguugacgguccccgccaguguuagcuuaccuuccgguaucucuauggauaccgagucgaaaucagaccagcugacaccacacagccaggcaagugugacucagaacauuaccguagugcccgucccuuccacaggccuaaugaccgccgcgcuccaagugguuccagaucugucuaagaaaguggcuagcacucuuacagaagaagggggaggcggugggggaggcggcggguccgucgccccgaagcccccuagaggaaggaagaaaaagcggaugcuggagucagguuugccagagaugaaugaccccuacgugcucaguccugaggaugacgaugaccaucagaaagauggcaagaccuaucgcugucgaaugugcagccugacguuuuacucuaaauccgaaaugcagauccacucaaagagccauacugagaccaagccacacaaauguccccacugcaguaagacauucgcaaacucuuccuaucuggcccagcauauucguauccacagcggggcuaaaccguacucguguaauuuuugcgagaagucuuucagacaacucucccauuuacagcagcacacuaggauacacaccggagaccggccuuauaaaugugcacaucccggcugcgaaaaggccuuuacacagcugucaaaccuucaaagucaccgcagacagcauaauaaagauaagccauucaagugucacaacugccauagggcuuacaccgacgccgcgagcuuggagguacaccuguccacgcacacuguuaaacaugcaaagguguacacauguaccaucugcucucgggccuauacuagcgaaacauaccuaaugaaacacaugcgcaagcauaauccucccgaucuccagcaacagguccaggcugccgcagcugccgcggccguggcacaggcucaagcccaggcucaggcccaggcacaagcccaggcucaggcgcaggcacaagcccaggcuucacaggccagucagcaacagcagcaacagcagcagcaacagcagcagcaacagcagcagccacccccucacuuucaauccccaggugcagccccgcaagggggaggcggcggggacagcaaccccaauccuccaccccagugcucuuucgaccugaccccuuauaaaacggcugagcaccauaaggauauuugucuuaccgugacaacuucaaccauccaggucgaacaccuggccaguagcuga

SEQ ID NO: 65155 - RNA, 1161 nt, Artificial Sequence
  derived and/or modified sequence opt3 from ZNF385A__Homo_sapiens__NP_001124439
augauccugggcagccucuccagagccgggccccuuccucuguugaggcagccaccgauuaugcaacccccuuuagaccugaagcagauacuaccauucccccucgagccugcuccaacccugggacuguuuucuaacuacucaacaauggaucccgugcagaaagcaguccuuagucacacuuucgguggcccuuugcucaagacgaaacggccaguuaucagcugcaauauuugucagauccgcuuuaacucccaaucucaggccgaagcgcauuauaaggggaaucgacacgcucguagagugaaaggaauugaggccgcaaagaccaggggccgggaaccggguguacgcgagcccggggacccugccccacccggaucgacaccuacuaacggcgauggcguggcuccaagacccgucucaauggaaaaugggcugggaccggcaccugguagccccgagaagcagccaggcaguccuucucccccauccauccccgagaccgggcagggagugacaaaaggcgaaggugggaccccugccccagcuagccugccgggaggcuccaaggaggaagaggagaaagccaagaggcucuuauacugcgcgcuguguaaaguugcagugaacucacuuagucaauuggaagcccauaauaagggcacuaagcacaaaacaauacuggaggcucggagcgggcuaggacccaucaaggccuauccucgccucgguccacccaccccuggcgaaccagaggcacccgcucaggaccgaacguuccauugcgaaauuuguaacgucaaaguaaauucugaggugcagcugaagcagcacaucuccucaagaaggcaccgggaugggguugccggaaaaccgaacccucuucugagccgucauaagaaaagucgcggcgcgggugaguuggccgggacucucaccuuuucuaaggaacugccaaaguccuuagcaggcggacugcuccccagcccucuugcuguggccgcugucauggccgcagccgcuggcucgccccugucuuugagaccagcgccugcagcuccccuacugcaagggccaccgauuacacacccucuccugcaucccgccccaggacccaucaggacugcccacgguccuauacuuuucuccccauacuga

SEQ ID NO: 65156 - RNA, 1188 nt, Artificial Sequence
  derived and/or modified sequence opt3 from ZNF385B__Homo_sapiens__NP_001106868
auguggagcggccugcccuccagagggucuaccugccacacaacuacgcucccugcccuugugaggaccccaacacugaugaugcagccgucauuggacaucaagcccuucaugaguuuuccugucgauagcuccucugcuguuggauuauucccaaacuuuaauacuauggaccccgugcaaaaagcaguaauuaaccauaccuucggugugucgauaccuccaaagaaaaagcaggucaucucauguaaugugugccagcugcgguuuaacagcgauagucaggccgaggcgcacuacaaaggcuccaagcaugcuaagaaaguuaaggcccuagacgcaaccaaaaauaagcccaaaauggugccuucuaaggauagcgccaaggcuaacccauccuguucaauuacaccgaucacugggaauaacagugacaaaagcgaagauaagggaaaacucaaggcaucuuccucaagccaacccaguucuuccgagagcggcucguuccugcuuaaaucugguacaaccccucugccacccggggccgcuacguccccuucaaagaguacuaauggagccccaggcaccgucguggaaagcgaggaagagaaagcgaagaaguugcucuauugcucccuguguaaaguagcaguuaacucucugagccagcucgaggcccacaauacaggcucaaagcauaaaacuaugguggaagcucgcaacggggccggacccauuaagaguuacccgcgaccugguucccguuuaaaaaugcagaauggcagcaaggggucuggacugcagaacaagaccuuucacugcgagaucugugacguccacgucaauucagaaauacaacuuaaacagcauaucaguagcagaaggcacaaggaucggguggcaggcaaacccuugaagccaaaauauuccccuuacaacaagcugcagcgcucucccucgauucuagcugccaagcucgcguuccagaaagacaugaugaagccacuggcccccgcauuucuuagcuccccucuggcugccgcugccgcagugucaagugccuugucucucccaccgagacccagcgcuucccuguuccaagcgccugcaaucccacccgccuuacugaggccuggucaugggccaauucgggcuacacccgccucaauccucuuugcaccguauuga

SEQ ID NO: 65157 - RNA, 1188 nt, Artificial Sequence
  derived and/or modified sequence opt3 from ZNF385D__Homo_sapiens__NP_078973
augagaaacaucauguacuucggcgggaccugccagagccccgcccugccugcucucgugaggccaccggcacccccucuucaaccaucccuggacauuaagcccuuuuugccuuucccauuagauacagccgcggcugucaaucuguuucccaacuucaaugccauggacccuauacagaaagcaguuaucaaccacacuuuuggagugccacuaccgcaucggcgcaagcagauuaucucuuguaauauuugccagcuccgauucaacucagauagucaagccgcugcacacuauaaagguacgaagcaugccaaaaagcugaaggcucuugaggccaugaaaaauaagcagaaaagcguaaccgcgaaggacuccgcaaaaacaacuuuuaccucuaucacaaccaacacuauaaauacaucgucagauaagaccgacggcacggccgggacucccgcuaucagcaccacaacuaccguggaaauucguaagaguuccgucaugacaaccgagaucacgucuaaaguggaaaagagcccuacuacagccaccggaaacuccucauguccaaguacugagacagaagaggagaaagcaaagagacuguuguacugcagccucuguaaaguugcugucaauucugccucccagcuggaagcgcacaacucaggcaccaagcauaaaacgaugcuggaggccaggaaugguagcgggaccauuaaggcauucccccgggcuggagugaagggcaaaggcccugugaacaaggggaauacaggacuccagaacaaaacuuuucacugcgaaaucugugauguacacguuaacagugagacccaauuaaagcagcauauaucuucccgcagacacaaagacagggccgcugguaagccacccaagccgaaauauagcccuuacaauaagcugcagaaaacagcccauccccuuggcgugaaguuggucuucucgaaagagccaucuaagccucuggcaccccggauucuaccaaacccccucgccgcugcggcagccgcugccgcaguggccguguccucaccuuuuagucugcgcacugcuccagccgcaacccuuuuccagacaagcgcgcugccgcccgcuuugcuccgaccugccccagggcccaucagaaccgcacacacuccuguccuguuugccccauauuga

SEQ ID NO: 65158 - RNA, 1077 nt, Artificial Sequence
  derived and/or modified sequence opt3 from ZNF391__Homo_sapiens__XP_011512871
auggagagccugagaggcaacaccgcccaggggcccacaaaugaagaggacuacaagaacgaaggacaacucuccaggcagacuaaaugcccugcucagaagaaaucuucauucgagaauacggugguccggaagguuagugugacccuuaaagaaaucuuuacaggugaggagggcccagaaagcuccgaguucucucugucgccgaacuuggaugcacagcaaaagauucccaaggggcacggaucaccuauaagccgcaaaaauaguaaggacaacuccgauuuaaucaaacaucagcgacuguuuucucagcguaagccauguaaaugcaaugaaugugagaaggccuucagcuaucaguccgaccuacucguacacucaaggauucauggcggugagaagcccuuugaaugcaacaaaugugggaagaguuucagcagaucuacucaccugaucgagcaucaacggacccacacaggagaaaaaccuuacgagugcaaugaauguggcaaggcguuuucccgcucaacccaccuuagccugcaucagaggauucacacuggcgagaaaccauaugagugcagugaaugugggaaggcuuucucuagauccacaaacuugagccagcaucagcggacccacacgcaagagcgccccuacaaaugcaaugaauguggaaaggccuuuggugaucgaucgacuaucauacagcaccagagaauccauaccggcgagaacccuuaugaaugcucuaagugcgggaaagcauucuccuggauuucaagucucacagagcaccaaaggacucauaccggagagaauccauacgaauguagcgagugcggcaagguguuuucccggucuagcucacugacagaacaccagcguauccauaguggugagaaaccgcacgaaugucgcgucugcgggaagggauucuccagaucuagcucacugauuauccaccagaggacccauacgggcgagaaacccuauaaguguaacgacugcggcaaggccuuuugucagaguagcacucucauacggcaccaacauuuacacacaaaagaguga

SEQ ID NO: 65159 - RNA, 1542 nt, Artificial Sequence
  derived and/or modified sequence opt3 from ZNF395__Homo_sapiens__NP_061130
auggccagcgugcuguccagaaggcucggcaaacggucucuucugggggcucgcgucuugggacccucagcaagugaggguccuagcgccgcgccaccguccgaacccuuacuggagggcgcugccccucagccauucaccacaucugacgauacucccugccaagaacagccuaaagagguucuaaaggcaccaucgacgucagggcuccaacagguggccuuucagcccggacagaaaguauacgugugguauggcggucaggaaugcaccgggcuggucgagcagcacagcuggauggagggacaagugacaguuuggcuucuggaacagaagcuccaggugugcugucgagucgaggaagugugguuggcugagcugcagggcccuugcccacaagcaccgccccuggagccuggcgcccaggcucucgccuaccguccaguaaguagaaacaucgacguucccaaaaggaaguccgaugcgguggaaauggacgagaugauggcagccauggucuuaacuucucugagcuguuccccuguggugcagucaccacccgggaccgaagcuaauuucagugccagccgggcagcuugcgauccguggaaggagucuggagacauuuccgauucagguagcaguacaaccucuggccauugguccgggagcucgggagucucuacuccuuccccaccacacccucaagccucacccaaauaucuuggcgacgcguuugguaguccacagacagaucauggguucgaaaccgaccccgaucccuuuuugcuggacgagccagccccgcgcaagaggaaaaacagcguuaaggugauguacaaaugucuauggcccaauugcggaaagguacucagauccauagugggcaucaagcggcacgucaaagcacugcaucuuggcgauacgguggacucugaccaguucaagcgcgaggaagauuuuuauuacacugagguucagcugaaagaagagagcgcugccgcugccgcagccgcugcggcagggaccccugugccaggaacacccacuucagaaccugccccaacccccaguaugacagguuugccgcucuccgcucugccuccacccuuacacaaggcccaaagcucuggcccugagcaccccgggccagagucaagucugccuagcggagcacucuccaaaucugcccccggcucguucuggcauauucaggcugaccacgccuaucaggcacuucccagcuuucagaucccggucuccccucauauuuacaccucagugaguugggcggcugcccccucugcagccuguagccuguccccaguacgaucaaggagcuugucuuucuccgaaccccaacagccugcuccagccaugaagagucaccuaaucguuacgagcccuccuagagcacagucuggugcucggaaagcccguggggaggcgaagaagugccgcaaaguguacggcauagaacacagagaucagugguguacugccuguagguggaagaaggcuugccaacgguuucuggacuga

SEQ ID NO: 65160 - RNA, 1416 nt, Artificial Sequence
  derived and/or modified sequence opt3 from ZNF398__Homo_sapiens__NP_065832
augaagggcaacuacgagagccugaucuccauggacuaugccauuaaucagcccgaugugcucucucaaauacagccugaaggggagcacaacaccgaagaccaggcuggaccagaggaaucagagaucccgacagaucccagugaggaaccugguauuagcacuuccgacauccuuucuuggauuaaacaggaggaggaaccacaagucggcgcacccccugagucgaaggaaucagauguuuacaaaagcacguaugccgacgaggaacuggugaucaaggcggagggguuggcuagaaguuccuuaugcccagaaguacccgugccuuucucuagcccaccggccgcagccaaagaugcuuuuuccgacgucgcauucaagucacagcagaguaccagcaugacacccuuuggaaggccugccacugaucugccagaggcuucugagggccaggugaccuucacacaacuagguuccuacccccucccuccacccguuggggaacagguguuuucaugucaucacugcggaaagaaucugagccaggacaugcuucugacccaucaguguagucacgccacugagcauccguugccuugcgcgcaaugucccaaacacuucacaccacaggcagaucucucuuccaccagccaggaccacgccucggaaacgccucccacuugcccacauugugcucggaccuuuacacaccccucucgccugacuuaucaucugcgaguccacaacuccaccgagcguccuuucccaugcccggauugucccaagagauuugccgaccaagcaaggcucacaucacaccggcgcgcucaugccagugaaagaccuuucaggugcgcgcaguguggccggagcuuuuccuuaaaaauaucucugcuuuugcaccagcgcggccaugcccaggagcgaccauucagcugcccccaaugcgggaucgacuuuaauggacacucagcacugauuagacaucagaugauccacaccggugagaggccuuacccauguacggauugcaguaaguccuucaugcggaaagaacaccuacucaaccaucgucgccugcacacuggcgagagacccuucagcuguccgcauugcgggaagucuuuuauuaggaagcaccaccuuaugaaacaucagcggauccacacaggagaacgaccuuauccauguucauacugcggccgcaguuucagauacaagcagacccugaaagaccauuugaggagcggucacaaugggggauguggcggcgauuccgaccccucugggcaaccucccaacccaccuggaccccucauaacuggucuggagacaucgggcuuaggggugaauaccgaaggacuggagacgaaccagugguauggcgaggguagcgggggcggaguacucuga

SEQ ID NO: 65161 - RNA, 5448 nt, Artificial Sequence
  derived and/or modified sequence opt3 from ZNF407__Homo_sapiens__NP_001139661
augauggacagcgagaacaagcccgaaaaugaugaggacgagaagaucaacaaggaggcacaggaucugaccaaacucuccucucacaaugaagacggcgggccugugucagaugucauugcuaguuucccagagaacagcaugggaaagcgggguuuuuccgagucuagcaauucagacagcguugugauaggcgaagauaggaacaaacaugcaaguaagcggcgcaaacuugacgaggcagaaccgcugaaauccgggaagcaaggaaucugccgauuggagacaucugagagcuccguaacugaaggcgguauugcguuagaugagacggggaaagaaaccuuccugucagacuguacagugggaggcacuugccugcccaaugcucucaguccuagcuguaacuuuucuaccaucgaugucgugucccugaagacagacaccgagaaaacuucagcccaggaaaugguuagccuugaucuggagcgugagaguccauuucccccuaaggaaauuucuguguccugcacaaucggcaaugucgacaccguguugaaguguagcauaugcgggcaccucuucucgucuuguuccgaccuggagaaacaugcagaaucacacaugcagcagccaaaggagcauacgugcugucacugcagucacaaagccgaaagcuccucugcucugcauaugcacaucaagcaagcacauggaccccagaaaguauucagcugugaucucugcgguuuucagugcucagaggagaacuuacugaaugcccacuaccuuggcaagacucacuugagaaggcagaaccuggcugccagaggcggguucguucaaauucuaaccaaacagccuuuuccaaagaagagucgcacaauggcgacuaaaaaugugcauuccaagccgagaaccagcaaaucuaucgcaaagaacucagacaguaaagggcucaggaaugucgguagcacauucaaggauuuucggggguccauuucuaagcagucgggaagcuccucagaacugcuuguggagaugaugcccagucgcaacacccugucucaggaaguggagaucgucgaggaacacguuacgagcuugggccucgcccaaaacccugagaaucagucccgaaaacuggacacuuuagugacaucagaaggccugcucgagaaacuugaaagcaccaaaaacacucugcaggcugcccauggaaauucuguaacauccagaccaaggcccgagcggaacauauuggugcuaggaaauaguuuccgucgcagaagcucuaccuuuacgcugaagggucaagccaagaagagguucaaccuccugggcauuaagcgggggaccuccgagacacagcgaauguauaugaaacaccuucgcacucagaugaagacccaugaugcugaaucaguccugaaacacuuggaggccuguaguagcgugcagagaguuugcgugacaacuucggaaacccaagaggcggaacagggacagggcuccgccaggccuccagacucuggucuccacagccugacagucaagcccgcaucagggagucagaccuuaugugcuugcacugauuguggccaaguggccacgaaucggacagaccuggagauccauguaaaacgcugccacgcuagagagaugaaguucuacuguaggaccugcgauuuuuccucuaugagccgucgggaccuagaugaacaucuccacuccaaccagcaccagcagacugccucaguucugagcugucaaugcuguaguuucauuucucuugacgagaucaauuugcgagaccauaugaaggaaaaacacaacaugcauuuucugugcaccccgugcaaucucuucuuucuguccgagaaggauguggaagaacacaaagcaacagagaagcauaucaacagccuuguccagccuaaaacccugcagucgucaaauucugacuuggugcuccagacucugcccuuaaguacacuggaauccgagaacgccaaggaaagcauggaugacucuggaaaagcuagccaagaggaaccacuaaaguccagagucucacacggcaaugaggugaggcacaguagcaagccucaguuccaguguaaaaagugcuuuuauaaaacgagaucuuccaccguucucacucggcauauuaagcugagacacgggcaagauuaccauuuccuuuguaaagcgugcaacuuguauucacugaguaaggagggaauggaaaagcacauaaaaaggagcaagcaucucgagaacgccaaaaagaauaacaucggucuguccuuugaagaguguauugagcgcgugugcaucggcgccaaugacaaaaaggaagaguucgauguaucugggaacggacgaauagaaggccacauugguguccaguuacaggagcacucguaccuggaaaaggggaugcuugcuagcgaggaguugucacaguccggcggaaguacaaaagacgaugaacucgccucuaccacaacucccaagcggggccguccaaaagggaauaucagcagaaccuguucccauugcggacugcuagcaucaucuaucacgaaccugaccgugcacauuaggcgcaagcauagccaccaauauaguuaccucuguaaaguuugcaaguacuauacagugacuaagggugacauggagcggcacugugccaccaaaaagcauaaaggcagagucgaaaucgaggcuuccgggaagcacagcucugauauuauagugggacccgaaggcgguucacuggaggccgggaaaaagaaugcaggcuccgcgguaacaaugagugacgagcaugcuaacaaaccugccgaaagcccaacuucggugcuugagaagccggauaggggaaauucuaucgaagcagagguugaaaacgucuuucacuccuuggacggcgaggugaauagccaucuguuagacaagaaagagcagauuucaagugaacccgaggauuucgcccagccuggggacguguacucucagcgagaugucaccggaacgggcgaaaacaagugccuccacugcgaguuuuccgcucacagcucagccagucuggagcuucauguuaaacgcaagcacacaaaagaguucgaguucuauuguauggcaugcgacuacuaugcugugacccggagagaaaugacuaggcaugccgcgacagagaagcacaagaugaaacgucaaagcuaccuaaauuccgccaacguggaagcugguucugcagauaugagcaagaauaucaucaugccagaggaggaacaccagcagaacuccgaggaauuucagauuauaucagggcaacccucugacaccuugaaaagucgcaacgccgcugauuguucgauccucaaugagaacacuaaucuggacaugagcaagguacuaugcgccgcagauuccgucgaaguggagaccgaggaagagucuaacuucaaugaagaccauucauuuugugagacauuccagcaggcgccuguuaaagauaaggugcggaagccagaagagaugaugagccugacgauguccaguaacuauggaucucccagcagauuucaaaaugagaacucaggcuccagugcccucaauugcgaaaccgcuaaaaagaaccacgagauuagcaaugacgccggugaacugaggguccauugugagggcgaagggggaaacgcaggcgaugggggaggcgugguuccgcaccgacaucuuugcccugugacuuuggacggugaacggucugcugaguccccaguacuggucgugacacgcaucaccagagaacaggggaauuuagagucaggaggccagaacaggguggcccggggucacggccucgaagaccugaaagggguccaggaggaucccguucuuggaaauaaggagauucugaugaacagccaacacgaaacagaguucauccuagaagaggacggcccugcaucggauucuacuguggaaaguuccgacguauacgagaccauaaucagcauugaugacaaagggcaggccauguacucauuuggacgauucgauuccucuaucauuagaaucaagaaccccgaggacggcgaacucauagaucagagcgaggaaggucugauugcuacgggggugcgcaucagugaguugccacugaaggacugugcgcagggagucaaaaagaaaaaguccgaaggcagcucuauuggugagucaacaaggauccguugcgaugacuguggcuuuuuagccgacgggcucaguggacugaaugugcauauagcaaugaaacacccuaccaaggagaagcauuuccacugccuucugugcggcaaauccuuuuauacugaaagcaacuugcaccaacaucucgcuucugccgggcacaugcggaaugagcaggccucgguugaggaacugcccgagggaggcgcuaccuucaagugugugaaaugcacagaaccauuugauucagagcagaaccuauuccugcauaucaagggucagcacgaggaacuucucagagaagucaauaaauacauuguggaggacacugagcaaaucaacagggaacgcgaggaaaaucaggggaacguuuguaaguauugcggaaaaaugugucgaagcuccaauaguauggcauuccuggcccauauuagaacccacacaggcucuaagccguuuaagugcaaaaucugucacuucgcgacggcucaguugggcgaugcccggaaccaugugaagaggcaccuggggaugcgcgaguacaaaugccaugucuguggaguagcauuugugaugaagaaacacuuaaauacccaucuccuggguaagcacggcguugggacuccuaaggaacguaaauucacaugccaccuuugugaccgcucguuuaccgagaagugggcccugaacaaucauaugaaauugcacacuggagagaagcccuucaaaugcacauggccaaccugccauuauuccuuucucacggcuucagcaaugaaggaucacuaccggacucacaccggcgaaaagaguuuccugugugaccuaugcgguuuugccgggggaacaaggcaugcgcugaccaaacaccgccgacagcauacuggcgagaagcccuucaaaugugaugaaugcaacuuugcuucuacaacccaaagccaccuuacaagacauaagcgggugcacacuggcgagaaaccuuauagguguccauggugcgacuaccgcuccaauugugccgaaaacauaagaaagcacauucuccauaccgggaagcacgagggagucaaaauguacaauugccccaagugugauuaugguacgaacgugccuguagaguucaggaaccaucugaaagaacagcacccggacaucgagaauccagauuuggcauacuuacacgccggcaaggggcagaaacuguga

SEQ ID NO: 65162 - RNA, 1551 nt, Artificial Sequence
  derived and/or modified sequence opt3 from ZNF410__Homo_sapiens__NP_001229853
augcugagcgacgagcucgaauccaagcccgagcuucuggugcaguucguccaaaacaccucuaucccuuugggccagggguuaguugaaucagaggccaaagauauuacaugccugagucuacucccagugacugaagcuagcgaguguuccagacugaugcuuccggagcccguaccuuggagggaagaggacggaaagucugguugcucggaucugaaugacacgaccaaccacucaaauagcaguaaagaagugccauccucugcagucuugcggagccuccgcgugaacguuggccccgauggggaggagacacgagcccagacugugcagaaguccccugaauuucugucaaccagugagucuucuucccugcuccaagacuuacagccaucagauagcacaaguuucauacugcuuaauuugacccgugcgggacugggcagcuccgcugaacaucuagucuuugugcaggacgaggccgaagauagcgguaacgacuuccucucgucugaguccacugauucaaguauccccugguuucugagaguacaggagcuugcacacgacagccugauugccgcuacaagggcacaauuggccaaaaaugcuaagaccuccucuaacggggaaaauguucaucucggaagcggcgauggccagucaaaggacagugggccucugccacagguggagaaaaaguuaaaauguacggucgaaggaugcgaccggacuuucguguggccggcccacuuuaaguaccaucugaaaacccaccgcaacgauagauccuucaucugucccgcggaggguugcggcaagagcuuuuaugugcuccagaggcuuaagguccacaugcggacacauaauggggaaaaaccuuucaugugucacgagucuggaugcggcaagcaauuuacuaccgcagguaaccugaaaaaucaucgccgaauccacacaggggagaagccauucuugugugaagcccagggaugcggcagaucauuugcugaguacaguagccuaaggaaacaccugguugugcauuccggcgaaaagccccaccagugucaaguaugcgggaaaaccuucucucagucgggaagccggaacgugcauaugcguaagcaccaucuccagcugggugccgcaggcucccaggagcaagaacagacggcugagccucuuauggggucaagucuguuggaggaagccucugucccaagcaagaaucucguguccaugaacucacagcccagccugggaggcgagucuuuaaaccugccgaauacuaacuccauucuagguguugacgaugaagugcucgcggaggggaguccucgcagccugucuuccguccccgacgugacacaccaccuuguaaccaugcagucaggcagacaaaguuaugagguuagcguguugacugccgucaauccacaggaaucgcuggcaccucuccccaggcuggagugcuccggagcuuucucugcccauuguaaccuuugccugccaggcagcucagauagucccgcuuccgccucuuga

SEQ ID NO: 65163 - RNA, 1668 nt, Artificial Sequence
  derived and/or modified sequence opt3 from ZNF415__Homo_sapiens__NP_001129510
auggacggcgaugggcugaccuucagagacguggccaucgaguuuagccaggaugaauggaagugccucaacuccacacaaaggacucuuuaccgggacgucaugcuggagaauuaucgcaacuugguuucuuuagaucugucacgaaauugugugauuaaagaacuagcuccccagcaggagggaaacccuggugaaguauuccacacggugacccucgagcagcaugagaagcacgacauagaagaguuuugcuuccgugaaaucaaaaagaaaauucaugauuuugacugucaauggagagaugacgagaggaauugcaacaaggucacaacugcaccaaaggagaaucugaccugucggcgcgaucagagagacaggcggggcaucgggaacaaaaguauuaagcaccagcuuggacugagcuucuugccgcauccccacgaacuccagcaauuucaggccgagggcaaaaucuacgaaugcaaucacguggagaaguccguuaaccaugguucuucggugucaccuccacagauaaucagcaguacaauuaaaacccacgucuccaauaaguaugggacugauuucaucuguucuagccugcugacacaggaacaaaaguccugcauucgcgagaaacccuaccgauauaucgagugugacaaggcgcucaaccauggaucacacaugaccgugagacagguaagucacagcggcgaaaaaggcuacaagugcgacuuaugugggaaaguguuuucucagaaguccaaucuggcuaggcauuggcggguucacacgggagagaaaccuuauaagugcaacgaaugcgaucguucauucagccgcaauaguugucuugccuugcauagaaggguccacacuggugagaagccauacaaaugcuacgaaugugacaagguguuuucucggaacuccugccuggcacuacaucagaaaacccacauaggcgagaagcccuauacauguaaagagugcgggaaggccuucagcgugcgaucgacucucaccaaccaccaagucauucauucuggaaagaaaccuuacaaguguaaugaaugcggcaaaguguuuucccagacaucaagucuggcuacccaccagcgcauccauacgggugagaagccauauaaauguaacgaaugcgggaagguuuucagccaaacuuccucucuugcaagacacuggaggauucacacaggagagaagccguacaaauguaaugaaugcggcaagguauucagcuauaacucacaucuggccagucaccggcgcgugcauaccggcgagaaacccuacaagugcaaugagugugggaaggcuuuuuccguccacagcaacuugacuacacaucaggugauccacaccggagaaaaaccuuauaagugcaaucagugugguaaaggcuucucuguucacucaagucucacgacccaucaggugauccacacaggggagaagccauacaaaugcaacgaauguggaaagagcuuuuccgucagacccaaucugacuaggcaucaaauuauacacaccggcaaaaagccuuacaaaugcucugauugugguaagucguucagcgugcguccaaacuuauuucggcaucagaucauucacacaaaggagaaacccuauaagcgaaauuga

SEQ ID NO: 65164 - RNA, 1536 nt, Artificial Sequence
  derived and/or modified sequence opt3 from ZNF419__Homo_sapiens__NP_001091961
auggccgcugcagcccugagagaccccgcucaggugccugucgcugccgaucuccuuaccgaccacgaggaacaaggcuacguuacauucgaggauguggcaguauauuuuagccaggaagaguggaggcuguuggacgaugcccagcgguuacuguaccgcaacgugaugcuagaaaauuucacucuccuggcuucccuugggcuggcaucuucaaagacgcaugagaucacccaguuggagaguugggaggaaccauuuaugccggccugggaagucgugacaagcgcuauuccccgaggaugcuggcacggugccgaggcggaggaagcaccugagcaaauagccuccguuggccuccugucuucgaacauccagcagcaucagaaacaacacuguggggaaaagccacugaaacgucaggagggaagagugcccguccucaggucaugcaaggugcauuuaagcgaaaagagucugcagucccgggagguaggcaaggcucuuuugauuucuagcgguguucugaagcaccaggugacucacaccggggagaaaucccaucgcucaaguaagagcagagaagccuuccacgcaggaaaaaggcauuauaaguguucugagugcggcaaagcguuuggccaaaaguaccuacucguccagcaccagcggcugcacgccgggaagaaaacauaugaauguuccgagugcggaaaacuuuuccgcgacaugucaaaucuguuuauccaucaaauugugcacaccggugaacgaccuuacggcuguagcaacugcgggaaaaguuucucuagaaaugcgcauuugaucgagcaccagagggugcauacuggagagaagccauuuacauguuccgaaugcggcaaagccuuccggcacaacagcacccucguccagcaccauaagauacacacggguguucgucccuaugaguguucggaaugcgggaaacuguuuucuuucaauuccucauuaaugaagcaucagcgcauccacacuggagagagaccuuacaagugcagugaauguggcaaauuuuacagccacaaguccaaccugauuaaacauuggagggugcacaccggcgagcggccauauaagugcucugauugugggaaauucuucacacaaugcagcucacucaugcagcaucagaagguacacacuggagagaagccguuuaaauguaaugaaugcggucgauucuuucgcgagaacaguacccuugugagacaucagaggguccacacaggcgcaaagcccuacgaaugucgggagugcgggaaauucuuuucccaaagcucuacccugaugcagcaccgcaaggugcauaucggagagaaaccuuucaaguguaaugaaugcggcagauuguuuagggagaacucaagucuaguuaagcaccagcgugugcauacgggugcuaaaccauaugaaugucgggagugcgggaaguucuuucgacacaauagcucccuguucaaacauagaaggauucacacuggcgaaaugcaguga

SEQ ID NO: 65165 - RNA, 2340 nt, Artificial Sequence
  derived and/or modified sequence opt3 from ZNF41__Homo_sapiens__NP_700359
auggccgcuaacggcgacagcccucccugguccccagcacuggccgcggaggggagaggaucuucaugcgaagcuagugugagcuucgaggaugucaccguugacuuuuccaaggaagaguggcagcaccucgauccggcccaaaggcggcuuuacugggacgugacacuggaaaauuauucucauuuguuaucgguagguuaccagauccccaaaucagaggcagccuucaagcuggagcagggcgaagggccuuggaugcuagagggagaagcuccacaccagagcuguaguggcgaggcaauugguaaaaugcaacagcaggggauacccggaggcaucuuuuuccauugcgagcgcuuugaucagccuauuggcgaagacucccucuguucuauccuggaggaacuuuggcaagauaacgaccagcuggagcagcgacaggaaaaucaaaacaauuugcucagccacgugaagguccugauuaaagagcguggguaugagcauaagaacaucgaaaagauaauccacgugacuacgaaacugguuccauccauuaagagacuccacaauugcgauaccaucuuaaaacauacacugaacucacacaaucauaacaggaauagugccacuaagaaccuuggaaaaauuuucgguaauggcaacaauuuuccccacagcccuucuuccaccaagaacgagaacgcuaagacaggggccaauucaugugaacacgaccauuacgagaaacacuugagccauaagcaggcgccaacccaccaucagaaaauccacccggaagagaagcuguaugugugcacugagugugucaugggauucacacagaaaagucaccuauuugaacaucagcggauacacgcaggcgagaagucucgcgaaugcgauaaauccaacaagguguucccccagaagccucagguagacguucauccaagcguguacaccggugagaaacccuaucucuguacgcaaugcgggaaggucuuuacucugaaaucgaaucuuauuacccaccagaagauccacacaggacagaaaccuuacaaguguucugaaugcggcaaggccuucuuucagagauccgaucuguucaggcauuugcggauucacacuggcgagaaaccauacgagugcucagaaugugggaagggauucagucaaaacagcgaccucuccauccaucagaaaacccacacaggugagaagcauuaugaaugcaaugaguguggcaaggcuuuuacccgcaaaucugcccugcgaaugcaccagagaauccacacgggggagaagcccuacgugugcgcagacuguggaaaagccuucauucaaaagagccauuuuaacacucaccaaaggauacauacaggcgaaaaaccguaugagugcucagauugugguaagaguuucaccaaaaagucccaguuacacgugcaucagcggauccacacuggggaaaagccuuacauuugcacagaguguggcaaagucuuuacccaccguacgaaucugaccacacaucagaagacucacaccggagaaaaacccuauaugugcgcugaguguggcaaggcguucacagaccaaagcaaccucaucaaacaucagaagacucacaccggggagaaaccauacaagugcaauggaugcgguaaggccuuuauauggaaaucucgccuuaagauucaccagaaaucacauaucggcgaaagacacuaugaguguaaggauugcgggaaagcauucauccaaaagaguacacugagcguucaucagaggauucacaccggagaaaagccuuacgugugucccgagugcggcaaggcuuuuauccagaaaucccauuucauugcccaccaccggauacauacuggugaaaaaccauacgaguguucugacugcgggaaguguuuuacgaaaaagucgcaguugcgaguacaccaaaagauccauacaggcgagaaacccaacauuugcgcugaauguggaaaggccuucaccgaucgcagcaaucuaaucacucaccagaaaauccacaccagagagaagccuuaugaaugcggcgacugugggaaaacauuuaccuggaaguccaggcugaacauucaucagaagucacacacuggagagcggcauuacgaaugcaguaaaugcgguaaggcauucauacagaaagccacacucucuaugcaccaaaucauucauacgggcaagaaaccauaugcuuguaccgagugccagaaggcguucacugaucgcagcaaucugaucaaacaccagaagaugcacuccggggagaagagauacaaagcaucagacuga

SEQ ID NO: 65166 - RNA, 3675 nt, Artificial Sequence
  derived and/or modified sequence opt3 from ZNF423__Homo_sapiens__NP_001258549
auggaggacgaaagcaucuauaccugcgaucacugucagcaagacuucgagucccuggccgaucucacagaccauagagcucacaggugccccggcgauggggacgaugacccucagcuuucuuggguggcaucaaguccaagcuccaaggaugucgccucuccgacucagaugauuggagacgguugugaucugggcuugggggaagaggaaggaggcacggguuuacccuacccuugccaguuuugugacaaaucguucauacggcugucauaccuaaagcgccaugagcaaauccacagcgauaaacucccauuuaagugcaccuauuguagucgacuguucaaacauaagcguuccagagacaggcacauuaaacuucacacaggggacaaaaaguaccauugccacgagugugaagcggcuuuuucucggagcgaucaucugaaaauccacuugaagacucacuccucaaguaaacccuucaagugcaccguuuguaagcgcggauuuagcucuacauccucacuccagagccauaugcaggcccacaaaaagaacaaagagcaucuggcaaagagugaaaaagaggccaagaaagacgauuucaugugcgacuauugcgaggauaccuuuucucagacugaggaacuggaaaagcacgugcucacaagacauccucaauuauccgagaaggcugaccugcaguguauucacugcccagaaguauucguggaugagaauacccuuuuggcacacauccaucaggcccacgcuaaccagaaacauaagugucccaugugcccugagcaauuuagcucggucgaaggcguguacugucaccuggacucucacaggcagccagauuccucaaaucauaguguuagcccggaccccgugcuaggcuccgucgccucuaugagcucagcgacgccugauaguuccgcaagcguggagcgggggucuacuccagacucaacccucaaaccccugcgcggacagaagaaaaugcgagacgauggucaaggcuggacaaagguaguuuauaguugcccuuacuguagcaagagagacuucaacucccuugccgugcuggaaauacacuugaaaacuauccaugcugauaagccacagcagucucauaccugccagauuugucucgacucgaugcccacacuguacaauuuaaacgagcacgucaggaaacugcacaagaaucacgccuauccggugaugcaauuugggaacaucagcgcauuccauugcaauuacuguccugaaauguucgcugauauuaacucccuccaggagcacauccgggugucacauugcggacccaaugccaacccaagugacggcaauaacgcguuuuucugcaaucaguguucuauggguuuucuuaccgagagcucccugacggaacacauacagcaagcccauugcucagucgggagcgcaaaauuggagucuccuguugugcagcccacucaguccuucauggaaguauauaguuguccauacugcacaaacagccccauuuuuggaucuauccuaaagcugaccaagcacauuaaagagaaccacaagaauaucccucucgcucauuccaaaaagucaaaagccgaacagaguccagugagcucggaugucgagguguccucuccgaagcgucaacgccugagcgcuucagccaacaguaucuccaauggcgaguaucccuguaaccagugcgaccuuaaguucucuaauuuugaaucuuuccagacucaccugaaauugcaucucgagcuguuacugagaaagcaggcauguccucaaugcaaagaagauuuugacucccaggagucacuacuccagcaccugacaguucacuacaugaccacgagcacccauuaugugugugagaguugcgauaagcaauucucuuccgucgacgaucuucagaaacacuugcuggacaugcauacauuugugcucuaccacuguacucugugccaggaaguauucgacagcaagguuucgauucaggugcaucuugccgucaaacacucaaacgagaagaagauguacaggugcaccgcuuguaauugggauuuucggaaagaagcggaccugcaagugcacgucaagcauucucacuugggcaacccagcaaaagcccauaagugcauauucuguggggagacauucaguacugaaguggagcuccagugccacaucaccacacacuccaaaaaguauaauuguaaguuuugcagcaaggcuuuccaugccauuauccuguuagagaagcaucugcgagaaaaacacuguguuuuugaugcagccaccgagaacggaacugcuaauggugugcccccuauggccacgaagaaagcagaaccagcggaccuacagggcaugcuccugaagaaccccgaggcuccgaauagccacgaagccagcgaggaugacguagaugcauccgagccuauguacgggugcgacauauguggagccgcuuauacaauggaaguccuuuugcagaaccaucgccugagagaucacaauauuaggccaggcgaggacgaugguucacggaagaaagccgaguucaucaaggggagucacaaaugcaacguguguagccgcaccuuuuucucugaaaacggccucagagaacaucugcaaacucacaggggacccgcaaagcauuacaugugcccuaucugcggcgagcguuuucccuccuuacugacccuuacagagcacaaaguuacccacucaaagaguuuggacacugggacaugucggauuugcaagaugccacuccagagcgaagaggaguucaucgaacauugucagaugcacccugaucugcgaaauucccuaacgggauuuagaugcguggucuguaugcagaccgugacuucuacacuggagcucaaaauucaugguaccuuccacaugcaaaagcuggcuggcucgagcgccgcgucaucccccaacgggcagggacuucagaaauuguauaagugcgcccuguguuuaaaagaauuuaggaguaagcaagaccucguaaaacuggacgugaauggccuuccauacggucugugcgcuggguguauggcacgcucugccaacggccagguuggaggcuuggcuccgccugagcccgccgaucggccaugcgcagggcucagaugucccgaaugcagcgucaaguucgaguccgcggaagaccuggagucacauaugcaaguggaucacagggaccuaacaccugagacuucuggaccacgcaaggguacccagacgagccccgugccucggaaaaagaccuaucagugcauaaaaugucagaugacauuugaaaaugagcgagaaauccagauucacgucgccaaccauaugaucgaggaaggcaucaaucacgagugcaagcuguguaaccagauguucgauaguccggcuaaacuccugugccaucuuauugagcacuccuucgaagggaugggaggcacuuuuaaguguccaguuugcuucaccguguuugugcaagccaauaaguugcagcagcauauauucgcaguacacggucaggaggacaaaaucuacgauuguagccaaugcccccagaaguuuuucuuucagacagaacugcagaaccacacuaugucucaacaugcucaguga

SEQ ID NO: 65167 - RNA, 1710 nt, Artificial Sequence
  derived and/or modified sequence opt3 from ZNF430__Homo_sapiens__NP_001166142
auggagaaccugaaaagcggcguguacccccucaaagaagccuccgggugcccuggagcugacagaaaucuucuggucuauucuuucuacgagaaggguccauugaccuuuagggauguugcaaucgaguucucauuagaagaauggcagugucuggacacagcccaacaggaucuauaucggaaagugaugcucgagaacuaccgcaaucugguauuucuuggcauugcggugaguaagccggaccugauaacuugcuuggagcaggggaaagaacccuggaacaugaagcgacacgcuauggucgaucagccuccagugacguauagccauuucgcccaagaccucuggcccgagcagggaaucaaggauuccuuucaggaaguuauucugcguagauacggcaaauguggucacgaggaccugcagcucaggaccgggugcaagucuguggaugaguguaauuuacauaaagaaugcuaugacgagcugaaccaaugucuuacaacuacccagucggaaaucuuccaguacgauaaguacgucaauguguuuuauaaauucucaaacccuaauauucagaagauccggcacacaggaaagaaaccauuuaagugcaaaaagugugacaagagcuucugcauguugcugcaucuaacccaacacaagcgcauacacaucagagagaacaguuaccagugugaagagugcggcaaaguauuuaauugguucuccacucucacaaggcaucggcgcauucacaccggcgagaagcccuauaagugcgaacagugugggaaagcauuuaagcaaucuagcacgcugacuacccauaaaaucauucacacaggagagaagccuuaccgaugcgaagagugugguaaaacuuucaacagauccucacaccuuaccacacauaagaggauccacaccggcgaaaagccauaucggugcgaggagugugggcgugccuucaaucgcaguagccaucugacgacucacaaaauaauucauacaggagaaaagccguacaaaugcgaggaauguggcaaggcuuuuaaccagucuuccaccuugacuacacacaaaaucauucacgcuggugagaagcccuauaagugcgaagagugugggaaagccuucuacagauuuucauaccucaccaagcauaaaaucauccacacgggagagaaguucuauaaaugcgaagaguguggcaagggcuuuaauuggagcaguacccugacaaagcauaaaaggauucacacuggggaaaagccuuacaaaugcgagcagugcggaaaggcuuucaacgagucuuccaacuuaaccgcccacaaaauaauccauacaggugaaaagccauauaaaugugaggaaugcggcaaggcguuuaaucggagccccaagcugacugcacacaaaguuauucauucgggggagaagccuuacaaaugugaagagugcggaaaggccuucaaccaguuuucuaaucucaccaaacacaagaucacacauauaggcgauaccuccuauaaguaccuugagugugacaaagcauucucacaaaguagcacucugacgaagcacaaagugauucacacaggugaaaagccauauaacugcgaggaauacgggaaagccuuuaaucaguccucuaacuugaucgagcagagcaauucauacuggcgagaaacccuacagauguga

SEQ ID NO: 65168 - RNA, 1959 nt, Artificial Sequence
  derived and/or modified sequence opt3 from ZNF432__Homo_sapiens__XP_011525850
augaucaacgcccaggagcugcucacccuugaagacgugacagucgaguucacuugggaagaguggcaacuguugggccccuuucagaaggauuuauacagagacguuaugcuggaaauuuauagcaaucuacucuccaugggguaccaggugucuaaaccugaugcucugucaaaacuugagaggggagaggaaccauggacgauggaggacgaacggcacagucgcauaugcccggagaacaaugagguagaugaccaucugcaggaucacuuggaaaaccaacgaaugcucaaaagcguggagcaguaucaugaacacaaugcauucgguaacaccgccucccagacaaagucucugugucuguuucgugagaaucaugacacuuucgaacucuacaucaaaaccuuaaagucgaaccugucacuugucaaucagaacaagagcugcgagauuaauaacaguacaaaauuuuccggcgaugggaagucuuucuugcacggaaauuaugaggaacuguacagcgcggcuaaauuuuccgugucaaccaaggccaacaguacuaaaagccaaguuucuaagcaccagagaacacaugagaucgaaaagaaucacguguguuccgagugcggcaaagcauucgucaagaaaucacagcuaaccgaccaugaaagggugcacacgggugagaagcccuauggguguacucucugcgccaaaguauuuagccggaagagucgccugaacgagcaccagaggauucauaaaagagaaaagucuuucaucuguuccgagugcggaaagguuuuuaccaugaaaagccggcuuauagaacaccaacgcacacauacuggcgagaagccuuacaucuguaacgaaugcggcaaaggguucccaggaaagcgaaaucugauugugcaccagagaaaccauaccggugagaaaucguacaucuguucugagugcggcaagggguuuacaggaaaguccauguugauuauccaccagaggacccacacgggcgaaaaacccuauauaugcucagagugugguaagggguucacuacaaaacauuacgucauuauccaccaacggaaucauaccggagaaaagccuuauauuugcaacgaguguggcaaaggcuucacuaugaagagucguaugaucgagcaccagcgcacacacaccggggaaaagccauacaucugcagcgaguguggaaaagguuuucccagaaaguccaaucucauugugcaucagaggaaccacacgguggaaaaaucuuaucugugcagcgaguguggcaagggguucaccgucaaaucaauguuaauaauccaucagcggacacacacuggagaaaagccuuauaccugcagugaguguggcaaggguuuuccacugaaaucccgacucauuguucaucaacgcacacacacuggggagaagccguacagaugcagcgaauguggcaaaggauucaucguaaauucuggccuuaugcugcaccagaggacccauacaggggagaagcccuacauaugcaacgaaugcggaaaagguuuugcuuucaagucaaauuugguggugcaccagcggacccauacuggcgagaaaccuuuuauguguagugaaugcgggaagggauucacgaugaagcgcuaccuaauuguccaccagcaaauccauacagaggagaaaagcuguaucugcuccgaauguggcagagguuuugcaaaggagaccgaacuggcccuccacaaacaggugcacacuggggagaagccauauggcugcaacgaauguggaaaaggcuucaccaugaagucuaggcugauuguucaucagcguacacacaccggggagaagcccuuugugugcucggagugucggaaggcuuucagcuccaagcgaaaucuuaucguccaucagagaacucacaacggaaauaaaccuuga

SEQ ID NO: 65169 - RNA, 2022 nt, Artificial Sequence
  derived and/or modified sequence opt3 from ZNF433__Homo_sapiens__NP_001073880
augauguuccaggacagcguggccuuugaggaugucgcuguuaccuucacacaagaagagugggcacugcucgaccccucccagaagaaccuuugcagagaugugaugcaggaaacuuuuaggaaucuggccucuaucggcaaaaaguggaaaccucagaacauuuacguagaguaugaaaauuugcggcgcaacuuacgaauagugggggagcgucuguucgagucaaaggaaggacaccaacauggugagauccuaacgcaggucccagacgauaugcucaaaaagaccacaacuggcgugaagaguugugaaagcuccguuuacggggaggugggaucugcgcacucgucacugaauagacauauuagggacgauaccggccacaaggcuuaugaguaccaggaauauggucagaaaccguacaaaugcaaguauuguaaaaagcccuuuaacugccuuagcaguguccaaacacaugagcgggcccacuccgggcgcaagcuguacgugugugaagagugcggaaaaaccuucaucucucacagcaauuugcagagacauaggauuaugcaccggggcgacggcccuuacaaguguaaauuuugcgggaaggcacucauguuccugucccuguaucucauccauaaacgcacucacacaggagaaaagccauaccaguguaaacagugcgguaaggccuuuucacacaguagcucuuuacgaauacaugagagaacccacacgggcgagaagcccuauaaauguaacgaaugcgggaaggcuuuccauuccucaacuugccugcacgcacauaaaaggacccacacaggagagaagccuuacgaauguaaacaaugcggcaaggccuuuagcaguucucacuccuuccagauccaugagcggacucacaccggugaaaagccauaugaguguaaagagugcgggaaggcuuuuaaaugucccagcucgguacgucgccaugaaagaacacacucuaggaagaaaccuuacgagugcaagcacuguggaaagguucuuuccuauuugaccucauuccagaaucaucugggcaugcacacgggcgaaauuagucauaaaugcaagaucugugggaaagccuucuacagcccauccucucuacaaacucacgagaagacacauaccggagaaaaaccguacaagugcaaccagugugguaaggcguuuaauagcucaaguuccuuccgguaucacgagcgaacucacacaggcgagaaacccuacgaaugcaagcagugcgggaaagcauuucgcagcgccucucuccugcagacccauggaagaacgcacaccggcgagaagccuuaugcuuguaaagaaugcgguaagccauucucaaacuuuaguuucuuucaaauucaugagaggaugcaccgggaggaaaaacccuacgaguguaagggguauggcaagacauucagccuuccuucccuguuucaucgccacgaaagaacucacaccggaggcaaaacauacgagugcaagcagugugggaggucuuucaauugcucgagcuccuuucguuaucauggacggacucacaccggugaaaaaccauacgaguguaagcagugcggcaaagccuuccgaucagcaagucaguugcaaauccaugggagaacacacaccggagagaagcccuacgaauguaagcagugcggcaaggcuuuugguucugccagccaccuccagaugcaugggaggacucacacgggcgagaaaccguaugaauguaaacagugcggaaaguccuucggcugcgcgucacgccugcaaaugcaugggcggacacacaccggagagaaaccuuacaaguguaagcagugcgguaaagccuucggcugucccagcaacuuaagaaggcaugggcgcacucacaccggagaaaagccauauaaaugcaaucaguguggcaagguguuucgauguucuucccagcugcaaguccacggucgggcacauugcauagauacaccuuga

SEQ ID NO: 65170 - RNA, 2487 nt, Artificial Sequence
  derived and/or modified sequence opt3 from ZNF438__Homo_sapiens__NP_001137240
augcagaacagcguguccgucccuccuaaggacgagggcgaaucuaauaucccaucagggaccauucaaaguagaaaaggacugcagaacaagagccaguucaggacaauagccccgaaaaucguucccaaggugcucacuucccggaugcuuccuugccacucuccaucgcgcucagaucagguaaaucugggucccagcauuaacaguaaauuguuaggcauguccacgcaaaauuacgcucugaugcaaguggcagggcaggagggaaccuuuucucuagucgcccucccucauguggcgagcgcucagccaauccagaagccccgaaugucccugccugaaaaccuuaagcugccaauuccgcguuaucagcccccuagaaauucaaaagccaguaggaagaaaccaaucuugauauuccccaagagcggcuguucuaaagcacccgcccagacacagaugugcccacaaaugucccccucaccgccucaccaucccgagcuccuguacaagccaagcccuuuugaagagguucccagucuggagcaggcuccagcaucuaucuccacugccgcucucaccaacgguagcgaccacggggauuuacggcccccugugacaaauacccauggaucgcugaacccaccggccacucccgcgucuuccacaccugaagaaccagcaaagcaggaccuuaccgccuugucaggcaaagcucacuucgucaguaagauuacgagcuccaaacccucugccguggcaagcgaaaaguuuaaagagcaaguagaucuggcuaagacuaugaccaaucuaucaccuacaauccucggcaacgccguucagcugauuaguuccgugccaaaagggaaacuucccaucccgccuuauagccgcaugaagacuauggaggucuacaagauaaagucugacgcgaauauugccggauucucacugccaggucccaaagcagauugugacaagaucccuaguaccacagaaggcuuuaacgcugccaccaaaguggcuagcagauugcccgugccacaggucucccagcaaucugccugcgagucggcauucuguccucccacgaagcucgaucugaaucacaagacuaaauuaaacagcggggccgcuaagaggaaaggacggaagcgcaaaguuccagacgaaauucuggcguuucagggcaagcgaagaaaguauaucaucaacaaaugcagggaugguaaggagcgggugaaaaaugacccgcaggaguuccgugaucagaagcucgggacacuuaaaaaguaccgcuccauuaugccuaagcccauaaugguaaucccaacccuggcaucauuggccagucccacuacacuacaaucucagaugcugggaggccucggccaggacgugcugcuuaacaauagccugaccccuaaauauuugggguguaagcaggacaacuccucaagcccaaaacccucuuccgucuuuagaaauggauucagugguauuaagaaaccuuggcauaggugccacguguguaaccaucacuuucaauucaagcagcaccuccgggaucauaugaauacgcacaccaaccgacgcccguacagcugcagaaucuguaggaaaucuuacguucggccaggcucccugucaacacauaugaaguuacaccauggggagaaucgccugaagaaacuaaugugcugcgaguucugugcuaagguguuuggacacauaagagucuauuucggccaccucaaagaagugcauaggguaguuauuaguacugagcccgccccuagcgaacugcagccaggugacauccccaagaaccgugauaugucggugcgggggauggagggcucccuugaacgagagaauaaaucuaacuuggaggaagacuuucugcucaaucaggcagaugaggucaagcugcaaaucaagugcggaagaugucagauuaccgcccagagcuucgcugaaaucaaauuucaccuucuggacgugcauggcgaggaaauugaggggagguugcaagagggaacauucccugguucaaagggcacucaggaggaacucguccagcacgccaguccggauuggaaacgccaccccgaacgggggaagccagagaaagugcauuccucuagcgaggaaucccacgcaugcccuagacugaagaggcaguuacaucugcaccaaaacggaguugagaugcuaauggaaaaugagggcccccagucagguaccaacaagccacgcgaaacaugucaggggccugagugccccggccuccauaccuuucugcuuuggagccacaguggauucaacuguuugcugugcgcggagaugcucggccgaaaagaagaccuguuacaccauuggaagcaccagcauaauugugaggauccaucuaaacugugggcuauacuuaacacuguguccaaucaagggguaaucgaauugagcucggaggccgaaaaguga

SEQ ID NO: 65171 - RNA, 2016 nt, Artificial Sequence
  derived and/or modified sequence opt3 from ZNF443__Homo_sapiens__NP_005806
auggccagcguggcucuggaggacgucgcaguuaacuucaccagagaagagugggcccuccuuggccccugccagaagaaucuguacaaagaugugaugcaagaaacaaucaggaacuuggacuguguagugaugaaguggaaagaucagaauauugaggaccaguaucgguacccucgcaagaacuuacgaugccguaugcuggaaagauuugucgaguccaaagaugggacucaguguggagagacgucuucacaaauacaggacaguaucgugaccaagaauacacuaccagguguuggcccgugcgaaagcuccaugaggggagagaaggugauggggcacucuucgcucaacuguuauauucgggucggcgcgggucauaaaccccacgaauaccaugagugcggggagaagccugauacucacaaacagcgcggaaaggcuuucucauaucauaauagcuuucagacccacgaaagacugcacacaggcaaaaagccauacgacuguaaggagugcggcaaaaguuucuccucucuugggaaccugcaaaggcauauggccgugcagcggggagauggucccuauaaguguaaauugugcggcaaggcauuuuucuggccuagccuccugcacaugcaugaacgcacccacacuggggagaaaccauacgaauguaagcagugcuccaaagccuuuucauucuacaguagcuaucugcgacacgagagaacacauaccggagagaagcccuacgaaugcaagcaguguucuaaggcuuuuccuuucuauuccucauaccucaggcacgagcggacgcauacuggcgaaaaaccauauaaaugcaagcaauguagcaaagcauuuccggacaguucuuccugcuuaauccacgagcguacccauacaggugaaaagcccuacacuuguaagcagugcgggaaagccuucagcguaucgggaucucugcagcgccacgagaccacacacuccgcugagaagccuuaugccugucaacagugcggcaaagcguuucaucaccuuggcucauuccagagacauaugauuaggcacaccgggaauggaccacacaaguguaaaaucugcgguaagggcuucgauugucccaguagcuugcagucccaugaacggacgcacacuggggagaagccuuacgaaugcaaacaaugcggaaaggcacugucucaucgaagcucauuucgcagucacaugauaaugcauacaggcgacgguccacacaaauguaagguuugcgggaaagccuucguguaccccuccgucuuucagagacacgagaggacccauacugcugaaaagccguauaaguguaaacagugcggcaaggccuaccggaucucuagcucacuacgcagacacgagacaacccauacgggagagaaaccuuauaaguguaaacucggcaaggcauucauugauuuuugcaguuuccagaaccacaaaaccacacauacuggggaaaagcccuacgaguguaaggaaugcggaaaggcuuuuagcagguuccguuaucugucccggcacaaacgaacccacacaggugagaaaccauacgaguguaagacuugcagaaaagccuuuggccauuaugacaaucuuaaggugcacgaaaggauccauucuggggagaagccuuacgaauguaaagagugcggaaaggcguucucguggcugaccugcuuuuugcgccacgaacggauucacaugagagagaaaagcuacgaguguccccaaugcggcaaggccuucacacauuccagguuucuccagggucacgagaaaacccauacuggggaaaacccauaugaauguaaggagugcggcaaggcauucgcuucacugaguucuuuacaccgccauaaaaagacgcacuggaaaaagacacacaccggagaaaaucccuacgaguguaaagagugcggcaaggccuucgcuagccuguccucacuccaucgacacaagaaaacucauuga

SEQ ID NO: 65172 - RNA, 984 nt, Artificial Sequence
  derived and/or modified sequence opt3 from ZNF444__Homo_sapiens__XP_011525370
auggagguggccguccccguuaagcaggaagcugagggccuggcacucgacagcccuuggcacagauucaggcgguuucaucuuggggaugccccaggaccgcgcgaagcgcuggguuuguuacgagcucugugccgugacuggcuaagacccgaggugcacaccaaagaacaaaugcucgagcugcuuguacuggagcaguucuuguccgcccucccugcagauacacaggccuggguguguucuaggcagccacaaucaggcgaagaggcugucgcacugcuggaggaacucugggggcccgccgcuaguccugacggaagcuccgccacucgggugccacaggauguuacgcagggccccggugcgaccgggggaaaggaggacucuggcaugaucccuuuagcaggcacagccccaggggcugaaggaccggcccccggugauucgcaggcagugcgcccuuacaaacaagagccaucaagucccccucuggcuccaggccuucccgccuuuuuggcggccccggggacuaccagcugcccugaauguggaaagacaucccugaaacccgcacaucuacucagacacaggcagucucauagcggcgagaagccacacgcuugcccugaaugugguaaggccuuccggcgcaaagagcaccuucgaagacauagggacacccaccccggguccccaggaucacccggcccugcucugcggccacugccggcccgugagaagccccaugcaugcugugaaugcggcaaaacuuuuuauuggcgcgagcacuuggucagacacaggaagacacauaguggggcccggccuuucgcuuguugggaaugcggaaaagguuuuggccgacgcgagcacgugcucagacaucagaggauucacgggcgggcggcagccagcgcucagggagccguagcaccaggccccgauggugggggcccuuucccacccuggccgcugggauga

SEQ ID NO: 65173 - RNA, 1992 nt, Artificial Sequence
  derived and/or modified sequence opt3 from ZNF44__Homo_sapiens__NP_001157748
auggcccugugcuacggcaccuucuggggguaucccaagaugcucgaggcugcaaaccuuauggaaggacugguggacaucgguccuugggucacauugccaagaggccagccggagguuuuagaaugggggcugcccaaagaucaagacagcguggccuuugaggauguagcggugaauuucacucacgaagagugggcucuacucggaccuucccagaagaaccuguacagggacgucaugcgggagacgauucgcaaucuuaacuguauaggcaugaaaugggaaaaucagaacaucgaugaccagcaucaaaaucugcgacguaacccaagaugcgaugugguugagagguuugguaagucuaaagacgggucacaguguggagaaaccuugagucagauucggaauagcaucgugaacaagaauacacccgcccgcgucgaugcaugcggcuccucugugaacggcgagguaauuauggggcacucgucacucaauuguuauaucagaguugacacuggacauaagcacagggagugccaugaauacgccgagaaaagcuauacccacaagcagugugguaaaggccugaguuaccggcacuccuuccaaacaugcgaacgcccucauaccgggaagaaaccauaugauuguaaggagugcggaaagacuuuuucuagccccggcaaccugcgaagacacaugguggucaaagguggggacggaccuuacaagugugaacucugcggcaaggcuuucuuuuggccauccuuacugaggaugcaugagcggacacacaccggcgagaagccguacgaaugcaaacaguguucaaaggcauuccccguguauaguagcuaccuucgucacgagaaaauacauacgggggaaaagccuuaugagugcaagcaguguucuaaagccuuuccagauuacuccucauauuugcgccacgaaagaacucauaccggagagaagcccuacaaaugcaagcagugugguaaggcuuucagcgugaguggcucucugaggguccacgagcggauccauacaggggaaaaaccuuauacuugcaagcaauguggaaaagccuuuugccaccuaggcuccuuccagcgacacaugauuaugcauagcggugacgggccacacaaguguaaaaucugcggcaagggauuugacuuccccggcucggcgcgcauucaugaggggacccacacacucgaaaaaccguacgaguguaagcagugcggaaagcugcuuucucacagauccucauucaggcggcauaugauggcacacaccggugauggcccucauaaaugcacgguuugugggaaggccuuugacagucccagcguguuccaacgccacgaaagaacucauacaggagagaaaccauacgagugcaagcaguguggcaaggcuuuuaggaccuccucuagccugcguaaacacgaaacuacacacaccggugagcagccuuauaagugcaaaugugggaaggccuucucagauuuguuuaguuuccagucccaugaaacgacccacagcgaggaggaacccuacgagugcaaagaauguggcaaggcauuuucuucauucaaauauuuuugccggcaugagcgaacacacagugaagagaaaagcuacgagugucaaaucugcggaaaggcuuucuccagauuuucuuaucucaaaacucaugaaaggacccacacagccgagaagccauacgaauguaaacagugccgcaaggcguucuuuuggcccucguuccuguuacggcacgagagaacucauaccggcgaaaggccuuaugagugcaaacacugugggaaggccuucagccgcuccucauuuugccgagagcaugaacggacacacaccggagagaaaccauacgaauguaaggagugcgguaaggcauucaguucucugagcuccuuuaaucgucacaaaagaacucauuggaaggacauacucuga

SEQ ID NO: 65174 - RNA, 3186 nt, Artificial Sequence
  derived and/or modified sequence opt3 from ZNF451__Homo_sapiens__NP_001026794
augggcgaccccgggagcgagaucauugaauccgugccuccagccggaccggaggcuucugaaucaaccacagaugagaacgaagacgauauacaguucgucagugaggguccccugagaccuguucucgaguacaucgaccuugugagcuccgaugacgaagaaccaucuacuucguauacggaugaaaauauuaagaggaaagaccacaucgauuaccaaaaggacaaaguagcacugaccuuggcccgguuagcgcgccauguggaggucgagaagcagcagaaagaagagaagaaccgagcuuuucgugaaaagauugauuuccagcacgcccauggccugcaagagcuagaauuuaucagagggcacucagacacagaggcagccaggcucugcguggaucaguggcugaaaaugcccggacuuaagacuggcaccauaaauugugguacaaaaagcaguuuccggcgcgggggacauaccuggguuuccggcaagccuauccugugcccaauuaugcacuguaacaaagaguuugacaauggccacuugcuccuggggcaucugaagagauucgaccacucucccugcgauccuacuaucacacuccauggaccauuuuucagcuccuuugcuuguguggucugcuauaagaaauucgugacccagcagcaauacagggaccacuuauuugauaaggaagcaacggacgauggucacaacaauaaccugcuuccgcagauuauccaguguuucgccugccccaauuguuuucuucuguucucacggaaagaggaaugcaguaagcauaugagcggcaaaaaccacuuccaucagucuuuuaagcuaggggacaauaaaggaauagcucacccuauuuccuucccaucauuugccaagaagcuccugaucagccuuuguaaagauguacccuuccaaguuaagugcguggcgugccauaaaacucugcgcagucacauggaguugaccgcacacuuucgaguccauuguagaaacgccggcccuguggcuguggccgaaaagucuauuacacaggucgcagagaaauucauccucagggguuauugcccagacuguaaucagguuuuuguggaugagacuuccacccaaaaccacaagcagaauagcgggcauaagguacgggugaucaacucggucgaagagucugugcuguuauacugccacuccucagaaggaaacaaagaccccaguagcgaucugcaccuccuucuggaccaguccaaguucucuagcuugaaacguacaaugucaauuaaggagaguuccagccuagaauguauagcuaucccgaaaaagaagaugaaucugaaagacaagucucaugagggcguugccugcgugcagaaagagaagucagucgugaaaaccugguuuugugaaugcaaccaacgcuucccuagugaggaugcgguagaaaagcacguuuuuagcgccaauacgaugggcuauaaguguguggucugcgggaaagugugugacgauuccggagucauuagacuccauaugucuaggauccacgguggcgcacaucugaacaauuucuuguuuuggugccggacuugcaagaaagagcugacacgaaaggacaccauaauggcucacgugacugaguuccacaacgggcaucgcuacuucuacgaaauggaugagguugaaggagagacauugcccucgagcuccaccacgcucgacaaucugaccgccaacaaaccaucaagugcuauuacagugaucgaucacucuccugccaauagcucccccagaggcaaguggcaguguaggaucugcgaagacauguuugauucacaggaguauguaaaacagcauuguaugagcuuagcaucucacaaguuccaucgguacuccugcgcccacugucgcaagccauuucacaaaauugagacucuguauagacauugccaagacgaacacgauaacgagaucaagauuaaauacuucuguggucuaugcgaccucauauuuaaugucgaagaggcuuuccugagucauuaugaggagcaccacagcaucgauuacguguuuguuucugagaagaccgaaacauccauuaaaacugaggacgacuuccccgugaucgaaaccucaaaccagcuuacaugugggugcagggagaguuauaucuguaaggucaaucguaaggaagauuacagccggugcuugcagauuaugcuggacaaaggcaagcucugguuucgaugcucgcuguguuccgcgaccgcacagaaccuuacugauaugaauacgcauauacaccaagugcauaaagagaagucugacgaggaggaacagcaguacguaaucaaaugcggaacauguaccaaggccuuccacgauccugaaagcgcucagcaacauuuucacagaaagcacugcuuccugcagaaaccaucaguggcccauuuuggcagugagaaguccaacuuguauaaauucacugcaucugccagccacaccgagaggaagcucaaacaggcuauuaacuacuccaagucacuggacauggaaaaggggguugagaaugauuuaagcuaucaaaacaucgaagaggaaauugucgagcugccggaccuagauuaccuccgcacaaugacccauaucguguucguggacuuugauaauuggaguaacuucuuuggacaucugcccggucaccuuaaucagggcacuuucauauggggguuucagggaggcaacacaaauuggaaaccuccauugaacuguaagaucuauaauuaccugaaccggauugguugcuucuuucuccaccccagauguucuaaaaggaaggacgccgcagauuucgcgaucugcaugcacgcugggcgccuggacgagcaguuaccuaaacaaauuccauuuacgauccuguccggcgaccagggauuccuugaauuggagaaucaguuuaagaaaacccagcgacccgcccauauacucaacccgcaccaucuggaaggcgauaugaugugugcacuacugaauagcauuucggacacuacaaaggagugcgauucagacgauaacaugggggccaagaauaccucuaucggagaagaguucauuaguacagaggacgucgaacucgaggaagcuauccggcguucccuggaggaaauguga

SEQ ID NO: 65175 - RNA, 2049 nt, Artificial Sequence
  derived and/or modified sequence opt3 from ZNF45__Homo_sapiens__NP_003416
augaccaagagcaaagaggccgugacauucaaggacgucgcuguuguguuuuccgaagaggaacugcagcuccuugaucuggcacaaagaaaauuguacagggacguaauguuagagaacuuccggaauguggucucugugggccaccagucaacucccgaugggcugccucagcuagaacgcgaggagaagcucuggaugaugaaaauggccacgcagcgagacaacaguagcggagcgaagaaucugaaggaaauggagacccuucaagaaguuggucugcguuauuugccacaugaggagcucuuuugcucccagaucuggcagcagauuacaagagaacugauaaaauaccaagauucuguggucaacauccagaggacuggcugucagcuggagaagcgggacgaucuccacuauaaagacgaaggguucucgaaucagucaagccauuuacaagugcaccgcguacauaccggagagaagccguacaaaggcgaacacugcguuaagaguuuuuccuggucuagccaucugcagauuaaccagagagcucacgccggugagaagcccuauaaaugugagaagugcgauaaugcauucaggcgguuuuccucacuucaagcccaccagcgcgugcauagucgagcuaaaagcuacacaaacgacgcaucuuauagauccuucucacagaggagccacuugccucaccaucagcgggucccaaccggggaaaaucccuacaaguacgaggaauguggacguaacgugggcaaaaguucucacugccaagccccucugaucgugcauacuggcgagaagccauauaaaugugaagagugcggggucggauuuucccagcgcagcuaccuacagguucaccucaaggugcauacagguaagaaacccuauaagugugaggaaugcggcaaaucguucucuuggagauccaggcugcaggcucacgagcggauucacaccggggaaaagccuuacaaauguaaugccugcggaaagucauuuaguuauagcucccaucuuaacauccacugccgaauacauacgggcgagaagccauacaaaugugaagagugcgguaagggguucucuguaggaagccaucugcaagcgcaccagaucucacacacuggcgagaaaccguauaagugugaagagugcggcaaaggguuuugucgcgcaaguaauuugcucgaucaccagagaggacauaccggugaaaagcccuaccagugcgacgccuguggcaagggguucuccaggagcucugauuucaacauucacuuucgggugcauacaggagagaaaccuuacaagugcgaggaauguggcaaagguuucucacaagcuaguaaucuguuagcccaccagcgcgggcacacuggcgagaagccauauaaaugcggaaccuguggcaagggguuuagcagauccucugaccugaacguccauugcaggauccacacaggagaaaagcccuacaaaugcgagcguugugguaaggcauucucgcaguuuagcucccuccaggugcaucaacggguucacaccggcgaaaaaccuuaucagugcgcugagugugggaagggauucucagugggcagucagcuucaagcccaucagcgaugccacacgggugagaaaccauaccagugugaagagugcgggaagggcuuuuguagagcgucuaacuuccuggcccacaggggaguccauacuggcgaaaaacccuaucgcugcgacgugugugggaagcgguuuagacagaggagcuacuugcaagcacaccagcgcguacauacaggagagcgaccguauaagugcgaagagugugguaaaguuuucuccuggucaagcuaccuacaggcucaccagcgggugcacaccggcgagaagccuuacaaaugcgaagagugcgggaagggauuuucuugguccaguagccugauuauccaucaacguguccacgccgaugacgaaggcgauaaagacuuccccucuuccgaggauucacauagaaagacuagguga

SEQ ID NO: 65176 - RNA, 7521 nt, Artificial Sequence
  derived and/or modified sequence opt3 from ZNF462__Homo_sapiens__NP_067047
auggaggugcugcagugcgacggcugugauuucagagcccccagcuacgaagaccucaaggcucacauccaagauguccauaccgcauuucuucagccuacagacguugccgaggauaacgugaaugaacugaggugcggguccguaaacgcgucuaaucagacugagguggaauucucaaguauuaaagacgaguuugcuauagccgaggauuugagcggacagaacgcaacguccuuagguaccggcggguauuacggacacucuccaggcuauuacggucaacauaucgccgcuaauccgaagcccacaaacaaauucuuucaguguaaguucugcguccgguauuuucgcucgaaaaaucugcuaauugaacacacucgaaaggugcauggggcacaggccgagggaucaagcaguggcccuccaguucccggcucccucaacuacaauaucaugaugcacgaaggguucggaaagguguuuucuugucaguucugcaccuauaaaagcccucguagagcuaggauuaucaagcaccaaaaaauguaccauaagaacaaucugaaagagacaaccgccccacccccugcgccagcaccgaugcccgacccugucgugccacccguaucccuucaggauccuuguaaggagcugccagccgaaguuguggagcggucaauauuggaaaguauggucaagccccucacuaaaagccgcgguaacuuuugcugugaguggugcucuuaccagacaccgagaagggaacgguggugugaccacaugaugaagaaacaucgcuccauggugaagauccugucaagccugcgacagcaacaggagggcaccaaucucccugaugugcccaacaaaagugcuccaucuccuacguccaauagcacuuauuuaaccaugaacgccgcaucgagagagauucccaacacaacugucucuaauuucaggggguccaugggaaacucaaucaugcggccaaauaguagcgcuuccaaguuuucucccaugagcuacccucagaugaaaccaaagucaccgcacaacaguggccugguuaaucuuaccgaacguucccgcuaugguaugacagacaugaccaacagcucugccgauuuggagacgaauucaaugcugaacgacaguagcuccgacgaagagcuaaaugaaauugauucugagaacgggcucucggcgauggaccaccaaacuagcggacuguccgccgagcagcuuaugggcucagauggcaauaagcuguuggaaacaaaagggauccccuucagaagguucaugaaccgguuucagugcccuuucugcccauuucucaccaugcaucgacgcaguauaucuagacacauugagaauauccaucugagcggaaagacugcaguguacaaaugugacgaaugccccuucacauguaaguccucauuaaaacugggugcucacaagcagugccauaccggcacgaccagcgauugggacgccguaaacucucaauccgagaguauuagcucuucccucaaugaagggguggucucauaugagaguagcucgaucaacggaaggaaguccggcgugaugcuugauccucugcagcagcagcaaccaccccagccgccuccacccccucccccaccucccccaucucagccgcagccuuugcaacagccccagccaccccagcuacaaccuccacaccagguucccccucagccgcaaacacagccacccccuacucagcagccacaacccccuacccaggcugccccgcugcaccccuacaaauguacaaugugcaacuauagcacuaccacacucaagggucugcgggugcaucagcagcacaaacauucauuuugugacaaucuuccaaaguucgaggggcaaccuaguucccugcccuuggaaaacgagaccgauucucacccaagcuccucaaauacugucaaaaagagccagacgaguauccucggccugucuuccaagaacaauuuuguggcaaaagccagccgcaaguuagcuaacgacuucccucuggaucuaucgcccguaaaaaagagaacaaggauugacgaaauagcgucaaaucuccagucuaaaaucaaccagaccaagcaacaggaggacgcaguuauuaauguggaggaugacgaagaggaagaggaagauaacgaggucgagaucgaaguggagcuggaccgugaagaggaaccaacugagccgauaauugaggucccuaccaguuuuuccgcccagcaaaucugggugcgggauacaagcgaaccccagaaggagccaaauuuccgaaacaucacccacgacuacaaugcuacuaacggagccgaaauugagcuuacauugucugaagaugaggaggacuacuauggcagcuccacgaaucugaaagaucaucagguuucaaacaccgcacuccugaacacucagacacccaucuacgggaccgaacacaauagugagaacacagacuuuggagauagcgguagacuuuauuacugcaagcauugugacuucaauaacaaaucugccagguccgugucaacucacuaucaacgcaugcauccuuacauuaaguuuaguuuccgguauauacuggauccaaaugaccacagcgcuguauacagaugcuuggaauguuacaucgacuauaccaacuucgaggaucuccagcagcacuacggcgagcaucaccccgaagccaugaauguccugaacuuugaccauuccgauuuaauuuauaggugccgcuucugcucuuacacgucgccuaaugugcgaagccugaugccgcacuaucagcggaugcauccaaccguuaaaaucaacaaugcaaugaucuuuucauccuacguggucgagcaacaggaagggcuaaacacagagagucagacucuccgugaaauucugaauucugcgcccaagaacauggcuaccagcacaccuguggccagaggaggcggucuucccgcaacuuucaauaaaaacaccccaaagacguuuacaccugagugugagaaccagaaggaccccuugguaaauaccgugguugucuaugauugcgacguguguuccuucgccucaccaaacaugcacucugugcugguccacuaccaaaaaaagcauccugaagagaaagcuagcuacuuuaggauacagaagacuaugcgcaugguuaguguggaucggggguccgcccucagccagcugucuuucgaagugggcgcaccgaugucacccaaaauguccaauaugggaaguccaccucccccacagccucccccgccagacuuaagcacagagcuguauuacugcaagcacuguucguauucuaacagauccguagucggcgugcuuguucauuaccaaaagaggcacccugaaaucaaagugaccgcuaaguauauucgacaggcccccccaacugcggccaugaugcgcggggucgagggaccccaggguagcccucggccgcccgcuccaauccaacaguugaauagaucaaguucugagagggauggcccucccguggaaaacgagauguuuuucugccagcacugugacuacgggaaucguaccguuaaaggagugcucauucauuaucagaagaaacaccgcgauuuuaaggcaaacgccgacguaauccggcaacauacagcuacgauaagaucccugugcgauaggaaucagaagaaaccugccagcuguguccuagugucaccaaguaaccuggaacgagacaagaccaaacuccgggcacugaagugccgccaguguagcuacacuucccccuacuucuaugcgcuuagaaaacacaucaagaaggaccauccugccuugaaagcuacagugaccucuauuaugaggugggccuuucuggauggcuuaaucgaggcagguuaccacugcgaauggugcauuuauagccacacagagccaaaugggcuccugcuucauuaccagcggcgacaccccgagcauuaugucgacuacacuuauauggcuaccaagcugugggccggcccggauccuuccccacccucauugacgaugccugcagaagccaaaacauacagaugucgcgacugcguuuucgaggcugugucuaucugggauauaaccaaccacuaccaagcguuccacccaugggccaugaauggagacgaaaguguacuccuggauauuaucaaggagaaagacgcaguggagaagcccauucuaucgagcgaagagcuggcuggcccggucaacugugaaaauuccaucccuacucccuuuccagagcaggaagccgagugcccugaggaugccaggcucucucccgaaaaaucacugcagcuugcuagcgcaaacccagccauauccaguacccccuaucaguguacagugugccaaucugaguacaauaacuugcaugggcuguuaacucacuauggaaagaagcauccuggcaugaaaguuaaggcggcugacuucgcccaggauaucgacauuaacccaggugcaguguacaaaugucgucacugcccguauaucaauacccggauucaugggguccucacacacuaccagaagagacaccccagcaucaaagugacggccgaagacuuuguucaugauguggagcaaucagcugacauaucccagaacgaugucgaagagaccaguaggauuuucaagcagggauauggcgcauaccgcuguaagcugugcccuuacacucacgguacacuugagaaacugaagauccauuaugaaaaauaccacaaucagccagaguuugacguauucagccaaucucccccuaagcuaccagugccccucgaaccugagaugaccacugaaguuuccccgucacaggugagcaucacagaggaggaagucggcgaggaaccagugucgaccucucacuuuaguacgucccaucugguaagccacacuguguuccgaugucaguugugcaaauauuuuugcucaaccagaaaggggauugcccggcauuacaggaucaagcacaacaauguccgcgcgcagcccgagggaaaaaacaaucuguucaagugugcuuuaugcgccuauacaaacccuauucguaaaggccucgcagcccauuaccaaaagagacacgauauagacgcuuauuacacccacugucuggccgcaucccggacuaucucugauaaacccaauaagguuauuaucccaagcccucccaaggacgauaguccacagcuuuccgaggaacugaggcgcgcuguggagaaaaagaaaugcagcuuguguucuuuucagucauucaguaagaaagggauugugucccauuacaugaagcgacacccgggagucuucccuaagaaacagcaugccagcaagcucggcgguuauuuuacagcgguguacgccgacgaacacgagaaacccacccugauggaagaggaggaaagagggaacuucgagaaggcagaaguugagggagaagcucaagagaucgaguggcuaccauuucggugcauaaaauguuucaagcugucuuuuucgacagccgaacuucucugcaugcauuauacugaucaccacucaagggaccugaaacgcgauuucaucauuuugggcaauggucccagacugcagaacagcaccuaccaguguaagcauugcgacuccaaguuacagaguacggcugagcucacaucucaccugaauauccauaacgaagaguuucaaaaaagggcaaagcggcaggaacgucgcaaacagcuucugagcaagcaaaaauaugccgacggcgccuucgcugauuuuaagcaggagcgaccuuucgggcacuuggaggaaguaccaaagauuaaagagagaaagguggucggauacaaauguaaguuuugcguggaaguucaccccacccucagggcgaucugcaaucaucugcggaaacacgugcaguauggcaacgucccugcaguguccgccgcuguaaaggggcuacgcucacaugagagaagucaccuggcccuugcaauguucacuagggaggacaaguacucuugucaguacugcagcuuugucuccgccuuccggcauaaccucgaucgacacaugcaaacccaccauggacaccauaaaccguucagauguaagcugugcucauuuaaaagcucuuauaauucccgcuugaagacacacauauuaaaagcucacgcgggcgaacaugccuacaaguguaguuggugcagcuucucgacuaugaccauuucccagcugaaggagcacucucucaaagugcaugguaaggcacugacgcuuccaaggccccggaucguuucacuguugagcagucacucccaucacucuagccagaaagcuacaccugccgaagagguggaagacucaaacgauuccaguuauagcgagccacccgacguccagcaacagcuaaaucacuaccagucugcagcccuggcucguaacaauucaagaguguccccuguuccccucagcggggccgcggcaggaaccgagcagaagacugaagccgugcugcauugugaguuuugcgaauucucuaguggcuauauccaaucgauuaggcgccacuaccgggauaaacaugguggcaagaaacuuuuuaaguguaaggacugcuccuucuauacaggguuuaaaagcgcuuucaccaugcacgucgaggccggacauucagcugugccagaagagggcccgaaggauuuacgauguccucugugccucuaccacacuaaauacaagagaaacaugauagaccacaucguauugcauagggaggaacgcgugguucccauugaggucugccggucuaaacugagcaaguaucuccagggggugguguuuagaugugauaagugcacauucaccuguuccagugacgaaucacugcagcaacacaucgagaaacauaaugaacuuaagccauacaaaugccagcuguguuauuacgagacgaagcacacugaggaauuggauucucaccuacgugacgagcauaaagucagcaggaacuuugaacugguaggacgggugaaucucgaccaguuagagcagaugaaggagaagauggaauccaguagcuccgaugacgaggauaaagaagaggaaaugaacucuaaggcagaggaccgcgagcugaugcgauucucagaucacggcgccgcucuuaauaccgaaaaaagauuuccuugcgaguucugugguagggccuucagccaagggucggaaugggagcggcauguucugcgccacggaauggcacucaacgacacaaagcagguguccagagaagagauucaucccaaagagaucauggaaaauagugucaagaugccaucuauagaggaaaaggaggaugacgaagcgaucggcauugauuuuagcuugaaaaacgagaccguggccaucugcguugugacagcugacaagucacugcucgagaaugccgaagcaaaaaaggaguga

SEQ ID NO: 65177 - RNA, 11778 nt, Artificial Sequence
  derived and/or modified sequence opt3 from ZNF469__Homo_sapiens__NP_001120936
augcccggcgaacgcccuagaggggccccuccgcccaccaugacaggagaccugcagccucggcaaguggcuagcuccccaggucaccccucucagccuccacucgaagauaacacucccgccacgcgcaccaccaagggcgcccgagaggcagggggacaggcucaggccauggaacuuccugaggcucaaccacgucaggccagggacggcgaacugaagccgcccucauugaggggucaggcuccuagcuccacuccagggaagcggggauccccacagaccccuccaggccgcucucccuuacaagcaccgucgcggcuggccggcagggcugaggggucaccuccccagcgguacauccuuggaauugccagcagucgcacaaaaccaacccucgaugagacuccugaaaauccccagcuggaggcggcacagcuuccagaagucgacacaccccaagguccuggcaccggggccccacugcgaccgggauugcccaggacggaggcucagccugccgcagaggaacucggcuuccacaggugcuuucaggagccacccuccucuuucacuagcaccaacuauacauccccuucagcuacuccacggcccccggccccugguccaccccaaagucgugggaccagcccucugcagcccggaucuuacccagaauaucaggcguccggcgccgauucauggccucccgcagcugagaauagcuuuccaggcgccaacuucgggguuccgccugcugaacccgagccaauacccaagggaagucgcccugguggcucuccaagagggguguccuuucaguuccccuuuccugcccugcacggagcaagcacaaaaccguucccagccgacgucgcuggccaugcguuuaccaaugguccccucguguucgcauuucaccaaccucagggggccuggccagaggaagcugucggcacgggacccgccuacccuuuaccgacucagcccgcaccaucgccucugcccuguuaucagggccaaccagggggacuuaacaggcauucugauuuguccggugcccugucaaguccuggcgcugcccacagcgcaccccggccauucuccgacucucuacacaagagccucacaaagauccugccggagcgaccucccucagcgcaggaugggcuuggaaguacccgcggcccacccuccagccugccucagagacauuuuccaggucaggcuuacagggccucugggguggacacuucacccggcccuccggauacagaauuggcagccccaggacccccucccgcucggcucccacaacugugggacccuaccgccgcacccuauccaacgccuccgggcgggcccuuagcugccacccgcaguauguucuucaauggacagccaagcccuggucagagacugugccucccccaguccgcgccacuuccuuggccccaaguucugccgacagccaggccaucuccucacggcauggagauguugucgcgucuacccuuuccagcugggggacccgaauggcagggcgguagccagggggcacugggcacugccggaaaaaccccuggcccgcgggagaagcuccccgcugugcgauccucacaagggggaaguccagcccuguucacauacaacggcaugacugauccuggugcacagccccuauuuuucggggucgcgcagccucaggugucuccacauggaacccccagccugccuccacccagaguaguuggcgccuccccgucagagagcccuuugccaucucccgcuacaaauaccgccgguuccacuuguaguagccucucuccuauguccucaaguccagcaaaccccagcucggaagagucccaacugccgggcccuuuagggcccucugcauuuuuccacccaccuacgcacccccaggaaacaggaagcccauuucccucaccugagccaccgcauagucugcccacccacuaccagccugaaccagccaaagcauuccccuuuccugccgacggccuaggggcugagggagcguuccagugccucgaggaaacuccauuuccccaugagggcccugaaguggguagagggggacugcaaggcuucccgcgcgccccacccccuuaucccacccaccauuuuucccuuucuagcgcauccuuggaccagcuggauguccuccugacaugucggcagugcgacagaaauuacucaagccuugcugccuuccuggcccacaggcaguucugugguuugcuccuggcucgcgcaaaggauggccaccaacgaaguccagggccucccggauuaccaucuccgccugccgcgccccgggugccagcugacgcccaugcaggccugcuaucccacgccaaaaccuuucuccuggcuggggaugcacaggccgagggaaaggacgauccccuucguacuggcuucuugccuagccuggcggcuacaccauuuccccucccugccucggaccuggauauggaggacgaugcaaaguuagacucacugauuacggaagcccuuaacgguauggaguaucagucugacaauccggaaaucgauaguuccuucauugacguguuugcugaugaggaaccaagcgggcccagaggaccuucuagcggccauccauugaaauccaaggccggugucacccccgagucaaaagcaccucccccacucccggcugccacuccugacccccaaacaccaaggccuggcgaucgcgggugccccgcgcggggaagaccaaagaccaggagucugggccuagccccuacagaggcagacgcucccagccaggggcgacagcagcgccggggaaaacaacugaaacucuucagaaaagaucuggacucuggcggugccgcugaaggguccggaucaggcggcgggggaagggcaaguggucuucguccgcgccggaacgauggcuugggggagagaccaccucccaggccacgacggccccgcacucaggccccuggaagcagagccgacccggcuccaaggguuccccgggcggcagcccugccugaagagacccgauccucuagacgcaggcguuuacccccacggaaggauccuagaaagaggaaagcucgcggcggugccugggggaaggaacucauccugaaaauagugcagcagaagaaucgacuuagagaguacgacuuugcaucggagagcgaagaggaugaacaacccccaccucggggaccgggcuucaggggccgccgugggagaggagagaaacggaaggaaguagagcugacgcagggucccagggaggacgaaccacagaagccucgcaaagccgcucgacaggaggcgggcggggacggagcccccgcaaacccagaagaaccuggcgguucaagacccgggccgggacgguccccacaagcuaggggcccuagucgcucuuuggagaccggcgccgcagccagagaagggggacccaagugugcugauaggccaagcguggcccccaaagacccucuccagguccccacaaacacugagaccuccgaagagacacggccaucacuggauuuuccucaggaagcgaaggagccggagacugcagaagagucugcccccgacagcaccgaguucacggaggcucuacguagucccccugccgcuugcgccggugaaaugggcgccucccccgggcugcucaucccagagcagccucccccgagccgccacgauacaggaaccccuaaaccaucuggcucacuggcuaauacugcaccacacgguuccaguccuacaccaggggugggaagccuuuugggcggccccgggggaacccaagcaccuguuucgcauaacucuaaggacccacccgcgcgacagccgggugaguuucuggccccuguggcuaaucccuccagcacugccuguccaaagcccucagucuuaaguucuaaaauuuccagcuucggcugcgauccugcaggguuuaacagagacccacucggagugcccguagcuaagaaaggcccucagccauauucaaguccgcacagcgaacuguuccuuggucccaaggaucuggccgggugcuuccuagaggaacuccauccuaaaccauccgcaagggacgcacccccugcuucuagcuccugucugugccaagauggagaggacgcgggcucauuggaaccacagcugccccggucuccgccuggcaccgccgagacagagccagggcgcgcagcuagucccccuacguuagaaucgagcucccucuuucccgaucugccaguugacagauucgacccgccucuuuacggaucucugucagccaauagggauagcgguuugcccuuugccugugcagacccaccccagaagaccgugccuuccgauccacccuauccuaguuuccuccugcuagaggaagucucuccaaugcugccgagccacuuucccgaccuuucaggcgggaaggugcucuccaaaacuugcccuccagagcggacagucgugcccggagcugccccuagucugccaggcaaggguagcggguguucuguugcguugaugucccaucugucagaggaugaauuagagauccagaaacucgugaccgaacuggagagccaacuucagcgaucgaaggacacaagaggcgcuccccgcgaacuggccgaggcagagucuguaggaagggucgaauugggcacugggaccgagccuccgagucagcggcguacgugccaggccacagugccccacgaagauaccuucuccgcugcagaccucacuagaguuggagagagcaccgcccacagggaaggugcggagucagcuguggccacagucgaggcagugcaaggccgcccagggggaacuuggccuugucccgccuccuuucauccaggccacgcugcccugcuaccuugcgcacaggaagaucugguaucuggugcucccuucagcccaagaggggccaacuuucauuuccagccggugcagaaagcgggcgccaguaagaccggacuuugucaagcagagggcgacucccgaccuccccaggauguuugccucccagaacccagcaaacagccugggccacaacuggacgcuggaucuuuggccaaguguucacccgaccaggaguuaaguuuuccuaagaauaaagaagcagcuuccagccaggagucugaggauucgcugagacuccugccgugcgaacagagggguggcuuccuucccgagccagggacagccgaccaaccucaccgcggagcccccgcgccagaggcuuucggcucacccgcgguccaucuggcccccgauuuggcuuuucagggugacggggccccaccgcuagaugcaacguggccuuucggcgccagccccucccacgcugcgcagggacacagugccggccgggcagggggacaucugcacccaaccgcuggcagaccugguuuugaggggaacgaguucgcccccgcaggagccucuagccucacugcuccacguggcagggaagccuggcuggugccugugcccuccccggcgugcgucucaaauacacauccaagucggcgcucucaggaccccgcacuuagcccuccaauucgacaauuacagcugcccgguccuggcguugccaaguccaaagaugggauccucggauugcaggagcugaccccggcugcccagucacccccaagagugaacccuagcggccucgaagggggaacuguggagggcgguaagguagcaugugggcccgcucaaggaucuccaggcgguguccaggugacaacccugccugccguugcuggccaccagcuugggcuggaagccgacggacacuggggcuugcuagggcaggcagagaaaacgcaaggacagggcacugcgaaucagcugcaacccgagaacgguguguccccagggggaaccgauaaucaugccagugucaacgcuagcccuaagacagcccucaccggccccacugaaggcgcaguguuacuggagaagugcaaagggucgagggcugccaugucccuucaggaagaggcagaaccgacaccuucuccacccucaccuaaucgggagagccuggcccucgcguugaccgcugcccacagucgcuccggaucugaggguagaacaccagaaagggcaagcucacccggccugaacaagccgcuccuggccacuggggacuccccugcucccaguguuggagaucuugccgcaugugcuccaagccccaccucugccgcgcauaugccuugcucacuaggcccacugccccgagaggacccuuugacguccccaagccgggcucaggguggguuaggaggccagcugccggccucucccaguugucgugauccuccaggcccccaacagcuccuggcaugcucgccugccugggcuccacuugaagaggcagacggggugcaggccacaaccgacacuggagcggaagauucccccguagccccgccuagccugaccacaucaccaugugaccccaaagaggcucucgcagguugcuugcugcagggcgaggggucuccucuagaagaucccagcuccuggccaccuggaagugucucagccgugacuuguacccacucuggcgacacgcccaaggauagcacacugagaauaccagaggacucccgcaaagaaaagcucugggagaguccggguagggcuaccagucccccucuugccggggcaguguccccaucugucgcuguucgggccacuggacugucaagcacacccaccggcgaugaggcgcaagccggcagaggguuaccuggaccagacccccagucgcgcggugcaccuccgcauacuaacccagauaggaugccccgaggccacuccaguuacucuccuagcaauacagcucgguuggggcacagagaaggacaggccgugaccgcaguaccaacggagcccccuacucugcagggcgccggucccgacucaccagcuugccucgaaggggagaugggaaccuccucuaaggaaccggaggauccuggcacacccgagaccggcaggaguggggccacaaaaaugccacgcgugacuuguccuagcaccggacugggucuuggccguacgacagcgcccuccucaacugcuagcgacuuucaaucugauaguccacagucccaucggaacgcaagccaccagaccccgcaaggggacccucugggaccccaggaccucaagcagagaucaaggggcuacaaaaagaaaccagccucuacagaaaauggucaguggaaggggcaagcuccccauggaccuguaaccugcgaggugugcgccgcauccuuccgcucgggcccaggcuugagccgacacaaggcccggaaacacagaccccauccuggggcuccggcggaaccaagucccgccgcacugccugcccagcagcccuuagagccacuagcucagaagugucaaccucccaggaaaaagucucaccgcguuuccggaaaagaaagaccaaaccauagccggggugauccuucacacgugacucagccgcccccagcacagggcaguaaggagguccugagggccccugggagcccccacagccagcaacuccacccaccuucucccaccgagcacgaaguggacguuaaaacaccggcuucaaagccacgucccgaucaggcccgagaggacgaacuucauccuaagcaggcggagaaacgcgaaggaagacgguggaggcgcgagccaacgguggauagccccucccacucugagggcaagaguaauaaaaagagagguaaacugcgggggaggcgauugcgugaagagucgauucugccugucagcgcagacguaaucuccgauggaagaggcucacgccccucuccagccauggcuagcuaugccgcaaguccuucccauugccucucaguggaaggcgggccggaggcugacggagagcaacccccacggcuggccacucuugguccuggcguuauggaaggggcggccgagaccgaucaggaagcucucugugcaggagagacaggcgcccagaagcccccaggugacaggaugcugugcccugggagaauggauggcgcugcauugggagaacagcccaccggccaaaagggggccucugcucgcggauuuugggguccgcgggagacuaaagcccugggcguguguaaggagagcggguccgaaccagcagaggacaguagcagggcccacucucgaucagaagagggagucugggaagagaacacaccucccuuaggcccacuagguuucccugagaccuccagcagucccgcggacucuacgacuuccucgugccugcaggggcucccggauaauccugacacacagggcggagugcagggccccgaagggccaacccccgaugcuagcggaucauccgccaaagacccuccaucucuuuuugaugacgagguaaguuucagccaacuguuucccccugguggcagauugacccggaagaggaacccacacguguacgggaaacgcugugaaaagcccguccugccgcucccuacucagccaucauucgaggaaggaggcgaucccacacuggguccugcacgucuuccaaccgacuuauccgauagcucuagucugugccucugucaugaggaccccugggaggaugaagacccugccggcuugccagaguccuuucugcuagauggguuccugaauagcagaguucccggaauugacccgugggcuccuggccucucacuuugggcccuggaaccaucucgagaggcaggggcugagaaguugcccucgcacugcccugaagacgauaggcccgaggccaucccagaacugcauauggugccggcggcauggcggggacucgagaugcccgccccugcugacgauagcuccaguucucugggcgacgugucaccagaacccccuagcuuagagcgcgagagaugugauggugggcuuccaggaaacacacaucugcucccccuaagggccacugacuucgaaguccuguccacgaaauuugagaugcaggauuugugcuuccugggcccuuuugaagacccagugggucucccgggccccaguuuccuugauuuugaggggaccgcuucuagccagggaccucaaucccggcgcacagaagaggcagccggcgcggggagagcccagggacgaggcaggccagcuaagggucggcgugcaucauauaaaugcaagguuuguuuccagcgcuuuagaagccugggggaguuggaccugcauaaacucgcccacacucccgcuccuccaccaaccugcuacauguguguagaaaggcgguucggaucuagagaguuacugcgcggccaccuucaggaacgacaugcccaauccaaggcagguccgugggccugcggcaugugucugaaggagguggcugaugucuggauguauaaugaacaccuaagggagcaugcggugcgguuugccagacgugggcaggcacgcaggagucucggagaccugccuggcggguuggagggaucaagcgcuguugcccaucugcucaacucgaucacagaacccgcaccaaaacaucaccggggcaagagauccgccgguaaagcugcggggucuccuggagaccccuggggccaggagggcgaagccaagaaagauaguccaggggagcgagcaaagccuagggcucgcagcacccccucaaauccggacggagccgccacuccagauuccgcuucugcaacggcccuugcugacgcggguagccccggcccuccacggaccacacccaguccuuccccagaucccugggccgggggagagccucuguuacaagcaacuccggugcacgaagccugcaaggaccccagcagagauugucaucacugcggcaaaagguucccaaagccuuuuaaacugcagcgccauuuggcuguccacucuccccagcguguguaccucuguccacggugcccuagaguauaucccgagcacggugaacugcuagcacaucuugggggagcccacggccugcucgagcgaccggaacugcagcauaccccauuguacgcuugugagcugugcgccacagucaugaggauuauaaagaaaucauucgcaugcuccagcuguaacuacaccuuugcgaagaaagagcaauucgaccgccacaugaauaagcaucuccggggcgggagacagccuuucgccuuuaggggagugcgcagacccggugcuccaggccagaaggcccgggcacuugaagggacucugccuaguaaacgaaggcguguugcuaugcccggaucugccccaggcccgggugaggauagacccccuccacgggggucaucccccaucuuaagcgaaggaucgcugccugcguugcuccaccugugcucugagguggcccccaguacaacgaagggcuggccagaaacccuagagcgcccugucgacccggugacucaccccauuaggggcugugagcuuccauccaaccaucaggaaugcccucccccaagccugucaccuuuccccgcugcacucgccgaugggcgaggagacugugcucuggauggugcauuggagagaccagaaaacgaggccucuccuggcagcccggggcccuuacugcaacaggcccucccacuuggagcuucccugccucggcccggcgcacgcggucaggacgccgaagggaaaagggcgccccuaguuuuuaguggaaagagacgggcuccuggcgcccguggccgcugcgcacccgaccacuuccaggaggaucaucugcuccaaaaagagaaggaagugucaagcucccacauggucucugaagggggaccgaggggugccuuucacaagggcagugcuacaaaacccgccgggugucagagcuccucaaaggaccgaucugcagcuucgaccccaagcaaagccuugaaguucccugugcaucccagaaaagcgguaggaucccuggcaccuggcgagcuugcccgggguaccgagaaugggaugaagccagcuacacccaaggccaaaccuggaccaaguucucagggcagcggcucaccgaggcccgggacuaagacgggagguggcucccaaccucagccagcuagcgggcagcugcagucugagaccgcaacaacucccgccaaaccuaguuuuccaucccgcucacccgcgccggaaagacucccugcccgggcucaagcaaagagcugcaccaaaggaccaagggaggccggcgaacaggguccccacgggucuuuaggcccuaaggagaagggagaaucguccacaaaacgcaagaaaggccaggugcccgggccagcucgaagugagagcguuggaucauucgguagagccccgucugcacccgauaagccuccacguacaccccggaaacaggccacuccuuccaggguccugccaacgaagcccaaaccuaacagccaaaauaagccaagacccccgccuagugagcagagaaaggcugaaccaggccauacacagcggaaagacagguuggggaaggcguuuccccagggacgaccucugcucagaccacccaaacgcggcaccgccgugcacggugcagagccugcugaaccgcauacucaccggaccgccgaggcacaaucagaucuucugucccagcuauucgggcagaggcugacaggcuuuaagaucccccucaaaaaggacgccagcgaauga

SEQ ID NO: 65178 - RNA, 771 nt, Artificial Sequence
  derived and/or modified sequence opt3 from ZNF483__Homo_sapiens__NP_001007170
augcaggccguggucccccugaacaagaugaccgcuaucagcccugagccacaaacacucgcauccacugaacagaaugagguuccgagagugguaacgucuggcgaacaggaggccauucuuagggggaacgcggcugacgccgaaucauuccggcagcgcuuucgaugguucugcuacagugagguggcaggaccccguaaagcccugagccaauugugggaguuauguaaucaguggcugagaccugauauacacaccaaggaacagauccuagagcuccuggucuuugaacaguuccuuacaauucugccaggugagaucaggauuugggugaaaucccaacaucccgagucuucggaagagguugugacuuugaucgaagaccucacccagaugcuggaggaaaaggauccugucucacaggacagcacagugagucaggaggagaacuccaaagaagauaagaugguaaccguuugcccaaauacugagucuugugaaagcauaacacugaaggacguggcugucaacuuuucccggggcgaguggaaaaagcucgaacccuuccaaaaagaguuauauaaggaggugcugcuugaaaauuugcgcaaccuggaguuucuagauuucccugugucaaaacucgaacugaucagucagcuuaagugggucgagcugccaugguugcucgaagagguuagcaagucuuccagacuggacauucacggggcagugaaaaagaugcagauguuuucagaggccgaauga

SEQ ID NO: 65179 - RNA, 1590 nt, Artificial Sequence
  derived and/or modified sequence opt3 from ZNF490__Homo_sapiens__NP_065765
augagaaggaacagcucccugucuuuccagauggagcggccccucgaagaacaagugcagucaaaguggaguagcucccagggccgcaccgggacaggagguucugacguccuucagaugcaaaauucggaacaccauggccagucaaucaaaacucagacggauagcauuagucuggaggacguugccgugaacuuuaccuuggaagagugggcuuuacuggauccugggcagcgaaauauauaccgugacguaaugagagcaacauucaagaaccuagccugcaucggagagaaauggaaggaucaagacauugaagaugagcacaaaaaucagggcaggaaccuccgguccccaaugguggaagcgcugugugagaauaaggaggacugcccgugugguaagucuacuagccagauccccgaucuuaacaccaaucuggaaacaccuaccggguugaaaccaugcgacuguuccgucugcggagagguguuuaugcaucagguuucacucaaccgccacaugagaagucauacugaacaaaagcccaaugagugucacgaauauggcgagaaaccucacaagugcaaagaguguggcaagacauucaccaggucuagcuccauucggacgcaugaacgcauccacacuggggagaagccauacgaaugcaaagaguguggaaaggcuuuugccuuccuguuuucauuccgaaaccauauaagaauccacaccggugaaacacccuaugagugcaaagagugcggcaaggcauuuagguaccugacugcccuccggcgucacgagaaaaaucauaccggggagaagccuuauaaauguaagcagugcggaaaggcuuucauuuacuaucagccauuuuuaacacacgaacgcacccauacgggcgagaaaccguacgaauguaagcaaugcgguaaagcauucagcugucccacuuaccugagaagucacgagaagacacauaccggggagaaaccuuuugugugcagggaauguggacgggccuucuucucucacuccagccuucgaaagcacgucaagacucauacaggcgugcagccauauaccugcaaaaaguguggcgaggcuuuuaaaucgucuuccucaugcgaaguacacgagcgcacgcauuucggggagaagcccuacgaauguaaacagugcggaaaggccuuuaacaguagcuccuauuugcagcugcacgagagaguucacaccggugaaaagacauacgagugcaaagaauguggcaaggcguuccuauauucuacucauuuuaggauccacgagcggacccauacacgcgagaaaccuuacgaaugcaagcaaugugggagaguguucauuuauuuuagccaccucaggcgucaugagcggucacacacuggagucaaaccaugcgaauguaagcagugcggcaaggcauucaccugucugaauagucuuaaagugcacaagcgaauccauacaggugagagacccuuucagugcaggcagugugggaaagccuucuccuacagcaagucucugcacgugcaugaacgcacccacucacggcaaaaaccguga

SEQ ID NO: 65180 - RNA, 1596 nt, Artificial Sequence
  derived and/or modified sequence opt3 from ZNF492__Homo_sapiens__NP_065906
augcuggagaacuacagaaaucucguguucgucggcaucgccgcuagcaagcccgaccuuauuaccugccuggaacaggggaaagagccuuggaacguuaagaggcacgaaaugguggcagagccaccgguaguguguuccuauuuugcccgggauuuguggcccaaacaaggaaagaaaaauuacuuccagaaggucauauuacgccgauauaagaaaugcgguugugaaaaccugcagcuacguaaguacugcaaaucuauggacgaguguaaggugcauaaagagugcuauaauggccucaaccagugucugacaacuacgcaaaauaagaucuuucagugcgauaaguacguuaaaguguuccacaaguuuucaaacaguaauagacauaccauuaggcacacagggaaaaagagcuucaaauguaaggaaugcgagaaauccuuuuguaugcuuucucaucuggcgcagcacaagcggauccacucgggagaaaagccuuauaaaugcaaggagugcggcaaagcauacaacgagacuucaaauuugagcacccauaagcgcauucacacagguaaaaagccauacaagugugaagagugcgggaaagccuucaacagacucagucaucugaccacucacaagaucauacacacaggcaaaaagcccuauaaaugugaagagugcggaaaggcauuuaaucaguccgccaaccugaccacgcauaagaggauccacacuggcgaaaaaccuuacaagugugaggagugcgggcgggcuuucucucaaagcuccacccucacagcacauaaaauuauccacgccggagaaaagccauauaaaugugaggaaugcgguaaggcuuuuucacagaguagcacuuuaaccacacauaagauuauccacaccggcgagaaauucuacaagugugaagagugcgggaaagccuuuucucagcugucccaccuuacgacucauaagcgcauacacucaggagagaaacccuauaagugugaagagugcggcaaagcguucaagcagagcaguacauugaccacucauaagcgaauccacgcuggugaaaaauucuacaagugcgaggucuguucuaaagccuuuuccagauucagccaccugacaacccauaagaggauucacacgggggaaaaaccuuauaagugcgaggaguguggaaaggcuuuuaaucuaucgucucaacucaccacacauaaaauuauccacacuggcgaaaagccauacaaaugcgaggaauguggcaaggccuucaaccaguccucaacccugaguaaacauaaggugauccacacaggggagaagccguacaaauaugaggaaugcggaaaggcauuuaaccagagcucccaccuuacuacccauaaaaugauucacacaggugagaagcccuacaaaugugaagagugcggcaaggcuuucaauaacucuagcauacugaaucggcauaagaugauccacaccggggaaaaauuguauaagccugagucauguaacaaugccugcgacaacauugcgaaaaucaguaaguacaaacguaauugugccggagagaaguga

SEQ ID NO: 65181 - RNA, 1764 nt, Artificial Sequence
  derived and/or modified sequence opt3 from ZNF496__Homo_sapiens__NP_116141
augcccaccgcccugugcccuagagugcuggcuccaaaggagagcgaagaaccgaggaaaaugcgguccccucccggcgaaaacccaucuccccagggggagcuuccuucaccagaaaguagccgccgacuguuccguagauuuagguaccaagaggcagccggaccccgggaggcguugcagcgcuuaugggaccugugugguggcuggcuaagaccugaaaggcacacaaaggagcagauccucgaacugcuuguccuggagcaguucuuggcuauucucccacgggagauacaauccuggguucgcgcccaggaaccggagucuggggaacaggcaguggccgcuguagaggcacuggaacgagagcccggaagaccuuggcaguggcugaaacauugcgaggauccaguggucaucgacgauggcgacucgccccucgaucaagaacaggagcaguuaccuguggaaccacacucagaccuggccaagaaucaggaugcucaacccauuacucuugcccaguguuugggucugccgagcaggccucccagucagcuauccggggacccaguucuccaagaugcguuucugcuucaggaggaaaacgugcgggacacgcagcaggucaccacacugcaauugccucccucucgugugagcccauucaaagauaugauccucugcuuuuccgaggaggacuggucacuguuagaucccgcacagacuggauucuauggcgaauuuauuaucggcgaggacuacgggguaaguaugccuccaaaugaccuggccgcucagccggaucucagccagggagaagagaacgaaccccgcguuccugagcuucaagaccugcaggguaaggaggugccacaggucucuuauuuggauucccccucacuacagccuuuccaaguggaagagagaaggaagcgggaggagcuccaggugccagaguuucaggccuguccccagaccgucguuccgcaaaauacauacccugcaggcgggaacccacgaagccuggaaaauagucuggacgaggaagugaccauagagaucguacuuucuuccagcggagaugaagacucgcagcauggccccuauugcacugaggagcuggguucuccuacagaaaaacagcgcuccuugcccgcuucacacagaaguagcaccgaggccgggggagaagugcaaacguccaagaaaucuuacgucuguccaaacugcggcaagauuuucagguggcgggugaauuuuauccgccaucucagaagcaggcgugagcaggaaaaaccucacgaguguucaguuugcggcgagcuguucagugauuccgaagacuuagaugggcaccuggagagccaugaagcgcagaagcccuaucgguguggagccugcgguaagucuuuucgacuaaacucacaccuccugagucauagaaggauucaccuucagccagaccgcuugcaaccgguggagaaacgggaacaggcagcuagcgaggaugccgacaagggcccuaaagagccccuggaaaaugggaaggcuaaacucuccuuccagugcugugagugcggaaaggccuuccagagacacgaccaucuggcaaggcaccgcucucauuuucaccuuaaagauaaggcccgaccauuccaaugucgguacugcgucaagucguuuacucagaacuacgaccuguugcgucaugaaagacuccacaugaaaaggcgcagcaagcaggcucucaauuccuauuga

SEQ ID NO: 65182 - RNA, 816 nt, Artificial Sequence
  derived and/or modified sequence opt3 from ZNF501__Homo_sapiens__NP_659481
augaacagcucccagaucucucugagaaugaagcacggcagggugaauaugcagaaaaagcccucaaaaugcagugagugugggaaguucuuuacccaacggagcucccucacacagcaucagcgcauucaccgaggagaaaaaccuuacgucugcucugagugugguucgugcuuccguaagcaaucaaaccuuacucagcaucugagaauacacacgggcgaaaagccauauaaauguaaugagugcgaaaaggccuuucagaccaaagcuaucuugguucagcauuuaaggauucacacaggggagaagccguacaaauguaacgagugcggaaaggcauucugucaaagccccagucugaucaagcaccagcggauucauacuggcgaaaaaccuuauaagugcaccgagugugguaaagccuuuucccagucuaucugccuaacacgccaccagagaagccauuccggggacaagccauucaaaugcaaugaauguggaaaggcguuuaaccaaucagcuugccucaugcagcaccagaggauacacaguggcgagaaacccuacaccuguacugagugcggcaaggccuucacacaaaauagcucucugguggaacaugagcggacccacacgggggaaaaacuuuauaaauguuccgagugcgaaaagacuuuucgcaaacaggcacaucugucagagcacuaccgaauccauaccggagagaagccuuaugaauguguagguugcggcaagagcuucagacacaguucugccuugcucaggcaccagcggcugcaugcuggggaguga

SEQ ID NO: 65183 - RNA, 2862 nt, Artificial Sequence
  derived and/or modified sequence opt3 from ZNF507__Homo_sapiens__NP_001129628
auggaggaaagcuccucuguggccaugcugguccccgacaucggcgagcaggaagcuauucucaccgcagagucaauaaucaguccuagccuugaaauugaugagcaaagaaagacaaaaccagacccgcugauccacguuauucagaaguuguccaaaaucguggagaacgaaaagucucagaaaugcuuacugauagggaagaagaggccccggucgucagccgcgacucauagccuagagacgcaggaacucugugagaucccugcuaaaguaauucaaaguccagccgcagauacccgccgagccgagaugucccagacaaauuucacucccgacacccuggcucagaacgaaggaaaggcaaugucuuaccagugcagccuuuguaaauuucuguccucaaguuucagcguguugaaggaucacaucaaacaacauggucagcagaaugaggucauucucaugugcucugaaugucacaucacaucccguucacaggaggaacuggaggcccaugugguuaacgaccacgauaaugacgcuaacauacacacccaaagcaaggcccagcagugcgugaguccuucuuccagccuguguagaaagacuacagagaggaaugaaaccauuccagauauccccgucucgguggacaaccuccaaacgcauacuguacagaccgcgucuguugcagagaugggccggcgcaaaugguaugccuacgaacaguaugggauguacagaugcuuauuuuguuccuauacaugcggacagcaaaggaugcugaagacucacgcuuggaaacaugccggcgagguggauuguucauacccuauuuucgaaaaugagaacgagccacuugguuugcuggacaguagcgcagcugccgcgcccgggggagucgaugccguggugaucgcaaucggcgaauccgagcuaucuauucacaauggcccgagcguccagguucagauaugcucaagugaacagcucuccucuagcucaccucuggagcaaagugcugaacgcggggugcaccuuagccaguccguaacccuggacccaaacgaggaggaaauguuggaggugaucucugacgccgaagagaaucucauucccgauucgcuguuaacaagcgcucagaagaucauauccucaaguccuaacaaaaagggacaugucaaugugauuguugagcggcugccaucugccgaagagacccucagccagaaacgauuucuuaugaacacggaaauggaggaagguaaggaccuguccuugacugaggcacaaaucggcagagaggggauggaugacguguauagggccgauaagugcacagucgacaucggaggccuaauuaucgguuggucaagcucugaaaagaaggaugagcugaugaacaaagggcucgcuaccgacgaaaaugcgcccccgggacggcgucgcacuaacuccgagagucugagacuucacagccuggcagccgaggcuuuggugacaaugccuauuagggccgcagaacucacccgggccaaucugggccauuacggcgauauaaacuuacuggaccccgauacgucucagcgacagguagacuccacccuagcugccuacucaaagaugaugaguccacucaaaaauagcucggacgggcugacaucccuuaaccagucuaauagcacuuugguugcacugccugagggacgccaagaacucucagauggucaggugaagaccggcaucaguaugucccugcuuacagucauugagaagcugagagaaaggacugaccagaacgcgucugaugacgauaucuugaaagagcuccaagacaaugcucagugucagcccaacagcgauaccucccugucagggaauaacguggucgaauauaucccaaaugccgagcggcccuaccgcugcagauuaugucacuauacaagcggaaacaagggcuacauuaaacagcaucugagggugcaccgucaacggcagccuuaucagugcccaauaugugagcacaucgcagacaauaguaaggaucuagaaucucauaugauucaccauugcaaaacccgaaucuaccaguguaagcaaugcgaggaauccuuccacuauaagagccagcucagaaaccacgagagggagcagcauucgcugccggacacucuuucaauugccacgucuaacgaaccccgcaucaguuccgauacagcugacgguaaauguguucaggaggggaauaagagcucugugcaaaaacaguaccggugcgauguaugugacuacaccagcacuaccuaugucggcgugagaaaccacaggcgcauacauaauuccgacaagccuuaccgaugcucauugugcggauauguuuguagucacccacccagccugaaaucucauauguggaagcacgccuccgaucagaacuacaauuaugaacaagugaacaaggcaaucaaugacgcuauuucacagaguggccggguccucgggaaaagcccuggaaagacacagcugaaauccucugaggaaucggccgauccagugaccgguagcucagagaacgcgguauccaguucugaguuaaugagccagacucccuccgaagugcugggcacaaaugagaacgaaaaacuuucaccgacgucuaauaccagcuacaguuuggagaaaaucuccagccucgccccuccaucuauggaauauugcguucugcuauuuuguugcuguauuugcggguucgagucaacuuccaaggagaaccugcucgaccacaugaaagaacaugagggagaaaucgucaauauaauucugaacaaggaucacaauacagcucuuaacaccaacuga

SEQ ID NO: 65184 - RNA, 2679 nt, Artificial Sequence
  derived and/or modified sequence opt3 from ZNF512B__Homo_sapiens__NP_065764
augaccgaccccuucugcgugggcgggagaaggcugccuggaagcuccaagucugguccaggcaaagaugggucacggaaggagguccgccucccgaugcuucacgacccuccuaaaaugggaaugccaguugugcgaggcggucagacaguacccgggcaagccccucuguguuuugauccaggaagucccgcuagcgacaagacugaaggcaaaaagaagggccguccuaaagcagagaaccaggccuugagagauaucccauuaucccugaugaaugacuggaaggaugaguucaaagcgcauucuagggugaagugcccgaacucgggguguuggcuagaguuucccucaauuuacggacucaaauaucacuaccagcggugccaggguggcgcuauaagcgaccgccuggccuucccuuguccauuuugcgaagcagccuucacgaguaagacccaacuugagaagcauagaaucuggaaucacauggauaggccccugccugcuuccaaaccagggcccauuucucggccggucacaaucagccgcccugugggaguuuccaagcccauuggcgugucaaaaccagucacuaucgguaagccuguggggguaaguaaacccauaggaaucagcaagccaguuucugugggccgacccaugccugucaccaaagcaauuccagugacaagaccggugcccgucaccaagccuguuacuguguccaggccaaugcccguaacaaaggccaugccugugaccaaaccaaucacggucacuaagucagugcccguuaccaaaccggugccugucacaaagccaauuacugugaccaaauugguaacaguuaccaagcccgugccugucacgaagcccgugacugucagccggccaaucgugguuaguaaaccugugacaguaucucgucccauagcuauuucccgccauaccccaccguguaagaugguccuccugacuagaagcgagaacaaagccccuagggcgacaggccgaaauucggggaagaaacgggcagccgacucucuggauaccugccccaucccacccaagcaggcucgcccugaaaacggagaguaugguccauccucaaugggccagaguagcgccuuucagcucuccgcagacacgucuagcgggucauuaagucccggauccagaccuagcggcgguauggaagcucugaaggccgcggggccggccucuccacccgaggaggauccugaaaggaccaaacaccggcgcaagcagaaaacaccaaagaaauucacuggcgagcaacccucaauuaguggaaccuuuggccuuaagggguuggugaaggcagaagacaaagcuagaguucacaggagcaagaaacaggagggaccugguccggaagacgcccguaagaaagugcccgcugccccaaucacagucuccaaggaggcacccgcccccguggcucauccagcgccuggcgggcccgaggaacaguggcaacgggcaauccacgagcgaggagaagccguauguccaacuugcaaugugguuaccagaaaaacacuggucggccuaaagaagcauauggaggugugucagaaacuccaggaugcucugaagugccaacacugcaggaaacaguucaagucuaaagccggucuuaacuaccacaccauggcagaacauucggccaagccgagcgacgcugaggccuccgaagggggcgaacaggaggaacgcgagcggcugagaaagguguugaaacagaugggaaggcuccgcuguccucaagaaggcugcggggcagcguuuucaagucugaugggauaucaguaccaccagcgacggugugguaagcccccaugcgaggucgauucucccagcuucccuuguacucauugcggcaaaacguaucguuccaaggcugggcacgacuaccauguuagaucagagcacacagccccacccccugaggaaccgaccgauaaaagcccagaagcagaggaccccuuaggaguggagaggacuccuucuggccgcgugcggagaaccuccgcccagguagcugucuuucaucugcaagaaauugccgaggaugaacucgcaagggacuggacaaagcgacgcaugaaggaugaccuugugcccgagaccgcucggcugaauuacacuagaccagguuugccuacacuaaacccccagcugcucgaagccuggaaaaaugagguuaaggagaaagggcacgugaacuguccaaaugauugcugugaagcgauauauaguagcgucucuggccugaaggcccaccuugcuuccugcucaaaaggagcacaucuggccggcaaguacagguguuugcucugcccuaaggaguucaguagcgaaucgggggugaaauaucacauccugaagacgcacgcugagaacugguuccguaccuccgccgacccgcccccaaaacaucgcucucaggacagcuuaguuccuaagaaagaaaagaaaaagaaucuggcaggaggcaagaaacgggguagaaagcccaaagagaggacuccagaggaaccuguggcgaagcuacccccgcgacgggaugacuggccaccugggugccgcgauaaaggagccagaggcucaacagguaggaagguaggcgucaguaaggcucccgagaaauga

SEQ ID NO: 65185 - RNA, 1617 nt, Artificial Sequence
  derived and/or modified sequence opt3 from ZNF512__Homo_sapiens__NP_001258215
augagcuccagacugggcgccgugcccgcuaccucugggccuacaacuuucaagcagcaaaggucaacgcggaucgucggagcaaagaaccgcacccagugcaguauuaaggacaauagcuuucaguacacaauaccacacgaugacucccucucugguucgucaagcgccaguuccugugagccgguuucugauuuccccgcgagcuuucgaaaauccacuuauuggaugaagaugcguagaaucaaaccugcugccaccucacauguggaaggcagugggggaguaagcgcaaagggcaagaggaaaccacggcaggaggaagacgaggauuaccgcgaguucccccaaaagaaacacaaacuuuaugguucucuggaggagcagugguacuuggaaauuguggacaaaggguccgucucaugcccuacaugucaggccgugggaagaaagaccaucgagggcuuaaagaaacauauggaaaacugcaagcaggagauguuuacuugucaccauugcggcaaacaacugaggagccuagcugggaugaaguaucacguuauggcaaaucacaacagucucccaauucugaaagccggagaugagaucgacgaacccucugagcgggaacgccuucgaacagugcugaagagauuggguaaacucagguguaugcgggaguccugcagcucgucuuucaccuccauaaugggcuaccuguaucauguccguaagugugggaagggagcugccgaacuggagaaaaugacgcucaagugccaccauuguggcaaaccuuaccgcucaaaggcggguuuagcauaccaccugagaagugagcacgggccaaucagcuuuuucccggaauccggacagcccgagugccuuaaagaaaugaauuuggagucuaagagcggcggcagggugcagcggcgaucagccaagauugcuguauaucaucugcaggaacuagccagugcagagcucgcuaaagaguggccuaagcgcaaaguucugcaagaucuugugccagacgauagaaagcugaaauacacuaggcccggguugccuaccuuuucccaggaaguccuccacaaguggaagacagacaucaaaaaguaucaucggauucagugcccaaaccaaggaugugaggccguguacagcucugugucaggucugaaagcgcacuuaggcaguugcacucuggggaauuucgucgccggaaaguauaaaugucuccuuugccagaaggaauuuguuagcgaguccggcgugaaguaccauaucaacucuguacacgcagaagauugguucguggucaaucccaccacaaccaaaucguuugagaagcugaugaaaauaaagcagcgccagcaagaggaagagaaaagaaggcagcagcaccguagccggcgauccuugagaaggcgccagcaaccggguauugaacuaccugagacggagcugucacuccggguggggaaggaccagagaaggaacaaugaagaacugguugugagugcuucuuguaaagaacccgagcaggaaccagucccugcccaguuccaaaaggugaagcccccaaaaacuaaccauaagcgcggccgaaaauga

SEQ ID NO: 65186 - RNA, 1440 nt, Artificial Sequence
  derived and/or modified sequence opt3 from ZNF513__Homo_sapiens__NP_001188388
augggcuucgagagagacagcgaaggggauucccugggagccaggcccggucucccuuacggccuuucugacgaugagucagggggaggccgggcucugagugcagaaagcgagguggaggaaccagcccgcgguccgggggaggcgcgaggagaacgucccggcccugcuugccaguuguguggcgggccaaccggagagggucccugcuguggcgccgggggaccuggcggugggccauuacugcccccuagacuacucuauuccugcaggcuguguacauuugucucucacuacucgucacaucuuaagcggcacaugcaaacucauagcggagaaaaaccauuccgcugcggcagauguccguaugcaagugcccagcugguuaacuugacgaggcacacccggacacauacuggcgagaagcccuaccgcugcccucacuguccauuugcuugcuccucucucgggaaucugcgaagacaccagaggacccaugcaggacccccuacaccacccuguccgaccugcgguuuccggugcuguacuccucgucccgcccgcccaccuagccccacagagcaggaaggcgcugugccaagaaggcccgaggacgcccugcucuuaccugaucugucccuucacguaccacccgggggagcgucauuuuugccggacugcggccaacugcggggugaaggggagggccuauguggaaccggcagugaaccucucccagagcugcuuuuccccuggacgugccgaggguguggacaggagcuggaagagggugaaggcagccgcuugggggcagccaugugcggaagauguaugaggggcgaggcuggugggggcgccucuggaggcccucaggggccauccgauaaaggauuugcaugcucacucugucccuucgcuacucauuauccgaaccaccuggcccggcacaugaagacccauagcggugaaaaaccuuuucgcugcgcgagauguccauacgccagugcacacuuagacaaucugaagaggcaucagcgugugcacacaggcgagaagcccuauaaaugcccucucugccccuacgcuugugggaaccuugccaaucugaagcggcauggacgaauccacucuggcgauaaaccauucagaugcuccuuguguaacuacagcugcaaucaaucgaugaaccuaaagaggcacaugcugcgccauacuggugagaaaccuuuucggugugcuaccugcgccuauacaaccgggcacugggacaauuacaagagacaucagaagguccacggccacggaggcgcagggggacccggccucucugccuccgaagguugggcuccaccgcauucaccucccagugugcugagcuccagggggccacccgcgcuuggaacggcaggcucucgcgccguucacacugauagcucauga

SEQ ID NO: 65187 - RNA, 3492 nt, Artificial Sequence
  derived and/or modified sequence opt3 from ZNF516__Homo_sapiens__NP_055458
auggacagaaacagggaggccgaaauggagcugcggcgcggccccagcccuacccgagcugggcguggacacgaaguggauggugacaaggcaacaugccauacuuguugcaucuguggcaaauccuucccauuucagucuucacucagucaacacaugagaaagcauacgggggagaaaccguacaagugccccuauugugaucacagggccagccagaaaggaaaucuuaagauucauauacggucccaccgcaccggcacacugauccagggucacgaaccugaggcgggggaggcuccauugggagaaaugagagccucugagggcuuagacgcaugcgccucgcccacuaagucagcuagcgcauguaacaggcugcuaaauggcgccagucaggcugauggggcccggguccucaacggagcgucccaagcagacucuggucgcguucugcuucgaagcuccaaaaagggcgccgaagggucagcuugcgccccuggagaggcaaaagcugccgugcaguguaguuucugcaagagccaguuugagaggaaaaaggaucuggaauugcauguacaccaggcgcauaagccauucaaauguagacucugcucuuacgccacccugcgggaggaaucccugcucucacacauugagcgugaccacaucacagcacaaggccccgguagcggggaggcuugcguggagaauggaaagccugaguuaaguccaggcgaauuuccgugugaggucugcggccaggccuucucucagaccugguuucugaaagcucauaugaagaaacaccgcggguccuucgaucauggaugucacauuugcgguagaagguuuaaggaacccugguuccuuaaaaaccauaugaaggcccacggcccuaagacugggagcaaaaaucggccaaagucggaguuggaccccaucgcaacaauaaacaaugugguucaggaagaggugaucgucgccggacugucucuauaugaggugugugcuaaaugcggcaaccucuuuaccaaucuggauucccuuaacgcgcacaaugcaauucaucgacgcguagaagccucaagaacgagggcuccugccgaggaaggugcagaggggccaagugacacuaagcaauucuuucugcaguguuugaaccuccggcccagcgccgcuggcgauuccugcccgggaacccaggccggccgcagaguugcagaacuggacccugugaauagcuaccaagcguggcaguuagcuacaagggggaaagucgccgagcccgcagaguaucugaaguacggagccugggacgaagcucucgccggugauguggcauucgacaaggaucgucgggaguaugugcuugucagccaggaaaaacgaaagagagagcaggacgcuccagccgcgcaaggcccucccaggaaacgcgccucagggccaggagaucccgcuccugcaggccaccuggacccacggagugccgcuagaccgaacaggcgcgccgcagcgacuaccggucaggggaaguccagcgaguguuucgaaugcggcaaaaucuuucgaacauaccaucagaugguuuugcacucucgggugcaccguagagccaggcgcgagcgggauucagacggagauagagcugccagggcacgauguggcagucuaagcgaaggggacuccgcuucucagcccucgagcccuggauccgccugcgcagccgcugauucaccagguaguggccuggcggacgaggccgcagaagacucuggggaggagggagcucccgaaccugccccaggcggucaaccccgccggugcuguuucagcgaggaaguaaccuccacggagcucucaagcggggaucagucucauaagaugggcgacaacgccuccgaaagagauacuggagagaguaaggcuggcauugcagccagcgugucuauccuggaaaauuccucaagggaaacaagucgucgccaggagcagcaccgguuuagcauggaccuuaaaaugccggcguuccauccuaagcaagaagucccagugcccggggauggaguugaguuuccuucguccaccggcgcugaaggucagacugggcaccccgccgagaaacugucugacuugcauaacaaggagcacagcggaggcgguaaaagagcacucgccccagaucugaugccuuuagaccugucagcuaggaguacacgagaugaccccuccaauaaggaaaccgcaucuagccuacaggccgcgcucgugguccacccaugcccguacuguucccauaagacguauuacccugaggugcuguggaugcacaaacggauauggcaucgcguaucaugcaacagcguugcucccccauggauucagcccaauggcuauaagaguaucagaucuaaccuuguguucuuguccaggagcgggcggaccggaccuccacccgcccugggcgggaaagaaugucaaccucuccugcuugcacgauuuacaagaacucaggucccgggaggcaugccagguucgaagucagggucuaguccccugggaguggucaccaaagccgcuuccaugccuaagaauaaagagagccacucuggcgguccaugcgccuugugggcacccggcccugauggguaccgccagacaaagccgugucauggacaagagccccacggcgcugccacucaggggccacucgcgaagccuaggcaggaagccagcuccaaacccgugccagcaccuggaggcgguggguucucacguagugcuacccccacaccaaccguuauugcccgggcuggagcacagccgagcgccaacucuaagccuguggagaaauuuggcguacccccagccggugcuggcuucgcgcccacuaauaagcacuccgcaccugacucacugaaagccaaguuuagugcucaaccacaggggcccccuccggccaagggagaaggcggggcaccacccuuaccucccagagagccaccuagcaaagccgcucaggaacugaggacgcuagcgacaugcgccgcaggaucccgcggcgaugcugcccuccaggcacaacccggugucgccggggcuccaccugugcugcauucuaucaagcaggagccgguugccgagggacacgaaaaacgacuugacaucuugaacauuuucaagaccuauauacccaaagacuuugcgacucuguaccagggcuggggcgugucggggccaggacucgagcauagagguacccugcggacacaggcaaggccuggcgaguucgucuguaucgaaugcgggaagucuuuccaccaacccggacacuuacgcgcccauaugcgugcucacucagugguauuugaauccgauggcccaagagguagugaggugcauaccacuucugccgacgcuccuaagcaggggcgggaucacagcaauacaggaacgguucagaccgucccccugaggaaaggcacuuga

SEQ ID NO: 65188 - RNA, 1623 nt, Artificial Sequence
  derived and/or modified sequence opt3 from ZNF519__Homo_sapiens__XP_011523906
auggagcugcucaccuucagagacguggccaucgaauuuagccccgaggaauggaagugccuugauccugcucagcaaaaccuguacagggacgucauguuggagaauuaucggaacuuaguuucccuggcaguguacucuuauuacaaucagggcauucuaccagaacaggggauacaggauucauucaaaaaggccacacucggacgcuaugguaguuguggccuggagaacaucugccuuuggaaaaauugggagagcauuggggaaggagagggccaaaaggaauguuacaaccugugcucccaguauuugacuacgucucacaauaaacaucucaccguaaagggugacaaggaguaccgaaucuuucagaaaaagccgcaguuccugucggcggcucccacagagccuuguauuccaaugaacaaauaccaacacaaguuucugaaaucaguguucugcaauaagaaccagaucaauuuuaaccaugauagcaauauaaguaagcaccauuccacucacuuccucgaaaacuauuacaauuguaacgagugcgaaaaagucuuuuaucagucuagcaaguuaaucuuccccgagaacauucacauccagaaaaagccuuacaauuccaacgaauguggggagaccucagacccauuuaguaaacugacacaacaucagcguauuuauaucggagagagcucucagagaugcaauaagaaauguauaauuguguucucccaaucacaccuuaagggccauaagaucauuaacaccggcgagaaaagcguuaaguacaaagaaagggggaaggccuuuacucggggauugcaccugggucaccagaaaauccauacaggcgaaaagcccuauaagugcaaaaagugcgauaaagcauucaauaagaguucucaccuagcccagcaucagcgcauccacaccggggagaaaccuuucaaguguaaggaaugcggaaaggcuuuuaacagaggcuccuaccucacgcaacaucagaggauucacacuggugagcgggcauucaaaugugaggaaugcgggaaagccuuuaaucgcggaagcuaccugacccagcaccagcgaauacauacaggcgagaagccauucagauguaaagaaugcggcaaggcuuuuaacaggucgucuuaugugacucaacaccagcggaugcauaccggggagaagccguucaaauguaaggaaugcggaaaagccuuuaaucgugcgucccaccuuacacagcaccagcgcauccauaccggugagaagcacuucaaauguaaggagugcggcaaagcauuuaacagagggucacaucugacgaggcaccaacggauucauacuggagaaaagaguuucaagugugaggaaugcggcaaagccuuuaucugggguagccacuugacacagcaccagcgaguccauaccggggagaaguucuuuaaaugcaaggaguguggcaaggcuuucacucgcuccucucaccucacacagcaucaaagaauacacaccggagaaaaacccuucaagugcaaagaguguggcaaggccuuuaauaggcggagcacgcugacccagcaucagauuauccacacacgcuga

SEQ ID NO: 65189 - RNA, 3936 nt, Artificial Sequence
  derived and/or modified sequence opt3 from ZNF521__Homo_sapiens__NP_056276
augagcagaaggaagcaggccaaaccccggucccugaaggacccuaacugcaaacucgaggauaagaccgaagacggcgaggcucuugauuguaaaaagcgcccagaagacggggaggaacuggaggaugaggcagugcacucuugcgacucauguuugcaagucuucgaaaguuuaagcgauaucacagagcauaagauuaaucagugccagcugacugacggaguugauguggaagacgauccgacguguuccuggcccgccucuucgccuucaagcaaagaccagaccaguccaucccacggugagggcugcgauuuuggggaggaagagggaggccccggucuaccuuacccaugucaauucugcgacaagucuuuuagccgacucuccuaucugaaacaucacgaacagucacauagugacaaacuucccuucaaguguacauacugcagccgucuguuuaagcacaagagaucuagggaucggcacauaaaauugcauacuggggacaagaaauaucacuguuccgagugcgaugcggcuuucucacgcagcgaccaucucaagauccaccugaaaacccacacaaguaacaagccuuacaaaugcgccauuuguagaaggggauuucugucuuccagcucgcuccauggccacaugcagguacaugaacggaauaaggauggcucucaguccgggucacgcauggaggacuggaagaugaaagauacccaaaagugcagucagugugaggaaggauucgacuuuccagaggauuuacagaaacacaucgcagaaugccauccggaguguagccccaacgaagaccgagccgcucugcagugcguguauugucacgagcuuuucgucgaggaaacuuccuugaugaaucacauggagcaagugcauucuggugaaaagaaaaacagcugcucaauuuguagugaguccuuucacacaguugaagaacuguacagccauauggauucucaccagcagccugagucaugcaaucacaguaacagcccaucccuagugaccgucggcuauacgucugugucgagcacuacccccgacuccaaucucucaguagacaguucuacaaugguugaagcagccccuccaauccccaagagcagagggaggaagcgggcugcccaacagacuccggauaugaccggaccuuccucaaaacaggcgaaggugacauacagcuguauauacugcaacaaacagcuguucucuucccuugcaguccugcaaauccauuugaagaccaugcaccucgacaaacccgagcaggcccauauuugccaguauugucuggaaguguuaccaagucuguacaaucucaacgagcaccuuaaacaggugcaugaggcucaagauccuggccugaucgucagcgccaugcccgcaauuguuuaucagugcaauuuuuguucugaagugguaaacgacuugaauacgcuacaggagcacauccguugcucccacgguuucgcuaacccagccgcgaaggauucaaacgccuucuuuuguccccauugcuacaugggguuccugacugacaguagccucgaagaacacauacgccaggugcauugugaucugucgggauccagauuuggcucuccuguccuuggcacaccaaaggaaccggugguugagguguauagcugcucauacuguaccaauagucccauuuucaacuccguccugaaguugaauaaacacaucaaggagaaccauaaaaauauuccucucgcacugaacuauauccacaaugggaagaagucuagggcuuuaagcccacugucccccguggccaucgaacaaacuucacuaaaaaugaugcaggcuguaggaggugccccugcacggccaacaggcgaguacauuugcaaccaguguggggccaaguacaccagccucgacaguuuucagacgcaccugaaaacccaucuugauacaguuuugcccaagcugacuugcccgcaaugcaauaaagaguucccuaaccaggagucucuccugaagcacgugaccauacauuuuaugaucacauccacuuauuacauuugugaaagcugcgacaaacaguucaccucggucgaugaccuucaaaagcaccuguuggauaugcacacauuuguguucuuucgauguacccucugccaggaggucuucgacucaaaggugucuauccagcugcauuuagcuguuaaacacaguaaugagaagaaaguguaucgcuguacuuccugcaacugggacuuuagaaaugaaacggaucugcagcuacauguaaagcacaaccaucucgagaaucaaggaaaaguccacaaguguauauucugcggcgagagcuucgguacagagguggaacugcagugucacauuaccacucauucuaagaaauacaacugcaaguuuuguagcaaagcguuccacgcaaucauccuuuuggagaagcaucugagggagaaacacugcguuuuugaaaccaagacaccaaacugcgggaccaauggcgccuccgaacaggugcagaaggaagaggucgagcuccaaacucuguuaacaaacucacaggaaagucacaauagccaugacggaucugaggaagauguggacacguccgagcccauguauggcugugauauuugcggggcugccuacaccauggaaacucugcuucagaaccaccaguugcgggaccauaauauccgcccuggagagucagcaauugucaaaaagaaagccgagcucauaaaggguaacuauaaauguaaugugugcaguagaacauucuuuagcgaaaacggccugagggagcacaugcaaacccaucuagggcccguuaagcacuacauguguccaaucugcggagaacguuucccuucccugcucacacugacugagcacaaggucacccauucuaaaucgcuugauacgggcaauugucggauuugcaagaugcccuugcagagcgaagaggaguuucuggaacacugucagaugcauccagacuuacgaaacucacucaccgguuucagaugcgugguguguaugcaaacagucacuuccacccuggagcuuaaaauccacgggacauuucacaugcagaagacuggcaauggaagugcuguucagaccacgggcagggggcagcaugugcaaaaacuguacaagugcgccucuugcuugaaagaguuccgcagcaagcaggaucucgugaagcuggacaucaacggacuaccguauggucugugugcaggcugcguaaaucucuccaaaucagcgucuccugggauuaacguacccccaggaacaaaucggcccggccugggucagaacgagaaccuuagcgcuauagaagggaagggcaaagugggaggcuugaagaccagauguaguuccugcaauguuaaauuugagagcgagucugaacugcagaaccacauccaaacuauucauagggaguuagugccugauucaaauuccacacagcucaagaccccacaggucagucccaugccucgcaucagcccgucgcagucugacgaaaagaaaacuuaccaauguauuaagugccagaugguguucuauaacgagugggauauccagguucacguggccaaucauaugauagacgaggggcugaaccacgaauguaaacuuugcucccagaccuuugacagcccagcaaagcugcaaugucaccuaaucgagcauucauucgaaggaaugggcgguacauucaaaugccccguauguuuuacggucuucgugcaggccaauaagcuccagcaacacauuuuuagugcucaugggcaggaggauaagaucuacgacugcacccagugcccucagaaauucuuuuuccaaacugaacugcagaaccacacaaugacccagcauucuuccuga

SEQ ID NO: 65190 - RNA, 3903 nt, Artificial Sequence
  derived and/or modified sequence opt3 from ZNF536__Homo_sapiens__NP_055532
auggaggaagccagccugugccucggcguguccucugcugagcccgaagcagagccucaccuuucagggccaguccugaacggacaguacgccaugagucaaaaguugcaucagaucaccagccaguuaucccacgcguucccggaacugcaucccagaccuaauccagaggagaaacccccugcuucucuagaagagaaggcccacguuccaaugucgggucagcccaugggcucacaaauggcacuccuggccaaccagcuugggagggaaguggacacaagccugaauggacggguagauuugcagcaguuucucaacggccaaaaucuggguauuaugagucagauguccgacauagaggaugacgcucgcaaaaaccgaaaguauccuuguccacugugcgggaaacguuucagauuuaauucuauccucagcuuacauaugaggacucacacgggagagaagccguucaagugucccuacugcgaucaccgggcagcccagaaaggcaaccugaagauucaucuucgcacccacaaauugggcaaucuggggaagggaagagguagggugcgggaagagaaccgccuacuccaugaacuggaggaacgagcuauccuuagagacaaacagcugaagggcuccuugcuccaaccuaggccagaucugaagcccccuccacacgcccagcaggcgcccuuagcagccuguacacuggcucuccaagccaaucacucagucccggacguggcacauccuguucccaguccaaaaccugcuagcgugcaggaggaugccgucgcgcccgccgcaggguuucggugcacuuucuguaagggaaaauuuaagaaacgugaggaacuugaccgccacauuagaauccugcauaagccauauaaaugcaccuugugugauuucgcugccucucaggaggaagaacuaauaucccacguggaaaaggcucauaucacagccgagucagcacagggccaaggucccaacgggggaggcgagcagagcgccaaugaauuuaggugcgagguauguggccagguuuucagucaggcuugguuucugaaggggcacaugcggaaacacaaggacucuuucgaacauugcugccaaauuuguggacgacgcuuuaaagagccuugguuccucaagaaccacaugaaagugcaucugaauaagcuguccgucaagaacaaaagcccaucggauccggaagugcccgugccuauggguggcaugucucaggaggcgcacgcaaaccuguacuccagauauuugucaugccuccagaguggguucaugaccccagacaaggccggacugagcgagcccucccaguuauacggcaaaggugaacugccuaugaaggagaaagaagcucuagggaagcuccugucuccaaucagcucaauggcccacggcguccccgagggagacaagcauagucuuuugggcugucugaaucucguuccgccucugaaauccagcugcauugagaggcuucaagcagccgcuaaggccgcagaaauggauccagugaacucuuaucaggcguggcagcugauggcucgggggauggccauggagcacggauuuuugucaaaagaacauccccuccagcgcaaucacgaggacacucuggcaaacgccgguguauuauucgauaaggagaaaagagaguacgugcuggucggcgcugacgggaguaagcaaaagaugccugccgaucuagugcauagcacaaaaguuggaucccagagggaccuccccucuaagcuggauccacuugagucgagccgugacuuuuugucccacggccugaaucagacccucgaauacaaccugcaagguccugggaauaugaaagagaagcccacggaauguccagauugcggccggguguuccgaacuuaucaccaggucgugguacauucaagaguucacaaaagggaccgcaagggagaggaagauggcuuacauguggggcuggacgagcggagaggaagugguucugaccaggagagccaguccgucucaaggagcaccacaccggggucuuccaacgugacugaagagaguggcgucggaggcggucuuagccaaaccgggucugcacaggaagauuccccucaccccucaaguccaagcucguccgacaucggcgaggaagcuggacgcucugccggcgugcagcagcccgcguugcuccgagaucggagccuggggucagccaugaaagacuguccuuacugcggaaagacauuucguaccagucaucaccuaaagguucaccugagaauacauacgggcgagaaaccauauaaguguccccacugcgauuacgcugguacucaauccgcaucucucaaauaucaucuggagaggcaccaccgcgaacggcagaauggggccggaccucuuagcggccagccgccaaaccaggaccauaaggaugagauguccucaaaagcuagcuuguucauuagacccgacauccugaggggugccuuuaagggcuuaccugggauugauuuccgaggaggcccagcaagucaacaguggacaucuggggugcucuccagcggagaccacucgggccaggcgaccgguaugucaucugaaguacccagugaugcccugaaggggacugaccuuccuuccaaaagcacacauuuuucugagaucggacgcgcuuaccaaagcaucgucuccaauggcgugaacuuccaggguucacugcaggccuuuauggauaguuucguuuugagcucucucaagaaagagaaggacaugaaagacaaggcacuggcugauccgcccuccaugaaggugcacggcgucgacgggggagaagagaaaccaucaggcaagaguagccagcggaaauccgaaaagucucaauaugagccucuagaucugucggugagacccgacgccgcaagccucccagggucauccguaaccgugcaggauaguauugccuggcauggaugucuguuuugcgcuuucacgaccucuagcauggaacuuauggcguugcaccuucaggccaaucacuuaggcaaagcaaagaggaaggacaacacaauagguguuacugucaauugcaaagaucaggcucgugaggccuccaagauggcccuccugccuucacuucaaucuaacaaagaccuggggcuaagcaacaugaucaguucccucgauagcgcuucugagaagauggcacagggacagcugaaagaaaccuugggcgagcagaagucaggugccuggacaggccauguggaccccgcguucuguaauuuuccauccgauuucuacaaacaauuugggguguacccgggaauggucggcaguggggcuagcucgucuugcccuaacaaggaacccgacggaaaggcccacuccgaggaagauguuccaauucugauccccgagacuaccagcaaaaauacaaccgacgacuuaucagauauagcaaguucugaggacauggauuccagcaagggcgaaaacaaugacgaggaagauguggagacugaaccugagaugaugacgaaaccacucucagcccugaguaaggacagcuccucugaugguggggacagccuucagcccacaggaaccucccagccugugcagggccugguaucaccguugucucaagcuccagagaaacaguggcauagucagggccuccugcaagcacaggauccccuagccgggcugccuaagcccgaacgcggaccacagucgcuugacaagccuaugaacaugcucagcguccugcgggcguauuccucugaugguuuggcugccuucaauggccuggcaucaagcacugccaacuccggguguauuaaaagacccgacuuaugcggaaaguga

SEQ ID NO: 65191 - RNA, 1884 nt, Artificial Sequence
  derived and/or modified sequence opt3 from ZNF555__Homo_sapiens__NP_001166246
auggacagcguggucuucgaggauguugccguggacuuuacccuggaagagugggcucuccuugauuccgcacagagagaccuguacagggauguaauguuggaaacauuccaaaacuuagccucuguggacgaugagacucaguuuaaggcgucaggcagugucagccagcaggacaucuauggggagaaaauucccaaggaauccaaaauagcuacguucacccggaaugugucuugggccucgguucugggaaagaucugggauucacuaagcauugaggaccaaacaacuaaccagggucgcaaucuccgaaaccacggccuggaacgucuuugcgagaguaaugaucaguguggggaagcacugucccagaucccucauuugaaccucuacaaaaagauuccaccgggagugaagcaauaugaguacaauaccuauggcaaagucuuuaugcacagaaggacaucucugaaaagccccaucaccgugcauacuggucacaaaccuuaccagugccaggagugugggcaggccuauuccugccggucacaucugcgcaugcacguaagaacacacaacggagaaaggccauacguuuguaagcucugcggcaaaaccuucccccggacgaguagcuuaaaucgccaugugcgaauacacacugcugagaagaccuacgaauguaagcaaugcggcaaagcauuuaucgacuucucuucccugacaucacaucuuagaagccacacuggggagaagccuuauaaauguaaggaaugcggaaaagccuuuaguuacucuuccaccuucaggcggcacacaauuacccauacgggugagaagccauauaaauguaaggagugcgcugaagccuuuagcuacucgucuacuuuccgucgccacaugaucucccauacaggcgagaagccccacaaaugcaaggaauguggggaggcguuuucauauaguagcgcauucagaaggcauaugauuacccacacuggagaaaaaccuuacgagugcaagcaguguggcaaaacauucaucuauuugcaguccuuucggcgacacgagcgcauacauaccggugaaaagccauacgagugcaagcaaugugggaaaacguucauuuacccgcagucuuuuagaaggcacgaacggacccauggaggcgagaagcccuaugaaugcaaccaguguggcaaagccuucagccacccuucaaguuuucgcgggcacaugagaguccauacaggagagaagccauacgagugcaaacagugugguaagacuuucaauuggcccaucucccugaggaagcacaugcguacccauacacgggaaaaaccuuaugagugcaagcaauguggcaaggcuuuuagccuaucugccugcuuccgagaacacgugagaaugcauccagaggauaagucauacgagugcaaacucugugggaaggcauuuuauugccacauuagucugcagaagcacaugaggcgccauacugcugaaaaacuuuacaaguguaaacagugcggaaaggccuucagcuggcccgagcuguugcagcaacacgugcggacccauacagucgaaaaaccguaugaguguaaggaaugcggcaaaguuuuuaaguggccuuccucucuccccauccacaugagacugcauaccggugagaagccauaccaguguaaacacugcgggaaggcguucaacuguucgagcuccuuaaggcgccacgugcgaauccauacuacggagaaacaguacaagugcaauguaggccacccucccgccaacgaauuuauguguucagcaagugagaaaucucaucaggaacgggaccugauuaagguggucaauauggugcucccacuuuga

SEQ ID NO: 65192 - RNA, 1809 nt, Artificial Sequence
  derived and/or modified sequence opt3 from ZNF559__Homo_sapiens__NP_001189335
augagaaucaccgccgcuauucugacagcaaggagccgguggcgccuccgaaacuccauaucugccuuccuuuuuacugugacguucgcguggugucccccuggccugucaaauuugaccaucuuaaguugcccagaccaccugagccaggaugucuuuugccuacaugaguccaaguucgaagaggaacguaugguugcuggguggcucacaaacuacucucaagacucggugacuuuugaggauguagccguggacuucacccaggaagaguggacacugcuugaucagacccagagaaaucuguauagggacgucauguuggagaacuacaaaaaucucguggcaguugauugggaaucacacauuaacacuaaguggagcgccccgcaacagaauuuucugcagggaaaaacaaguuccguggucgagauggaacggaaccauuucggugaggagcuguuugacuucaaucagugugaaaaggcucucucugagcacagcugcuuaaaaacccaucgcagaacguauuuuaggaagaagacuugugaaugcaaccaaugugagaaagcauuccggaagcccuccaucuuuacccugcacaaaaagacagauauuggcgaggaacuuccuaauugcaaccagugugagacugccuucucacagcacuugcaucuggugugcaaaaagaccagucagaaucuacaccucguauguaagaaaacacauacccaagaaaagccauacaaaugcagcgacugcgagaaggggcugcccucuuccucacaccuucgcgaauguguucgaaucuauggaggcgagagaccuuacacgcacaaagaauauguggagacuuucagccauaguacagcucuguuuguccacaugcagacccaggauggugagaaguucuacgaaugcaaagccugugggaagccauuuacugagucuuccuacuugacacaacaucucaggacccacagccgggugcugcccauagaacauaagaaauucggaaaggcguuugcauucucgccugacuuagccaaacacauccgucugcgcacgagaggcaagcacuaugugugcaacgaguguggcaaagaauuuaccugcuucucuaagcucaauauucauaucaggguccacacaggggagaagccauacgaguguaacaaaugcggaaaggcuuuuacugauuccucaggucuuauuaaacaucggcgaacccacacaggcgaaaagccguaugaguguaaagaaugcgggaaggccuucgcaaacaguagccaccugacuguucauaugcgcacccacacaggagagaagcccuaccaguguaaagagugcggcaaggcuuuuaucaauuccucuagcuucaaaucacauaugcagacccacccuggugugaagccauaugacugccagcaaugugggaaagccuuuauaagaaguuccuucuugauuaggcaucuacggagccacucugcggaacgccccuucgagugcgaagaguguggaaaggccuuuagauacucaagucaccugagccagcauaagaggauccacacuggcgaacguccuuauaaaugccagaaguguggccaggcauucuccauuucuucggggcucacgguacauaugcggacacacaccggagagcgaccauuugagugccaagaaugugguaaggcuuucacuagaagcaccuaccugaucaggcaucuucgcucccacucaguggagaaacccuacaaagaaugcggccagacauuuaguaacucuagcugucugaccgagugcgucuga

SEQ ID NO: 65193 - RNA, 1743 nt, Artificial Sequence
  derived and/or modified sequence opt3 from ZNF568__Homo_sapiens__NP_001191766
augaagcccgcccagagaaaccuguacagggacgugaugcucgagaauuauagcaaccuugucaccguuggcugccaagugacaaaaccugauguaaucuucaagcuggaacaggaggaagaaccaugggugauggaagaggagauguuugggcggcacuguccggaagucugggagguggacgaacagauuaaaaagcagcaagagacuuugguucgcaaagugacguccauaucuaagaagaucuuaauuaaagagaaggucaucgaaugcaaaaagguggcuaaaauuuucccccugucaagugauaucguaaccagccgacaguccuuuuacgacugugauucucuagacaagggacucgagcauaaucuggaucuucugcguuaugaaaaggguugcguuagagagaaacagucgaacgaguucggcaagccuuuuuaccacugugcaucauauguggucacaccauucaaaugcaaucagugugggcaagacuuuagccauaaguucgauuugauaaggcacgagcggauccaugccggagagaaacccuacgaaugcaaggaguguggcaaagcguuuagucgcaaggaaaaccucauuacucaccagaagauccacaccggugagaaaccuuauaagugcaaugaaugugggaaggcuuucauucagauguccaaccugaucagacaucacaggauacauacaggagagaagccauacgccugcaaagacugcuggaaggcauuuucucagaaaagcaaucugauugagcacgaacggauccacaccggcgagaaacccuacgaauguaaggagugcggcaaauccuucucacaaaagcagaaccucauugaacaugagaaaauccacacuggggagaagccuuaugccuguaaugaaugcggacgcgcuuuuagucgaaugagcucugugacauuacauaugagaucccacaccggugagaagccauacaaauguaacaagugcggcaaagcauucucacaguguagcguguucaucauucauaugaggagucacacgggggaaaagccguaugucugcucugaguguggaaaagccuuuucccaaagcucgucucugacuguucacaugcggaaucauaccgcugagaagcccuacgaaugcaaggaguguggcaaagccuucucccguaaggaaaaccuuauaacacaccagaaaauccauacuggugagaagccuuaugaaugcucagagugcgggaaagcguuuauucagaugaguaauuugauccgccaccagagaauacacaccggagagaagccauacgcauguacagugugcggcaaagccuucagccaaaaguccaaccugaccgaacaugagaagauucacacgggcgaaaaacccuaucauuguaaccagugcgggaaggcuuuuucucagaggcagaaucuacucgagcacgagaaaauccauacuggagaaaagccuuucaaauguaacgagugcgguaaggccuuuagccggaucucaagucugacacuucacguacgaucccacaccggcgaaaagccauacgaguguaauaaaugcgggaaggcauucagccaauguucucuguugauuauccauaugcgcucacacacuggagaaaaacccuuugagugcaacgaauguggcaaggcuuucagucagagagccagccucuccauucauaaaaggggucacacaggggagcggcaucagguguacuga

SEQ ID NO: 65194 - RNA, 2061 nt, Artificial Sequence
  derived and/or modified sequence opt3 from ZNF569__Homo_sapiens__NP_689697
augaccgagagccagggcacagugacuuucaaggacgucgccaucgauuuuacgcaagaagaguggaaaagacuggaccccgcucagaggaagcucuaccggaacguuaugcuugaaaauuauaacaaucugauuaccgugggguacccuuucacaaaaccagauguaauauuuaaguuggagcaggaagaggagccgugggugauggaagaggaagucuuacgccgacacuggcagggagagaucugggguguggacgagcaucagaaaaaccaagaucgucugcuaagacagguugaagugaaguuccagaagacucucaccgaggaaaaaggcaaugagugccaaaagaaauuugcaaacgucuucccccuuaauuccgacuuuuucccuucuaggcacaaccuguaugaauacgaucuguuugggaaguguuuggagcauaauuucgacugccacaacaaugugaaaugucucaugcggaaggagcauugcgaauauaacgagccaguaaagucauacggaaauaguagcucccacuuuguuauuacacccuucaaauguaaccacugcggcaaggguuuuaaucagacccuggaucugauccgccaucucaggauucacacuggggaaaaaccuuaugaguguucuaacugcagaaaggccuucucgcauaaagaaaaguuaaucaaacacuacaagauacacucacgggagcagagcuacaaguguaacgagugcggaaaagcguucaucaagaugaguaaucugauucgccaucagcgaauccacacaggcgaaaaaccauaugcuuguaaggagugcgaaaaauccuuuucucaaaagagcaaccuuauugaccaugagaagauccacaccggcgaaaaacccuacgagugcaaugagugugggaaggccuucucccagaaacagucauugauagcacaucaaaaggugcacacgggagaaaaaccuuaugccugcaacgagugugguaaggcuuuuccaagaauugcaagucuggcccuacacaugaggagccauacuggcgaaaagccguacaaaugcgauaagugugggaaggcuuucucucaguuuuccaugcucaucauucacguccggauccauaccggagagaaacccuaugagugcaaugaauguggcaaagccuucucacagagcagugcgcugacagugcacaugcguucucacacuggugagaagccuuacgaaugcaaggagugucgcaaagcauuuucccauaagaaaaacuucaucacccaccagaagauucauacaagagaaaaaccauaugagugcaaugagugugggaaggccuuuauacaaaugagcaaccuugugaggcaccagcggauccauaccggagaaaaacccuacauuugcaaggagugcggcaaggcuuucucgcagaaaucuaaucugaucgcccacgaaaagauacacuccggcgagaaaccuuacgaauguaacgagugcgggaaggcauuuucacagaaacaaaauuucauuacgcaucagaagguccacacuggagagaagccauaugacuguaacgaaugcgguaaggcuuuuagucagaucgccagcuugacacuccaucugcgaucccacaccggcgagaaacccuacgaaugugauaaaugcgggaaggcguucucucaguguagcuuacugaaucuccauaugcgcucacacacuggagagaaaccguauguuugcaacgaauguggcaaggccuucagucaaagaacaucccuuaucgugcacaugaggggucauaccggggagaagccuuacgagugcaauaaauguggcaaggcauuuagccagucuucaagucugacgauucacauccggggacauaccggcgaaaaacccuucgacugcagcaagugcgggaaggcuuuuucccagauuucuucguugacacuacacaugcgcaaacacacuggagagaagccauaucauuguauagaaugcgguaaagccuucagccagaagucccaccugguaagacaucaaaggauccacacccauuga

SEQ ID NO: 65195 - RNA, 1281 nt, Artificial Sequence
  derived and/or modified sequence opt3 from ZNF577__Homo_sapiens__NP_001129062
augaagaacgccaccaucgugaugagcgucagaagggagcagggcuccucuucaggggaaggaagucugagcuucgaggacguugcuguggguuuuacacgggaagaguggcaauuccucgaucagucccagaaaguacuuuacaaggaagugaugcuggagaauuauauuaacuuggucucuauaggcuaccgcgggacuaaacccgacucguuauuuaagcuggagcagggagaaccuccaggcaucgcagagggugccgcgcacucacaaauuugccccgggggaaaaccccaugaauguagcgugugcggccgagcuuucagucguaaggcccagcuaauccagcaccagagaacggagaggggcgagaagccucauggguguggagaaugcgguaaaaccuuuaugcggaagauucaacucacagagcaccagcgcacucauaccggcgaaaaaccacacgaguguuccgaaugcgggaaggcauucucuagaaaaagccagcugaugguucaccagaggacacauaccggagagaagcccuaucgguguuccaagugcggcaaagccuuuucacgcaagugucgacuuaauagacaccaaaggagucauacuggugagaaacuguacgggugcagcguguguggaaaggcuuucucucagaaagcauauuugacagcccaccagcggcuccacaccggcgauaagccuuacaaaugcuccgacugcggccguacguuuuauuucaagucagaucugacucgccaucaaagaauccacaccggggaaaagccauacgaguguagcgaaugcgagaaggcuuuuaggaguaaaucuaaacugauacagcaucagcggacacacacuggagaacgacccuacuccugucgcgagugcgguaaggccuucgcgcauaugagcguccucaucaaacacgagaagacccacauuagagaaacagcaaucaacucguuaaccguggagaagccuucuuccaggucacauacgagucuguauaugagcgaacuuauucaggagcagaaaacuguaaauacaguuccaaucgaaaugccguccucuggcaccccgccuuugcugaacaagagcgagcggcuaguggggcgcaaugucgugauaguggagcaaccauuucccagaaaccaggccuucgucguuaaucaggaguucgaacaaaggauuucacucacuaacgaagugaauguagcuccuagugugaucaacuacauucuguaucuuacagacaucgucuccgaguga

SEQ ID NO: 65196 - RNA, 519 nt, Artificial Sequence
  derived and/or modified sequence opt3 from ZNF580__Homo_sapiens__NP_057286
augcugcuccuucccccuagaccaccgcaccccaggagcuccucuccugaggccauggacccacccccuccaaaggcucccccuuucccaaaagcagaaggcccgucaaguacccccagcuccgccgcggggccucggccaccccgccugggacgacauuuguuaaucgaugcuaacggugugccuuacacauauacuguccagcuggaggaggaaccacgugggcccccgcaaagagaagccccucccggcgagccaggaccuaggaagggcuacucuugccccgagugugcacggguuuuugccucgccacuacgccuccagucacacagagugagccauagugaccugaaacccuucacgugcggugcuugugggaaggcauuuaaaagguccucucaccuuagccggcaucgcgccacccaccgagcuagagccggaccuccacacacaugcccgcugugucccaggcgguuccaggaugcggcagaauuggcccagcauguacgucuccacuga

SEQ ID NO: 65197 - RNA, 594 nt, Artificial Sequence
  derived and/or modified sequence opt3 from ZNF581__Homo_sapiens__XP_006723303
augcuggugcuccccagcccuugcccacagccgcuugccuucuccucugucgagaccauggaagggcccccuagaaggacaugucggucaccagagcccggcccuaguagcuccaucggaucuccacaagcaucgucacccccucgcccaaaccacuaccuguugauugacacucaggguguuccguauacgguguuaguagaugaagagagccagcgagaacccggcgcaaguggggccccuggacagaagaaaugcuacuccuguccagugugcucucgugucuuugaguauaugagcuaccugcaaagacauuccauaacccacucagaggugaagcccuucgaaugugacaucugcggcaaagcguuuaagagggcuagucaucuagcccggcaccauagcauucaccucgcuggugggggacgcccucacggcuguccacugugccccagaagguuccgggaugccggcgagcuugcucagcauucucgcguucacuccggggaacgaccguuucaguguccucauugccccagaagguucauggagcagaauacacugcaaaaacacacucgguggaagcacccauga

SEQ ID NO: 65198 - RNA, 1554 nt, Artificial Sequence
  derived and/or modified sequence opt3 from ZNF582__Homo_sapiens__NP_653291
augagccugggcuccgaacucuucagagacguggccaucgucuuuucucaggaagaguggcaauggcuugcucccgcacagagggaucuguaccgggacguuauguuggaaaccuauucaaacuuagugagucuggggcuagccguaagcaagccugaugugauuuccuuccucgagcagggaaaagaaccauggauggucgagcgcgugguuucugguggccugugcccggugcuugagucgcgauacgacacaaaggaacuguuucccaaacagcacgucuaugagguggaaucaccucaaugggagauaauggagagcuugacgaguuacgggcucgaauguuccucuuuccaggaugacugggagugccguaaucaguuugauagacagcaaggaaacccagacaggcauuuccaccagaugaucauucggcaugaagagaugcccacuuuugaucagcacgcgagccugaccuucuaucagaagauccauacacgcgaaaaaccuuuuggcuacaauaaguguagaaaggacuucuggcaaaaagagcugcucauuaaccaccaggguaucuauacuaaugagaagccauacaaaugcaaggaaugugggaaggcuuuuaaauacggauccagguuaauacagcacgagaacauccauucaggcaagaaacccuaugaaugcaaggaguguggcaaagccuucaauagugggagcaacuuuauucaacaccagcggguacauaccggagaaaagccuuacgagugcaaagauugugagaaggcauucucucgcuccucacagcugaucgaacaccagcgaacacacaccggugagaaaccauaucaaugcaaggaauguggcaaggccuucaauagaauuagccaucuuaaaguucacuacaggauccauacuggggagaagccguaugcuugcaaagaaugcggaaagacauuuagucaccggucucaguugauacagcaucagaccgugcacacgggccguaaacuguacgaguguaaggagugcgguaaggcauucaaccaaggguccacucuaauucgccaccagagaauccauaccggagaaaaacccuaugaguguaaggucugcggcaaagccuuuagggugagcucgcagcucaagcagcaccaacggauucauacaggcgaaaaaccuuaccaguguaaggugugcgggcgagcuuucaagcgcgucucucaccugacuguucacuacagaauccauaccggagagaaaccauaugaguguaaggaaugcgguaaagccuuuucccacuguucacagcuuauccaucaccaggugauucauacagagaagaaacccuacgaauauaaggagugcgaaaagacccugagucacgacagcacgacuguacaaccucagaggaugcacaaucgggagacacaugugaacauaaucaaugucgagaaaccauccauuucuagcuaccccuugcucaucauacgcgaguucaugcuggcgucaaaccacaugaauggcaguaacggggaguccccguuagcauga

SEQ ID NO: 65199 - RNA, 1710 nt, Artificial Sequence
  derived and/or modified sequence opt3 from ZNF583__Homo_sapiens__XP_011524819
augagcaaggaccuggugaccuucggcgaugucgccguuaacuuuucccaggaggaaugggaguggcucaaucccgcucaaagaaaccuuuacaggaaagugaugcuggaaaauuaucggucuuugguaucauuaggggugagugucagcaagccugacgugaucucccugcuagagcagggaaaagaaccauggaugguuaagaaagaggguacacgcggcccgugccccgauugggaguacguguucaagaacucugaauuuucgucaaagcaggagacuuaugaagagagcaguaaagucgugacgguaggggcacgacaccucuccuacucucuggacuauccuagccuucgugaggauugucaguccgaagacugguacaagaaucaacugggaucacaggagguucauuugagucagcucauuauaacccacaaagaaauccugccagaggugcagaacaaggaauauaauaaaagcuggcaaacauuccaucaggauacuauuuuugacauccagcagucuuuccccaccaaggagaaggcccacaaacaugagccucaaaagaaauccuacagaaagaaaucagucgaaaugaagcacaggaaaguguacguggagaagaagcugcucaaaugcaacgauugugaaaaggucuuuaaucagagcaguucuuuaacacugcaccagcggauucauaccggcgagaaaccauaugcgugcguugaaugugguaagacuuucucccaaagcgcuaaccuugcccagcacaaacgcauccauacaggggagaagcccuacgagugcaaggaauguagaaaagcauuuucgcagaaugcccacuuggcucagcaccaaagggugcauaccggagagaagccuuaucagugcaaagaauguaagaaagcauucucucagauagcccaccugacgcagcaucaacggguacacacuggcgagcgcccauuugaaugcaucgaguguggcaaggcuuucuccaacgggucauuucuagcccagcaucagcggauucacaccggagagaagccguacgugugcaaugucugcgguaaagcguucagucacagaggcuaucucaucgugcaucagaggauucacacaggggaacggcccuacgaguguaaggaaugccguaaagcauucagccaauaugcccaucuggcucagcaccagcgcguucacacuggagagaagccuuacgaguguaaagugugcagaaaggccuuuucccagaucgcauaccuugaccaacaucagaggguccacaccggcgaaaagccauaugaguguauagaaugcgguaaggcuuucucuaacagcucaagucuggcccagcaucaacggucccacacaggggagaaacccuacauguguaaagaaugccgaaagaccuuuagccagaaugcgggauuggcccagcaucagcgcauucacacgggcgagaaaccuuaugaguguaacgugugcggcaaggcauucucuuacucagggagucucacucugcaccaaagaauccauacaggagaaaggccauaugaguguaaagauugccgaaagagcuuucgccagagagcucacuuagcccaucacgaaaggauucauaccauggaguccuuccugacucucucuucgcccagcccguccacaucaaaccagcuuccucgucccguagguuuuaucaguuga

SEQ ID NO: 65200 - RNA, 2310 nt, Artificial Sequence
  derived and/or modified sequence opt3 from ZNF585B__Homo_sapiens__NP_689492
augcccgccagcuggaccuccccucagaagucuucagcucuggcaccagaggaccacggcaguagcuacgaaggguccgugucuuucagagaugucgccaucgacuuuucgagggaggaauggcggcaucucgaucuuucacaacgcaaccuguaucgagacguuauguuggagacauacagccacuuacugagugugggauaucagguaccgaaacccgaaguggucaugcuagagcaggguaaggagccuugggcgcuccagggcgaacguccaagacauuccugccccggggagaaacugugggaucacaaucaacauaggaagauuauaggauacaaaccugcuucuagccaggaccagaagaucuauuccggcgaaaagucauacgagugugccgaguucgguaaaaguuuuacuuggaaaagccaguucaaagugcaccuuaagguuccaacgggggaaaaacuguaugugugcauugaguguggacgggcauuuguccaaaagcccgaauuuaucacccaccagaagacacauaugcgcgagaaaccuuacaagugcaacgaauguggcaaaucuuucuuccagguguccucauuguuuagacaccauaggauucacacuggcgagaagcucuacgagugcagcgaaugugggaaaggauucccauauaauagugaucugucuauccacgagaagauacauaccggugaacggcaccaugagugcacagacuguggcaaagccuuuacccagaaguccacucugaagauccaccaaaagauucauacaggggaacgcagcuacaucugcauugaguguggacaggcuuucauccagaagacccaacucauagcacaccgaaggauucacucgggcgagaaaccguaugaaugcaacaauugcgguaagucuuuuaucuccaaaucacaguuacagguacaucagagaguucacacgcgggugaagcccuacauuuguacugaguaugggaaggucuucaguaacaauagcaaccugaucacccaugagaaaauccaaucccgugagaagucuagcauuugcacagaauguggaaaagccuucacuuaccgcucagagcuuauaauccaccagaggauucacaccggcgagaagccuuaugaaugcagugauuguggcagagcuuuuacacagaaauccgccuugaccgugcaucagcggauccacacgggggagaaaagcuacauaugcaugaaguguggacuggcguucauucgaaaagcacaucuaaucacucaccaaaucauucauacaggugaaaagccauacaaaugcggccacugugggaagcucuuuaccucuaaaucacagcugcacgugcauaagcgcauccacacuggagagaagcccuaugucugcaauaaauguggcaaggccuucacaaacagaaguaaucuuauuacccaucagaaaacgcacaccggugaaaagagcuacauaugcuccaaaugcgggaaggcuuuuacacagaggucugaccugaucacucaucaacggauucacaccggcgaaaaaccuuaugaguguaacacaugcggaaaggccuucacucagaagucgaauuugaacauccaccagaaaauccauaccggcgaacgccaguacgagugucacgaaugcgggaaggcauuuaaucaaaagagcauucucauaguucaucagaagauccacacaggagagaaaccauauguguguaccgagugcgguagagcuuucauuaggaaguccaacuuuaucacucaccagcguauucauacgggcgaaaagcccuacgaguguucagauugcgggaaaaguuucacaucuaagagccaacuguuaguacaccagccggugcauaccggagaaaaaccuuaugucugugccgagugcggcaaggcguuuuccggucggucaaaccugagcaaacaccagaagacucauaccggggaaaagcccuacaucuguucugagugcggcaaaacauuccgacagaaguccgagcucauaacccaccacagaauccauacuggagaaaaaccauacgagugcagugacuguggcaagagcuuuacgaaaaagucucaacuucaggugcaccagaggauucauacaggggaaaagccuuauguuugcgccgaguguggaaaagcauucuccaaucgcucaaaccugaauaagcaccagaccacucacacaggugauaaacccuacaagugcggcaucugugggaaaggauucgugcaaaagagugucuuuagcgugcaucagucgucccacgcuuga

SEQ ID NO: 65201 - RNA, 3804 nt, Artificial Sequence
  derived and/or modified sequence opt3 from ZNF592__Homo_sapiens__NP_055445
augggcgacaugaagacccccgauuucgacgaucugcucgccgcuuuugacaucccugauccaacaagccuugacgcaaaagaggccauucagacuccguccgaagagaacgaaucuccccugaagccuccagggauaugcauggaugagucagugaguuugagccacuccggaucugcgcccgacgucccugcuguuucggugaucgugaaaaauacgucaagacaagagagcuucgaagccgagaaggaucauauuaccccaaguuuacugcacaacgguuuuaggggcuccgaccuacccccugauccacauaauugugggaaauucgacucuacauuuaugaacggagauagcgcacgguccuucccgggcaagcucgaacccccuaagucagagccacugcccacuuuuaaucaguucaguccuaucagcucuccagaacccgaggacccgauuaaagacaacgguuuugggaucaagccuaaacacuccgauucauacuuucccccaccucuuggaugcggcgccguaggcgggcccguccuggaggcuuuggcaaaguucccagugcccgaacuccauauguucgaccacuuuuguaaaaaggagccuaagccagaaccgcugccccugggaagccagcaggagcacgaacaaaguggucagaauaccguugagccucauaaagauccagacgccacacgcuucuucggcgaggcucucgaauuuaacucucaccccuccaauagcauaggggagucgaagggauuagcccgagaacugggcaccuguucuuccgugccuccacgucagagacuuaaacccgcgcauucaaaguugaguagcugcgucgcagcccugguggcucuacaggccaaaaggguagcauccguuacuaaggaggaucaaccgggucacacaaaagaccucucugggccuaccaaggaaagcucaaagggaaguccaaaaaugcccaaguccccuaaaagcccccggucuccacuggaggcuacgcgcaagucaaucaaaccuagugauagccccagauccauuugcucugacucgagcuccaagggcucaccaaguguggccgcgucuagcccgccugccauccccaaggucaggauuaaaacuaucaagaccuccucaggcgagauaaaacggacagugacucgcauucuuccagaucccgacgauccuagcaagucuccaguggggaguccccugggaagugcaaucgcugaagccccuagcgagaugccgggugacgaagucccaguugaggaacacuuccccgaggcuggcaccaacucuggguccccucagggagcccgaaaaggcgacgagucaaugacaaaggcaagugauagcucguccccaucuuguagcucaggucccagagugccuaagggggccgcuccgggcagucagaccggcaaaaagcagcaauccacggcguugcaggcaucuacucucgcccccgcuaaucuguuaccaaaagccguacaucuggcaaaccucaaucuugugccucacagcgucgccgcuuccgugacagccaagucaagcguucagaggcggagucaaccccagcugacccagaugucugugccauugguccaucaggugaaaaaggcagcgccucuaauuguagaaguuuuuaacaaggugcugcacuccagcaaucccgucccacucuaugcuccgaaccugucgccucccgccgacucacguauccaugugccagcaucuggauacugcugucuugagugcggggaugccuucgcucuggaaaaauccuugucccaacacuauggacgcagaagcguccacaucgaggugcucuguacucugugcucuaagacauuacuguuuuucaacaaaugcagccuacucaggcaugcccgggaccacaaguccaaaggucugguuaugcaguguucacagcuuuuggugaagcccauuagugcagaucagauguuuguaagcgcuccugucaauucuaccgccccagcggcccccgcuccuuccucaaguccgaaacauggccugacgagcggguccgcaucuccacccccucccgcccucccacuguacccugaccccgugcgacuuauacgcuauucgaucaagugccuggagugucacaagcaaaugagagauuacaugguuuuggcugcccacuuccagaggaccacagaagagacugaaggacugaccugccaggugugucagaugcucuuaccaaaccaaugcagcuuuugugcacaucagcggauucacgcgcauaaaucaccuuauugcuguccggagugcggcguccugugucgcuccgccuacuuccagacacacgugaaggaaaauugccuacauuacgcuagaaaaguagguuauaggugcauccacuguggggugguucaccucacucuggcccuuuugaagagucauauacaggagcgucacugccaagucuuucauaaaugugcauucugccccauggcuuuuaagaccgccucuagcacagcagaccacuccgccacccagcauccaacucagccucaccggcccucacaacugauuuacaaguguucuugcgagaugguguucaacaaaaagcgacacauccagcagcauuucuaucagaaugugagcaaaacgcaagucggcguuuuuaaguguccagaaugcccucuccuguucgugcagaaacccgaguuaaugcagcacgugaagaguacacauggaguaccgagaaacgucgaugaacuguccagccuucagucuucagcugacaccuccaguagcaggccaggcucgcgcgugccuacugagcccccagcgaccucuguugccgcacgguccagcucauugcccagugggagauggggaaggccugaagcucaccgccgaguggaggcccggccgcgucucagaaauacagguuggaccugucaagagugccaggaauggguccccgauagggagucuuacgugucccacaugaagaaaagccauggccgcacucugaagcgguauccauguagacagugcgaacagucauuucacacaccuaacagucuaaggaaacauauccgaaauaaccacgacacgguuaagaaauucuauaccugcggguacuguacugaggauagccccuccuuuccucgcccaucucugcucgaaagccauauuucccugaugcacggaauccggaaucccgaccuuucacaaacaucuaaggugaagccuccaggcggucacaguccccagguaaaccauuugaaaagaccggucucgggggugggcgacgccccuggaaccagcaauggcgcuacaguguccucuacuaagaggcacaaaucacuguuccagugcgcaaaguguagcuuugccaccgauuccggguuagaguuccaaagucauauuccacagcaccaggucgacucuagcacggcgcagugccuccuguguggacuuugcuacaccucagcuuccagucugagccgucacuuguuuauaguucauaaagugcgcgaucaagaggaagaggaagaggaggaagccgcagccgcugagauggcaguagaaguggccgagcccgaagagggcucuggugaggaagucccuauggagacacgggaaaacgggcucgaggaaugugcgggagagccacuguccgcugaccccgaggccagaaggcuacugggcccggcaccugaagaugacgguggccacaaugaucauucacagccccaggccagccaggaccaagauucgcacacucucucuccacagguguga

SEQ ID NO: 65202 - RNA, 1515 nt, Artificial Sequence
  derived and/or modified sequence opt3 from ZNF596__Homo_sapiens__XP_011533044
augcccagcccugacuccaugaccuucgaggauaucauuguggacuuuacacaggaagagugggcccugcucgauacuucucaaagaaaacuuuuccaggacgucaugcuggaaaacauaucacacuugguuaguaucggcaaacaguuaugcaagagcgugguacugucccagcuagagcaaguggaaaaacucucuacgcagaggauuucgcugcuucaggggcgggaggucggaaucaagcaucaggagauuccauuuauccaacacauauaccagaaagguaccucaacaaucagcacuaugcgcagucauacccaggaagauccguuccuguguaaugacuugggcgaggauuuuacacagcacauugcucucacccaaaacgugaucacuuauaugcgaacaaagcauuucguuuccaagaaauuugggaagauuuucucugacuggcugagcuuuaaucagcacaaagaaauccacaccaagugcaaauccuacggaucacaucuguucgauuaugcauuuauacagaacagugcccuccguccccacagcgugacgcauacuagagagauuaccuuagaguguagggucugcggcaagacauucucuaaaaauuccaaccugcggcgccacgaaaugauccacacuggugagaaaccucaugggugucaccuuugcggaaaggcguuuacccauuguucagacuugagaaaacacgaaaggacacauaccggcgagaagccauacggcugccaccugugugggaaggcuuucagcaagaguucuaaucuacggcgccacgaaaugauucauacgcgagagaaagcccaaaucugccaccucuguggaaaggcauucacucauugcuccgaucugagaaagcacgagaggacacaccuuggugacaaacccuauggcugccuguugugugggaaggccuuuagcaaaugcucguaccuccggcagcaugaacguacccacaacggagagaagccuuaugaaugucaucugugcggcaaggcuuucucucacuguucccauuuacgccagcacgagagaucacacaauggugaaaagccacaugggugccaccuguguggaaaggcauuuacugagaguagcgugcucaaaaggcaugagcggauccacacaggcgaaaagcccuacgagugccauguauguggcaaagccuucaccgaauccucugaucuucgacgccacgagagaacgcacaccggggaaaagccuuacgagugccaucuguguggaaaggcuuuuaaccacagcucaguuuugaggcggcaugagcgcacacacacuggugaaaaaccauaugagugcaauauuugcggcaaggccuucaacagaaguuacaauuuuaggcuacaccgucgggugcauaccggggaaaaaccguaugucuguccccugugcggaaaggcguucuccaaauuuuucaaccuccgacagcacgagagaacacauacuaagaaagcaaugaauauguga

SEQ ID NO: 65203 - RNA, 2379 nt, Artificial Sequence
  derived and/or modified sequence opt3 from ZNF606__Homo_sapiens__NP_079303
auggccgcuaucaaccccugggcaagcuggggcgcccugaccgaccaguccugggggaugacagcgguggauccuugggcuucuugggcccucugcccacaauacccggcauggcacgucgagggaucacuugaagaggguagaagggccacuggccugcccgcugcacagguucaggaaccugugacguucaaggacguagccguggauuuuacccaggaggaaugggggcaauuggacuuaguccagcggacacuguaucgcgaugugaugcuagagacuuacggacaucuccugaguguuggcaaucagauugcuaaaccagaggugauaagccuucuggaacagggugaggaacccugguccgucgagcaagccuguccucagcgaaccugcccagagugggugcguaacuuggaaucuaaggcgcucauccccgcacagucgauuuucgaggaagaacagucacacgggaugaaacuggaaagauauaucugggacgauccuugguuuagcaggcuggagguacucggauguaaggaccaauuagagauguaccauaugaaucagaguacagccaugcggcagaugguuuucaugcaaaaacaggugcugucccagcgcucuagcgaauuuugcggccuuggcgcugaguucucccagaacuugaauuuugucccaucacaaagagugagucagauugaacacuucuauaagccggauacccaugcccagagcuggaggugugacucugcaaucauguacgcugauaaggugacuugcgagaacaaugacuaugauaaaacagucuaccaguccauacaacccaucuacccugcccggauucagaccggggacaaccuguuuaaguguacggacgcgguuaaaucauucaaucacaucauucacuuuggagaucauaaggguauccacacuggcgaaaaacuauaugaguacaaggagugccaucagauauucaaccagagcccaaguuuuaaugaacacccccgccuccacgugggggagaaccaauauaauuacaaggaauaugagaacauuuucuacuucucuuccuuuauggaacaucagaaaaucggaaccguagagaaggccuauaaauacaaugagugggaaaagguguucggcuacgacagcuuucugacacagcacacuucgaccuauacagcagagaaaccuuacgauuauaacgaaugugguaccucuuucauuugguccucauaccuuauccagcauaagaaaacgcacacuggggagaagccauaugagugcgacaaguguggaaaagucuuucgaaacagaagugcucugacaaagcaugaaaggacccacacuggcaucaaacccuacgagugcaauaagugcggcaaagccuucagcuggaacucccacuugauugugcauaagcggauacacacaggggaaaagccguauguuuguaaugagugcggaaaaucuuuuaacuggaauagccaucucaucggucaccaacguacccacacgggcgaaaagccuuucgaguguaccgagugcgggaaaucauuuaguugguccagccaucugauugcucacaugcgcaugcauacaggagaaaagcccuucaaaugugaugagugcgaaaaggccuuuagagacuacucugcauuaucaaagcacgagaggacucauaguggcgccaaaccauacaaguguaccgaaugcgguaagagcuucuccuggucuucgcaccugaucgcucaccagcggacacauacuggggagaagccuuauaacugucaggagugcggcaaagcguuucgagaacgcagcgcacucaccaagcacgagauaauucauuccggaaucaagcccuacgaauguaauaaaugcggcaagucaugcagucaaauggcccaccuugugagacaucagaggacacacaccggggagaaaccauaugaauguaacaagugcggaaaaucuuucagccaguccugucaccuggucgcucaucggcgcauccacacuggugagaagcccuacaaaugcaaucagugugagagaucauucaacugcagcucucauuugauugcccacaggcguacgcacacaggcgaaaagccuuaucgguguaaugagugcgggaaggcauuuaacgaauccaguagccuaaucgugcaucugcgaaaucacaccggagagaaaccauacaaguguaaccauugcgagaaagccuucuguaaaaauucuucccucauuauacaccaaagaaugcauucaggcgagaaaagguuuaucugcagugagugcgguaaggcuuucagcgggcacucggcccugcuucagcaccagcgcaaccauuccgaagagaagcugaacuga

SEQ ID NO: 65204 - RNA, 2088 nt, Artificial Sequence
  derived and/or modified sequence opt3 from ZNF607__Homo_sapiens__NP_001166148
augagcuacggcuccaucaccuucggggacguggccauugauuuuucucaccaggagugggaauaucugucacucguccaaaagacacuuuaccaggagguuaugauggaaaacuaugacaaucuggugaguuugggacauagcguauccaaacccgauuuaauaacucugcuagagcaggguaaggaaccuuggaugaucgugagagaggagacgagaggcgaaugcaccgaccucgauucucggugugagauuaucucggacgggaaaaugcagcuguaccgcaagcacucaugcgucacacuucaucaacgaauccacaacggacagaaaccauaugaauguaagcagugccaaaagagcuucagucaucugacugaguugauggugcaccagaccauucacacauccgaggaaccggaucagugugagaaauuucguaaggcuuucucucaucucaccgaccugagaaaacaccagaagauaaaugcaagggaaaaacccuacgagugcgaagaguguggcaagguuuuuagcuauccugccaaccuggcgcagcaugguaaggugcacgucgagaaaccauacgaaugcaaggaguguggggaggcuuuccggacuucccgccaacucacagugcaccauagauuucacuacggagaaaaacccuaugaaugcaaggaguguggcaaagccuucucaguauacggcagguuaagucggcaucagagcauccacaccggggagaagccuuuugaaugcaauaaaugcggaaagucuuuccgccugaaggcaggucuuaaaguucaucaguccauucacacgggcgagaagccacacgaauguaaagagugcgggaaggccuuucgacaauucucacauuuggugggacacaaaagaauccauacuggcgaaaagcccuaugaguguaaggagugcgguaaaggguuuaccuguagguaccagcugacaaugcaccagcggauuuauagcggagaaaagcacuacgagugcaaagaaaacggcgaggcuuucaguucuggccaucagcuaacugcaccucacaccuucgaguccgucgaaaagccauauaaaugugaggaaugcgggaaggccuuuagcgugcauggacgucucacacgccaccaagguauccauucgggcaagaaaccguacgaguguaauaagugcgggaaaucuuucagacugaacuccucacuuaagauacaccagaauauucacaccggagaaaaacccuacaaguguaaggagugcggcaaggcuuuuagucagagggcccaucuggcgcaccauaaccggauccacacggguuauaaaccuuucgagugcaaagaauguggcaagagcuuucgaugcgcauccuacuuggugauucaugagcgcauccacacuggggaaaaaccauaugucugucaggagugcggaaagggcuucucuuacagccacaaacucacaauccauagaaggguucacaccggggaaaagcccuaugaguguaaggagugcggaaaagccuuuucagugaguggucaacugacucagcauuuauccauucacagcggcaagaaaccuuucgaauguaauaagugcgggaaaucuuuucgguucauaucaguacugaaggcucaccagaacauccauagugccgagaagccauacgaauguaaagagugcggaaaggcauuucgccacgcuacaagccucauuuaucaugauagaacccacgccggcgaaaaauccuacgaguguaaggagugcggugaaacguucucucaugcgucgcaccuuaucauacacgagaggauucauaccagcgacaaacccuacgaaugcaagcguugugggaaggccuuucacugcgcauccuaucuggugcggcaugagucaguccacgcugauggcaauccguacaugugugaggaaugcggaaaagccuucaacaguucucacgaguugagcauccaucaccgagugcauacaggcgaaaagccuuucaaauguaauaagugcagaagguccuuucgccuacggucaauccuggagguucaccagaggauucauaucuga

SEQ ID NO: 65205 - RNA, 4539 nt, Artificial Sequence
  derived and/or modified sequence opt3 from ZNF608__Homo_sapiens__NP_065798
augagcgugaacaucuccaccgccggcaagggggucgaccccaauacaguugauacuuacgacucuggagaugacugggagauuggugugggcaaccugauaaucgaucucgacgcugaucuugaaaaagacagacagaaguucgagaugaauaacucaacgaccacaacuucuagcuccaauucuaaagauugcgggggaccugcaucgucaggcgccggugcgaccgcugcccuggcagacggguugaaguuugccagcguacaagcuagugcaccacagggaaacucccacaaagaaacaucuaagagcaaggugaaaagguccaagaccucaaaagaugccaauaagaguuuaccgagcgcugcccuguauggcauucccgagaucucuuccacuggcaaacggcaggaaguccaggggcgcccuggagaggcgacagguaugaacucagcacuaggccaaagcgugaguucugggggauccggcaauccaaacagcaauucgaccucuacguccacuucagccgcuaccgccggugcagggaguuguggaaagagcaaggaggaaaaacccggcaagucccagucuagccgaggcgcuaaacgugacaaggaugccgggaaaucaagaaaggacaaacaugaccuccugcagggacaccagaacgguaguggcucccaagcgccuagcgggggacaucuuuacggcuucggugccaagucuaaugggggcggagcaucaccauuucacugcggcgggacaggaagugguagcguugcugccgcuggcgagguguccaagucugcccccgauucggggcugaugggaaacagcauguuggucaaaaaggaagaggaggaagaggaaucccauaggcggauuaaaaagcucaaaacugagaagguggacccucuguucaccguaccagcaccgcccccuccaaucucaaguucucugacaccccagauacucccuagcuauuuuuccccaucaagcucuaauaucgccgcucccguugaacaguuacuggugcgcaccagauccgucggcgugaacacgugugaggugggugucguuacugagccggaaugccuugggccuugugagcccggcacaagugugaacuuggaaggaauuguauggcacgagaccgaagagggcgugcuggucgugaauguuacuuggaggaacaagacauacguggggacccuacucgauugcacgaaacacgacugggcgccaccucgguucugugagagccccaccucugaucuggaaaugcgcggaggucgaggcagagggaagagggcacgguccgccgcugccgcaccaggaucagaggccaguuuuacagaaagccguggccuucagaauaaaaaccgcgguggggcuaauggcaagggaagaaggggcucgcugaacgccuccgggcggcgaacucccccuaauugcgcagcggaggacaucaaggcuucuccaagcucaaccaacaagcgcaagaauaaaccgcccauggaauuggaucucaacaguuccucugaggacaauaagccuggaaaaagagucaggacaaacagccgguccacuccaaccacaccccaaggcaagccugagaccacuuuccuggaucaggguuguucaagcccaguguuaauugacugcccccauccgaauuguaacaaaaaguauaagcacaucaaugggcugcgcuaccaucaggcccacgcacaccucgauccugaaaacaaacuugaguuugaaccagacagugaggacaagauaucugauugcgaggaaggacuguccaacguagccuuggagugcagcgaacccucgacgucaguuucugcuuaugaccaacuaaaagccccugcaagucccggcgcugguaauccaccuggcacacccaaggggaaaagagagcugauguccaacggaccaggcagcauuaucggggccaaggcgggcaaaaauucuggaaagaagaaaggucucaacaaugaacugaacaaucuuccggugauuagcaacaugaccgccgcucuggauuccuguucagcagccgacgggaguuuggcugccgagaugccuaagcucgaggcagaaggacugaucgauaaaaagaauuuaggcgacaaagagaaggguaagaaagcgacuaacugcaagaccgauaaaaaucugagcaagcuaaaaucugccaggcccaucgcuccagcccccgcaccuacaccaccccagcucauugcuauaccuaccgccacuuucacaacgaccacuacaggcaccaucccggggcugccaucccuuacaacuaccgucgugcaggcaacgcccaagucaccuccauugaagcccauucagccuaaaccgaccaucaugggagaacccauaacagucaacccagcccuggugagucucaaggacaaaaagaaaaaggagaagcguaaacugaaggauaaagaaggcaaggagacugggagcccuaaaauggacgcuaaacuuggaaaacuggaggauuccaagggcgcgucuaaggacuugcccggucauuuucucaaagaucaccugaauaagaacgaaggguuagccaauggacugucggagagccaagaaucacggauggcauccauuaaagcugaggccgacaagguuuacaccuucacagacaacgccccaaguccuucuaucggcagcgcuucccgacuagaauguucaacucucgugaacggucaggcacccauggccccacugcauguacuuacccagaauggcgcggagucuagcgcugccaaaacgaguuccccggcauacagcgauaucucugacgccgcugaugacgggggaucagauuccagaagugagggcaugaggagcaaggcaucgucuccuuccgacauuaucagcucaaaggauagugucgugaaagggcacucuuccacaaccgcccagagcucacaauugaaggaaagucauagccccuauuaccacuccuaugacccauacuauucucccagcuacaugcacccuggacagguuggcgcgccagcugccgguaacuccgggucaacucagggaaugaaaauuaagaaagagucugaagaggaugcagagaagaaggacaaagccgaacagcuggauaguaagaaaguggaccauaauucggcuagccuccaaccccagcaccaguccgucauaacacagcgccauccugcccuggcacaaucuuuauauuacggccaguacgcuuauggccuguacauggaucagaagucacuuauggccaccagcccggcguaucggcaacaguacgagaaauauuacgaagaccagagauuggccgagcagaagauggcacaaacugggaggggagacugcgaacgcaaguccgagcucccacugaaagagcuagguaaggaagagaccaaacagaagaacaugcccagugcuacaaucucuaaagccccuagcacgcccgaaccaaauaagaaccacucaaagcugggcccuuccgugcccaauaaaaccgaggaaacugggaagagucagcuccugagcaaccaccagcaacagcuucaggcugauucuuuuaaagcaaagcagauggagaaucaucaauugauuaaagaggccguagaaaugaaguccgugauggacucaaugaaacagacaggaguugauccaaccagccgauucaagcaggacccugauucgcggacauggcaccauuaugucuaccaaccgaaguaccuggaccagcagaaaucugaggaauuagaucgugagaagaaacucaaggaagacagucccagaaaaacuccaaacaaggaguccggcgugccuagccugcccgugucacuuaccuccaucaaggaggaaccaaaagaggccaagcacccugauucucagagcauggaagagaguaaacugaagaaugacgauaggaaaacgcccgucaacuggaaggacucccgcgguacacggguugcugugagcucuccgaugucacaacaucagaguuauauccaguacuugcacgcguauccauacccucagauguaugaccccucccacccagcauacagagccgugagccccguacucaugcauucuuauccuggggcuuaccugucgccgggauuccacuaccccgucuauggcaagaugucaggcagggaggaaaccgagaaagugaauacuagcccauccguuaacaccaagacaacuaccgaaaguaaagcccuagaucugcuccaacagcaugcaaaucaguaccgaucuaagagcccugcccccguggagaaagcuacagcggaacgcgagcgggaggccgaaagagagagggaccgucacuccccuuuugggcagcgccaucugcacacgcaccaucacacccaugucggaauggguuauccacuuauucccggccaauacgauccuuuccagggguugacuucagcagcucugguggccagucagcagguugcagcccaagcuagugccagcggaauguuuccaggccagcggagagaauga

SEQ ID NO: 65206 - RNA, 2229 nt, Artificial Sequence
  derived and/or modified sequence opt3 from ZNF615__Homo_sapiens__XP_011525128
augaugcaggcccaagagagccugacccucgaagacguggcugucgauuucacaugggaggaauggcaguuucuuucccccgcacagaaggaccuguacagagauguuauguuggagaacuauucuaauuuaguggccguaggcuaccaggcgucaaaaccugacgcucugaguaagcuagaaaggggagaggagacuugcacgaccgaagaugagaucuauagccggauuuguuccgacucugggggugccucgggcggggcauacgccgaaauacgcaaaaucgaugacccacuccaacaccaucugcagaaccagucaauucagaaaagcgugaaacaaugccacgagcagaauauguucggaaacaucgucaaucagaacaagggccauuuucuucugaagcaggauugugacacauucgauuugcacgagaaaccgcucaagaguaaucuguccuuugaaaaccaaaaacgaucuagcggucugaaaaauuccgcugaguucaaccgugacgggaaaucacucuuucaugcaaaucacaagcaguucuauacugaaaugaaguuucccgccauugcuaaaccuaucaacaagagucaguucauaaaacaacagagaacccacaauaucgagaacgcccaugugugcagcgaauguggaaaggcguuuuuaaaacugucucaguucauugaucaccagaggguucauacaggcgagaagccacacgugugcuccauguguggcaaagcauuuucacgcaagagccggcuuauggaccaccaaagaacccauacugaguugaagcacuacgaaugcacagagugugacaaaaccuuccugaagaaaagucagcuaaauauccaucagaagacgcacaugggagggaaacccuauacuugcucucagugugguaaggccuucauuaagaaaugcaggcucaucuaccaucaacggacccacacaggcgaaaagccucacgggugcuccgucuguggaaaggcuuuuagcacuaaguucucgcugaccacacaucagaaaacccacacgggcgagaagccauacauaugcucugaaugugguaagggguuuauugagaaacgccgacuuacugcccaucacagaacacacaccggagagaagcccuucaucugcaacaaauguggcaagggcuuuacucugaaaaacuccuugauuacacaucagcagacccacacgggggaaaagcucuauaccugcucagaguguggaaaggguuucaguaugaaacauugccugauggugcaccaaaggacacauacuggcgaaaagccuuacaaauguaaugagugcgggaagggauuugcauuaaaaagcccacugauccggcaccagcguacccacacaggcgaaaagccguauguauguacugagugccgcaaagguuucaccaugaaguccgaucucaucguucaucagagaacacacaccgcugagaagcccuacauuugcaacgacugugggaaaggcuuuacugugaagucuaggcuuauaguccaucagcggacgcacacaggagaaaaaccuuaugugugcggcgagugugggaagggauucccagccaaaauccgacugaugggucaucaacgcacccacacuggcgaaaagcccuacauuugcaaugagugugggaagggauuuaccgagaaaagccacuugaacgugcauagaaggacacacaccggcgaaaagccuuaugucugcucagagugugguaaagggcuaacuggcaagaguaugcugaucgcgcaucagcggacacacacgggagaaaaaccauacauaugcaaugaguguggcaagggguucaccaugaaguccacucucagcauucaccagcaaacacauaccggagaaaaacccuacaagugcaacgagugugauaaaacauuucgcaagaaaacuugccugauccagcaccagagauuccauaccgguaagacgucuuucgccugcaccgaguguggcaaguuuucacuuaggaaaaaugaccugaucacacaccagcguauucauacuggggaaaagccguauaaaugcagugauuguggaaaggcauucaccacaaaaagcggcuugaacguucaccaacggaagcacacuggugagcgaccuuacgggugcuccgacuguggcaaggcuuuugcccaucucucuauccuggugaagcacagaaggauucaucgcuga

SEQ ID NO: 65207 - RNA, 2586 nt, Artificial Sequence
  derived and/or modified sequence opt3 from ZNF618__Homo_sapiens__NP_588615
augaaccagcccggcggggccgcugcaccucaagccgacggagcgagcgcugccgguagaaaguccaccgcaucuagggagcggcugaaacgcucacagaagaguacaaaaguggaaggcccagagccgguccccgccgaagcuagccucuccgcagagcaggggacuaugacggaaguuaaggugaaaaccgagcuuccugaugacuacauccaggagguaauuuggcaaggagaagccaaggaggaaaagaaagcugugucuaaggauggcacaucggacgucccagccgagauaugcgugguuaucgguggggugcgaaaucagcagacucugggaucauaugaguguggcauuugcggcaaaaaguacaaauauuacaacuguuuccagacccacguccgugcgcauagagauacagaagcaaccagcggggagggagccagucaauccaauaacuuuagguauacuugcgacaucugugguaagaaguacaaauauuacucuugcuuccaggaacaccgggauuugcaugcuguggacguauuuagcguugagggcgcccccgaaaaucgcgcagauccuuucgaccaggggguggucgcuacagaugaggugaaggaggaaccacccgagccuuuucagaaaauuggaccaaugaacaauaucaccuccgacauauucaagaaaaaggaagugagacaaugucagaaaagggagacgggcaacuacacuugcgaauuuugugguaagcaguauaaguacuauaccccguaccaagagcacgucgccuuacaugcgcccaucaaaucagccuucagucggcgcguugaggggaaggcacagaaucacuuugaagagacaaacucaucuucccagaauagcagcgaaccuuauacuugcggagcuuguggcauucaguuccaauuuuacaacaaucugcuagagcacaugcagagucaugccgcugauaacgaaaauaacaucgccucuaaccagucccgaagcccacccgcagugguagaggagaaauggaagccucaggcccaaagaaauucggcuaacaauaccacaaccucuggccucacgccaaacuccaugauucccgaaaaagagaggcagaauaucgcggaacggcugcuucgugugaugugcgcagaccugggggccuugucagucgugaguggaaaggaguuccucaagcuggcucagacucugguugacagcggugcccgcuauggcgcauuuuccgugacagagauacucgggaacuucaauaccuuagcccugaaacaccuuccgagaauguacaaccaggucaaggugaaaguaacuugcgcuuugggaucuaaugccugucugggcauugguguuacaugccauagccaaucaguggggccugauaguuguuacauccuaaccgcauaucaggcggaaggcaaccacauuaaguccuacguccucggagugaaaggcgcugacaucagggauagcggggaccugguccaccauugggugcagaauguucuuucugaguucgugaugucagaaauccggacgguauaugucaccgauugccgagugaguacaagcgccuuuuccaaggcaggaaugugucugcgcugcucugccugugcuuugaacucgguugugcagagcguccucuccaagagaacucugcaagccaggucaaugcacgaggugauugaauuacugaauguaugcgaggaccucgcagguaguaccggccuugcuaaagagacauucgggucucuggaagagacuagcccacccccuuguuggaacuccgugaccgauucauugcuacugguucaugaacgguacgagcagauaugcgaauuuuauagccgcgccaagaaaaugaaucucauccagucucugaacaagcaccuucuguccaacuuggcggccauucucacacccgucaaacaagcugugaucgagcugaguaaugagagccagccaaccuuacagcuggugcuacccacuuacgucagacucgaaaagcuguucacggcaaaggccaacgacgcuggaacaguuucuaaacuuugucauuuguuucuggaggcccucaaggaaaauuucaaagugcacccugcacacaagguggcgaugauacuggauccacagcaaaaacuuaggccgguacccccuuaucagcaugaggaaauuaucggcaaggucugcgagcugaucaacgaggugaaagaauccugggccgaggaagcugacuuugagccagccgcaaagaagccccguucagcugccguugagaauccugcagcccaggaagaugaccgguuggguaaaaacgagguguacgacuaccuccaggaaccacuguuccaagcuacccccgauuuauuucaguauuggaguugcgucacucagaagcacaccaaacuggcgaagcuagccuucuggcuccuggcagugccggcuguuggggcccgaagcggcugugugaauaugugcgagcaggcccuuuugauuaaaagaaggcgccugcucucgccugaagacaugaacaagcugauguuuuuaaaguccaauaugcuguga

SEQ ID NO: 65208 - RNA, 1386 nt, Artificial Sequence
  derived and/or modified sequence opt3 from ZNF627__Homo_sapiens__NP_660338
auggacagcguggccuucgaggaugucgcuguuaacuuuacccuggaagagugggcacuccuugaccccucccagaagaaucuguacagagaugugaugagggaaacauuccggaacuuggccucuguaggcaaacaaugggaggaccagaauaucgaagauccuuuuaagauuccacgccgaaacauaucacacaucccggagcguuuaugcgagaguaaagaagggggacagggugaggaaacuuucagccagauucccgacggcauccugaauaagaaaacgccuggggugaagccaugugaguccucugucugcggagaggugggcaugggucccucgucacuaaacagacauauuagggaucacaccgggcgggaaccuaaugaguaucaagaauacggaaagaaaagcuauacacgcaaccaguguggcagagcgcucaguuaccauagguccuuuccaguucgggagcgcacucaccccggcgggaagccuuaugacugcaaagaauguggagagaccuucaucucucuggugagcauacgaagacauaugcuuacacacagggguggcgucccauacaagugcaaagugugugggaaggcuuuugauuauccgucccuguuccggauccacgagcguucacauaccggagaaaagcccuacgagugcaaacaguguggcaaggccuuuaguugcagcucuuacauucgcauccacgaaagaacucauacaggugacaaaccuuaugaguguaagcagugcgggaaagcauucuccugcucaaaguacauuaggauccacgaacggacccacacgggagagaaaccauaugaguguaagcaaugcggcaaggccuuucgaugugcuagcaguguacgcucucaugaaagaacucacaccggcgagaaauuguucgaaugcaaggagugugggaaagcacucacaugccuggccuccguuaggcggcauaugauaaagcacacuggaaauggucccuacaaauguaaggugugcggcaaggcuuuugauuucccuagcucguuccgcauucaugaaagaacccacacaggggagaaaccauaugacuguaagcagugcggaaaagccuuuucuuguuccucaaguuucaggaagcacgagcguauccauaccggcgaaaaacccuacaagugcacgaagugcgguaaagcguuuagccgguccucuuauuuccgaauccacgagagaacucauacaggggaaaagccguacgaguguaaacagugcggcaaggcauuuagcaggucaaccuacuuccgcguccacgagaaaauucacacuggagaaaagccuuaugagaaccccaauccaaacgccaguguggugccuguccuguccuga

SEQ ID NO: 65209 - RNA, 2610 nt, Artificial Sequence
  derived and/or modified sequence opt3 from ZNF629__Homo_sapiens__NP_001073886
auggagcccgaaaccgcccuguggggcccugaccuccaggggccagagcaaagcccgaacgaugcucacagaggagcagaauccgagaaugaagaggagucucccaggcaggaaucaaguggugaggaaaucauuaugggcgacccugcccagagcccagaguccaaggauucuacagagaugucgcuugaacggucaagccaggaccccagugugccucaaaacccacccacuccucuggggcauuccaauccauuggaucaccagauaccguuagaucccccugcgccagaggucguucccacgccuucugacuggaccaaggcuugcgaagccagcuggcaguggggagcacugacaacuuggaacuccccacccgugguaccggccaaugagccuucacuacgcgaacucgugcagggccgacccgcuggugcagagaaaccauacaucuguaacgagugcgggaaaaguuucagccaauggucuaagcugcuucgucaucagagaauccacaccggagaaaggccuaauacauguuccgagugcggcaaaucauuuacccagagcagucaucugguccagcaccaacggacucacacaggcgaaaagcccuauaaguguccagacugcgggaaauguuucucuugguccagcaacuuggugcagcaucagcgcacccacacgggagagaagcccuacaaaugcacugaaugugagaaggccuuuacccaaucgacaaaucucauuaaacaucagagaucucacacuggugagaagccuuauaagugcggcgaauguaggcgggcuuucuaccgcuccucagaucugauucagcaccaggccacccauacaggggagaaaccauauaagugcccggaaugcggaaaacgauuuggccaaaaccacaaucugcucaagcaucagaaaauccacgcgggugagaagcccuacagauguaccgaaugcgggaaaaguuucauacagagcuccgaguuaacgcagcaucaaaggacucacacaggagagaagccuuaugaaugucuggagugcggcaagucuuuuggccacagcucaacccuuaucaaacaucagcggacucacuugcgugaagacccauucaagugucccguuugcgggaaaacauuuacccugagugcaacgcuacuccgccaucagagaacccacacaggagagaggccuuacaaguguccagagugcgguaaauccuucagcgugucuucaaaccugauuaaucaccagcggauccaucgaggcgaacgccccuacauuugugccgauugcgggaagaguuuuaucaugagcuccacucuuauaagacaccaaaggauucauaccggagagaagccguauaaauguucugacugcggcaagucguucauccggagcucccaccugauucagcaucgcagaacacacacuggugaaaaaccuuacaagugcccagagugugggaaaucauuuagucagucuagcaacuugaucacccacgucaggacacauauggaugaaaaucucuucgugugcuccgacuguggcaaggcuuuccuggaggcccacgaguuagaacagcaucguguaauccacgagcggggaaagacccccgcaagacgagcucaaggcgacucacugcucgggcuuggagauccuagccuguugacucccccaccuggugccaaaccccauaagugccuaguuuguggcaaaggguuuaacgacgaaggaauuuucaugcagcaccagaggauacacaucggcgagaacccauauaagaaugcggauggucugauugcccaugcagcuccgaaaccuccccaacuccgcucuccacggcugcccuuuagagggaacuccuacccuggcgccgcugaaggaagggccgaggcaccaggccagccccuuaagccuccggaggggcaggaaggauucagucagcgccgaggucuguugagcucuaagacguauaucugcucccacuguggcgagucauuucucgaccggagugugcuguuacaacaucagcugacacacgggaaugaaaaaccauuccuauuucccgauuaccguauaggacucggcgagggugccgggccuagcccauuccugucgggcaagcccuuuaaaugcccugaauguaagcaguccuucggacuuucuagcgaguugcugcuccaccagaaaguccaugcuggcgggaagucaagucaaaaauccccggagcugggaaagucuagcuccgugcuucuggaacacuugagaucaccccucggcgcgaggccauaucgcugcagcgacugucgggcaaguuuucuggauagaguggccuuaaccaggcaucaggagacucacacccaggaaaagccucccaacccagaggacccucccccagaggcugucacacugucuaccgaucaggaaggugagggggaaacuccgacaccuacggaguccagcucgcauggagaaggccaaaaucccaaaacccuaguugaggagaagccauaccucugccccgaaugcggugccggcuucacugagguggcagcccugcuuuugcaccgaucaugucacccugggguaucucuguga

SEQ ID NO: 65210 - RNA, 1458 nt, Artificial Sequence
  derived and/or modified sequence opt3 from ZNF639__Homo_sapiens__NP_001290355
augaacgaguaccccaagaaaagaaagaggaaaacccugcacccuagccgguauuccgacucuucaggcaucagucgcauugccgauggguucaauggaauauuuagcgaccauugcuacuccguguguucuaugcgacagccagaucucaaguauuucgacaacaaagaugacgauucggacacagaaacuucaaaugaucuuccgaaguuugcugacgguaucaaggcacguaacagaaaucaaaacuaccugguccccagcccuguuuugaggauuuuagaucacacggccuucaguaccgagaaauccgcggacaucgugauuugcgaugaagagugugacucuccagaaagcguaaaucagcagacacaggaggagucccccaucgaagugcauacugcugaggacgucccuauagccguggaaguucacgcaaucucagaggauuaugacauugagaccgaaaacaauaguagcgagucucugcaagaucagacagacgaggaaccacccgccaagcuaugcaaaauccucgauaagucccaggcucugaacgugaccgcacagcaaaaauggccucuucugcgggccaauucaagcggcuuguacaagugugaacucugcgaguuuaacaguaaguauuucucugaccugaaacagcauaugauucugaagcacaaacgcacugauuccaaugucuguagagugugcaaggagagcuuuucgacaaacaugcucuuaaucgaacacgcuaaacugcaugaggaagacccauacauauguaaguacugcgauuauaaaaccguaauuuucgagaaucuuucucagcacaucgccgacacgcauuuuuccgaucacuuguacuggugugaacagugcgacguucaauucucaaguagcuccgagcuguaucuacacuuucaggagcauucuugcgacgaacaguaccucugucaauucugcgagcacgaaacuaacgauccggaggaccugcauagccacguggucaacgaacaugcguguaagcugauugagcugucagauaaguauaauaacggggagcacggacaguacaguuugcucuccaaaaucaccuuugacaagugcaaaaauuucuucgugugucaggugugcggcuuuaggagccggcugcacacaaacgucaaucgccauguugcaaucgaacacacuaagauuuucccccaugugugugaugacugcgguaaaggguuuucuucaauguuagaguauuguaagcaccugaacagucaccucagcgaaggaauauaccuuugccaguacugugaguauuccaccggccaaaucgaggaucugaagauucauuuggacuucaaacacucugccgaucuaccucauaagugcucggacugccugaugcgauuuggcaaugaaagagagcucaucagccaccuuccaguacaugaaacaaccuga

SEQ ID NO: 65211 - RNA, 4107 nt, Artificial Sequence
  derived and/or modified sequence opt3 from ZNF644__Homo_sapiens__XP_011540563
augagaucauuccugcagcaagacgugaacaagaccaaauccaggcucaauguccuuaacggccuggccaauaacauggaugacuugaagaucaauacagauauuacuggggcuaaagaggaauuacuggacgauaacaauuuuauaucugacaaggagucaggaguucacaaacccaaggauugccagacgaguuuccagaagaacaauacccuaacacucccugaggaacugagcaaagacaaguccgaaaacgcacuuucugguggccagucgucacuguuuauccaugccggggcgccaacugugagcagugagaauuucauuuugccgaaaggagcugccguaaacggccccgugucccacucuagccucaccaagacauccaauaugaacaaagguucagucagucugaccacugggcaaccuguggaucagccaacaaccgagagcuguucuacgcugaagguugcagccgaccuccaguuauccacuccccagaaggcuucacaacaucaggugcuguuucuuuugagcgaugucgcacacgccaaaaauccuacccauaguaacaagaaacugccaacaucugcuuccgugggaugcgacauccagaacagcguaggcucgaauauuaagucugauggcacucuaaucaaccagguugaagugggggaggacggagaagaccuccuggucaaagaugacugugugaauaccgugacagguauauccucaggcaccgauggguuccggagugagaacgacacgaauugggauccccaaaaggaguuuauccaguuccuuaugacuaacgaagagacagucgacaaagccccuccacacagcaagauuggacuggaaaagaaacgcaagcgaaaaauggauguuuccaagaucacccguuacacugaggacugcuuuucugauagcaauugugugccgaacaaaucaaagaugcaggaaguagacuucuuggagcaaaaugaggaacuccaggcgguggauagucagaaguaugcacuguccaaagucaagcccgagagcacagacgaagacuuagagucuguggaugccuuucagcaccugauuuacaacccugacaaaugcggcgaagagucaaguccaguucauaccagcacguuccucuccaauacccuuaagaaaaagugugaggaaucugauucggagagccccgcuacauuuuccacugaggaaccuucauucuauccaugcaccaaguguaacgugaauuucagagagaaaaagcaucugcacaggcacaugauguaccacuuggacgguaacagucauuuucggcaccuaaaugucccccgcccguaugccugcagagaaugugggaggacauuccgggaucgcaacucucugcucaaacauaugaucauacaccaagagcgaagacagaagcugauggaagagauuagggaacuuaaagagcugcaggacgagggacggagcgcacguuugcagugcccucaaugcguguuuggcacuaacugucccaagaccuucguacagcaugcuaagacacacgaaaaagauaagcgcuacuauugcugugaggaaugcaauuuuauggccguuaccgagaacgaacucgagugucacagaggcaucgcgcauggggccguggucaaaugcccaauggugacuuccgacauugcacagaggaagacgcagaaaaagacauucaugaaagauucagucgugggaagcucuaagaaguccgcuaccuacaucuguaaaaugugcccuuuuacuaccagugccaagagcguucugaaaaagcacacagaguacuuacauucuuccucauguguggacaguuucgguagcccccugggccuagauaaacggaagaaugacauccucgaggaaccaguagauucggacuccaccaagacucugacaaaacaacagucuacgaccuuucccaagaacagcgcucuuaaacaggacgucaagcgaacuuucgggucaacaagucaguccucuagcuuuuccaaaauucacaagcgcccucacagaauacaaaaggccaggaaaucaaucgcacagagcggagugaauaugugcaaccagaauaguucuccacauaagaacguuaccauuaaauccagcguggaucaaaagccgaaauauuuccaccaggccgcuaaggaaaagucgaaugcgaaagcaaacucacauuacuuguaucggcacaaguacgagaauuaucgcaugaucaaaaagucuggcgaaaguuaccccguccauuuuaaaaaggaggaggccuccagccugaacucucuccaccuguucagcuccucaaguaauagccacaacaauuucauaucugacccucauaaaccagaugcuaagagacccgaauccuuuaaggaccacaggcguguggccguaaaacgggugauuaaggagagcaaaaaggaaaguagcguugguggggaggaucuugacuccuauccugauuuccugcauaaaaugacagucgugguguugcagaagcucaacucugcagaaaagaaagacucguacgagacugaggaugaaagcucaugggacaacgucgagcugggcgauuacaccacgcaggccaucgaagacgagaccuauuccgauaucaaucaagagcacguuaacuuauuuccacuguucaagaguaaaguggaaggacaggagcccggcgaaaaugcuacacuaucuuacgaccagaacgacggguuuuauuucgaguacuaugaagauacuggaagcaauaacuuucuccaugagauucacgacccgcagcaccuggagaccgccgaugcaucccuuucaaagcauucuagcguguuccacuggacagacuugagucuggagaaaaaguccuguccuuacugcccagcgacuuuugaaaccgguguaggccucagcaaucauguccgagggcaucugcacagagcuggauuaucuuaugaagccaggcacgugguuucacccgagcaaaucgcaacguccgauaagaugcagcacuucaaacgcacaggcaccgguacuccugugaagcgggucagaaaagccauugaaaagagugagacaaccagcgagcauacuugccagcugugugggggcugguuugacaccaaaauaggacuuucgaaccacgugaggggccauuugaagcgccucgggaagacaaaaugggaugcucacaagucucccaucugcguucugaaugaaaugaugcagaacgaggaaaaauacgagaagauucuaaaagcccucaauucccgacggaucaucccacguccuuucguggcacaaaagcuggcuagcucagacgauuuuauuagucagaacguaauaccccuggaagccuacagaaauggacuuaagacggaggcguugucugucuccgccagcgaggaagagggucugaacuucuuaaaugaauaugacgagaccaaaccagagcucccgucaggcaagaaaaaccagagucugacucuuaucgaacuguugaagaacaaaaggaugggggaggaacgcaauagcgcuauuuccccucaaaagauccacaaccagacagcacggaaaagauucgugcagaagugugugcucccccugaaugaggauucuccacuaauguaccagccccaaaagauggaccugaccaugcauagcggaaugccugucaaacucaggacaugcguucacuguaacacuaccuuuacguccgccgugucacugucuaaucaucuucgagcuuaugcccgcaagaaaagugcaggcuugcugacagguaccgcguuagacugcaagcagaaaaagucgcggagcagauccgggucuaagaaaaagaugcucacucugccacacggcgccgaugaaguauacauucuuaggugucguuucugcggacugguguuucgcggcccccuaucaguccaggaggacuggaucaaacaccuccagcggcauauagugaacgcuaaucugccuagaaccggggccggaaugguugaggugacuagcuugcugaagaaaccggcauccaucacagaaaccaguuucucuuuacucauggcugaggccgcaagcuga

SEQ ID NO: 65212 - RNA, 1278 nt, Artificial Sequence
  derived and/or modified sequence opt3 from ZNF645__Homo_sapiens__NP_689790
augaacaagaugcccgccggcgagcaggaaugcgaguacaauaaagaagggaaguauuacagcaaaggagugaagcuggucaggaaaaagaagaaaaucccugguuauagauggggcgacauuaagauaaacaucauuggggagaaagaugaccucccaauccacuucugugauaagugcgaccuuccgauuaaaaucuacggacggauaauccccuguaagcaugcuuuuugcuaucacugugcaaaucuguacgauaagguuggcuauaaagugugcccucgcugucgauacccaguauugcguauugaagcccauaagagagguuccguguucaugugcucuaucguccaacaguguaaaaggaccuacuuaucacagaagagucugcaggcgcacauuaaacggcgccauaagagagcuaggaaacaagugacaagcgccucccuagagaagguucggccccacaucgcaccuccacagacugagauaucugacauucccaagcgccuccaggaucgagaccaccugucguauaucccuccagaacagcauacgauggugucacuuccgagcguccaacacaugcugcaggagcagcauaaccagccccacaaagauauucaagccccuccacccgaauugagucucucccugccuuuuccaauccagugggagaccgugucuaucuucacaagaaagcacgggaaucugacuguagaccauauucagaacaauagcgauuccggagcuaaaaagcccaccccgccugacuacuaucccgagugccaaucacagccagcaguuaguagcccucaccauauaaucccccagaaacagcacuacgccccacccccuucuccauccucaccggugaaccaucaaaugcccuauccuccacaggaugucgugacacccaauagcgugaggagucaggucccugcucucaccacuacauacgacccaucuuccggcuauauuaucguuaaggugcccccggacaugaacagcccuccauuacgggcgccccagucgcaaaauggcaacccuucugccuccgaauuugcaucacaccacuacaaucugaacauacuuccccaguucaccgagaaucaggaaacguugaguccacaguuuacucaaaccgaugccauggaccaucgucgcuggccugcuuggaagagacugagccccuguccaccgacaagguccccucccccaucuacucuacacgggcggagccaucacucacaccagcgacgccauagaagguacuga

SEQ ID NO: 65213 - RNA, 5499 nt, Artificial Sequence
  derived and/or modified sequence opt3 from ZNF646__Homo_sapiens__NP_055514
auggaggacacacccccuagccuguccugcucugauugucagagacacuucccaucacucccggaacuuaguaggcaccgggagcuguugcaccccagcccuaaccaggacuccgaagaggccgauucuaucccgcgccccuaccgaugccagcaguguggccguggguauagacauccuggaucguuagugaaucacaggcggacccaugaaacuggucuguuuccaugcacgaccuguggcaaagacuucucaaaccccauggcucuaaaaagccacaugcgcacacacgcaccugaggggagaaggcggcaucgcccaccgcgacccaaggaggccacuccucaccuccagggagaaaccgucaguacagauuccuggggccaaagacuggguucuagcgaggggugggaaaaucagaccaaacauacugaggagacaccagacugcgaauccguucccgauccuagggcggcuucaggaaccugggaggaccuuccaacgcggcagcgugaaggccuggccagucaccccggcccggaggauggggcagacggaugggguccuagcacuaacucugcccgcgcucccccauugccuauucccgcauccucacuccugagcaaucuggaacaguaccucgccgagagugugguaaacuuuaccggcgggcaagagccaacacagucucccccugcugaagaggaaagaagguauaaguguucccagugcggaaaaacuuacaagcacgccggcagcuuaaccaaucaucggcagucgcacacacuggguauauauccaugugcgaucugcuucaaggaguuuucuaaccuuauggcauugaaaaaucauucccgacugcacgcccaauaccgcccguaucauuguccccacugcccuagaguguucaggcuaccacgggaacuccuggagcaccagcagucacaugagggggaacgccaagagcccagaugggaagagaagggaaugccuaccacgaacggccacacugaugaaaguagccaggaccagcuuccauccgcucagaugcugaauggcucugccgaguugagcacaucaggggagcucgaagauaguggacuggaggaauacaggcccuuucguugcggugacuguggccggaccuaccgacaugcaggguccuuaauuaaccacagaaaaagccaccaaacuggagucuauccgugcucucuguguucaaagcaacucuucaaugcugccgcgcuuaaaaaccaugugagggcccaccaucgcccucggcagggcguuggugagaaugggcagccaagugugcccccugcaccccuguugcuagcugagacaacccacaaggaagaggaagacccaacgaccacacuggaucauagaccuuacaagugcagcgaguguggcagggccuaucgccaccgaggaucccucgucaaccaccggcauucucaccguacuggcgaauaccaaugcucgcugugucccagaaaauauccaaaccuuauggcucugaggaaucaugugcgcguacacugcaaggccgcacggagaagcgccgacaucggggcugagggagcgccgucccauuugaaaguugagcucccucccgauccaguggaagcagaggccgcuccccacaccgaccaggaucacgucuguaagcaugaagaggaagccacagacauuacuccugcagccgauaaaaccgcugcccacaucugcucaauauguggucuguuauuugaggacgcagagagucuggaaaggcauggccuaacacacggggcgggagagaaggaaaacucucgaaccgagacuacgaugagcccaccccgcgcuuucgccugccgggauugcggcaaauccuacagacacucagguagccucaucaaucauaggcagacacaccagaccggggacuuuucuuguggcgcaugcgccaagcauuuccacacuauggcugccaugaagaaccaucugcgucgccacucccggagaaggagucgacggcaccgcaaaagagcaggaggcgcuagcgggggaagggaagccaaacuuuuggcggccgagucuuggacccgggagcuggaagauaaugagggucucgaauccccucaagacccgucaggcgagaguccacauggggcugagggaaaccuggaaagcgacggcgauugucuucaggcagagucggaaggugacaaaugcgggcuggagcgagaugaaacacacuuucagggcgacaaggaguccggaggcaccggggagggauuggaaagaaaagaugccucucuccuggacaauuuagauauucccggcgaggaaggugggggaacucauuucugugacagccugacaggcguggaugaggaccagaagccugcuacgggucaaccaaacucaaguucccacucugccaaugcagugaccggcuggcaggcgggggccgcucacacuugcagcgauuguggacauuccuucccccacgccacaggccuacucucacaucgcccuugccacccgcccgggaucuaucaguguagccugugcccaaaggaauuugacagucuuccugcauugaggucucauuuccaaaaccaccgucccggagaggcuaccuccgcccagccauuucuguguugccucugcggcaugauuuucccuggucgggcaggguacagacugcacaggcgccaggcccauagcucgucaggaaugacagagggcucugaagaggaaggugaggaagagggcgucgcugaggcggcccccgcacgaaguccaccguuacagcuguccgaagcugagcuuuugaaucaacuccagagagaaguugaggcccuggauagcgccggguacggacacaucuguggcugcugugggcagacuuaugacgaccuaggaucucuggagcggcaucaccagagccaauccucaggcaccacggcugauaaagcaccuaguccccucgguguggccggggacgcgauggaaaugguaguggauagcguccuggaggacauagugaacucuguuuccggagaaggcggugaugcuaagucacaggagggcgccgggaccccacuuggagacaguuugugcauucagggcggggaaagccuguuagaggcacagcccaggccuuuucgcuguaaucaaugcggaaaaacauaccgucacggcgguucccucgugaaccauagaaagauccaccagacuggggauuuccuguguccagucugcucucgguguuaucccaaucuugccgcuuacaggaaccaucugcgcaaccacccucgaugcaaaggaucggagccacaggugggcccaauucccgaagcagccggcagcucagaguugcaaguagggccuauccccgaaggagguuccaauaagccacagcauauggcggaggaaggcccugggcaggcugagguugagaagcuccaggaagaacugaaaguggaaccccuagaggaagucgccagagugaaggaggaggucugggaagagaccacagugaaaggagaagagaucgagccacggcuggaaacugcagagaagggcugucaaaccgaagccaguucugagaggccuuuuagcugcgaaguuugcggucgcuccuauaaacacgcugggucacucauuaaccacagacagucucaucagacgggacacuucggcugucaggccugcagcaagggcuuuaguaaucugaugucccuuaagaaccauaggcggauacacgcagacccgcgucgcuuccgauguagcgagugcgggaaggcuuuuagauugaggaagcaacuggccucucaucagcgggugcacauggagcgcagaggagguggcgggacaaggaaagcgacccgggaagaucgacccuucagauguggacagugcggccgcacuuacaggcacgccgguucauuacucaaucaucggcguucccacgagacagggcaguauaguuguccaaccugcccuaagacuuacagcaacagaauggcacugaaagaccaucaaaggcuucacucggaaaaucgccggagacgagcuggaaggucucgccggaccgccguaagaugugcucugugcggccguuccuuucccggcagggggagccuagagcggcaccuccgcgaacaugaggagacagaacgagagccagcaaacggacaggguggccuggaugggacggccgccucagaagcuaauuugaccggaagucagggccuggagacucaguuagguggggcggaaccugucccccaccucgaggacggagugccgagaccaggcgagaggucucaauccccuauccgggcagccagcucagaagcucccgagccacugaguuggggcgccgggaaggcaggagguuggcccguuggcgggggacuuggcaaccauagcggugggugggugccucaguuccugacacgcuccgaggaaccggaggauucuguccacagaagccccugucaugccggagacugccaguugaauggcccaacccucucccacauggacucaugggauaacagggacaauucuagucaacugcagccuggcucgcacagcuccugcucucagugugggaaaacauacugccagucaggaagccuacugaaccauaauacuaacaagaccgaucgacacuauugucuucucugcuccaaggaguuccugaaccccguggcuacgaaaagucauucucacaaucacauugacgcgcaaacauuugccuguccugauugcgguaaggcauucgagagccaucaggaauuggcuucacaucugcaggcccaugcacggggccacucccagguaccagcccaaauggaggaagcucgugaccccaaagccgggaccggagaggaucaggugguuuuaccuggccaggguaaggcgcaggaggcaccaagugaaacucccagagggccgggcgagagcgucgaacgcgccaggggaggccaagcugugaccucuauggccgcugaggacaaagaacggccuuuuagauguacacagugcgggcgcuccuacaggcaugcaggaucacuccugaaccaccagaaggcccacacuaccggucuuuauccauguagccugugccccaaguugcucccuaaucugcuaucgcugaaaaaccauucucgaacacacacggauccaaagcggcauuguugcaguaucugcggcaaggcuuucagaaccgccgcaaggcuugaggggcacggacgcgugcaugcgccccgugagggcccguuuacuuguccucacugcccccggcacuucagaaggcgcauauccuuuguccaacaucagcagcagcaccaagaagaguggacaguugccgguagcggggcuccaguggccccugugaccggccgaggagaccucccccugccacccccuccaacuccgacaacccccuuguuagauccuucaccacaguggcccgcagaccuguccuucucucucuga

SEQ ID NO: 65214 - RNA, 1821 nt, Artificial Sequence
  derived and/or modified sequence opt3 from ZNF652__Homo_sapiens__NP_001138837
augagccacaccgccuccucuugccaggagcugguggaaaacugugcuguccauguugcaggcauggcccaagaggacucaagaaggggacaggugcccaguagcuucuaccacggggcgaaucaggaacucgaucuuuccacaaagguauauaaacgggagucugguucgccuuacucagugcuggucgacacuaagaugagcaaaccacauuugcacgaaacggaggagcagccguauuuucgcgaaacccgagcugugagugauguucaugccgugaaggaggaccgugaaaacuccgaugacacagaggaggaagaggaagaggucucuuacaaaagagaacaaaucaucguggagguaaauuuaaacaaucagacucugaacguuagcaagggcgagaaggggguguccucacagaguaaagaaacccccguccuaaagacaagcucugaggaagaggaagaggaguccgaagaggaagcaaccgaugacucaaaugauuauggagagaacgaaaaacagaagaaaaaggagaagauaguggagaaagugagcgucacucaaaggcggacacgcagagccgcuaguguugcagccgcuaccacgucuccuacuccaaggaccacacggggccgccgaaaguccguggaacccccuaaaagaaagaaaagggccacuaaggagccaaaagcgcccguacagaaggcaaagugcgaagagaaagagacccucacaugugaaaagugcccucggguguucaauacccguugguaccuggagaaacacaugaacgucacgcaccgcagaaugcagaucugugacaagugcgguaaaaaguuugugcuugaaagcgagcugucguugcaucagcaaacugauugugaaaagaauauucagugcguuucuuguaacaaauccuucaagaaacucuggucacugcacgagcauaucaagauugugcacggguaugccgagaaaaaguuuaguugcgaaaucugugagaagaaauucuacacaauggcucacgucaggaagcauaugguggcccacaccaaagacaugccauuuacuugcgaaacaugcggaaagagcuucaaacgguccaugucucugaagguacauagccuccagcacucaggcgagaagccguuucgaugugaaaauugcgaugagcgcuuccaauacaaauaucaguuaagaagucauauguccauacacaucggccacaagcaguuuaugugucaguggugcgggaaagacuucaacaugaagcaauacuuugacgagcauaugaaaacccacacgggagaaaagcccuucauuugugagaucugcgguaagagcuucaccucuaggccuaauaugaaacggcaucgcagaacacacacuggcgaaaagccauaucccugugauguuugcgggcagagguuucguuucucaaacaugcugaaagcacacaaggagaaauguuuucgggugaccaguccugucaacgugccacccgcuguccagauuccgcuuacaacuagcccugccacccccgugccauccguugugaauacagcgaccacuccuacgcccccaaucaacaugaaucccguaucuacauugccuccacgaccgauaccccauccuuucucgcaucugcacauucacccacauccccaccacccucaucaccuaccaauucccccggucccucaucucccacccccucccgcccuguuuaagagcgaaccacuuaaccacagaggacaguccgaggacaauuuccugaggcauuuggcagagaaaaacucaagugcucaacaccacuga

SEQ ID NO: 65215 - RNA, 1746 nt, Artificial Sequence
  derived and/or modified sequence opt3 from ZNF654__Homo_sapiens__NP_060763
augcugugcaacaaggaguuccucggcgggcacaucgugagacaugcccaggcucaccagaaaaaggggagcuuugcaugugucauuugcgguaggaaauuccggaaucgcggccuuaugcaaaagcaucugaaaaaccacguuaagaagauacagcgacagcaaaucgccgcggcucagcaggacgaucaggaagugaccgccuuggaggaaauuaauuguuccucuucaaguaucagcuuugagaacggaaauuccgacucuaaagauuuagaaguagagacacugacugcaucgucagagggaaacaaggaagugauucccgagcaugucgccgaguucaucgaaauaccuaucagcgugccagaggacguuauugaaaaugugaucgagaacggcaguccgaauaacucccuaaauaacgucuuuaaaccccucacggaaugcggugaugacuacgaggaagaggaggaugaagagggggacuaugaagaggaugacuacgaucugaaucaagaaaccucugugauucacaagaucaacggaacaguaugucacccuaaagacauauaugcuacugaucaggagggcaauuucaagugcccagcacuuggcuguguucguauuuuuaagagaaucggguuccugaacaaacaugccaugaccgugcaccccacagacuugaacgucaggcagaccgugaugaaguggagcaaaggaaagugcaaauuuugucagcggcaauucgaggacucccagcauuuuauugaucaccucaaucgccacucauacccuaacguguauuucugccugcauuuuaauuguaacgaaaguuucaagcugccauuccagcucgcucaacacacuaaaagccauagaaucuuucaggcccagugcucuuuccccgagugccacgaauuauuugaggaccugccucuuuuguacgaacaugaggcgcagcacuaucuguccaagacaccagagucaagcgcacaaccgagugaaaccauccuaugggauguccagacggacucuaaucccaaccaggagaaggauuccagcucgaaugaaaaacagacuauuucucucccuguuuccaccucaaagaguaggaaagagagcacagagccaaagacuuguauagaauccauggagaaaaagaccgacucucuggugcaaaacgguaaugaacggagcgaugacacaguaucaaacaucagucuuauugaucagaagaugcccgacaucgagccuaauuccgaaaacaauugcaguucuucagauauagugaacggccacagugagauugagcagaccccacuggucagcuccgaccccgccuugaaaaucgacacgaaucgcauccgaacugaaaacgggucuauucucccgucggugguuccucaggagcauaacacacugcccgugagccaagcuccauccaagccuaauuuaaccucagaacacacuagcuacggacugauccucacaaaacccuacgucagaccacuucccccuucuuaucuggaugagagguacuugagcaugccaaagcggcguaaauuccuaaccgaccgcguggaugccuguuccgaccaggauaacguauauaagaagucaguuaaaagacugaggugcggcaagugucucacgaccuacugcaaugcagaagcucuggaggcccaucuugcgcagaaaaagugucagacacuguuugguuucgacagcgaugacgagucugccuga

SEQ ID NO: 65216 - RNA, 786 nt, Artificial Sequence
  derived and/or modified sequence opt3 from ZNF664__Homo_sapiens__NP_689650
augaucuacaagugccccauguguagagaguucuuuagcgaaagggccgaccuguucaugcaccagaaaauucauaccgcugagaagccucacaaaugcgauaagugugacaaaggcuuuuuccauauauccgaacuccacauccauuggcgggaucacacaggggagaagguguauaagugcgacgauuguggaaaagacuuuucuacuacgaccaaguuaaaccgccacaaaaagauucauacagucgaaaaaccauacaagugcuaugagugugguaaggcauucaauuggucaagucaucugcaaauccacaugcgaguucacacuggcgagaaaccguacgugugcagcgaaugugggcguggauuuuccaacucuucgaauuugugcaugcaccagagaguacauaccggcgagaagcccuucaaaugugaagagugcgguaaggccuuuaggcacacaucaagccuuugcaugcaucagcgggugcacaccggggagaaaccuuauaaguguuacgaaugcggaaaagcguucagucaguccucuagccuguguauucaucaacgcguccacacuggcgagaagccauauagaugcuguggcugcgggaaggcuuuuucccagucaaguagccuauguauccaccagagggugcauacaggagaaaaacccuucaagugcgaugagugugguaaagccuuuucucaguccaccucacucugcauacaccaacggguucauacgaaggaacgcaaccaccugaaaaucagcgugauuuga

SEQ ID NO: 65217 - RNA, 1833 nt, Artificial Sequence
  derived and/or modified sequence opt3 from ZNF667__Homo_sapiens__NP_071386
augcccagcgccagaggcaaguccaaaucuaaggcuccuaucaccuucggggaccuggcaauuuacuuuucacaggaggaaugggaguggcucaguccaauacaaaaagaucuuuaugaagacgugaugcuggagaacuacaggaauuuggucagcuuaggacuguccuuccggcgcccgaacguuaucacacuacucgaaaaggguaaagcccccuggaugguggagccuguacgacguagaagggcgccagauucuggcucgaagugcgagacuaagaaacugcccccuaaucaguguaacaagucagggcagagcauuugccagaaacuugugagugcucaacagaaggccccaacgcggaaauccggauguaauaagaacucuguccuggugaagcccaaaaagggccacagcgguaaaaagccuuugaaaugcaaugacugugggaagaccuuuucccgcucauucagucucaaacugcaucagaacauccacacaggagaaaagccauuugagugcagcaauuguagaaaggcauucaggcagauuucuuccauccugcuccaucaacggauacacucaggcaaaaagagccaugaaugcaacaaauguggcgagaguuuuaaucagcgcacuaccuuaauccugcacaugcgaauccacgaugggaaggagauucuugacugcggaaaagccuugucucagugucaguccuucaacauucaucaaaagauccacguuguggguaaugucugccagugcagaaaguguggcaaagcauuuaaccagaugagcucgcugcuacuccauaagaaaauacacaaugggaagaaaacacacaaguauaacaagugcggaaggggcuucaaaaagaaaucuguguuuguaguucauaagcggauucacgcuggugagaaaaucccggaaaacgccaaggcucugucccaaucacuucagcagcguagucaucaccuggaaaaucccuucaagugucgcaaaugcgggaaguuguuuaacagaauuagcccucucaugcugcaucagaggauccacaccuccgagaaaccauacaagugugauaaaugcgacaaguucuuccggcgauuaucuacucugauccuccaccuucgcauucauaauggagaaaaacuguauagauguaacaagugcgagaagguguguaauaggcacagcucauugauacaacaucagaaaguccacacaaagaaaaagaaacuauuugagugcaaggaauguggcaagauguucaguggcaccgccaaccugaaaauccaccagaauauucauuccgaggaaaagcccuuuaaaugcaacaagugcagcaaaguguucgggcggcagucuuuucucaucgagcaccaacgcauacauacgggagaaaagccuuaccagugugaggagugcgguaaggcguucucacacagaauuagucugacuaggcauaaacguauccacaccgaagaucggccauaugagugugaccagugcggcaaggcauuuagccaguccgcccaccuugcucaacaugaacgaauccacacaggggagaaacccuacacuuguaagaccugcggaaaagccuucucucagagaacaucgcugauuuugcaugaaaggagccacaccggcgagaagccguacgaguguaaugaaugcgguaaggcauuuuccucagggagugaucucauccgccaucagcggucucacagcuccgagaaaccuuaugaauguucaaagugcggcaaggcuuacagcagaucuuccagucugauuaggcaccagaacacgcauagcgaggagaaagccuga

SEQ ID NO: 65218 - RNA, 1860 nt, Artificial Sequence
  derived and/or modified sequence opt3 from ZNF668__Homo_sapiens__NP_078982
auggagguggaagccgcugaggcaagaagccccgccccuggcuacaagagguccgggcggcgcuauaaaugccugucuuguaccaagacauucccaaacgcgccgcgagcugcccgucacgcagccacucauggacccgcugacugcucagaagaggucgcagaaguuaaaccuaagccagagacggaggccaaagcugaagaggccaguggugaaaaggugagcggcuccgcggcaaagcccagaccuuacgccuguccacucugccccaaggcuuauaaaaccgccccugagcuuaggucucacgggcggucgcauacaggagagaaaccauuuccgugucccgaaugcggccgcagauucaugcagccuguaugucugagggugcacuuggcaucacaugcuggugaguuaccauuucggugcgcccacugucccaaggcguacggggcccugagcaaacuaaagauccaccaacgcggacauacuggcgaacgaccuuaugcaugcgcugauuguggcaagaguuucgccgacccauccgucuuuagaaaacacaggcggacccaugcugggcuccgucccuacucuugcgagcgcugcggaaaggccuaugcagaacugaaagaucuuagaaaucacgagaggagccacacaggugagcggccguuccuguguuccgaaugcggcaagucauuuagucgaucuagcuccuugaccugucaucagcgcauucacgccgcucagaaaccuuacagaugccccgcgugugggaagggauucacucagcucucaagcuaccaaagucaugagaggacacacucuggcgaaaaaccauuucugugcccucgguguggucgcauguucuccgaccccagcucguuuagaaggcaucagcgugcacacgagggggugaagccauaucacugcgaaaaguguggaaaagauuuccggcagcccgccgaccuggcuaugcaucgaagaguucacaccggcgauaggccuuuuaagugccuccagugugacaaaacguucguggccucuugggauuuaaagcgccaugcacugguccacuccggccaacggccauucagaugcgaggagugcgggagggccuuugcugaacgcgccucacuuacuaaacacagucgagugcauagcggagagcggccguuccacuguaacgcaugcgguaaguccuuuguaguuucuagcucauugcguaagcaugaaagaacccacaggaguuccgaggcggcuggcgugcccccugcccaggaacuggucguggggcuagcacucccagugggagucgccggcgagagcucugcugcccccgcagcuggugccgggcugggcgacccuccagcgggacuucugggcuugcccccggagucagggggaguuauggccacacaguggcaagugguagguaugacuguggaacaugucgagugucaggaugcuggcgugcgcgaagcaccugggccacucgagggagccggcgaggcugguggggaagaggccgacgaaaaacccccucaguucguuugccgggaguguaaggaaaccuuuaguacaaugacccuguuaagaaggcacgagcgaagccaccccgagcugcgcccauucccuugcacgcaguguggcaaauccuuuucugaucgggcaggacucagaaagcauucgaggacucacagcuccgugcgucccuacacaugcccacauuguccgaaagcguuccuuucagccagugaccugcgcaagcacgaacggacccauccuguccccaugggcacuccaacacccuuggagccucuaguggcucugcucgggaugccagaagagggacccgccuga

SEQ ID NO: 65219 - RNA, 1728 nt, Artificial Sequence
  derived and/or modified sequence opt3 from ZNF674__Homo_sapiens__NP_001139763
auggccaugagccaggagucccugaccuucaaggacguguuugucgauuucacacucgaagaguggcaacagcuugacucugcucagaaaaaccuguacagagauguuauguuggaaaauuauucacacuuagugaguguaggccaucugguggggaagcccgacgucaucuuuaggcuaggaccuggugaugagagcuggauggcagacggcgggacuccagugcggacgugcgccguuugggaaguggaugagcagauugaccacuacaaagagucccaagauaaguuccucuggcaggcggcuuuuauaggaaaagaaacccugaaggacgagucuggccaggaauguaagaucugccgcaaaauuaucuaucuuaacacagauuucgucucggugaagcagcgacugccgaaauacuauucaugggagcguuguagcaagcaucacuugaauuuucucggucaaaacagaaguuacguaaggaaaaaggacgaugggugcaaggccuauuggaaaguuugucugcauuacaaucugcacaaggcacagcccgccgagcgguucuuugacccuaaccagcgcggaaaagcucuccaccagaagcaagcauuaagaaaaucccagaggucucagacuggcgaaaagcuguacaaaugcaccgaguguggcaagguguucauucaaaaggccaaucuugucgugcaucagcggacacacaccggggaaaaaccauaugagugcugugaaugcgcuaaggccuuuagccagaaauccacuuugaucgcgcaucagcgcacacacaccggagagaagcccuacgaguguucagaaugcgguaaaacguucauacaaaagaguacucugaucaagcaccagcgaacccauacaggcgagaaaccuuuugugugcgacaaguguccaaaagcauucaagagcucuuaucaccuaauuagacaugagaaaacucacaucaggcaggccuucuacaaggggauuaagugcaccacauccucacucaucuaucagcggauacauaccagcgaaaaaccccaauguagugaacacggaaaggcuucugaugagaaaccuuccccaacgaagcacuggcguacucauacaaaagagaacauuuacgaaugcagcaaguguggcaagucguuucgcgguaaaucucaccuguccguccaucagagaauccacaccggggagaagccguaugaaugcucaauuuguggaaaaacuuucaguggcaagagccaccuuuccguucaucacaggacacauaccggcgagaaacccuacgaaugccggcgaugugggaaggccuuuggagagaaaucuacgcugaucgugcaccagcgcaugcauaccggugagaagccuuacaagugcaaugaauguggcaaagcauucagcgagaagucaccauugaucaaacaccagaggauucacacaggggaaagacccuaugagugcacugacugcaagaaggcuuuuagucggaaauccacccucauaaagcaucaacgcauccacacaggagagaaaccuuacaaguguagcgaaugcggcaaagccuucucuguaaagucaacucugauugugcaucacagaacccauacaggugagaaaccauaugaauguagggauugcgggaaggcguuuaguggcaagagcaccuuaaucaaacaccagcguucccacacuggagacaagaaccuguga

SEQ ID NO: 65220 - RNA, 1896 nt, Artificial Sequence
  derived and/or modified sequence opt3 from ZNF676__Homo_sapiens__XP_011526034
auguggagcgugcugugccucucccuucagcccgagggcgcccugaccuucagagacgucgcuaucgaauuuucuuuggaggaauggcaauguuuagauucaacacagcagaaccuguacaggaauguuaugcuagagaacuaucggaaucucguguuccuggggauugcagccuuuaagccugaccuuauaaucuuccuggaacagggaaaagagccauggaacaugaagcgccacgagaugguagaggagccgcccgugauuugcagucauuuuagccaagaguucuggccugaacaggguaucgaggauuccuuucagaaaaugauuuugcgacguuacgacaaguguggccacgaaaaucuccaucugaaaaucucuugcacuaacgucgaugaguguaaugugcacaaggaaggguauaacaagcugaaucagucgcucacgaccacacaaucaaaaguuuuccagugcggaaaguacgcgaacguguuucauaaauguagcaauaguaacagacacaagauaaggcacacuggcgagaaagguuuaaagugcaaggaauauguccgguccuucuguaugcugucucaucuuagccagcacgagcgcaucuacaccagagaaaauuccuauaaaugcgaagagaacgggaaggcuuuuaauuggucaaguacauugaccuacuacaaaagcauucauacuggagaaaagccauauaaaugugaggaaugcggcaaggccuucucuaaauuuuccauccugacaaagcacaaggugauucacaccggcgagaaacccuacaagugcgaggaaugugggaaagcauucaacaggucaagcauccuaacgaagcauaaaauaauucacacuggagagaagccuuauaagugcgaagagugugguaaaggcuucaguucuguauccacccucaacacacauaaggccauccacgcugaagagaaaccauacaagugcgaggaaugugggaaagcaagcaauucgucuuccaagcugauggagcauaagcggauucacacuggagaaaaacccuauaagugcgaggaguguggcaaagccuuuucauggaguagcucccuuaccgaacacaagcgcauccaugcuggugagaaaccuuacaagugcgaagagugugggaaggccuucaaccgaucuagcauccugacaaaacacaagauuauacauaccggagaaaaaccauauaagugcgagggcuguggcaaagcguuuucaaagguuaguacguugaauacucacaaagcaauccacgccgaggaaaagccguacaagugcgaggaaugcgggaaagcuagcaacuccucuucaaagcucauggagcauaaaaggauucacacaggagaaaagcccuacaaaugugaggagugcgguaaggccuucaguuggagcuccucucugaccgaacauaagagaauccacgcaggcgagaaaccuuauaagugugaagagugcgggaaggcuuuuacuuggucgagcuccuucacaaaacauaaacggauacacgccgcggaaaagccauacaagugugaggagugcggaaaaggcuuuucaaccuucaguauuuuaacgaagcacaaaaucauccauaccggugaaaagcguuauaaaugugaggaaugcgggaaggccuuuucuuggagcuccauucugacagagcacaagaucauucauacuggcgagaaacccuacaagugugaagagugcggaaaagcauucucacgcucuagcucccucaccagacacaagaggauacauacaggcgaaaaaccuuauaagugugaggaaugcgggaaggcuuuuaaaaguagcucuacuguguccuaccacaagaaaauccacaccggagagaauccauga

SEQ ID NO: 65221 - RNA, 1743 nt, Artificial Sequence
  derived and/or modified sequence opt3 from ZNF678__Homo_sapiens__NP_848644
augcccggccacccugagagcagaaagaccaggcggauccugacaaugcucccacgccuugugcugaacuccuucccgcaggucauuuuguuacccaauccuccaaaaguucugcgacuacaagggcuccuggccuuuucugacgugguaauagaguucucacccgaagaaugggcuugccuugauccugcacagcguaaccuguacagagacgugauguuugagaauuauaggaacuuggucagucucgccauccugagcuacuccauucaggaucugcucccagaacaggacaugaaggauuuaugucaaaaagugacucugacgcggcaucgcucuuggggacuugacaauuugcaccugguuaaggauuggagaaccgugaacgaggguaaaggccagaaggaguauugcaauaggcuaacacaguguucgucaacuaagagcaaaaucuuccagugcauugaaugugggcggaacuuuaguuggcgcuccauccucaccgagcauaagcgaauacacacaggagaaaaacccuacaagugcgaggaguguggcaaagucuucaauagaugcucuaaccugaccaagcauaagaggauccacacuggugaaaaaccuuauaagugugacgagugcgggaaaguguuuaauugguggagccaacuuacaaaccacaagaaaauucauaccggagaaaagccauacaaaugugaugagugcgacaagguauucaauugguggucccagcugacgucacacaagaaaauccauaguggcgaaaagccguaucccugcgaggaguguggcaaagcguuuacucaguucagcaacuugacccagcacaagcggauucacacaggggaaaaaccuuacaagugcaaggaguguugcaaggcuuuuaauaaauucucuaaccucacucaacauaaacguauccacaccggagaaaagccauacaaaugugaggaaugcgguaacguuuuuaaugaguguucccaucugacacgccacagaaggauacauaccggcgagaagcccuauaagugcgaagagugugggaaagccuucacgcaguucgcaucauuaacucggcacaagcgcauucacacaggagaaaaaccuuaccagugcgaggaauguggcaagaccuuuaaccgaugcagccaucugaguucucacaaaagaauccauacuggugagaagccauauaagugcgaggaaugugggaggacauucacccaauuuuccaaucucacgcagcacaaacggauucacaccggagagaagcccuacaaaugcaaggaauguggcaaagccuucaacaaguuuagcucgcuuacacagcaucgcagaauccacacuggcgugaaaccguauaagugcgaggagugugggaaggucuucaaacagugcucucaucugaccucccacaagaggauccauacaggagaaaaaccuuacaaguguaaagagugcgguaaggcuuuuuaucaaucaaguauuuugagcaagcacaaacguauacacacugaagagaagcccuacaaaugugaagagugcggcaaggcauucaaucaguuuuccucucuaacccggcauaaacgaauccacacaggggagaagagauacaaguguaaagaaugcggaaagggcuucuaucagagcucaauucauaguaaauacaagaggaucuauaccggugaggaaccagauaaaugcaagaagugugggucccuguga

SEQ ID NO: 65222 - RNA, 1623 nt, Artificial Sequence
  derived and/or modified sequence opt3 from ZNF683__Homo_sapiens__XP_011539498
augaucaccagagugggcugggaggucaggauugaagggaacggagacaugaaggaggaaagcgccgcucagcuggguugcugucaccggcccauggcacucggcgggacaggaggcucccuuucuccuucacuggauuuccaauuguuucgcggugaccagguuuucagugccugccgaccauuaccggauaugguggacgcgcaugggcccagcugugcuuccuggcugugcccucuaccacucgcccccggacguucugcacugcuugccugucugcaggauuuggaccucaaucugugcacuccucagccagcuccccugggcacggaucuccaaggcuuacaggaggacgcacugucgaugaaacacgaaccuccagggcuucaggccucaagcaccgaugacaagaaauuuacaguaaaguacccgcagaacaaagauaaguugggaaagcaacccgagagagcuggugagggcgccccuuguccagcguucaguucccauaauucuagcagcccucccccacugcagaacaggaaaucacccaguccgcuagcauuuugcccuugucccccagugaauagcauaucuaaggaacucccuuuccugcuucacgccuuuuaucccggguacccacuguugcugcccccuccacaucuguucacuuauggagcuuuaccguccgaccagugcccccaccuccucaugcuuccucaggauccaucauaccccaccauggccaugccuagccuguugaugauggucaacgagcuaggccacccaagugcacggugggaaacacugcuccccuauccgggugcuuuucaagccucugggcaggcgcugccuucccaggcccgcaauccaggagcaggcgcugcccccaccgacagcccuggccuugagagagggggaauggcuucgcccgccaaaagggugccacugucuucccaaacugguacagcagccuugccuuacccccucaagaaaaagaacggcaagauccuguaugaguguaauauuugcgggaaaucauucggacaguuaaguaaccugaagguucaucuacgggugcacagcggcgaacgcccauuucagugcgcucucugucagaaauccuucacccaacuggcgcaucuucagaagcaccacuugguccauacgggugagcgaccgcacaaaugcucuaucccuugggugcccgggagaaaucauuggaaguccuuucaggcauggagggaacgggagguaugucacaaacguuucucaaguuccagcaaccugaagacucaucuccgccugcacucuggcgccagaccauuccagugcucaguuuguaggagucgguuuacccaacacauucaucuuaagcugcaccaucgauugcacgcuccccagccuugcggacucgugcacacacagcugccauuagccagccuggcaugucuagcccaguggcaucaaggcgcucucgaccugauggccgucgcauccgaaaaacacaugggguacgauaucgacgaggugaaggugucuucgacuagccagggaaaagcgcgcgcugucucccuuucaagugccgguacccccuugguuaugggccaggaucagaauaacuga

SEQ ID NO: 65223 - RNA, 3714 nt, Artificial Sequence
  derived and/or modified sequence opt3 from ZNF687__Homo_sapiens__NP_001291693
augggcgacaugaagacccccgauuucgacgaucugcucgccgcuuuugacaucccugauauugacgcaaacgaggccauacacagcgggccagaagagaaugaaggaccggguggccccgggaaaccugagccaggagugggcuccgaaucugaggauacagcggcugccucagccggugacgggcccggagucccugcccaggcuagugaucauggccuuccacccccugacaucagcguuguguccguaauugugaagaacacugucugcccagagcaaucugaagcacuggccggcgggucggcuggagauggugcccaggcggcaggcgugacgaaagaggggccgguuggaccccacagaaugcagaauggcuucgguucaccugaaccuagcuugcccgggaccccucauaguccagcacccccguccggaggcacauggaaggagaaaggcauggaggggaagacuccuuuagaccuguuugcucacuucggacccgaaccaggugaucauucugacccucuacccccaagcgcccccuccccuaccagggagggcgcacucacaccaccgcccuuuccuucaaguuucgaacuggcucaggagaacgggccaggaaugcaacccccugugagcucuccaccccuuggcgcccugaagcaggaauccuguucaccgcaccacccucaggucuuggcgcagcaagguagcgggaguucuccaaaagccaccgacauccccgcauccgcuagcccucccccaguggccggcguaccauuuuucaagcagucgcccggacaucagucuccacucgcuuccccgaaaguuccugugugccagccccugaaggaggaggaugacgaugaaggcccagucgacaaaucaagucccgggagcccucaauccccaucuagcggagccgaggcagccgaugaagacucaaaugauagucccgcuuccaguucuucacggccucugaaggugcgcauuaagacuaucaaaacaaguugugguaacauaacccgaacggugacucaggucccgagcgacccagaucccccugcgccacucgcagagggcgccuuuuuagcugaagccucccugcuuaaguugucucccgcaaccccuacaucggaggggccgaaaguugugagcguacagcugggagacggcacucgucuaaaggguaccgugcuccccgucgccacaauccaaaaugcuuccaccgccaugcugauggcagcgucaguggcuagaaaagccguugugcuuccagggggcacggcaacuagcccuaagaugauugccaaaaacguccugggauuggugccccaggcucucccaaaggccgauggcagggcagggcugggaacagguggccagaagguaaauggggcuucuguugugaugguccagccuagcaaaaccgccacuggacccuccacaggcggugggaccgugaucucacggacgcaaagcucuuuagucgaggcguucaacaagauucucaauuccaaaaaccugcuuccagccuaccgcccgaaucugaguccucccgcugaagcaggcuuggcccuaccacccaccggauauagaugccuggaguguggcgacgcuuuuagccucgaaaagucucuggccaggcacuacgaccggcgcuccaugcgaaucgaggugacaugcaaccauugugcaagaaggcuuguuuucuuuaauaaaugcucacuguugcuccacgcgcgggaacacaaggauaaggggcuggugaugcaguguagucauuuaguaaugcguccugucgcccuggaccagauggugggacagccagauauaacuccccuacucccuguugcugugccgccagucagcggcccccuggcccuuccugcauuggguaaaggggagggagcuauuaccucguccgccaucacaacuguggcagccgaggcucccguacugccacucucuaccgaaccucccgcggccccagcaacaagcgcuuauaccugcuuccgcugucuggagugcaaggaacaaugcagagacaaagccggcauggccgcucacuuccagcagcuugguccuccggcacccggcgccacuucaaacguguguccaacgugcccuaugaugcugcccaacagguguaguuuuuccgcgcaucagcggaugcacaagaaucgaccaccucauguuugccccgagugugggggaaacuucuugcaagcuaauuuucagacacaccuccgcgaggccugccugcacgucucuagaagggugggcuaccgguguccgagcugcuccguggucuucgggggaguuaacucaauuaaaagccauauccagaccagucacugugaaguguuucauaagugcccaaucuguccuauggcauucaagucuggccccuccgcccacgcucacuuauauagccagcauccaucguuucaaacucagcaggcaaaacugauuuacaagugcgccaugugcgauaccguguucacacacaaaccccuacucucaucucauuuugaccaacaucugcuuccucagcgcguaagugucuucaaguguccguccugccccuugcuguuugcgcagaaaagaaccaugcucgagcaccugaagaauacucaccagagcgguagguuagaagagacagcugggaagggagccggcggugcacugcuuacgccaaaaaccgaaccugaggaguuggccgugucucaaggcggggcugcccccgcaacugaagagagcuccucaaguagcgaagaggaagagguuccuucuuccccagagcccccucguccagcuaagcggccccgaagagaacucggaucaaaaggccugaaagggggaggcggugggccgggaggcuggacauguggucuaugccacaguugguucccugagagggaugaauauguggcccauaugaagaaggagcacggcaaaagcgucaagaaguuuccaugucgccugugcgaacgguccuucuguucugcgcccucgcucagaaggcaugugcgcguuaaccacgaggggauaaaacgaguguacccuugccgguacuguaccgagggaaagcguacauucagcucaagacugauccuugaaaaacauguacaggucaggcacggcuugcagcugggggcccaguccccaggacgcggcacuaccuuagcacgggguaguucugcuagagcccaagggcccggaaggaagcgacgccagagcuccgacucaugcucugaggaaccggauagcacgaccccucccgcuaaaaguccacggggcggcccuggguccggaggucacggcccccucagauauaggucuagcucauccacagagcagagucugaugauggggcuucguguggaggacggagcacagcaaugucuggauugcggcuugugcuuugccagcccagguucgcucucucgccaucgguucauuucccacaagaagagacgaggggugggaaaagccagcgcucugggccuaggcgacggggaagaggaagcgcccccuucaaggagugauccagacggaggugacucuccgcugcccgcauccggcgggccucucacuuguaaggucugcggaaaaagcugugauucaccacugaaucuuaagacccauuuucggacacacggcauggccuucauccgcgcuagacagggugccguuggggacaacuga

SEQ ID NO: 65224 - RNA, 1503 nt, Artificial Sequence
  derived and/or modified sequence opt3 from ZNF689__Homo_sapiens__NP_612456
auggcucccccuagcgccccacugccggcacagggccccgggaaggccagaccuuccaggaaacggggacgccgaccacgugcgcucaaguucguggacgucgcuguuuacuuuucucccgaggaaugggguugccuuagaccugcccaaagggcacuguaucgggaugugaugcgcgagaccuacggccacuugggggccuuaggaugugcuggcccaaaacccgcacugaucucauggcuagaaagaaacacagacgauugggagccugccgcucucgacccacaggaauauccgaggggucugacuguacagcggaagagucgcacgcgaaagaaaaauggggagaaggagguguuucccccuaaagaagccccaagaaagggaaaaaggggccggcgucccagcaagccucgccuuauuccaagacagaccuccggcgggcccauaugcccggauuguggaugcacauucccugaccaucaagcgcuggagucucacaaaugugcacagaacuugaagaagcccuacccaugcccugauugugguaggcgguucucguaucccucacuccuggucagccaucgacgcgcccacaguggcgaaugcccauacgugugugaccagugcgggaaaagauuuucccagaggaagaaucugucucaacaucagguuauccacacuggagagaaacccuaucacuguccugauugcggccggugcuuccgcagaagcaggucccucgcuaaccaucguaccacacacaccggugagaagccacaucaguguccgucaugcgggcggcgauuugccuaccccaguuuacuggcaauucaccagagaacucacacaggagaaaaaccuuacaccugucuugagugcaauaggcgcuuccggcaaagaacggcuuuggugauccaucagaggauucacacuggcgaaaagccauaucccuguccugacugcgagcgccgauuuucuagcuccucacggcuggucagccaucguagagugcacaguggcgaaaggccauacgccugugagcauugcgaggcgcgcuucucucagcgguccacccuacuccaacaccagcugcuucacacaggggaaaaacccuauccguguccugauugcgguagagccuuuaggcgaagcggaucgcuggcaauccaucgcucuacucacaccgaggaaaaguugcaugcuugugacgauugcggccggagauucgccuacccaucccuccuggcuucacacaggcguguacacaguggggagcgccccuaugccugcgacuuauguagcaagcgguuugcacaguggucccaucuggcccagcaccaacuccuucauacaggagaaaaaccuuuccccugccuggaguguggcagaugcuucaggcagcgauggucuuuggcuguucacaaguguagcccaaaagcgccuaacugcucaccccggagugcaauagguggguccagccagcgcggcaaugcccauuga

SEQ ID NO: 65225 - RNA, 1773 nt, Artificial Sequence
  derived and/or modified sequence opt3 from ZNF703__Homo_sapiens__NP_079345
augagcgacucccccgccggcucuaacccuagaaccccagagucaagugggagcggauccgguggcgggggaaagaggccggcugugcccgcagccgucucucugcucccuccagcggauccccuucggcaggcuaaucgccugccuauccgaguuuugaaaauguuaucggcccacacaggccaucugcuacacccagaauaccuccaaccccugucaagcacuccugugaguccaauugagcuugacgcaaagaaauccccgcuggccuugcucgcucagacgugcucucagauagguaagcccgauccuccacccagcuccaaacugaacucaguagcagccgcugccaaugggcugggagcggaaaaggacccuggccguagugcaccaggcgccgcuagcgccgcagcugcccucaagcaguuaggggauucucccgcggaggacaaauccucauucaagccguauagcaaaggaagugguggcggggauucuagaaaggacuccggaagcucgucuguguccucaaccaguagcuccucuagcucaaguccuggcgauaaagccgguuuuaggguccccuccgcagcuuguccaccuuuucccccacauggggcccccgugagcgcuucuucaaguagcuccucuccuggaggcucgcggggcgggagcccacaccauuccgacugcaagaacggagguggcguugggggaggcgaacuggauaagaaagaccaagagccgaagcccucaccugagccagccgcagugagucgcggugggggcggagaacccggcgcccacgggggagcugagucuggugcgagcggcagaaaauccgaaccuccaucagcacuugucggggccggacacguggcucccguaagcccguacaagccuggccauucuguuuucccauugcccccuuccaguaucgguuaucacgggagcauugugggcgccuacgcaggauaucccucucaguucgucccaggccuggauccuuccaaaucagggcuagugggaggucagcucaguggcgggcugggacuucccccaggcaagccgccuagcucgucuccccugacaggugccuccccacccagcuuuuugcaggggcucuguagggacccuuacugccugggcggauaucauggcgcuucacacuuagggggaaguuccuguucuacuugcagcgcccacgacccagcaggccccucccugaaagcggguggguacccucucguguacccgggacauccacuucaacccgcugcccugucaagcagugcagcccaggcugccuugccuggccacccacuauauaccuacgguuucaugcugcagaaugagccccucccucauucuuguaacugggucgcagcuuccggcccgugcgauaagcgguuugccacaagcgaggaacugcuuucgcaucugcgcacccacacugcguugcccggggccgagaagcuccuggcugcauauccaggagccucaggcuuagggucugcugccgcagcggccgcugccgcagcuaguugucaucugcaccuaccucccccagccgcaccuggaucccccggcagccucucucugcgaaauccacacacacuugguuugagcagauaccacccguaugggaaaucccaucugucaaccgccggaggccucgcuguuccuagucugcccacggcggguccauacuauagccccuacgcccuuuacggccagaggcuggcaucugcuuccgccuugggguaucaauga

SEQ ID NO: 65226 - RNA, 1239 nt, Artificial Sequence
  derived and/or modified sequence opt3 from ZNF704__Homo_sapiens__NP_001028895
augaccuucacauuucagagcgaggaccugaagagagauugcggcaaaaagaugucccaccaacauguguucucucucgccauggaagaggacgucaaaacugcugauacgaagaaagcaucaaggauccuugaccacgaaaaggagaacacccggaguauuugucuguuggaacagaagcgcaaaguugugagcuccaauauagauguacccccugcccgaaagucuucggaggaguuagacauggauaaagugacagcggcuaugguccugacuucacuaagcaccaguccacucgugcguuccccgcccguuagaccuaacgaaucucugagcggguccuggaaggagggagguugcgugccaucaaguacaagcagcuccggcuacuggucauggagcgcccccagugaccagucuaauccuuccaccccaucucccccucuuucggcagauucuuuuaaaccauucagguccccggcccagcccgacgaugggaucgacgaagcugaggcaucaaaccuguuguuugaugagccuauuccacggaagcgcaagaauaguaugaaagucauguucaagugucucuggaaaaacugcggaaaggugcugagcacugccgcuggcauccaaaaacauauuagaacaauccaccuggguaggguaggggacuccgacuauucugauggagaagaggacuuuuacuauaccgaaauaaagcucaauacggauagcguugccgacggcuuaucaagucuggcgcccguguccccuagccagucucuugcaucaccacccacuuucccgaucccugauaguagccggaccgagacacccugugccaaaacugaaaccaaguugaugacaccacugucccgcucugcuccuaccacgcuauaccucguccauacugaccacgccuaucaggcaacacccccagugaccauucccggcucggcuaaguuuacuccuaacgggagcuccuucucaaucaguuggcagucuccaccggugacauuuaccgguauucccgucagcccuacgcaccauccaguuggaaccggcgagcaacgacagcacgcccauacagugcuguccucacccccuagagggacuguaagccuuaggaaaccacggggagagggcaagaaaugccguaagguguacgguauggaaaaucgcgauaugugguguaccgcgugcagauggaaaaaggccugucagagguuccuggacuga

SEQ ID NO: 65227 - RNA, 231 nt, Artificial Sequence
  derived and/or modified sequence opt3 from ZNF706__Homo_sapiens__NP_001254638
auggccagaggccagcaaaagauccagagccagcagaaaaacgcuaagaaacaagcagggcagaagaaaaagcagggacacgaccagaaggccgcggcuaaagccgcacugauuuacacaugcaccguguguaggacucaaaugcccgauccuaagacguucaaacagcauuuugaguccaagcacccaaaaaccccgcuucccccugaacucgccgacguccaggcuuga

SEQ ID NO: 65228 - RNA, 2286 nt, Artificial Sequence
  derived and/or modified sequence opt3 from ZNF711__Homo_sapiens__NP_068838
auggacagcggcgggggaucccugggucuccacacccccgauucuagaauggcccauacaaugaucaugcaggacuucguggcuggcauggcagggacugcccacauugauggagaccauauagucguuucagugccugaggcgguacuugugagugaugucgugacggacgauggcaucacccuggaccacgguuuggcugccgaaguugugcaugggccagauauuaucacagagacugacgucgugaccgaaggaguaauuguuccggaggcaguguuagaagccgaugucgcuaucgaggaggaccuggaagaggaugacggcgaccacauacuaacaagcgaacucaucaccgagacugugagggugcccgagcaagucuuuguugcagaucuggugacaggcccuaacgggcaccuugaacauguagugcaggacugcgucuccggaguggauucuccaaccaugguuucggaggaagugcuggucacuaauucagacacggagaccgugauucaggccgcugguggcguacccgggagcacaguuacuaucaagaccgaagaugacgaugacgaugacgugaaaaguacauccgaggauuacuugaugauuucucucgacgacgucggagagaagcuggaacacaugggcaacaccccucugaaaaucgguagcgaugggucccaggaggacgccaaggaagauggauucggcucagaggugauaaaagucuauauuuuuaaggcggaagcagaggacgauguggagaucggcgggacggaaauuguuacugagagugaauacacaagcggacauucuguggccgguguacucgaccaaucccggaugcagcgcgagaagauggucuauauggcugugaaagauucaagccaggaagaggacgauauccgagacgagcguagaguuaguaggcgguacgaagauugucaggccucuggcaauaccuuagacuccgcacuggagagccgcucgucuacugcugcccaauaucuucagaucugcgaugggauuaacacaaauaagguguugaaacagaaggcgaaaaagagaaggcggggagaaacccgccaguggcaaacggccgucauaaucggcccagacggucagccccugaccguguacccuugucacauuugcacaaagaaauucaagucccgaggguuucuaaaaagacacaugaagaaccauccagaccaccucaugaggaaaaaguaucaguguacugauugcgacuucaccacaaauaaaaagguaucauuucauaaccaccuggagagucauaaacuuaucaauaagguggauaagacucacgaguucaccgaauacacacggcguuaccgcgaggcaagcccgcuguccucuaacaaauugauacucagagacaaggaacccaaaaugcacaaguguaaguauugcgauuacgagaccgcugaacaaggccuguuaaauaggcaucugcucgccguucacagcaaaaacuuuccucaugucuguguggagugcggaaagggcuuccggcacccaucagagcuuaaaaagcacaugcgaacucauacgggggaaaaacccuaucagugucaguacugcauuuuucgcugcgcugaccagaguaaucugaagacacacaucaaguccaaacauggaaacaauuugccuuauaagugugagcacugcccacaagccuucggugaugaaagagagcuacagaggcaucuggaccucuuucagggccacaaaacccaccaguguccccauugcgaucacaagagcacuaacucuucagaccugaaacggcauaucauuagugugcacaccaaggauuucccgcauaagugugaagucugcgacaaaggguuccaccgcccuagcgagcuuaagaaacacuccgauauccauaagggaagaaaaauucaccaauguaggcauugcgacuuuaagacaucugaccccuucauacugucgggccacaucuugagcguucacaccaaagaucagccacucaaguguaagcguugcaaacgggguuuucgacagcagaacgagcugaagaaacauaugaagacucacacagggagaaaaauuuaccaaugugaauauugcgaguacuccacgaccgacgcaucaggcuucaagaggcaugugaucaguauccacacuaaggauuacccucaucgcugcgaauuuuguaaaaagggauuccggagacccucugagaaaaaucagcacauuaugaggcaccauaaggaagccuuaauguga

SEQ ID NO: 65229 - RNA, 1488 nt, Artificial Sequence
  derived and/or modified sequence opt3 from ZNF716__Homo_sapiens__NP_001152751
auggccaagagacccggcccuccagggagcagggagaugggacugcucaccuuccgggacaucgcuauugaauuuucccuugcagaguggcagugccuggaucacgcccaacagaacuuguaccgcgacgugauguuagaaaauuaucgaaaccuggucucucuagguauagcgguuucaaaaccggaucucaucacaugucuggagcagaauaaggaaccccagaacauuaaacguaaugagaugguggcuaagcauccuguaacuugcagucacuucacgcaagaccuucagagcgagcagggcaucaaagauucccugcagaaggugauuuugagaagguacgggaaguguggacaagaagaccuccaggucaaaaagugcuguaaaucugugggcgagugcgaaguucauaaggguggguauaacuacgugaaucagugucugucggccacccagaacaaaacauuucaaacucacaagugcgucaagguguucggaaaauuuucaaauagcaaccggcauaagacccgccacacaggcaaaaagcacuucaaauguaagaaugauggcaaaaguuuuugcaugcuguccagacucaaccagcaucagaucauacacaccagggagaagucuuauaagugugaggaaugcgggaaauccuucaauugcagcucaacuuuaacacggcauaagcgcauccacaccggagagaaaccauaccgaugugaagagugcgguaaggcauuuaguuggagcgccucucugacgaaacacaagaggauucauacuggcgaaaagcccuauaccugugaggagagagggaaaguauucucccggucaacacuuacuaacuacaagcguauccacaccggagaaaaaccuuacacaugcgaggaauguggcaaggcuuuuagccgcaguucuaccuugacgaaucauaaaaggauucacacuggugagagaccauauaagugcgaagagugugggaaggcauucucccugagcucgacacucaaaaagcauaaaaucguucacaccggagagaagcuauacacuugcgaagaguguggcaaagccuuuacauucucuuccacccugaacacgcacaagcggauacauaccggcgaaaagcccuauacaugcgaggaaugugggaaggcuuucucacuuccuaguacuuuuaccuaccacaaacgaacacauacuggagagaaaccauauaagugcgaggaaugcgguaaagccuucaacuguagcuccacccugaagaaacacaagauuauccacacaggcgagaaguuguacaaaugcaaggaaugugggaaagcguuuaccuucucuagcacucucaauacgcauaagcgcauucacacaggagagaaaccguauaagugcgaggaaugugaccaaaccuuuaaguggcauucaagucuggcaaaccacaaaaauaugcauacuggcgagaagcccuacaaauacgaauga

SEQ ID NO: 65230 - RNA, 2745 nt, Artificial Sequence
  derived and/or modified sequence opt3 from ZNF717__Homo_sapiens__NP_001277137
auguuccccguguuuagcggcugcuuccaggagcugcaagaaaagaacaaaucccucgagcuugucucuuuugaagagguugccgugcacuucaccugggaagaguggcaggaccuggaugacgcucagagaacauuguacagggauguaauguuagagacuuauucaagucuggugagccuagggcauuacaucacgaagccugaaaugauuuuuaaacucgagcagggagcagaaccauggauagucgaggagaccccgaaucugcggcuuuccgccgugcaaaucauugacgaucugaucgaacgcucucacgagucgcaugaccgauucuuuuggcagauuguuaucacaaacucaaauacuagcacccaggaacguguggaguuggguaagacauucaaccucaauaguaaccacguccugaaucugauaaucaacaauggcaacuccucugggaugaaacccggacaguuuaaugauugucaaaacauguuauucccuauuaagccaggcgaaacccagagcggugagaagccccaugugugcgacaucacuagaaggucccaccggcaccaugagcaccucacacagcaucacaaaauucagacccugcuucaaacguuucaguguaaugaacaggggaagacuuucaacaccgaggcgauguuuuucauccacaaacgcguacauauaguucaaacauucggaaaguauaaugaauacgagaaagcaugcaacaacucagccgugauuguccaggugaucacucaggugggccagccuaccuguugcagaaagagugauuuuacaaagcaccaacagacccauacgggcgaaaaaccauaugagugugucgagugcgaaaagcccagcauuucuaaauccgacuugaugcugcaguguaagaugccuacugaggaaaaaccauacgcaugcaauuggugugagaagcuauucucauauaaaagcagucucaucauccaccagaggauucauacaggggaaaagccguacggaugcaacgagugcgguaagaccuuucggcgcaaaucuuuccugacucuucacgagcgaacacacaccggcgauaagcccuacaaauguauagaaugcgggaagacguuucauuguaaaucccuguugacccuccaccauagaacacacagcggagagaagccuuaucaaugcucggaauguggcaagacuuucucucagaaauccuaccugaccauccaccauaggacacacacuggugagaagccauaugccugcgaccauugugaggaggcuuuuucacacaaaagucgguuaaccguucaucagcguacacacaccggggagaagcccuacgaaugcaaugaguguggaaaaccuuucauuaacaagagcaaucugcgccuccaccagagaacucauacgggcgaaaagccauaugagugcaacgaguguggcaaaacauuucacaggaaguccuuccuuaccauccaucaauggacucacaccggggaaaaacccuacgagugcaaugaaugcggaaagacauuucgguguaaaucuuuccugaccgugcaucagcgaacucacgcuggugagaagccguaugccugcaacgaauguggcaagacauacagccacaaaucauacuugacgguacaucaccgcacccauacuggggagaagccuuaugagugcaaugaauguggaaaaaguuuucacugcaaguccuuccuaacaauacaccagagaacccaugcuggcaaaaagcccuacgaguguaacgaaugcgagaaaacauucauuaauaagcugaaccucgguauccacaagaggacucauaccggggaacggccauaugaguguaaugagugcggcaaaacguuucgccaaaagagcaaccugucuacccaccagggaacacauacuggcgaaaaaccuuacguguguaaugagugcgggaagaccuuccacagaaaaucauuucuuacaauccaccagaggacucauaccggaaagaaccguauggaugucaugaacguggaaaagcuguucguucggaaucacacguugcucuauauucgagagcugacacccgguaaaaguccaaugaacgugaugaaugucgagaaccccuuuaucagaaggcagauuuuccgcagcauaaagguguuuacccggggcagaaauccuaugaacguagccaauguugaaaaaccaugccaaaaguccguguuaacuguccaucacaggacacacaccggggagaaaccguacgaauguaacgagugcggaaagacuuucugucauaagucuaaucugucgacccaccagggcacacauagcggugaaaaacccuaugagugcgacgagugucgcaagacguuuuacgacaaaaccgugcuaacuauccaccagcgaacacauaccggggaaaagccuuucgagugcaaagaaugucggaagacauuuucccagaagucaaaacucuucguccaccaccguacucauaccggcgagaagccauuuagaugcaacgaauguaggaaaacguucagucaaaagucuggacugagcauucaccagcgcacacauaccggcgagaaacccuacgagugcaaggaaugugggaaaacuuucugccagaagucccaccuuucacggcaccagcaaacccauaucggagaaaagagcgauguggcggaagcagguuauguuuuuccucagaaucacucuuucuuuccauga

SEQ ID NO: 65231 - RNA, 1938 nt, Artificial Sequence
  derived and/or modified sequence opt3 from ZNF746__Homo_sapiens__NP_001156946
auggccgaggcuguggcagcccccaucagcccuuggaccauggcggcuacaauucaggccauggaaagaaagauagagucccaagcagccaggcugcucucucuugaaggccggacugggauggcugagaaaaagcuggcagacugcgaaaagacggccgucgaguucggaaaccaguuggaggguaaaugggcuguuuuaggcacccugcuacaggaauacgggcuccugcagcgccgacuugagaauguggaaaaccuguugcguaauagaaacuuuuggauccucaggcugccaccgggaucaaaaggcgagagucccaaggagugggguaagcuggaagauuggcaaaaagagcucuauaagcacguaaugcgggggaauuacgaaacauuagugagccuggacuaugccauuuccaaaccugagguccuuucucagaucgaacagggaaaggagccauguaacuggcgcagacccggcccuaaaauuccagaugugcccguugacccuucgccaggcucagggccgcccgugccugcgccagauuugcugaugcagaucaagcaagagggagaacuacagcuccaggagcagcaagcacugggugucgaagccugggcugccggccagcccgacauaggggaggaaccuuggggacuuagccagcuggauaguggcgcuggugacaucuccacugaugcaaccucuggggugcauagcaauuucuccacaaccauuccacccacuucauggcaaacagacuugccgccucaccaucccaguagcgccugcucugauggaacccucaagcugaacacggcggccuccacugaggcagacguaaaaaucguuauuaagaccgaggugcaggaagaggaagucguggcuacaccagugcacccuacugauuuagaggcccauggcacccuguuuggccccgggcaggcuacaagguucuuuccaucacccgcccaggaaggagcaugggagagccaagguaguucuuucccuucccaggacccaguccucggccuucgggagccggcccgccccgaacgagacaugggggagcugagcccugcuguugcgcaggaagagaccccacccggagauugguuguuuggcggugugagauggggguggaauuucagguguaaaccuccaguaggccuaaacccccggacgggaccggagggccugccuuacucgucuccagacaauggggaagcaauccucgaucccucccaggccccucgucccuuuaacgagccaugcaaguauccuggacgcacuaaagguuucggccacaagcccgggcugaaaaagcacccagcugccccgccuggaggcagacccuuuacaugugcaaccugcgguaagucauuccaacuucaggugagucugagcgcccaucagagguccuguggggcuccagacggcucuggacccggcacugggggagguggcagcgggucaggaggcggugggggcggaaguggcgggggauccgcccgggauggcagcgcauugcgaugcggugaaugugggcgcugcuuuacaagaccugcgcaccucauaaggcaucggaugcugcacaccggagagcgcccauuccccuguacggaaugcgagaaaagauucaccgagaggucuaaguuaauugaccacuaccguacacauacuggcguccggccuuuuaccugcacagugugugguaaaucauucauccgaaaggaucaccugagaaaacaucagaggaaucacgcugccggcgcaaagacuccggcccgcgggcaaccacuacccaccccuccagcucccccugacccguuuaagagucccgccagcaaaggaccacucgcauccacagaucugguuaccgacuggacuugcggccuuucuguguuggggccuacggauggaggcgacauguga

SEQ ID NO: 65232 - RNA, 1935 nt, Artificial Sequence
  derived and/or modified sequence opt3 from ZNF74__Homo_sapiens__NP_001243453
auggagauccccgccccugaaccagagaagaccgcucugagcucccaggacccggcacucucucuuaaagaaaaccuggaggauauuucaggcuggggguugcccgaagccagaaguaaggagagcguguccuucaaagacgucgcgguugauuuuacacaagaggaauggggacaguuagacucuccucagagggcucuguaccgggaugugaugcuagagaauuaucagaaccuccuggcccuugguccaccccugcacaagccugacguaauaucgcauuuggaacgcggcgaggagccauggucaaugcaacgagaagugccccgugggccuugcccagagugggaacucaaagcagucccgagccagcagcagggaaucuguaaggaggaacccgcccaagagccuauuauggagagaccacugggcggugcucaggcaugggggaggcaggccggagcucugcagcggagucaagccgcgcccugggcuccugccccagcuauggugugggauguucccguggaagaguucccgcuccgcugcccuuuauuugcccagcagagaguccccgaaggcggcccacugcuugacacuaggaagaaugugcaagcaacggaggggcggaccaaagcuccugcccgcuugugugcgggagaaaacgccuccacacccucugagccagagaaguucccccagguacgaagacagaggggugcaggcgcuggggaaggagaguuuguuugcggcgaaugugguaaagccuuccggcagagcuccucacugacucuacaccgucgcuggcauaguagagagaaggcuuacaaaugcgaugaaugugggaaggccuuuaccuggagcacaaaucuccuggagcacaggcggauccauaccggagagaagccuuucuuuugcggcgaauguggcaaagcauucucuugccacuccucacuuaacgugcaccaacgcauucauacuggggagcgaccauauaaguguagcgccugcgaaaaagcauuuaguuguucuucccuguugagcaugcaccucagaguccauacaggagagaagccguacaggugcggugagugcggcaaagcguucaaucagcggacccaccugacgcgccaccauagaauccacacuggggaaaagcccuaucaguguggaucgugcggcaaagcauuuaccugucauucuuccuuaacagugcacgagaagauacauucaggugacaagccuuucaaaugcagugauugugaaaaggccuucaacagcaggucccgucugacucuccaccagcggacccacacaggggagaaaccauuuaagugcgcugacuguggcaaaggauucucuugccaugccuaccuucuggugcaccgaagaauccauagcggcgaaaagcccuuuaaguguaaugagugcgggaaagcauucucaagucacgccuauuugauuguccacaggcgcauccauaccggagagaagccuuuugauugcucccaauguuggaaggcuuucagcugccacucuucacuaauuguucaucagcggauccacacgggugaaaaaccauacaaauguagugagugcggcagagccuuuagccagaaccauugucugauaaagcaccagaagauucacuccggggaaaaaucuuucaagugcgagaaauguggagaaauguuuaauuggucgagccaucucacugagcaccaaaggcugcauuccgagggcaagccccuugcaauccaguucaacaaacaccuguugucaacauacuaugugccggguagucuccugggggcgggcgacgcuggauuacgcgacguagauccuauugacgcccuggauguggcaaagcuacucugcgucgugccaccccgagccggccggaauuuuucucuggggagcaagccucguaacuga

SEQ ID NO: 65233 - RNA, 2172 nt, Artificial Sequence
  derived and/or modified sequence opt3 from ZNF750__Homo_sapiens__NP_078978
augagccugcucaaggagagaaaacccaagaaaccucacuacaucccaaggccgcccggcaagccuuucaaauauaagugcuuucaguguccauuuaccugcaacgaaaagucccaucuuuucaaucacaugaaauacgggcuguguaagaacucuauuacauuggugucagagcaagaccggguccccaaaugcccuaagaguaauagcuuagauccaaaacagacuaaccagcccgacgccacggcuaagccugcauccucuaagucgguugccaauggacugucagcguucgauagcaaacuacagcauaguuccgcucgcgaagacauaaaggagaaccucgaacugcaagcccgagguacccaccguugucuuggccagaaaccagcacugcauagagccucuccgugcaagagccccgcuccugaggcagccuugggggcucagccagcccucgagggagcggcaaggcccuccgccuuugugccuguaggcgaacaccggcugaaagguccagauaaugcugaggcccccgaaacacuggcacuccacaacccgacugcuaaggccgugucauuccauaccaaaagugcguuucacacaccuggguaucccuggaaggccggaagcccauucuuaccucccgaguuuccacauaagaucucuuccaccaaaggccugggcgcaauuucacccuacaugcacccuacuaucccagaguauccgccccacuucuacacagaacaugggcuugcuaccauuuauagcccuuacuugcuggccggaaguucuccagagugugacgcuccccuacucuccgucuacgguacgcaggauccucgccacuuucugccacaucccggcccgaucccuaagcaccuugccccaagccccgcaacuuaugaccauuacagauucuuucaacaguauccuucgaaucugcccauaccauacggguucuauaggccugaaucugccuucuccucauacggauugcggcuucccccagugaccggccugacacgcgaucagaguagccacuuacuggaggaagcuacucucguuuauccggcguccucuccuagccgacuuaaccccucagacccaaauagaaaacacguggaguuugagagucccaucccugaagcaaaggauuccagcaaagccggucagagggacaccgaggggucuaagaugucaccacgggcuggaagugccgcaacaggcagccccggccguccuuccccgaccgauuucaugcaaacgucucagacuugcgaagggcuguacgacuugucgaacaaggccgcuagcuccgcccuaggacgccuguacccacccgagcagucacucacagcauuuagaccugucaaaaagaguaccgaaugucugccagcgcaagcugccgagacuacagcagagucucccgugagccuuaauguaguuaacggugacccuccggcccccaccggcuccgcuucacuggugagcgaagccgcaccaucuuccccugaugacaguagcgggaugggacccuugaaucucucuaaaaaguccgagauuaaccuggcugccacgcaugaaccaaccuaucagggcucaccucaggcggagacagccaguuucagcgaauuacaggaucugccccuaaaccucucggucaaagacccaugcaauacucaagcuccgaggccugcauuucccggucggccacgagccgcugagcccgccgcagcggugccucagaagaccgggacagagggcuccgaagauggaccaucucaccccgagacuaagccuggcagccuggacggggauggagccccgccaaccggucccggcgaagaggcuccugacgccugugcaguggauucaagugaggaacagaaacagacagcugccgucgcacuuugccaauuggccgcuuacucuccccgcaacaucagaguuggggacggagaugcggccgcaccagagccugcuugcaggcaggacacccccacucuguccagcauggaaucccaggaggcccagugugaccuccggccaaagggccaaaaacgcacgucacugagagaugccgguaagagccagcagggggcuaaaaaggcaaagcuccaggacacagccaggguguucacccugcgucggcgagcgagaguaaguuga

SEQ ID NO: 65234 - RNA, 1194 nt, Artificial Sequence
  derived and/or modified sequence opt3 from ZNF763__Homo_sapiens__NP_001012771
augauguuccaggaccccguggccugcgaggaugucgcuguuaacuuuacccaagaagagugggcacugcucgacaucagccagagaaaacuuuacagggaagugaugcuggagacauuccggaauuugacuuccauuggcaaaaaguggaaagaucagaacauagaauaugaguaccagaauccucgccgaaacuuucguucuuuaaucgaggggaauguaaacgaaauuaaggaggacucacacuguggagaaacguucacccaagugccagaugacagacugaauuuucaggagaaaaaggccaguccggaggcaaagagcugcgauaacuucgucuguggugaagugggcaucgggaacuccucuuuuaauaugaauauuaggggagacaucggccauaaggcuuaugaguaccaggauuaugcccccaagccuuacaaaugccagcaaccaaagaaagcauuccgguaucaccccucguuucgcacacaggaaagaaaccauacuggugagaagccuuacgccuguaaggaaugcgggaaaaccuucauaucacacagcggaaucaggcggcgcaugguuaugcauaguggcgacggcccauacaaguguaaauuuugcgggaaggcugugcacugucuacgacucuaucugauucacgagagaacacauaccggagagaaacccuacgaaugcaagcagugugucaaauccuucucuuauagcgcaacucacaggauccaugagcggacacacaccggugaaaagccuuacgagugccagcaaugcggcaaggccuuucacuccucaaguagcuuccaggcucauaaacguacgcacacugggggaaagccauaugaauguaaacagugcggcaagucuuucuccuggugucauucauuucaaauucacgagcgcacccauacaggugagaaaccgugcgaauguagcaagugcaauaaggccuucagaaguuacaggucuuaucuucggcacaaacgaucccacacuggggagaagcccuaccaguguaaagaaugccgcaaggcguuuaccuacccuagcucgcugagaaggcaugagcggacacacucugcgaaaaagccauaugaauguaagcagugcggaaaagccuuguccuacaaguucucaaacacccccaaaaaugcucucuggcgcaagacgcuguga

SEQ ID NO: 65235 - RNA, 1224 nt, Artificial Sequence
  derived and/or modified sequence opt3 from ZNF764__Homo_sapiens__NP_001166150
auggcucccccucuggccccacucccgcccagagacccuaacggcgcagggccagaguggagggaacccggagccgugagcuucgcggaugucgcuguuuacuuuugccgggaggaaugggguugucuucgcccugcccagcgagcacuguaucgugacgugaugagagagaccuacggccacuuguccgccuuagggaucggaggcaauaagccagcucugauuucuuggguagaagaggaggcagaacuauggggucccgccgcucaagauccugagguggccaaaugccagacacagacugacccagauucaaggaacaagaaaaaggaacggcagcgcgaggggacgggagcgcucgagaaaccggaccccgucgcagccggcaguccuggccuuaagagcccacaagcucccuccgccgggccuccauauggaugggaacagcugucuaaggcaccccauagagguaggccgucgcugugugcucacccucccgugccacgggccgaucagcgccauggcugcuacguuugugggaaaucauucgcguggcgaagcaccuugguggagcacgucuauagucauacaggagaaaagccuuuucacugcacugacuguggcaaagguuucgggcacgccuccucucucagcaagcauagagcaauacacaggggagagcggccccaucguugccuggaauguggccgcgcuuuuacccagagauccgcccugacaucacaccucagggugcacaccggcgagaaaccauacgggugcgcugauuguggacggcgauucagucaaagcucugccuuauaucagcaucgcagaguacacuccggugagacucccuuuccuugcccagacugcggcagggcauucgccuacccgucagaucugcggcgccauguuagaacacacaccggggaaaagcccuacccuuguccagacugcggaagguguuuucgucagagcagugagauggcugcgcaucggcgaacgcacucuggcgaaaagcccuauccuugcccacagugugguagaagguucgggcaaaaauccgcaguggccaagcaccaguggguccaucgccccggcgcuggaggccaccgggggagaguggccggaaggcuuagcgugacuuugaccccgggucauggcgaucuggacccuccagucggguuucagcuauaccccgagaucuuccaagaaugcggauga

SEQ ID NO: 65236 - RNA, 1572 nt, Artificial Sequence
  derived and/or modified sequence opt3 from ZNF765__Homo_sapiens__XP_006723529
auggcccugccccagggccuccuuaccuucagagacguggcuaucgaguuuagccaagaagaguggaagugccuggauccugcacagaggacauuguaccgggacgucauguuagaaaacuaucgcaaucugguuucccuagauauuucuucaaaauguaugaugaaggaguucaguagcacugcccaggggaaccgagaaguguuucacgcgggaacgucccagcgucaugagucucaccauaauggugacuucugcuuucaagauauagacaaagauauccacgacauugaguuccaguggcaggaagaugagagaaacggccaugaagcucucaugaccaagaucaaaaagcugacagggucgacugagagguacgaccagaauuaugccggaaacaagccaguaaaauaccaacuuggcuuuucauuccacagccaucugccggaguugcacauuuuucacaccgaagagaagaucgauaaucagguggucaaaaguauacaugacgcaucccucgugucuacagcccagcggaucagcugucgccccgaaacccacauuuccaacgauuaugguaauaacuuccugaauagcagucuguuuacucagaagcaagagguucacaugagagaaaaaucauuccagugcaacgacucugggaaggcuuacaauuguuccucacucuuaaggaagcaucagcugauccaccuuggagagaaacaauauaagugcgacauuuguggcaaaguguuuaacagcaagcgguacgucgcacgccaucgaagaugccacacaggcgagaaaccuuacaaguguaaugaaugcgggaaaaccuucagucagacguauuacuugacuugucauaggcggcugcacaccggagagaagccauauaagugcgaagagugcgauaaagccuuccacuuuaagucuaaacuacagauccaucgucgcauacacacaggugaaaagcccuacaaauguaacgagugcggcaagacuuucucccaaaagagcuaucucaccugucauagaaggcugcacacaggggagaaaccuuacaagugcaacgaauguggaaaaaccuuuucgcggaagucucacuucacgugccaucaccgagugcauacuggcgagaaaccauauaaguguaaugaaugcuccaagacauuuucacacaaaaguagccuuaccuaccaucgcagacugcacacugaggaaaagcccuacaaauguaacgagugcgguaagacauucaaucagcaguugacccucaacauuuguaggcugcacuccggggagaaaccuuauaagugcgaagagugcgacaaggcuuacucuuuuaaaagcaauuuagaaauccaucagaagauucacacggaggagaacccauauaaauguaaugaaugcggaaagaccuucucacggacaaguucccugacuuaccaucaccgccuccauaccggccagaaaccguauaagugugaggauugcgacgaagccuuuagcuucaaaucuaaccuugagagacacaggcguaucuacacaggcgaaaagcugcacguauga

SEQ ID NO: 65237 - RNA, 1548 nt, Artificial Sequence
  derived and/or modified sequence opt3 from ZNF76__Homo_sapiens__NP_001278961
auggagagccugggccuccacaccgugacacuuuccgacgggacuacggccuacguccagcaagcuguuaagggagaaaaacuguuggagggucaggugauccaguuagaagauggcaccacagcauauauucaucagguaacugugcaaaaggaggcccugucuuucgaagacgggcagcccguccagcuagaggauggaucaauggcguacauacacagaaccccuagggagggcuaugacccaaguacacucgaagcugugcagcuggaggaugguagcaccgccuacauccaucacccgguugcagugcccuccgaaucuacuauucuugccguccaaacagagguggggcuggaggacuuggcugcagaagaugacgagggauuuucggccgaugcuguaguugcccucgaacaguaugcgucaaaagugcugcaugacagccagaucccucggaacggcaagggccagcaagucggggaucgcgcauuccgaugcggauacaaagguuguggccgucuguauaccacggcccaccaccucaaggugcaugagagagcucacacuggggacaggccauaccggugcgauuuucccaguuguggaaaggccuucgcaaccggcuacgguuuaaaaucccaugugcgcacacacacuggggaaaagccuuauaaaugcccagaggagcuguguucuaaggcuuuuaaaaccagcggagaccuucagaagcacgucagaacacauaccggcgaaaggcccuuccagugcccuuuugagggcugugggcgguccuucacgacuucaaauauucgcaagguucacgugcgaacacauaccggagaaagaccauacacuugcccggagccccacugugguaggggcuuuacaagugccaccaacuauaaaaaucauguacggauccacacgggggaaaagccuuacgugugcaccgucccaggauguggcaaacguuucacagaguauagcucuuuguacaagcaccaugugguucacacucauugcaaacccuauaccugcuccacaugugguaagacuuaccgccaaaccucaacacuggcgaugcacaaaagaagcgcccacggggagcuagaagcaaccgaggaaagugagcaggcucucuacgaacagcagcaacuggaggccgcuucugccgcagaggaauccccuccacccaagaggccgcggauagccuaucuuagcgaggugaaggaagaacgagacgauaucccugcucaggucgcgauggugacugaggaagacggcgcaccccagguagcccugauuacgcaggauggagcucaacagguuacaaucauuaccucgggcgccguggucgcagaggacucuuccguggccucauugcgccaucagcaggucgcucuccuggccacugcaaacgggacccacaucgcggugcaauuagaggagcagcagacacuggaagaggcuauaaauguugccaccgcagccaugcagcaaggagcugugacucucgagacaacgguaagugaaagcgguugcuga

SEQ ID NO: 65238 - RNA, 1452 nt, Artificial Sequence
  derived and/or modified sequence opt3 from ZNF774__Homo_sapiens__NP_001004309
auguggcugggcaccagcgggaaguccggacuccccggucacugccuugagaacccucugcaggaaugucauccagcccaauuggaggaaugggcuuuaaaaggcaucucuagaccgucagugauuagucagcccgagcagaaggaggaaccuuggguccugccacuacagaauuucgaggcaaggaaaauaccccgggaaagccacacagacugcgagcaucaaguugccaagcucaaccaggauaauuccgaaacugcggagcagugugggacgucuucggagcgcaccaacaaagaccugucacacacacuuagcuggggaggcaauugggaacagggucuggaguuggaagggcaacauggaacucucccuggcgagggccagcuggaaaguuuuucccaggagcgagaucugaacaagcucuuagacggguacgugggagagaagccaaugugcgcugaaugugguaaaucuuucaaucagagcuccuaucugauccgucaccuuagaacccacacaggcgagaggcccuauaccugcauugaaugugggaagggauuuaaacaaucaagugauuugguaacucaucggcgcacacacaccggcgagaagccuuaccagugcaaagguugugaaaagaaguucagcgacucuuccacgcugaucaaacaucagagaacucacaccggggagaggccauacgagugcccggaauguggaaagacauuuggccggaaaccccaccuaauuaugcaucaacgcacucacaccggcgagaagccuuaugccugccucgaaugccauaaaucauucagccgaaguucuaacuuuaucacacaccagagaacccauacgggggugaagccauacagguguaaugauugcggagaguccuucagccagucgucugaccugauaaaacaccagcggacucacacaggugaacgucccuuuaaguguccugagugcggcaagggguuccgcgauuccucacauuuugucgcacacaugaguacccauagcggagagagaccauucuccugucccgacugccacaaaucuuuuagccaaucaagucaccuugugacucaucagaggacacacaccggcgaacggccguucaagugugagaacugcgguaaaggguucgccgauuccagcgcucugaucaagcaucagcgaauccacacgggcgaacgcccuuauaaauguggagagugcggcaagucuuuuaaucagucaagucauuucauuacccaccaaaggauucacuugggggacagacccuaccgguguccagagugcggaaagacauuuaaccagcgcagccauuuccucacucaccagagaacccauacaggugaaaaaccuuuucacugcuccaaguguaauaaaucuuucaggcagaaggcacaucuguuaugccaccaaaacacucaccugaucuga

SEQ ID NO: 65239 - RNA, 1557 nt, Artificial Sequence
  derived and/or modified sequence opt3 from ZNF776__Homo_sapiens__NP_775903
auggccgcugcagcccugagacccccugcgcagggcaccgugacauucgaggacgucgcuguuaacuuuagccaagaagaguggucccuccuuucugaagcccagaggugccuguaccacgaugugauguuggagaauuuaacucugaucucaagucuaggguguugguauggagcaaaggacgaaacgccaagcaaacagacccucuccauucagcaagagucuccgcugcggacacauuggacugguguaugcaccaagaaagugcaccuuuggggcaugugugggccccuguugggagauauacuccaucagggcacacagcacaaccagaagcugaaugguuucggggccuacgagaaaaagcuggacgaugacgcuaaccaucaccaagaucagaagcagcacaucggagaaaaaucguaucgcucaaaugcaaagggcaccagcuuugucaaaaacugcaaguuccauaugagucacgagccuuuuauuuuccaugaagugggcaaagacuuucucuccucuuuacgacugcuucagcaagaggauauccacacuagcgggaaguccaauuucgagacaaagcacgguauuccauugcagggaggcaaaacccauuacaucuguggggaaucaacgauacccuuuaguaacaagcacagccugguucuacaucagcgucuccugccuagagagggaccauaugugugcucugacuccggcaaauucacuucaaagagcaauaguuuuaacaaucaccaaggugucaggaccgggaaacggcccuaccaguguggacagugcgaugaaucuuucugguauaaggcccaucuuacagagcaccagcgcgugcacacuggcgaaagaccuuacgaguguggcgagugcgacaaauccuuuagccauaagcacucgcugguagaucaucaaaggguucacaccggggaacggccauacgagugugacgaaugcggaaagucuuucucccacaaacgcucauuggugcaucaccagcgaguccauacaggugagagaccguaucagugcggcgaaugugggaagaguuucaaccacaaaugcaaucucauccagcaucaaagggugcacaccggagagcggcccuuugaguguacggcuugcggcaagcuguuccguagcaacucccacuuaaaagaacaucagcgcgugcacacuggugagagaccuuacgaauguaaggagugcaggaagucuuuucgguauaaaagccaucugacagaacaccagcgaguccauaccggggagcgcccauacgaguguagagaaugcggcaaguguuuccaccagaaaggaucacucauucaacaccagcagauccauaguggcgagaggccccacgaaugcggggaguguggaaagugcuuucaucagaaagguucccuuauucggcaccaacagauccacagcggcgagcgcccucaugaaugcggggaguguggaaagugcuucagacagaagggcaaucugauaaaacaccaaaggguucauacuggugaacgucaccaugaguguuga

SEQ ID NO: 65240 - RNA, 2274 nt, Artificial Sequence
  derived and/or modified sequence opt3 from ZNF778__Homo_sapiens__NP_001188336
auggccgcucccgaccuggcacacggcgggcaugugagcagagauuccgucugccuccacgaggaacagacccaagccgcgggaaugguugcugguuggcuuaucaacuguuaccaggacgccgugacauucgaugacguagcaguggauuuuacucaggaggaauggacgcuguuggacccuucucagagggauuuauaucgggacgucaugcuggagaauuacgaaaaccuagccucagugggccaucaccucuuccaaccaaguguuauuuauuggcuggagcaggaggaggaacuucgcgcugggcgacgugcagugcugcaggaauggagauugaagaccaaaggaccggcccucaggcaggaucggagcugguuucgcgcuuccaaugagacacaaacugccagaucucauaacggcggucagcugugcgacaggacccaguguggggaggcguucucggaacacucaggacugagcacacacguccggacccagaauacuggcgauaguugcguguccaaccauuacgagcgcgacuuuuucauacccugucaaaagacacucuuuaaaaucggcgaacaguucucuguauuagggcagugcggaaaggcauuuagcuccaccccuaauguugugucacaacaggccuguacgcgagauagaagucuggacuauagcucuugcggugaggucuuccuuaaccaguccuacuugcaggcuagggccggcucacacaauggggaagagacuuggaaauggaagccauguggaaaggcacugacccauagcaugggcugcgcuacacccguggagaugcacgccgugcggaacccucacgucugucgugaaugcgguaaagcguuucgcuauacugccuaccuaaccgggagaguucaagugcauccaggagagaagcccugcgaacucgaggaauguggcaaagcaaguccuguaucuuccagccugacacagcacgugaggauucaugcugccgagaagccaugcgaguguaaagaaugcggcaaggcuuucaccgggcuuucgggacugucuaagcacguccagacggacccgggucagaaacccuacgaguguaaggauugcggcaaagccugugggggauuuuauuugcucaaugaacauggcaagacucacacacgggagaaaccuuucgcaugcgugguuugugguaaguacuuccgaaacuccucaugccugaauaaccacgugcgcauccauaccgggauuaaaccauauacuuguaguuacugcggcaaggccuuuacagucagaugcggauuaaccaggcacgugcggacgcauaccggcgaaaagcccuauacauguaaagacugcgggaaggcuuucuguacuagcuccggacugaccgagcacguacgcacacacacuggugagaaaccuuacgaaugcaaggauuguggcaaaucuuuuaccguuagcucaagucucacagagcaugcgagaauccacaccggggaaaagccauaugagugcaagcaauguggaaaagcauucacuggcagguccggucuuacgaagcauaugcguacacacaccggggagaaacccuacgaaugcaaggacuguggcaaagccuacaaucggguguaucuguugaacgagcaugucaagacucacaccgaagagaagccguuuauaugcacagugugucgaaagagcuucagaaacucuucaugccuaaauaaacacauccagauucauaccggaaucaaaccuuacgaaugcaaggauuguggcaaaacuuuuacagucaguagcucccugacggagcacauuaggacccauacuggggagaagcccuaugaaugcaagguguguggaaaggcuuucacaaccucuucgcaccucaucguucauauacgcacacacacuggugagaaaccauacauuugcaaagaauguggcaaggccuuugcaagcuccucacaccugaucgagcaucggagaacccacacgggggaaaaaccuuauauuugcaacgaguguggaaaggccuucagggcuaguucucaucuucacaaacacggccgcauccauaccggucagaagcccuacaagugcaaagagugugggaaggccuauaaucgauuuuaccuguugaaagaacaccucaagacauacacugaggaacagguguucguaugcaaagacuguggcaagagcuuuaagaacuccucaugccugaaucaucacacccaaauccauacagaugagaaaccauucuga

SEQ ID NO: 65241 - RNA, 972 nt, Artificial Sequence
  derived and/or modified sequence opt3 from ZNF784__Homo_sapiens__NP_976308
auggccgcugcaagacccgaggcccagagcagguccucuccuaccccagaaucacggagucaagagccgcuggaccucgugcuuguccccgaugacugccgcccuggcacaccacccagcgaucugaucgaaauucagguugugaagguaacugacacgaccuuggugccugagccacccgaaccuggguccuuccacugugcguuaugcccagcugccuuucgacuggucucugagcuacucuuccaugagcacggacaucuggccggugcagaaggcgggggacagggcggugauccgucgcguugucacgugugcgggcauucaugucccggaccugcuagccuuagagcacacuacagucugcacacaggcgagaggccauaucggugcgccuuguguccccgcgcuuuuaaagcccucgcgccucugcugagacaucagcacaggcauggcguugaaccagggacuucccggcgacccccggacaccgcagccguggcugagcaacgcccuggagucgcccccgagagagcagaagugguaauggcugccgcggccgcuggugcagccguuggcaagccauucgcuugcagguuuugugccaaaccuuuccggcguucuagcgauaugcgcgaccacgagagagugcacacaggggaaaggcccuaccauugcggaauauguggcaaggguuuuacccaguccucaguccucagugggcacgcacggauccauacuggagagcgaccauuccgcugcacauuaugcgauagaaccuuuaacaauagcucuaacuucaggaaacaccagcggacgcauuuucacggccccggcccugggcugggagacuccgguggccagcuugggucaagcgccgcugaaggaaguggcucugguuguggggugggcgauccagcggaggagggacgcggcgaaacugcaaaggugaaggucgaggccgaccaauga

SEQ ID NO: 65242 - RNA, 1425 nt, Artificial Sequence
  derived and/or modified sequence opt3 from ZNF79__Homo_sapiens__NP_001273625
auggccgcuggccugcucaccgcagggcccagaggaagcacauucuuuuccucugugacugucgccuucgcgcaggagagguggcggugccuuguuucaacgccucgcgaccgauuuaaggaagguaucccaggcaaaagucguagccugguguuguuagggcugccgguaucccaacccggaaugaacucucagcuagagcagagagaaggcgcuuggaugcucgagggugaagaucugaggucgccuucaccaggguggaagauuauaagcggaagucccccugagcaggcccuuuccgaggcaucuuuccaagacccauguguggaaaugcccccuggcgauagcgaccacggcaccuccgaucuggagaaaucauuuaauuugcggccaguccucaguccgcagcagcgcgugcccguugaagccagaccuaggaagugcgagacacauacugagagcuucaaaaacucugaaauccugaagccacaccgggcuaagcccuacgcauguaaugagugcgggaaagccuuuuccuauuguucaagccugagucagcaucaaaagucucacaccggagaaaaaccuuacgagugcuccgaaugugguaaggcuuucagccagucgucuucccucauucagcaucagcgcauccacacaggcgagaaaccauauaagugcucagagugugggcgagccuuuagucaaaacgcgaauuuaaccaagcaccagagaacucauacaggagaaaaacccuacaggugcagcgagugugaaaaggcauucuccgacugcucugcccuggugcagcaccaacggauucauaccggcgagaaaccguaugaaugcagcgauugugguaaggcuuuucgucacucagccaaccuuacgaaucaccagcgcacucauaccggggagaaaccuuacaagugcagugaguguggaaaagcauucuccuauugcgcugccuuuauccagcaccagagaauacauacaggcgaaaagcccuacaggugugcggccugcggcaaggcauucagccaaucugcuaacuugacuaaucaccagcggacccauacaggggagaaaccauacaaguguucagaaugcggaaaagccuucagucagagcaccaaccugaucauucaccagaagacgcacacuggugagaaaccuuauaaguguaaugaaugcggcaaguuuuucuccgagucuucggcucuaauccgacaucacauuauccauacaggggagaaacccuacgaauguaacgagugcggaaaggccuuuaaucaaagcuccucacucagucagcaccagcgcauacacaccggcgucaaaccauaugaaugcucugagugugguaaggcauucagaugcagcuccgccuuugugaggcaucagcggcugcacgcuggggaguga

SEQ ID NO: 65243 - RNA, 447 nt, Artificial Sequence
  derived and/or modified sequence opt3 from ZNF7__Homo_sapiens__NP_001269725
auggagguggucaccuucggcgacguugccgugcacuuuagcagagaagaguggcagugccuggaucccgggcaaagggcucucuaccgggaaguaaugcuugagaaccauuccucuguggcaggacuggccgguuucuuggucuuuaagccugaauuaaucucacgccuggagcagggcgaggaaccaugggugcuagaccuccagggggcggagggaacagaagcuccgcgaacgaguaaaacuggcuuccugggucgucccaccauggggcaggagccuagacacccacaugcacccccugccacaccaguucccggacuuccuaagcacuguagccaaaggcugacuuugccaccgcccggccucuccucuucgccucugggccauuuucuggugcacgaucaggaccggcgcagagggaccucagccauuuggauggucuga

SEQ ID NO: 65244 - RNA, 1995 nt, Artificial Sequence
  derived and/or modified sequence opt3 from ZNF800__Homo_sapiens__XP_005250238
augccccugagagacaaguacugccagaccgaucaccaucaccauggcuguugcgagccuguguauauccucgaaccaggggacccgccccuucugcaacagccuuugcagacaagcaaauccgguauucagcaaauaaucgaguguuucaggucuggaacuaagcaguuaaaacacauucugcuaaaggaugucgacacgaucuuugaaugcaaacucugucggucacuguuccgcggccuuccaaaccugauuacccauaagaaguuuuacugucccccuaguuugcagauggaugacaaucucccagauguuaacgacaaacagagccaagccaucaaugaucugcuggaggcuauauaucccuccguggacaagcgagaauacaucauuaaacucgagccuaucgagacaaaccagaaugcaguauuccaguauauuucucguacugauaacccaaucgaagugaccgagucgucaagcacaccggaacagaccgagguccaaauacaggagacaaguacugaacaguccaagaccgugcccguuacggacacugagguggaaaccgucgagccuccacccguggaaauuguaacagaugagguugccccuacuucugacgagcaaccacaggaaagccaggcggacuuagagaccuccgauaauucagacuuugggcaccagcugaucugcugccuuuguagaaaagaguucaacaguaggcggggagugcgcagacacauuaggaagguccauaagaaaaagauggaagaauugaaaaaguacaucgagacacggaaaaaucccaaccaaagcucuaagggccgcuccaaaaaugugcuggugccgcuaucacgaagcugcccugucuguugcaagaguuuugcuaccaaggccaacguuagaaggcacuucgaugaggugcaucggggucuccgucgcgacucuaucacgcccgauauugcaacuaaaccagggcagccucuguuucuugacuccauaagccccaagaaaucguucaagacaagaaaacagaagucuuccucaaaggccgaauauaaucugaccgcuugcaaauguuugcucugcaagaggaaauacaguagccagaucaugcugaagcggcacaugcaaauuguacacaaaaucacuuuauccggaacaaacucuaagcgagagaagggcccaaauaacaccgcaaacagcucagaaauaaaagugaaggucgagcccgccgauaguguggaauccagcccuccaucuauuacgcauucaccgcagaaugagcugaaaggcaccaaccacaguaaugagaagaaaaacacacccgcugcccagaagaauaagguuaaacaggacagcgaauccccuaagucuacuucgccaagcgcggcagggggacaacagaaaacccgcaagcccaaacucuccgccgguuuugauuucaagcagcuuuacuguaaacugugcaagagacaguuuacaucaaagcaaaacuugacuaaacauaucgagcuacacaccgacggcaauaacaucuaugugaaguucuacaaauguccucugugcacauaugaaaccaggcggaagcgcgaugucauuagacauaucacugugguacacaaaaagaguucuagguaccucgggaagauuacggcuagccuggagauacgugccaucaaaaagccaauugacuucguucuuaauaaaguggcaaagcggggacccucccgagacgaggcuaaacacucagauagcaagcaugacggcacaucuaacuccccgaguaagaaauaugaagucgccgauguggguaucgaggucaaggugaccaaaaauuuuagccugcacagauguaacaagugcgggaaagcguucgccaagaagacuuacuuggaacaucacaaaaagacccacaaagcaaaugcuucuaacuccccugagggaaauaagacaaaaggcaggucaacccgcaguaaggcccucguuuga

SEQ ID NO: 65245 - RNA, 3630 nt, Artificial Sequence
  derived and/or modified sequence opt3 from ZNF804A__Homo_sapiens__NP_919226
auggagugcuacuauaucgugauuagcuccacccaccugucuaacggccauuucagaaauauaaagggggucuuuaggggaccccucaguaaaaacgguaauaagacacuugacuacgccgaaaaagagaacacuaucgcuaaggcacuggaagauuugaaagccaauuucuauugugaguuaugcgacaagcaguacuauaagcaccaagaauuugauaaccauauuaauucauacgaccacgcgcauaaacagcggcugaaggagcuaaaacagcgcgaguucgcucgaaacguugccagcaagucccguaaagaugaaagaaagcaggagaaggcacuccaaaggcugcacaaacuugccgaacugcggaaggagacggugugugcuccuggcucugggccaauguuuaaaucgaccacaguaacugugcgcgagaauugcaacgaaaucucacagagagucgugguugacagcgugaauaaccagcaggauuucaaguauaccuugauucacagugaggaaaauacaaaagacgcaaccacugucgccgaggauccggaauccgcuaacaauuacacagccaagaacaaccaagugggagaccaggcgcagggcauccauaggcacaaaauagguuuuucuuucgcauuucccaagaaggccagcguaaaacucgaguccucagcugccgcauucagugaguacagcgaugacgcuucuguugggaagggauuuucccggaaaucacgcuucgugccuagcgccugucaucugcagcaaaguucuccaaccgauguccugcucuccagcgaagagaagacuaauucguuucaucccccugaagcgaugugccgagacaaagagacggugcagacccaggaaaucaaggaggugucuuccgagaaggacgccuuacugcuuccaucauucuguaaauuccaauugcagcugaguagcgaugcagacaacugccaaaauuccgucccccuagcugaucagauuccucucgaaucuguugugaucaacgaggacauuccaguaagcggcaauucauuugaacugcuuggcaacaagaguacagugcuggauauguccaaugacuguaucagcguccaggccacuaccgaggaaaacgugaaacacaaugaggcuucuacaaccgagguugaaaacaagaaugggccggagacguuggcccccucaaacacugaagaggugaauauaacaauucacaaaaagaccaacuucugcaagagacagugugagccuuuugucccagugcucaauaaacacaggaguacuguacugcaguggcccagcgaaauguuaguuuauacaaccacgaagccuuccaucucuuacucgugcaacccacugugcuucgauuuuaaaagcaccaaggugaacaauaaccucgacaaaaauaagcccgaucuuaaggaccuguguucccagcaaaaacaggaggauauuugcaugggaccguugucagacuauaaggacgucaguacagaaggucuaacugauuacgagaucggcucuagcaaaaacaaguguucccaggugaccccucugcucgcagacgauauccugucaagcucuugcgacuccgggaaaaaugaaaacacaggacagcgguauaagaauauuaguuguaaaauacgugagacugagaaguacaacuucaccaagagccaaaucaaacaggauacacuugacgaaaaguauaauaaaauucgccugaaggagacccaugaauacugguuucacaaaucuagaaggaagaagaaacggaagaaauugugccagcaucaccacauggagaagacuaaagaauccgagacgcgauguaagauggaggccgaaaacucauacacagagaaugcuggcaaguaucuccuggaacccaucagugagaaacaguacuuagcggcagaacaacugcuagauagccaucagcuccuggacaagcgcccaaaaucggaguccauaucucuuagcgauaacgaggaaaugugcaagaccuggaauacugaguauaacaccuacgacacaauuucaaguaaaaaucacuguaagaagaacaccaucuugcugaacggucaguccaaugccacuaugauccauucugggaaacacaaccucacauauagcagaacguacugcuguuggaagaccaaaauguccucaugcagccaagaucacaggagucugguccuucagaaugacaugaagcauaugucucagaaccaggcugugaaacggggauauaauuccguuaugaacgaaagcgagcgcuucuacagaaagaggcgucaacacucgcauucauacucuagugaugagucccugaaucggcagaaccacuugccugaagaguuucuccgacccccaagcacuucuguggcccccugcaaaccuaagaagaaaagaaggcgcaagcggggcagauuccauccaggcuuugaaacacuggaguuaaaagaaaauaccgacuauccgguaaaggacaacagcucccugaauccccuagauaggcucauuucagaggacaaaaaggagaagaugaaaccucaggaagucgcaaagaucgagcgcaacagugaacagacaaaucaacugcgaaacaaacuuagcuuccacccaaauaacuugcugcccucugagacuaacggggaaaccgagcaccucgagauggaaacgaccuccggagagcugucagaugugaguaaugacccuacaacuagcguuuguguggccuccgcuccaaccaaggaagccauugauaacacauuacuggagcauaaagaacggucugagaauauaaaccuuaaugagaagcagauccccuuucaggucccgaacauugaacguaauuucagacagucgcaaccuaagagcuacuugugccacuaugagcucgcagaagcgcugccacaggguaaaaugaacgagacucccaccgaguggcuaagguacaauucaggcauccugaacacgcagccuccccucccauucaaggaagcucauguguccgggcacacauuuguaaccgccgagcaaauccuggcaccucuugccuugcccgaacaggcucuguuaauuccacucgagaaucaugacaaauucaagaacgugccgugugaaguuuaucagcacauacugcagccuaauaugcuugccaacaaagucaaguuuacuuuucccccagcagcucugcccccuccaaguacacccuugcaaccucucccgcugcagcagucucuaugcagcaccuccgugacuaccauccaccauacagugcugcagcaacacgccgcggccgcugcagccgcugccgcagcggccgcugccggaacguucaagguccuccagccacaucagcaguuccugucacaaauucccgcacuuacccgcacuucuuugccucagcugagcguuggcccaguggguccccgguuauguccugggaaucagccgacauuuguggcucccccacagaugccuaucauucccgccaguguacuccacccaucccaccuggcauucccuagccuuccccaugcccuguuuccaucucuacucucaccgcacccuaccgucaucccccugcaaccauuguucuga

SEQ ID NO: 65246 - RNA, 4050 nt, Artificial Sequence
  derived and/or modified sequence opt3 from ZNF804B__Homo_sapiens__NP_857597
auggccugcuaccuggugaucagcuccagacaccucucuaacggccauuauagggggauuaagggagucuuccgggguccccuuuguaaaaauggcucaccuaguccagacuuugcugagaagaaaagcaccgcaaaggcccuggaagauguuaaagcgaacuucuacugcgaguugugugacaagcaguaucacaagcaucaagaauuugauaaucacauaaacuccuacgaccaugcucacaaacagcgcuuaaaggagcugaaacagcgagaguucgcccguaauguggcaucuaagucguggaaagaugaaaagaagcaggagaaagcccuaaagagacuccaccaacuggcugaacuuaggcagcagucagagugcguaagcgggaacggaccggcauauaaagcuccccggguggccaucgaaaagcagcugcaacagggcauuuuuccuaucaaaaauggucgcaaggucaguuguaugaaauccgccuugcuccugaaggggaagaaccugccaagaauuaucucugacaaacagaggagcacaaugcccaaucggcaucagcuccaauccgaucgccgaugcuuauucggaaaccaggugcugcagacuucaagugaccuuagcaaugcgaaccacagaacgggcguuucuuuuaccuucuccaagaaagugcauuugaagcuggagucaagcgcaagugucuuuucugagaauacagaagagacucacgauuguaacaaauccccuauauacaagaccaagcaaacagccgacaaaugcaaguguugcagguucgcuaauaaagauacccaccuaacuaaggaaaaagaggugaacaucagcccaucgcaucucgaaucuguacugcacaacacaauuuccaucaauucaaagauucuucaggacaagcaugauaguaucgacgagacccuggaggacagcauaggcauucacgccuccuuuucuaaaagcaacauccauuugucagauguugacuucacgcccaccagucgggaaaaggagacucguaauacacucaaaaacacucuggaaaauugugugaaccacccuugccaggcaaaugcuuccuuuagcccaccgaacauuuauaaucacucugaugcccgcaucucagagugcuuagacgaguucaguagccuggaacccuccgagcagaagucuaccguccaucucaacccuaauucgagaaucgaaaacagggagaaaagccuugauaagacagaacggguguccaagaaugugcaacgacuggucaaagaggcguguacccacaacguugccucaaagccauugcccuuccuacaugugcagaguaaagacgggcacacgacucugcaguggccuacagaacuccugcuuuuuaccaagacugagccaugcauuucuuacggauguaauccccuguacuucgauuuuaaauugagccgcaacacaaaggaggaccacaaccucgaagaucugaaaaccgaguuagguaagaagccgcuggaacuaaaaacgaagagagagucccagguaucaggccucaccgaggaccaacagaaacugauacaggaagauuaucaguacccuaagcccaaaacaaugaucgcaaauccagacugggagaaguuccaaaggaaguauaaccuugacuacagcgauucugaaccuaauaaauccgaguauacuuuuagugcuaacgacuuggaaaugaagaaucccaaagugccacuguaccucaacaccagccugaaggauugcgccgggaaaaauaacucuuccgagaauaaacuuaaggaggcuucacgggcccauuggcagggaugucgcaaagcaguccugaacgacauugaugaagacuugaguuuccccagcuauaucucgagauuuaagaaacacaagcucauaccuugcuccccacaucuggaguucgaagaugagaggcaguuuaauuguaaaucuagcccgugcacagugggcggucacucagaccaugggaaggauuucaguguuauuuuaaaguccaaccacaucucuaugacuagcaaaguguccggauguggcaaucagcguuacaagcgguacucaccccaaagcugccugagucgauauucuuccagccuagacaccucgccuucaucuaugaguucccucagaagcacauguucuagccacagguuuaacggcaauucccgcgggaaccugcuuugcuuccauaaacgggaacaccauucagucgagagacacaagaggaaaugcuugaagcauaacuguuuuuaccugagugaugacaucaccaaaagcucucagaugcaguccgagccacaaaaggaacgcaauugcaagcucugggagucauucaaaaacgaaaaguauaguaaacgacgguacugucacugccgugagagacagaagcugggaaagaaucagcagcaauucagcgguuuaaaguccacuaggauuaucuauugugauucuaacucgcagauuagcugcacgggcucauccaagaaacccccuaauugucaggggacacagcacgaccgccuggacaguuacucuauagaaaagauguauuaccuuaacaaaagcaagcggaaucaagaguccuugggaucaccacauaucugcgaucucggcaaagugagacccaugaaguguaacucugguaauauuagcugccugcuaaagaacuguaguuccgggccgagcgagaccacugaaucuaauaccgccgagggcgaaaggacaccucugaccgcuaaaauccuccuggagcgaguacaggcgaagaaaugccaggagcagucauccaacguugaaaucaguagcaauucgugcaagucugagcuugaagcaccaucccaagugcccuguacuauucaguuggccccuagcggaugcaaccgccaggcucugcccuuaucagagaaaauacaauacgccagugaaucucggaaugaccaggauuccgcaaucccaagaacaacggagaaggacaagagcaaaucaagucacaccaacaacuuuacuauucucgccgauacagacugugauaaucaucugagcaagggcaucauucaccuugucaccgagucccagucucugaacaucaaaagggacgcuacaacuaaggaacagagcaaaccuuugauauccgagauccaacccuucauucagucaugcgauccagugccgaaugaauuuccuggggccuuccccucuaacaaguauaccggagucacggacaguaccgagacacaggaagaucagaucaaucucgaccugcaagaugugucgaugcacauuaaccauguugaggguaauaucaacagcuacuaugaccguacuaugcagaagccagacaaaguggaggauggccuagaaaugugucacaaguccauaucucccccucugauucagcagccaaucaccuuuucacccgacgagauugauaaauacaagauccuccaacugcaggcacagcagcauaugcaaaaacagcuuuugagcaagcaucugcgcguauuaccugcggcugggccgacagccuucuccccagcaaguacuguccagaccgugcccguucaccaacacacgucuauaacaaccauccaccauacuuuucuccagcacuucgccgugagcgcuucacuguccagucauagcucucaccuuccuauugcccaucugcacccacuaucccaggcacacuuuucacccaucagcuucucgacacucaccccuacuauuaucccggcucaucccaccuuucuggccggacacccauugcaucuggucgcggccacaccuuuccaccccucucacauaacguuacagccacucccucccaccgcuuuuauuccaacucuguucggcccgcaucuuaauccugcaacaaccaguaucauccaccugaaccccuugauucaaccaguguuccagggucaggacuuuugccaucacuccuguagcucacagaugcaacagcucaaugaaguaaaagaggcccugaacguguccacacaccuaaauuga

SEQ ID NO: 65247 - RNA, 822 nt, Artificial Sequence
  derived and/or modified sequence opt3 from ZNF80__Homo_sapiens__NP_009067
augagccccaagagagacggccuggggaccggagauggucuccacucccaggugcuucaagagcaggucucuacaggcgacaaccugcaugaaugcgauucacaggggccuaguaaagacacuuugguuagggagggaaagacguacaaauguaaggaaugcggcagcguguucaauaaaaacuccuuacugguacggcaccagcaaauccauaccggugugaagccauaugagugucaggaaugcgggaaggccuuuccggagaaagucgauuucgugcgccccaugcguauucacacaggagagaagccuuguaaaugcguugaauguggcaagguguuuaaucgaagaucucaucuacucugcuacaggcagauacacacuggcgagaaaccauaugaauguucggagugcgggaagaccuucucauaccacagcgucuuuauccagcaucgggugacacacaccggagagaagcuguucgguuguaaagaaugcggcaagacuuuuuauuacaacaguucccuuacacgccauaugaaaauucacaccggggagaagcccugcaaauguucugaaugcggaaagacguucacuuauagaagcguauuuuucaggcacuccaugacccauacagcuggcaaaccuuacgaguguaaggaaugcgguaagggguuuuacuauucauacagucugacucggcacacccgcagccauacaggagagaaaccauaugaguguuuggaacaccgaaaggacuucggcuaccauucugcauuugcccaacaguccaaaauccacucaggcgggaagaaucucuga

SEQ ID NO: 65248 - RNA, 1185 nt, Artificial Sequence
  derived and/or modified sequence opt3 from ZNF812__Homo_sapiens__XP_011526544
augccccugcagagaugcgacgugggcgagcucugugaaccugggcuuugcggaaggcaagaggccaccgucgaugguaacagcgaaaauuguggcgagguuuucuccgaaugguuuugccugaagacacacaugcgggcucagaacgggggaaauaucuucgagggcaacuguuacgguaaagacauuuugucugugcauaaggaggcaucaauagggcaggaauuaaguaaauuuaauccaugcggaaagguauucacucugacgccggaucuagccgcgcaccucggcauccugaacgcucgccagcccuauaaauguaaggagugccgaaagggcuuuaaauacuucgccagccuugacaaucauauggggauucacaucggagaaaaguuuugugaguuccaagagugccguagagcaauuacccauuccucucaccugaaacagugugugacaguccacacugguaagaaaucgaagaagaccaaaaagcauggcaaaucauuuacaaacuucagccaguugagugcccacgugaagauccauaaaggggaaaaguccuuugagugcaaagaaugcggaaggucuuuccggaauagcuccucauuuaacguucacauacagauccacaccggcauuaagccucauaaguauacugagugugguaaggcuuucacacgcaguacccaccucacgcaacaugugagaacucacaccgggaucaaaccauacgaaugcaaagaguguggacaggcauucacacaguauacuggccuggccauucauaucaggaaucacaccggcgagaagcacuaccagugcaaagaaugugggaaggcuuuuaacggaagcucuacacugacccaacauaagauaauucacacgggugagaaacccuauggcugcgucgaaugugggaagacuuucaucacauccucauaccggagcaaacaucucaagacccaccacgaggaacgcccuuuugugugcaaaauuuguggaaaggccuucuuauacaguucuccacugaauguacaucuucagacucacacacgagagaaggcguugaucugcaaagaguguggcaaggcauuugccguuuccagccaucugucgagacacgaaaggauccauaccggugaggaacccuaugaguacaaagggaugaacgugacgauuuga

SEQ ID NO: 65249 - RNA, 1854 nt, Artificial Sequence
  derived and/or modified sequence opt3 from ZNF813__Homo_sapiens__NP_001004301
auggcccugccccagggccuccuuaccuucagagacguggcuaucgaguuuagccaagaagaguggaagugccuggauccugcacagaggacauuguaccgggacgucauguuagaaaacuaucgcaaucugguuucccuagauauuucuucaaaauguaugaugaaggaguucaguagcacugcccaggggaaccgagaagugauacacacgggaacccuccagcgucaugagucccaccauacaggugacuuuagauuccaagagaucgauaaagacauucacaaucuggaauuucaguggcaggaggaugaaaggaacucucaugaggcgccaaugacugagaucaagaaacuuaccggcucggcugaccgguacgaucagcgccacgccgggaauaagccgauuaaggaccaacugggaagcucauuccacagucauuugcccgaacuccacauguuucagacacagggcaaaaucgguaaccagguagagaaguccauaaaugaugcaucuagcaucuccaccucacaaagaauuaguugcaggccuaaaacucauaucagcaacaauuaugggaacaauuuccggaacucuucccugcugacacagaagcaggaagugcacaugcgcgagaaaucauuucaauguaaugaaagcggaaaggccuucaacuacaguucucucuuacgaaagcaccagauuauccaucugggcgagaaacaguauaagugcgacgucuguggcaaaguguuuaauagaaagaggaaccuuguuugccaccggcguugucauaccggggagaaaccauaccgcugcaacgaauguggaaagacguucucccagacuuauagcuugaccugccacagaaggcugcauacaggugagaaacccuacaagugugaagagugcgauaaggcuuuuucguucaaaucuaaucuaaagcggcaccgacgcauacacgcaggcgaaaaaccuuacaagugcaacgagugugggaaaacuuucucccaaaccucaagucucacaugccauagaaggcugcacaccggagagaagccauuuaaguguaaugaaugcggcaaaacguucagccggaaguccucucuuacuugucaucaccgccugcacacaggugagaaacccuauaagugcaacgaaugugggaaaaccuuuagccaggaguugacucucaagugccauagaaggcugcacacaggagaaaagccuuacaaauguaaugagugcggcaagguguucaacaaaaaggccaauuuagcucgucaucaccggcugcauucaggcgagaaaccauauaaguguaccgaaugcgucaagacguuuagucgaaacuccgcccucgugauucacaaagcgauccacauuggggagaagagauacaaaugcaaugaauguggaaagaccuucagcaggaucucugcacuuguaauccauacagccauucacacuggugagaaaccguauaagugcaacgaguguggcaaaggguuuaaucgcaagacccaucuggcuugccaccaucgguugcacacaggagaaaagcccuacaaauguaacgagugcggcaagguuuucaauagaaaaacucaccuagcccaucaccauaggcugcacaccggugacaagccuuauaaauguaacgaaugcgggaagguguuuaaucagaaggcacaccucgcucgccaucaccgacugcauacaggcgagaaaccauacaaguguaacgaaugcggaaaagucuucaaccagaaggccaaucuugcgcggcaccaucgucugcacaccggcgagaaacccuacaaguuuaacgagugugggaaggccuucaauuga

SEQ ID NO: 65250 - RNA, 1956 nt, Artificial Sequence
  derived and/or modified sequence opt3 from ZNF816__Homo_sapiens__NP_001189386
augcugagagaggaagccaccaagaaaagcaaggagaaagaacccggcauggcucucccucaggggaggcuuacauuccgggacguggcaaucgaguuuucccuggaagaguggaagugcuugaacccagcccaacgcgcguuauaccgagcugucaugcuggagaauuaucguaaccuagaguucguugauucuucacucaaaaguaugauggaauuuagcuccacuagacacucuauuacgggagaagugauacauaccgguacacugcagaggcacaagucgcaucacaucggcgacuucuguuuuccggagaugaagaaagauauucaucacuucgaguuucaguggcaggaaguagagcggaaugggcacgaagcccccaugacuaagaucaaaaagcugaccggaucaacagaccgcagcgaucauagacacgcaggcaacaaaccuauuaaggaccaacuugguuugaguuuccauucccaccucccagagcugcacauguuucagaccaaggggaaaaucucuaaucagcuggauaagagcauaggagccuccucagcuagugaaagccagaggaucucuugccggcucaaaacucauauuuccaacaaguacggcaaaaauuucuuacacucauccuuuacacaaauccaggagauuuguaugcgcgagaagcccugccagaguaacgaauguggcaaagcauucaauuauucuucccugcuucgaagacaucacaucacccauagcagggagcgggaauacaagugcgacgugugugggaagauauuuaaccagaaacaauauauugucuaccaccaccguugccauacgggagagaagacuuauaaauguaaugaaugcgguaagaccuucacacagaugucgucuuuggugugucaccgcagacugcauacuggcgagaaaccuuacaagugcaacgagugcgggaagaccuucuccgaaaaaucaagucuaaggugucaccggcgacuccacacaggagagaagccauacaaaugcaaugaauguggcaagaccuuuggucgcaacagcgcccugguuauccauaaagcuauucacacgggggagaagcccuauaagugcaaugaauguggaaaaacuuucucccagaagucuagccuucaaugccaucacauccugcauacaggcgagaaaccuuacaagugugaggaaugcgauaacguguauaucagaaggucacacuuggagcggcaccgcaaaauucauaccggcgaagggaguuacaaguguaaggucugcgacaaaguguuuagauccgauagcuaucucgccgagcaccagaggguacauacuggagagaagccauacaaauguaacaagugcggucguucuuucucacggaaaaguagccugcaguaucaccauacauuacacaccggcgaaaagccguacacgugcaaugagugugggaaaguuuuuagccgaagagaaaaccuggcgaggcaccaucgccuccacgcaggagagaagcccuacaagugcgaagagugugacaaaguguucucucggagaucgcaucuugagaggcaccgccgaauacacaccggcgaaaagccuuauaaaugcaaggucugugauaaagccuuucggagcgacuccugccuggcuaaucauacacgugugcacacuggugagaagccauacaaguguaacaaaugcgccaagguguucaaucagaaagggaucuuggcacaacaucagagaguccacaccggcgaaaagcccuauaaauguaacgagugcggaaagguuuuuaaucagaaggcuucacuagccaaacaucagagggugcacacagcggaaaagccuuacaaauguaacgagugcggcaaggccuucacugggcaaaguacccugauucaccaucaggcaauccacggaugccgcgagacacuccagauguga

SEQ ID NO: 65251 - RNA, 1986 nt, Artificial Sequence
  derived and/or modified sequence opt3 from ZNF81__Homo_sapiens__XP_011542204
augcccgccaacgaggacgcuccucagccaggcgaacacgggagcgcaugcgagguguccgucucuuucgaagauguuaccguggacuuuucaagagaggaauggcaacagcuggauaguacacagaggcggcucuaccaggacguaaugcuugagaauuauagccaucuguuguccgugggauucgaggucccgaagcccgaagugaucuuuaaauuagagcaaggugaaggcccuuggacucuggagggggaggccccacaccagucuuguucggauggaaaguucggcauuaaacccucacagcgccgaauaagcgguaagaguacguuucauuccgaaauggagggggaagacacccgugaugacucucuauacagcauccucgaggaacuguggcaggaugcggagcaaauuaaaagaugccaggagaagcacaacaaacuucuguccaggacaacuuucuugaauaaaaagauccucaacaccgaaugggacuaugaguacaaagauuuuggaaaguucguucauccuucaccaaaucugauucugagucagaaacggccccacaagcgcgacagcuuuggcaagucuuucaaacacaaccucgauuuacauauccacaauaaguccaacgcugccaaaaaucuggacaagacaauaggccauggacagguguuuacccaaaacucaagcuauagucaccacgaaaauacucauacaggggucaaauucugugagagaaaccagugcgguaaggugcuuucuuugaaacacucccugagccagaauguaaaguuuccuaucggcgaaaaggcaaacaccuguacggaguucgggaaaauuuucacucaaaggucgcacuuuuucgccccacagaagauccauaccguugagaaaccgcaugaacuaucuaagugcgugaaugucuuuacacagaaaccccuccuguccauuuaccuucgggugcaccgcgacgagaagcuguauaucuguacuaagugcggaaaggcuuucauacagaacucagaauugauuaugcacgagaagacccauacacgagaaaaaccuuacaaguguaacgagugcggcaaaucauuuuuccaagugagcucccuccugagacaccagaccacgcauacuggugagaaguuauuugaauguucugagugcgggaagggauucagccugaauagugcacucaacauccaccagaaaauucacacaggcgaaaggcaucacaagugcagugaguguggcaaagccuuuacccagaaguccacucuucggaugcaucaacguauccacacaggggagcgcagcuacaucugcacccaguguggacaggcuuucauucagaaagcccaucugauagcgcaccaaagaauccacacgggugaaaagccauaugagugcucugauuguggcaagucauuucccaguaaaagccaguugcagaugcauaagaggauucacaccggggaaaaaccuuacaucugcacagaguguggaaaggcauucacuaaucgguccaaccuaaauacccaucagaaaucucacacaggcgaaaagucguauauaugcgccgagugugguaaggcuuuuacugaccgaagcaacuucaauaaacaucaaaccauucacacaggggagaagccauacgucugcgccgauuguggccgcgcauucauccagaaauccgaacugaucacccaccagaggauucauacuacggagaagcccuauaaaugcccggacugcgaaaagucauuuaguaaaaagccucaccucaagguucaucaaagaauccacacaggagagaaacccuacauuugugcugaaugcggcaaggccuucaccgaucggucuaacuuuaauaaacaccagacuauacauaccggggacaagccauauaaauguagcgauugcggaaaggguuucacacagaaguccgugcugucaaugcaccgcaacauccauaccuga

SEQ ID NO: 65252 - RNA, 1833 nt, Artificial Sequence
  derived and/or modified sequence opt3 from ZNF823__Homo_sapiens__NP_001073962
auggacagcguggccuucgaggaugucgcuguuaacuuuacccaggaagagugggcacugcucggccccucccaaaagucucuuuacagaaaugugaugcaggaaacaaucaggaaccuggacugcauugagaugaaaugggaagaucagaauauaggggaccagugucaaaacgccaagcggaauuugcgcucacacacuugcgagaucaaagaugacagucaguguggagagacguucggucagauuccugauagcaucguaaacaagaauaccccacgagugaacccgugcgacuccggcgaauguggggaggucguguuaggacauucuucgcugaauugcaacauucguguugauacaggccacaaaucaugugaacaucaggaguauggugagaagcccuacacucacaagcaaagagggaaagcgaucagccaucagcacaguuuucagacccacgaaaggccuccaacaggaaagaaacccuucgacugcaaggagugugcuaaaaccuuuuccucucuaggcaaucuccggcgccauauggccgcacaccauggcgaugggccuuauaagugcaagcuguguggaaaagccuucguguggccaagccuuuuucaucugcacgaaagaacucacacaggugagaagcccuacgaaugcaaacagugcuccaaggcuuucccuuuuuauucaaguuacuugaggcacgagcggauacauaccggcgagaaagcauaugaauguaagcaaugcagcaaagccuucccagacuacucuacguaccuccgccacgagcgaacucauaccggggaaaagccguauaaguguacacagugcggaaaggcuuuuuccuguuacuauuacacuagacugcacgagaggacccacacaggcgaacagcccuaugccugcaaacaaugugguaaaaccuucuaccaucacacgucauuucggcgucauaugauccgccacacuggggauggaccucacaagugcaaaauuuguggcaagggcuucgacugcccaagcagugucagaaaccaugagacaacccacacuggggagaagcccuaugaauguaaacagugcggaaaggugcugucucauuccagcucguucaggucucacaugaucacacauaccggugacggcccucagaaaugcaagauuugugggaaagcguuuggaugcccaucccucuuccagcggcacgagcgaacgcacaccggcgaaaagcccuaccaauguaagcagugcgguaaagcauuuucauuagccgggagucugcgcagacaugaggcuacacacacuggcguaaagccguacaaaugucagugcggaaaggccuucagcgaucuuuccucuuuucagaaucaugaaaccacacacacuggcgagaaaccuuaugaguguaaggaaugcgggaaggcauucagcuguuuuaaauacuugucacaacauaagaggacccacacaguugagaaacccuaugaaugcaagaccugucggaaggcuuucagucacuuuuccaaccugaaagugcaugagcgcauccacagcggagagaaaccauacgaaugcaaggagugcgguaaggccuucucuuggcuaacuugucuccugagacaugaaaggauacacacgggcgagaaaccuuaugaaugccuucagugugggaaggcguuuacacguucacgguuccugcgaggacacgagaaaacccauacuggcgagaaguuguacgaaugcaaagagugugguaaggcccucaguagccugagauccuuacacaggcauaagcgcacccacuggaaagacacacuguga

SEQ ID NO: 65253 - RNA, 3234 nt, Artificial Sequence
  derived and/or modified sequence opt3 from ZNF827__Homo_sapiens__NP_849157
augcccagaaggaagcaggagcaaccuaaacggcugccaagccacgugucccgccaggaagaggccgaaggcgagcucucugaaggggagcauugguacggaaacucaagugagaccccgagcgaggcuuccuauggugaaguccaggaaaauuacaaacuuucucuggaggaccgaauccaggagcaaucgacaucacccgauacuagcuugggcaguacgaccccuuccucucacacauuagaacugguugcacuagacagcgaggugcuccgugauucccugcagugccaggaccaucuuucaccagggguaaguagccugugugaugacgaucccggaucuaacaaaccuuuguccucaaaucucagaaggcugcuggaagccggcagccucaaguuagacgcggcugccacugcaaacggucggguggagaguccagucaauguggggucuaaccuguccuucucgcccccuagccaccaugcccagcaacuuucuguuuuggcucgcaaacuggcagaaaagcaggagcagaaugaucaguauaccccauccaacagauuuauuuggaaucaaggaaaguggcuaccgaacucaacaaccacuugcagucucagccccgacuccgccauacugaaacuuaaggcugccgcgaaugcagugcugcaggauaaaucuuugacaaggaccgaggaaacgaugcgguucgagagcuuuucaaguccuuucuccagccagucugccucaaguacucucgcugcccugagcaagaaagucuccgaacgcucuuuaaccccaggccaagagcaucccccuccagcaucgagcuuucugucccucgcuucaaugacaaguucugccgcgcuucugaaggaaguggccgcacgagcugccggcagcuugcuagcugagaaguccucacugcuccccgaggacccgcugccucccccaccuagcgaaaagaagcccgagaaaguaacuccacccccuccaccgcccccuccacccccuccacccccgccuccacagucucuugaacuguugcuccugcccguuccuaaggggagaguguccaaacccaguaacagcgccucugaggaagaguccggaaagccauuccaguguccuaucugcgguuuagucauuaaaaggaagucauacuggaagcggcacauggugauccacaccggccugaaaagucaccaguguccccuaugcccauuucguugugcacgcaaggauaaucucaaaagccauaugaaggugcaccaacaccaggacagaggggagacauuccagugccagcuguguccguuuaccucguccaggcauuucucucuuaaauugcacaugcggugccaucaacacuuucugcgaacggaagccaaggucaaggaggaaauuccugaccccgauguuaaaggaagcccacaucucucagacagugcuugucugggccagcagcgcgagggugggggaacugagcuugugggcacaaugaugaccuccaacacucccgaaagaacaucucagggcggggcgggaguaagcccucuguuggugaaggaggaaccaaaagaggauaauggucuccccaccuccuucacgcugaacgcagccgacaggccugcuaaccacaccaaguuaaaagauccgucagaauaugucgccaauagcgcaagugcccuguuuucucaagacaucuccgugaagauggcuagcgauuuccuaaugaagcucucggccgcaaaccagaaagagccaaugaaucugaacuucaagguuaaagaggaacccaaggagggcgaaucacuuucuacaacuuugccucggaguuccuacguguuuagcccagagucugaagucagcgcgcccgggguguccgaggacgcucugaaaccucaggagggaaagggcucaguacuccgcagagauguuagugugaaggccgcaagcgaacuguuaaugaaacugucugccgaguccuauaaggaaacccagauggucaaaauaaaggaggaaccgauggagguggacauccaagauucacacgucaguauuagccccuccaggaauguggguuacucuacacuuaucgggcgugagaaaacugaaccauugcagaagaugccugagggccggguucccccagaacgaaaccucuucucgcaggacauuagcgugaaaauggcuucagagcugcuauuucaacuguccgagaagguaaguaaggaacauaaucacaccaaagagaacacaaucagaaccacuacgucuccuuucuuuagcgaagacacauucaggcagucccccuuuaccucaaauucuaaggagcuccugccaagcgauaguguccuucauggacgcauauccgccccggaaacugagaaaauuguguuggaggcaggcaacgggcugccuagcuggaaguucaaugaccaguuauuucccugcgauguuugcggaaaaguguucggucggcagcaaacccucucuagacaccugucacuucacacagaagagaggaaguacaagugucaucugugcccauaugcugccaaaugucgcgcgaacuugaaucagcaccucaccguccauuccgugaagcugguaaguacugacacagaagauaucgugagcgccguuacgucggagggcucugacgggaaaaagcaccccuacuauuacuccugccaugucuguggauuugaaaccgagcuaaacgugcaguucgugagccacaugucacugcacgucgauaaagagcaguggauguuuaguauuugcuguacugcuugcgacuucguuacaauggaagaggcagaaaucaagacccauaucggcacaaagcacacuggugaggaucgaaaaaccccuucugaauccaauagcccaucaaguagcucccucucugcccugagcgacuccgcuaacucaaaggaugacucugaugggagucagaaaaacaagggcggaaauaaccuuuuggugauuucggugaugcccggcagccaaccuuccuuaaauucugaggagaaaccggaaaagggguucgaguguguauuuugcaacuucgucuguaagacgaaaaauauguuugaacggcaucugcagauacaccucaucacccguauguucgagugcgacgugugccauaaguuuaugaaaacaccagagcagcugcuugaacacaagaaaugucacacuguucccaccggaggucugaaguga

SEQ ID NO: 65254 - RNA, 1542 nt, Artificial Sequence
  derived and/or modified sequence opt3 from ZNF829__Homo_sapiens__NP_001165450
augaccggcaaggggcugggagaggacacagaagauagauggggugccggcgcucucgggcccugcggaaggagcggccuuaaaggugggggaugugugugggaggcagaagccggcggcucccgggggcaggagaucgaaacuauucuggcgaacauggagacgucuuugcgcucaggacaaauaccuaccuuagacaguagcgagcacaaucuguccccagaaccgcuagagcucgaucgaaugccccauucuccucugaucucgauuccacacgucuggugccaucccgaagaggaggaacguaugcacgacgagcuucugcaggcuguuucaaaggguccugugauguucagagauguaagcaucgacuuuagucaggaagagugggaauguuuggaugccgaccagaugaaccucuacaaagaggugaugcuggagaauuucuccaaccuggucucugugggccucagcaauuccaagccagcaguuauuucauuacuggaacaagggaaagagcccuggaugguggauagggaacuuacacggggauugugcagugaccuggagagcaugugugaaacuaagauccuaucucucaagaaacgccauuuuucccaggucauaaucaccagagaggauaugucaacauucauucagccuaccuuucugaucccaccgcagaagacuaugagcgaggaaaaacccugggagugcaagauuuguggcaaaacauucaaccaaaauagucaguuuauccagcaccagaggauacacuucggugaaaagcauuaugagucuaaggaauacgggaaauccuuuagccggggaucgcuugugacccgccaccaacgaauccauacgggcaagaaaccuuaugagugcaaggaguguggcaaagccuucucuugcuccucauacuuuagucagcaccagagaauccacacuggggaaaagccauaugaguguaaagaaugcggaaaggcuuucaaguacugcagcaaccugaaugaccaucaaaggauucacaccggugagaaacccuaugaguguaagguaugcggcaaagcauuuacaaaguccucucaguuguuccuccaucugcggauucacacuggggaaaaaccuuacgaguguaaggaaugcggaaaggccuucacccagcauagccguuuaauccagcaccaacgcaugcacacaggcgagaaaccauacgaauguaagcagugcgguaaggcuuuuaacucagccaguacccugacgaaucaucacaggauucaugcgggggagaaacucuaugagugugaagagugcagaaaagcauucauacaguccagcgaacuuauccagcaccaacggauucacacugaugagaagcccuacgaauguaacgagugcggcaaggccuuuaauaaaggaucuaaccugacacgacaucagcgcauccacaccggcgagaagccguaugacuguaaagaaugcgggaaggcuuucggaucaagaagugacuugauaaggcaugaggguauucacacuggcuga

SEQ ID NO: 65255 - RNA, 5034 nt, Artificial Sequence
  derived and/or modified sequence opt3 from ZNF831__Homo_sapiens__NP_848552
auggaggugcccgaaccuaccugcccagccccgcccgcuagagaccagccugcaccaacacccggcccuccaggggcccccggaggucaagcgagcccucaccugacucucggcccaguccuucugccgcccgagcagggguuggcuccuccaacgguuuucuuaaaggcccugcccaucccucuauaccauaccgugccacccggaggccuccagccgagggcaccucugguaacagguucccuugaugggggaaacgugcccuuuauucugucuccagucuugcagccugaaggccccggcccaacucaaguggggaaacccgccgcuccuacccucacaguuaauauagugggaacccugccaguccugucaccgggucucggccccacuuuagggaguccuggaaaggugcggaacgcaggcaaauaucuguguccacacugcggucgcgacugucuuaagcccagcguauuggagaaacauauccgaucccacacaggggaacguccuuucccaugcgccaccuguggaauugcuuuuaagacgcagucuaaucuguacaagcauagaaggacucagacccaccuaaacaauucgcggcucucaagcgagagugagggcgccggcgggggacugcuugaagagggugauaaagcgggcgaacccccgcgcccugaggggagaggagaguccaggugccagggcaugcacgaaggugcaucugagcggccacugagccccggggcccauguuccuuugcucgcuaagaaccuggacgugcgcacagaagccgcacccuguccaggcuccgcuuucgccgaucgagaggcgccuugggacucagcccccauggcaaguccaggauuaccggcugccagcacucaaccuuggagaaaacugcccgaacagaagucuccaaccgcuggcaaacccugcgcccuccagaggcagcaagcaacagccgcugagaagccuugggaugcgaaggcaccagaggggcggcuucguaaaugugaauccaccgacucaggauaucugagccgcagugauucugccgagcagccccacgcuccuugcuccccguugcauagccuaucggaacacucugccgaguccgaaggugagggcgggccaggacccggcccuggugucgcaggggccgagccaggcgcuagagaagccggacuggagcucgaaaagaaaaggcuggaggaacggaucgcacagcuuauuucacacaaucaagcggugguggacgaugcucagcuggacaacguccgaccccgcaagacgggcuugaguaaacaggggagcaucgaucucccuacuccguacacauauaaggacuccuuucauuucgacauaagagcccuggagcccggaaggcggcgcgcaccagguccuguuagaucuaccuggacucccccagauaaaagcaggccuuuauuuuuccacucagugcccacacagcugaguaccacgguagagugugugccagucacccguuccaauagccuaccguuuguggaaggcucucggacauggcucgagccucgagaacccagagacccauggucaaggacucaaaagccccugaguccucgcccagggcccgcccggcuuggaugcagaagcggcuuguccucuaccgauguuccuucgggucauccgagggcucuggugcgccaggccgcagucgaggaccucccagggacacccaucggcgaugcucuggugccugccgaggacacugaugcgaagcgaaccgccgcucgggaagcaauggccggaaaaggccgugcugggggaagaaagugcggccagaggcgccuuaaaauguucagccaggagaaguggcaaguauacggugacgaaacauuuaaacggauuuaucagaagaugaaggccuccccccacgggggaaaaaaggcaagagagguuggcauggguucaggcgcggaacugggguucccauugcagaaagaggccgcuggaaguucuggcaccgugccuacucaggauaggcgaacgcccguccaugaggacaucagcgccggggcaacaccagaaccuuggggaaacccgcccgcucucgaggccucccuggugaccgaaccaacuaagcacggcgagaccgucgcacgccggggugauucagacagaccuaggguggaagaggccguuagcucucccgcuuuagggggacgugacuccccauguaguggcagccgcucuccucuggugucccccaauggucggcuagagcucggcuggcaaaugccgccagcgccugggccccugaaaggaggcgauguagaagccccaagacccgucuggccugacccgaagcuugaggggggagcaaggggcgugggugauguucaggaaacaugcuugugggcucagaccgugcugcgauggcccucacgggggaguggagaggacaagcucccaagcgaacgcaaaaagcugaaagucgaggauuuacacucguggaagcagccugagcccguguccgccgaaacuccuggcgguccaacacaacccgccucucugagcucacagaaacaggacgcugauccuggcgagguaccagggggaaguaaggaauccgcaagacaagugggcgagccccuugagucuagcggggccuccuuggcggcugccucaguugcacucaagagggucggaccgcgggacaaagccacgccucugcauccagcugcacccgccccugcggaacacccaagccuagcuacccccccgcaggccccucgagugcugagugcacucgccgauaacgcuuuuucucccaaguaccugcuuagauugccacaggccgagacuccucugcccuuaccaauucccuggggcccucgccauucccaggacagccucuguucgucagguuggccagaagagagggcaucuuucguggggaguggacugggcacaccgcuuucccccagcccugcuucuggcccaagccccggggaagccgauuccauccuggaggacccuucaugcagucguccacaagauggacggaaaggugcgcaguugggcggggacaagggagacagaauggccaccagcaggcccgcagcucgcgagcucccuauaucugccccgggcgcuccacgagaagcaacauccucacccccuacucccaccugugaggcccaccugguccaggauauggaaggugacagucacagaauucaucggcuaugcauggggagcacgcuggccagggcucgccucuccggagauguucugaauccaugggugccuaacugggagcuuggcgaacccccaggcaaugcgccggaggacccuucuucggggcccuuggugggaccagaucccuguagcccucugcagccagguucauucuuaaccgcacucacacguccccaaggcguaccuccgggguggccagagcuggcccuuuccagucacucuggaacuagcagaucccauucaacccggucuccccacagcacacagaacccuuuuccaagucugaaagcugaacccaggcuaacuuggugcugucucucccgcagcgucccucugcccgccgagcagaaggcaaaagccgcuucuguguacuuggcgguucauuucccaggcucaucccugcgagacgaagguccgaacgggccucccggaaguaauggcggcuggaccuggacgagcccaggggagggagguccugcccagaugucgaaguuuucuuaucccacagugccaggcgucaugccucaacaccagguguccgaacccgaguggaagaaaggguuaccguggagagcaaagaugagccggggaaacucaaaacagaggaagcucaaaaucaauccaaagcgcuacaagggcaacuuccugcaaaguugcguucagcuuagagcuucuaggcugcggaccccuacuugggugcgucgccgauccagacaccccccagccuuggagggucucaaacccuguaggacaccugggcagaccagcucagaaauugcaggacugaaucuacaggaggaaccgaguugcgccacuagcgaguccccacccugcuguggcaaggaggaaaaaaaggagggcgauugccggcaaacccuggggacacuuucucucggaacgagcucccgcaucguaagagaaauggacaaaaggaccgucaaggauaucucaccuucugcuggugagcauggcgacuguacuacacacaguaccgccgcgacaucggggcugagcuugcaguccgauacuugccuggcaguggugaacgacguccccuuaccaccuggaaagggccucgaucugggucuucuggaaacccaguugcucgccucucaggacucaguuagcacggaccccaaaccauauauuuuuuccgaugcucaacggccuaguucuuucgggagcaagggaacauuuccgcaucacgacauagccaccucaguggcugcaguauguaucucccugcccgugcgaacugaucauauugcccaggagauccacagugcugagagcagagaccacucucagaccgccggccgcacacuaacuuccucaagcccagauucgaaagucaccgaagagggcagggcacagacacugcuuccugggcggcccucuaguggacaacguauauccgacagcgugccacucgaaucaacggagaagacccaucuggaaauuccugcguccggucccucuagcgccaguucccaccauaaagagggcagacacaagacuuucuuuccgagcagggggcaguacggaugcggcgagaugacaguuccauguccuucuuuggguucagaugggcgcaagcggcaggugaguggcuuaaucacccgaaaagacuccgucgugcccagcaagccagaacagcccaucgagauuccugaagcucccucuaaaucgcugaagaaaagaucacucgagggaaugaggaagcaaacucgcguugaauucagcgauacauccagugacgaugaggaccggcuggugaucgagauuuga

SEQ ID NO: 65256 - RNA, 3480 nt, Artificial Sequence
  derived and/or modified sequence opt3 from ZNF91__Homo_sapiens__NP_001287880
augcccggcaccccugggagccuggagaugggacuccuuacauucagagacguggccaucgaauuuuccccagaggaauggcagugccuggauacugcucaacagaacuuguacaggaaugucauguuagagaacuaucggaaucuggcauuccuagguauuuguccgcacuuuccccaggacuucuggccugaacagucuauggaggauucauuucaaaagguucuccugcgcaaauacgagaagugcggccaugaaaaccuucagcugcgaaaaggguguaagaguguggacgagugcaaaguacacaaggaaggauauaauaaguugaaccagugucucacgaccgcccagagcaaaguguuccaaugcggcaaguaccugaaagucuuuuauaaguuccucaauuccaaccgucauacaauaagacacacugguaaaaaguguuuuaagugcaaaaagugugugaaaucuuucugcaucaggcugcauaagacccagcacaaauguguuuacauuacagagaagucgugcaaaugcaaggagugugaaaagaccuuucacuggucaagcacuuuaacaaaucauaaagagauccacaccgaagauaagccauauaaaugcgaggaaugugggaaggcguucaaacagcugaguacgcuuacuacccauaagauuaucugcgcuaaggagaaaauauacaagugugaggaaugcggaaaagccuuuuugugguccucuacacugacucggcacaagcgcauccacaccggcgagaaacccuacaagugugaagagugcggcaaggcauucagccauuccucaacacuagccaaacacaagaggauucauaccggggaaaaaccuuauaagugugaggagugcggaaaagcauucaguagaagcucuacgcucgcaaagcacaagcggauccauacuggugaaaaaccauacaaguguaaagagugcggcaaggccuuuuccaacucaagcacacuggcuaaucacaaaauuacccacacugaagagaagcccuauaaaugcaaggaaugugacaaggccuucaaacgccuuaguacacugaccaagcauaaaaucauacacgcgggggagaaguuguacaaaugcgaggaauguggaaaggcauuuaaccgaucuuccaaucucacgauucauaaguucauccacaccggcgagaaaccuuauaagugcgaagagugugguaaagccuuuaacuggagcucgucucugacaaagcacaaaagauuccauacuagggagaagccauuuaagugcaaagaaugugggaaggcuuucauuugguccucaaccuuaacacggcacaaacguauccauacuggagagaagccguacaaaugcgaagaguguggcaaggccuuucgccagaguagcacccugacaaagcacaaaaucauucauaccggcgaaaagcccuauaaauucgaggagugcgggaaggcauuuagacaaucccucacucuuaauaaacacaagauaauccacucuagggaaaaaccuuacaaguguaaggagugcggaaaggcuuucaaacaguuuagcacgcugacaacccauaaaauuauccacgccgguaagaaauuguacaagugcgaagaguguggcaaggcguucaaccauucaaguucccuaagcacucacaaaauaauucauaccggggaaaagucuuauaaaugcgaggaguguggaaaggccuuccuguggucaaguacacuccggcgacacaaacgcauccacaccggcgaaaagccauacaagugcgaggaaugugguaaagcauuuagccauuccucugcucuggccaagcacaaaagaauccauacuggggagaagcccuauaaaugcaaggaauguggcaaggcuuucucgaacagcuccacacuugccaaucacaaaauuacgcacaccgaggagaagccuuacaaaugcaaggaaugugauaaaacuuuuaagaggcugucaacauugaccaagcauaaaaucauucacgcaggagagaagcucuauaaaugcgaagaguguggcaaggccuucaaccggaguucuaaucugacaauacauaaauuuauccacacuggggagaagccauacaaaugcgaagagugcggaaaggcuuucaacuggagcuccucauuaaccaagcauaaacgcauucacacgagagaaaagcccuuuaaauguaaggagugcgguaaagcguucaucuggagcucuacccugacaaggcacaagcguauccauacuggcgaaaagccguauaaaugugaggagugcgggaaggcauuuucccggaguagcacccuaacaaaacacaagacuauucauaccggagaaaaaccuuacaaguguaaggagugcggcaaagccuucaagcacucuuccgcucucgccaaacacaagauaauccaugcuggugaaaaacuguacaagugugaggaaugcgggaaggccuuuaaucagucaaguaaccuuacgacacacaaaauuauccauaccaaggagaaacccagcaagucggaggaaugugacaaggcuuucauuugguccucuacuuugacagagcacaaacgaauccauaccagagagaaaacuuauaagugcgaagaauguggcaaggccuuuagccaaccaucacaccugaccacacacaaaaggaugcauacgggagagaagccuuacaaaugcgaggaaugcggcaaggcauucagucaguccucuacccucacuacacacaaaauaauccauaccggggagaagcccuauaagugugaagagugcggaaaagcguuccgcaagagcuccacacugacugagcacaaaauuauccacaccggugaaaagccauacaaaugugaggaaugcggcaaggcuuuuucacagagcaguacgcuuacacggcauaccagaaugcacacuggggagaagcccuauaaaugugaagagugcggaaaggccuucaauaggucuuccaaacugaccacacauaagauuauccacacuggcgagaaaccuuacaagugugaagagugcgguaaggcauuuauaagcucgucaaccuugaacgggcauaaacgcauucacacacgagaaaagccauauaaaugugaggaaugcggcaaggccuucucucagaguuccacgcucacccggcacaaacgucugcauacuggagagaagccguacaaauguggcgagugcgggaaggcuuuuaaggaaagcucugccuuaacaaaacacaagaucauucauaccggagagaaacccuacaagugcgaaaaauguggcaaggcauucaaucaaagcuccauccugacuaaccacaagaaaauacauacaaucaccccugugauuccacuacucugggaggcugaagccggugggucaagaggacaggagauggagacgauccuggcgaauacugucaagccccuuuuguauuga

SEQ ID NO: 65257 - RNA, 1665 nt, Artificial Sequence
  derived and/or modified sequence opt3 from ZNF92__Homo_sapiens__NP_001274461
augggcccccugaccuucagagacgugaagaucgaguuuagccucgaagaguggcagugccuugauacagcccaaaggaaccuguaccgggacgucauguuggaaaauuaucgcaacuuaguuuuccuggugauguguucccacuuugcucaggauguauggccugagcauucuauuaaagacucauuccagaaggugauacuacgaacuuacgggaaauauggacacgaaaaucuccagcugcguaaggaucauaaaagugucgacgcaugcaagguguacaaggguggcuauaacgggcuuaaucaaugucugacgaccacagauagcaaaaucuuucagugcgacaaguacguuaaaguguuccacaaguuuccaaacgucaauagaaacaaaauuaggcauacuggaaagaagccguucaaauguaagaaucggggcaaauccuuuugcauguugucucagcucacccagcacaagaaaauccacacacgcgaguauucguacaagugugaggaaugcgguaaagccuucaacuggucaagcacccugacuaagcauaagauuauccacacaggggagaaacccuacaagugugaagagugcggaaaagcguuuaauagaaguuccaaccugaccaagcauaaaauaauccacacgggcgagaagccuuauaagugugaagagugcggcaaggcuuucaauaggucuagcacucucaccaaacacaaacggauucauacagaagagaagccauacaaaugcgaagagugugggaaggccuuuaaccaauucuccaucuuaaauaagcacaaacgcauucauauggaggauaagcccuauaaaugcgaagaguguggaaaggcauuccgaguguuuucaauccugaaaaagcacaagauaauucauacuggugaaaaaccuuacaagugcgaggaauguggcaaagccuucaaccaguuuaguaaccuuaccaagcacaaaaucauucacacaggggagaagccauauaaaugcgacgaguguggaaaggcuuucaaucagagcucuaccuugacgaagcauaaaagaauccacacuggcgaaaagcccuacaaaugcgaggaaugugguaaggcauuuaaacaguccucaacacugaccgagcauaagaucauucacacuggggaaaagccuuauaaaugcgagaaguguggaaaagccuucagcuggaguucugcuuuuacaaagcacaaaaggaaccauauggaggauaagccauacaagugcgaagagugcggcaaagccuucuccguauuuagcacccuaacgaagcacaaaauaauccauacccgggaaaagccguacaaaugugaggagugcggcaaggcguucaaucaaucgucuauuuuuacaaagcacaaaaucauacauacugaagggaaguccuauaaaugugagaagugcggaaacgcauucaaucagucaaguaaccucaccgcccguaaaauuaucuacacaggugaaaagcccuauaaauacgaggaaugugacaaggcuuuuaauaaguucagcacucugaucacccaccagauuaucuauacaggcgagaaaccuugcaagcacgagugugggcgcgccuucaacaaauccucuaauuacaccaaggaaaaacuucaaacuuga

SEQ ID NO: 65258 - RNA, 1863 nt, Artificial Sequence
  derived and/or modified sequence opt3 from ZNF93__Homo_sapiens__NP_112495
augggcccccugcaguucagagacguggccaucgaguuuagccucgaagaguggcacugccuugauaccgcucaaaggaaccuguaccggaaugucauguuggaaaacuauuccaauuuaguuuuccuggggauugugguaucuaagccugaccuaauagcacaucucgagcaggguaaaaagccacugacaaugaaacgccacgaaaugguggccaacccgucagucaucuguagucauuuugcgcaggaucuuuggcccgagcagaauauuaaggacagcuuccaaaaagugauccugcgacguuacgagaagagaggacacggcaacuugcagcucauuaagaggugcgaauccguugaugaguguaaagugcauacugggggauauaauggccugaaccagugcucuacgaccacacagucgaaggucuuucaaugugacaaauacgguaagguguuccacaaauuuucaaauagcaaccggcacaauauccgccauacugaaaagaagccuuucaaaugcauagagugugggaaggcuuuuaaccaguucaguacccugaucacacacaaaaagauucauaccggagagaaaccauauaucugcgaagaguguggcaaggccuuuaaauacuccucugcacucaauacucacaagaggauucacacaggcgaaaagcccuauaaaugcgauaagugugacaaagccuucaucgcuagcuccaccuuaucaaagcaugagauaauucacacggggaaaaagccuuacaagugcgaagagugcggaaaagcauuuaaccagaguagcacucugaccaagcauaaaaagauccacacaggugagaaaccauacaagugugaagagugcggcaaggccuucaaucagucuuccacucuuaccaaacauaagaaaauucacacaggggaaaagcccuauguaugugaggaaugcggaaaggcuuucaaauacucaagaaucuugaccacgcacaagcggauccauacuggcgagaaaccuuauaaguguaacaaaugcgguaaggccuuuauugcgagcaguacacugucucgccacgaguucauacauauggggaaaaagcacuacaaaugugaagagugcggaaaggcauuuaucugguccagcguucuaacccgacacaagagagugcauacuggcgaaaaaccauauaagugugaggaaugcggcaaagccuucaaguacucgucuacacucuccucacacaaaaggagucauaccggggagaagccguauaagugugaggaaugcggaaaggcuuuugucgccagcuccacgcugucuaaacacgagauuauccauaccgguaaaaagcccuacaaaugcgaagaguguggcaaggcauucaaccaaagcucaagucuuacaaagcacaaaaagauacacacuggggagaaaccuuacaagugcgaagaguguggaaaggcuuuuaaucaguccagcucucugaccaaacauaagaaaauucacacaggcgaaaagccauauaaaugcgaggaaugugguaaggccuucaaccagucaaguacuuugaucaaacauaagaaaauccacacccgggagaagcccuacaagugcgaggaaugugggaaagcguuucaucucagcacacaccugaccacucacaagauuuuacauacgggcgagaaaccuuaucguugccgcgaauguggaaaggccuucaaucacuccgcaacacugucuucgcauaaaaagauccacagcggcgagaagccauacgaaugcgauaaaugugggaaggcuuuuauuucccccucaagucucucuagacacgagauaauccauaccggagagaaaccguga

SEQ ID NO: 65259 - RNA, 1719 nt, Artificial Sequence
  derived and/or modified sequence opt3 from ZNF98__Homo_sapiens__NP_001092096
augcccggcccucuggggagccucgagaugggagugcuuaccuucagagacgucgcccuggaauuuuccuuggaggaauggcagugcuuagauacagcucaacagaaccuguacaggaauguuaugcuagagaacuaucggaaucucguguucguagguaucgcagccucuaagccagaccugauuacuugucuugaacagggcaaagagccguggaacgugaagcgccacgagauggucacggaacccccugugguuuacucauauuuugcgcaggaucuguggccaaaacaagggaagaaaaauuacuuccagaaggugauauugcgaaccuauaagaaaugcggacgugagaaccuccagcugagaaaguacuguaaaaguauggacgaaugcaagguccauaaagaguguuauaauggccugaaccagugccucacaacuacccaaaauaagaucuuucaguacgauaaguacgugaaaguauuccacaaguuuagcaacuccaauaggcauaaaauuggucacacagggaagaaaucuuucaaguguaaagagugcgaaaagucguuuuguauguuaucacaucuggcucagcacaagcggauccacagcggagagaaacccuauaagugcaaagaauguggcaaggccuacaacgaggcaaguaaucuuuccacccauaaacgcauucacacuggcaagaagccuuauaaaugcgaagagugcgggaaggccuucaacagauugucucaucugacaacccacaaaaucauacacacgggaaagaaaccauacaagugugaggaaugcgguaaggcuuuuaaucagagcgcaaaccuaacuacccauaaaaggauccacacaggcgagaagcccuauaaaugugaagagugcgggcgggccuucucccaaucaaguacucucaccgcucauaagauuauccacgccggagaaaaaccuuacaagugugaggagugcggcaaggcguuuagccagucuuccacacugaccacgcauaaaauuauccacacuggugaaaaguucuauaaaugugaggaaugcgggaaggcauucucacgccuuagccaccugacaacccauaaacgaauacacaguggagagaagccauacaaaugugaagagugcggcaaggccuuuaagcagucuuccacuuugacaacccauaaaaggauucacgcuggcgagaaguucuacaaaugugaaguuugcagcaaggccuuuucgagauucucucaccucacgacccauaaacggauccacacaggggagaagccguauaagugcgaagaguguggaaaagcauuuaaccuguccucacaauuaacuacccauaagauuauccacacaggugagaaacccuacaagugcgaagaguguggcaaggcuuucaaucagaguagcacucuguccaaacauaaggugauccacaccggggaaaaaccuuauaagugcgaggaauguggaaaagccuuuaaccagucuagccaccucacaacccauaagaugauucacacuggcgagaaaccauacaagugcgaggaaugugguaaggcguucaauaacucaaguauacuuaaucgucauaaaaugauccacacgggggagaagcuguauaaacccgaauccugcaacaaugccugugacaacauugcaaagaucagcaaauacaagcgcaauugcgcuggcgagaaauga

SEQ ID NO: 65260 - RNA, 5757 nt, Artificial Sequence
  derived and/or modified sequence opt3 from ZNFX1__Homo_sapiens__NP_066363
auggaggaaagaaggccccaccuggacgcccggccucgcaacagccauaccaaucaccgaggcccaguggauggggagcucccgccccgugcuagaaaccaggcaaauaacccuccagccaaugcgcuuaggggaggugcuucccaucccggccggcacccucgcgccaacaaucauccagcagccuacuggcaaagagaagagagguuccgggcuauggggcgcaacccccaccagggacgaagaaaucaggaaggccacgcaucugacgaggccagggaucagcggcaugaccaagagaacgauacacguuggcgcaaugguaaccaggacugcagaaauaggcggccuccauggucaaacgauaauuuucagcaguggcgaacuccgcaccaaaagcccacggaacagccucagcaggcuaaaaagcugggguauaaauucuuggagaguuuacugcaaaaggacccaagcgaagucguuaucacccuagccacaucccucggacugaaagagcuucugucucauucgucaaugaagagcaacuuuuuggagcucauuugucaggugcugcgcaaggcgugcaguuccaaaauggauagacagucuguacugcacgugcucggcauauuaaagaacagcaaauuccugaaggucugucuucccgcauacgugguuggcaugaucacugaaccuauuccagacaucaggaaucaauaucccgagcacauuuccaacaucauaucauugcugcaggaucuagugagugucuuuccggccagcucugugcaggaaaccuccaugcucguaucacugcuuccuacaagccugaaugcuuugcgggccagugggguugacaucgaggaagagaccgagaaaaaccucgaaaaggugcagacuauuaucgagcaucugcaagaaaagcgcagagagggaacauuaagggucgauaccuacacgcuggugcagcccgaagcagaggaccacguggagucuuaucguacuaugccaauuuacccuaccuauaaugaaguccaucucgacgagcggcccuuccuucgaccaaacaucauauccgguaaauacgauagcacagcuauuuaccuggacacucacuuuagauugcuaagggaagauuucguucgcccccugcgggagggcauccucgaacugcuucagucguuugaggaccaggggcugagaaagaggaaauucgaugacauucgcaucuauuuugauacccgaaucauuacaccuaugugcucuuccucaggaauaguguacaagguacaauucgacaccaaaccauugaaguuugugcgguggcagaauaguaaacgucuccuguauggcagcuuagucuguauguccaaggauaacuucgagacguuccuguuugccacugugucuaauagagaacaggaggaccuaugcagggguaucguucagcucuguuucaacgaacaaagccagcagcugcuugcggaggugcagccgucagauaguuuuuugauggucgagacaaccgccuacuucgaagcauaucgccaugugcuggaggggcuccaagaaguacaggaggaagacguucccuuucagcggaauauuguggagugcaacucccacgucaaggagccuagauaccugcuuaugggaggcagguaugacuucacuccacugaucgaaaaucccagcgcuacaggcgaguuuuugcgaaacguggaagggcuccgccacccucggauaaauguccuggauccaggacaauggcccucuaaagaggccuuaaagcuggacgauucacagauggaagcucuacaguucgcccucaccagagagcuggcaauuauccaggguccgccuggcacggggaaaaccuacgugggacuuaagaucguucaagccuugcugacaaacgagaguguguggcagauuagccuccagaaauuuccaauccugguagucuguuacacuaaccaugcuuuagaccaguuccuggaaggcauuuauaauugccaaaagaccuccauagugaggguuggugggcguucuaacucggagauccuuaagcaguuuacauugcgcgaacuccggaauaaaagagaguucaggcgaaaccugcccaugcaccuacggcgcgcguacaugagcauuaugacucagaugaaggaauccgagcaggagcugcaugaaggcgcaaaaacccucgaguguacaaugagaggagugcugagggaacaauaucuucagaaguacaucucaccucagcacugggagaguuugaugaauggccccguccaagauucugaguggaucugcuuucagcacuggaaacauagcaugaugcuggaaugguuagggcucggaguggguuccuucacccagucaguaagcccagccggcccugagaacacugcucaggccgaaggggacgaggaagaggagggagaagaggaaucuucccugauugagauagcagaagaggccgaucuuauccaagcugaccgggugauugaggaagaggaaguuguccgaccccagagacgcaagaaggaggaaaguggcgccgaucaggagcuggcaaaaauguugcucgcgaugaggcuggaccacugcgguacggggacagcugccggccaggagcaagcaaccggagaauggcagacucagcguaaucagaagaaaaagaugaaaaagcgggugaaggaugagcuaagaaaacugaacaccaugacagccgcugaagccaaugagaucgaggacguguggcaacucgaucugagcucuagguggcagcuuuaucgcuuguggcugcaguuauaccaggcagacacccgaagaaagauucucuccuaugaacggcaauacaggacuucagcugagcgcauggccgaacugcgucuucaggaggaccugcauauccuaaaagaugcgcaggucguuggcaugacaacgaccggggccgcuaaguacagacaaauacuccagaaaguggaaccacggaucgugauuguagaggaggcagccgaaguccuggaggcucacacuaucgccacauugaguaaggcaugucagcaucugauuuuaaucggagaccaccagcaacucaggccgagcgcgaacguguaugaucuggccaaaaauuucaaccuugaaguuucgcuguuugagcgcuuggugaaggucaauauaccuuucgugcgacucaacuaccagcacagaaugugccccgaaauugcucggcugcuaaccccacauaucuaucaggaccuggagaaucaccccuccguucuuaaguacgagaaaauuaagggugugucuagcaaccucuuuuucguagaacauaacuuuccugagcaggaaauccaagagggcaaaucacaccagaaucagcaugaagcccacuucgucguggagcuguguaaguauuuuuugugccaggaguaccugccaagucaaauaacaaucuuaacuaccuauacggggcagcucuucugucugaggaaacuuaugcccgcaaagaccuuugcuggagugcgcguccacguuguggauaaguaccagggcgaagagaacgacauuauccuguugucccucguaagaucuaaucaagaagguaaagugggguuccugcagauuagcaacaggaucugcgucgcccuaucccgggcaaagaaaggcauguacuguauaggaaauaugcagaugcuggccaaggugccucuuuggucaaaaauuauccauacacuccgugagaacaaucagaucggcccgaugcugcgcuugugcugucaaaaccacccagagacucauaccuuaguuagcaaggcuagugauuuucagaaggugcccgaagggggaugcucucugccuugugaguuccgacucggcugcggucacgucugcacaagagcgugucacccauaugacuccagccauaaagaauuucagugcaugaagcccugucagaaagugauuugccaagaggggcacagguguccucugguuugcuuccaggaaugucagccgugccaggugaagguccccaaaacuaucccacgguguggacaugagcaaaugguaccuugcucggugcccgagucagauuucuguugccaggaaccaugcucuaagagucuucgcuguggccacagaugcucccauccuuguggugaggacugcguucagcuguguagcgaaauggugaccauuaaguugaaaugcggccacucucagcccgucaagugugggcacguggagggacuacuguacggcgggcuccugguaaaaugcacgacaaaguguggaaccauacuugauugcggccauccauguccggguagcugccacuccugcuuugaagggagguuccaugagcggugucaacagccuugcaaacgauuacugaucuguucacacaagugccaggagcccuguauuggagaaugcccacccugucaaagaacuugccagaaucgcugugugcacagucagugcaaaaagaaguguggcgagcucugcagcccuugcgucgaaccauguguuuggaggugccagcauuaucaauguacaaaauugugcucugagcccuguaaccggccuccgugcuacgugccauguaccaagcugcucgugugcggucaccccuguaucggccugugcggggaaccuugucccaaaaagugccguauuugccauauggacgaggucacucagaucuuuuucggauuugaggaugaaccagacgccagauucgugcagcuugaggacuguucccacauauuugaaguucaggcacuggauagguauaugaaugagcaaaaagacgaugagguagcuauccgcuugaaggugugcccuauuugucagguccccauccggaagaaccuacgauacggcaccucaauuaaacagagacuggaagagaucgaaauaauuaaggagaaaauccaggggagugccggagaaaucgccacaagccaagagaggcucaaggcuuuacuggagcgcaaaucccuucugcaucagcucuugccagaagacuuccugaugcucaaggagaagcuggcacagaaaaaucuuucugugaaggaucuaggccugguugaaaacuauauuucguuuuacgaccacuuggccagcuuaugggauucacugaaaaagaugcacgugcucgaggaaaaacgggucagaacgcgucuggagcaagugcaugaguggcuugcgaagaagaggcuguccuucaccagucaggaacucucugacuugcggagcgagauacagcgccugacuuaccuaguaaaucugcucacacgauauaaaaucgcugaaaagaaagucaaggauuccauugccguggagguuuacucagugcagaacauccuugaaaaaaccugcaaguuuacacaagaggacgagcagcugguccaggaaaagauggaggcauuaaaagccacuuugccuuguucuggucuggggauuagcgaagaggagagagugcagaucguuagugcuauaggauauccgaggggccacugguucaagugccggaacggucauaucuacgugauuggcgauugugggggagcaauggaacgcggcaccugccccgacuguaaagaggucaucgggggaacgaaucacacacucgaaagauccaaccaacuggccagcgagauggacggcgcgcagcacgcugccuggucugauaccgcaaauaaccuuaugaauuucgaagagauucaggguaugauguga

SEQ ID NO: 65261 - RNA, 1212 nt, Artificial Sequence
  derived and/or modified sequence opt3 from ZNHIT2__Homo_sapiens__NP_055020
auggagcccgccggcccuugcggguucuguccagcuggagaagugcagccggcaagauauaccugccccagguguaacgccccuuacugcagccugcgguguuaccgcacacacgguacuugcgcggagaauuuuuaucgagaccaaguccucggcgaacuucguggguguuccgcuccacccucuagacuggccucagcauugaggcgguuacgccagcagagagagacggaagaugagccuggagaggccggccugaguagcgguccagcucccgggggacuauccggccucugggaaaggcuggcaccuggcgagaaggccgcuuucgaacggcuucugucucgcggggaggccggacgauugcucccaccguggagacccuggugguggaacaggggugcgggcccucagcugcuggaggaacucgacaaugcaccagggucggaugccgcugaguuagaacuggcccccgcacggaccccuccagacucaguuaaagaugcuagcgccgcggagcccgccgcagcugaacgugugcuuggagacguaccgggcgccugcacaccugugguccccacucgcaucccagcuauugugaguuuguccagagguccuguuucuccccuggugagguuucaacuaccaaacguccucuucgccuacgcacauacccuggcccuuuaucacgggggagaugacgcucuguugagcgauuuuugugcgacacuccugggcguguccggcgcauuaggggcccagcagguauucgcuucagccgaggaggcacugcaggccgcugcccauguucucgaagcaggagagcaucccccugguccacuuggcacccgaggggcgaugcacgaaguggcucggauacuguugggagagggcccgacuaaucaaaaggguuacacacuagccgcacugggggaccucgcccagacccugggccgcgcuagaaaacaggccgucgcaagggaggaacgggaucaccuuuaucgcgcuagaaagaaaugccaguuucuguuggccuggacgaacgagaaugaagcggcccucacuccccuggcuuuagacugugcaagggcccaccaagcucaugccgugguggcagaggaagucgcggcccugaccggagagcuagaacgucucuggggcgggccuguuccacccgcuccucggacacugaucgaggagcuuccaaguuga

SEQ ID NO: 65262 - RNA, 468 nt, Artificial Sequence
  derived and/or modified sequence opt3 from ZNHIT3__Homo_sapiens__NP_004764
auggccagccugaagugcuccaccguggucuguguuaucugccucgagaaacccaaguacagauguccugcuugcagggugccauauuguucuguagugugcuuccggaaacacaaggaacaguguaacccggagacacgccccgucgagaaaaagauucgaucagcacuuccuacuaagacggugaaaccaguugaaaauaaggacgaugacgauaguauagccgacuuucugaacagcgaugaagaggaggaccguguguccuugcaaaaucugaaaaacuuaggcgaaucugcgacccuaagaucgcuccugcuuaauccccaucugaggcaguugauggucaaccucgaucagggggaggacaaggcuaaacugaugcgggccuacaugcaggaaccucuguucguggaguuugcagauugcugucucggaaucguagagccaucacaaaaugaagagagcuga

SEQ ID NO: 65263 - RNA, 381 nt, Artificial Sequence
  derived and/or modified sequence opt3 from ZNRD1__Homo_sapiens__NP_001265715
augagcgugauggaccuggccaauaccugcuccucuuuccagucagaucucgacuuuuguagugauugcggcagcguccuuccccugccuggggcucaagacacaguuacuuguaucagaugcggauucaacauuaacgugagggauuuugaggguaagguagugaaaacguccgucguguuccaccaguugggcaccgcaaugccaaugucuguugaagaggggccggaaugucagggacccguggucgaccggcgcugcccucgauguggccaugaggguauggccuaccacacacgucagaugagaucggcggaugaagggcaaacuguguuuuauaccugcacaaauuguaaguuccaggagaaagaggacucauga

SEQ ID NO: 65264 - RNA, 2811 nt, Artificial Sequence
  derived and/or modified sequence opt3 from ZNRF3__Homo_sapiens__NP_001193927
augagacccaggagcggcgggcggccuggagccaccggucgccgacguagaaggcugcggcgcagaccaaggggccuccggugcucccgccuuccgcccccuccaccccugccuuuguuacuggggcuacuccuggcugcagccggaccaggcgcggcucgagccaaggagacagcauucguggaagucguucuuuuugagucuucacccaguggugacuacacuacguauaccacagggcugacuggaagauucagcagggccggcgcuaccuuguccgcagaaggcgagaucgugcagaugcacccucucgggcuguguaacaauaacgaugaagaggaccuguacgaguauggauggguagguguggucaaacucgaacaaccagaguuagauccgaagcccugccugacagugcuuggcaaagccaagcgggcuguucagcguggggccaccgcggugauuuuugacgucucugaaaauccugaggcaauagaucaguugaaccagggaucggaggacccacugaaacgccccgugguauacguuaagggcgccgaugcuaucaagcuaaugaauauugugaacaaacaaaaggucgccagagcaaggauccagcaucggccuccacgacagcccacugaauauuucgacauggguauuuuucucgcuuucuuugugguggucucacugguuugucuuauccuguuggugaaaauaaagcucaaacagcgcagaagccaaaauaguaugaacaggcuggccguacaggcguuagagaagauggaaacacggaaguucaauuccaaaucuaaggggcgcagagagggaagcugcggcgcccuggauacccucuccucaaguagcacgucugacugugcaaucugccuugaaaaauacauugauggcgaggagcugagggugaucccguguacucaccguuuucaucggaagugcgucgacccuugguugcuacagcaccauaccuguccccacugccgacacaacauuaucgaacagaaagggaauccauccgcuguguguguugagacaucaaaccugagcagaggaaggcaacagcgcgugacucucccuguccauuaucccggucgggugcacagaaccaaugccauaccagcuuaccccacaaggaccaguauggauucucauggcaacccuguaacgcugcuuacuauggaccgccacggggaacagucccuguacagcccacaaacaccggccuauauucgaucguaucccccuuugcaccucgaccauucucuggcagcccaccggugcggauuagagcaucgugcuuacuccccagcgcaccccuucagaaggccuaagcugucaggccgcaguuuuagcaaagcagccugcuucucccaguacgaaaccauguaucagcauuacuauuuucagggucuaucuuacccagagcaagaggggcagucacccccgagccucgcuccucggggcccagccagagcauuucccccuaguggauccggcagccugcuuuuccccacuguugugcacgucgccccaccuucucacuuggaaucagggaguacaagcuccuucucuuguuaccauggacacaggucggugugcagcgguuaucuggcugauugucccggcuccgacucaaguucuagcuccucaagcgggcagugccauuguucuuccagugauagcgucguggacugcaccgagguuucuaaucagggaguguacggcuccuguucaacguuccgaaguagccucucguccgauuaugacccauuuaucuaccgcucucggagcccgugcagagccucagaagcgggugggaguggcuccucuggaaggggcccugcacuguguuucgaggggagcccaccucccgaggaacuucccgcuguacacucccacggagccggucguggcgagccauggcccgggccugcaucaccgagcggagaucaagucaguaccugcucucuggaaaugaacuauuccagcaacucgucauuggagcaucgcggcccaaauucuaguacauccgaagugggucucgaggccagccccggggcugccccugaccugcggagaacuuggaagggcggacacgaguuaccaucuugugcaugcugcugugaaccccagccuagcccggcuggccccuccgccggggcggccggaucaaguacccuguuucuaggcccacaucucuacgaggguagcgggccugcuggaggcgaaccccagucugguuccucacagggccuguaugggcuucacccagaucauuugccuaggacagacggaguuaaguacgagggccugcccugcuguuucuacgaagagaaacaaguggcacgagggggaggcggugggaguggaugcuauacugaggauuacagcgucuccgugcaguauacccucacagaggaaccaccgccuggcuguuaccccggugcccgggaccugucucagcgcauuccaaucauccccgaagacguagauugcgacuuaggccugccuucggauugucaggggacccacagccuuggaucauggggcgggacuagaggaccagacacgcccaggccucaccggggcuugggugcuacacgagaggaagagagagcccucugcugucaagcacgcgcgcugcuaaggccggggugcccacccgaggaagccggagcugugcgugccaacuuuccuuccgcacugcaggauacccaggagaguucuacuaccgcuacagaagccgcaggcccccggagccauuccgccgacucaucuagcccaggugcuuga

SEQ ID NO: 65265 - RNA, 1917 nt, Artificial Sequence
  derived and/or modified sequence opt3 from ZP1__Homo_sapiens__NP_997224
auggccggcgggagcgcuaccacauggggauaccccguggcacugcuccuucuggucgccacuuuggguuuaggcagauggcugcagccugacccagggcuaccgggacucaggcacuccuaugauugcggcaucaaggguaugcaacugcuuguuuucccccggccugggcagacgcugcgcuuuaaagugguagacgaguucggaaaccgauuugaugugaauaacuguucuauuugcuaccauugggucaccucacguccacaggaacccgcgguguucagugcugacuauagaggcugucacguuuuggagaaggauggcagguuucaucuccggguguucauggaagccguccugccuaaugggcgcguggacguagcacaggaugccacacugauaugcccaaaacccgacccuagcagaacucucgauucccaauuagcuccaccggcaauguuuucuguuucgacuccccagacacugucauuccuuccuaccagcggacacaccagucaggguuccggccaugccuuuccaucucccuuggacccugggcacagcuccgugcacccaacacccgcucugccgucaccuggacccggcccaacccuagccacgcucgcgcagccucauugggguacucuggagcacugggaugucaacaagagggacuacaucgggacccaucuuagucaagaacagugucagguggcaagcggacaucugcccugcauugugcggcgcacaucuaaagaggccugucagcaagcuggcugcuguuaugauaauacucgagaggucccaugcuacuauggcaacaccgccacaguucaguguuucagagacggguacuuuguguugguagugucccaggaaauggcacucacccacaggaucacgcuggcuaauauucacuuagccuacgcgcccacuucaugcagcccuacacaacacaccgaggccuucgucguguuuuauuucccacugacucauugcggaacaaccaugcagguugcaggggaccagcucaucuacgaaaacuggcuugugaguggcauacacauccagaaggggccgcaaggaucuauuacgcgggauuccaccuuccagcugcauguccguuguguguuuaaugcuagcgacuucuugcccauccaggccucgauuuuuccuccacccucuccugcuccaaugacacagcccggcccgcuacgccuggagcucagaaucgccaaggaugagacuuucuccucauauuacggugaagacgauuauccuauaguaaggcugcuucgggagccaguucacguggaaguccgacuguugcaacgcaccgaccccaaccucgugcuguuacugcaccagugcuggggugcaccuagugccaaucccuuucagcagccacaauggccuauucuaagcgauggcugucccuucaaaggagacuccuacagaacacagauggucgcucucgauggcgcgacuccauuucagucucauuaucagagguucaccguggcaacauuugcccugcuugacagcgggucacaacgggcuuugcgcggacugguuuaccucuucugcaguaccuccgccugucacacuagcggucuggagacgugcucuacagcauguucaaccggcacuaccagacagaggcguaguagcgggcaucggaacgauacagcccgaccgcaggacaucguguccucuccuggacccguaggcuuugaagacucguacggucaagagccaacccuugggcccacugauagcaauggcaacuccucacugagaccuuugcucugggcuguccuguuacugccagccguggcacuuguucucggauucggcguguuugucgggcugagucagacaugggcgcagaagcuaugggagucuaauaggcaguga

SEQ ID NO: 65266 - RNA, 1623 nt, Artificial Sequence
  derived and/or modified sequence opt3 from ZP4__Homo_sapiens__NP_067009
auguggcugcucagaugcgugcuucugugugucagcuuguccuuagccguuucuggccagcacaagcccgaggcuccugacuacucaagugugcugcauugcgggccauggagcuuccaauuugcaguaaaccuaaaucaggaagccaccuccccgcccgugcucaucgcgugggauaaccagggacugcuucacgagcugcagaaugacucugauugugguacauggauuaggaaaggcccugggucgucagucguguuggaagcuacuuauagcaguugcuacguuacggagugggacucccauuauauaaugccagugggagucgaaggcgccggugcagccgagcacaaggugguaaccgagcggaaacuccugaagugucccauggaucugcucgcucgcgacgcaccugauacagacuggugcgauucuaucccagcccgagaccguuuacccugugcuccuagcccaauuuccagaggggauugcgaaggacugggcuguugcuacucaagugaggaaguuaacagcuguuauuacggcaauacugugacccuucauugcacaagggaggggcacuucucuaucgccgucucccggaacgugaccucaccgcccuugcugcuagacagcgugcgccucgcgcugagaaaugauagugcaugcaacccugucauggccacucaggcuuuuguucuuuuccaauuuccauucacaucuuguggaaccacgaggcagauuacuggugaccgggccguguaugagaaugaacugguagcaacccgcgacgugaaaaacggcucccgagggagcgucacaagagauucgaucuuuagguugcacgugucuugcuccuacucaguuaguagcaauucccuccccauaaacgugcaggucuucacucugccuccacccuuuccggagacccaaccuggacccuuaacacuggaacuccagaucgcuaaggacaagaauuacggcucuuauuacggugugggggauuauccaguaguuaaacuucugcgggacccuauuuacguggaggucagcaucuugcaucguaccgaucccuaucuaggacugcuccugcagcaguguugggccacgccaucaacugacccccuuagucaaccucaguggccaauucuggugaagggcugcccguacaucggcgauaacuaucagacacaauugauacccguccagaaagcgcucgaccugccuuucccaucccaccaucagcgcuuuagcauuuucaccuuuucuuucgugaaucccacuguugaaaagcaggccuuaagagggccugugcaccuucacuguucaguaagugucugccaaccagcagagacacccagcugugugguuaccugcccggaucuauccaggcggcgaaacuucgacaacucuucgcagaauacgaccgcuagcguguccucaaaaggaccuaugauccuccugcaggccacaaaggauccacccgagaagcugcgcgucccuguggacaguaaaguauuguggguggcuggucugucuggcacucucauucugggggcccuucugguuagcuacuuggcagucaagaaacagaaguccugucccgaccaaaugugccaguga

SEQ ID NO: 65267 - RNA, 951 nt, Artificial Sequence
  derived and/or modified sequence opt3 from ZPBP2__Homo_sapiens__NP_942141
augaugagaaccugcgugcugcucagcgccguccuuuggugucugacaggcgacaagaucuacguugaguugcaccagaacucccccguguuaauuugcauggauuucaaacugucuaagaaagaaauaguagacccuacuuaucuauggaucgggccaaaugagaagacgcucaccggaaacaauaggauuaacaucacagaaacuggucaacugauggugaaagauuuucuugagccgcugucaggcuuguacaccuguacacucaguuauaagaccgucaaggcugaaacucaggaggagaaaacagugaagaaacgguacgacuucaugguuuuugcauaucgcgaacccgauuacagcuaucagauggccgugcgauucaccacgcguuccugcauugggagauacaaugacgucuuuuucagggugcugaagaaaauccuggauucucucauaucggacuuaucaugucauguaaucgagccuagcuacaagugccacaguguugaaauuccagagcauggacugauccacgagcuuuuuauugcguuccaggugaaccccuuugcuccuggcuggaagggugccuguaauggguccgucgauugcgaagacacuaccaaccauaauaucuugcaagcacgggaucgcauagaggacuucuuuagaucucaggccuauauuuucuaccacaacuuuaauaaaacacugccagcuaugcacuucguggaucauagccuacagguggucaggcucgacuccugucggcccggauucggcaagaacgaacgccugcacucaaauugcgcaaguuguugcguugugugcagcccugccacuuuuucuccagacguaaacgugaccugucagacaugcgucuccgugcuuaccuauggcgcuaaaucauguccgcaaacgagcaauaagaaccagcaguacgaggauuga

SEQ ID NO: 65268 - RNA, 1296 nt, Artificial Sequence
  derived and/or modified sequence opt3 from ZPLD1__Homo_sapiens__NP_778226
augaugcugagauucagcaugugcaggggcaacgacgagggguuugccauggaacagaucuggcuccuucuguuguuaaccauucgggugcugcccggauccgcucaauucaaugguuacaacugugaugcaaaucuacacucucgcuuuccugccgagcgagacauaucagucuauugcggcguucaggcgaucacaaugaagauuaacuucuguacugugcucuuuaguggguacagcgaaacggaucuggcucuuaauggacgucauggcgacucccacugcagagguuucaucaacaauaacaccuuuccagccguagugauuuucaucauaaaucugucuacauuggagggguguggaaacaaucucgucgugucgacuaucccgggcguuucagcauauggcaacgccaccagcgugcaggucgggaauauuaguggauacaucgauacacccgacccuccaaccauuaucuccuaucugcccggucugcucuacaaauuuucuugcagcuauccuuuagaauaccuggugaacaauacucagcuugcuuccucaagugcagccauaagcguaagggagaacaacggcacauucguuucuaccuugaaucugcuacucuacaacgauuccacguauaaucaacagcugauuaucccaucaauugggcuuccccugaagacuaaaguguuugcugccguccaggcgaccaacuuggacggacgguggaaugugcucauggauuacuguuauacaacuccuagcggcaacccaaaugacgauauccgcuacgaccuguucuuaaguugcgauaaggacccgcagaccacagugaucgagaacgguagaucucaaagggggcgguuuuccuucgaagucuuccgcuuuguuaaacauaagaaucagaagaugagcaccguguuccugcacuguguaacgaaacucugccgagcagacgauugucccuuucuuaugccuauuugcucgcauagagagaggcgggacgccggacgucgcacuacauggucuccacaguccucaaguggcagcgcugugcuguccgccggccccauaaucaccagaucugaugaaacuccuacaaacaauagccaguuggggucaccaaguaugcccccguuccaacuaaacgcaauuaccuccgcucugaucagcggaauggucauacucggugugacgucuuuuucacugcuucugugcaguuuggcccuccugcacaggaagggcccuaccagcuuaguucugaaugggauucggaaccccguguucgacuga

SEQ ID NO: 65269 - RNA, 1380 nt, Artificial Sequence
  derived and/or modified sequence opt3 from ZPR1__Homo_sapiens__NP_003895
auggccgccagcggcgcaguggagcccgggccuccaggagccgcggucgcuccgucccccgccccugcaccacccccugccccagaccaccuguucagacccaucucugcugaagaugaggaacagcaaccuaccgagauugaaucacucugcaugaacuguuacugcaaugguaugacaaggcuucuguugacuaagauaccauuuuuccgggagaucauuguuaguagcuuuuccugugagcauugcggcuggaacaauacggaaauccagucugcagggcgcauucaggaccagggagugcgauauaccuuaucgguacgugcccuggaggauaugaacagagaaguggucaaaacagacucagcugccacuaggaucccggagcuagauuucgagauacccgcguuuagccaaaagggcgcacucaccacaguggaaggucugaucacccgggccauuagugggcuugagcaggaccagccugcucgcagagccaauaaagaugcaacugcugaaaggaucgacgaguucauuguuaagcugaaagaauugaaacagguggccuccccauuuacacucaucauagaugaccccucuggaaacagcuucgucgagaauccucacgcgccacaaaaggaugacgcccuggugauuacccauuacaaccggacgcgccagcaggaggaaaugcugggccuccaggaggaagcacccgcugagaagccggaagaggaggauuuacgaaaugaaguacugcaauuuuccacuaacuguccugagugcaaugcccccgcucagaccaacaugaagcugguucagaucccacacuucaaagaagugauuaucauggccacaaauugugagaacugcggccauagaacuaaugaagucaagucagggggagcaguggagccuuuggguaccaggaucacacugcacauuaccgacgccagugacaugacgcgggaucuacucaaaagcgagacuuguucuguggaaauacccgagcuggaauuugagcuuggcauggcuguccuugggggaaaguucacaaccuuggagggccuccugaaggacauccgugaauuaguuacuaaaaacccauuuacacugggugauuccucaaaccccgggcaaaccgagcgccuccaggaguucagccagaagauggaccagauuaucgagggaaauaugaaagcgcacuucauaauggaugacccugcaggcaacaguuaucuucaaaauguguacgccccagaagaugacccggagaugaagguagagagauauaaaaggacguuugaucagaacgaagaacugggcuugaaugacaugaagaccgaaggguacgaggcuggacuagcuccccagcgguga

SEQ ID NO: 65270 - RNA, 3234 nt, Artificial Sequence
  derived and/or modified sequence opt3 from ZRANB3__Homo_sapiens__NP_001273497
augcccagagugcacaacaucaagaaaagccugaccccucauauuuccugcgucacaaaugagucugacaaccuccuugauuuccugccagacagguugcgggccaaguuacugccguuucagaaagauggcauaaucuucgcucuaaagcgcaaugggcgauguaugguugcagacgaaaugggacucgguaaaacuauucaagccaucggcauuacguacuuuuauaaggaggaauggccccugcuuaucgugguaccuucaagucugcguuacccauggaccgaggaaauagagaaguggauccccgaguugagcccugaagagauuaacgugauccagaauaaaacagaugucagaaggauguccacuucuaaggugaccguucucggguauggacugcugacagcggacgcuaaaacccucauugaugccuuaaacaaucagaacuucaagguggucaucguggacgaaucgcacuacaugaaaucacggaaugcaacucgcagcagaauacugcuuccaauuguacagaaggccaggcgggcuaucuugcugacaggcacccccgcacuaggucgcccugaggagcucuuuaugcaaauugaagcccuguucccacagaaguuugggcgauggacggauuaugcuaaaagauacugcaacgcccauaucagguauuucggaaagcggccgcagugggacugucguggcgcgaguaaucuuaacgagcugcaccaguugcucuccgauaucaugauucgcagacugaaaacugaaguuuuaacccaacugcccccuaaggugaggcagcggauaccauuugaccuccccucugcagccgcuaaagagcuuaauacuagcuucgaagagugggagaagaucaugcgaacuccuaacuccggcgccauggaaaccgucauggggcugauuacacgcauguuuaaacagaccgcaaucgcuaaggccggagcggugaaggauuacauaaaaaugauguugcagaaugacucacuaaaguuccugguguuugcccaucaccucaguaugcugcaagcaugcacggaggcugucauugaaaacaaaacuagauacaucaggaucgacgguagcguuucuuccucagagcggauucaccuugugaaccaguuccagaaggauccagacacacgcguagccauccugagcauucaagcugccggccagggguugaccuucacugcagccagucauguggucuuugcugaacucuauugggaucccggacacauaaaacaggcggaggacagagcacauaggaucggccaguguucuuccgugaauauucacuaccugaucgccaacgguacauuagauacccugaugugggggaugcuaaaucguaaggcucaaguuacgggaagcacccucaacggccggaaggagaaaauccaggccgaagagggcgacaaggaaaaaugggauuuccugcaguuugcagaggccuggacaccgaaugacucgucugaggaacuucgaaaggaggcuuuguucacucacuuugaaaaagagaagcagcaugauauuagauccuucuuugugccucaacccaagaaaaggcagcugaugaccucaugcgacgaaaguaagcgcuuccgggaggagaacacagucgugagcuccgauccaacuaaaaccgccgcaagagacauaaucgacuaugaaucugauguagagccugaaacaaagaggcucaaacuggcggcuagcgaggaccacuguucacccagugaagagaccccaucccagagcaagcagauucgcacuccccuuguugagucugugcaagaagccaaggcacagcugacgaccccugccuuuccagucgagggguggcagugcucauuguguacauacaucaauaacagugaacucccguauugcgagaugugugaaacuccccagggaagcgcugugaugcaaauugauucccugaaucauauccaggacaaaaacgagaaggaugacucucagaaagauaccucgaagaaaguccaaacaauaagcgacugcgagaagcaggccuuagcacaguccgaaccuggucagcuggcugauucaaaagaggaaaccccaaagaucgagaaggaagacggccuaacaagucaacccgagcaguggaaaucuagcgauacacucccuguguacgacacgcugauguucugcgccucccgaaauaccgaucggauucacaucuauacuaaggacgggaaacagaugucauguaacuuuauuccacuugacaucaaguuggaucugugggaggaccuccccgcgagcuuccagcugaaacaauaccguucuuuaauacugagauuuguuagggaaugguccagucuuacagccaugaagcagcgcauuaucagaaagagcggacaguuguucugcucuccgauucucgcucuggaggaaaucaccaaacagcaaacaaagcagaauuguacuaaaagauacauaaccaaggaggauguggcaguagccuccauggacaaagucaagaacgugggcggucauguuaggcuaaucacgaaggagucacgaccucgcgauccauucaccaaaaagcugcucgaagacggggcuugcgugcccuuucugaauccuuauacaguccaggccgaucuuacugugaaacccaguaccagcaagggcuacuugcaagcaguagacaacgagggaaacccacuguguuuacggugccagcagccuacaugucagacuaaacaagcgugcaaggccaauucgugggauuccagauucuguucucucaagugccaggaagaguuuuggauuaggagcaacaauucauaucugcgugcuaaaguguucgaaaccgagcacggcguuugucagcuuugcaacgucaaugcccaggagcuguuuuugcgccuccgggacgcacccaagagucaacggaaaaaccugcuauacgcuacguggacauccaagcugccacucgaacagcugaaugagaugaucaggaacccgggggaaggacacuucuggcaaguggaucauauuaaaccuguguaugguggcgggggacagugcucucuugacaauuugcagacccuguguacugucugccacaaggagcgaacagcccggcaggcaaaagaacgcagccagguuagaaggcaguccuuagccucaaagcauggcagcgauaucacccgguuucucgugaagaaauga

SEQ ID NO: 65271 - RNA, 1449 nt, Artificial Sequence
  derived and/or modified sequence opt3 from ZRSR2__Homo_sapiens__NP_005080
auggccgcucccgagaagaugaccuucccugaaaaaccaagccacaagaaauacagagcagcccugaagaaagagaagaggaagaaacggcgccaggaacucgcgcgacuucgugacuccggccugucucaaaaggaggaagaggaggauacauuuaucgaagaacagcaguuggaagaggagaaauuacuggaaagagagaggcagcggcuacaugaagaguggcuccugcgcgaacaaaaggcucaggaggaguucagaauuaaaaaggaaaaggaggaagccgccaaaaagaggcaggaggaacaggagcggaaacuuaaggagcaaugggaggagcagcagcgcaaagaacgagaggaagaggagcagaagagacaagagaaaaaggaaaaggaagaggcacugcagaaaauguuggaccaggcugagaacgaacucgagaaugggacuacguggcaaaacccggaacccccuguggauuuuagggucauggagaaggaccgggcaaauugcccauucuauucaaaaaccggagccugucguuuuggugaucgcugcaguagaaagcacaacuuccccacaagcuccccuacucugcugauaaaaucuauguuuaccacauucggcauggaacaguguaggcgggacgauuacgacccagaugcuucgcucgaguauucagaggaagagaccuaccagcaguuuuuagacuucuaugaagauguucugcccgaguuuaagaauguggggaagguaauccaauucaaagugagcugcaaccuugaaccucauuugcgaggaaaugucuacgugcaguaucagagugaggaggaaugucaggccgcgcugucccuauuuaacggccgcugguacgcagguagacaacuccagugcgaguucuguccaguuacuagguggaagauggccauuugcgggcuguucgaaauccagcaguguccgcggggaaaacacugcaauuuucuucauguguuccgcaaccccaauaacgaguuuugggaagcuaauagagacauuuaccugucuccugauaggacaggcagcuccuucggcaagaacucagagcgucgggagcgaauggggcaccacgacgacuauuacaguagauugaggggacgccggaauccaagccccgaucauucuuauaaaagaaacggugaauccgagaggaagucaagccgccaccgaggcaagaaaagucauaagcggaccucuaaaucccgugaaagacacaacagcaggucgcgcgggcggaauagagacaggucucgagaucgcucccggggaagaggcucaaggagucguagccgcucccggucuagaaggagccgacggucacgcagucaauccagcucuagaucaaggagucggggucgaagacgcagcgggaacagggaccguacgguccaguccccuaagucuaaauga

SEQ ID NO: 65272 - RNA, 1701 nt, Artificial Sequence
  derived and/or modified sequence opt3 from ZSCAN18__Homo_sapiens__NP_001139014
augagaagggugggcgggcgggccgacgaggaugcuaccgcagccggaagccuguggguccucgcgcccccugaaccaacaggucaccuuguuaucccgggcacuucuccccuggagccuccaugccccugguuggacucccauauuuuccagugucgcuuugggaagauguuaccucuggaaaaggcuuucgccucaccacgaaguagccccgcaccuccagaucuaccgacgcccggauccgccgcuggcgugcaacaggaggaaccugagaccauaccagagcguacacccgcagaccucgaauuuucuagacugagguuccgggaguuuguauaccaggaagccgcugguccucaccagacucuugcccgccugcaugaguugugcagacaauggcucaugccagaggcgaggucgaaagaacagaugcuggagcugcucguguuagaacaguuccuggggauccuucccgauaaaguccggccgugggugguugcacaguauccugagucauguaagaaagccgcuagcuugguggaaggacuggccgacguccuagaggagcccggcaugcuccugggcaguccagcaggguccucuagcauucuuuccgauggaguguacgaacgccacauggacccucuguugcuccccggugagcuggcuucaccaagucaagccuuaggcgcgggggaaauccccgccccuagcgagaccccauggcugucuccggauccccucuuucuugaacagcgaagaguaagggaggcaaagacagaggaagacggaccugcuaacaccgagcagaagcugaaauccuucccagaagauccccagcauuugggcgaguggggucaccuagacccugccgaagagaaucugaagucauaucggaaacuccugcuuuggggguaccaacugagccagccagaugcugccagucguuuggacacugaggaacuccgccugguugagagagacccccagggaucuuccuuaccggaaggcggcaggcggcaagagagcgcagggugcgccugugaggaagcugcgccugcaggagugcugccagagcuacccacagaagccccucccggugaugcucucgccgacccaccuucgggcaccacggaggaagaggaggaacagcccgggaaggcaccagauccgcaggacccucaggaugccgagucugacuccgcuacuggaucacaacgacagagugucauucagcagcccgccccagaucgcggcaccgcaaaacuggguacaaagagaccccacccugaagacggggauggccaaagccuugagggaguguccucuagcggcgacucagcgggguuggaagcuggacaggguccaggcgccgaugagcccgggcugaguaggggaaagccuuaugcaugcggcgaguguggugaagccuuugcuuggcucucccaucugauggagcaccauagcucucacgggggccggaaacgcuacgccugccagggauguuggaagacuuuccacuuuucacuugcacuggcugaacaucagaaaacccacgagaaggagaaaaguuaugccuugggcggggcgagaggaccgcaaccaagcacaagggaagcccaggcuggugcacgugccggcgggcccccugaguccguggaaggagaggcuccacccgccccuccggaagcacagcgguga

SEQ ID NO: 65273 - RNA, 1476 nt, Artificial Sequence
  derived and/or modified sequence opt3 from ZSCAN22__Homo_sapiens__NP_862829
auggccauccccaagcacagccuguccccugugccaugggaggaagacucuuuccuccaggucaaaguugaggaagaggaagaggcuucacuuagucaaggcggggagagcucccaugaucacauugcacauucugaagccgcgagacugagguuucggcacuuccgcuacgaggaggcuucgggaccgcaugaagccuuggcacacuuacgagcccugugcugucaguggcuacagcccgaggcucacucaaaggaacagauacucgagcugcuugugcuggaacaauuuuugggugcacucccuccagagauccaggccuggguaggcgcucagagccccaaaaguggggaagaggccgcggugcuggucgaggaccugacccaggugcucgauaagcguggaugggacccuggcgcagaaccaacagaggccuccugcaaacaaucugauuuaggugaaagcgagcccuccaacguuacugaaacgcugaugggaggggugucacuuggcccugcuuucgucaaggccugugagccagagggcaguagcgaaagaucuggguuguccggagagauuuggaccaagucagugacacagcagauccauuuuaaaaagacuagcgguccguauaaagacguacccaccgaucagaggggccgggaaaguggggcaucucgcaauuccagcucggcuuggccuaaccugacaucucaagagaagccacccuccgaagacaaauucgaucuaguugacgccuacggaaccgagccuccauauacuuacucaggcaagagaaguagcaagugcagggagugucggaaaauguuucaguccgcgucugcccucgaagcacaccagaagacacauagccgcaaaacccccuaugcuugcucagagugugguaaggccuucagucgauccacgcaccuggcucaacaccaggugguccauacuggggccaaaccgcacgaaugcaaggaguguggaaaagcauuuagcagagugacccaucuuacacagcaccagaggauucauacuggcgagaagccuuacaagugcggcgaaugugggaaaaccuucucucggucaacacaccugacccaacaccagcgugugcauacgggagagcgccccuaugaaugcgaugccugcgguaaggcuuuuagucagagcacucacuugacacagcaucaaagaauccacaccggcgagaaaccauacaagugugacgcgugcgggagggcauucuccgauuguucugcccucauacggcaucugcgaauccacucgggagaaaaaccuuaccagugcaaggucugucccaaggcuuuugcccagagcuccucauuaauugagcaccagcgcauccauacuggcgagaaaccauauaagugcagugacugugguaaagcauucucuagaagcuccgcccugaugguucaccucaggauucauaucacagugcuucaauga

SEQ ID NO: 65274 - RNA, 1437 nt, Artificial Sequence
  derived and/or modified sequence opt3 from ZSCAN26__Homo_sapiens__NP_001104509
auggccaccgcucuggugagcgcacacucccucgcuccccuuaaccugaagaaagagggcuugagagucguuagggaagaccauuacucuacaugggagcagggguucaaguuacaaggaaauucaaaaggucugggccaggaaccucuaugcaagcaguuucggcagcuccgcuaugaggaaacuacggggccacgagaggcgcugagucgucuuagagagcugugucaacagugguugcagccggaaacccacacaaaagagcagauccucgaacugcuggugcucgagcaauucuuaauuauacugcccaaggagcuucaggcuaggguacaggaacaucacccugagagccgggaagauguggucgugguuuuggaggaccugcagcuagaucucggagaaacuggccaacaggacccagaucagcccaagaaacaaaagauccugguggaggagauggccccucuuaaagguguccaggaacagcagguucgccaugagugcgaaguaaccaagccagagaaagaaaagggggaggagacaagaauugaaaacggaaagcugaucguugugaccgacuccuguggcagggucgagucuucgggcaaaauuucagaacccauggaggcacacaaugaagggagcaacuuggagcggcaccaagccaagccuaaagagaagaucgaauacaaaugcagugagcgcgaacagcgauuuauacagcaucucgaucugaucgagcacgcuuccacucauacaggaaagaaauuaugugagucugacgugugccagagcuccucacugaccggucacaagaaggugcucaguagagaaaaaggccaccaaugucaugagugcgggaaggcauuccagaggagcucucaccuuguccggcaucagaaaauucaccugggagaaaagccauaucaguguaaugagugcggcaaaguguuuucccaaaacgccgguuugcuagaacaucugcguauccacacgggggagaagccguaccucuguauucacugcggaaagaauuuccgcagaucaagccaucugaacaggcaccagcggauccauagucaggaggaacccugcgaguguaaagaaugcggcaagacuuuuucucaggcccuucuguugacccaccaccaacgaauacauucccacagcaaaucgcaucaguguaaugagugcggcaaggccuucucucucacauccgaucugauucgccaccauagaauccacacuggggaaaaaccuuuuaaguguaacauuugccagaaggcguucagguuaaauucacaccuggcacaacaugugcggauccacaacgaggagaaaccauaucaguguagugaaugcggagaggccuuucgccagagaagcggucuauuccagcaucaaagguaccaccauaaggacaaacucgcuuga

SEQ ID NO: 65275 - RNA, 744 nt, Artificial Sequence
  derived and/or modified sequence opt3 from ZSCAN31__Homo_sapiens__NP_001230173
auggugacccagcugagauacgagagcuucugccuccaccaauuucaggaacaggacggcgaguccauccccgaaaaccaggagcuugccucuaagcaagaaauucugaaagagauggagcauuugggggauucaaaguuacagagggacgucagucuggauagcaaauaucgggaaacauguaagcgcgacuccaaagcugagaagcagcaggcacacucuacuggagaacgacgucauagaugcaaugagugugguaagucguucacgaaaucaagcguucuaauagagcaccaaaggauccauaccggcgaaaagccuuacgagugcgaagagugugggaaagccuuuagucggcgcuccucucucaacgaacacagaaggagccacacaggagagaagccauaucagugcaaagaguguggcaaggcguucuccgcuucaaauggucugacucggcaucgcaggauucacaccggggaaaagccguacgagugcaaaguguguggaaaggccuuucuucugaguagcugcuugguacagcaucagagaauccacacaggcgaaaaacgauaucaaugucgggagugcggcaaggcauucauucagaacgccgggcucuuucagcaucugcgugugcacaccggagaaaaacccuaccaaugcucucaguguuccaagcuguucucaaaacgcacucucuuaaagaagcaccagaaaauccauacaggugagagaccuuga

SEQ ID NO: 65276 - RNA, 1227 nt, Artificial Sequence
  derived and/or modified sequence opt3 from ZSCAN32__Homo_sapiens__NP_001271458
auggccgagggccugugggaacagggguuccucagaacccccgagcaaugcaggacaaaguuuaaaagccuucagcuguccuaccggaaggugcgccgaggacgugucccugaaccauguaucuucuaugaggaaaugaacgcuuugucugguucaugggcaagugccccgcccauggcgagcgacgcuguuccuggccaggagggguccgauauugaggccggagaauuaaaucaccagaacggcgagccaacugaaguggaggacgguacgguagauggggcagacagagaugagaaagacuuuaggaaucccggacaagaagugcggaagcuggaucuaccuguccucuucccaaaccgccugggcuuugaguucaaaaaugaaauaaagaaggagaaccuuaaaugggacgauucugaagagguggagaucaauaaggcccugcagagaaaaucgaggggcguuuacuggcauucagaauugcagaaggggcucgagagcgaacccaccagucggcgccagugccgaaacuccccuggagagucugaagagaaaacaccaagccaagagaagaugucccaccagucauuuugugcuagagacaaggcaugcacucauauucugugugguaaaaauugcagucagagcgugcacucuccgcauaagcccgcccugaaacucgaaaaggucucccaguguccugagugcggcaaaaccuucucaaggagcaguuauuuagugcggcaccaacguauccacacaggggaaaagccacauaaauguucugagugcggaaagggcuuuuccgaacgcagcaaccugaccgcucaccuuagaacucauacaggugagaggcccuaccagugugggcagugcggaaagucguucaaucaaucuuccucauugauuguacaccagcggacccacacgggcgagaaaccuuaucagugcaucguuuguggcaagcgauuuaacaauaguagccaguucuccgcccaucgcagaauacacacuggggaaucuccauacaaaugcgcgguguguggaaagaucuuuaacaauagcucacauuucagugcacacaggaaaacccauacaggugagaagcccuaucggugcucccacugugaacgcggcuucacuaagaacagcgcccugaccagacaccaaacaguccauaugaaagcugugcuaucuucacaggaggggagggaugcccucuga

SEQ ID NO: 65277 - RNA, 1338 nt, Artificial Sequence
  derived and/or modified sequence opt3 from ZSCAN9__Homo_sapiens__NP_001186408
augaacaccaauagcaaggaggugcugucccucggcguccagguucccgaagccugggaggaacuucugacaaugaaaguggaggcuaagucucacuugcaauggcaggaaucaagauuaaaaaggaguaacccucuggcacgggagaucuuccgccgacauuuucgucagcuaugcuaccaggagacuccagggccgagagaagcccucacgaggcugcaagagcuuuguuaucaguggcugcggccccacguaagcaccaaggaacagauuuuggaccuccuggugcuggagcaguuccucuccauauuaccuaaagagcugcaaggauggguccgcgaacauugcccagagucuggugaagaggcggugauccuuuuggaagaucuggagagagagcuagacgaaccccagcacgagaugguugcucauaggcaccggcaggaagugcucuguaaggagauggucccucuggccgaacagacaccacuuacucugcaaucgcagcccaaggagccucaguugaccugcgauucagcacaaaaaugucacagcauuggcgagacagaccucauccgcagucugcgaagaagggccguguuaauuccacugggggcucaucucuuuuccaccgauacuuuccuguuuucuaagccgguaguuaucccccagcuuaaaggaggcggugaaacauggccuaauaacagagggguguugcgugacgaggucaccaagacggaagaucgcgagcuagugcugagaaaagacugcccaaagauaguggaaccccacggaaagauguucaaugagcagacuugggaggucagccagcaagauccuucccauggcgaaguuggcgagcacaaagacaggaucgaacggcagugggggaaccuccugggagagggucagcacaagugugaugagugcggcaaaucauuuacccagaguagcgggcuuauucgacaucaacgcauccacacaggagaaagaccauacgaguguaaugaaugcggcaaggcauucucuagguccucaggucuguuuaaccaucgggggauucacaauauccagaaacgcuaucauuguaaggagugcggaaaaguguucagccagagugccggcuugauacagcaccaacggauucacaagggcgaaaagcccuaccagugcucucaguguuccaaaagcuauucgaggcguucuuuucucaucgagcaucagcggucccacacuggggagcgaccgcaucaaugcauugaauguggaaagucauucaacagacacugcaaucugaucaggcaccagaaaauccauaccguagcugaguuaguguga

SEQ ID NO: 65278 - RNA, 1902 nt, Artificial Sequence
  derived and/or modified sequence opt3 from ZSWIM2__Homo_sapiens__NP_872327
augcugagaaggggcuacaaggccagcgagcggcgccgacaccucuccgaacgucuuucuuggcaucaggaccaagcucugucaaguagcaucuauuuguuaagagagauggggcccaccggauuccugcuaagggaagaggaaccugaguacauggauuuucggguguuccucgguaacccacacgucugcaauuguuccacauuuccgaaaggcggggagcugugcaagcauauuuguuggguucuucugaaaaaguucaaauugccccgcaaccacgaaucugcacuccagcugggacugggcgagagagaaauaucggaccucuuaagggguauccaucgggugcagacuccucagccagggacgaaugaugagaacgagcacguagaagaggacggauauauuaagcaaaaggaaaucgauucagaggacauuugcagcaucugucaggaacugcuuuuggagaaaaagcugcccgugaccuuuugccgcuucggcuguggcaauaguauacacaucaaaugcaugaagauucuagccaacuaccaguccacaucuaauacuagcaugcucaaauguccucugugccgaaaggaguuugcgccacuuaagcugaucuuggaagaguucaaaaacuccucaaagcucgucgcugccgcagaaaaagagagacuggauaagcauuuagggauucccuguaauaacugcaaacaguuuccuaucgaaggaaagugcuauaaauguaccgagugcauagaguaccaccugugucaagaaugcuucgacaguuguugccaucucagccacacauuuaccuucagggagaagcggaaucagaaguggcguucucuugaaaaacgcgccgaugaggugguuaaguauauugacacuaaaaacgaaaucgaggagaagaugucccacuuucaggaaaaacagggucaaguguacacaccaaagcauauugucagaucacugccguugcagcuaaucaccaagaauagcaaacugcucgcucccggcuaccagugucugcuuugccugaaggcauuccacuuggggcaacauacgaggcuccugccuuguacucacaaauuccaucggaagugcaucgauaacugguuauuucacaaauguaauaguugcccaauugacggacaggugauauauaacccccugaccuggaagaacucugccguaaauggccaggcucaccaguccguuagcaaccgagauaucauucaucuaucgaagcaaaaagagccugaccucuucaucccagguacagggcuggugcuuaagcagaaucgcuugggaauacugcccucuauuccgcagugcaacuuugacgaacucaauacuccucagucccccaaagaugccuacgagaacaccacaaucgacaaucuguguucaaucaaacuugauaacaguaauagcaagaagcugaccuaugacuacaagauuucccaacacuucccaagauauuugcaggaucucccuacggucucuuuuggcaaaauccccagccagacucuguuaccacccauugugcauaagaacauagugugcccuacagcgauggagucaccauguaucaguggcaaauuccacaccucccugagcaggaugacuaaggggugcaaauguaauaaccacaaucuaaagaaaacaccggcaaccaagauucgggaagacaacaagcgcucuacgcuccugcccgaggauuuuaaucuuaucgucaacuggucaaccgccaaauugagucugagcaagagauacuccaacugcaugggagaaaucacaaggaaauguucucaucucucgcgucagccuguuagccacuccgugaauacuaagucaaccgagcugaguuuaauuauagaagguguacaacuguga

SEQ ID NO: 65279 - RNA, 3648 nt, Artificial Sequence
  derived and/or modified sequence opt3 from ZSWIM6__Homo_sapiens__NP_065979
auggccgagagaggccagcaacccccuccagcuaagaggcugugcugucggccgggaggagguggcgggggaggcgguagcuccgggggaggcggcggggcaggagguggcuacucuucagccugccgccccgggccucgagcgggaggcgcugccgcagccgcugcauguggugggggagccgcucucggccuucugccacccggcaaaacccagaguccugaaucuuuguuagacaucgccgcgcguagaguggcagagaaguggccauuccagagggucgaggagcgguuugaacgcauucccgagccuguucagagaaggauaguguauugguccuucccacggucugagcgcgaaaucugcauguacucgucauuuaacacagggggaggugccgcuggcgggccgggagaugacagcggcggugggggcggagccggcgggggagguggcgggggaaguuccucuagccccgcagcuacuuccgccgcggccacgucagcagcugccgcugccgcagccgcugcggcagccgcugccgcagccgcuggcgccggugcaccuaguguaggggcggcuggcgccgcagauggaggcgacgagacccgacugccauucagaagggggauugcccuacucgaaagcggauguguggauaauguccugcaaguggguuuucaccuuucuggcacaguuacugagcccgcuauccaguccgagccugaaaccgugugcaacgucgccauuucauucgaccgguguaaaaucacaagcgugaccugcaguugugggaauaaggauauauuuuauugcgcacauguaguugcucugucuuuguaccguauccgcaaaccagaccaggugaagcuccaucugcccauuuccgagacucuguuccagaugaacagagaucaacuccagaaguuuguccaguauuuaaucacagugcaccacaccgaagugcugccgacggcccagaaacuugcggacgagauuuugagccaaaauucggaaaucaaccagguccauggagccccugaucccacugcuggcgcaucuauagacgaugagaauuguuggcaccuggacgaggaacagguucaagaacaggugaagcuauuccucucccaggguggguaccacggcucaggaaaacagcugaaccuucuguuugccaagguaagggaaauguugaaaaugcgggacaguaauggcgcucgaaugcucacccugauuacagagcaauucauggccgauccacgcuuaagccuguggagacagcaggggacugcaaugaccgacaaguauaggcagcucugggaugaacuuggagcgcuguggaugugcaucguguugaacccucauugcaagcuagagcaaaaagccuccuggcugaagcagcucaaaaaguggaauagcgucgacgugugucccugggaggauggcaaccacgguagcgaacugccaaaucuuacaaacgcucugccccagggggccaaugcaaaccaggacucaaguaaccggccucaucgcaccguuuuuacgagagcuauugaggccugcgauuugcacuggcaagacucccaccuccagcauaucaucagcucugaucuguacacuaauuacuguuaucacgacgauacagaaaacucauuauucgacaguaggggauggccacuguggcaugagcacgugccgaccgcaugcgcccgugucgacgcucuacggagccauggcuacccccgagaagcgcucagacuggccauugcaauagugaauacucuuaggcgccagcagcaaaaacaguuggagauguuccggacacagaagaaagagcugccucacaagaacaucaccuccauuacgaaucucgaagguuggguaggccacccacuggaucccguugggacccuuuucucuucgcugauggaggcuuguagaaucgacgaugaaaacuugagcggauucuccgacuuuacagagaauaugggccaaugcaagucacucgaguaucagcaucugccugcccacaaauucuuagaagagggggaaaguuaccugacucuagccguggaggucgcucucauaggacugggccagcagaggauuaugccagauggucuuuauacccaagaaaaggugugucgcaacgaggagcaguugaucucuaaacugcaggaaaucgagcucgacgauacacuggucaagauuuuucgaaaacaggcaguguucuuacuggaagccgggcccuacagcggacuuggcgagaucauucaucgggaauccguuccgaugcacacuuuugcgaaguauuuguucaccucacuccugccucacgacgcugagcuagccuacaagauagcacugcgugccaugagacuccuggugcuugagagcacagcuccaucuggugauuugaccaggccccaucacaucgcauccguagucccuaaucgcuacccccggugguuuacucugagucauauugaaagccaacagugcgaguuagccucuacgaugcucacagcggcuaaaggcgacgugagaaggcuggaaaccguucuugaguccauccagaagaacauccacucaaguagccauauuuucaaacuggcccaggaugcauuuaagauagccacuuugauggacucgcucccagauaucacccugcuaaaagugucccuggaacucgggcugcaagucaugcgaaugacacuuucuaccuugaauuggcgccggagagagauggugagguggcugguaacuugugcuacagaggugggaguuuaugccuuagacagcauuaugcagacgugguucacccucuuuacuccuacagaagcaaccucaaucgucgcuacaacugugaugaguaacuccaccauugugcgucugcaccuugacugccaccagcaagagaagcuggccucuagcgcgcgcacgcuagcccuccagugugcaaugaaggauccccagaauugcgcucuguccgccuugacccugugcgaaaaagaccauaucgcuuucgagacagcauaccagauagucuuagaugccgccacuaccggcaugucauauacacaacucuucacuaucgcucgguacauggagcacagaggguauccaaugagggcguacaagcuggcaacccuugccaugacgcaucugaacuugagcuauaaucaggacacacacccggcuauuaacgauguucucugggccugugcacugagucauucucuagggaaaaacgaacuggccgcuaucauuccucuuguggugaaguccguaaaaugcgcgaccguccucagcgacauccugcgacgguguacuuugacaacccccggcauggugggucugcacgggcgcagaaauucgggaaaguuaaugucacucgauaaggccccacugaggcagcuucuggacgcaacuauaggcgcuuacauuaacaccacacacucucgguugacgcauaucaguccccgacacuacuccgaguuuauugaauuucucagcaaagccagagagaccuuucugauggcacaugauggucacauccaguucacucaauuuauagacaaucuaaagcagaucuauaaaggcaagaaaaagcugaugaugcuuguucgcgaaagguucggguga

SEQ ID NO: 65280 - RNA, 2340 nt, Artificial Sequence
  derived and/or modified sequence opt3 from ZW10__Homo_sapiens__NP_004715
auggccagcuucgugaccgagguccuggcucacuccggcagacucgaaaaggaggaccuugggacaaggaucucucggcugacucgccgaguugaagagauuaaaggagaagugugcaacaugauaucaaagaaauacagugaguuuuugcccagcaugcaguccgcacaagguuuaaucacgcagguagauaagcugucugaggacauugaucuacucaaaucgcguaucgaaucagaggugagaagggaccugcaugucagcaccggcgaguucacagaucuuaagcagcagcuggaacgggacagugugguuuugucccuccugaagcaacugcaggaguuuucuacugccauugaagaguauaauugugcgcucaccgaaaagaaguacgugacaggggcucagcgcuuagaggaagcccagaaaugccugaaacuuuugaaaagcagaaaguguuucgaucugaagauccuaaaaucccucucaauggagcugaccauacaaaagcagaacauccuuuaucaccugggagaggaauggcagaaauugauugucuggaaguuuccuccaaguaaagacacuagcucucucgaguccuaccugcagacagaauuacaucuguauaccgagcaaucacacaaggaagagaaaacgccgaugcccccuaucagcagugugcuccuugcauucucuguacugggcgaguugcauuccaagcuaaagagcuuuggucagaugcugcucaaauacauucugaggccacuugccucgugccccucucugcacgcuguuaucgaaucccagccuaauauagugauuauccgguucgagucaauuaugacuaacuuggaauauccaagucccagcgaggucuuuaccaagauccgccucgugcuggaaguguuacaaaaacagcugcuagaucucccucuggacacagaucuugagaaugagaagacuuccaccgucccauuggcagaaaugcugggggacaugaucugggaggaucucucugaaugucugauuaaaaacugccuuguuuacagcauaccgacaaauucaaguaagcugcagcaguacgaggagaucauucaauccaccgaagaguucgaaaacgccuugaaggagaugcgauuucucaaaggagacacgacugaccuguuaaaguaugcuagaaauaucaacagccacuucgccaauaaaaagugucaggaugugauaguagcggcaaggaaccugaugacaucugaaauucauaauaccgugaaaaucauccccgacucaaagauuaacgucccugagcuaccaacucccgaugaggacaauaagcucgaagugcagaaaguuaguaacacacaguaccacgaggugaugaaccuggaaccugagaauacccuugaucaacauagcuuuuccuugccaacgugccggaucucugaaucggucaagaaacugauggagcucgccuaucagacccuguuagaggcuacaacuagcuccgaccagugugccgugcagcuguucuacucaguacguaacauuuuccaccuuuuucacgauguugugcccaccuaucauaaggaaaauuugcaaaaacucccgcagcuggcagcuauacaccauaacaauugcauguacaucgcccaccaucuacugacacucggccaccaguuccgccugagacuugcgccuauuuugugugacggcacugccaccuuugucgaucuggugcccggguucaggcgguuaggaacagagugcuuucucgcacagaugcgagcucaaaagggugaacugcuugagcgccugaguucugccagaaacuucagcaauauggacgaugaagagaacuauuccgcugccucaaaggcagucaggcaaguguugcaccagcucaaacggcugggcaucguuuggcaggacgugcuaccaguaaauaucuacugcaaggccauggggacccugcucaacacugcuauuagcgaggucauaggaaaaaucacggcgcuggaagacauuucuacagaggauggcgaccgccuuuacuccuuguguaagaccgugauggaugaagguccucagguuuuugcaccccugagugaggagagcaaaaauaagaaauaucaggaagaggugccagucuacgugcccaaguggaugccuuucaaggaauuaaugaugaugcuccaggccucucugcaagagaucggggacagaugggcugauggaaaaggcccacuugccgcagccuuuuccucaagugaaguaaaggcucugauuagggcccuauuccagaacacugagcgucgggcagcggcucucgccaaaaucaaguga

SEQ ID NO: 65281 - RNA, 1434 nt, Artificial Sequence
  derived and/or modified sequence opt3 from ZWILCH__Homo_sapiens__NP_001274752
auggcccacaaccccaauaugacccaucugaagaucaaccucccugugacagcacuuccaccgcugugggucagaugcgacagcuccgaucccgagggcacuuguugguugggggcugaauuaauuacgaccaauaacucuauaacaggaaucguucuguacgugguaucaugcaaagccgacaagaauuauagugugaaccuagagaaucucaaaaaccugcacaagaaaaggcaucaccuuagcacugucaccuccaaggguuucgcgcaguacgaacuguuuaagucuucggcuuuggaugacacaauuaccgccucacaaacugcaaucgcccucgauauuagcuggaguccuguggacgagauccugcagauaccaccccuguccucuacagcuacccucaauaucaaaguugaaagcggcgagccucgggggccauuaaaccaucuguaucgcgagcuuaaguucuugcuggugcuagcagauggacuccgaacgggcgucacugaauggcuggagccccuugaagccaaauccgcuguggagcugguacaggaguuuuugaaugaccucaacaagcuggaugguuucggggacucaaccaaaaaggauacagaaguugagacuuuaaagcacgacaccgccgcgguggaucguagugucaaaagacuguuuaaggugaggagcgaccucgacuucgcagaacagcuuugguguaaaaugucuuccucagugauuagcuaccaagaucuggucaagugcuuuacauugaucauucagagucuacagcggggagacauccagccuuggcugcacucuggcuccaauagccuccugucgaaacuuauacaucaaucuuaucacggcaccauggauacgguuucccugucagggacuauuccagugcagauguugcucgagaucggacuggacaagcugaaaaaggauuacauuaguuucuuuaucggucaggaacuggccagccuaaaccaucucgaguauuucaucgcuccguccguagacauucaggagcaaguguaccgcguccagaagcugcaccacauacuugaaaucuuggugucuuguaugcccuuuauuaaaagccagcaugaguuacucuucucacugacacaaaucugcauaaaguacuauaaacagaauccucuugaugaacagcacauuuuucagcugccaguuagacccaccgccgugaagaacuuguaccaaagugagaaaccucagaaguggagggucgaaaucuauuccggccagaagaaaaucaagacuguguggcagcucagcgacucuucaccaauugaucaucugaacuuccacaaacccgacuucagugaguuaacacugaaugggagccuagaggaacggaucuuuuucaccaacaugguaacguguucccaaguucauuuuaaguga

SEQ ID NO: 65282 - RNA, 693 nt, Artificial Sequence
  derived and/or modified sequence opt3 from ZWINT__Homo_sapiens__NP_001005413
auggaggccgcugaaaccgaggcagaagccgcggcucuggaggugcucgccgaagucgcaggcauccuugagcccguugggcugcaggaggaagccgaguugccugcuaagauuuuaguggaguucguaguggacagccagaaaaaggauaaacugcuaugcucccaacuccaggucgcagacuuucugcagaacauacuugcccaagaagauacagcuaagggacuggacccauuggccucugaggauacuucaagacagaaagcgaucgcagccaaggaacaguggaaggagcucaaagcuacguacagggaacacguggaggccauuaagaucggucugaccaaagcacugacacagauggaagaggcucaacggaagcgcacucagcuccgagaggccuucgaacaguuacaggcgaaaaagcaaauggccauggagaagcguagagcaguucagaaucaguggcaacugcagcaggaaaaacaucuucagcacuuggcugaggugagugccgaaggcaagcugcuauuuccggaggcugaggccgaagcagagaaccuccccgacgauaaaccucaacagccaaccaggccccaggaacagagcacaggggacaccaugggacgggauccuggcgucuccuucaaggccgugggucugcaaccagcuggggacguaaaucuucccuga

SEQ ID NO: 65283 - RNA, 1719 nt, Artificial Sequence
  derived and/or modified sequence opt3 from ZYX__Homo_sapiens__NP_001010972
auggccgcucccagaccuagcccagcaaucuccgugucugucucagccccggcguucuacgcuccccagaagaaauuuggcccuguuguggccccaaagcccaaaguaaacccuuucaggccaggggacagugagcccccuccagcaccgggagcccaacgggcucagaugggucgcgugggcgaaauucccccuccacccccugaggauuuuccacugcccccgccuccccucgcaggggacggagaugacgccgaaggcgcucuugguggggccuucccaccucccccacccccuauagaggaauccuuuccaccggcgccccuggaggaggaaaucuucccuuccccacccccuccacccgaggaagagggaggcccggaggcaccuauuccacccccuccccagccacgagaaaaggucucuucgaucgauuuggagauugacucauuaagcagucugcuagaugacaugaccaaaaaugauccuuuuaaggcccguguguccucuggcuauguucccccaccgguggcuacaccuuucagcuccaagucaaguacuaaacccgccgcagggggaacggcuccacugcccccuuggaaaagcccaucuuccucacagccccucccucaagucccggccccagcgcagagccagacccaguuucacgugcaaccccagccucagccaaaaccccagguacaacuucauguucagagucagacacaaccugugucucuggccaacacucagccgagaggucccccagcauccagcccugcucccgccccaaaguucucgccugucacccccaaauuuacaccaguggcuucuaaguucuccccgggcgccccugggggaucaggcagucagcccaaucagaaguugggucacccagaagcacucagcgccgggaccggaagcccccaaccuccaucuuuuacuuacgcucagcagagggagaaaccccgggugcaggaaaagcaacauccugucccgccacccgcgcagaaccagaaucagguucgcagcccuggcgcacccggcccacugacacugaaagagguggaggaacucgagcaauuaacccagcagcugaugcaggacauggaacacccucaaagacagaacguagccgugaaugagcuuugcgggaggugucaucagcccuuggcucgggcccaaccagcaguccgcgcccugggacagcuauuccacaucgcuugcuucacgugucaccagugcgcccagcaacuccagggucagcaguuuuauucacuggaaggcgcaccuuacugugaggggugcuauacugauacccuugagaaguguaacacaugcggagaaccgauaacugaccgaaugcugagagcgaccggcaaggcuuaccauccccacuguuucacaugcgugguuugugccaggccauuggaggguaccaguuuuaucguggaucaagcaaaucggccucauugcguccccgacuaucacaagcaguacgccccacguugcuccguguguagcgaaccuauuaugcccgagccggggcgcgacgaaacgguaagaguuguggcucucgauaaaaacuuccacaugaagugcuacaagugugaggacugcggcaaaccacugucuaucgaggccgaugacaauggauguuuuccuuuagauggccauguccugugcaggaagugucacacugcacgggcucagacauga

SEQ ID NO: 65284 - RNA, 8886 nt, Artificial Sequence
  derived and/or modified sequence opt3 from ZZEF1__Homo_sapiens__NP_055928
augggcaacgcccccagccacuccucugaggacgaagcugcagccgcggggggagaggguuggggcccucaucaggauugggcugccgugucagggaccacaccaggaccgggcgucgcagcccccgcucugccuccagcagccgcucuccuugaacccgccagacugagggaggcggcagccgcuuuguuaccuacuccacccugcgaaagucugguuagccggcaccgcggugcccuauuccgauggcucgaggagcgucuggggagaggagaagaguccgugacgcuugaacaauuuagggagcuguuggaggcacggggcgcuggcuguucuucggaacaguucgaggaagccuuugcgcaguucgacgccgagggggauggaaccguagacgcagaaaauaugcucgaggcucugaagaacucaagcggugccaaucugcagggcgagcucagucauaucauucgccaauuacaggcuugcucccuggugccuggguuuacagauauauucucugaaagcaaagagggacuugacauccacuccucaaugauuuugagauuucugcauaggaaccggcuaaguagcgccgucaugccauacccgaugcucgaacacuguaauaacaugugcacuaugcgcucuuccgugcugaaggagucacuugaucagcugguucagaaagaaaaggagagccccggcgacuugacccgaaguccugagauggauaaacucaagucuguggcaaaguguuaugccuacaucgaaacauccagcaauucggcugacauugauaaaaugaccaacggugagacuucuuccuauuggcaaucagacgggagugcgugcagccacuggaucagacugaagaugaaaccagaugucguguuaaggcaucuguccauagcaguagccgcuacagaccagucuuacaugccccagcagguuaccguggccgucggacggaaugcaagcgaccuccaagaagugcgugaugugcacaucccuucaaacgucacgggcuauguuacucuucuggagaaugccaacgugagucaguuguacguacagauuaauaucaagcgcugucuauccgacggcugcgauaccagaauucaugggcugagggcugugggauuccaacgggucaaaaagagcggugugucuguuucagacgccagugcaaucugguauuggagccuccugacaucccuugugacugcgucuauggaaaccaacccagcuuuuguccagacagugcugcacaauacccagaaggccuugcgacacaugcccccgcucucgcugagcccuggcuccacggauuucucaacuuuuuuaagucccaacguacuggaggagguugacucuuuccuaauacgcauuacaagcuguugcuccaccccagaaguggagcucacucugcuugcauuugccuuggcuagagggucagucgccaaagugaugagcucucuguguacaaucaccgaucaucucgacacgcaguacgaugcauccagucugauucuuagcauggcuucugucaggcaaaaccuguugcucaaguacggaaaaccucugcaguuaacccugcaggccugcgacgugaagggcaaagaagauaaguccggucccgagaaucuacucguugagccauggacacgggacggguuccugacugaaaccggcaaaacacgcgcgucaacuaucuucaguaccggaacagagagcgccuuucaggugacccaaaucagaauuaugguaaggcguggcgggauaggagcucagugcggucuugucuucgcauauaacucguccucugacaaguuuugugccgaagagcacuucaagcgguuugaaaaauacgauaaguggaaauugcaggagcugcgacaguucgugaagagcagaaucggcugcucaagugacgaucucggggaggacgaucccauuggaugguuugaacuggaggaagagugggacgaagcugauguuaaauuacaacaguguaggguggccaaguaucugauggucaaguuccuuugcacucgccaggaguccgcagagcgguugggcgugcagggucucacgaucucuggguaccugagaccugcgagggccgaagcugagcaaagcguaacaugugcccauugccgcaaagacaccgaagaguccguguguggcgcaacucuacugcuccgaacccugcaguuuauacagcaacuugcucacgauuugguucagcagaaggaaucaggacugaaauauaagagcuucuuagacuuugccggccucgaucugcagauuuucuggaauuuuuacaguaaacuuaagcaaaacccacgggaggagugcgucucugcacagacacuguugcuccagcugcuacaguccuguuucagcgugcugcaaggggacgugcucgccgcuucggaagaggaaaaggcgccgauccagucacccaaaggagucgaggccgcaaaggagcuguauacccaucuuugcgauguuguggacaaaguggacggugauucuguaccuauggaaaucuugaagcaggagguccguaauacucuguuaaacggcgcugccauuuucuuuccaaauagacagacaaggcgcaaccaccucuucacgaugaugaaugugaccgaacaagagcacaaacagagucugcagcuuacuuuucggucccuguguacauacuucagcgacaaggaucccgggggacuacuccuguugccugaaaagaacgaccuggccaaaaugaauaucucugagguuuuagcugugauggauacccucgucagcguggcagccagagagugcgaacugcuuaugcuguccggcgcgccaggugagguugggucaguguuguuuagucucuucuggagcguacaaggcucucugcuauccuggugcuaccugcagcuuaagucaacagacaguggagcuaaagaucucgccgucgaccugauugaaaaguaugugggccaguuuuuggcaagcaugagggccauacuggaguccuuauucucucaguacucggggaaaacuaucguggaacgacucuguaacagcgucuuuucaauggcugcacgccaacugguuauuuuccuucuggauuuuugcaccuuggacaucccccauugugugcuccugcgggaguucuccguacuaacggagcugcuuaagaaacucugcaguggaccggaaggcggucugagaaaguuggauguggagaccuggcagcaggaacagccugucguguuacacacauggacuaaggagucugcccauaauuaugaaaacaauugucacgagguuagcguguuugucuccccaggggcgaccuacuucgagguggaauucgacgauaggugcgagacagaaaaacguuaugacuaccuggaguuuacugacgcucgcggacggaagaccagauaugauacgaaaguuggcacagacaaguggcccaaaaaggugaccuucaaggccgguccuaggcuccaauuucuguuccacucagauucuagccauaacgaguggggcuacaaauuuacugucacagcaugugggcuucccgacguagccgugaguuggggacuggauuugcagcuacugguuucccgacucaugggccggcuggcuagccagugcauggcccuuaagucugugcgccaguuagggucaaacauggucgugccacaagcaaaaauggcucugguacucuccaguccuuuguggaagcccguguucagacaccaggucuguccagaacuggagcucgaagccagcuggccgacccauccucacaggaauucgaaagagguuaagaacauccccgacgauccaugccggcauuuucugcuugacuucgcgcagucugaacccgcccagaauuuuuguggaccuuacuccgagcuguucaagggcuuuauucaagcaugccgaaaacaggcuccaaagacugauauaguggccgguagcaccaucgaccaggcugugaacgcaacauucgccgccuuggucuauagaacgcccgaucuauacgagaaacugcaaaaguaugugaauucagggggaaaaauugcucucagugaagaguucgcgcagguuuacucuuuagcagacggcauccgcauuuggaugcuggaaaugaagcagaagucccuuaugagccuggguaacgaggccgaagagaaacacucaagugaggcuaccgaaguaaauccugagagccucgccaaggaaugcaucgagaaauccuugcugcuccugaaguuucuuccgacuggcauaucuagcaaagaauccugugagaagcuagagacagcagacgaaaccucacaccugcagccauugaacaaaaggcaacguacaucuaguguggucgaggaacauuuccaggccucggugagccccacugaggcugcgccuccagccaccggggaucagucccccggauuaggcacgcagccuaagcugccgucuucaagcgggcuccccgcagcugacguuuccccagccacagcagaggaaccucugagucccucuaccccaacucggagaccucccuuuaccaggggacgccuucgacugcucagcuucagaucaauggaggaagcccgguuggugccaacagucaaggagaaauauccggugcugaaggauguaauggacuuuaucaaagaucaaucccuaagucacaggagcgucgugaagguucugucucuccgcaaagcucaggcccaguccauucuugaagugcugaagaucacucagcauugcgcggagucauuaggccaaccucacuguuuccaucccccauuuauuuuguuccugcucgagcugcuuaccugccagaaggacuuuacaaauuacuucggucaccuggaaggguguggagcagaucuccacaaagagauccgugacacguauuaccaguugguccuguuuuuagugaaggccguuaaaggcuucagcucgcuaaacgauagaucucugcuccccgcucuuaguugcgugcaaaccgcccuguugcaucugcucgacauggguugggaaccuaaugaucuggcuuuuuucgucgacauacagcuuccagaucuccugaugaagaugucccaggagaacauuagcgugcacgacucaguaaucucccaguggucugaagaggacgaguuggcagaugccaaacaaaauagcgaauggauggacgagugucaggauggcauguucgaagcuugguacgagaagauugcccaggaagaccccgagaagcagcggaaaaugcauauguuuaucgcaagguauugcgaucuguuaaacguggacauaaguugugaugggugcgacgagaucgcgccuuggcaccgcuaccgaugucuacaaugcuccgauauggaccugugcaagacuuguuuccucggaggcguuaaaccggaagggcacggagaugaccaugagauggucaauauggaauuuacaugcgaucacugucagggccuuauuaucgguagacggaugaacugcaacgugugugacgacuucgaucugugcuauggguguuacgccgcuaagaaauauagcuacggacauuugccaacccacucuauuacugcccaucccauggugacaaucaggauaucagaccgccagagacugauucagccuuauauccacaauuacaguuggcuccuguuugcagcucuugccuuauacuccgcacaccuggccagcgcugaggaugucgacggcgagaagcucgauccccaaaccaggucuucggcgacgacuuugcggucacagugcaugcagcugguaggcgacugucuaaugaaggcccaucaggggaaaggacugaaggcacucgcucuucuggguguguugccagauggcgacagcucccuggaagaucaagcccucccuguuaccgugcccacaggggccagugaggaacagcuggagaaaaaggcaguccagggagcugaauuaucugaggccggcaacgguaaacgugcggugcacgaggaaauccgcccaguugacuucaagcaacgaaauaaggcugauaaaggggugagccuuuccaaggacccuucaugccagacccagauuagugacucuccggccgaugcaagccccccaacuggacugccugacgccgaggauuccgaagucucaagccagaaacccaucgaggaaaaggcugugacaccaucuccugagcaaguauuugcagaguguucccagaaaagaauucucggccuacuggccgcgauguugcccccgcugaagaguggcccaaccgugccucucauagaccuugaacauguucugcccuugauguuccaggucgugaucagcaacgcugggcaccugaaugagacauaucaccucacuuuaggacugcuuggucagcugauuaucaggcuacucccagccgaaguggaugcagccgucauuaaaguucugucggcuaagcauaacuuguuugccgcaggcgacuccucuaucgugcccgauggguggaagaccacgcaccugcucuucucacuuggagcuguaugccuggacagccgggugggcuuagauugggccugcaguauggcggagauacugcgcuccuugaauucugccccucucuggagagacgucaucgcaacauuuaccgaucauuguauuaaacaacugccguuccagcuaaagcacacuaacaucuuuacccuucuggugcucguugguuucccccaggugcugugcgucgggacaagguguguauacauggacaaugcuaacgaaccacauaaugugauuaucuugaaacacuucacugagaagaaccgggccguuauaguggaugucaaaacccgaaagagaaagacggugaaagacuaucagcugguccaaaagggaggcggccaggagugcggggacagccgcgcacagcucucacaauacucccagcacuuugcuuucauugccagucaucuucugcagagcucuauggauucacacuguccugaagccguggaggcgacauggguuuuaucccuggcuuugaaaggacucuauaagacccugaaagcacaugguuuugaagagaucagggccacuuuccuacagacagaccuucugaagcuccuggugaagaaaugcagcaagggcaccggguuuucuaaaacuugguuguuacgggaucuggagauccucaguauuaugcuuuacucguccaagaaagaaauaaaugcucuggccgagcacggagaccuagaacuggaugagcguggcgacagagaagaggagguagaaaggcccgugagcucaccuggugauccagagcaaaagaagcucgaccccuuggaagggcuggaugagccuacacgcaucuguuuccuuauggcacacgacgcccugaacgcuccacuccauauuuuacgggcgaucuaugaacugcagaugaaaaagaccgauuacuuuuucuuggagguccagaaacgauuugacggagacgagcugacgacugaugaaagaauuaggucucucgcccagcgcuggcaacccagcaagucccuucggcuggaggaacagagugcaaaagcuguugacaccgauaugaucauacuaccgugccugucaagaccugcccguugugaccaggcaacagccgagucuaauccagugacccagaagcucaucagcuccacagaaagugaguugcaacagagcuacgcuaaacagaggcgguccaagucugccgcgcugcuucacaaggagcugaacugcaaaucaaagcgcgcaguccgagauuauuuauucagagugaacgaagccacugcuguacucuacgccaggcaugugcuggcaagcuugcuggcugaguggcccucgcacguuccuguguccgaagacauucucgagcuuaguggcccagcccauaugaccuauauccuggauauguuuaugcaacuagaggaaaaacacgagugggaaaagauucugcagaaaguccuccagggcugucgggaggacauguuggggacgauggcucuggccgcaugccaguucauggaagagcccggaauggaggugcaaguccgcgaaucuaagcacccguacaauaacaauacaaacuuugaggauaaggugcauaucccuggugcgauauauuuaagcauuaaauucgacucacagugcaauacugaagagggcugugaugaacuugccauguccucuaguagcgacuuccagcaggauagacacuccuuuucagggagccaacagaaguggaaagacuucgagcugcccggagacacccucuacuauagguuuacaucugauaugaguaacaccgaguggggcuaccgauucacuguuaccgcuggucaucuggggcgguuucagacaggauucgaaaucuugaagcagaugcuguccgaggaacguguagugccacaccucccucuugccaaaaucugggaguggcuggucggcguggcaugcagacaaacgggccaucagcgccuaaaggcuauucaccuguuacucaggaucguucgguguugcgggcacagcgaccugugugauuuggcccuucugaagccccucuggcagcuguuuacucauauggaauacggauuguucgaggacgugacccagccagguauacugcuaccccuccacagagcacuuacagagcuguuuuucgucaccgaaaaucgcgcccaagaguuaggcgugcugcaggauuaucuccuggcguugacuacagacgaucaucuucugaggugcgcugcccaggcacuccaaaacauugccgcuaucucacuggccauuaauuacccuaacaaagcaacccgacuauggaauguagaauguuga

SEQ ID NO: 65285 - RNA, 1515 nt, Artificial Sequence
  derived and/or modified sequence opt3 from ZZZ3__Homo_sapiens__XP_011539507
auggccgcuagcagauccaccagggugacacggucuacugucggccugaacgggcucgacgagucauucugcggacgcacgcuucgaaaucguaguaucgcacaccccgaagagauuagcuccaacucucagguuagaucgaggucaccuaagaaacggccagaaccggugcccauacaaaaggguaauaacaauggccgcaccacagaucugaaacagcagagcacuagagagaguuggguauccccuaggaagcggggguugucuagcuccgaaaaagacaacaucgagcgccaggccauugagaauugugaacgaagacaaaccgagccagugucacccgucuuaaagaggaucaagcggugccugcguagugaagcgccuaacagcucugaggaggauuccccaauuaaaucagacaaggaaagcguggagcagcgcaguacaguuguggauaaugacgcugauuuucagggaaccaaaagagccuguaggugccuaauccucgacgauugugaaaagcgggagaucaaaaaggucaacgugucugaagagggcccccugaauagugcaguaguugaggaaauaacugguuaccuugccgugaacggggucgacgauagcgacucggcugugauuaauugcgaugacugucagccugacggaaacacaaagcaaaauucuaucggcuccuaugugcugcaggagaaaucagucgcagaaaacggcgauaccgacacgcagacuuccauguucuuggauagccgaaaggaggacuccuacauugaucauaaaguuccaugcaccgacucucaggugcaaguaaagcucgaagaucacaaaaucgugacagccugucugccggucgagcaugugaaccagcugacuaccgagcccgcuacagggccuuuuagcgaaacccagucaagucuccgcgacuccgaggaagagguugauguggucggagacagcucugccucaaaggaacaaugcaaagagaauacgaacaaugaguuagauacaagucuggaaagcaugccagcguccggugagcccgaaccuucuccagugcuugacuguguaucggcacagaugaugagcuuguccgagccccaggagcacagauauacucugaggaccucaccgcggcgcgccgcuccuacuagaggcagucccacaaagaacucuagcccauacagggaaaaugggcaguucgaggaaaacaaucuauccccuaacgagaccaaugccacgguuucagacaacgugagccaaucucccaccaauccaggagaaauaucccagaacgagaagggcauuugcugcgauagucagaauaacgguagcgagggggucucuaaacccccuuccgaagcacgucucaauaucggacaucugccaucagcuaaggagagugccagccagcacauuacagaagaggaagacgaugacccggauguguauuacuuugagucggaccacgucgcgcuuaaacauaacaaggaguauguguga

SEQ ID NO: 65286 - RNA, 1245 nt, Artificial Sequence
  derived and/or modified sequence opt5 from 37135__Homo_sapiens__NP_443070
augagccaccaugacgauggcgccaccguggggcugggaauccagaugugcgagggcuggagagucgaagcugcccucuccuuccugccccaccaacggaaguggggagagacagcgggggcuguuauggccggcggggugauggacaaagaauacgugggauuugccgcucugccuaaccagcugcaucgcaagucugucaaaaagggcuucgauuuuacgcucaugguggccggcgagagcgggcugggaaaauccacccuuauuaauucucuguuccucacaaaccuguaugaagacagacagguuccggaggcuagcgcccggcugacccagacacucgcgaucgagcgcagaggcguggaaauugaggaagggggagucaaggugaagcugacccuuguugauacacccggcuuuggggacuccguggauuguucugacugcuggcugccugucgugaaauucaucgaggagcaauuugaacaguaccuccgggaugagagcggacugaaucgcaagaacauucaggacuccagagugcacuguugccuuuauuucaucagccccuuuggccggggccugcgcccucucgaugucgccuuccugagagcuguucaugaaaaagugaauaucauucccgugaucgggaaggccgacgcucugaugccucaggagacccaagcccucaaacagaagauucgggaucagcugaaggaagaggagauccacauuuaccaguuuccggaaugugacucugacgaggaugaagacuucaaacgccaagaugcggagaugaaggaauccauccccuuugccgucgugggaagcugcgagguugugagagacggcgggaaccggccuguccgcggaagacgguauucuuggggcacgguggagguugaaaauccccaccauugugauuuccuuaaccugagacgcaugcucgugcagacccaccuucaggaccuuaaagaggucacacaugaucugcucuacgaaggguaucgggcuagaugccugcaaucccuggcccgcccuggagcucgggacagagccagccgcucuaagcucucccggcagagcgccaccgagauuccccugccgaugcuuccucuggcugauacagaaaaacucaucagagagaaggacgaggaacugcgccggaugcaggagaugcuugagaaaaugcaggcgcaaaugcagcagucccaggcccaaggcgaacagucugaugcucuguga

SEQ ID NO: 65287 - RNA, 1086 nt, Artificial Sequence
  derived and/or modified sequence opt5 from 37500__Homo_sapiens__NP_001008492
augagcaagcagcaacccacccaguucaucaacccugagacaccgggcuacgugggguuugccaaucugcccaaccagguccacagaaaauccguuaagaaaggauucgaauuuacgcucaugguggugggcgagucugggcugggaaagagcacccuuauuaauucccuguuccucacagaccuguauccugaacgggucauccccggcgcugccgagaaaauugaacgcaccgugcagaucgaggcgucuacaguugagauugaagagagaggggugaagcugcggcugaccgucguggauacaccuggauacggcgacgcuaucaacugccgcgauuguuuuaagaccaucauuagcuauaucgacgaacaauucgagagauaccuccaugaugaguccggccugaaucggcgccacauuaucgacaacagaguucauugcuguuuuuauuucauuucucccuuugggcacggacugaaaccucucgauguggccuucaugaaggccauccauaauaaagucaacauugugccggugaucgcuaaggccgacacgcugacccuuaaagaacgggagcgccugaagaagagaauccucgaugaaauugaggaacacaauaucaaaauuuaccaccuucccgacgcugagagcgaugaggacgaagauuuuaaggagcagacacggcuucugaaagccuccaucccuuucagcgucguuggcucuaaccagcucauugaagcgaaggggaaaaaggugcgcggaagacuguaucccuggggcguggucgagguggaaaauccugagcauaacgacuuucugaaacuccggaccaugcugaucacacacaugcaggaccuucaagagguuacccaggaucugcauuacgaaaauuuccgcuccgagagacucaagagagggggacggaagguggaaaacgaggacaugaauaaagaucagauccugcuugaaaaggaggccgagcugcgccggaugcaggaaaugauugcuagaaugcaagcccagaugcagaugcaaaugcagggcggcgacggggauggaggcgcucucgggcaccacgucuga

SEQ ID NO: 65288 - RNA, 1053 nt, Artificial Sequence
  derived and/or modified sequence opt5 from 37865__Homo_sapiens__NP_061979
augagcaagggccugcccgagaccagaacagacgccgcuauguccgaacucgugccugagccgcggcccaaaccugccguccccaugaagccuaugucuaucaacagcaaucugcuuggguacauuggaaucgauacgauuaucgaacagaugcgcaaaaagaccaugaaaacaggcuucgacuuuaacauuaugguuguggggcaauccggacugggcaagucuacccucgugaauacacuguucaagagccaggucuccagaaaagcgucuagcuggaaccgggaggaaaagauccccaaaaccguggagaucaaggcuauugggcacguuaucgaggaaggaggcgugaaaaugaaacuuacagucauugauaccccuggcuuuggggaccagaucaauaacgagaauugcugggaaccgauugagaaguauaucaacgagcaguacgaaaaguuccugaaggaggaagugaauauugcccgcaaaaagagaauccccgauacgcggguucauuguugccucuauuuuaucuccccuaccggacacagccugcgcccccuggaccucgaguucaugaaacaucugucuaagguggucaacauuaucccugugauugccaaagcugauacaaugacccuugaagagaaguccgaguuuaagcaaagagugcggaaagaacuggaggucaauggcaucgaguucuacccccagaaggaauuugacgaagaucucgaggacaaaacagagaacgauaagauucgccaggaaagcaugccguucgccguuguggggucugacaaagaguaucaggugaauggaaagagaguccugggccggaagaccccuugggggaucaucgaaguggagaaccuuaaucacugugaauuugcucugcuccgcgauuucguuauuagaacgcaucugcaagaccugaaagaggugacacacaacauccacuacgagaccuaucgggccaagcgccucaacgacaauggaggccugcccccugucuccguggauacagaagagagccaugacucuaaccccuga

SEQ ID NO: 65289 - RNA, 1413 nt, Artificial Sequence
  derived and/or modified sequence opt5 from 38231__Homo_sapiens__NP_001185642
augcccggcuucuacagcgugaugaccgacgaggaaaucaagagauuucuggaggauacaacggacgauggggaacucuccaaauucgucaaggacuuuucuggaaacgccagcugccacccuccggaggcuaaaaccugggccucccggccccagguuccugaaccccgcccucaagcgcccgaucuguaugacgaugaccuugaguucagaccuccgucucggccccagagcuccgauaaucagcaguacuuuugugcuccugcuccccugucuccuagcgcccgccccagauccccguggggcaagcucgacccuuaugauagcucugaggacgauaaagaauacgugggguucgccacacugcccaaccaagugcaucggaaguccgucaagaaaggauuugacuucacccuuaugguggccggcgagagcgggcugggaaagucuacacucguuaauucccuguuucugaccgaccucuaucgcgauagaaaacugcuuggcgcugaggaacggauuaugcagacaguggagaucaccaagcacgccgucgacauugaagagaaaggcgugcgccugagacucacgaucguugauaccccuggguucggagacgcggugaacaauacagaaugcuggaagcccgucgccgaguacauugaucagcaguuugaacaauauuuccgggacgagagcggccugaaccgcaagaauauccaggauaacagagugcauuguugccuuuacuuuaucucucccuucgggcacggacugcggccucucgacguggaguucaugaaagcucugcaucagcgcgucaauauuguuccgauccuggccaaggcugauacccucacacccccugaaguggaccacaaaaagagaaaaauucgggaggaaaucgagcacuuuggcauuaagaucuaccaguuccccgauugugacuccgacgaagaugaggacuuuaaacugcaagaucaggcccuuaaggagagcauuccuuucgcggugaucggguccaacaccgucguggaagccagaggacgccggguuagaggccgccuguaucccuggggcaucguggaggucgaaaauccggggcauugcgacuuugugaagcuccggacgaugcugguuagaacacacaugcaggaucuuaaagacgugacccgcgagacacauuacgaaaacuaucgggcucaauguauucagucuaugaccagacuggucgugaaggagcgcaaucggaacaaacucaccagagagagcggaacagauuucccuauccccgccgucccucccggcacggacccugaaaccgagaagcugauucgcgaaaaagaugaggagcugcggagaaugcaggaaaugcuccacaagauccagaagcaaaugaaagagaauuacuga

SEQ ID NO: 65290 - RNA, 1041 nt, Artificial Sequence
  derived and/or modified sequence opt5 from 38596__Homo_sapiens__NP_001009939
auggacagccuggccgcuccccaggauagacucguggagcaacugcuuuccccucggacccaggcccagcgcagacugaaggacaucgauaaacaguacgucggcuucgcgacacucccgaaccaaguucaccggaagucugugaaaaagggguuugacuucacgcugaugguggcuggagaaagcggccuugggaaauccacccugguccauucucucuuucugacagaucuguauaaggaccgcaagcuccugagcgccgaggaaagaauuucccagaccguggagauccuuaaacacacaguugauauugaagagaagggagugaaacugaagcucaccaucgucgacacacccggcuucggggaugccgugaauaacaccgagugcuggaaaccuauuacggacuacguugaucagcaguuugaacaauauuuccgggacgagucuggacugaaucgcaagaacauccaggauaauagagugcauuguugccuuuacuuuaucagccccuucggccacggccugcggccugucgacgugggguuuaugaaggcucuccaugaaaaagugaacauugucccccugaucgccaaggcugacugucugguuccuuccgagauucgcaaacucaaggagagaauccgggaagagauugauaaauucggaauccacguguaucaguuuccggaaugcgacagcgaugaggacgaagauuucaagcagcaagaccgcgagcugaaagagucugcccccuuugcggugauuggcuccaauaccgucguggaagccaaggggcagagaguucggggacgccuuuacccuuggggcaucguggagggggcucugagacuccgggaagccgcucagcacgcccauccccacgcguaugccagaccucaaggacgcgauguccggagagcucugcgcgagcuuccccgggcccugcauccggcugacgaucagcagacagacccuggccagccccacggcgaaccucaccccgaucccgccgccgcucauccugggagacgcgacuga

SEQ ID NO: 65291 - RNA, 1305 nt, Artificial Sequence
  derived and/or modified sequence opt5 from 38961__Homo_sapiens__NP_055944
auggccgcuaccgacaucgccagacaggugggcgaggggugccggacagucccccuggcgggacacguuggcuucgauagccucccugaccaacuggugaacaaguccgugucucagggguuuuguuucaauauucuuugcgucggagaaacgggccuggggaaaagcacccucauggauacacuguuuaacaccaaguucgagggagaaccggcuacacauacccagcccggcgugcagcuucaauccaauacauacgaccugcaggagucuaacguucgccucaaacugaccaucgugagcacggucggcuuuggggaucagauuaauaaggaagacuccuauaaaccuaucguggaguucauugaugcccaguuugaggccuaccugcaagaggaacucaagaucagacggguucugcacaccuaucaugacucucgcauccacgugugucuuuacuucauugcucccacaggacauagccugaagucccucgaucuggucaccaugaaaaagcuggacagcaaagugaacaucauuccuaucauugccaaggcugaugccaucucuaaauccgaacugacaaaguuuaagauuaaaaucaccagcgagcucgugucuaauggcguccagaucuaucaguuccccacggacgaugaguccguugcggaaauuaacgggacaaugaaugcccaccuuccuuuugcugugaucggaagcaccgaggaacugaagauuggcaacaaaaugaugagagcccggcaguacccgugggggacagugcaagucgagaaugaagcucacugcgacuucgugaagcuccgcgagaugcugaucagaguuaacauggaggaccuucgggaacagacccauacccgccacuaugagcuguacagacgguguaaacucgaagagaugggauuuaaggauacagaccccgauucuaaaccuuucucccugcaggaaacguacgaggccaagcgcaaugaguuccuuggcgaacugcaaaagaaagaggaagagaugagacagauguuugugcagcgggucaaggaaaaagaggcggagcucaaggaagccgagaaagaacugcaugagaaguucgaccgccugaagaaacuccaccaggaugagaagaaaaagcuggaagacaaaaagaaaagccuugaugacgaggugaacgcuuuuaagcaaagaaagaccgccgcugaacugcuccagucccagggcucucaggccgggggaagccaaacacugaaacgggauaaggagaaaaagaauaaccccuggcuuugcaccgaauga

SEQ ID NO: 65292 - RNA, 1311 nt, Artificial Sequence
  derived and/or modified sequence opt5 from 39326__Homo_sapiens__NP_001011553
augagcguguccgccagaucugcugccgcggaggaacggagcgucaacuccucuaccauggcucagcaaaagaaucuggagggcuacguuggguucgccaaccuccccaaucagguguaucgcaaaagcgugaagagaggauuugaguucacacugauggucgugggcgaguccgggcuuggaaaaucuacgcugauuaacagccucuuucugaccgaccuuuacuccccugaauauccgggccccagccaccggauuaagaaaacaguucagguggagcagucuaagguccugaucaaggaagggggagugcaacuccugcugaccauuguugauacaccuggcuucggcgacgccguggauaauuccaacugcuggcagcccgucaucgacuacauugauagcaaauuugaagacuaucucaaugcugagucucgcgugaacagacggcagaugccugauaaucgcgugcaguguugccuguacuucaucgcccccuccgggcauggacuuaagccucuggacaucgaauuuaugaaaagacuccacgagaaggucaacauuaucccgcugauugcuaaagccgauacccuuacacccgaggaaugucaacaguucaagaagcagaucaugaaagagauucaggaacauaagaucaaaauuuaugaguuuccugaaaccgacgaugaggaggaaaauaagcugguuaaaaagaucaaagaccggcucccccuggcgguggugggcagcaacacgaucauugaggucaaugggaagcgcgugagaggacggcaauacccuuggggcguugccgaaguggagaacggggaacacugcgauuucaccauccugcgcaauaugcucauuagaacacauaugcaggaccugaaggacgucaccaacaacgugcacuacgagaauuaucggucucgcaaacuugcugccguuacauacaacggaguggauaauaacaagaauaaaggccagcugaccaagagcccccucgcucaaauggaggaagagagacgggaacacgucgccaaaaugaagaagauggagauggaaauggaacagguguuugagaugaaagucaaggagaaagugcagaagcugaaagacuccgaggcggaacuucagagacgccaugagcaaaugaagaagaaccuggaggcccagcacaaagaacucgaggaaaagcggagacaguucgaggaugaaaaagcuaauugggaggcccagcaacgcauccuggagcagcagaacuccucucggacgcuggaaaagaauaaaaagaagggcaaaaucuuuuga

SEQ ID NO: 65293 - RNA, 1761 nt, Artificial Sequence
  derived and/or modified sequence opt5 from 40057__Homo_sapiens__NP_001106963
augaagaaaagcuacuccggcgggaccagaacaucuagcggacggcugcgcagacucggcgacuccucugggcccgcccugaagcggagcuucgagguggaagaggucgaaacgccuaacuccaccccgccccgcagaguucagacaccucuucugcgggcuaccguggccucuagcacacaaaaauuucaggaucucggagugaaaaauuccgagcccagcgcgcgccacgucgacucucugucccagagaagcccuaaggcuucucuucggcgcguggaacuguccggccccaaggccgccgagccuguuagcagacggaccgagcucucuaucgauauuuccagcaaacagguggaaaacgcuggggccaucggaccgucccgcuucggccugaagagagcugagguccugggccauaagacacccgaaccugcgccccggcgcaccgagauuacgaucgugaaaccucaagagucugcccacagacggauggaacccccggccagcaagguuccugaggugcccaccgcuccugccacagacgcugcccccaaaagagucgaaauucagaugcccaagccugcggaggccccgaccgcucccuccccugcccagacacucgaaaauagcgagcccgcuccugugucucagcugcaaucccgccuugagcccaagccgcagccucccguggccgaagccaccccucggagccaggaggcuacggaagcggcccccucuugcgucggggauauggcugacacaccuagagaugccggacugaaacaggcccccgcuagccgcaacgagaaggccccgguugacuuuggcuauguggggaucgauuccauccucgaacaaaugcggagaaaagcgaugaagcagggauucgaguuuaauauuaugguggucggccagucugggcugggaaaaagcacccuuaucaacacacuguucaaguccaaaauuagccgcaagucugugcaaccuaccuccgaggaacggauccccaagaccauugagaucaaaagcauuacacaugacaucgaagagaagggcguuagaaugaaacucacggugaucgauacccccggcuuuggggaccacauuaauaacgaaaauuguuggcagccuaucaugaaguucauuaacgaucaguacgagaaauaucugcaggaggaagucaauaucaaccgcaagaagcggauuccggacacaagagugcauugcugucuguacuuuauccccgcuaccggacacucucuccgcccucuggacaucgaguucaugaaacggcuuuccaagguugugaauauuguccccgugaucgccaaagccgauacacugacccucgaagagagaguccacuuuaagcaacggauuacggcugaccugcuuagcaacggcaucgauguguauccucagaaagaguucgacgaagauuccgaggaccgccugguuaaugaaaaguuuagagagaugauucccuucgccguggucgggucugaucaugaauaccaggugaacggaaagcggauccucggcagaaaaacaaagugggggaccaucgagguugagaacaccacacacugcgaguucgcuuaucugcgcgaccugcucauucggacccauaugcagaauaucaaagauauuacaagcuccauccacuuugaagccuacagagugaagcgccugaacgaaggaucuagcgcgauggccaauggcauggaggaaaaagagccugaggcucccgaaauguga

SEQ ID NO: 65294 - RNA, 1365 nt, Artificial Sequence
  derived and/or modified sequence opt5 from 40422__Homo_sapiens__NP_653311
auggccagcuccgagguggcuagacaccuucucuuccagucucauauggccaccaagacaacgugcaugagcucccaaggcucugacgaugaacagaucaaacgggagaacauucgcagccugaccauguccgggcacgucggauuugaaucucuucccgaccagcugguuaauagaagcauccagcaaggcuucuguuuuaacauucucugcgugggggagacaggaaucggcaaguccacccugauugauacacuuuucaauaccaacuuugaagacuacgagagcucucauuucuguccuaaugugaaacugaaggcgcagacauaugagcuccaggaauccaacguccagcugaaacugaccaucgugaauacgguuggguuuggagaucaaaucaacaaggaggaaagcuaccagccgauuguggacuauaucgaugcucaguucgaggccuaccuccaggaggaacugaagauuaaacggucucuuuuuaccuaucacgacucccgcauccaugucugccuguacuucauuagccccacaggccacucucucaagacccuggaucuucugacaaugaaaaaucucgacuccaaggugaacaucauuccuguuaucgccaaagcugauaccgugagcaagacggagcugcaaaaguuuaaaaucaagcugauguccgaacucgucucuaauggcgugcagauuuaucaguuccccacagacgaugacaccaucgccaaagugaacgcugccaugaaugggcaacugccuuuugcggucguuggaagcauggacgaggugaaggugggcaacaaaauggucaaggccagacaguaccccuggggagugguucagguggaaaaugagaaccacugugauuucgucaaacuucgggagaugcugauuugcacaaacauggaagaccuccgcgagcagacccauaccagacacuacgaacuguaucggcgcuguaagcuggaggaaaugggguucacagaugugggcccugagaauaagccgguuuccgugcaagagacguacgaagcuaaaagacaugaguuucacggggaacggcagcgcaaggaggaagagaugaaacagauguucguccagagagugaaggagaaagaagccauccugaaggaggcugaacgggagcuccaagccaaguuugagcaccugaaacgccugcaucaggaagagagaaugaagcucgaagagaaacggagacugcuugaagaggagauuaucgcguucagcaagaaaaaggccaccucugaaaucuuucacucccagagcuuccuggcuacaggaucuaaccuccgcaaggacaaagaucggaagaauagcaacuuucuguga

SEQ ID NO: 65295 - RNA, 1290 nt, Artificial Sequence
  derived and/or modified sequence opt5 from 40787__Homo_sapiens__NP_060713
auggccguggcugucggcagacccagcaacgaggaacugcggaaucucucccugucugggcacguuggauucgacagccuuccugaucagcuggugaacaaguccaccucucaaggcuuuugcuucaauauccucugugugggggagacaggaauuggcaaaagcacgcugauggacacccuuuuuaacacaaaguucgaauccgauccggccacccauaaugagcccgggguccgccugaaagcgagaucuuacgaacuccaggagagcaacgugcggcugaagcugacaaucguugacaccgugggauuuggcgaucagauuaauaaagacgauuccuauaagccuaucgucgaguacauugacgcucaguucgaagccuaucuccaagaggaacugaagaucaaacgcagccuuuuuaacuaccacgauacaagaauccaugccugccuguauuucauugcucccaccggccacucucucaagucccuggaccuugugacgaugaaaaagcuggauagcaaaguuaauaucauuccuaucauugccaaggcugacaccaucgccaagaacgagcuccauaaauuuaagucuaaaauuauguccgagcuggugagcaaugggguccagaucuaccaguuccccacagaugaagagaccguggcggaaaucaacgccacaaugucugugcaucugccuuuugcugucguuggauccaccgaggaagugaagauuggcaauaaaauggccaaggcucggcaguauccguggggagugguccaaguggagaacgagaaucacugugacuucguuaaacuccgcgaaaugcugaucagagugaacauggaggaccuucgggaacagacgcacacacgccacuacgagcuguacagacggugcaagcucgaagagaugggguuuaaggauaccgaccccgauagcaaaccuuucucccugcaggagacauaugaagccaagcgcaacgaguuccuuggcgaacugcagaaaaaggaggaagagaugagacaaauguuugucaugcgggugaaagagaaggaagcggagcucaaggaagccgagaaagagcugcaugaaaaguucgaccugcucaaacgcacccaccaggaggaaaagaaaaagguugaggauaagaaaaaggaacuggaggaggaagugaauaacuuucagaaaaagaaagcugccgcucaacuucugcagucucaggcccagcaaagcggggcccagcagaccaagaaggacaaagauaagaaaaaugcuuccuucacauga

SEQ ID NO: 65296 - RNA, 939 nt, Artificial Sequence
  derived and/or modified sequence opt5 from 41153__Homo_sapiens__NP_001147930
auggacccccugagacggagcccuuccccgugccucucuagccagcccuccucuccuagcacacccccuugugagaugcugggccccguggggaucgaagccguccuugaucaacugaagauuaaagcuaugaagaugggauucgaguuuaacaucaugguugugggccaguccgggcucggaaaaucuaccauggugaauacgcuguucaagagcaaagucuggaaguccaacccuccgggccuuggggugcccaccccucagacacugcagcuccacagccugacccauguuauugaagagaagggagugaaacugaagcucacagucaccgacacacccggcuuuggcgaucaaaucaauaacgacaauugccugcgcccucuugauauugaguuccugcagagacucugucggaccgugaacguugugcccgucaucgcccgcgcggacucucugacgauggaagagagagaggcuuuucggcgcagaauccagcagaaucuucggacccacugcauugauguguacccgcaaauguguuucgacgaagauaucaacgacaaaauucucaauuccaagcugcgcgauagaaucccuuuugccguggucggggccgaccaggaacaucugguuaacggacggugcgugcugggccgcaaaacaaagugggggauuaucgagguggagaauauggcucacugugaguucccccuccugagagaucuucugauucggagccaucuccaggaccugaaggacaucacccacaacauccacuaugaaaauuaccgcgucauuagacuuaacgaaucucaucugcucccucggggacccggcugggugaaucuggcccccgcuuccccugggcagcugacaaccccgagaacguuuaaaguuugccgcggagcccacgaugacagcgaugacgaguucuga

SEQ ID NO: 65297 - RNA, 1299 nt, Artificial Sequence
  derived and/or modified sequence opt5 from 41883__Homo_sapiens__NP_997249
auggccgagagaacaauggcuaugcccacacagaucccugccgacggcgauacgcaaaaggaaaacaauauucggugccugaccacaaucgggcacuucggauuugagugucucccgaaccagcuggugagccgcuccauuagacagggcuucaccuuuaauauccuuugcgucggggaaacaggaauuggcaaaucuacccugaucgacacacucuucaacaccaaucugaaggauaacaaaagcucccauuuuuacucuaauguugggcuucagauccaaacguaugagcugcaggaaagcaacgugcagcucaagcugaccguggucgagacagugggauacggcgaccagauugauaaagaggcguccuaucaacccaucguugacuacauugaugcucaguucgaagccuaucugcaggaggaacucaagaucaagcggucucuguuugaguaccacgacagccgcgugcaugucugucuuuauuucauuuccccuaccggccacagccugaaaucucucgaucugcuuacaaugaagaaucuggacuccaaagugaacaucauuccccucaucgccaaggcugauaccaucagcaaaaaugaccugcagacguuuaagaacaagauuaugucugagcugaucuccaaugggauucaaaucuaccagcucccuacagaugaagagaccgccgcucaggccaacagcucuguuuccggacugcuucccuucgcgguggucggcagcacagacgaagugaaaguggggaagagaaugguccggggacgccauuacccuuggggcguucugcaaguggagaaugaaaaccacugcgacuuugugaaacucagagauaugcugcuuuguaccaacauggagaaucugaaggagaaaacccacacacagcauuaugaaugcuaccgguaucagaagcuccagaaaaugggguucacggacgucggaccgaacaaucaacccguguccuuucaggagauuuucgaagccaagcgccaggaguucuacgaucagugucaaagagaagaggaggaacugaagcagcgguuuaugcagcgcguuaaagagaaggaagcuaccuucaaagaggccgaaaaggagcugcaggacaaauuugagcaccucaagaugauccaacaggaagagaucagaaagcuggaagaggagaaaaagcagcuugaaggcgagauuaucgauuucuauaaaaugaaggcugccucugaagcgcugcagacacaacucagcaccgacaccaaaaaggauaagcaucggaaaaaguga

SEQ ID NO: 65298 - RNA, 1488 nt, Artificial Sequence
  derived and/or modified sequence opt5 from A1BG__Homo_sapiens__NP_570602
augagcaugcugguggucuuccuccugcuuuggggcguuaccugggggcccgugacagaggccgcuaucuuuuacgaaacgcagccuucccugugggccgagucugaaagccuccugaagccgcuugcgaacgugacccugacaugccaagcucaccucgagacccccgacuuccagcuguuuaaaaauggagucgcccaggaaccugugcaucuggauucccccgccauuaagcaccaguuccuccugacaggcgacacccaagggagauaucggugucgcucuggacuuagcacaggcuggacccagcuguccaaacuccuggagcuuacggggccuaagucucugcccgcuccuuggcucagcauggccccgguuuccuggaucacccccggacugaaaacaaccgcugugugcagaggcguccugcggggcgugacauuucuccugcgcagagagggggaucaugaguuccuugagguuccugaagcccaggaggacguggaggcgaccuuucccguccaccagccuggaaacuacagcuguucuuaucggacggauggcgaaggggcccuguccgagcccagcgcuacagugaccauugaagaacucgccgcuccgccucccccugugcugaugcaucacggagaaucuucccaaguccuucaccccggcaauaagguuacacugaccugcguggcgccccucagcgggguggacuuccagcugcgcagaggagagaaggagcugcucgucccucggucuuccaccagcccggaucgcaucuuuuuccaucugaacgccguggcccuuggcgacggcgggcacuacacauguagauaucggcugcaugauaaucagaacggaugguccggcgacucugcucccguugaacucauucugagcgaugagacgcuuccugcccccgaauuuuccccugagcccgaaagcgggcgcgcucugagacuccggugccuggccccgcuggagggagcccgcuucgcucucgugagagaggaccggggcgggagacgcguccaccgguuucagucuccugcgggaaccgaagcccuguucgagcuucacaauaucuccguggcugauagcgccaacuacucuuguguuuauguggaccugaaacccccuuucggcggcagcgcccccuccgaaagacucgagcugcaugucgacgggccucccccgcgcccucaacugcgggcuacauggucuggagccgugcuugcgggcagagaugcuguccuccgcugcgaagggcccauccccgacgugaccuuugagcugcugcgggagggagaaacaaaggccguuaaaaccgugagaacgccuggcgccgcugccaaucucgagcugauuuucgucgggccgcagcacgcuggcaacuaccgcugucgguacagaagcugggugccccauacauuugaauccgagcuuagcgauccuguugagcugcucguggccgaaucuuga

SEQ ID NO: 65299 - RNA, 1761 nt, Artificial Sequence
  derived and/or modified sequence opt5 from A1CF__Homo_sapiens__NP_001185747
auggagagcaaccacaaguccggcgacgggcugucuggaacccagaaagaagccgcucucagagcccuggugcaacggacaggcuacagccuuguccaggagaaugggcagcgcaaguauggagggcccccuccgggcugggaugcggcucccccugaaagaggaugcgagaucuucauuggcaaacugccccgggaccucuuugaagaugagcugaucccucuuugugagaagauuggcaaaaucuacgaaaugcgcaugaugauggacuucaacgggaauaacagaggauaugccuuuguuacguucuccaauaagguggaggccaagaacgcuauuaaacagcugaauaacuacgaaauccggaauggccgccuccugggggugugcgccucugucgauaacuguagacuguuugugggaggcauccccaagaccaaaaagcgggaggagauucucagcgaaaugaaaaagguuacagaggggguggucgacgugaucguuuauccuuccgcugccgauaagaccaaaaaucgcggauucgcguuuguggaauacgagucucauagagccgcugccauggcucggcgcaagcugcuuccgggccggauucaacuguggggccacgggaucgccgucgacugggcggaacccgagguggagguggaugaagacacaaugagcuccgucaaaauucucuauguuagaaaccugaugcuuagcaccucugaggaaaugaucgagaaggaguucaauaacauuaaaccuggagccguggaacgcgugaagaaaaucagagauuacgcuuuuguccauuucuccaaucgggaggacgccguggaagcuaugaaggcccugaacggcaagguucucgaugggagccccaucgaggugacacuggccaaaccugucgacaaggacucuuacgugagauauacccgcggaacgggcgggcggggaaccaugcugcagggcgaauacacauauucccucggccagguuuacgaucccaccacaaccuaucugggggcuccgguguuuuacgcgccucagacguaugccgcuauucccagccuucacuucccugccacaaaaggacaucugucuaacagagccaucauucgcgcucccuccguccggggcgccgcgggggugagaggacucggcgggcgcggcuaccuggcuuacaccggacuuggccggggguaucaagucaagggagacaaaagagaggauaagcuguacgacauccuccccggcauggaacugacaccuaugaauccggugacccugaagccccaggggauuaaacucgccccucagauccuggaggagaucugccagaagaacaauuggggacaacccguuuaucagcuucacagcgccauuggccaggaucaacgccagcuguuucucuacaaaaucaccauuccugcucuggccucccagaaccccgcuauccacccguucacaccucccaaacuuucugccuucguggacgaagcgaagacguaugccgcugaguacacccugcagacacucgggauuccuaccgauggcggagacggcacaauggccaccgcugccgcggccgcuacggccuuucccggguaugcugucccuaaugccacagcccccgugagcgcugcgcaacugaagcaggccguuacccugggacaggaucucgcugccuacaccacauacgaaguguauccgaccuucgccgucacagcucggggcgacggguacggaacguuuuga

SEQ ID NO: 65300 - RNA, 4425 nt, Artificial Sequence
  derived and/or modified sequence opt5 from A2M__Homo_sapiens__NP_000005
augggcaagaacaaacugcuccaccccagccuggugcuucugcuccugguccuucugccuaccgacgccuccguuucugggaagccgcaguacauggugcucgugcccagccugcugcauacagagacgaccgaaaaaggaugcguccuccuguccuaucuuaaugagacagugaccguuucugcuagccuggaauccgugagaggcaaccggucucucuucacagaucuggaggccgaaaaugacguccuucacuguguggcguuugcuguuccuaagagcuccagcaacgaggaggugauguuccugaccguccaagugaaagggcccacacaggaauuuaagaagcgcaccacggugauggucaaaaaugaggauucucucguuuucgugcagaccgacaaguccaucuacaaaccuggacagacagugaaguuuagagucgugagcauggaugaaaacuuccauccccugaaugagcugauuccucucguuuauauccaagacccgaaaggcaaccggauugcccaguggcagucuuuucagcuggaagggggacuuaagcaauucuccuuuccccugagcucugaaccuuuccagggcuccuacaagguggucgugcagaaaaagagcggcgggcgcaccgagcaccccuuuacaguugaagaguucgugcucccuaaauuugaaguccaggugaccguccccaagaucauuacgauccuggaggaggaaaugaauguguccguuugcggacuuuauacauacggcaaaccggugccugggcaugucaccgugucuaucuguagaaaguauagcgaugccuccgacugccacggagaggauagccaggcuuucugugaaaaauucucuggccaacugaacucccacgggugcuuuuaccagcaaguuaagacaaagguguuccagcucaaacggaaggaguacgaaaugaaacugcauaccgaggcccagauucaggaggaaggaaccgucguggagcugacaggccgccaaagcucugaaaucacgagaaccauuacaaagcucagcuuugugaaaguugacucccacuuccggcagggcauccccuuuuucgggcagguccgccugguggauggaaagggcgugccuauucccaauaaggucaucuuuauuagagggaacgaggcuaauuauuacucuaacgccaccacagacgaacauggacuugugcaguucagcaucaauaccacgaacguuaugggcacaucccugaccgugcgggucaacuauaaagaucgcagccccuguuacggguaucaaugggugucugaggagcacgaagaggcgcaccauaccgccuaccucguguuuuccccuagcaagucuuucguucaccuggaaccgaugucccaugagcuucccugcggacacacacagaccguccaggcucauuauauccugaauggcggcacacuccuggggcugaaaaagcucagcuuuuacuaccugauuauggccaaaggaggcaucgugagaacggggacccacggacuucugguuaagcaggaggacaugaagggccacuucuccauuucuaucccugugaaaagcgacauugcucccgucgcccggcuccugaucuaugcggugcugccuacaggggaugugaucggcgacuccgccaaguacgaugucgaaaacugucuugcuaauaaaguugaccucucuuuuagccccucccaaagccugccggccucucaugcucaucugcgcgugaccgccgccccucaguccgugugcgcucucagagcggucgaucagagcgugcugcuuaugaagcccgacgccgagcugucugcuuccagcguuuauaaccuccugccugaaaaagaucugacaggauuccccggcccucuuaaugaccaggaugacgaggauuguauuaaccggcacaauguguacaucaacgggauuaccuauacgcccgucucuagcaccaaugaaaaggacauguacuccuuccucgaggacaugggacugaaggccuuuacaaacagcaaaaucagaaagccgaaaaugugcccucaacugcagcaguaugagaugcacggccccgaagggcuccgcgugggauucuacgagucugauguuaugggccgggggcacgccagacuggugcaugucgaggagccccacaccgaaacagugcgcaaguacuuuccugagaccuggauuugggaccuuguuguggucaauuccgcuggcguggccgaggugggagucacgguuccggauacaaucaccgaauggaaagcgggcgcuuucugccugagcgaggacgccgggcucggaaucuccucuacagccagccugcgggcuuuucaacccuucuuuguggaacugaccaugccuuauuccgugauuagaggcgaggccuucacccuuaaggcuacaguccucaacuaccugcccaaauguauccgcgugucuguucagcuggaagccagcccugcguuucucgccgugcccgucgagaaggagcaggcuccucauugcauuugugccaaugggcggcagacgguguccugggcuguuacccccaagucucugggaaacgugaauuucacagucagcgccgaagcgcuugagucccaagaacugugcggcaccgaggugccgagcgucccugagcacgggagaaaagauacagugaucaagccccuccugguugaaccugagggccuggaaaaagagaccacguuuaacucucuucucugucccuccggaggcgaagugagcgaggagcugucucugaagcucccgccuaacgucguggaagaguccgcccgcgcuagcguuucugugcugggggacauucuuggauccgccaugcagaauacacagaaccugcuccagaugcccuauggcugcggggaacaaaauaugguccuguucgcuccuaacaucuacgugcuggauuaucuuaaugagacccagcagcugacccccgaaauuaaaagcaaggccaucggauaccucaacacaggcuaucagcggcaacugaauuacaagcauuacgacggguccuauagcaccuuuggcgagagauacggacgcaaccagggcaauacauggcucacggccuucgugcugaaaaccuucgcucaggcgcgggccuauaucuuuauugaugaggcucacaucacacaagcccuuauuuggcugucucagagacagaaggacaacggguguuuccggagcuccggaucucuccugaauaacgccaucaaaggcgggguugaagaugaggucacccugagcgcuuacauuacaaucgcccuucuggaaaucccccucaccgugacgcacccugugguccgcaaugcgcuguuuugccucgaguccgcuuggaagaccgcccaggaaggagaccauggcucucacguguauacaaaagcccugcuugcuuacgccuucgcgcuggcuggcaaccaagauaagagaaaggagguucucaaaagccugaaugaggaagccgugaagaaagacaacuccguccauugggagcggccgcagaagcccaaagccccuguggggcacuuuuaugaaccccaggcuccuucugccgagguugagaugaccagcuacgugcugcuugcuuaccugacagcccagcccgcgccuaccuccgaagaccucacaagcgccaccaacauugucaaguggaucacgaagcaacagaaugcucagggaggcuucucuuccacacaggauaccgugguugcccugcaugcucucagcaaauauggggccgccaccuuuacaagaaccggaaaggcugcgcaagugacgauucagucuuccggcacauucagcuccaaauuucaggucgacaacaauaaccgccugcuucugcagcaagugucucugccggagcuccccggggaauacagcaugaaggugaccggagagggcugugucuaucugcagacaucccuuaaauacaauauccugccugaaaaggaggaguuccccuuugcccucggcguucagacccugccucaaacaugcgaugaacccaaagcucacaccagcuuccagauuucucucuccgugagcuauacggggucucggagcgccuccaacauggccaucguggacgucaagauggugucuggauucaucccgcugaagccuaccguuaaaaugcuugagagaagcaaucacgugucccgcacagaagucucuagcaaccaugugcugauuuaccuggauaagguuuccaaucagacccucagccuguuuuucacagugcuucaggacguccccgugagagaucugaaacccgcuaucgucaagguguaugacuacuacgagaccgaugaauuugccauugcggaguauaacgcuccuuguucuaaagaccucggcaaugccuga

SEQ ID NO: 65301 - RNA, 4365 nt, Artificial Sequence
  derived and/or modified sequence opt5 from A2ML1__Homo_sapiens__NP_653271
augugggcccagcugcuccugggcaugcuugcucugagccccgccaucgcggaggaacucccuaacuaccuggugacccuuccggcuagacugaauuuccccuccguccaaaagguuugccucgaccugucuccuggguauagcgaugugaaauuuacagugacgcuggagaccaaggacaaaacacagaagcuccuggaauacuccggacuuaaaaagcggcaucugcacuguauuucuuuccucgugcccccucccgccggcgggaccgaggaagucgccacaauccgcguuagcggagugggcaacaauauuuccuuugaggagaagaaaaagguccugauccagagacaggggaacggaaccuucgugcaaacagauaaaccucuuuauaccccgggccagcagguuuacuuucggauugugacgauggacucuaauuucguccccgugaacgauaaguauagcaugguggaacugcaggacccuaauuccaaccgcaucgcucaauggcucgaggucguucccgaacagggcaucguggaucugagcuuucagcuggccccugaggcuaugcucgggaccuacacaguggccgucgcggagggaaaaaccuucggcacauuuucuguggaagaguauguucugcccaaguucaagguggaagucguggagccgaaagaacuuuccaccguucaggagagcuuucuggugaagauuugcuguagauacacguacgggaaaccuaugcucggagccguccaagugucugucugccagaaggcuaauacauauugguaccgggagguggaacgcgagcagcugcccgacaaauguagaaaccuuuccggccaaaccgauaagacagggugcuucagcgccccuguugacauggcuaccuuugaucugaucggauaugccuacucucaccagauuaauaucguggcgaccgucguggaagagggcacaggcguugaagccaacgcuacgcagaauauuuauaucucuccccagauggggagcaugaccuucgaggacacauccaacuucuaccaucccaauuuuccuuucucuggaaaaauucgggugcgcggccacgaugacagcuuucucaagaaccaucuggucuuccuggugaucuaugggaccaacggaacauuuaaucaaacccucgugacggacaacaauggccuggccccguucacacuugagaccuccggguggaacggaaccgauguuagccuggaaggcaaguuucagauggaggaccucgucuacaaucccgaacaggugccuagauacuaucagaacgcuuaccugcaccuucggcccuucuauucuacaacccgcuccuuucugggcauccacagacucaaugggccucugaaauguggacaaccccaggaggugcuggucgauuacuauauugacccggccgaugccagcccugaccaggaaaucucuuucagcuacuaucucauuggcaaggggucccuggugauggagggacagaaacaucuuaacucuaagaaaaagggccugaaggcuagcuuuucccucagccugacauucacgucucggcuggcgcccgauccuucccuuguuaucuacgccauuuuucccagcgggggcguggucgcugacaaaauccaauucucuguggagaugugcuucgauaaucagguuucccucggauuuagcccuucccagcagcugcccggcgccgaaguggagcugcaacuccaggccgcuccggggucucugugugcccuucgcgcggucgacgaaagcgugcugcuccugagaccugaucgggagcuguccaacagaucuguuuacggaauguuccccuuuugguauggccacuaccccuaucagguggcugaguacgaccaaugcccugucagcgggccgugggacuucccccagccucuuaucgaucccaugccucagggacauuccagccagcgcucuauuaucuggcggcccuccuuuagcgaaggcaccgaccucuucuccuuuuucagagauguggggcugaagauucuguccaaugccaaaaucaagaaaccuguggacuguagccaccgcucucccgaguauagcacagccaugggcgcuggaggcgggcacccggaagccuuugaguccagcaccccucuccaucaagcugaagauucucagguccggcaguacuuccccgagacauggcugugggaccuuuuuccuauuggaaacuccggcaaggaggccguucacgugaccgugcccgaugcgaucacggaauggaaggccaugagcuucugcaccucccagucuagaggguuuggacugagcccgacagucggccucaccgcuuucaaaccuuucuuuguggaccugacacugcccuauuccguugugcgcggggagucuuuccggcuuaccgccacgaucuuuaauuaccucaaggauugcauuagaguccaaacagaccuggcuaaaagccaugaauaccagcuggaguccugggccgauucucagaccagcuccugucucugcgcggacgaagccaagacacaccauuggaacaucaccgcugugaaacugggccacauuaauuucaccaucagcacaaagauucuugauucuaacgagccuuguggaggccagaagggguuuguuccccaaaaaggacgcuccgacacgcugaucaagcccgugcucgucaaaccugagggcgugcugguugaaaagacccacagcucucugcuuugcccgaaagggaagguggccuccgagagcgucucucucgaacugcccguggacauugugccugauuccacaaaggcuuaugucaccguucugggagacaucaugggcacagcccuccagaaccuggaugggcuugugcagaugcccagcggcuguggagagcaaaauauggugcuguucgccccuaucauuuacguccuccaguaucuggaaaaggcuggccugcuuaccgaggagauccgguccagagcggugggguuucuggaaauuggauaccagaaggagcucauguauaaacauagcaacggcucuuacagcgccuucggggaacgcgacggaaauggcaacacguggcugacagcuuuuguuaccaagugcuucggccaggcccaaaaauuuaucuucauugaucccaagaauauccaggacgcccucaaauggauggcugggaaccagcugccuuccggauguuaugccaaugugggcaaccuucugcacaccgcgaugaaagggggagucgaugacgaggugucucucacagcuuacguuaccgccgcccugcuggagaugggcaaggauguggacgauccgauggucagccaggggcuucggugccugaaaaauuccgcuacaucuacgaccaaccucuacacacaagcccugcucgcguauaucuucagccuggcuggagaaauggacauuagaaauauccuucugaagcagcucgaucagcaggccauuaucuccggcgagucuauuuacuggagccaaaaacccaccccuuccagcaacgccucucccugguccgaaccugcugccguggacgucgagcugacagcuuaugcccugcuugcgcagcugaccaagcccagccucacgcagaaagaaaucgccaaggcuaccucuaucguggccuggcuggcuaagcagcggaaugccuacggcggguuuuccagcacacaagacaccguuguggcccuccaggcucuggcgaaauaugccacaaccgcuuacaugccguccgaggagauuaaccuugucgugaagucuacagaaaauuuccagcgcaccuuuaacauccaaagcguuaacagacugguguuccagcaggauacgcugccuaauguccccggaauguauacacucgaggccuccggccagggguguguguacgugcaaaccguucugcgguacaacauucuucccccuaccaauaugaaaacauuuagccugucugucgaaaucggaaaggccagaugcgagcagcccaccuccccucgcagccucacgcugacaauucauaccucuuaugugggcagccgguccucuagcaacauggcuaucguggaagucaaaaugcucuccggguucucuccgauggagggaacaaaucagcugcuucugcagcaaccccuggugaagaagguugaguuuggcaccgacacacucaacaucuaccuggaugaacuuauuaaaaauacccagacguauaccuucacaaucagccaguccgugcuggucaccaaccucaagccugccacaauuaaaguguacgacuauuaccugcccgaugagcaggcgaccauccaauauagcgacccuugugaauga

SEQ ID NO: 65302 - RNA, 1023 nt, Artificial Sequence
  derived and/or modified sequence opt5 from A4GNT__Homo_sapiens__NP_057245
augagaaaggagcugcagcucagccuguccgugacccuucugcucgucugcggcuuccuguaccaauuuacacuuaaaucuagcugucuguucugccuccccuccuuuaagucucaccaggggcuggaagcccugcucagccaucggcgcggaaucguuuuccuggagacguccgaaagaauggagccuccgcaccuugugucuuguagcguggaauccgcugccaaaauuuaucccgaguggccugucguguuuuucaugaagggccugaccgacagcacacccaugccuucuaacuccaccuaccccgcguuuagcuuccucucugcuaucgauaauguuuuucuguucccucuugacaugaaacggcugcucgaggauacaccgcuguuuuccugguauaaccagauuaaugccagcgccgaacgcaacuggcugcauaucucuuccgacgcuagcagacucgccauuaucuggaaguacgggggaaucuauauggauaccgacgugauuuccauccggcccauuccugaggaaaauuuccuggcugcccaggcgucucgcuacagcuccaacggcaucuuuggguuccuuccccaccauccuuuccugugggagugcauggagaauuuugucgaacacuauaacagcgccauuuggggaaaucaaggccccgagcucaugacaagaaugcugcgggugugguguaaacuugaagauuuccaggagguuucugaccugcgcugccucaacaucuccuuucugcacccgcagagauucuacccuauuagcuaccgggaauggcgcagauauuacgaggugugggauaccgagcccucuuuuaaugucagcuaugcucugcaucucuggaaccacaugaaucaggaaggccgggccgugauccgcggguccaacacgcugguggagaaucuuuacagaaagcauuguccucggaccuauagagaccugaucaagggacccgaaggcucugucacaggggagcucggacccggcaacaaauga

SEQ ID NO: 65303 - RNA, 1542 nt, Artificial Sequence
  derived and/or modified sequence opt5 from AAAS__Homo_sapiens__NP_001166937
augugcagccugggccucuuucccccuccgcccccuagaggccaggugacccuguacgagcacaacaaugaacuugucacaggauccucuuaugagucucccccucccgacuuucggggccaauggaucaaccugccuguucuccagcugacgaaggauccgcuuaaaacccccgggcgccuggaccauggaacaagaaccgccuucauucaccaucgggaacagguguggaagcgcuguaucaauauuuggagagaugugggccucuuugggguccugaacgagaucgcuaauuccgaagaggagguguucgaauggguuaaaacagccucuggaugggcgcuggcucucugccggugggccagcucccugcacggcucucuuuuuccucaucugagccuccgcuccgaggaccugauugccgaguucgcucaggugaccaacuguacaaucguccccagccuuaagcacagacugcaacggaauguggccucucucgcuuggaaaccucuguccgccagcguucuggcgguggccugccagagcuguauccucauuuggacccuggaucccacgucccuuagcacccgcccgucuuccgggugcgcucagguccugagccacccugggcauacacccgugaccucccucgccugggcuccuucuggaggcagacugcuuagcgccucccccguggacgcggccauccgggucugggauguuagcacagaaaccugugugccccugccuugguuccgcgggggaggcgugacgaaccuccuguggucuccggacggguccaagauucuggcuacaacccccagcgccgucuucagagugugggaggcucagauguggacaugcgaacgguggccuacccucucuggacgcugucaaaccggcugcuggagccccgauggcuccagacugcuuuuuacaguucugggggagccucucaucuacucucugagcuuccccgaacgguguggagagggcaaggggugcgugggaggcgccaaauccgccacgauugucgcugaccuuagcgaaaccacaauccagaccccggauggggaggagagacugggaggcgaagcgcacucuauggugugggacccuuccggcgagcgccucgccguucugaugaaggggaaaccccgggugcaggauggaaagccugucauucugcucuuuagaacacgcaauagccccguguucgaacugcuuccuugcggcaucauccagggggagcccggagcucaaccgcagcugauuaccuuucauccuucuuucaacaaaggcgcccuccuguccgucggguggagcacgggccggaucgcccacauuccccuguauuucgugaaugcucaguuucccagauucuccccuguucuuggacgcgcccaagaaccgcccgcgggcgggggaggcucuauccacgaccucccucuguuuacagagaccagccccaccuccgcuccuugggacccccugccugggcccccgccugugcucccccauucuccucacagccaucuguga

SEQ ID NO: 65304 - RNA, 2019 nt, Artificial Sequence
  derived and/or modified sequence opt5 from AACS__Homo_sapiens__NP_076417
augagcaaggaggaaagacccggccgggaggaaauccuggagugccaggugaugugggaaccugacuccaaaaagaacacccaaauggaucgcuucagagccgcugucggggccgcguguggacucgcucuggagucuuacgacgaucuuuaucacuggagcguugaguccuacucugacuuuugggccgaguucuggaaauuuagcggcauuguguucucccggguguaugaugaagucguggacacaucuaaggggaucgccgauguuccggaaugguuuaaaggaagccgccugaauuacgcugagaaccuccugagacauaaggagaaugaccggguggcccuuuauauugcucgcgaaggcaaggaggaaaucgucaaagugacguucgaggaacugagacaggagguugcccucuuugcggccgcuaugcggaagaugggggugaaaaagggagaucgcgucgugggcuaccugcccaacuccgagcacgccguggaagcuaugcuggccgcggccagcauuggcgcuaucuggucuuccaccagcccugacuucggggucaauggaguucucgauagauuuucucagauccagcccaaacugauuuucuccguggaggccguggucuauaacggcaaggaacauaaucacauggagaaacuucaacaggugguuaaggggcugccugaccucaagaaaguggucgugauccccuacguuagcucucgggaaaacauugaucuguccaagaucccuaauagcguguuucuugacgacuuccuggcuacaggaaccuccgagcaggccccgcagcucgaguuugaacaacugcccuucucucauccucuguucauuauguuuagcuccggcacaaccggggcccccaaaugcaugguccacagcgcuggaggcacacucauccagcaccugaaggagcaucuucugcacggcaacaugaccucuuccgauauucuccuguguuacacgaccgugggguggaugauguggaauuggauggucagccuucuggcgacaggagccgcuauggugcucuaugacggcucuccucugguucccaccccgaacgugcugugggaucucgucgaccgcaucgggaucacagugcugguuaccggagccaaauggcuuagcgugcuggaagagaaggccaugaagccugucgaaacgcauucccuccagaugcugcacacaauucuuucuaccggcagcccccugaaagcucaguccuacgaguauguguacagaugcaucaagagcucuauucuccugggguccaucagcggaggcacagauauuaucucuuguuucaugggccacaauuuuucccugccuguguauaaaggggagauccaagcccggaaccucggaauggcgguugaggcuuggaaugaagaaggcaaggccgucuggggagagagcggggagcuggugugcaccaaacccauucccugucagccuacccauuucuggaacgacgaaaacggcaauaaguaccgcaaggccuauuuuuccaaauucccggggaucugggcucacggcgauuacugcagaauuaaccccaagacaggaggcaucgugaugcuugggcggucugacggaacgcugaauccuaacggcgucagauuugggagcuccgagauuuacaauaucguggaaucuuucgaggaaguugaggauagccucugugugccccaguauaacaaauaccgcgaggaacgggucauccuguuucugaagauggccuccggacaugcuuuccaaccugaccuugugaaacgcauuagagaugccauccggaugggccucagcgcgagacacguucccucucugauucuggagaccaaggggaucccguauacacucaauggcaagaaaguggaagucgccgugaagcagauuaucgcuggaaaagccguugagcagggcggggcuuuuuccaacccugaaacccuggaccuuuaccgcgacauucccgagcugcagggauucuga

SEQ ID NO: 65305 - RNA, 1200 nt, Artificial Sequence
  derived and/or modified sequence opt5 from AADAC__Homo_sapiens__NP_001077
augggcagaaagagccuguaccuccugaucguggggauucuuaucgccuauuacauuuauacaccccugccugacaacgucgaggaaccguggcggaugauguggaucaaugcucaccucaaaaccauucagaaccuggccacguucguugagcuucugggacuccaucacuuuauggauuccuucaagguggugggcucuuuugacgaagugcccccuaccagcgaugagaaugucacaguuaccgaaacaaaauucaacaauauccuggugcgcgucuacgugcccaagagaaaauccgaggcgcugcggcgcgggcucuuuuauauccauggaggcggguggugcguuggaucugcugcccugagcggcuacgaccuucuguccagauggaccgccgaucggcucgacgcuguggucgugucuacaaacuaucgccuggccccuaaguaccacuuccccauucaauuugaggauguguacaaugcucuuagaugguuccugcggaagaaaguccucgccaaguauggcguuaacccugaacgcaucgggauuagcggagacuccgcgggcgggaaucuggccgcugccgugacccagcagcugcucgaugacccggaugugaaaaucaagcugaaaauucagagccuuaucuaccccgcucugcaaccucucgacgucgaucugcccucuuaucaggagaacuccaauuuucuuuuccugagcaagucucucauggugagauuuugguccgaauacuucacgaccgaccggagccuggagaaggccaugcugucucgccagcauguuccuguggaguccagccaccucuuuaaauucgucaacugguccucucugcuucccgaaagauucauuaagggacacguguauaauaacccgaauuacggcagcuccgagcuggcgaaaaaguauccuggguuucucgacguucgggccgcuccccugcuugccgaugacaacaaacugcgcggacucccucugacauacgugaucaccugucaguacgaucugcucagagacgauggccugauguaugucacacggcuuagaaacaccggcgugcaagucacgcauaaucacguggaagacggguuccauggagcuuuuagcuuccugggccucaagaucucucaccgccugauuaaccaguacaucgaguggcugaaagaaaaucuuuga

SEQ ID NO: 65306 - RNA, 948 nt, Artificial Sequence
  derived and/or modified sequence opt5 from AAGAB__Homo_sapiens__NP_078942
auggccgcuggcgugcccugcgcccuggucaccagcuguuccucuguuuucagcggggaccagcucgugcaacacauccugggaacagaggaucuuauuguggaagucacguccaacgacgcggugagauuuuacccuuggaccaucgauaauaaguauuacucugcugacauuaaccugugcguugugccgaauaaauuccucgucacagccgagaucgccgaaagcgugcaggcuuuuguuguguauuucgauuccacccagaagucuggccuggacagcgucuccagcuggcuuccccuggccaaggcuuggcucccugaggugaugauucuggugugugaucgggucucugaagacgggaucaaccgccagaaagcccaagaguggugcaucaaacauggauuugagcugguugaacucucccccgaggaacugccugaggaggaugacgauuuccccgaaagcacaggcgugaagagaauugugcaggcgcuuaaugccaacgucuggucuaaugugguuaugaagaacgaccggaaucagggguuuucccugcucaacagccugaccggaacaaaucacucuaucggcuccgcugauccuugucauccggagcagccccaccuuccugccgcugacagcaccgaaucccugucugaccaucgcggcggggccagcaacacgaccgaugcgcaaguggacuccauugucgaucccaugcucgaccuggauauccaggagcuggccagccucacaaccggaggcggggacguggaaaauuucgagagacuguuuucuaaacuuaaggagaugaaagauaaggcugccacacugccucacgaacagcggaaaguucacgcugagaagguggccaaggccuucuggauggcuauuggaggcgaccgcgaugaaaucgaggggcucuccagcgacgaggaacauuga

SEQ ID NO: 65307 - RNA, 2886 nt, Artificial Sequence
  derived and/or modified sequence opt5 from AAK1__Homo_sapiens__NP_055726
augaagaaauucuuugacagcagacgggagcagggcggguccggacugggcucugggagcuccggaggcgggggaucuaccagcggccucggcuccggguacaucggacgcguguucggcauugggagacaacaggucacaguugaugaagugcuggccgagggaggcuuugcuaucguguuccuuguccggacgucuaacgggaugaagugcgcccugaaacgcauguuugugaauaacgaacacgaccuccagguuuguaagagagagauucagaucaugcgggaucugagcggacauaaaaauauugugggcuauaucgacuccagcaucaacaaugucucuuccggcgaugugugggaaguucuuauucugauggacuucugccgcgggggacaaguggucaaccucaugaaucagagacugcagaccggcuuuacagagaacgaggugcugcagaucuucugugauaccugcgaagcgguggcucggcuccaccaauguaagacacccauuauccaucgcgaccugaaggucgagaauauucuucugcacgauagagggcauuacguucucugcgacuuuggaagcgccaccaacaaauuccagaauccucagacagaaggcgugaacgccguggaggaugagaucaagaaauauaccacgcugucuuaccgggcuccggaaauggucaaucuuuauuccgggaagauuaucaccacaaaagccgacaucugggcucugggaugucuccuguacaagcugugcuauuuuacccuccccuucggcgagagccagguggccauuugugauggcaacuuuacaaucccugacaauucucgcuacucccaagacaugcacugccugauuagauacaugcuugaacccgauccugacaagcggcccgauaucuaucagguuagcuacuucuccuucaaacugcucaagaaagaguguccuauuccgaacgugcagaacucucccaucccugcgaagcugcccgaaccugucaaagccagcgaggcugccgcuaagaaaacccaacccaaggcccgccuuacggacccgaucccuacaaccgagacauccauugcgcccagacagcggccuaaggccgggcagacccagcccaaucccggaauccugccuauucaaccggcucucacccccagaaaacgcgccacagugcagccucccccucaggcugccggcagcucuaaccagcccgggcugcuggccuccguuccgcaaccuaagccccaggcuccucccagccagccucucccccagacgcaagcgaaacagccgcaggccccucccacaccccagcaaaccccuucuacccaggcucagggacugccggcccaagcccaggcuacaccccagcaccagcaacagcuuuuucugaagcagcagcaacagcagcagcaaccucccccugcccagcagcaacccgcgggcaccuucuaucagcagcagcaagcucagacgcagcaguuucaagccgugcauccugccacacagcagcccgcuaucgcccaguucccggucgugagccaagggggcucccagcagcagcucaugcaaaauuuuuaccagcagcaacagcagcagcaacagcagcagcaacagcagcagcuggcuaccgcccuucaccaacagcagcugaugacccaacaggcggcccuccagcagaaaccuacaauggcugccggacaacagccccagccucagcccgcugccgcgccgcaaccugcccccgcucaggaaccugccauucaggcucccguccggcagcaacccaaggugcagaccacaccuccgcccgccguucagggccagaagguggggucucugacgccucccagcuccccuaaaacccaaagagccggacaucgccggauccugagcgaugucacacacucugcuguguucggcguucccgcguccaagagcacccagcuccugcaggccgcugccgccgaggcuucucuuaacaaauccaagagcgccacaaccacgccuuccgggucuccgagaaccagccaacagaauguguauaaccccuccgaaggaucuacauggaauccuuuugacgaugacaacuucagcaaacugaccgcggaggaacuccugaauaaggauuuugcuaagcugggcgaggggaaacaccccgagaagcugggcggauccgccgaaagccucaucccuggcuuccagucuacacagggggacgccuuugcuaccacguccuucagcgccggaacagcggagaaacgcaagggcgggcaaaccgucgauucuggacugccccugcucuccgugagcgacccguuuauuccucuucaggugcccgacgcucccgaaaaacuuaucgagggccugaagucuccugauacaagccuccugcugcccgaccuucucccuaugaccgauccguucggguccaccagcgacgccguuauugaaaaggccgaugucgcuguggagucucugauccccggccuggagccucccgugccucagcggcuccccucccagacagaaagcgucacguccaacagaaccgacucucugacaggagaggauagccuucuggacugcucccuccugucuaauccgaccacagaucugcuugaagaguucgccccuaccgcuauuagcgcccccgugcauaaagcggccgaggacuccaaccucaucucuggcuuugauguuccugaagggagcgacaagguggcugaggaugaguucgaccccauuccuguccugaucacgaaaaauccccaaggaggccacucccgcaacagcucuggguccagcgaaucuucccugccgaaucucgcccggagccugcuucugguggaccagcucaucgaucuguga

SEQ ID NO: 65308 - RNA, 759 nt, Artificial Sequence
  derived and/or modified sequence opt5 from AANAT__Homo_sapiens__NP_001160051
auggagccccagagcaugaagggccagaaaagaccuuucgggggaccguggcggcugaaggugcucggcgggcccccuuggcugcgcagaacccuucccaaacugggacggccuaaggaagcccccgucgcucgcauguccacacaaucuacgcacccucucaaaccggaggcccccagacugccucccggcaucccugaaagccccuccugccagcggcgccauacccuuccggcgucugaguuuagaugucugacaccugaagacgcuguuagcgccuucgagauugagcgggaagccuuuaucuccgugcucggggugugcccccuguaccuggaugagauucgccacuuccucacccuguguccugaacuuucucugggaugguuugaggagggcugccucgucgcuuucaucauuggcagccugugggacaaggaaagacuuaugcaggagucccugacacuccaucggagcgggggacacaucgcccaucugcacgugcuggcuguucaccgcgccuuuagacaacagggccgggggcccauccuccuguggcgcuaucuucaucaccugggaucucagcccgcggugagacgggccgcucucaugugugaagaugcccuggucccuuucuacgagagauuuuccuuccaugcugugggcccgugcgccauuaccguugggagccuuacauuuauggaacugcacuguucucuccgcggacaccccuuccugcggagaaacuccggcugcuga

SEQ ID NO: 65309 - RNA, 468 nt, Artificial Sequence
  derived and/or modified sequence opt5 from AARD__Homo_sapiens__NP_001020528
augggccccggggacuucagacggugccgcgagagaaucagccagggacugcaaggccucccugggcgggccgaacugugguuuccgccccgcccugcuugugauuucuuuggagacggcagauccaccgauauucaggaggaagcccuugcggcuucuccccugcucgaggaccugcggcgcagacuuacacgggccuuccagugggccgugcagcgcgcuaucagcagacggguccaagaagccgcugccgcggccgcugcccgcgaggagcaguccuggacggggguugaagcuacccuggccagacuccgggcggagcugguggaaaugcacuuucagaaccaucagcuggcccgcacacuccuggaucuuaauaugaaggugcaacagcugaaaaaggaguacgagcucgaaauuaccucugacagccaguccccuaaagaugacgcugccaaccccgaguga

SEQ ID NO: 65310 - RNA, 2958 nt, Artificial Sequence
  derived and/or modified sequence opt5 from AARS2__Homo_sapiens__NP_065796
auggccgcuagcguggccgcggcugccagacggcugcgcagagccauccggcgcucccccgcuuggagaggccucucucaccggccucugagcuccgagccgcccgccgcuaaggccucugcgguccgcgccgcuuuccuuaacuuuuucagagaccggcaugggcaccgccugguuccuagcgccuccgugagaccccggggagauccuucucuccuguuugugaaugcuggcaugaaccaguucaaacccauuuuucuugggaccgucgacccucgcagcgaaauggccggauucagacggguggccaauucccaaaagugcguucgcgccggcgggcaucacaacgaucuggaggacgugggaagagaucucagccaucacacauuuuucgaaaugcugggcaauugggcuuuuggcggggaguacuucaaagaagaggccuguaacauggcuugggagcugcucacgcaggucuauggaaucccggaggaacggcuguggauuucuuacuuugacggcgaucccaaggccgggcuugacccugaucuggaaaccagagacaucuggcucucccugggagugcccgccagccgcguucuuucuuucggcccucaggagaauuuuugggagaugggggauacaggacccugcggcccguguaccgaaauucacuaugaccuggcuggcggggugggagcgccucagcucgucgagcuguggaaccugguguucaugcaacauaaucgggaagccgauggcucccuccagccccugccucagagacacguggacacagggaugggacuugagcgccuggucgcuguucuccagggcaaacauagcaccuacgacacagaucuguucucuccccuucugaacgccauccaacaggggugccgggcgcccccuuaucucggaagagugggcguggcugacgaaggccgcaccgauacggccuaccgggucguggcggaccacaucagaacccuguccguuuguauuagcgaugggguguuuccgggaauguccgggcccccucugguccuccgccggauccugagacgcgcugugcgguucucuauggagauucuuaaggcucccccuggcuuucugggaagccucguucccguggucguggagacacugggcgacgccuauccggaacuucagagaaauuccgcccagaucgccaaccuggucagcgaggaugaagcugccuuccucgcgucucuggagcgggggcgcagaauuaucgaccggacccugagaacacucggcccuuccgauauguuucccgccgaaguggcuuggagccugucucuuugcggagaccugggccucccucuggauaugguugagcugaugcuugaggaaaagggggugcaacucgacagcgccggacuggagcgccuggcucaggaagaggcccagcaccgggcgagacaagccgaacccguccagaaacagggccucuggcuggacgugcaugcucuuggggagcugcagcgccaaggaguuccucccaccgaugacuccccgaaguacaauuacucucucagaccuagcggcuccuaugaguucgggacgugugaagcccaggugcugcagcuguacacagaggauggcaccgcugucgccagcgugggaaaaggccagcggugcgggcuucuccuggaccgcacaaacuuuuaugccgaacaaggaggccaggcuucugauagaggguaccuggugcgggcgggacaggaggacguucucuuccccgucgcccgcgcucagguguguggcggguuuauucugcacgaggccguggcccccgaaugccuuagacugggcgaucaaguccagcuccauguggacgaggcuuggcggcugggauguauggccaagcacaccgcgacccaucugcuuaauugggcucuccgccagacacugggcccugggacggaacagcaaggaucccaccugaacccggagcagcucagacuggauguuaccacacagacaccccuuaccccugaacaacugcgggccguggagaacaccguccaggaggccgugggccaggacgaagcuguuuauauggaggaagugccccucgcccugacggcgcaggucccugggcugcgcagccuugaugagguguaccccgacccuguuagaguggucucugugggagugcccgucgcucacgcccucgauccggccucccaagcugcccugcagacaagcguugaacugugcugcggcacccaucuccugcggaccggggcugugggcgaccuugugaucaucggagacagacagcuguccaaaggcacaacccgccuccuggccgucacaggggagcaggcgcaacaggcccgggagcugggacagucucuugcucaggaagugaaggccgcuacggagagacugagccucggcucccgcgauguugccgaagcccugcggcucucuaaggacauugggagacugaucgaggcuguggaaaccgcggucaugccucaauggcagcgccgggagcuucuggccacagugaaaaugcuccagagacgcgcuaauaccgccauucggaagcugcaaaugggacaggccgcuaaaaagacacaggagcugcuugaaagacacagcaaaggcccccugaucguugauaccguguccgccgagagccucucuguccuggugaagguugugcggcagcucugugaacaagcgccuuccacgagcguccugcuucugucuccccagccgaugggcaaagugcucugcgcuugucagguggcccagggggccaugccuaccuucacagcugaggccugggcgcuggcugucugcucccauaugggaggcaaggccugggggagccgcguuguggcccaaggaaccggcucuacaaccgaccuggaggcugcccuuagcauugcucagacguaugcccugucccagcucuga

SEQ ID NO: 65311 - RNA, 2907 nt, Artificial Sequence
  derived and/or modified sequence opt5 from AARS__Homo_sapiens__NP_001596
auggacagcacccugacagccuccgagaucagacagcgguucauugauuucuucaagcgcaacgaacacacguacgugcauucuagcgcuaccaucccccucgacgauccuacacugcuuuuugccaaugcgggcaugaaccaauucaaaccgauuuuucugaauaccaucgaccccucccacccuauggcuaagcucucuagagccgccaacacacagaaaugcauucgggcugggggaaagcauaaugaucuggacgaugucggcaaagacguuuaucaccauaccuucuuugagaugcuugggagcugguccuucggagauuacuuuaaggaacuggccuguaagauggcucucgagcugcugacacaggaauuuggcauccccaucgagcgccucuaugugaccuacuuugggggagacgaggccgcgggccuggaagccgaucuugagugcaaacagauuuggcaaaaccugggccucgacgauacgaagauccugccugggaauaugaaagacaacuucugggaaaugggagacaccggccccugugggccuugcucugagauucacuaugauagaaucggaggccgggacgcugcccaccuugugaaucaggaugacccgaacguccuggagauuuggaaucucguguuuauccaguacaaccgcgaagcugaugggauucugaagccccugccuaaaaagagcaucgacacaggaaugggccucgagagacugguuuccgugcuucagaauaagaugagcaacuaugauaccgaccuguucguccccuacuucgaagccauccaaaaaggcacaggggcgcggccuuacaccggaaaggugggcgccgaggaugcugacgggauugauauggccuaucgcguucucgcugaccaugccagaacgaucacaguggcccuggcugacggaggccggcccgauaauaccgggcgcggauacguccuuagacggauucugcgcagagcggugcgguaugcccacgaaaaacucaacgcuucuagaggcuuuuucgccacacugguggacgucguugugcagucccugggcgaugccuuuccggagcucaagaaagacccugauauggugaaggacaucauuaacgaggaagagguccaguuccugaaaacccuuagccgcgggcggagaauccuggaucgcaagauccagucucucggagacuccaagaccauucccggcgauacagcuuggcugcuuuacgacacguauggguuuccuguggaucugaccggacucaucgccgaagagaaaggccugguuguggacauggauggguucgaagaggagcggaagcuggcgcaacucaaaagccagggcaagggagcuggcggggaagaccugauuaugcuugacaucuacgccauugaggaacugagagcccgcggacucgaggucacagaugacucucccaaauauaauuaccaucuggauuccagcggcuccuacguguuugaaaacaccguugcuacagugauggcccugcggagagagaagauguucgucgaggaagugucuaccgggcaggaguguggagucgugcuugacaagacgugcuuuuaugcugaacaaggcgggcagaucuacgaugagggcuaucucguuaaaguggacgauagcuccgaggacaagacagaguucaccgucaaaaaugcccaggugcgcggaggcuacguucugcacaucgggaccauuuauggagaucugaaggugggcgaccaggucuggcucuuuaucgaugaaccccggagacgcccuauuaugagcaaccacacagcgacccauauccugaauuucgcccuucggucugugcugggggaagcugaccaaaaaggaucccucguggccccggauagacugcgguuugacuucacagcuaagggcgccaugagcacgcagcagauuaagaaagcggaggaaaucgccaacgagaugauugaggcugccaaggcuguuuacacccaggacuguccccuggccgccgcuaaagcgauccaagggcuucgcgccgucuucgaugaaacauauccugaccccgugagaguggucucuaucggcgugccuguuagcgagcuccuggaugaccccuccggaccggcuggcucucugaccagcguggaauuuugcgggggaacacaccucagaaauuccagccaugccggcgccuucgucauugugaccgaggaagcuaucgccaaggggauucggcgcaucguugcggugacgggagcugaggcccagaaagcccugcggaaggcugagucucuuaagaaaugucuguccgucauggaagccaaggugaaagcgcagaccgcuccuaacaaggauguucagagagagauugccgaccucggcgaagcccuggcuacagccgugaucccccaauggcagaaagaugagcugcgcgaaacccuuaagagccucaaaaaggucauggacgaucuggacagagcuucuaaggccgaugugcagaaacgggugcuggagaagacaaaacaguuuaucgacuccaauccuaaccaaccccucgucauucuggagauggaaagcggggcguccgccaaggcucuuaaugaggcccugaaacucuucaagaugcacucuccucagaccagcgcuaugcuguuuacgguugacaacgaagccggcaagaucacaugccugugucaggugccccaaaaugccgcuaaccgcggacuuaaagcguccgagugggugcagcaggucucuggccucauggaugggaagggaggcgggaaagacgugagcgcccaggcuaccggaaagaauguuggcugccugcaagaggcccugcagcucgccacauccuucgcucagcugagacuuggcgaugugaaaaacuga

SEQ ID NO: 65312 - RNA, 2997 nt, Artificial Sequence
  derived and/or modified sequence opt5 from AASDH__Homo_sapiens__NP_001273597
augaagaaaugcaaccugaaguacauccucguggagaaaaagcagauuaauaaauucaagagcuuucacgaaacccugcuuaacuaugacacauucacggucgagcauaaugaucugguucucuuuagacugcacuggaagaacaccgaagugaaucuuaugcugaacgacggcaaagagaaguacgaaaaagagaagaucaaauccauuucuagcgagcaugugaaugaagagaaggccgaagaacacauggaucuccggcugaagcauugucuggcuuauguccuccacacauccgggaccacaggaauccccaaaauugugcgcguuccucacaagugcaucgugccgaacauccaacauuucagaguccuguuugacauuacccaggaggaugugcuuuuccuggccucuccccucacauuugacccuagcguuguggaaaucuuccuggcgcuuuccucuggcgcuagccugcucauuguccccaccuccgugaaacugcugccuagcaagcucgccucugugcuguuuucccaccaucgggucacgguucuucaggccacccccacacugcuccgcagauucgggagccagcugaucaaaucuaccgugcuuuccgcuacaaccagccugcgggugcucgcccugggaggcgaggcuuuuccuucucugacgguccuccgcuccuggagaggggaaggaaauaagacacaaauuuucaacguguacggcaucaccgagguuagcuccugggccacaauuuaucggaucccggagaaaacccuuaauucuacccugaagugugagcugcccgugcagcucggcuuuccucugcuugggacagucguggagguucgcgauacgaacggauucaccauccaggaaggcagcgggcaaguguuccugggaggcagaaaucgggucugcuuucucgacgaugaggugacagucccccuggggaccaugcgcgcgacaggagacuucgugaccguuaaggauggcgaaaucuuuuuccugggcagaaaagacucccagauuaagcggcacgggaaacgccucaacauugagcuggugcagcaggucgccgaggaacuucagcaaguggagagcugugcuguuacgugguacaaucaggaaaagcugauccucuuuauggugucuaaagaugccuccgucaaggaguauauuuucaaggaacugcagaaauaccugccuagccacgcugugcccgacgagcuugugcucaucgacucucugccguuuacaagccauggaaagaucgauguuuccgaacugaacaaaauuuaccucaacuauaucaaucugaagucugagaacaaacuuagcggcaaggaggaccugugggaaaagcuccaauaccuguggaaauccacccugaaucuuccugaggaucuccugagaguccccgacgaaagccuguuccucaacucugggggagauucccuuaagagcauucggcugcugucugagaucgagaaacucgugggcaccuccgugccugggcugcuggaaauuauccuuagcuccucuauccucgagauuuauaaucacauccugcagacagucgugcccgacgaagauguuaccuuuagaaagagcugcgccacaaaacgcaagcuguccgacauuaaccaggaggaagcgucuggaacgagccuccaucagaaggccaucaugaccuucacaugucacaaugagauuaacgcuuuugugguccugucccggggcagccaaauccuuucucucaauuccaccagauuccugacaaaacugggccauugcagcucugccugucccuccgauagcgugucucagaccaacauucagaaucugaaggggcuuaacagcccuguucucaucggaaaauccaaggacccgagcugcguggcuaaagucucugaggaaggcaagcccgccaucgggacgcagaaaauggagcugcacgugcgcuggcgguccgauaccggaaaguguguugacgccagcccucugguggucauucccacauuugacaaguccucuaccacaguguacaucggcagccacucccauagaaugaaagcuguggauuucuauucugggaaggucaaaugggaacaaauucucggcgaccgcaucgagagcuccgcgugcguuucuaagugcggaaauuucauuguggugggcuguuacaacgggcuggucuaugugcuuaaaagcaauuccggagaaaaguacuggauguuuaccacggaggaugccguuaagagcucugcuacaauggacccuaccacaggccugaucuacaucgggucccacgaucagcaugccuaugcccucgacauuuaccggaaaaagugcguguggaaaagcaaguguggaggcaccgucuucucuucccccugccugaaccugaucccgcaccaccuuuauuuugcuacccucgggggccugcugcucgccgugaacccugcgacaggaaauguuauuuggaaacauagcuguggcaagccccuguucucuuccccucagugcuguagccaguacaucugcauuggguguguggauggaaaccuucugugcuuuacgcacuucggcgagcaagucuggcaguuuuccaccagcgggcccaucuucucuagcccuuguacaucccccucugaacagaagaucuuuuucggaagccaugacugcuuuauuuauugcuguaauaugaaaggccaccuccaguggaaguucgagaccacauccagaguguacgcuaccccguuugccuuccauaacuauaaugggucuaacgaaaugcugcuggccgcugccagcacggauggcaaaguuuggauccuugagucccaaucuggacagcugcagagcguguacgaacucccuggcgaggucuucuccagccccguggugcuggagucuaugcucauuaucgggugccgcgacaauuacgucuauugucuggaucuucugggaggcaaccaaaaguga

SEQ ID NO: 65313 - RNA, 930 nt, Artificial Sequence
  derived and/or modified sequence opt5 from AASDHPPT__Homo_sapiens__NP_056238
augguguuccccgccaagagauuuugccuggucccuagcauggagggcguucggugggcuuucuccugugggaccuggcucccgucucgcgccgaauggcugcuugcggugagaagcauccagcccgaggaaaaagagcggauuggacaauuuguguucgcucgcgacgccaaggccgcuauggccggcagacugaugauccggaaacucgucgcugaaaagcugaacauuccuuggaaucacauccgccuucagagaacagccaaagggaagcccgugcuggcgaaggauuccucuaacccuuaccccaauuuuaacuucaauauuagccaucagggagacuaugccguucucgcugccgagccugagcuccaggugggcaucgauaucaugaaaacguccuuuccggggcggggaucuauucccgaguucuuucacaucaugaagcgcaaauucaccaacaaggaaugggaaacaauucggagcuuuaaagacgaguggacccaacuggauauguucuacagaaauugggcucugaaggaguccuuuaucaaggccauuggcgucggccugggguucgaacuucagcgccuggaguucgaccucagcccucugaaccuugauaucggacagguguauaaagaaacaagacuguuucucgacggcgaggaagagaaggagugggcguucgaagagucuaaaauugaugaacaucacuuuguugccguggcucugcggaagcccgacgggucccgccaucaggaugucccuagccaagacgauucuaaacccacccagagacaguucacaauccugaauuuuaacgaccucauguccagcgccgugccgaugaccccugaggaccccucuuucugggauugcuuuuguuucacggaagagaucccuauucggaauggaaccaaguccuga

SEQ ID NO: 65314 - RNA, 2781 nt, Artificial Sequence
  derived and/or modified sequence opt5 from AASS__Homo_sapiens__NP_005754
augcuucaggugcacagaaccggccucgggcggcugggagucagccuuuccaagggccugcaucacaaagccguucucgcugugcgcagagaggacgugaacgccugggaacggcgcgcgccccuggcuccuaagcauaucaaagggauuacaaaucuuggauacaagguccugauccaaccgucuaacagacgggccauucacgauaaagacuaugugaaggccggcgggauccuccaggaggauauuagcgaggcuugccugauccugggaguuaagagacccccugaagaaaaacucaugucccgcaagacguacgccuucuuuucucauaccaucaaagcucaggaggccaauaugggccugcuugacgagauucugaagcaggaaauccggcucauugauuaugagaaaaugguggaccaccgcggcgucagagugguugcguucgggcaaugggccggaguggcuggcaugaucaacauucugcacgggaugggacuucggcugcucgcccugggccaucacacacccuuuaugcauaucgggauggcucacaauuaccgcaacagcucccaggccguccaggcggugagagaugccggauaugaaauuucucugggccucaugccuaagagcaucggcccccugaccuucguguuuacagggaccggaaaugucuccaagggcgcucaggccaucuucaacgagcuuccuugugaguacguugaaccgcacgagcugaaagaagugagccaaacaggggaccuccggaagguguauggaaccguccugucucgccaucaccaucuugugagaaaaacggaugcuguuuacgaccccgccgaguacgauaagcacccugaacgguauauuuccagauuuaauaccgacaucgcccccuacacaaccugccugauuaacggcaucuauugggagcagaauacaccucgccuccugacccggcaggaugcucagagccugcucgcgcccgggaaauucucuccggccggaguggagggcuguccugcucugccccauaagcuggucgccauuugcgacaucuccgccgacacgggcgggagcaucgaauuuaugacagaguguaccacaauugaacacccuuucugcauguacgaugcugaccaacacaucauucaugauucuguggagggauccggcauccugauguguagcauugacaaccuccccgcccagcugcccaucgaagcgaccgagugcuuuggggauaugcuuuauccuuacguugaggaaaugauccuguccgacgcuacccagccgcucgagucucaaaauuucagccccguggucagagaugccgugauuacauccaacggaacgcugccugacaaauauaaguacauccagacccugcgcgaaagccgggagagagcccagucucucuccaugggcacacgccggaagguccuggugcuugggagcggcuacauuucugaacccguucuggaguaucucagcagagauggaaauaucgagauuaccgugggcuccgacaugaaaaaccagaucgaacaacuggggaagaaauacaacauuaauccugucucuauggauaucuguaagcaggaggaaaaacugggauuucuuguggcuaagcaggaccucguuaucagccugcugcccuaugugcuccacccgcuggucgccaaggcuugcauuacaaacaaagugaauauggugaccgccuccuacaucacgccugcgcuuaaggagcuggagaaaagcguugaagacgccggcauuacaaucauuggggagcucggacuggaucccggccuggaccauaugcuugcuauggaaaccaucgauaaggccaaagaggucggggcuaccaucgaaucuuauauuuccuacuguggcggacucccugcccccgagcacagcaacaauccucugcgcuauaaguucucuuggucccccgugggcgugcugaugaacgucaugcagagcgcgacauaccuccuggacgggaaggugguuaauguggccggaggcaucuccuuccuugaugcugucaccucuauggacuuuuucccggggcugaaccucgagggauacccuaaucgggauagcacaaaauaugccgaaauuuacggcaucuccucugcucacacgcugcugagagggacccuucgcuauaagggcuacaugaaagcccucaacggauuugugaagcugggccugauuaaucgggaggcccuccccgcuuucagacccgaagcgaacccucugacauggaaacaacuucugugcgaccucguugggaucagcccguccagcgagcaugaugugcugaaggaagccguccugaagaaacuuggaggcgacaauacccagcucgaggcugccgaguggcuggggcugcucggagaugaacaggugccccaggccgagucuauccuggacgcucuuuccaagcaccugguuaugaaacucagcuauggcccugaagagaaggauaugauugugaugcgggacucuuuugggauccgccaucccuccggccaccuggaacauaaaacaauugaccuggucgccuacggagauaucaacggcuucagcgcgauggcuaagaccguggggcuuccuacggccauggccgcuaaaaugcugcucgacggagagauuggcgccaaggggcugaugggacccuuuucuaaggagaucuauggcccuauccucgaaagaauuaaagcggagggcaucauuuacaccacacaaagcaccaucaagcccuga

SEQ ID NO: 65315 - RNA, 1683 nt, Artificial Sequence
  derived and/or modified sequence opt5 from AATF__Homo_sapiens__NP_036270
auggccggcccccagccucuggcucuccaacuggagcagcuucugaacccgagacccagcgaagccgacccugaggcggaucccgaagaggcuaccgccgcccgggugaucgaccgcuucgaugaaggggaggacggagagggcgauuuucucgucguuggguccauuagaaagcuggcuucugccagccuucuggacacagauaaacgguacugcggaaagacgaccucccgcaaagccuggaaugaagaccacugggagcagacacucccuggcucuagcgaugaagagaucuccgacgaggaagggucuggagaugaggacagcgaaggccugggccuggaggaauaugaugaggacgaccucggggcugcggaggaacaggaguguggagaucauagagaauccaagaaaagccggucucacuccgccaagacccccggcuucagcgugcaaucuauuuccgacuuugagaaguucacaaaagggauggaugaccugggaagcucugaagaggaggaagaugaggaauccggcauggaggaaggggacgaugcugaggacagccagggagaguccgaagaggaucgcgccggcgacagaaacucugaagaugacggcguggucaugaccuuuagcuccgugaagguuagcgaggagguggaaaaagggcgggcugucaagaaucagaucgcccuuugggaccagcugcucgagggacgcauuaaacugcaaaaggcgcuucugacaaccaaccagcucccucagccggauguguucccccuguuuaaggacaaaggcgggccugaguucucuuccgcccugaagaauagccauaaagcucucaaggcccugcuuagaucucugguuggacuccaggaagaacugcuuuuucaauaccccgauacgcgguaucugguggacggcaccaaaccuaacgcugggagcgaggagaucuccucugaagaugacgagcucgucgaagagaagaaacagcagcgcagacgggugcccgccaagcgcaagcuggaaauggaggauuacccgagcuucauggccaaaagauuugcugacuucacaguguaucggaauagaacccugcaaaaguggcacgauaaaacaaagcucgcguccggaaaacugggcaagggcuuuggggccuucgagcgcagcauccuuacccagauugaccauauccugauggauaaggaacggcuccugagacgcacgcagacaaaacggucugucuacagaguucuuggaaagccugagcccgcugcccagccugugcccgaaucccugcccggcgagccugaaauucucccgcaagcccccgcuaacgcccaccugaaagaccuggaugaggagaucuucgacgacgaugacuuuuaucaccagcuccugcgcgaacuuauugagcggaagaccagcucucuggauccuaaugaccagguggcgauggggagacaguggcucgcuauccaaaaacugcgcuccaagauucauaagaaagucgaucggaaggccagcaaaggaagaaagcugcgcuuccacgugcuuuccaaacuccugucuuuuauggcccccaucgaccauacaaccaugaacgaugacgcucggaccgaacuguacagaagccucuucggccagcugcacccucccgaugaggggcacggcgacuga

SEQ ID NO: 65316 - RNA, 4125 nt, Artificial Sequence
  derived and/or modified sequence opt5 from AATK__Homo_sapiens__NP_001073864
augagcuccucuuucuuuaaccccagcuucgccuuuuccucucacuucgacccugauggcgcuccgcugagcgagcucuccuggcccucuagccuggccguggucgcgguuuccuuuagcgggcuuuucgcugugaucgugcugaugcucgccugccuguguugcaagaaaggaggcauuggguuuaaggaguucgaaaaugccgaaggagacgaguacgcugccgaucuugcucagggcucuccugccaccgcggcccaaaacgggcccgacgucuaugugcugccucucacagaaguuucccugcccauggcuaaacagccuggaagaagcgugcagcugcucaagucuacggaugucggccggcauucccugcuuuaccugaaagagaucggccgcgggugguuuggaaagguguuccucggcgagguuaauagcgggauuucuuccgcccagguggucgugaaggaacugcaagcuagcgccuccgugcaggagcagaugcaguuucuugaagagguccaaccguauagagcgcugaaacacucuaaccuccugcagugucuggcccagugcgcugagguuacccccuaccuccuggugauggaguucuguccucuuggagaccugaagggcuaucuccggagcugccgcguggccgaauccauggcucccgauccuagaacacugcagcggauggccugugaagucgccugcggggugcuucaucugcaccgcaauaacuuuguucauagcgaccucgcucugagaaauugucugcucaccgcggaucugacagugaaaaucggagacuacggccuugcccacugcaaguaucgggaggauuacuucgucaccgcugaccaacugugggugccccuccgcuggauugccccggaacugguugaugaggugcacucuaaccuucuggucguggaccagacaaaauccggcaaugucuggagccucggggugaccaucugggagcuguucgaacugggaacgcagccuuacccccaacauucugaccagcagguucucgccuauaccgugagagagcagcaacugaaacuuccuaagccccagcugcagcucacacugagcgaucggugguacgaagucaugcaguuuuguuggcugcaacccgagcagcgcccuaccgcugaagaggugcaccuucuccuguccuaucugugcgccaagggcgcgacagaggcugaagaggaguucgaaagacgguggcgcucucucagacccgggggaggcgggguuggacccggcccuggcgccgccgggcccaugcugggaggcguggucgaacuugcugccgcuagcuccuuuccucugcucgagcaguucgccggggacggauuucaugcggauggcgacgaugugcugaccgugacggagacaagccgggggcugaacuucgaauacaagugggaggccggcagaggagcugaagccuuucccgcuacccuuucuccgggccgcacagcccggcuccaggagcugugcgcgccugacggggcucccccuggaguuguccccgugcuguccgcccacagcccuucucucggcuccgaguauuucaucagacuggaagaggccgcucccgccgccgggcacgauccggacugugcuggaugcgcgccuagcccgcccgccaccgcugaucaagacgaugacuccgacggcucuaccgccgccagccuugcuauggaaccucugcucgggcauggcccgcccguggaugucccuuggggacgcggcgaccacuacccccggagaucccuggcccgcgauccucugugucccucucggagcccuucccccagcgcggggccgcuuucucucgcugagggaggcgccgaagacgccgauuggggaguggcugccuuuugcccugcguucuuugaggacccccuggggacauccccucugggcagcucuggggcucccccgcucccucugacgggcgaggaugaacuugaggaaguuggagccagacgcgccgcucagcggggccauuggagauccaaugugagcgccaacaauaacucugggagccgcugucccgaguccugggacccugucagcgcuggaggccacgccgaagggugccccucucccaaacagaccccucgggcguccccggagcccggauauccuggcgagccccugcucgggcugcaggccgcuagcgcccaagaaccuggcuguugccccggacugccucaucuuuguuccgcucagggccucgccccggcccccugccuggugacaccuucuuggaccgagacagcuagcuccgggggagaucacccccaggcggaaccuaagcuggccaccgaggcugaaggcacgacagggcccagacucccgcugccuucuguucccagccccucccaagagggagccccucuucccucugaggaagccagcgcuccugacgccccggaugcgcugcccgacuccccuacccccgcuaccggcggcgaggugagcgccauuaaacucgccucugcucugaauggguccucuagcuccccugaagucgaggcccccagcucugaggaugaagacacagcggaggcuaccuccggaaucuucacagacacgagcuccgauggccugcaggcccggcgcccggacgugguuccugccuuuagaagccuucagaaacagguggggacccccgauucucuggacagccucgauauuccuuccucugcuagcgacggaggcuacgaagucuucucccccucugccacagggccuagcggaggccaaccccgggcucuggauuccggcuacgacaccgagaacuaugaaucuccggaguucgugcucaaggaggcccaggaagggugugagccucaggcguuugccgaacuggcuagcgagggagaaggccccgggcccgagacaagacuuuccaccagccugucuggacucaacgagaagaauccuuaccgcgauuccgccuauuucagcgaccuggaagcugaggccgaagccacgucuggcccggagaagaaaugcgggggagaucgggcucccggcccugaacugggccuucccuccaccgggcagccuagcgagcaagugugccugagacccggagucuccggcgaggcgcaggggucuggaccuggcgaaguucucccgccccugcuccagcuggaggggagcuccccugaacccagcacauguccuucuggacuugugcccgagccgccugagccccagggccccgccaaggugcgcccuggccccuccccuagcugcucucaauuuuuccugcucaccccggucccccugagaagcgaagggaacuccucugaguuucagggaccucccggccugcuuagcgggccugcuccccagaaacggaugggaggcccggggacaccucgcgcuccccugagacucgcccugccuggacuccccgccgcccuggaaggccggccugaggaagaggaggaagacuccgaggauucugacgaaagcgacgaggaacuucgcuguuacuccgugcaagagcccagcgaggauucugaagaggaagcgccggcuguuccuguggucguggccgagucccagagcgccagaaaucugcggucccugcucaagaugcccucucugcuuagcgaaaccuucugcgaggaccuggagcgcaaaaagaaggcuguuuccuuuuucgaugacgugacggucuaucucuuugaucaggaaucucccacaagagagcugggcgaaccuuucccgggggccaaagagagcccucccaccuuucuccggggaucccccggcagcccuucugcgcccaaccgcccucagcaagccgacgggucccccaauggaagcacagcugaggaaggcgggggauucgccugggaugacgauuuuccgcugaugaccgcuaaggccgcuuucgccauggcgcuugacccugccgcucccgccccugcugcccccaccccgacgccugcccccuucucuagauuuacagugucccccgcuccuaccagccgguucucuaucacacacguuagcgauuccgacgcggagucuaaaagaggccccgaagccggcgcugggggagagagcaaggaagccuga

SEQ ID NO: 65317 - RNA, 1503 nt, Artificial Sequence
  derived and/or modified sequence opt5 from ABAT__Homo_sapiens__XP_011520703
auggccagcaugcugcucgcucagagacuggccugcuccuuccaacacucuuaccggcuucuggugcccggcagccgccauaucucccaggcggcugccaaggucgacguugaguuugauuaugacgggccucucaugaaaaccgaagugccgggacccagaucucaggagcugaugaagcagcuuaacauuauccaaaaugccgaagcugugcacuucuuuuguaacuacgaggaaagccggggcaauuaucuggucgauguggacgggaaccgcaugcucgaucuguacucccagauuucuagcguuccuaucggauauucccaucccgcccugcucaaacugauucagcagccucaaaaugcuagcauguucgugaacagacccgcccuuggcauccugccuccggagaauuuugucgagaagcuccggcagucucugcuuuccguggcgcccaaagggaugagccagcugaucacaauggccugcggaucuuguuccaacgaaaaugcucucaagacgauuuucaugugguaccgcagcaaggagagaggccagcggggcuuuucucaagaggaacuggagaccugcaugaucaaccaggccccugggugucccgacuauuccauucugagcuucaugggagcuuuucacggccgcacaauggggugccucgccaccacacauuccaaagcgauccacaagauugauaucccuucuuucgacuggcccauugccccguuuccuagacugaaauacccccuugaagaguucguuaaggaaaaucagcaagaggaagcucggugucuggaggagguggaagaucucaucgucaaauaccgcaagaagaaaaagaccguggccggaaucauuguggagccuauccagagcgaaggcggggacaaccacgcuuccgaugacuuuuucagaaaacugcgggauauugcccgcaagcauggaugcgccuuccuugucgacgagguucagacaggcggcggguguaccggaaaauuuugggcucacgaacauuggggccuggacgaucccgcggacgugaugacguucagcaagaaaaugaugaccgggggauuuuuccacaaggaggaguuuagacccaaugccccuuaucggaucuucaacacauggcucggcgauccgucuaagaaucugcugcucgcugaagugauuaacaucaucaaaagagaggaccugcuuaacaaugccgcccacgcugggaaggcccugcucaccggacugcuugaucugcaggcgcgcuacccccaauuuauuucccgggucagaggccgcggcacauucugcagcuuugacaccccugaugacucuauccggaacaaacucauucugaucgcuagaaauaagggggugguucugggaggcuguggggauaaaagcauucgcuuccggcccacgcucguguuuagagaccaucacgcccaucuguuccuuaacaucuuuuccgauauccuggccgacuucaaguga

SEQ ID NO: 65318 - RNA, 6834 nt, Artificial Sequence
  derived and/or modified sequence opt5 from ABCA12__Homo_sapiens__NP_056472
auguucaccuacaucaagauuaucacaagcggcgacuccgauaacauuacgcacguguggaaugaagacgaugggcagacccugucucccagcucccucgcggcucaacugcuuauccuggaaaacuuugaggacgcccuccugaauauuucugcgaacagcccuuauaucccguaccuugcuugcguucggaauguuacagauucccuggcccggggaucucccgaaaaccuccgccugcugcagagcaccaucagauucaagaaguccuuucuccggaauggcagcuaugaggacuacuucccucccgugccugaagugcugaagucuaaacuuucccagcugcgcaaccucacagagcugcuuugugagagcgaaaccuuuucucugauugagaaguccugccagcucagcgauaugucuuucgggucccugugugaagagagcgaguuugaccugcaacuccuggaagccgcugagcuuggaacagaaaucgccgcuucccugcucuaucacgauaaugucauuucuaagaaggugagagaccugcuuaccggcgaucccagcaaaaucaaccugaauauggaccaguuccucgagcaggcccugcagaugaacuaccuggaaaauauuacgcaacucaucccuauuaucgaggcgaugcugcacguuaacaauuccgccgaugcuagcgagaagccggggcagcuucuggaaauguuuaaaaacguggaggaacucaaggaggaccugcggcgcaccacaggaaugucuaacagaaccaucgacaaacuucuggccauucccaucccugauaaucgggcugaaauuaucucccaggucuucuggcuccacagcugcgacacaaacauuaccacgcccaagcuggaggaugccaugaaggaguuuuguaaucugucucucagcgaacgcuccagacagucuuaucugaucggccuuacacugcuccacuaccugaacaucuacaauuucaccuauaaaguguuuuucccucggaaggaccaaaaacccguugagaagaugauggaacuguucauucgccuuaaagagauccucaaccagauggcgagcggcacacauccgcugcuggauaagaugagaucccucaaacagaugcaucugccucggagcgugccccuuacccaagccauguaccgcucuaauagaaugaacaccccucagggguccuuuagcacaauuucucaggcucugugcucccagggaaucacgaccgaauaucucacagccaugcugcccagcucccaacggcccaagggcaaucacaccaaggacuuccugacauacaaacuuaccaaggagcagauugcuucuaaauaugggaucccuaucaacagcacgccguuuuguuucucccucuacaaggauauuaucaauaugcccgccggaccugucauuugggccuuucugaaacccaugcugcucggcagaauccuguaugcuccuuacaaccccgugacaaaggcgauuauggagaagucuaaugugacccuucgccagcuggccgaacuccgggagaaaagccaggaauggauggacaaguccccgcuguucaugaacagcuuucaucugcuuaaucaagcuaucccuaugcuccagaacacccugagaaaccccuucguccagguuuuugugaaauucucuguggggcuggaugccgucgagcuccugaagcagauugacgagcuugauauccugcgccucaaacuggaaaauaacaucgacauuaucgaccaacugaauacacuuuccagccucaccgugaacauuucuuccugcguucuguacgaucggauccaggccgcuaagacaauugacgagauggaaagagaggccaagcgccuguauaaaagcaaugaacucuuuggaucugugaucuucaagcugccuagcaaccgguccuggcacagaggcuacgauagcggcaaugucuuucuucccccugugaucaaauauacgauucgcaugucucugaagaccgcgcagacaacccggucccucagaacaaaaaucugggcucccgggccgcauaacagcccuucccacaaucagauuuacggacgcgccuucaucuaucugcaagacucuauugagcgggccaucaucgagcugcagaccggcagaaacagccaggaaauugcuguucaagugcaggccauccccuaccccuguuucaugaaggauaauuuucuuacguccgucucuuauagccugccuauugugcucauggucgcuugggugguuuucaucgccgcguuugugaagaaacuggucuacgagaaggaccuccggcugcacgaauacaugaaaaugaugggggugaacuccugcucucauuucuuugccuggcuuauugagagcguuggauuccugcucgugaccaucgucauccugauuaucauucugaaguuuggcaauauccuuccgaaaacaaacggguucauucuguuucucuauuucuccgauuacagcuuuucugugaucgcuauguccuaucugauuagcguguucuuuaauaacaccaacaucgccgcucucaucggaucucugauuuacaucauugccuucuuccccuuuaucguucuugucacaguggaaaaugagcuguccuaugugcucaaggucuucaugagccugcugucuccuaccgcguuuuccuacgccagccaguauauugcucgcuacgaggaacagggcaucggccuucaaugggagaacauguacacgucccccgugcaggacgauacaaccagcuucggguggcuguguugccucauccuggccgacucuuuuauuuauuuccucaucgcuugguacguuagaaauguguuuccuggaacauauggcauggccgcccccugguacuucccuauucugcccagcuauuggaaagaacgguuugggugcgcugaggucaagccggaaaaguccaacggacuuauguucaccaauaucaugaugcagaacaccaauccuucugcgagccccgaguacauguuuuccucuaacauugagccugaacccaaagaucugacagugggcguugcccugcacggggugacgaagaucuauggcagcaaagucgcuguggacaaucucaaccugaauuucuacgagggacauaucaccucccuucugggcccgaacggggccggaaagacaaccacaauuucuaugcucaccggccuguucggggccagcgcuggaacgaucuuuguuuacggcaaagauauuaagacagaccuccacaccgugagaaagaauaugggggucuguaugcagcaugacgugcuguucuccuaucuuaccacaaaagaacaucugcugcucuacggcagcaucaaggugccucacuggaccaaaaagcaacugcaugaggaggucaaacgcacacuuaaggauacgggacuguauucucaccggcauaagagaguuggcacccucuccgggggaaugaaacgcaagcugagcauuucuaucgcccucauuggcggguccagaguggugauccuggacgaacccagcacaggagucgauccuugcucccggcgcucuaucugggacgugauuagcaaaaacaagaccgcgagaacaaucauucuuuccacccaccaccuggaugaggcugaaguucugagcgaccggaucgccuuucucgagcagggcgggcugcgcuguugcggcucucccuucuaccuuaaagaagccuuuggagauggcuaucaucugacgcucaccaagaagaaaucccccaaucugaacgcuaacgccgugugugacacaauggcggucaccgcuaugauucagagccaccucccugaggccuaccugaaggaggauaucgggggagaacuuguguauguucugccgcccuucucuacaaaagugagcggcgccuaccugucccuccugagagcucuugacaaugggaugggagaucugaacaucggcugcuacgggauuucugacaccacagucgaggaaguguuucucaaucugaccaaggagagccagaaaaacuccgccaugucucuggaacaucucacgcaaaagaaaaucggcaauagcaacgcuaauggaauuuccacaccugaugaccuuagcguuucuuccagcaacuucaccgaccgggaugacaagauccugacccgcggcgagagacuggauggguuuggacuccugcuuaagaaaauuauggccauccugaucaagcgguuccaccauacacgcagaaauuggaaaggccucauugcccaggugauccugcccauugucuuugugaccacggccauggggcugggaacacuccggaacuccucuaauagcuauccugagauccagauuucccccucucuuuacggcaccagcgaacaaacagcuuucuaugccaacuaccacccuuccaccgaggcucuggugagcgccaugugggacuuuccgggcaucgauaauaugugucugaacacaucugaccuccagugccugaauaaggauucccuugaaaaauggaacaccagcggggagcccauuacgaauuucggagucuguucuugcuccgaaaacguucaggaguguccuaaguucaacuauucucccccucacagacgcaccuacuccagccaggugaucuauaaucugacaggccaacggguggagaacuaccucaucuccaccgccaaugaauuuguccagaagagauacgggggauggucuuucggccugccccugacaaaagaccuccgcuuugauauuaccggggugccggcuaaccggacgcuugcgaagguuugguaugacccugagggauaccauagccugcccgccuaucugaauagccucaacaauuuccugcuuagagugaacaugagcaaauacgaugcugcccgccacggcaucauuauguauucccaucccuacccuggcguccaggaccaggaacaagccacaaucucuagccugauugacauccucguggcucuguccauccugaugggguauucuguuaccacagccagcuuugugaccuacgucgugcgggagcaccagaccaaggcgaaacagcuccagcauauuuccggaaucggcgucacaugcuacugggugacgaauuucauuuaugauauggucuuuuaccuugugcccgucgcuuucucuaucgggauuaucgccaucuuuaagcugccugccuucuauagcgagaacaaucugggagcugugucccuccugcuucugcucuuuggcuacgccaccuucagcuggauguaucugcuggcggggcucuuucacgaaacaggaauggcuuucauuaccuacguuugcgugaaccuuuucuuuggcaucaauucuauugucucccugagcgugguguauuuccugucuaaggagaaaccgaacgaccccacacucgaacugaucuccgagacccuuaagagaauuuuucugaucuucccucaauuuuguuucggcuacgggcucauugaacugagccagcagcagucuguucuggauuuucucaaagccuacggagucgaguaucccaaugagacguucgaaaugaacaaacuuggcgccauguuuguggcucuggugucccaagggacaauguucuuuagccugcgccuccugaucaacgagucccuuaucaaaaagcugagacucuucuuuagaaaguucaauagcucucacguccgggaaaccauugacgaggaugaagacgugcgcgccgagagacugcggguugagagcggagcugccgaguucgaucuggugcagcucuacugccuuaccaaaacauaucagcugauccauaagaaaauuaucgcggucaacaauauuuccaucggcaucccugccggggaguguuuuggacugcucggcgugaacggcgcugggaagaccacaauuuucaaaaugcugacgggagacaucauucccucuagcggcaauauccuuauucgcaacaagaccgggucccugggacacguugauucucauagcucccucgugggcuacugcccgcaagaagacgcccuggaugaccuggucacaguggaggaacaccucuauuuuuacgcuagaguucacgggaucccugagaaggauaucaaagagaccgugcauaaacuucugcggagacugcaccucaugcccuucaaagaccgcgccacaucuauguguagcuauggaaccaagcggaaacuguccacggcccuugcucugauuggcaagccuagcauccuccugcuggacgaacccucuuccggcauggauccuaaaagcaagagacaucucuggaagauuaucucugaggaaguccagaauaaaugcuccgugauucuuaccagccacuccauggaggagugugaagcgcugugcacacgccuggccaucauggugaacgggaaguuucaguguauuggaucucuccagcauaucaaaagccgguucggcagaggguuuaccgucaagguucaccugaaaaauaacaaggugacaauggagacccuuacaaaguucaugcaacugcacuuucccaaaacguaccucaaggaccagcaucuguccaugcuggaauaccacgugccggucaccgcuggaggcguggccaauaucuucgaucuccuggagacaaacaaaaccgcccuuaauauuaccaacuuucugguuagccagacaacgcucgaagagguguucaucaauuuugcuaaggaccagaaaucuuaugagaccgccgauacauccagccaagggucuaccauuagcgucgacucccaggaugaccagauggaaucuuga

SEQ ID NO: 65319 - RNA, 15177 nt, Artificial Sequence
  derived and/or modified sequence opt5 from ABCA13__Homo_sapiens__NP_689914
augggacacgcugggugccaguucaaggcucugcucuggaaaaauuggcuguguagacuucggaaucccgugcuguuucucgcugaguucuuuuggccuugcauucuguucgugauucuuaccguucugcgcuuucaagaaccgcccagauaccgggauaucuguuaccuccagccucgcgaucugcccagcugcggagugauuccuuucgugcagucccugcucuguaacacgggcucuagaugccggaauuuuagcuacgaaggguccauggaacaccacuuccgccugucuagauuucagacggccgcugaccccaagaaagucaacaaucuugcuuuccugaaggaaauccaagaucucgccgaagaaauucauggaaugauggacaaagcuaagaaccugaagcggcuuuggguggagcgcagcaauaccccugauuccucuuauggcagcuccuuuuucacaauggaccugaacaaaaccgaagagguuauccucaagcuggaaagccugcaccagcagccgcauaucugggauuuucuccugcuucugcccagacuccacacaucucacgaccauguggaggaugggauggacgucgccgugaaucugcuucagaccauucugaacucccucaucagccuggaggaucuggacuggcucccucugaaucaaacauucucucagguuuccgaacuugugcugaacgucaccauuagcacgcucaccuuccugcagcagcacggaguggcugugacagagcccgucuaccaucuuucuaugcaaaauaucguuugggauccucagaaagugcaguaugaccugaagucccaauuuggcuucgacgaucuccacaccgaacagauucugaacagcuccgccgagcugaaagaaauccccacagacaccucucucgagaagaugguguguagcguccuguccagcacgucugaggaugaagcggagaaguggggccacgucgggggaugccauccgaaaugguccgaagccaagaauuaccuuguucacgcugugagcuggcugcgggucuaucaacagguguuuguucaauggcagcagggcucucuccugcagaaaacacugaccgggaugggacauagccuugaggcccuccgcaaccaauucgaagaggaguccaagccuuggaaaguggucgaagcucugcacacagcccugcuccugcuuaacgacucucugagcgcggauggccccaaggacaaucauaccuuuccuaaaauucuccagcaccuguggaagcugcagucccuucuccagaaccugccccaauggcccgcccugaagagauuccuccagcuggauggggcccuucggaaugccaucgcucagaaccugcacuuugugcaggagguccucaucugucuggaaaccagcgccaaugacuucaaaugguuugagcugaaccaacuuaagcucgaaaaagauguguucuuuugggagcugaagcagaugcuggccaaaaaugcuguuugcccuaacggacgcuucucugagaaggaaguguuucucccgcccggcaauuccagcauuuggggcgggcugcagggacuucuguguuacugcaacucuuccgagacaagcguccucaauaagcugcugggcuccguggaagacgcggauagaauccuucaagagguuauuacguggcauaaaaacaugucugugcucaucccugaggaauaccuggacuggcaggagcuggaaaugcagcucagcgaggccucccugucuugcacccggcuuuuccugcuccugggggcugaccccagcccugaaaaugaugucuucuccagcgacuguaagcaccagcuggugucuacagugauuuuucauacccuugagaaaacacaauucuuucuggagcaggccuauuacuggaaggccuucaaaaaguuuaucagaaagaccugcgaaguugcucaguaugucaacaugcaggaguccuuccaaaaucgccuccuggccuuucccgaagagagcccguguuucgaagagaacauggauuggaaaaugaucucugacaacuacuuucaguuccucaauaaccugcuuaaguccccuacggcgagcauuucucgggcucugaauuuuacaaaacaccuccugaugauggagaagaaacugcacacccuugaagaugagcagaugaacuuccugcucagcuuuguggaguucuucgagaagcugcuccugcccaaucuuuuugacuccagcaucgugccuucuuuccauucccugcccagccucaccgaagauauucugaacaucuccucucuguggacaaaucaccuuaagagccugaaaagagacccuuccgccaccgaugcccagaagcuccuggaguuuggaaacgaggucauuuggaaaaugcaaacacucggcucucauuggauccgcaaggaacccaaaaaucugcuucgguucaucgagcugauucuguuugaaaucaacccgaagcuccuggagcuuugggcuuaugggauuagcaaaggaaagagagccaagcuggagaauuucuuuacgcuccugaacuucuccgugccugaaaaugagauccucucuaccagcuuuaacuucucccagcuguuucacagcgacuggcccaaaucucccgcuaugaauauugauuucguucgccuuuccgaagccaucauuacaagccugcaugaguucggcuuucuggaacaggagcaaaucucugaggcgcucaacaccguguacgccauccggaacgcuuccgaccuguucagcgcccuuucugaaccucagaagcaggaggucgauaaaauucugacacacauccaccucaauguguuucaggacaaggacuccgcucugcuccugcaaauuuauagcuccuucuacagauacaucuaugaacuucugaacauucagagccgcggcucuagccugaccuuucucacgcagaucuccaaacauauccuggauauuaucaagcaguucaauuuucaaaacauuucuaaggccuucgcguuucuuuucaaaaccgccgagguucucgggggaaucagcaauguguccuacugccagcagcuccugucuauuuuuaacuuccucgaacugcaggcucaauccuuuauguccacagagggccaggagcuugaagucauccacaccacacugaccgggcugaagcagcuccugaucauugacgaggauuuccggaucucucuuuuccaguauaugagccaauuuuucaauuccagcguggaagaccugcucgauaacaaaugucugauuucugacaauaagcauaucuccagcguuaacuacucuacguccgaggaaagcuccuuuguguucccgcuggcccagaucuuuucuaaucucagcgcuaacgucuccguguucaauaaauuuaugagcauccacugcacagugucuuggcuucagauguggaccgagaucugggagacaauuucccaacuguucaaguuugauaugaacgucuucaccagccugcaucacggauuuacccagcuccuggacgaacuugaggaugacguuaaggugucuaaaagcugucagggcauccugcccacacacaauguggccagacucauucugaaccuguucaagaacgucacgcaggccaaugauuuucauaacugggaagacuuccucgaucuucgcgacuuccugguggcucuggggaaugcgcucguuuccgugaaaaagcugaaccuugagcaagucgagaaaucucuguuuaccauggaagccgcucuccaccagcugaagacauucccuuuuaaugagagcaccucccgggaguuccugaacucucuccuugagguguuuaucgaguucagcuccacaagcgaguauauuguuagaaaucuggacucuaucaacgauuuucuguccaauaaccucaccaauuacggcgagaaguucgaaaacauuaucacggagcugcgggaagccaucguguuucuucgcaaugucagccaugacagagaucuguucuccugcgccgacauuuuucagaacgugacagaguguauccucgaagauggauuccuguauguuaauaccucucagcggaugcugcgcauucuggacacccuuaacagcacauuuuccucugagaauaccaucagcucccugaaaggcugcauuguguggcuggaugucaucaaccaccucuaccugcuuagcaacucuuccuucagccaagggcaucugcagaauauccucggaaacuucagagacauugagaauaagaugaacucuauccugaaaauugugacaugggugcugaauaucaagaaaccccucuguuccagcaacggcucucauauuaauugcgucaacaucuaccuuaaggauguuacggacuuucugaauaucgugcugaccacaguguucgaaaaagagaagaagccuaaauuugaaauucuccuggcccuucugaacgauagcaccaagcagguccggauguccaucaauaaccucacaaccgacuucgacuuugccucucagagcaauuggagauauuucacggagcugauucugcgccccaucgaaauguccgaugagauuccuaaccaauuucagaauaucuggcuccaccuuauuacccuggggaaagaguuccagaagcuggugaaaggaaucuacuuuaacauccucgaaaacaauagcuccucuaagacagagaaccugcuuaauauuuucgcgaccagccccaaggaaaaagacguuaacuccgugggcaauucuaucuaucaucuggcuagcuaccucgccuuuucccugucucacgaucugcaaaacagcccgaagauuaucauuuccccugagaucaugaaagccacagggcucggcauccagcuuauuagagacgucuucaauagccugaugcccgugguucaucacaccucuccucagaacgcuggauauaugcaggcccugaagaaagugacauccgucaugcggacccucaagaaggcggauaucgaccugcuuguggaucaacuggagcaggucagcgugaaucucauggacuuuuucaaaaacauuucuuccguuggcacggggaaucugguggucaaccugcucgugggacuuauggaaaaguucgcugauagcucucacuccuggaauguuaaccaucugcugcagcucagccgccuguuucccaaagacguggucgaugccgugaucgacguguacuauguucuuccgcacgccgucagacugcuccagggcgugccugggaagaauauuacagagggacugaaagauguguacuccuucacccugcuccauggcaucaccaucagcaacauuacaaaggaagacuuugcuaucgucauuaagauccuucuggacaccauugagcuggugucugauaaacccgacaucauuagcgaagcccucgcuugcuucccuguugugugguguuggaaccacacaaauagcggguuucggcaaaacucuaagaucgaucccugcaauguccacggccugaugagcuccucuuucuacggaaaaguggccagcauccuugaccauuuucaccugagcccccagggcgaggauucuccuuguagcaacgaguccagccgcauggaaauuacaagaaagguugugugcaucauucaugagcucgucgacuggaacucuauccugcuggaacucuccgagguguuccacguuaacauuagccuggugaaaaccguccagaaguuuuggcauaagauccuuccguucgugcccccuucuaucaaucagacacgggauuccauuagcgaacugugucccuccgggucuaucaaacaaguggcgcuccagauuaucgagaagcugaaaaacgucaauuuuaccaagguuacaagcggagagaacauucuugacaaacuguccagccucaauaagauccugaacaucaaugaagauaccgagacgucugugcagaacauuaucuccagcaaucuggaacgcaccgugcagcucauuucugaggacuggagccuggaaaaauccacacacaaccuucugucucucuucaugaugcugcaaaacgccaaugucaccggcagcucccuugaggcucugucuagcuuuaucgagaaguccgaaacaccuuauaacuucgaggaacucuggcccaaguuccagcagauuaugaaagaucugacccaagacuuuagaauccggcaucugcugagcgagaugaauaaggggauuaaaucuaucaacuccauggcccugcagaagaucacgcuucaguucgcucacuuucuggagauucucgauagcccuucccugaaaacacuugaaaucauugaggacuuccugcucgugaccaagaauuggcugcaggaauacgccaacgaggacuauucucgcaugaucgaaacacuguuuauuccgguuaccaaugagagcuccaccgaggauaucgcccuccuggcuaaggcgaucgccacauucuggggaucucuuaaaaacauuagcagagcuggcaauuuugacguggccuuccugacgcaccuccugaaccaagaacagcuuaccaauuuuuccgucgugcagcuccucuucgagaacauccugauuaaucugaucaacaaucucgccgggaacagccaggaagcugccuggaaccugaaugauacagaccuucaaauuaugaacuuuaucaaucugauccucaaccauaugcagucugagaccucccggaagacaguucugagccuuagaucuauuguggauuucaccgaacaguuucugaaaacguucuucucccucuuucugaaggaggacagcgagaauaaaaucucucugcuccugaaguacuuccacaaggaugucauugcggaaauguccuuugugcccaaagacaagauccuugagauucugaaacucgaucaguuccugacacuuaugauccaagaccgccugaugaacauuuuuagcucucucaaggaaaccaucuaucaccugaugaaaagcuccuucauccuggauaauggcgaguuuuacuucgacacccaucagggacucaaguuuaugcaggaccuguucaacgcccuucugcgggaaacaagcaugaagaauaaaaccgagaacaauauugacuuuuucacagucgugucccaacucuucuuucacguuaacaagucugaggaccuguucaaacuuaaucaggaucugggcagcgcccuccaucuggugagagaaugcuccacggagauggcccgccugcuugacaccauccugcacucuccuaacaaggauuuuuaugcucucuaccccacacugcaggaagugauucucgccaaucugaccgaccuucuguucuuuaucaacaacagcuucccucugcggaauagagcgacacucgagauuaccaaacgccuggucggggcuaucucccgggccucugaggaaagccauguucuuaagccccugcucgagauguccggaacgcuggugaugcuccugaacgauagcgccgaccugagagaucuugcuaccucuauggacuccaucgugaaacugcucaagcuggucaagaaagugagcggcaagaugucuacaguuuuuaaaacccacuucauuuccaauacaaaggauagcgugaaauuuuucgacacccuuuacucuaucaugcagcaauccguccagaaccuggugaaggaaauugccacacucaagaaaaucgaucacuuuacguucgagaagauuaaugaccugcucgucccguuucuggaccuggcuuucgaaaugaucgggguggagccuuauaucagcucuaacuccgauauuuucagcaugagccccuccauccuuucuuacaugaaucagagcaaagacuuuuccgauauucuggaggaaaucgccgaguuccucaccucuguuaagaugaaccuggaagacaugcgcagccuugcgguggccuuuaauaacgagacacagaccuucuccauggauucugucaaucugcgggaagagauucucggaugucuggugcccaucaacaauaucaccaaccaaauggacuuucuguauccuaaucccauuagcacacauuccggcccucaggauaucaaaugggagauuauccacgaaguuauuccguuccucgacaagauccugagccagaacucuacggagauuggcuccuuucuuaagauggugaucugccugacccucgaagcucuguggaaaaaccuuaagaaagauaauuggaacgucagcaaugugcugaugacauucacccagcaucccaacaaucuccugaagacaaucgagaccgugcuggaagccucuuccgggauuaaaagcgacuacgagggagaucucaacaagucccuguauuuugacacgccucuuucucaaaauaucacacaccaucagcuggagaaggcuauucacaacguucucagcagaaucgcccuguggcggaaaggccuucuguucaauaacuccgaauggauuaccucuacccgcacacucuuucagccccuguucgagaucuuuaucaaggccaccacagggaaaaaugucaccagcgaaaaggaggagagaacgaaaaaggaaaugauugacuucccuuacuccuucaaacccuuuuucugucuggagaaguaucucggaggccuguuugugcuuacaaaguacuggcaacagaucccgcugaccgaucagagcguggucgaaauuugcgagguuuuccagcaaacagugaaaccuucugaagcuauggagaugcuccagaaggugaaaaugauggucgugcggguucugaccaucguggcggagaaccccuccuggacgaaggacauucuuugugccacccugagcugcaaacagaaugggauccgccaccucauccugucugcuauucagggagucacacuggcccaagaucauuuucaggaaaucgagaagauuuggagcuccccuaaccagcucaauugcgaaucucugagcaagaaccuuuccagcacccuggagucuuucaaauccagccucgaaaacgccacaggccaggacuguaccucccaacccagacuggagacagugcagcagcaccuuuacaugcuggcuaagucucucgaggaaaccuggagcuccggcaauccuaucaugacguuucugucuaacuucacaguuaccgaggaugugaaaauuaaggaccugaugaaaaauaucaccaagcucacagaagaacugcggagcuccauucagaucucuaacgaaaccauccauagcauucuugaggccaauaucucccacagcaagguccuguuuucugcgcucacaguggcucuguccgggaaaugcgaucaagagauucuucaucugcuccugacguuccccaagggagagaaaagcuggaucgccgccgaagaacuguguucucucccgggcuccaagguguauagccugauuguccuucugucuagaaaccucgacguucgcgcuuuuaucuacaaaacccugaugccuagcgaggccaaugggcugcucaacucccuucuggauaucgugagcucccugucugcgcuccuggccaaggcucagcacguguucgaguaucuucccgaauuucugcacacauucaagauuaccgcccuccuggagacacuggacuuccagcaagucagccagaaugugcaggcucgguccucugccuuuggauccuuccaguuuguuaugaaaauggugugcaaggaucaggcuuccuuccuuucugacagcaacauguuuaucaaucuccccagagucaaagaacugcuggaggaugacaaggaaaaauucaacauuccugaggacuccaccccguuuugucucaagcuguaccaggagauccuucagcugcccaauggcgcccucguguggacguuccugaagccuauucugcaugggaaaauccuuuauacccccaacacaccugaaaucaauaagguuauucagaaagcgaacuacaccuuuuauaucguggauaagcucaaaacacugagcgagacccugcucgaaaugucuucccuguuccaacgcagcggaucuggccagauguuuaaucagcuucaggaggcccugcggaacaaguucgucagaaacuuuguggaaaaucaacuccacauugacguugauaaacugacggagaagcugcagacauacggcgggcuucucgacgagauguucaaccaugcuggagccggccgcuuccgguuucugggguccauccuggugaaucucagcucuugcgucgcucugaacagauuccaggcccuucaauccguggauauucuggaaaccaaggcccacgagcuccugcagcagaauagcuuucuggcuucuaucauuuucuccaacagccuuuuugacaaaaauuuccgcuccgaaagcgucaagcugcccccucacgugucuuacacaaucagaaccaacguucuguauagcgugcggaccgaugucgugaaaaauccguccuggaaguuucauccccagaaccugccugcggacggauucaaauacaauuauguguuugcgccccuccaagauaugaucgagcgcgcuauuauccugguucagacaggccaggaagcccuugagccugccgcucagacgcaagccgcgcccuacccgugucacaccucugaccuguuccucaacaaugugggguuuuucuuuccucugauuaugaugcugacauggauggucagcguggccuccaugguuagaaaacuuguguaugagcaggaaauccagauugaggaauacaugcggaugaugggaguccaucccgugauccacuuccucgcuugguuccuggagaacauggccguccugaccaucucuagcgcuacacucgccauugugcugaagaccuccggcaucuuugcgcacagcaauacguucauuguuuuucuuuuccugcucgauuuuggcaugucuguggucaugcuguccuaucugcuuagcgccuucuuuucucaggcuaacacagccgcucucugcaccucccugguguacaugaucagcuuccugcccuacauuguucuccuggugcuucauaaccaacugucuuuugucaaucagaccuuccucugucugcuguccacaaccgccuuugggcagggaguguucuuuaucacauuccuugagggccaggaaacggggauccaauggaacaauauguaucaggcucucgagcagggaggcaugaccuucgggugggugugcuggaugauucuguuugacagcucccuguacuuccucuguggaugguaucugucuaaccuuaucccuggcacauuuggccugcgcaaacccugguacuucccuuuuaccgccagcuauuggaaguccguuggguuccucgucgagaagagacaauacuuucuguccucuucccuguucuuuuucaaugagaacuuugauaauaagggaagcucucuucagaaccgggaaggcgagcucgaggggagcgcgccgggagugacacugguguccgucaccaaagaauaugagggccacaaggccgugguucaggaccugucucucacguucuacagagaccagauuaccgcucugcuugggacaaauggagccggcaagaccacaaucauuagcaugcugaccggccuccaucccccuacauccgggaccaucauuaucaacggcaaaaaucugcaaacggaucugagccgcgugcggauggaacuuggcgucugcccccagcaggacauccuccuggauaaccugacagugagagagcaccuccugcuuuucgcuucuauuaaggccccucaguggaccaaaaaggaacugcaucaacagguuaaucagacccuccaggacguggaucugacacaacaccagcacaaacagacgcgcgcccuguccgggggacuuaagcggaagcucagccugggcaucgcguuuauggggaugucuagaaccgucgugcuggacgagcccacauccggaguugauccgugcagccggcauucccucugggacauucugcuuaaauaccgcgagggcagaaccaucauuuucacaacccaccaucuggaugaagcugaggcccucucugaccggguggcuguccugcaacacggccgccugagauguugcgggccucccuuuugucuuaaggaagccuauggacagggccuccggcugacacugacccgccagccuagcgugcucgaggcccaugaucugaaagacauggcuugcgugacgucccuuaucaagaucuacauuccccaggccuuccugaaagacucuagcggguccgaacucaccuauacaaucccuaaggauaccgacaaagcgugucugaagggacuguuucaagcccuugaugagaaccugcaccagcuccaccugacaggcuacgggauuagcgacaccacgcucgaggaagucuuccugaugcuucugcaggauucuaauaagaaaucccauaucgcucucggcacagagagcgaacugcagaaccacagacccaccggacaucugucuggcuauugcgggucccuugcccggccggcuacaguucaaggagugcagcugcuccgcgcccagguggcggccauucuggcuagacggcucagacgcacccugcgggccggcaagagcacgcuugcugaccugcuccugccuguccuguuuguggcccuugcuauggggcuguucaugguuagaccccucgccaccgaguaucccccucugcgccucacaccgggacacuaucagcgggcggagaccuacuuuuucucuuccggcggggauaaccuggaccuuacaagagugcugcugcgcaaauuucgggaucaagaccuccccugugccgaucugaauccuagacagaagaacagcagcugcuggcgcaccgaccccuucucccacccugaauuucaggauucuuguggcugccuuaaaugucccaaucggagcgcuuccgccccuuaccugacaaaccaucucggacacacccugcucaaucugucuggcuucaacauggaggaauaucuucuggcucccagcgagaagccgagacucgggggaugguccuucggccucaagaucccuucugaagccgggggagccaauggcaacaucagcaaacccccuacgcuggcgaaggucugguacaaucaaaaaggguuucauucccuucccucuuaucugaaccaccucaauaaccugauucucuggcagcaucugccgccuacaguggacuggcgccaguacggcaucacccuuuauagccaccccuacggaggcgcucugcugaaugaggacaagauucucgaguccauccggcagugcgggguugcccugugcauugugcuuggauucagcauccugucugccuccauuggcagcucugucgugagagaucgcgucaucggggcuaaaagacuccaacacaucuccggacugggcuaucggauguacugguuuaccaacuuccuguacgacaugcucuuuuaucuugugagcguuugucugugcguggccgucauuguggcuuuccagcugacagccuuuaccuuccgcaagaaucucgcggccacagcucugcuucugucucucuuuggcuacgccacgcugcccuggauguaucugauguccagaaucuucagcuccagcgauguugcuuuuauuucuuacgugagccucaacuucaucuuugggcuuuguaccaugcugauuacaaucaugccucggcugcucgccaucauuuccaaggcgaaaaaccugcagaauaucuaugacguccuuaaguggguguucaccauuuucccccaguuuugccugggacaaggccucguggaacuguguuacaaccagaucaaauaugaucugacacauaauuucgggauugacucuuacguuagcccuuuugagaugaacuuccucggauggaucuuuguccagcuugccucccagggcaccgugcugcugcuccugagagugcuucugcacugggaucuccugcgguggccgcgcgggcauucuacgcugcaaggaaccgucaagagcuccaaagacacagauguggaaaaggaggaaaagagaguuuucgagggccggaccaauggcgacauccucgugcuguacaaccuuucuaaacacuaucgcagauuuuuccagaauauuaucgcuguccaggauauuagccuggggauccccaagggagagugcuuuggccuccugggggugaacggagccggcaaauccacaaccuucaagaugcuuaauggggaaguuagccugacgucuggacacgcuauuauccggacaccuaugggcgacgccguggaucucuccagcgcuggcaccgccgggguccugaucggauacuguccccagcaagacgcgcuggacgagcuccugacaggcugggaacaucuuuauuacuauugcucucugcgcgggauuccuagacaguguauccccgagguggccggagaucucauucggcgccugcaccuugaagcucaugccgacaaaccuguggccaccuacuccggcgggaccaagagaaaacugagcacagcucucgcccugguuggaaagccggauauccugcuccuggacgagcccuccucuggcauggauccuugcagcaagcgguaucuuuggcagacgauuaugaaagagguccgcgaaggcugugcggcugugcugaccucccacagcauggaggaaugcgaggcccucugcacaagacuggccaucauggugaacgggucuuuuaagugucuuggaagcccccaacauauuaaaaaucgguucggcgacggguacaccgucaagguuuggcugugcaaagaggcuaaccagcacuguacagugagcgaucaccucaagcuguacuuuccuggaauccaguucaagggccagcaucugaaucuccuggaauaucacgugcccaaacgcugggggugccuugccgaccuguucaaggucaucgagaacaauaaaaccuuucucaacauuaagcauuacucuaucaaccaaacgacacuggaacagguguucauuaauuuugcuuccgagcagcagcaaacccuucagagcacccuggauccgucuacagacagccaccacacccaucaccucccuaucuga

SEQ ID NO: 65320 - RNA, 6786 nt, Artificial Sequence
  derived and/or modified sequence opt5 from ABCA1__Homo_sapiens__NP_005493
auggccugcuggccccagcuccggcuccugcuuuggaagaaccugacauuccggcgcagacaaacaugucagcuccugcuugagguggcuuggccucuguuuauuuuccucauucugaucagcguccggcuguccuacccucccuaugaacagcacgagugccauuuucccaauaaagccaugcccucugcgggcacgcucccuuggguucaggggauuaucuguaacgcuaauaaccccugcuuccgcuacccuaccccgggggaagcccccggcgugguggggaauuuuaacaagagcauuguugccagacuguucuccgacgcucggcgccuucugcucuauucucaaaaagauacaagcaugaaggacaugagaaaagugcugcggacccuucagcagaucaagaaguccucuagcaaucugaaacuccaggauuuucugguugacaacgagacauucuccggauuucuguaccacaaucucagccugccuaagucuaccguggauaaaaugcuucgcgccgacgucauccugcauaagguguuccuccaaggcuaucagcugcaccuuacaucccuguguaacgggagcaaaucugaagagaugauucagcucggagaucaggagguuuccgaacugugcggccugcccagagagaagcucgcugccgcggaacgggugcugcgcagcaauauggacauccuuaagccuauucugagaacccucaacucuacgucccccuuuccgagcaaagagcuggccgaggcuaccaagacacuucugcauucccucggcacccuggcccaagaacuguucucuaugcggagcugguccgauaugcgccaggaggucauguuucucacaaaugugaacuccucuagcagcucuacccagaucuaccaagcugugagcagaauugucugugggcacccugaaggaggcgggcugaaaaucaagucccuuaauugguaugaggacaacaacuacaaagcccuguucggaggcaaugggacggaagaggaugcggagacauucuacgacaacucuaccacacccuauugcaaugaucucaugaagaaccuggaaagcuccccucugagccggauuaucuggaaagcccuuaagccccuccugguuggaaagauccuguacacccccgacaccccugcuacaagacaggugauggccgaggugaauaaaacguuucaggaacucgcugucuuccacgaccuggagggcaugugggaggaacuuucuccgaagauuuggaccuuuauggagaacucccaggaaauggaucuggugcgcaugcuccuggacagccgggauaaugaccauuucugggagcaacagcuggauggccuugacuggacagcccaggauaucguugccuuucucgcuaaacaccccgaagacgugcagucuuccaacgggagcgucuauaccuggagagaggcguucaaugaaacaaaccaagccauucgcaccaucucccgguuuauggagugugugaaucugaacaagcuggagccuauugcuacggaaguuuggcucaucaauaaaucuauggagcugcuugaugaaagaaaguucugggccggaaucguguuuacaggcauuacccccgggagcaucgagcugccucaucacgucaaguacaaaauucgcauggacaucgauaacguggagcggaccaauaagauuaaagacggauauugggaccccggcccgagagccgauccuuucgaagacaugcgcuacgucuggggaggauuugcuuaucuccaggaugugguugagcaggccaucauccgggugcugacaggcaccgaaaagaaaacaggcgucuacaugcagcaaaugcccuacccuugcuauguggacgauauuuuccugagaguuaugucccgcucuaugccccuuuuuaugacgcucgcguggaucuacagcguggcugucauuaucaaggggauuguguaugagaaggaagcccggcugaaagagaccaugagaaucaugggacuggacaacuccauucucugguucagcugguucaucucuucccugaucccucuucuggugagcgccggccuccugguugucauucugaaacuugggaaccuccugcccuacucugauccguccgugguguuugucuuccugagcguguuugcuguugugacaauccuccaguguuuccugauuucuacccuuuuuagccgggccaaucuggcugccgcgugcggaggcaucauuuauuucacacucuaccugccuuauguccugugcguggccuggcaggacuacguuggguuuacccuuaaaaucuucgcuucccugcucagccccguggccuuuggcuucggaugugaguacuuugcucuguucgaggaacagggcaucgggguccaaugggauaaccucuuugaaucucccguggaggaagacggauucaaucugacgaccuccguuagcaugaugcuuuucgauacauuucuguauggcgugaugaccugguacauugaggccgucuucccugggcaguauggaaucccgcgccccugguacuuuccuugcacaaaguccuauugguucggcgaggaaucugacgagaaaagccaccccggguccaaccagaagagaauuucugaaaucuguauggaggaggagccuacccaucucaagcugggcgugagcauucaaaaucuggugaaagucuaccgggauggaaugaagguugcgguggacggccuugcccugaacuuuuaugaggggcagaucacguccuuccucggacacaauggcgcugggaaaacaaccacaaugucuauccugaccggacucuuucccccuaccagcggcacagccuacauucuggggaaggacaucagauccgaaaugagcacgauucgccagaaccuuggcgugugcccccagcauaauguccuguucgauaugcucaccguggaggaacacaucugguuuuacgcucggcugaaaggacugucugagaagcauguuaaagccgagauggaacaaauggcccuugacgugggccugccguccagcaagcucaagucuaaaacaucccagcugagcgggggaaugcagagaaagcucucugucgcucuggcguucgugggcggguccaaaguugugauucuugaugagccuaccgccggagucgaccccuauagccgcagaggcaucugggaacugcugcucaaguaccggcaggggcgcacaaucauucuguccacccaccacauggaugaggcugacgugcuuggcgauagaaucgccauuaucagccauggaaaacuguguugcguuggcucuagccucuuucugaagaaccaacucgggacgggauauuaccugacacuugugaagaaagacgucgaauccucucugagcuccuguagaaauucuagcuccaccgugucuuaucugaagaaagaggauagcgugucccaguccucuagcgacgccggccucgggagcgaucacgagucugacacccugacaauugaugucuccgcuaucagcaaccuuauucgcaagcauguuuccgaagccagacugguggaggacaucggacacgaacucaccuacgugcugccuuaugaggcggcuaaagaaggcgccuucgucgaacucuuccacgagaucgacgaucggcugucugaccuuggcauuagcuccuacgggaucagcgaaacaacgcuggaggaaauuuuucugaagguggccgaggaaucuggaguugaugcugagaccuccgacggcacacuccccgcccgcagaaaucggcgcgcguucggggauaagcagagcugccugagaccguuuaccgaggacgaugcugccgacccuaacgauucugacaucgaucccgaaagccgggagacagaccuucuguccggaauggacggcaaagggucuuaccaggugaagggauggaaacucacccaacagcaguucgucgcccugcucuggaagagacugcuuauugcucgccggagcagaaaaggcuuuuucgcccaaaucgugcugccugcuguuuuuguguguaucgcccuggucuucucccucauugugccgcccuuuggcaaguauccuucucuggaacuucagccguggauguacaaugagcaguauacguucgucagcaacgaugcgcccgaggacaccgggacacuggaacuccugaacgcccugaccaaggauccuggauuuggcacacgcugcauggaggggaaucccaucccugacacccccugucaggcuggagaagaggaauggacaaccgccccugugccgcaaacgauuauggaucucuuccagaacggcaauuggacaaugcagaaccccuccccugcuugccagugcagcucugacaaaaucaagaaaaugcuucccguuuguccucccggggccggaggccugccgccuccccaacggaagcagaauaccgccgauauucugcaggaccucaccggcagaaacaucuccgauuaccuggugaaaacauauguccagaucauugcuaagagccuuaaaaauaagaucugggugaacgaguuucgcuacgggggauucucccugggcguuucuaauacccaagcgcugcccccuagccaggaggugaacgacgccauuaagcagaugaaaaagcaucugaaacuggcuaaggauuccucugccgaccgguuccucaauagccuugggagauuuaugacgggacuggauaccaagaacaaugucaaggugugguucaacaauaagggcuggcacgccaucuccagcuuucugaacgugauuaacaaugcuauccuccgcgccaaccugcagaaaggggaaaaucccucucauuauggaauuaccgcguucaaccacccucuuaaucugacaaagcaacagcucuccgagguugcucugaugaccacaagcgucgacgugcuggugucuaucugcgucaucuuugccauguccuucgugccggccagcuuuguuguguuccucauucaggaacgggucucuaaagcuaagcaucuucaauuuaucagcggcgugaaacccguuauuuacuggcuguccaacuucgugugggacauguguaauuacgucgugccugccacccugguuaucauuaucuuuaucugcuuccagcagaagucuuaugugagcuccacgaaccuccccguccuggcgcuucugcuccugcuguacggcuggagcauuaccccucucauguaucccgcuuccuuuguguucaagaucccgucuacagccuacgugguccuuaccagcguuaaucuguucauugggaucaacggauccguggccacauuugugcuggaacucuucaccgauaauaaacugaacaauauuaacgacauccuuaagucugucuuucugaucuucccucacuuuugucucggcagagggcugauugauauggugaaaaaucaggcuauggccgacgcucuggaacgguucggagagaaccgcuuuguuagcccccucuccugggaucuugugggcagaaaucuguucgccauggcggucgaggggguggucuuuuuccugaucacggugcucauucaauaucgguuuuucauccgcccuagacccgucaacgccaagcugucuccucuuaacgacgaagaugaggacgugcggagagaacgccagcggauucuggauggaggcggccagaaugacauccucgagauuaaagaacugacaaagaucuacagacgcaagcggaaacccgcugucgauagaaucugcguggggauuccgccuggagaguguuuuggccugcucgggguuaacggagccggcaagagcuccaccuucaaaaugcuuacaggggacaccaccgugacacgcggagaugcuuuccugaauaagaacagcauccugucuaauauucacgaggugcaucagaacaugggcuauugcccccaauuugacgccaucacggaacuccugaccggccgggagcacgucgaguucuuugcccuucugagagggguucccgagaaagaggugggaaaggugggcgaaugggcuauucgcaagcucgggcuggucaaauacggagagaaguacgcgggcaauuauuccgggggaaacaaaagaaagcugagcacagccauggcucucaucggcggcccuccggugguuuuccuugacgaacccaccacagggauggauccuaaagcccggcgcuuucuguggaauugugcccugucuguggucaaggagggaagauccgugguccucaccagccauucuauggaagagugcgaggcucuguguacgcggauggccaucauggugaacggccgcuucagaugccuuggguccguucagcaccugaaaaaucgguuuggagacggcuacacaauuguggucagaaucgcggggagcaaccccgaucucaagccugugcaggacuucuuuggccuggcuuuccccggauccguucugaaggaaaaacaucgcaauaugcuccaguaucaacuuccuagcucucugagcucccuggcccggaucuuuucuauccucagccaguccaagaaaagacugcacauugaggauuacucugugagccagaccacccuugaccaagucuucgugaacuuugccaaggaucaguccgacgaugaccaccugaaagaucucucucugcauaagaaucagacagugguugacgucgcugugcugaccagcuuccuccaggacgaaaaggugaaagaguccuaugucuga

SEQ ID NO: 65321 - RNA, 7311 nt, Artificial Sequence
  derived and/or modified sequence opt5 from ABCA2__Homo_sapiens__NP_001597
augggcuuccugcaccagcuccaacugcuucuguggaagaacgugacccucaagagacggagccccuggguccuggccuuugaaaucuucauuccucuuguucuguuuuucauccuccuggggcugagacagaagaaaccgacaauuuccgugaaggaagugucuuuuuacacggcugcgccgcugaccagcgccggaauccugccugucaugcagucccuuugccccgacggccagagagaugaguucggguuucugcaauaugcuaauucuacagugacccagcuccuggaacggcuugaccgcguuguggaggaaggaaaccuguucgauccugccagacccagccucggcuccgagcuggaggcccugcggcagcaccucgaagcucugucugccgggccuggaacaagcggcucccaccuugaccgcagcaccgucucuuccuuuagccuggauucuguggcuagaaauccgcaggagcucuggcgguuccugacacaaaaccuuucccugcccaauagcaccgcccaggcgcuccuggccgcucgcguugacccucccgaaguguaccaucugcucuuuggcccuucuuccgcccuggauagccaguccgggcuucacaaaggacaggagcccuggucuagacugggcgggaacccccucuuccggauggaggaacugcuucuggcuccugcccuccuggagcaacugacguguacccccggaagcggcgaacucgggcgcauucugacagucccugagucccagaagggagcccuucagggcuauagagacgccgugugcagcggccaagcugccgcucgggcccgcagauuuucugggcuguccgccgaacuccggaaucagcuggauguggcuaaggucagccagcagcugggacuugacgcgcccaacggcucugauagcagcccccaagccccuccgcccagacgccuccaggcucugcugggggaccuccuggaugcccagaaaguucuucaggacguggacgugcugucugcccucgcucugcugcuuccucaaggagccuguaccggccggacacccgggccucccgcgagcggagcuggcggcgccgccaaugggaccggagcuggcgccgucauggggccgaacgcuacggccgaggagggagcgccuuccgccgcugcccucgcuacacccgauacccugcagggccagugcagcgccuucgugcagcugugggcggggcuccaaccuauccuguguggcaauaacagaacaaucgaacccgaggcccuucgccggggaaauaugucuucccugggcuucaccagcaaggaacagagaaaccucgggcugcugguucaccuuaugaccucuaauccuaaaauucucuacgcucccgccggauccgagguggaccgcgucauccugaaggcuaacgaaacauuugccuucgugggcaacguuacgcacuaugcccagguguggcugaauauuagcgcugagauccgguccuuucucgagcaggggagacugcaacagcaccuucgcuggcugcagcaauacgucgcggaacuccggcugcauccggaggcccugaaccuuucucucgaugaacugccucccgcucugagacaggacaauuucagccuccccuccggaauggcccugcuucagcagcuggauaccauugacaacgccgcuugcggcuggauccaauuuaugucuaaagugagcgucgauauuuucaagggguuuccugacgaggaauccaucgugaauuauacacucaaccaggccuaccaggauaauguuaccguguucgcgagcgucaucuuucagacacgcaaggacggcucucugccgccccacgugcauuacaaaauucggcaaaacuccagcuucaccgagaagacgaaugagaucagacgggcuuauuggcgcccuggacccaacacaggcgggagauuuuacuuccuguauggauuuguuuggauucaggauaugauggaacgggccaucauugacaccuucgugggccacgacgucguggagccugggucuuacgugcagauguuccccuauccuuguuacaccagagaugacuuucuuuucguuaucgaacacaugaugccccugugcauggucaucuccuggguguauagcguggccaugacaauucagcauaucgucgcugagaaagagcaccgccucaaggaagugaugaaaaccaugggacugaauaacgccguucauuggguggcgugguuuauuacaggcuucguccaacucucuaucagcgugacggcucugaccgccauucuuaaguacgggcagguucugaugcacucccauguggucaucaucuggcucuuucuggccguguacgcuguugccacaauuauguucuguuuucuggugagcguccuuuauucuaaagcuaagcuggccuccgcgugcggcggaaucauuuacuuccucagcuaugugccguacauguauguggccauccgggaggaagucgcucacgauaagauuaccgccuuugagaaauguaucgcuucccugaugucuacaaccgccuucggccucgggagcaaguacuuugcccuguaugaaguugcuggagugggcauucaguggcacacguucucccaaucuccuguggagggggacgauuuuaaucuucugcucgcggucaccaugcugaugguggacgccguuguguacggaauccugacaugguacaucgaggcuguccaucccggcauguaugggcuuccuagacccugguacuucccgcugcagaaaagcuauuggcucggcuccggacgcaccgaagccugggaguggucuuggccuugggccagaacaccccggcugagcgugauggaagaggaucaggcuugcgccauggaaucccgcagauucgaggagacccggggcauggaagaggaaccuacgcaccucccccugguugugugcgucgacaaacuuacaaaaguguacaaggaugacaagaaacuggcgcugaacaagcucagccugaaucuuuaugagaaccagguugugucuuuucuggggcauaacggagcuggcaaaaccacaaccauguccauucucaccgggcuguuucccccuacaagcggaucugccacgaucuacggccacgauauucgcaccgaaauggacgagaucagaaagaaucucggcauguguccgcaacacaacguccuguuugaucggcuuacaguggaggaacaucugugguucuauucccgccugaaaagcauggcccaggaggaaauuagacgggagauggacaagaugaucgaggaccucgaacugucuaauaagcgccacucccuugugcagacccugagcgggggaaugaaaagaaagcucuccgucgcuaucgccuuuguuggcgggagccgggcgauuauccuggaugagcccacagcuggaguggacccuuacgccagacgcgccauuugggaucucauccugaaauacaagcccggccggaccauucuucugucuacgcaucacauggacgaagcugaucugcucggggacagaaucgccaucauuagccauggaaaacugaagugcuguggcuccccucuuuuccugaagggcacauauggggauggauaccgccucacccuggugaaacggcccgcugagccuggcgggccgcaggaacccggacucgccucuagcccucccggcagagcgccucuguccucuugcagcgagcuucaagucucccaguuuauccgcaagcacguggccucuugucugcugguuagcgacaccuccacagagcucagcuauauucugcccucugaagcugccaaaaagggggcuuucgagcggcuuuuucagcaccuggaaagaucccucgaugcccugcaucugagcucuuucggacucauggacaccacacuugaggaaguguuucugaaagucuccgaggaggaucagagccuggaaaacuccgaggccgacgugaaggaaucucgcaaagauguucucccgggcgcugagggcccugcgagcggggaaggacacgccggcaaucuggcucggugcuccgagcuuacgcaaagccaggccucucugcaguccgccagcucuguggggagcgcuagaggagacgagggcgccggguacaccgacgucuauggagauuaccggccccucuucgacaacccccaggauccugacaaugugucccugcaagaagucgaggcggaagcucugucucgcgugggccagggcagcagaaagcucgaugggggauggcuuaagguucggcaguuccauggccugcuggugaaacgcuuucacugugccagacggaacuccaaggcccucuucucucaaauccugcuucccgcuuucuucgucugcguggccaugacaguugcgcugagcgugccugagauuggggaccucccgccccugguccuguccccuagccaguaucauaauuacacccagcccagaggaaacuuuaucccuuacgccaaugaggaacgccgggaguauagacuccgccuuucucccgaugcuuccccgcagcaacuggugagcacauuccggcugccuuccggcgugggggccaccuguguucucaaaucucccgcuaacggaagccugggcccuacgcuuaaucuguccucuggcgaaagcagacuccuggccgcucgcuuuuucgacuccaugugccuggagagcuuuacccaggggcucccccuuucuaacuucgucccucccccgccuucccccgcccccagcgauucuccugcguccccggacgaagaucugcaggccuggaaugugagccugcccccuacagcuggacccgagauguggaccucugccccuagccucccccggcuggugagagagccuguccgcuguacaugcuccgcucagggcaccggguuuucuugcccgagcuccgugggaggccaucccccucaaaugagaguugugacaggggacauccuuaccgacauuacgggacacaacgucagcgaauaccuccucuucacauccgaucgguuucgccugcauagauauggcgccaucaccuucggcaacgugcugaagucuauucccgccagcuucgggacccgggcuccucccaugguucgcaaaaucgcggugagacgggccgcucaggucuuuuacaauaacaagggauaucacuccaugccgacauaccucaauucucuuaacaaugccauucugagagccaaccugccuaagagcaaaggcaaucccgcugccuaugggaucaccgugacgaaccaucccaugaauaagacauccgcgucucucagccuggacuaccuucugcagggaaccgauguugugauugccaucuucaucauugucgcuauguccuuugugccugccagcuucguggucuuucucguugcugagaaaucuacaaaggccaaacaucugcaguucguguccggcuguaaccccaucauuuacuggcuggcgaauuaugugugggacaugcucaacuaccuugucccugcgaccugcugugugaucauucuguuuguuuucgaucugccggcuuauacaagccccaccaauuuuccugccgugcucucucuguuccuucuguacgggugguccaucacgcccaucauguauccugcuagcuuuugguucgaaguccccucuuccgccuacguguuucucauuguuaucaaccuguucauuggaaucaccgcuacaguggccaccuuccugcuccaacuuuuugagcacgacaaggaucugaaggucgugaauagcuaucugaaauccugcuuccucauuuuuccgaacuacaaccugggccauggccuuauggaaauggcguacaaugaguauaucaacgaguacuaugccaagaucgggcaguucgacaaaaugaaguccccuuuugaaugggauauugucacacgcggacugguggcuauggccguugagggcguggugggguuccuccugaccaucaugugucaguacaauuuucugcggagaccccaacgcaugccugucucuacgaaacccguugaagacgauguggacguggcuagcgagcggcagagaguccuccggggagaugccgacaacgacauggugaagauugaaaaucuuacaaagguuuauaaaucccgcaagaucggccgcauucuggccguggaucggcugugccucgggguccgcccuggcgaguguuucggacugcuuggcgugaacggggcgggaaaaaccucuacauuuaagaugcugaccggcgacgagagcaccacagggggagaggcuuucgucaauggccacuccgugcucaaagagcugcugcagguucagcaaucucucggguacugcccccagugugaugcccuuuuugacgaacugacggcuagagagcaucugcagcucuauacccggcugcgcggcaucagcuggaaggaugaggccagaguggucaaaugggcccuugaaaagcuggagcucacaaaguacgcugacaaaccggccggaaccuacuccggcgggaacaagcggaaacugucuacagcgauugcccugaucggauauccugcuuucaucuuucucgaugaacccaccacgggcauggaccccaaggcccgcagauuccuguggaaucuuauucuggaucucaucaaaacagggcggagcgugguucugaccucccacagcauggaggaaugcgaggcucuuuguaccagacuggccauuauggugaacggacgccuccggugccugggcucuauccagcaucugaagaauagauucggggacggcuacaugauuacaguccgcaccaaguccagccaaucugugaaagaugugguucgguuuuucaacagaaauuuuccugaggcgaugcucaaggaacgccaccacacaaaaguccaguaucagcugaaguccgagcauaucagccuugcccagguguucuccaaaauggaacaagugucuggaguccugggcaucgaggacuacagcguuucccagacgacccucgauaacguguuugugaauuucgcuaagaagcagagcgacaaccuggaacagcaagagacagagccgcccucugcccuucaguccccucuggggugccuccugagccugcuccggcccagaucugcuccuaccgaacugcgcgcccuugucgcugacgagcccgaagaucuggacacagaggaugaaggacucauuagcuuugaggaggaacgggcccagcuguccuucaauaccgacacgcuuuguuga

SEQ ID NO: 65322 - RNA, 5115 nt, Artificial Sequence
  derived and/or modified sequence opt5 from ABCA3__Homo_sapiens__NP_001080
auggcugugcugagacagcucgcucugcuucuguggaagaacuacacccuccagaagcggaagguccugguuacagugcuugagcuguuccucccccugcuguuuagcggcauccucauuuggcugcgccuuaaaauccaguccgaaaaugugccuaacgccacgauuuauccggggcagucuauccaggagcugccccucuucuuuaccuucccucccccuggagacacaugggaacuggccuacauucccagccacuccgaugcugccaagaccgucacagagaccgugagacgggcccuuguuaucaauaugcgcgugagaggcuuuccuucugaaaaagacuucgaggauuauauccgguacgacaacugcagcuccucuguccuggcugccgugguuuuugagcacccguucaaucacagcaaggaaccccucccucuggcugugaaguaucaucugcgcuuuuccuacacaagacggaacuauauguggacccaaacggggagcuucuuucucaaagagaccgaaggauggcacacaaccucucuguucccccuuuuuccuaaucccggcccgcgcgagccuacaucccccgaugggggagagccuggcuacauuagagaaggcuuccuggccguccagcaugcgguggaccgggccaucauggaguaccacgcugaugccgcuacccgccaacucuuccagagacugacggugacaauuaagcgguuucccuaucccccuuucaucgccgacccguuucuugucgcgauucaauaccagcugccccuccugcugcuccugagcuucaccuauacagcccuuaccaucgcucgcgccguugugcaggaaaaagagagacggcugaaggaauacaugagaaugauggggcucucuuccuggcugcacuggagcgcuugguuucuucuguucuuucucuuccugcugauugccgccucuuuuaugacccuccuguucugugugaaagucaagccuaacguggcuguucuuucccgcagcgaucccucccuggugcucgcguuucugcugugcuucgccaucucuacaaucagcuuuuccuucauggucagcacguucuuuucuaaggcuaauauggccgccgcuuucggaggcuuucuuuauuucuuuaccuacauuccuuauuucuuuguggcgccccgguacaacuggaugacacucucccagaaacuguguagcugccugcucucuaauguugcgauggcuaugggggcccaacugaucggaaaguucgaggccaaaggcauggggauucaguggagagaccuucugagcccggugaacgucgaugacgauuuuuguuucggacaggugcucggcaugcugcugcuugacuccguccucuacggccuggugaccugguauauggaggcuguuuuuccugggcaauucggagugccccagccuugguacuuuuucaucaugcccucuuauuggugcggcaagccucgcgccgucgcugggaaagaagaggaagacagcgaucccgagaaggcccugcggaaugaauacuucgaggcggagccggaagaccucguggccggaauuaaaaucaagcaucuguccaagguuuuuagagugggcaacaaagaucgcgcugccguccgggaccuuaaucugaaccucuaugaggggcagaucacagugcugcugggacacaacggcgcuggcaagaccacgacacuuagcaugcucaccgggcuguucccucccaccucuggcagagcuuacauuuccggauaugaaaucagccaggauauggugcaaauucgcaaaucucuggggcucuguccccagcaugacauccuguuugauaaucuuacaguugcggagcaccuguacuucuacgcccagcucaagggacugucccggcagaaaugcccugaagaggucaagcaaaugcugcacauuaucggccuugaggacaaguggaacagcagaucccgcuuucucucugggggcaugcggagaaaacugagcaucggaauugcucugaucgccggcuccaaggugcucauucuggaugaaccgaccucugggauggacgcuaucagccggcgcgccauuugggaucuucugcagagacagaaauccgaccggacaaucgugcucacgacccauuucauggacgaggccgaucugcugggagacagaauugcuaucauggcgaagggcgaacuucaguguugcgggagcucucuguuucucaaacaaaaguauggagccggcuaccacaugacacuggucaaggagccccauuguaauccugaggauaucucccagcucgugcaccaucacguucccaacgcuacccuggaaagcucugccggggccgagcuuuccuucauucugccucgcgaaagcacacaccgguuugagggccucuucgcuaaacuggaaaagaaacagaaggagcugggaaucgccucuuuuggcgcgagcauuaccacgauggaggaaguguuccuuagagucgggaaacugguggacuccagcauggauauccaggcuauucaacuccccgcccugcaguaucagcaugagcgcagagccucugacugggcuguugauuccaaucucugcggagccauggacccuagcgauggcaucggggcgcugaucgaagaggaacggaccgcugugaaacuuaacacaggacuggcccuccacugccaacaguucugggccauguuucugaagaaagcugccuacuccuggcgcgaguggaagauggucgcugcccaggugcugguuccccuuaccugugugacacuggcgcuccuggccauuaauuauucuagcgaacucuucgacgauccgaugcugagacuuacccugggcgaauacgggcggacggucgugccuuuuuccgugcccggcacaucucagcugggacaacagcucagcgagcaucugaaagacgcccuucaggccgaaggccaggagccucgcgaaguccugggggaucucgaggaguuccugaucuuuagagcuuccguugaaggaggcggguucaacgagcggugccucguggccgccucuuuucgcgacgugggagaaagaaccgucgugaaugcucuguucaacaaucaagcguaucacagccccgccacagcucuugccguuguggacaaccugcuguuuaagcuccuguguggcccgcacgccuccauugucgugagcaauuucccucagccccggucugcccuucaggccgcgaaagaucaguuuaacgaggggcgcaagggcuucgacaucgcucugaaucuccuguuugccauggccuuccucgcuuccaccuucagcauucuggccguuucugagagagcggugcaagcuaaacauguccaguuuguguccggaguucacguggccagcuucuggcuuucugcccugcugugggaucucaucuccuuucugaucccuagccuucugcuccuggucguguucaaggcuuuugacgugcgggccuucaccagagauggccauauggcugacacacuccugcuucugcugcucuacgggugggccauuaucccccugauguaccuuaugaacuuuuucuuucugggagcggccacggcuuauacccgccucacaauuuucaacauccuguccggcauugccaccuuucugauggucacaaucaugcggauccccgcuguuaagcucgaggaacuuagcaaaacccuggaucacguguuccuggugcucccuaaucauugccuggggauggccgucucuagcuuuuacgaaaacuaugagacgagacgcuacuguacauccucugaaguggccgcucacuauugcaagaaauacaauauucaguaucaagagaacuucuacgcguggagcgccccgggaguuggccgguucguggcuuccauggccgccucuggcugugcuuaccuuauccugcucuuucugauugagaccaaucugcuccagagacuucgcgggauccugugcgcccugcggagacgccggacccucacagaacuguauaccagaaugcccguccuuccugaggaccaggauguggcggacgaacggacacgcauucuggcucccagcccugauucccuccugcacacgccccugaucauuaaggagcucucuaaaguuuacgaacagagagugccucuucuggccgucgaccggcugagccucgccgugcaaaagggagaguguuucggccugcuuggguuuaacggagcuggcaagaccacaaccuucaaaaugcugacaggggaggaaucccucaccagcggagaugccuuugucggcggccaucgcaucucuuccgacguggggaagguuagacagcggaucggauauugcccgcaguucgacgcgcugcuggaucacaugacgggcagagagaugcucgugauguacgcccgccuucgggggauucccgaaagacauaucggagcuugugucgagaauacccugcgcggccugcuccuggaaccucacgccaacaaacuugugcggacauauagcgggggaaauaagagaaaacugucuaccggcauugcucucaucggcgagcccgccguuauuuuucuggacgagccuuccacagggauggaucccguggcucgccggcugcucugggacaccgucgccagagcgcgcgaaagcggaaaggccaucaucauuacaucccauucuauggaggaaugcgaggcucuuugcaccagacuggccaucauggugcagggccaauucaagugucuggggagcccgcagcaccucaaauccaaguuuggaagcggcuacucucugcgggcuaaagugcaguccgaggggcagcaagaagcccuugaggaguucaaggccuuuguugaucugacguucccuggaagcguccucgaggacgaacaccagggcauggugcauuaucaucugcccggccgcgaucugucuugggcuaaaguguuugggauucucgagaaggcgaaggagaaauacggagucgacgauuacagcgugucccagaucucucuugaacagguuuuccugagcuucgcccaucugcaacccccuacagcugaggaaggcagauga

SEQ ID NO: 65323 - RNA, 4929 nt, Artificial Sequence
  derived and/or modified sequence opt5 from ABCA5__Homo_sapiens__NP_758424
augagcaccgccaucagagaggugggcgucuggcggcagacacgcacgcugcuccugaagaacuaccuuauuaaaugcagaaccaagaaauccucuguucaagaaauccuguucccccucuuuuuccuguuuuggcuuauucugaucagcaugaugcacccuaauaagaaauaugaggaagugccgaacauugagcucaaucccauggacaaguucacacuguccaaccugauccucggguacaccccugugacaaauaucaccucuagcauuaugcagaaggucuccacagaucaucugcccgacgugaucauuaccgaagaguauacgaacgagaaagaaaugcuuaccucuagccuguccaagccuagcaauuuuguuggaguggucuucaaagauucuauguccuacgagcuccgguuuuuccccgacaugaucccugugagcucuauuuauauggauucccgcgcuggcuguagcaagucuugcgaagccgcgcaguacugguccagcggguuuacaguucugcaggcuuccaucgacgccgccauuauccaacuuaaaaccaacgugucucuguggaaggagcucgagagcacaaaggcugucaucaugggagaaaccgccgugguggagauugauacguucccgagaggcgucauccugauuuaucugguuaucgcuuuuucccccuucggguacuuucucgccauucacaucguggcggaaaaagagaagaaaaucaaggaguuccugaaaauuaugggacuucaugacacagccuucuggcugagcugggugcuccuguacaccucucuuaucuuucugaugucccuccugauggcugucauugccacagcuagccuccucuucccucagucuagcuccaucgugauuuuucugcuuuucuuucuguauggccucucuagcguuuucuuugcccugaugcuuaccccucuguucaagaaauccaagcacgugggcaucgucgaguuuuucgugaccguugcguuuggguucaucggacucaugauuauccugauugagagcuuuccuaagucucugguguggcuguucucccccuucugucauugcacauuugucaucggcauugcccaggugaugcaccuggaagauuucaaugagggggcuagcuuuucuaaccuuacggccggaccguacccucugaucauuaccaucaucaugcucacacugaacuccauuuucuauguccugcuugcuguguaccucgaccagguuauccccggcgaauuugggcugcggcgcagcucccuguauuuccucaaaccuucuuacuggagcaaguccaaaagaaacuaugaggaacugucugagggaaaugugaacggcaauauuagcuuuuccgagaucauugaacccgucagcucugaguucgugggcaaggaagccauccggaucuccgggauucagaaaaccuaccgcaagaagggagagaacguugaagcccuuagaaaccugagcuuugauaucuacgagggccaaauuacagcucuccuggggcacucuggaaccggcaaauccacgcugaugaauauccuuugugggcucugucccccuagcgacggauucgcgucuauuuauggccaucgggugagcgagaucgaugaaauguuugaagcccgcaagaugaucggcauuugcccgcagcucgacauccacuucgacguccugacaguggaagagaaucuguccauucuggcuagcaucaaagggauucccgccaauaacaucauccaggaggugcaaaagguucuucuggaucucgacaugcagaccauuaaagauaaucaggccaagaagcugucuggaggccagaaaagaaagcugucccuugggaucgcuguccucggaaacccuaaaauucugcugcucgacgaacccaccgccggcauggauccuugcagccggcauaucguguggaaucugcuuaaguaccgcaaagcgaacagagugacagucuuuuccacccacuucauggacgaggcugauauucuggccgaccggaaggccgugaucucucaagggaugcucaaguguguuggcagcuccauguuccugaaaucuaaguggggaauuggcuauagacugagcauguacaucgauaaauauugcgcuacagaaucccuuucuagccucgugaagcagcacauccccggggccacgcugcugcagcaaaaugaccagcagcucgucuacucccugccguuuaaagauauggacaaguucagcggacuguuuucugcucuugacucccauagcaaccucggcgugauuucuuaugggguuuccaugaccacacuggaggauguguuccugaaacuugaagucgaggccgagaucgaccaggcggauuacagcguguuuacccaacagccucuggaagaggaaauggacucuaaguccuucgaugagauggaacagagccuccugauucucuccgagacaaaggccgcucugguuagcaccaugucucuuuggaaacagcaaauguacacgaucgccaaguuucacuucuuuacccugaaacgcgagagcaaguccgugcggucuguccuccugcugcuucugauuuucuuuacagugcagaucuucauguuccucgugcaucacagcuuuaaaaaugcugucguucccaucaagcuggugccugaccucuauuuccugaagcccggagauaaaccucauaaguacaaaaccucccuucugcuccagaacucugccgacagcgauauuuccgaccugaucagcuuuuucacaucucagaauauuauggugaccaugaucaacgauuccgacuaugucagcguggcgccccacucugccgcucugaauguuaugcacuccgaaaaggauuacguguuugccgcugucuucaacagcacgaugguguauucucuuccgauucugguuaacaucaucuccaauuacuaucucuaccaucugaacgugacagagaccauucaaaucuggagcacacccuuuuuccaggaaauuaccgacaucgucuuuaaaauugagcucuacuuccaggccgcccugcuuggcaucauugugaccgcuaugccucccuauuuugcgauggaaaaugccgagaaccacaagaucaaggcuuacacacaacugaaacuguccgggcuccugccuucugccuauuggaucggccaggccguuguggacauuccgcuuuucuuuaucauucugauccucaugcugggaagccuccuggcuuuccauuacggccuuuauuucuacacggucaaguuucuggccgugguguucugucugauuggguauguccccuccguuauccucuuuaccuacaucgcgagcuucacauuuaaaaagauucugaauaccaaagaguucuggucuuuuaucuacuccguggcugcccuugccugcauugcuaucacagaaauuaccuucuuuaugggauauacgaucgccacaauccugcacuacgcguucugcauuaucauuccuaucuauccccuccugggcugucucauuagcuuuaucaagauuucuuggaagaacgugcgcaaaaaugucgauaccuacaacccuugggacagacugagcguggcuguuaucucccccuaucuucagugcgugcuguggaucuuccugcuccaguacuaugagaagaaauacgggggacggucuauuagaaaggaucccuuuuuccgcaaucugagcaccaaauccaagaaccggaaacuucccgaaccgccugacaaugaggaugaggacgaagaugucaaggccgagagacugaaggugaaagaacucaugggcugucaaugcugugaggaaaagcccucuaucaugguuagcaaccugcacaaagaguacgacgauaagaaagacuuccuccugucccgcaaggugaagaaagucgccacaaaguauauuagcuuuugcgugaaaaagggggagauccuuggccugcugggaccuaauggcgcugggaaaucuaccauuaucaacauccucgucggagauauugaacccacauccggccagguguuccugggggacuacagcuccgagacgucugaagaugacgacagccuuaaguguaugggauauugcccgcagaucaauccucuguggcccgauaccacacuccaggagcauuuugaaauuuacggcgccguuaaggggauguccgcuucugacaugaaagaggugaucagccggauuacccacgcccuggaucugaaggagcaucuccagaaaacagucaagaaacuuccugcgggcaucaagagaaagcuguguuucgcccuguccaugcucggaaacccccaaaucacccugcuugacgaacccagcacgggcauggauccuaaagcuaagcagcacauguggcgcgccauucggaccgcuuuuaaaaacagaaagcgggccgccauccugacaacccauuauauggaggaagcugaggcggugugcgaccgcguugccauuauggugucugggcagcucagauguaucggaacaguccaacaccugaaauccaaguucggcaagggguacuuucuggaaauuaaacucaaggauuggaucgagaaucuugagguggaccggcugcagagagaaauucaguauaucuucccgaacgcuagccgccaagagucuuuuuccagcauccuggccuacaaaauucccaaggaagaugugcagucucucagccaguccuucuuuaaacuggaggaggccaagcacgcuuucgccaucgaagaguacucuuuuagccaggcgacccuugaacaaguuuucgucgagcugacaaaagaacaggaggaggaagacaauuccugcggaacccucaacagcacgcuguggugggagcggacacaggaagauagagugguguucuga

SEQ ID NO: 65324 - RNA, 4854 nt, Artificial Sequence
  derived and/or modified sequence opt5 from ABCA6__Homo_sapiens__NP_525023
augaacaugaagcagaaaagcguguaccaacagaccaaggcccugcucugcaaaaauuuccugaagaaauggagaaugaagcgggagucccuucuggaauggggccucucuauccugcuugggcuguguauugcucucuuuagcuccucuaugcgcaacguccaguuccccggaauggccccucagaaucugggcagaguugacaaguuuaacagcuccucucugauggugguguauacaccgaucagcaaucucacgcaacagauuaugaacaaaaccgcgcuggcuccccuucugaaggggacauccgucaucggagccccuaauaaaacccacauggaugagauucuccuggaaaaccuucccuacgccaugggcaucaucuucaaugagacauuuagcuauaagcugauuuucuuucagggguacaacucuccucucuggaaagaagacuucuccgcucauugcugggauggauauggcgaguuuagcuguacccugacaaaguacuggaaucggggcuucguggcccugcagaccgcuaucaacacggccauuaucgagauuaccacaaaucaccccguuauggaggaacucaugucugugaccgcgaucacaaugaagacccugccuuuuauuacgaaaaaccuucugcauaaugaaauguucauccucuuuuuccugcuucacuucuccccgcuggucuauuuuaucagccucaacgugacaaaggagcgcaaaaagucuaaaaaccugaugaagaugauggggcugcaagacuccgccuucuggcucagcuggggacugauuuacgcuggcuuuaucuucauuaucuccauuuuuguuaccaucaucauuacauucacccagaucauugugaugaccggguuuauggucaucuucauucuguuuuuccuguacggacucucucugguggcccuuguguuucugaugagcguccuccugaaaaaggcuguucugacaaaucucgugguguuccugcuuacgcuguuuuggggcugccucggguucaccgucuucuaugagcagcugcccuccagccuggaauggauccuuaacaucuguucuccuuuugccuucacaaccggaaugauucagaucauuaagcucgauuacaaucugaacggcgugaucuuucccgacccuuccggcgauagcuauacaaugauugcgaccuucucuaugcugcuccuggacgggcuuaucuaccugcuccuggcccuguauuuugauaaaauucuucccuacggagacgagagacauuauagcccucucuucuuucuuaauuccucuagcugcuuccaacaccagcggacgaacgcuaagguuaucgaaaaagagaucgaugccgaacacccguccgacgauuacuuugagcccguggcuccugaguuccagggcaaggaagccauucgcaucagaaaugucaaaaaggaguacaaggggaaaagcggaaagguggaagcccugaaaggccuccuguuugacauuuaugaggggcaaaucacagcuauucuuggacauucuggcgcgggcaaguccagccugcucaacauccugaaugggcugucuguucccaccgaaggauccgugaccaucuacaacaaaaaucuuagcgagaugcaggaccucgaggaaauucggaagaucacaggcgucuguccccaguucaacgugcaguuugauauucugaccgucaaggagaaucugucccucuucgccaaaaucaaggggauucaccugaaagaaguggagcaagaaguucagcgcauccuucuggagcucgacaugcagaacauccaggauaaucuggcuaagcaucugucugagggacaaaagagaaaacuuacauucggcauuacgauccucggggacccucagauucugcugcucgaugaaccgaccacaggccuggaccccuuuagccgggaucagguguggucccuucugcgcgagagacgggccgaccacgucauccucuucucuacccagagcauggaugaagccgacauucuggcugaucgcaaggugaucauguccaacggaagacugaaaugcgccggcagcucuauguuucuuaagcggagaugggggcugggauaucaccucucccugcaucgcaacgagaucuguaauccugagcaaauuaccagcuucaucacacaccauauucccgacgcgaaacucaagacggaaaacaaagagaagcugguuuacacccuuccucuggaacggacaaauaccuuucccgaccucuucucugaucuggacaaaugcuccgaucagggcgugacaggguaugacaucagcaugucuacccugaacgaggucuuuaugaaacuugaaggacagagcacgauugagcaggauuucgagcaaguggaaaugaucagagacuccgagagccugaaugaaauggagcucgcucacucuuccuuuagcgaaaugcagacagccguguccgauaugggccuguggcgcaugcagguuuucgccauggcucggcucagauuucugaaacuuaagcgccaaaccaagguccugcucacacugcugcuuguguucgggauugccaucuucccgcugaucguggagaacauuauguacgcuaugcucaaugagaaaaucgacugggaauuuaagaacgagcuguauuuccucucuccuggccagcugccccaggaaccucggaccagccuucugauuaucaauaacaccgaguccaauauugaagauuuuaucaaaucucugaagcaucagaacauccuccuggaggucgacgauuucgagaauagaaacggaacagacggccuuagcuacaauggggccauuaucguguccggaaagcaaaaagauuaccgcuuuucuguuguguguaacacgaagcggcugcacugcuuccccauucucaugaacaucauuagcaauggccugcuccagauguuuaaccacacccagcauaucagaaucgaauccagcccuuucccccugucucacauugggcuuuggacaggacugccggacggcuccuuuuuccuguuucucguccugugcagcaucucuccuuauauuaccaugggguccaucagcgacuacaaaaagaaugcgaaaucucagcuuuggauuuccggccuguauacaagcgccuacugguguggacaagcucucguggauguuuccuucuuuauccugauucuccugcuuauguaucugaucuucuacaucgagaacaugcaguaucugcucauuaccagccagaucguguucgcccuggucauugugacgcccggcuacgcugccucucuuguguuuuucaucuacaugauuagcuuuaucuuccgcaagcggagaaagaacuccgggcuguggucuuuuuauuucuuuuucgcgagcacaaucauguuuuccauuacccucaucaaucauuucgaccugucuauucucaucaccacaaugguucugguccccagcuacacccuucugggauuuaaaacauuccuggaagugcgggaucaggagcacuaucgcgaguuuccugaagccaauuucgagcucuccgcuacggacuuccuggugugcuuuauuccguacuuccaaacccuucuguuugucuucguucucagauguauggaacugaagugcggcaaaaagcggaugagaaaagaucccguguuucgcaucucuccucagagccgggacgccaagcccaacccugaggaacccaucgaugaggacgaggauauucagacagaaagaauccgcaccgcuacagcccugaccacguccauucucgacgagaagccugugaucauugccagcugucuucacaaagaauaugcugggcaaaagaaaucuugcuucuccaagagaaagaagaaaaucgcggcccggaauauuagcuuuuguguccaggagggagaaauccugggccugcucgggcccaacggcgcuggaaagucuuccagcauccgcaugauuuccggcaucaccaagccgacagccggggagguggagcugaaaggaugcucuagcguucuuggccaucugggguacuguccucaggaaaaugugcucuggcccaugcugacccugagagagcaccucgaagucuaugccgcugugaagggacuucggaaagccgaugcgcgccuggcuauugccagacugguuuccgccuucaagcuccaugagcagcugaacgugccuguccaaaaacuuacagcuggcaucacccggaagcugugcuuugugcucagccugcugggcaauucucccguucuccuucuggacgaaccguccacagggauugauccuaccggacagcagcagauguggcaagccauccaggcgguggucaagaacacggagcgcggcgugcugcucacaacccacaaucuggcugaggccgaagcccuuugugacagaguggcuaucauggucagcgggcggcugcgcugcauuggaucuauccagcaucucaaaaacaagcugggcaaagacuacauucuggagcucaagguuaaagaaaccagccaggugacacuugugcacaccgagauccugaagcuguucccccaagccgcugggcaggagagauacuccucucuccugacguauaaacuuccugucgccgauguguacccccugagccagacauuucacaagcucgaagcgguuaagcauaacuucaaucuggaggaauauucccugucucagugcacccucgagaaaguguuucuugaacugagcaaggagcaagaggucggaaacuucgacgaagagauugauacaaccaugcgguggaaacugcucccccacuccgacgaaccuuga

SEQ ID NO: 65325 - RNA, 6441 nt, Artificial Sequence
  derived and/or modified sequence opt5 from ABCA7__Homo_sapiens__NP_061985
auggccuucuggacccagcugaugcuccugcuuuggaagaacuuuauguacagacggcgccaacccgugcagcugcucgucgagcugcuuuggccucuguuccucuuuuucauccugguugcugugagacacagccauccuccccuggaacaccaugagugccacuuucccaauaaaccccucccuuccgccggcacagugcccuggcugcaggggcuuaucuguaacgucaauaacacgugcuucccucagcugacccccggagaagaacccggccggcucucuaauuuuaacgacagccuggugucccgccuucuggcggaugcuagaacaguucucgggggagccucugcccaucggacccuggcuggccuggggaagcucaucgccacacugcgcgcugccagaagcaccgcgcaaccucagcccacaaaacaguccccucuugaaccucccaugcuggacguggccgagcuccugaccucucuucugcggacggagagccucggacuggcucugggccaggcccaagaaccccuccacucccugcuugaggcugccgaagaucuggcgcaggagcuccuggcccuucgcagccuggucgagcucagagcucugcugcagcggccccgcggcaccucugggccucucgaacugcuuuccgaggcccuguguagcgugagaggacccucuuccacaguuggccccagccucaauugguaugaggcuucugaccugauggagcugguggggcaggaaccugaguccgcccuuccggauagcucccucucucccgccugcagcgagcugauuggagcucuggacucccacccucucagccggcugcuuuggcgcagacugaagccccucauccugggcaaacugcuuuucgcgccugauacccccuuuacacggaagcucauggcccaagucaacagaaccuucgaggaacugacgcugcuccgcgacgugcgggaagugugggagaugcuggggccgagaauuuuuacauucaugaaugauucuuccaacgucgcuaugcuucagcgccugcuccagaugcaagacgaaggacggagacagccucgccccggcggccgggaucauauggaggcccugcgcuccuuucuggacccugggucuggaggcuacagcuggcaggaugcccacgcugacguugggcaucuugugggaacccucggccgcgugacagagugucugucccuggacaagcucgaagccgcgcccucugaggcugcccuggucagccgggcccuucagcugcucgcugaacacagauucugggccggggugguuuuccugggaccugaggauuccagcgaccccaccgaacacccgaccccugaucugggccccggccaugugcgcaucaaaauccggauggacauugaugucgugacaagaacgaauaagauccgggaccgcuuuugggaucccgggccugcugccgacccgcuuaccgaucucagauauguuuggggaggcuucguguaccugcaagaccuggucgagcgggcggccgugagaguccucucuggggcuaacccccgcgccggacuguaucuucagcagaugccuuaccccugcuauguggaugacguuuuucugcgggugcucuccagaagccugccucuguuccuuacacuggcuuggauuuacucugucacccucacagugaaagccguugugcgcgagaaggaaaccagacugcgggacacgaugcgcgcgaugggccucuccagagccguccuguggcuugggugguuucugagcugucucggccccuuccugcuguccgcugcccuucuggugcucgugcugaaacucggagauauccugccuuacucucaccccggcguugucuuucuuuuccuggcugccuuugccguggcuacagugacccagagcuuccuccuguccgcguuuuucucucgggccaaucuggcugccgccugcgggggacuugcuuauuuuagccuguaccucccguauguccuguguguggccuggcgcgacagacucccugcgggcgggcggguugcugccucccugcuuagccccguggccuucggauucggcugcgagucucuggcucugcucgaggaacaaggggagggcgcccaguggcauaacgucggaacccgcccuacagcggauguguuuucccuggcucagguuagcggccuucugcuccuggacgccgcccucuacgggcuggcuaccugguaucuugaagccgugugucccggacaguacggcauuccggagccuuggaauuuccccuuuagacggucuuauuggugcgggccuagaccgcccaaguccccugcuccgugccccacaccucuggaucccaagguccugguggaagaggccccucccggacucagcccuggcguuucugugagaagccuggaaaaacgguucccggggagcccccaaccugcgcuuagaggccugagccucgacuuuuaccagggacacaucacggccuuccugggccauaacggggcuggaaagaccacaacccucucuauucuguccggccuuuuucccccuagcgggggauccgccuucauccugggccacgauguccgcucuagcauggcugccauccggccccaccuggggguguguccgcaguacaacgugcucuuugacaugcugacagucgaugagcauguuugguucuauggcagacuuaaaggacuguccgccgcuguggugggcccugagcaggaccgccuccugcaagaugucgggcucgugucuaagcagagcguucagacccggcaccuguccggaggcaugcaaagaaaacuuucuguggcgauugccuuugucgggggaagccaggugguuauccuggacgaacccacggcuggcguggaucccgccucccgccggggcauuugggagcugcuccugaaguacagagaagggcgcacccuuauccugagcacacaucaccucgacgaggccgaacugcugggagaccgggucgcugugguugccggcgggagacucugcuguugcggaucuccucuuuuccugcggcgccaccugggcuccggguauuaccucacccuggugaaagcgagacuuccccugacaaccaaugagaaggcugauacggacauggagggaagcgucgauacacggcaggaaaagaaaaacggcucucagggcucccgcguggggaccccucaacuccuggcccuggugcagcauugggucccgggagccagacucguugaggaacuuccccacgagcuggugcuggugcucccuuauacaggcgcucaugacgggagcuuugccacccuguuccgggaacuugauaccagacuggcggagcuccgccugacaggauacggcauuucugacacgucccuggaggaaaucuuccucaaggucguggaggaaugugcugccgauaccgacauggaggaugggagcugcggacagcaccuuuguacaggcaucgccggccuggacguuacccugcggcucaaaaugcccccucaggagacagcucuggaaaauggggagcccgccggauccgcuccggaaaccgaucaaggcagcgggccugacgccgugggaagaguccagggcugggcgcuuacgcgccagcagcugcaagcccuccugcugaagcgguuucuccuugcuagacgcucucggagagggcuguucgcccagauugugcugcccgcucucuuuguuggacuggcccuuguguucagccugaucgucccucccuuuggccauuauccugcccuccgccugucccccacaauguacggcgcucaggugucuuucuuuagcgaggaugcgccgggggacccugggagagcucggcugcucgaagcccuucugcaagaggccggccuggaggaaccgcccguccagcacuccucucaccgcuucagcgccccugaggugccggcugaaguugccaaagugcucgcguccgggaacuggacccccgagucuccuagccccgcuugccaguguuccagaccuggagcccggcgccugcuucccgacugcccugccgcugccggcgggccgcccccuccccaggcggucaccggaagcggcgaagugguucaaaaucugacaggcagaaaccucucugauuuucuggugaagaccuacccucggcuggucagacaggggcucaagaccaagaagugggugaaugaggugcgcuauggaggcuucucccuugggggacgggaccccggccugccgagcgggcaggagcugggaagaucuguugaggaacucugggcccugcuuuccccucugcccggcggcgcucucgaucgcguccugaaaaaccugacggccugggcucauagccucgacgcccaggauucccuuaagauuugguuuaauaacaaaggguggcacucuaugguggcuuucgugaaucgggccagcaacgcgauccugagagcccaucugcccccuggacccgcucggcacgcccauuccauuaccacacucaaucacccucugaaccuuaccaaggaacaacugagcgagggcgcucucauggccucuuccgucgacgugcugguuagcaucuguguggucuucgccaugucuuuugugccggcuagcuucacacugguucucaucgaggaacgcgugaccagagcgaagcaccuucagcugaugggaggacugucccccacgcucuacuggcugggcaauuuucuuugggauaugugcaacuaucuggucccugccugcauugugguucucaucuuccuggcuuuucagcagcgggccuacguggcccccgcuaaccugccugcccuccuucugcugcuccugcuuuauggguggucuauuacaccccugauguacccggcgagcuucuuuuucuccgucccuucuacagccuauguggugcucaccuguaucaaucuguuuauuggaaucaacggcagcauggcuacauucguccuggagcucuuuuccgaccaaaaacugcaggaaguuagccgcauucuuaaacagguguuccugaucuuuccccauuucugccucggcagagggcugaucgauauggugcggaaucaggccauggcugacgccuucgagcgccuuggagauagacaauuucagucuccucugcggugggaagucgugggcaaaaaccuccuggcgaugguuauucaggggccccuguuccuccuguuuacccuucugcuccaacaccgcucccagcugcuuccucagcccagagugcggagccugccgcuccugggagaggaggacgaagacgucgccagagagcgcgaacgggugguucagggcgcuacacaaggggaugugcugguccucagaaaucugaccaagguguaccgcggccagcggaugccugccgucgacagacuuugucugggcauuccgcccggagagugcuucgggcuccugggagugaacggcgcugggaaaacguccacauuucgcaugguuaccggagauacccuugccucucggggcgaagcugugcuggccgggcauagcguggcgagagagccuuccgccgcucaccucucuaugggcuacuguccgcagagcgacgccauuuucgagcugcugacaggacgcgaacaccucgagcugcuugcucggcugagaggcguccccgaagcccagguugcccaaaccgcgggguccggacucgcucgccugggccuuagcugguaugccgaucggccugcugggacguacucuggaggcaauaagagaaagcuggccacagcccucgcucuggugggggaccccgccguggucuuucuggaugagccuaccacaggcauggaccccuccgcgcgcagauuccucuggaacagccugcuugccgugguucgggaaggacgcucugugaugcugaccucccauagcauggaggagugcgaagcucucuguucuagacuggccaucauggucaauggccgguuuagaugccuugggagcccucagcaccugaaaggacgguucgcugccggccauacacucacccugcgcgugcccgcggccagaucccagccggcugccgcuuuugucgccgcugaguucccuggggccgaacugcgggaggcgcacggaggccgccucagauuucagcugcccccuggcgggcggugugcccuugcucgcguguucggagaacuggccguucauggcgcugagcacgggguggaggauuucucugucagccaaacgaugcucgaagagguguuucuguauuucuccaaggaccagggaaaagaugaagacaccgaggagcagaaggaagccggcguugggguggaucccgccccgggacuucaacacccuaaaagagucagccaguuucuggacgaccccuccacagcggagaccgugcucuga

SEQ ID NO: 65326 - RNA, 4875 nt, Artificial Sequence
  derived and/or modified sequence opt5 from ABCA9__Homo_sapiens__NP_525022
augagcaagagacggauguccgugggccagcaaaccugggcccugcucugcaaaaacugucugaagaaauggcgcaugaagagacagacacuucuggaguggcuuuucucuuuucugcuuguccuguuccucuaccuguuuuucagcaaucugcaccagguucaugacacgccccagauguccucuauggaucucgggcggguggacagcuuuaacgauaccaauuaugugaucgcuuucgccccugaauccaaaacaacccaagagauuaugaacaaggucgcgucugcuccguuucugaagggacgcacaaucaugggcuggcccgacgaaaaauccauggaugagcuugaccugaauuacuccauugaugccgugagaguuaucuucaccgacacauuuagcuaucaccucaaguucucuugggggcaucggauuccuaugaugaaagaacaccgcgaucauuccgcccacugccaggcugugaacgagaagaugaaaugugagggaagcgaauuuugggagaagggcuucgucgccuuucaggcugccaucaaugcggccaucauugaaaucgcuaccaaccacucugugauggagcagcugauguccguuacgggggugcauaugaagauucuucccuucgucgcccaaggaggcguggcuaccgacuucuuuaucuucuuuugcauuaucagcuucucuacauuuauuuacuauguguccgucaauguuacccaggagagacaguacaucacaagccugaugaccaugaugggccuccgggaauccgccuucuggcugucuugggggcugauguaugcgggauuuauccucauuauggccacgcugauggcucuuaucgugaaaagcgcccagauugugguccugacaggcuucgugaugguuuuuacccucuuccugcuuuacgggcugucccucaucacacuggcuuuucugaugagcgugcucauuaagaaaccuuuccugaccggacuugucguguuucugcucaucguuuucuggggcauccugggguuccccgcccuuuacacccgccugccugccuuucucgaguggacacugugucugcucucuccguucgcuuuuacggugggaauggcgcaacugauucaccuugauuaugacgucaacuccaaugcccaucuggauagcucucagaaccccuaccucaucauugcuacccuguucaugcugguguuugacacacuucucuaucugguccugacccucuacuucgacaagauccugccugccgaauauggccacagaugcagcccccuguuuuuccuuaaauccuguuuuugguuccagcacggccgggccaaucaugugguucucgagaacgaaacagauucugacccuacccccaaugauugcuuugagccggugagcccugaguucugugggaaggaagcuauucgcaucaaaaaccugaagaaggaguacgccggaaaaugcgaaagagucgaggcgcugaagggcgugguuuuugacaucuaugaagggcaaauuacggcccuucucggacacuccggcgccgggaaaacaacccugcugaacauccucagcggacugucugugcccaccuccggcagcgucacaguguacaaucauacccucucucggauggcugauauugagaacaucuccaaguucacaggcuucuguccucagagcaaugugcaguuuggguuccugacgguuaaagagaaccuccgccuguuugcuaagauuaagggaauccugccccacgaagucgagaaagaagugcagagagugguccaagagcuugaaauggagaauauucaggacauccucgcccagaaccuguccggcgggcagaaucggaagcugaccuucggaaucgcuauucucggcgauccccaagugcugcuucuggacgagccuacagccgggcucgauccgcugucuagacaucgcaucuggaaccugcuuaaagaaggcaagagcgaccggguuauucucuuuuccacccaguucaucgaugaggcggacauucuggccgacagaaaaguguuuaucucuaauggaaagcugaagugcgcuggcagcucccucuuccugaaaaagaaaugggggaucggauaccaccuuagccugcaccucaacgaacgcugcgaucccgagucuauuacaucccuggucaagcagcauaucagcgacgccaaacugaccgcucagucugaggaaaaacuuguguauauucugccucucgagcggacgaauaaguuucccgaacuguacagagaucucgaccgcuguuccaaccaaggcaucgaggauuaugggguuagcauuaccacacugaaugaaguguuccuuaagcuggagggaaagucuaccaucgacgagagcgauaucggcauuugggggcagcuccagacagacggcgccaaagauaucggaucccuggucgaacuggaacaggugcuuagcucuuuucacgagacccggaagacgauuuccggcguugcgcuguggagacaacaggugugcgccaucgcuaaaguccgcuuccucaagcugaaaaaggagagaaagagccucuggacaauucugcuucuguucgggaucuccuuuaucccucagcuccuggaacaucuguucuacgagucuuaucagaaaagcuaccccugggagcuuuccccgaacaccuauuuucugucuccuggacaacagccccaggacccucucacacaucugcucgugauuaauaagaccggcagcaccaucgauaacuuccugcacucccuucggcgccaaaacauugccaucgaaguggacgcuuuugggacacggaauggaacggaugaccccucuuacaacggcgccauuaucgucagcggggacgagaaagaucacagauucuccauugccuguaauaccaagcggcugaacugcuuuccuguucugcucgacgugaucagcaauggccugcuuggaaucuucaacucuuccgaacacauucagacagaucgcagcaccuuuuucgaggaacauauggacuacgaguauggcuacagaucuaauacauuuuucuggauccccauggcugcguccuuuaccccguauauugccaugagcucuaucggggauuacaaaaagaaggcucacucccagcugcggauuagcggacucuauccuuccgccuacugguucggccaggcccugguggacgucagccucuauuuccugauccuucugcugaugcaaaucauggauuacaucuuuucucccgaggaaaucauuuucaucauucagaaccuccugauccagauccuuuguagcauuggguacguguccucucugguuuuucucacguaugugaucagcuucauuuuuagaaauggacgcaaaaacuccggcaucuggucuuucuuuuuccugauugucgugaucuuuagcauuguugcuacagaccucaaugaguacggguuccugggccuguuuuucggaaccaugcuuauucccccuuuuacccugaucggcucccucuucauuuucucugaaaucagcccggauuccauggacuaucugggggccagcgagucugagauuguguaccuugcgcugcucauccccuaucugcauuuucucauuuuccuguuuauccuucggugccuggaaaugaacuguagaaagaaacugaugcgcaaggauccugucuucagaaucagcccccggagcaaugcuauuuuuccuaaccccgaggaaccugagggagaagaggaggacauccagauggaacgcaugagaacagugaaugccauggccguucgggauuucgacgagacccccgugauuaucgcuucuugccuccgcaaagaauacgccggcaagaagaaaaacuguuuuuccaagcggaaaaagaaaauugcgacaagaaacgucagcuucugcgugaagaagggggaggugaucggacugcuuggccacaauggcgcugggaaauccacgaccaucaagaugauuacaggagacaccaaaccgacagccggccaagucauccugaaggggucuggaggcggggaaccucucggauuucugggcuauuguccccaggagaacgcccuguggccuaaucucaccguucgccagcaccuugagguguacgcugccgugaaaggccugagaaagggggaugcuaugauugccaucacgcggcuggucgacgcgcucaaacugcaagaucagcuuaaggcccccgugaagacccugagcgaaggaauuaaacgcaagcucugcuucguucuguccauccugggcaacccgagcgugguccuccuugacgagccuucuacagggauggaucccgaaggacagcagcaaauguggcaagugauuagagcuaccuuucggaauacagagagaggcgcccugcugaccacacauuacauggcugaagccgaggccguuugcgaccgcguggcuaucauggucuccgggcggcucagauguaucggaagcauucagcaccugaaaucuaaguucggcaaagauuaucuucuggagaugaagcucaagaaccuggcgcagauggaaccucugcaugccgagauccuccgccuuuuuccccaagcugcccagcaggaacgguucagcucccugaugguguacaaacugcccgucgaggacgugagaccucucucucaggccuucuuuaagcuggagauuguuaaacagagcuucgaucuugaagaguauucccugucucagagcacccucgaacagguguuucuggagcuguccaaggaacaggagcucggcgaccuugaggaagauuucgacccgagcgucaaauggaagcugcugcuccaagaggaacccuga

SEQ ID NO: 65327 - RNA, 3966 nt, Artificial Sequence
  derived and/or modified sequence opt5 from ABCB11__Homo_sapiens__NP_003733
augagcgacuccgugauccugagaucuauuaagaaauucggcgaggaaaacgauggguuugagagcgacaaguccuacaauaacgauaaaaagucucggcuccaggacgagaaaaagggagauggcguccgcguuggguucuuucaacuguucagauuuagcuccucuaccgacaucuggcuuauguucgugggaagccugugcgccuuucuccacggcauugcucagcccggggugcugcuuaucuucggaacaaugacggaugucuuuauugacuaugauguggaacugcaggaacuccagaucccuggcaaggccuguguuaauaacaccaucguguggacaaauuccagccugaaccaaaauaugaccaacggcacacggugcgggcugcucaauauugagucugagaugaucaaauucgcguccuacuaugcuggaauugccgucgccgugcugaucaccggcuacauucagaucuguuuuuggguuauugcugccgcucgccagauccagaagaugagaaaauucuauuuucggcgcaucaugagaauggaaauugggugguucgacugcaacagcgugggagagcuuaauacacgguucucugaugacaucaacaagauuaaugaugccaucgcggaccaaauggcccuguuuauucagcgcaugaccuccacgaucuguggcuuccuccugggguuuuucagaggauggaaacuuacccuggucaucauuagcgugucuccgcucaucggcauuggcgcugccacaaucgggcuguccgugagcaaguuuaccgacuacgaacugaaggcuuaugccaaagcgggagucguugccgaugaggugauuuccucuaugcggacaguggcugccuucggcggggagaagcgcgaagucgagagauacgagaaaaaccucguguuugcucagcgguggggaauccgcaagggcaucguuaugggguucuuuaccggauucguguggugccugauuuuucuuuguuacgcccuggccuucugguauggcagcacgcucguccuggacgaaggcgaauacacacccgggacccuugugcagaucuuucuguccguuauugugggagcucucaaucugggcaacgcgagcccuugccuggaggccuucgcuacagggagagccgccgcuaccucuaucuucgagaccauugaucggaaacccaucauugacuguauguccgaagauggauauaagcucgacagaaucaaaggcgagaucgaauuucauaacgucacauuccacuacccuagccgccccgaggugaagauucugaaugaucuuaacauggucaucaagccuggggaaaugacggcccuggugggcccgucuggagcgggcaaaagcaccgcucuccaacugauucagcgguuuuaugaccccugcgaggggaugguuacaguggauggacaugacaucagaucccuuaauauucaguggcugcgcgaucaaaucggcaucgucgagcaggaaccuguucucuucucuaccacaauugccgagaacauccgguacgggagagaagacgccaccauggaggacauugugcaggcugccaaggaagcuaaugccuauaacuuuaucauggaucugccccagcaauucgacacgcuggugggagagggcgggggccagaugagcggaggccagaaacagcgcgucgcgauugcccgggcucucaucagaaauccuaagauccugcuucuggauauggccacauccgcucucgacaacgagagcgaagccauggugcaagaggugcugucuaaaauucagcacgggcauaccaucauuuccguugcgcaccgccugagcaccguccgggccgcugauacaaucauuggauuugaacacggcaccgccguggagagagggacacaugaggaacuucucgagcgcaagggaguguacuucacgcuggucacccugcagucucagggcaaucaagcucucaacgaagaggacaucaaggaugccacagaagacgauaugcuggcccggaccuuuuccagagggagcuaccaggacucccuucgggcuucuauccgccagagaagcaaaucccagcugucuuaucucgugcacgagcccccgcuggcgguuguggaucauaagagcacauacgaggaagaccggaaagauaaggacauuccuguccaagaggaaguggagcccgccccuguuagacgcauccugaaauucuccgcucccgaauggcccuauaugcuugugggcagcgucggagccgccgugaauggcaccguuacgccucucuacgcuuuucuguucucucagauucuggggaccuuuuccaucccggacaaggaggagcagcggagccaaauuaacggagugugucuccuguucgucgccaugggcugcgugucucuuuucacacaguuucugcagggguaugcguucgcuaaguccggagaacuccugaccaaaagacugcgcaaguuuggcuucagagccaugcuugggcaggauaucgccugguuugacgaucuccggaauagccccggcgcucugacaacccgccuggccacggacgcgucucaagugcagggagcugccggcagccagauugggaugaucgucaacuccuucacaaauguuaccguggccaugaucauugcuuuuagcuucucuuggaaacucucccuggugauccuuugcuuuuucccuuuucuggcccucagcggagcuacacagaccagaaugcugaccggcuucgccucccgggauaagcaagcgcuggagauggucgggcagauuacaaacgaagcccuuucuaacauccgcacgguggcuggaauuggcaaagagagacgguucaucgaagcccucgagaccgagcuggaaaagcccuuuaagacagcuauccagaaagccaauauuuacggcuucuguuuugccuucgcucagugcaucauguuuauugcgaacagcgccuccuaucgcuacgggggauaccugaucucuaaugagggccuccacuucagcuauguuuuuagagugauuuccgcugucgugcugucugccaccgcccuugggcgggcuuucagcuacacaccuuccuaugccaaggcgaaaaucagcgcugcccgcuuuuuccaacugcucgacagacagcccccgaucucuguuuacaacaccgccggagaaaagugggauaauuuucagggcaaaauugacuucguggauuguaaguuuacguauccuucccggcccgacagccaaguccugaacgggcugucuguguccaucagcccuggacagacacuugcuuucguugggucuuccggcugcggcaaaagcaccuccauucagcugcucgagagauucuacgaucccgaccagggaaaggugaugaucgauggccacgacagcaagaaagucaaugugcaauuucugcgcucuaacauugggaucgugagccaggagccuguccucuucgccuguuccauuauggacaauaucaaguauggagauaacaccaaagaaauccccauggagcggguuauugcggcugccaagcaggcccagcugcaugacuuugugaugucucuuccggaaaaauacgagacaaaugugggcagccaagggucccagcugucuagaggagaaaagcagcgcaucgcuauugcccgggcuaucgucagagauccuaagauucuccugcuggacgaggccaccagcgcgcuugauacagaguccgagaaaacggugcagguugcccuggacaaggcucgcgaaggccggaccugcaucgugaucgcccacagacucucuacaauucaaaacgcugauaucauugccgucauggcccagggcgugguuaucgaaaaagggacccaugaggaacugauggcucagaagggagcguacuauaaacucgugacaaccggcagccccauuuccuga

SEQ ID NO: 65328 - RNA, 3843 nt, Artificial Sequence
  derived and/or modified sequence opt5 from ABCB1__Homo_sapiens__NP_000918
auggaccuggagggcgauagaaacgggggagccaagaaaaagaauuucuuuaaacucaacaauaagagcgaaaaagacaagaaggagaaaaagcccaccguguccgucuucucuauguuucgguacagcaacuggcuggauaaacuuuauaugguugugggcacacuggcugccaucauucacggggcgggacucccucugaugaugcuuguguucggcgaaaugacggacaucuuugcuaaugccgggaaccuggaggaucucauguccaauauuaccaaccgcucugacaucaaugauacaggauucuuuaugaaccuggaagaggacaugaccagauacgccuauuacuauagcggcauuggcgcugggguccugguggccgcuuacauccagguuuccuucuggugccucgccgcgggacggcaaauccauaagauucgcaaacaguuuuuccacgccaucaugagacaggagauuggcugguuugaugugcaugacgucggggaacugaauacacggcuuaccgaugacgugucuaagaucaacgagggaauuggcgauaagaucgggauguucuuucagagcauggcuacauucuucaccggauuuauuguuggcuucacgcgcggcuggaaacugacccucgugauccuggccaucuccccgguccuugggcugagcgcugccgugugggcgaagauucucucuuccuuuacagacaaagaacugcuggccuaugcuaaggccggagcuguggccgaggagguccucgccgcuaucagaaccguuauugcguucggcgggcagaaaaaggaacuggagcgguacaauaaaaaccuugaagaggccaagcgcaucggaauuaagaaagcuaucacagccaauaucagcauuggcgccgcuuuucugcucaucuacgccucuuaugcgcuggcuuucugguacgggaccacgcuugugcuguccggagaauauagcauuggccaggugcucacagucuuuuucucugugcugaucggcgccuuuuccguugggcaggccagccccuccauugaggcuuucgccaacgcuagaggagccgcguacgagaucuuuaagaucauugacaacaaaccuucuaucgauagcuauuccaagagcggccacaaacccgacaauauuaaggggaaccuggaauuucggaaugugcauuuuucuuacccuucccgcaaggaggucaaaauccucaagggacugaaccuuaaagugcagagcggccaaaccguugcccuggugggcaauucuggguguggaaagagcacaaccguccagcucaugcagagacuguaugaucccaccgaaggcaugguguccgucgacgggcaggauauucggacaaucaacgugcgcuuccuuagagagauuaucggaguugugucucaagaaccuguccuguucgcuacgaccaucgccgagaauauucgguacggcagagagaacgugacaauggacgaaaucgagaaagcuguuaaggaagccaaugcguacgauuuuauuaugaagcucccgcacaaauucgacacccuggugggggagcgcggagcccagcugagcggcgggcagaagcaacggaucgcuauugccagagcucucguccgcaaccccaaaauccugcuucuggaugaagccacauccgcccucgacaccgagagcgaggcuguggugcagguugcgcuggauaaggcccggaaaggcagaacgacaaucgucauugcucaccgccugucuaccgugcggaaugccgacgugaucgccggauuugacgauggcgucauuguggaaaaggggaaccaugacgagcuuaugaaggaaaaaggaaucuauuucaagcucguuaccaugcagacagcuggcaaugagguggagcuggaaaacgccgcggaugaguccaaaagcgaaauugacgcucuggagaugucuuccaaugauagcagauccucucucauccgcaagcggagcaccagacgcuccguccgggggucucaggcccaagacagaaaacugagcacaaaggaagcccuugaugaguccaucccucccgugagcuuuuggcggauuaugaaacugaaccucacggaguggccuuacuucguugugggagucuuuugcgcuaucauuaacggcgggcugcagcccgccuucgcgaucauuuucucuaagaucaucggcguguucacccgcauugacgauccggaaacaaagagacaaaauuccaaccuguuuagccuucucuuccuggcucugggaaucauuucuuuuaucaccuucuuccuccagggcuuuacauucgggaaagccggagagauucugaccaagcggcuuagauauaugguuuuucgcuccaugcugcggcaagacgugagcugguucgaugacccuaaaaauacgaccggcgcccucacaaccagacuggcuaacgaugccgcucaggucaagggggccaucggaucucgccuggcggugauuacacagaauaucgccaaccuuggcaccgggaucauuaucagcuuuauuuacggcuggcagcucacgcugcugcuccuggcuaucgugcccauuaucgccaucgcuggagucguugaaaugaaaaugcuuuccggccaagcccugaaggacaagaaagagcucgaagggagcggaaagauugccacagaggcuaucgagaauuucagaaccguggugucucugacacaggaacagaaauuugagcacauguaugcgcagucccugcaagucccuuaccggaacagccuucgcaaggcccauauuuucggcaucaccuuuuccuucacccaggcuaugauguauuuuucuuacgccggguguuucagauucggagccuaccucguggcucacaaacugaugagcuuugaagacguucugcucguguucuccgccgucguguuuggcgcgauggcuguuggccaggugucuagcuucgcccccgauuaugccaaggcuaagauuuccgccgcgcacaucaucaugauuaucgagaaaacaccccugauugacucuuacagcacggaagggcuuaugccuaauacccuggagggaaacgucacauuuggcgaggugguuuucaauuauccgacccggcccgauaucccugugcuccaagggcugucccuggaagucaagaaaggacagacacuugcucuggugggcagcucugggugcggaaaguccaccgugguccagcuccuggagcgcuuuuacgacccccucgccggcaaaguucugcuugauggcaaggaaauuaagagacugaacgugcaguggcuccgggcccaucuggggaucgugagccaagagccuauucuguucgacuguucuaucgcugagaauaucgccuauggagauaacucccgcgucgugagccaggaagagauuguuagagcugccaaagaagcgaauauccacgccuuuauugagucucuucccaacaaguacuccacgaaagugggcgacaaggggacacagcugagcggaggccagaaacaacggaucgcuauugcccgcgcucucgucagacagccgcauauccugcuccuggaugaagccaccuccgcccuugacaccgagagcgagaaggugguucaggaagcucuggauaaagcgcgggaggggagaacaugcaucgugauugcccaccgccucucuaccauccagaacgcugaccugauugucguguuccaaaauggacgggucaaggaacauggcacacaccagcagcugcuugcccaaaagggcaucuauuuuagcaugguguccguucaggccgggacgaaaagacaguga

SEQ ID NO: 65329 - RNA, 3840 nt, Artificial Sequence
  derived and/or modified sequence opt5 from ABCB4__Homo_sapiens__NP_000434
auggaccuggaggccgcuaagaacggcaccgccuggagacccacaagcgcggaaggggauuucgagcucggaaucuccucuaaacagaagcggaaaaagacgaaaaccgugaagaugauuggcguccugacacuuuuucgcuacagcgacuggcaagauaagcuguucaugucccucgggaccaucauggcuauugcccacggaucuggccugccucuuaugaugaucguuuuuggggaaaugacagacaaauucguggauaccgccggaaauuuuagcuucccggugaacuuuucccugucucuccugaaucccggcaagauucuggaggaagagaugacaagauaugcuuacuauuacagcggccucggggccggaguccugguggcugccuauauccagguuuccuucuggacccuugcggccggccggcagauccgcaaaauuagacagaaguuuuuccaugcuauccugcggcaagagauugggugguuugacaucaacgauacgaccgaacucaauacacgccugaccgacgauauuagcaaaaucucugagggaauuggcgacaagguggggauguucuuucaggccgucgcuacauucuucgccggauuuaucgugggcuucaucagaggcuggaaacuuacccugguuauuauggcgaucuccccuauucucgggcugagcgccgcugugugggccaagauccugucugcuuuuuccgauaaggaacucgccgccuacgcuaaagcgggagccgucgcugaggaggcccugggcgccauucggacggugaucgcuuucgggggacagaacaaggaacuugagcgcuaucagaaacaccuggaaaaugccaaggagaucggcauuaaaaaggcgaucagcgcuaacauuucuauggggaucgccuuucuccugauuuacgccuccuacgcucuugccuucugguauggaagcacacuggugaucuccaaggaauacaccaucggcaaugcuaugacagucuuuuucucuauucucaucggcgccuuuagcguugggcaagcggcccccugcauugacgcuuucgccaacgcuagaggagccgcguaugugaucuuugauauuaucgacaauaacccuaaaauugacuccuucagcgagcggggccauaagcccgauucuaucaaagggaaucuggaguuuaacgacgugcacuucuccuacccuagccgcgccaaugucaagauccugaaaggacucaaccugaaggugcagucuggccagaccguugcucuuguggggagcuccggcuguggaaagucuaccacaguccagcugauucaaagacucuaugauccggacgaaggcacgaucaacauugaugggcaggacauccggaauuucaacgugaauuaccugcgcgagauuaucggaguugugagccaggaacccguccuuuuuagcaccacaaucgccgagaacauuugcuauggcagagggaaugugaccauggaugaaaucaaaaaggcugucaaagaggccaacgccuacgaguucauuaugaagcugccucaaaaauuugacacacucgugggagaacggggcgcucagcugagcgggggccagaagcagagaaucgcgauugcccgcgcucugguucggaaucccaagauccuccugcuugaugaggccaccucugcccuggacacggaauccgaggcugaagugcaagccgcgcucgauaaagcuagagagggacgcacaaccaucgucauugcccaucggcugagcaccgugagaaacgccgacguuaucgcuggcuucgaggacggggugauugucgaacagggaucucacuccgagcugaugaagaaagaaggcguguacuuuaaacuugugaauaugcagacaagcgggucccagauccaaucugaggaguucgaacucaacgaugagaaggccgcgacccgcauggcuccuaauggauggaagucccggcuguuuagacacuccacacagaagaaccugaaaaauucucagaugugucaaaagagccucgacguugaaacggauggccuggaggccaacgugcccccggucuccuuccuuaaagugcugaagcucaauaaaaccgaauggccuuauuuugucguggggacaguuugcgccauugcuaacggcggacugcagcccgccuucagcgugaucuuuucugagaucauugcuaucuucggcccuggggacgaugccgucaagcagcagaaauguaacaucuuuucccugauuuuccuuuuccucggaauuaucagcuuuuucaccuuuuuccugcagggcuuuacauucgggaaggcgggagagauucugacccgccggcucagaucuauggccuuuaaggcuaugcugcgccaagacauguccugguucgaugaccauaaaaauagcacgggcgcccuuucuacccggcuggcuacagaugccgcccaggugcagggggcuaccggcacaagacucgcgcugaucgcccaaaacaucgcuaaucugggaaccggcauuaucauuagcuuuaucuacggguggcagcuuacgcuccugcugcucgccguugugcccauuaucgccgucuccggaaucguggaaaugaagcugcuugcuggcaacgccaaacgggacaagaaagagcuggaagcggcugggaagauugccacagaggccaucgaaaauauucgcaccguugugagccucacacaggagagaaaguucgagucuauguaugucgaaaaacuguacggacccuaucggaacuccgugcagaaggcucacaucuacggcauuaccuuuagcaucucccaagccuucauguauuucucuuacgcgggcugcuuuagauucggggcuuaccugaucgugaauggacauaugcgcuuucgggaugucauucuuguuuucagcgccaucguguuuggcgccguggcucucgggcacgccuccucuuucgcuccugacuaugccaaagcgaagcugagcgccgcucaccuguuuaugcuuuucgagagacagccgcugauugauuccuacucugaagagggacuuaaacccgacaaguuugaaggcaacaucaccuucaaugaggucguguuuaacuauccuacacgcgccaauguucccgugcugcaggggcucagccuggaggucaagaaaggacagacgcuggcucuugugggcuccagcggcugugggaagucuaccguugugcaacugcucgaaagauucuacgacccucuggccggaacaguccuccuggauggccaggaggccaaaaagcucaacgugcaguggcugcgggcucagcucgggauuguuucccaagaacccauccuguuugacugcagcauugcggagaauaucgccuauggagauaacucucgcguggucucccaggacgagaucgugagcgcugccaaagccgcuaauauucauccguucaucgaaacccugccucacaaguacgagacaagagugggcgauaaggggacccagcuuucuggaggccaaaaacagcggauugccaucgcgcgcgcucugauuagacagccccagauccuccugcucgacgaagccacguccgcccuggauacagagagcgaaaaggucguucaagaggcucuugacaaagcccgggagggccgcaccuguaucgugauugcgcauagacuguccaccauccagaacgccgaucucauuguggucuuccagaacgggcgggugaaggaacacggaacacaucagcaacugcuggcucagaaaggcaucuauuuuagcaugguuucugugcaggccgggacccagaaucuuuga

SEQ ID NO: 65330 - RNA, 3774 nt, Artificial Sequence
  derived and/or modified sequence opt5 from ABCB5__Homo_sapiens__NP_001157413
auggagaacagcgaaagagccgaggaaaugcaggagaauuaccaacggaacggcaccgcugaggaacagcccaagcugcgcaaagaggccgugggguccaucgaaauuuucagauuugcggacggacucgauaucacacugaugauucuuggcauccuggcuucucucgucaauggggccugccugccucuuaugccgcugguucucggagagaugagcgacaaccugauuuccggcugucuggugcagacgaauaccacaaacuaucagaauugcacccaaucucaggaaaagcucaacgaggauaugacacugcuuacccuguacuauguggggaucggagucgccgcucucaucuucggcuacauucagaucagccuguggauuaucacagccgcucggcagaccaaacgcauuagaaagcaauuuuuccacuccgugcuugcccaggacaucggcugguuugauucuugugacauuggggagcugaauacgcggaugaccgaugacaucgauaaaaucagcgacggaauuggcgauaagaucgcgcuccuguuccagaacauguccacauuuagcauugggcuggccguuggacucgugaagggcuggaaacugacccuugucacacugucuaccagcccccucaucauggcuuccgccgcugccugcucucgcauggugauuucccugacgagcaaggaacuuucugcguauuccaaagccggggcuguugccgaggaagugcugagcuccaucagaacagucaucgcuuuccgggcccaggagaaggaacuccaacgcuacacccagaaucugaaagacgccaaggauuuuggaauuaagagaacaaucgcuucuaaagugagccugggcgcgguguauuucuuuaugaacggcaccuacgggcucgccuucugguacggaaccucccugauucuuaauggcgagccuggguauacaaucggaacgguccuggcuguguuuuucagcguuauucauucuuccuacuguaucggcgccgccgugccccacuucgagaccuuugcuaucgcccgcggggcggcuuuccauauuuuucaggucaucgacaagaaaccuagcauugacaacuucucuacagccggauauaagcccgaaagcaucgagggcaccguggaauuuaaaaauguuuccuucaacuacccuucucggccgagcauuaagauccucaaaggccugaaccuuagaauuaaguccggggagacaguggcccuggucggacucaauggcagcgggaagucuaccgugguucaacugcugcagcggcucuaugaucccgacgauggauuuaucaugguggacgaaaacgauauccgcgcucugaaugucagacacuaccgggaccauauuggcguggucucccaggagccugugcuuuucgggacgacaaucagcaacaauauuaaauauggcagagaugacguuaccgaugaggaaauggagcgcgccgcucgggaagccaacgcguacgacuuuaucauggaguuccccaauaaguuuaacacccuggugggagaaaaaggcgcccagaugucugggggacaaaagcagagaauugcuaucgcccgcgcucucguccggaauccuaaaauccugauucuggaugaggccacauccgcgcuugacagcgaguccaagucugccgugcaggcugcccucgaaaaggcuagcaaaggcagaaccacaaucguuguggcccaccgccuguccacgauucggucugccgaccugaucgucacccucaaggaugggaugcuggcugagaaaggagcgcacgccgaacuuauggcuaagagaggccuguacuauagccucgugaugucccaggacauuaaaaaggccgaugagcaaauggagagcaugacauacucuaccgaacgcaagacaaacucccugccccugcauagcgugaaaucuaucaaguccgacuucaucgauaaagccgaggaaagcacccagucuaaggagauuagccuuccggaaguuucccuccugaaaauccugaagcucaauaagccugaguggcccuuugucgugcuggggacgcuugcuagcgugcugaacggcaccguccacccuguguucucuauuaucuucgccaaaauuaucacaauguuuggaaauaacgacaagaccacacucaaacaugaugcggagaucuauuccaugauuuucguuauccugggcgugauuugcuuugucagcuacuucaugcaggggcuguuuuauggacgggcuggcgaaauccuuaccaugagacuccgccaccuggccuucaaggccaugcuguaccaggacauugcuugguuugaugagaaagaaaauuccacagggggacucacgaccauccuggccauugacaucgcgcaaauccagggcgcuacagggucucggauuggcgugcuuacccagaacgccaccaacaugggacugagcguuaucauuuccuucaucuauggcugggagaugacauuucucauucugucuaucgcccccgugcuggcugucacggggaugaucgaaaccgccgcuaugacaggauucgccaauaaggauaaacaggagcuuaagcacgcgggcaagauugccaccgaggcucucgaaaacaucagaacaauugugagccugacccgggagaaagccuuugaacaaauguacgaggaaaugcugcagacgcagcaucgcaauacauccaagaaagcucaaaucauugggucuuguuacgccuucagccacgccuuuaucuauuucgcuuacgcggccggauucagauuuggcgcuuaucucauccaggccgggcggaugacccccgagggcauguucauuguuuuuaccgccaucgcuuacggagccauggcgauuggcgagacacuggugcuugcuccugaauauuccaaggccaaaagcggggccgcucaucuguucgcccuccuggagaagaagccgaacaucgacucuagaucccaggaaggaaagaagcccgauaccugcgagggcaaucuggaguuucgcgaagucagcuucuuuuacccuugucggcccgacguguucauucuuagagggcugucucucuccaucgagcgcggaaaaacaguggcguuugucggcagcucuggcugcgggaaguccacgagcguucagcugcuccaaagacuguaugacccugugcagggacaggugcuuuucgauggcgucgacgcuaaagaacugaacgugcaguggcuccggucccaaauugccaucguuccccaggagccggugcuguuuaauuguagcaucgccgaaaacauugcuuacggggauaauucucgcgucgugccucuggacgagaucaaggaggccgcuaacgccgcgaauauucacagcuucaucgaaggacuucccgagaaguacaacacccagguuggccugaaaggggcccagcucuccggaggccaaaagcagagacuggcuauugcccgggcucuccugcagaaaccuaagauccuucugcucgaugaagccacaucugcccuggacaaugauagcgagaaagugguccaacaugcucuggacaaggcgcgcaccggcagaacaugccuugugguuacccaccggcuguccgccauccagaacgcugaucucauugugguccugcacaaugggaagaucaaagaacagggaacgcaucaggagcuccugcgcaacagagacauuuauuucaaacuugugaacgcccaaucugugcaguga

SEQ ID NO: 65331 - RNA, 2529 nt, Artificial Sequence
  derived and/or modified sequence opt5 from ABCB6__Homo_sapiens__NP_005680
auggugaccgucggcaacuacugcgaggccgaagggcccguuggaccugcuuggaugcaggacggccugagcccguguuucuuuuucacacucgugcccuccacgagaauggcccuggggacccuugcgcuggugcucgcucugccuugccggcgcagagagcggcccgccggagccgauucucuuagcuggggcgcugggccucgcaucucccccuauguccugcaacuccugcuggccacacuccaggcugcccugccucuugcgggacuggccggcagagugggcaccgcucgcggggccccgcuccccucuuaccugcuucuggcuagcguucucgaaucccuggccggagcguguggccuguggcuccugguggucgagcggucucaggccagacagcggcuugcuauggggauuuggaucaaguuucgccacagcccuggacugcuccugcuuuggacaguggccuucgcugccgaaaaucuggcccucguuuccuggaacagcccccaaugguggugggcuagagcggaccugggccaacaggugcaguuuucucuguggguccuccgguaugugguguccgggggacuguucguccuuggccugugggccccuggccuccgcccccagagcuacacccugcagguucaugaggaggaucaggacguggaaagaucucaggugcgguccgcugcccaacagagcacauggcgcgauuuugggagaaaacuucggcugcucucuggauaucuguggccgagaggcuccccugcccugcagcucgucgugcugauuugccuugggcugaugggacucgagcgcgcucugaauguucuggugcccaucuucuaccggaacauugucaaucuucucaccgaaaaggccccuuggaacagccuggcguggacggugaccuccuauguuuuucugaaauuccuccaaggcgggggaacaggcucuaccggcuuugugagcaaucugagaacauuccuuuggauccgcguccagcaguuuaccucccggagaguggagcugcucaucuucagccaccuccaugagcugucucuucgcuggcaccucgggcggagaacgggagaaguccugcgcauugcugaccggggcacauccagcgugaccgggcugcucucuuaccugguuuucaacgugauccccacacuugccgauauuaucauuggaaucauuuacuuuagcauguucuuuaaugccugguucggccugaucgucuuucucuguaugucccuguaucugacccuuaccaucgugguuacagaguggagaacgaaguuccgccgggcuaugaacacccaggaaaaugccacaagagcucgggccguggacucucuccugaacuuugagaccgucaaauacuauaaugcggaaagcuacgagguggagcgcuauagagaagccauuaucaaguaccaagggcuggaguggaaguccagcgcuucucucgugcugcuuaaccagacacagaaucugguuauuggccucggacugcuggccggcucccuucucugcgcuuauuucgucaccgaacagaaacugcaagugggggauuacgugcuguuuggaacguacaucauucagcucuauaugccccugaacugguucggcacauacuaucggaugauccagaccaacuuuaucgacauggagaauauguucgaucuucugaaggaagagaccgaggucaaagaccucccuggggccggaccgcugagauuucagaagggccgcauugaguucgaaaacgugcauuucagcuacgcggaugggcgggaaacacugcaagacguuucuuuuaccgugaugcccggccagacacuugcccuggucggaccuuccggcgcugggaaaagcacgauccucagacugcuguuccgcuuuuaugacauuuccucuggauguaucagaauugauggccaggacaucagccaggugacccaagccucccugcggucucacaucgggguugugccccaggauacaguccuuuucaaugacaccauugcugauaacauccgcuacggaagagugacagccggcaaugacgagguugaagccgcugcgcaggccgcugggauucacgaugccaucauggccuuuccugagggcuaucggacccaagugggagagcgcggccugaagcucagcgggggagaaaagcagagagucgcuauugcccggacgauccugaaagcgcccggcauuauccugcuugacgaggcuaccuccgcccuggauacaagcaacgaacgcgccauccaggcuucucucgccaaggugugcgcgaauagaaccacaauuguggucgcucaucggcuguccaccguugugaacgccgaccagauccucgugauuaaagauggguguaucgucgagcgcggaagacacgaggcccugcuuagccggggcgggguguacgcugacauguggcaacugcagcagggccaggaagagacgucugaagacacaaagccgcaaaccauggagagauga

SEQ ID NO: 65332 - RNA, 2259 nt, Artificial Sequence
  derived and/or modified sequence opt5 from ABCB7__Homo_sapiens__NP_001258625
auggcccugcucgcuaugcacagcuggagaugggccgcggcugccgccgcuuucgagaagcggcgccauuccgccauccugauuagaccccuugugucugucagcggcuccgggccucaguggcggccgcaccaacugggagcucucggcaccgcccgcgcguaccagauccccgaaucucugaaaagcauuacauggcagagacuugggaagggaaacuccggccaguuucuggacgccgcuaaagcccuccaaguuuggccucugaucgagaagcggacgugcuggcaugggcacgcuggaggcggccugcauaccgaucccaaagaagggcucaaggacguggauacacgcaagauuaucaaagccaugcugucuuauguguggccuaaggacagacccgaucuucgggcgcgcgucgccaucagccugggauuccucggcggggcuaaagccaugaauauugugguuccuuuuauguucaaguacgcuguggacucccugaaccagaugagcggaaauaugcuuaaccugucugaugccccgaauaccgucgccacaauggcuaccgcggugcucaucggcuaugggguuuccagagccggagcugccuuuuucaacgaggugcggaaugccgucuuuggcaaaguggcucagaacagcauucgcagaaucgccaagaauguguuccugcaucugcacaaccucgaccugggcuuucaccuuucucggcagacaggggcgcuguccaaggcuauugaucgcggaaccagaggcaucagcuucguccucucugcccugguuuuuaaucuucugcccauuauguucgaagugaugcucguguccgggguccuguacuauaaauguggagcccaauuugcucuggugacgcucggcacccuggggacauacaccgccuucacaguugcugugacccgguggagaacgcgcuuccggaucgagaugaacaaggccgacaaugaugcgggaaacgccgcuaucgacagccuucugaauuaugagacagucaaauacuuuaacaacgaaagauacgaggcccagcgcuaugauggcuuccucaagaccuacgaaacagcuucccugaaaucuaccagcacccuugccaugcugaauuuuggccaguccgcgauuuucagcguggggcucacagccaucaugguucuggcuucucagggaauuguggccggcacgcugaccgucggggaccucgugauggucaacggacugcuuuuucaacugucccucccucugaauuuccugggcacaguguaucgggagaccagacaggcucuuaucgacaugaacacacucuuuacccugcugaagguugauacgcagauuaaagacaaggugauggccagcccccuccaaaucacaccucagaccgccaccgucgcuuucgauaaugugcacuuugaguacaucgaagggcagaagguucugucuggcauuagcuucgaggugcccgcgggcaaaaaggucgccaucgugggaggguccggaucuggcaaaagcacaauugugcgccuucuguuucgguucuaugaaccgcagaagggguccaucuaccucgcuggacaaaacauucaggacguuagccuggagucucugagacgcgccgucggcguggugccucaggaugccguccuuuuucauaauaccaucuauuacaaccuccuguacgggaauaucuccgcuagccccgaagagguguaugccguugcgaaacuggcuggccuccacgacgccauucugcggaugccucacggauacgauacacaggugggcgagagagggcuuaagcugucuggaggcgaaaagcaacgcgucgccaucgcucgggccauucucaaagacccucccgugauccuguaugaugaggcgacguccagccuggacuccauuaccgaagagacaauccuuggggcuaugaaggauguugugaaacauagaaccucuauuuucaucgcccaccggcucagcacagucguggacgccgacgaaaucauuguucuggaucagggaaagguggcugagcgcggcacccaucacgggcugcucgccaacccccauuccaucuacucugagauguggcacacgcagagcuccagaguccagaaucacgacaacccgaaaugggaagcuaagaaggagaauauuagcaaagaagaggaacggaagaaacugcaagaggagaucgugaacucugugaagggcugcggaaauuguuccugcuga

SEQ ID NO: 65333 - RNA, 2208 nt, Artificial Sequence
  derived and/or modified sequence opt5 from ABCB8__Homo_sapiens__NP_001269220
augcuggugcaccucuucagagucggcauccgcgggggacccuuuccuggccggcugcuuccgccccugagauuccagaccuuuagcgccguucggaacacauggcgcaaugggaagacgggacaacuccauaaagcugagggcgaauacuccgacggguauagaucuagcucccugcuucgggccguggcgcaccuucgcucucagcucugggcucaucugccuagagcuccccuggccccucgguggagccccuccgccuggugcugggugggaggcgcccuccugggcccuaugguccuuucuaagcacccgcaucugugucucguggcucugugcgaggccgaagaggcgcccccugccagcuccacaccccacguuguggggagccgcuucaacuggaaacuuuucuggcaguuccugcacccucaucuccugguccugggaguggcuguugugcucgcccugggcgcugcccuugucaaugugcagauuccccugcuccuggggcaacuuguggaagucguugcgaaguacaccagagaucacgugggaucuuuuaugaccgagucccagaaccugagcacacaucuccugauccuguauggcgugcaggggcuccugaccuucggauaccuuguccugcucucucacgugggcgagcggauggccguugacaugcgcagagcucuguuuuccagccuucugcggcaggauauuacauucuuugacgccaauaaaaccggccaacucgugucucgccugacgaccgauguccaggaauuuaaguccagcuuuaagcuggugaucucccaggggcucagaucuuguacacagguugcuggaugccuggugagccuuuccaugcugagcacccggcucacacugcugcuuauggucgccaccccggcccucaugggcguggggacgcugaugggaucuggccugagaaaacucucccgccaaugucaggagcagauugcucgggcgaugggggucgccgacgaagcucugggaaacgugagaacaguucgcgccuucgccauggagcaacgggaggaagagagauauggcgcugaacuugaggccugccgcugucgggcggaggaacugggcagagggaucgcucucuuccagggacugagcaauaucgccuuuaacugcauggugcugggcacccuuuucauugggggaucucucgucgccggccagcagcugacagggggcgaucugaugagcuuucucguggcuucccaaaccguucagcgcucuauggccaaucugagcgugcuuuucggacaggucgugcggggccuguccgcuggggccagaguguuugaguacauggcgcucaacccuuguaucccccugagcggaggcugcuguguuccuaaggaacagcugcgcgggucugucaccuuccaaaaugugugcuuuuccuaucccugccggcccggauucgaggugcuuaaagacuuuacacucacgcugccuccgggcaagauugucgcccugguggggcagagcggcggaggcaaaaccacaguugcuucucuccuggaaagauucuacgaucccaccgccgggguggucaugcuugacggacgggaucugcgcacacucgacccuuccuggcugagaggccaggugguuggguuuaucagccaggagcccgugcuguucggaaccacgauuauggaaaacauccgguuuggcaagcuggaggcuuccgaugaggaagucuacacagccgcgagagaggccaaugcucacgaguucauuaccucuuucccugaaggguauaacaccgugguuggcgaacgcggaacaacccucagcggcgggcaaaagcagcggcuggccaucgcuagagcccugaucaaacagcccacagugcucauucuggacgaggccacguccgcucuugacgcggagucugaacgcgucgugcaggaggcccuggauagagcuagcgccggacggaccgugcucgucaucgcccaucgccuguccacaguuagaggcgcucacuguauuguggugauggccgacgggcgggucugggaagcgggaacccaugaggagcugcuuaagaaaggcgggcuguacgcugaacucauccgcagacaagcccuggaugccccgcggacagcugccccucccccuaagaaacccgagggcccucgcagccaccagcauaagucuuga

SEQ ID NO: 65334 - RNA, 2112 nt, Artificial Sequence
  derived and/or modified sequence opt5 from ABCB9__Homo_sapiens__NP_001229942
augagacuguggaaggccguggucguuacccucgcuuucaugagcguggacaucugcgugacaacggccauuuacgucuuuucccaccuggaucggucucuucuggaggacauccgccauuucaacauuuuugauagcgugcucgaccugugggcggcuugucuuuauagauccugccugcuccugggcgccaccaucgggguugccaaaaauucugcucugggaccccggcgccucagagccagcuggcuggugauuacacuugucugucuguucgugggcaucuacgcuaugguuaagcuccugcuuuuuagcgaagugcggcgcccuaucagagauccgugguucugggcccuguuugucuggaccuauauuucucucggggcgagcuuccugcugugguggcuccuguccacagugcggcccggaacccaggcccuugagccuggcgcugccacagaagcugagggguuucccggaagcggccgcccucccccugaacaagccucuggcgcgacccugcagaaacuccuguccuacacgaagccggacguggccuuccuugucgcugccagcuuuuuccugaucguugcugcccucggggagaccuuucugcccuauuacacaggcagagccauugauggaaucgugauucagaaaucuauggaccaguucuccaccgcuguggucaucgugugccugcucgcgauugggagcucuuucgccgcuggaauccggggcgggaucuuuacacugauuuucgcccgccuuaacaucagacugcggaauugucucuuucgcucccugguuagccaagagaccuccuucuuugaugaaaacagaacgggagaccuuauuucucggcugacaagcgauaccacaaugguguccgaccucgucagccagaauaucaacguguuccugagaaauaccguuaaggugaccggcgucguggucuuuauguucucucuguccuggcagcucagccuggugacauuuaugggcuucccuauuaucaugaugguuucuaacaucuaugggaaguacuacaaacgccuuagcaaggaggugcagaaugcccuggcucgggccuccaacacggcggaagagaccauuucugcuaugaaaacagucagauccuuugccaaugaggaagaggaagccgagguguaucuccgcaagcugcaacagguuuacaaacugaaccggaaggaagcugccgcuuauauguacuauguguggggauccggccuuacccuccuggucguucaggugagcauccuguacuaugggggacaccucgugauuucuggccagaugacauccgggaaucugaucgccuucauuaucuacgaguuuguccuuggagauugcauggagaacgugagcuucucucugucccccggcaaggugaccgcgcucgucggcccuagcggguccggaaaaucuagcugugugaauauccuggaaaacuucuacccccuggagggcgggagaguucuucucgacggaaagccgauuuccgccuaugaccauaaauaccugcaccgcgugaucucucuggucagccaagaaccugugcucuuugcucgguccauuacggauaacaucagcuauggccugcccacaguuccuuucgagaugguggucgaagccgcucagaaggccaaugcgcauggguuuauuauggagcuucaggacggcuacucuaccgagaccggagaaaaaggcgcccaacuguccgggggacagaagcagagaguggcuauggcccgcgcucucguucggaacccucccgugcugauccuggaugaggccacaagcgcccuugacgcugaaucugaguaucucauucagcaagcgauccacggcaaucugcagaaacacaccguccugaucauugcccauagacucuccacaguggaacacgcucaucugaucgugguccuugauaaggggcgcguugugcagcagggaacgcaccaacagcugcucgcccagggcgggcuguacgccaagcuggugcagcggcaaaugcuuggccuccagcccgcugccgacuucaccgcgggacacaacgagccggucgcuaauggcagccauaaagccuga

SEQ ID NO: 65335 - RNA, 4479 nt, Artificial Sequence
  derived and/or modified sequence opt5 from ABCC10__Homo_sapiens__NP_001185863
auggagagacugcucgcccagcugugcggcagcuccgcugccuggccccuuccucugugggaaggggacaccacaggacacuguuucacgcaacucgugcugucugcgcuuccgcaugcucugcucgccguccugagcgccugcuaccugggcacccccagauccccugauuacauccuccccuguucuccuggguggcgccugagacuugcugccagcuuucugcucuccguuuucccccugcuugaccugcucccuguggcucugccgcccggagccggcccugggcccauuggacuggaggugcucgcgggcugcgucgccgcuguggccuggaucucucacagccuggcucuuuggguucuggcccauuccccucacggccauagccgggggccccucgcgcuggcccuuguggcucugcucccggccccugcucugguccugacagugcucuggcacugucagcgcggaacccugcuucccccucugcuccccggccccauggccagacugugccuucugauucuccagcuggccgcucugcucgcguacgcccuggggugggcugccccuggaggcccgcgggaacccugggcccaggagccucuucugcccgaagaucaagagccugagguugcugaagacggggagucuuggcucucccgcuuuagcuaugccuggcuggcgccccugcuugcuagaggagccuguggcgaacuccggcagccgcaggauaucugccgccugccucacagacugcagcccacauaccucgcccggguguuccaagcucauuggcaggagggcgcccgccuguggagagcucuuuauggggccuuuggacgguguuaccuggcgcucggccugcugaaacuugucgggaccaugcucggauucucuggcccucugcugcucucccugcuugugggguuucuggaggaaggacaggagccccucagccacggccugcuguaugcccuuggccucgcugggggagccgugcugggcgcuguccugcagaaccaauacggguacgaaguuuauaaggugacacuccaggcccgcggagcggugcugaauauucuuuacugcaaggcccugcagcucggcccuucuagacccccgaccggggaggcucugaaccugcuuggcacggacuccgaacggcuccugaauuucgccggauccuuucaugaggcuuggggccugccucuccaacuggccaucacccuuuaucugcucuaccagcaggucgggguggccuucguuggaggccugauccuggcgcuucugcucgugcccgucaacaaagugauugcuacaagaaucauggccuccaaucaggagaugcugcaacacaaggaugcucgcguuaaacucgugaccgaacugcuuucugggauucgggucaucaaguuuuguggaugggagcaggcccugggcgccagaguggaggcuugccgcgcccgggaacucgggagacugcgcgucauuaaguaucuggacgcggcuugcguguaccuuugggccgcccugcccguugugaucagcauugucaucuucaucacauaugugcucaugggccaccagcugaccgcuacgaaaguuuuuacagcccucgcgcuggugcggaugcuuauucugccucucaacaauuucccgugggucaucaacggacugcuggaagcuaaggugucccuugaucggauucagcuguuccucgaccugcccaaucauaacccucaagccuacuacagccccgauccucccgccgagccuucuaccgugcucgagcugcacggcgcucuguuuuccugggaccccguugggacaagccuugaaaccuucaucucucaucuggaggucaaaaagggaaugcucgugggcauuguggggaaagucggauguggcaagagcucccugcuugccgcuaucgccggggaacugcaccgccuccggggccauguggcgguuagaggacugucuaagggcuuugggcucgccacccaggagccguggauccaguucgcuacaauucgcgauaauauccuguuuggaaaaacguucgacgcccagcuuuauaaggaagugcuggaggcuugcgcccugaacgacgaucucagcauucugccugccggcgaccaaaccgaggucggggaaaaaggagugacacuuuccggcgggcagcgggcuagaaucgcgcuggcccgggcuguuuaccaggagaaggaacucuaucugcucgaugacccccuggccgccguggaugcugacgucgccaaucaccuucugcaccgcuguauucugggcaugcucagcuacaccacaagacugcuuugcacccaucggacggaguaucuggagagagcggaugcugugcuccugauggaagccggacgccucauccgggccggcccucccucugagauccugccgcuuguucaggcugugccuaaagccugggcggaaaacgggcaagaguccgacagcgcuacagcccagucuguccagaaucccgaaaagaccaaagagggacuggaggaggaacaauccaccagcggcagacugcuccaggaagaguccaagaaggaaggggccguggcucugcacguguaccaggccuauuggaaagcugucggacagggccuugcccuggcgauucucuuuucucugcugcucaugcaagccacacgcaacgcugccgauugguggcuuagccauuggaucucccagcugaaggcugagaacucuagccaggaggcccagccuuccaccagccccgccucuaugggccuguucagcccccaacuccugcuuuuuagcccugggaaucuguacauuccgguuuucccccucccuaaagcugcgcccaacggaucuuccgacaucagauuuuaccugacaguguaugccacgauugcuggcgugaauagccuguguacccuccuucgggccguccuguucgccgcugggacacugcaggccgcggcuacccuccaccgcagacugcuucaccgggugcugauggccccuguuacauuuuucaacgccacccccacgggacgcauccucaauagauucucuagcgauguggcuugcgccgacgacucccugccuuuuauucugaacauccuccuugcgaaugccgcuggccugcuggggcuccuggccguccuuggaagcggccugccguggcuccugcugcuccuucccccucugucuaucauguacuaucaugugcagcggcacuaccgcgcuuccagcagagaacugcggcgccucggcucccugacccuuucuccccuguauagccaucucgccgauacacuggcugggcuguccguucucagagccaccggagcgacauaccgguucgaggaagagaaccuuagacugcuggaacucaaucagcgcugucaauuugccaccucugcuacgaugcaguggcuggacauucggcuucagcugaugggcgccgcuguggucagcgccaucgccgggauugcucucgugcaacaccagcagggacuggcgaacccuggccugguugggcucucccuuucuuaugcccugagccugacaggacuccuguccggccuugugagcucuuucacccagacagaggcuaugcuggucuccguggagagacucgaagaguauaccugcgaucugccccaagaaccgcagggccagccucugcagcucgggaccggauggcuuacacaaggcgggguggaguuucaggacgucguucuggccuaccgccccggacugcccaaugcccucgauggcgugacguucugugugcagccuggggagaagcugggaaucgucggccggaccggcagcgggaaaucuucccuucugcucgugcuguuuagacugcucgaacccagcucuggacgcguucuucuggacggcguggauacaucccagcuggagcucgcucaacugcggagccagcuugccauuaucccucaggaaccguuccuguuuuccgggaccgucagagagaaccucgacccccagggacugcauaaggaucgcgcgcuguggcaagcccucaagcagugccaccuuagcgaagugaucacaucuaugggcgggcuggacggagagcugggcgagggcgggcggagccucucccugggacagagacaacuucugugucucgcucgggcccugcugaccgaugcuaaaauucucugcaucgacgaagccacggcgucuguugaucagaagacagaccagcugcuucagcaaaccauuugcaaacgcuucgccaauaagaccgugcugacaaucgcucacagacucaacaccauucugaauagcgaccggguccuugugcugcaggccggccgcgucguggagcucgauuccccugcuacacugagaaaccagccccauucucuguuucagcaacuccugcagagcucccagcaggggguuccugccucucuuggaggccccuga

SEQ ID NO: 65336 - RNA, 4149 nt, Artificial Sequence
  derived and/or modified sequence opt5 from ABCC11__Homo_sapiens__NP_115972
augaccagaaagcggacauacugggugcccaacagcuccggcgggcuggucaaucgcggaaucgacauuggcgaugacaugguuucugggcucaucuauaaaacguacacccugcaggauggaccuuggagccaacaggagagaaacccggaagcccccggccgggcugccgugccucccugggggaaguaugacgcggcccuucgcacaaugauuccuuucagacccaaaccucgguuuccggcuccccagccucuggauaaugccggacucuucuccuaccugaccgugucuuggcuuacaccccugaugauccagagccuccgcuccagacuggacgagaacaccauuccuccccugucuguccacgaugcuagcgacaagaaugugcaacggcuccaucgccugugggaagaggaaguuuccagacggggcaucgagaaagccagcgugcuucuggucaugcuccgcuuucagagaacacggcugaucuucgaugcccuucugggcauuugcuuuuguaucgcuucugugcucgggccgauucugaucauuccuaagauccuggaguauuccgaggaacagcucggaaacguugugcacggcgucgggcugugcuucgcgcuuuuucugagcgaaugugugaagucucucuccuucuccucuuccuggauuaucaaucagcgcaccgccaucagauuucgggcugccgugagcuccuucgcuuuugagaaacugauucaauucaagucugucauccauauuacgagcggagaggccaucuccuuuuucaccggcgacguuaacuaccuuuucgaaggggugugcuauggaccccuggugcucauuacaugugcgagccuggucaucugcucuaucuccagcuacuuuauuaucggcuacaccgccuucauugcuauccuguguuaucuccugguguuuccucuugccguuuucaugacaagaauggcugugaaagcccagcaccauaccucugaggucagcgaucagcgcauucgggugacguccgaaguucugacaugcaucaagcucaucaaaauguacaccugggagaagcccuuugccaagauuaucgaagaccugagacgcaaagagcggaagcugcuggagaaauguggccucgugcagucucugacaagcauuacccuguucaucauucccaccgucgcuacagcgguguggguccucauccacacgucccugaaacuuaaacugaccgccagcauggcuuuuucuaugcucgccucccugaaucugcuuagacucagcguguucuuuguuccuauugccgugaaggggcugacaaacucuaaauccgcugucaugcgcuucaagaaguuuuuccugcaagaaagcccgguguuuuauguucagacccuccaggaucccuccaaagcccugguguucgaggaagcgacacuuucuuggcaacagaccugcccuggaaucgucaauggcgcucuggagcucgaacggaacgggcacgccagcgagggaaugacgagaccccgcgacgcccugggcccugaggaagagggaaauucccuggggcccgaacuucauaagaucaaccucguggugucuaaaggcaugaugcugggcguuugugggaauacaggaagcggcaaguccagccugcucucugcuauucuggaggaaaugcaccuucuggagggguccgucggagugcagggcagccucgccuacgugccgcagcaggcuuggaucgucucugggaacauucgggagaacauccugaugggcggagccuaugacaaagcgagauaccuucaagugcuucauugcugcucccucaaucgcgaucuggaacugcucccuuucggcgacaugaccgagauuggggaacggggacugaaccuuagcggcgggcagaagcagagaaucucucuggcccgggcuguuuauagcgaucgccaaaucuaccuccuggacgauccccuguccgccguggacgcucacgucggaaagcacauuuuugaggaguguaucaaaaagacccuuagaggcaaaacagugguucucgugacccaucagcugcaguaccuggaguucugcgggcagauuauccuccuggaaaauggcaagauuugugaaaacggaacacacagcgagcuuaugcaaaagaagggcaaguaugcccagcugauccagaaaaugcauaaggaagcgacgucugauaugcuccaggacaccgccaaaaucgcugagaagccuaaagucgagucccaagcccuggcuacaagccuggaagagucccuuaaugggaacgccgugcccgaacaccagcugacccaggaggaagagauggaggaaggaucucucagcuggcggguuuaccaucacuauauucaagccgcuggcggguacaugguguccugcaucaucuuuuucuuugucgugcugauuguguuccucacaaucuuuucuuucugguggcugagcuauuggcuugagcagggauccggcaccaauucuagcagagaauccaacgggacgauggcggaucugggcaauauugccgacaacccucagcucagcuuuuaccagcuggucuauggacugaaugcccuucugcucaucuguguuggcguguguucuuccgggauuuucaccaaggugacacgcaaggcuagcaccgcccugcacaacaaacucuuuaauaaggucuuccggugccccauguccuuuuucgauacaaucccgauuggaagacugcuuaacugcuucgcuggcgaccuggagcaacucgaccagcugcugccuaucuuuucugaacaguuccuugugcugagccucaugguuauugccgugcugcucaucgucucugugcugucccccuacauucuucugaugggggcgaucaucaugguuauuuguuuuaucuacuauaugauguucaaaaaggcuauuggaguguuuaaacgccuggagaauuacagcagaagcccccucuucagccauauccugaacucucuucagggccugagcuccauucacgucuaugggaagaccgaggauuuuaucucucaauucaaacggcucacggacgcccagaacaauuaccugcuccuguuucuuagcuccacacgcuggauggcccugagacuggaaaucaugaccaaccucgugacacuggcuguugcccuuuucguggcguuuggcauuucuagcaccccuuauuccuucaaggucauggcugugaauaucgugcugcagcucgccucuagcuuccaggccaccgcucggauuggacuggagacagaagcccaauuuacggcugucgagcgcauccuccaguacaugaagaugugcguuuccgaggccccgcugcauauggaaggcaccagcuguccccagggguggccucaacacggagagauuaucuuccaggauuaucacaugaaauacagagacaacacacccaccgugcuucauggcaucaaucugacaauucgggggcacgaaguggucggaaucgugggccgcaccggcucugggaaguccagccugggaauggcgcucuuuagacugguugagccuauggccggccggauucuuaucgaugggguggacauuugcucuaucggacuggaagaucuccgcuccaaacugagcgucauuccccaggacccugugcuccuguccggcacgaucagauucaaccuugaucccuuugaccggcauacagaucagcaaaucugggacgcucuggagagaaccuuccugaccaaggccauuucuaaauuuccgaagaagcuccacacagauguuguggagaaugggggaaacuucagcgucggcgaacgccagcugcuuugcaucgcucgggccgugcugagaaauuccaaaauuauccucauugacgaggccaccgcuagcaucgacauggaaacagauacgcugauccagcgcaccauucgggaggcguuucagggcuguacaguccuggugaucgcccauagaguuaccacagugcucaacugcgaccacauucuugucauggggaauggaaaggugguugaguucgaucgcccugaagugcugcggaaaaagcccggcucucuguuugcugcccucauggccaccgcuacguccagccugagauga

SEQ ID NO: 65337 - RNA, 4080 nt, Artificial Sequence
  derived and/or modified sequence opt5 from ABCC12__Homo_sapiens__NP_150229
auggugggcgaggggcccuaccugaucagcgaccucgaucagagaggacggcgcagauccuucgccgaacgguaugacccuucucugaagaccaugauuccgguccgccccugcgcuagacuugccccuaaccccguugaugacgcgggccugcucagcuuugcuacauucuccuggcugacgccugugauggugaaaggguaccggcaacgccuuaccgucgauacacugcccccucucucuaccuaugacagcuccgauacaaaugccaagagauuucgggugcugugggacgaggaaguugcccgcgugggaccggagaaggcuucucugagccacgucguguggaaguuccagagaacccggguucucauggauaucguggccaacauucuguguaucauuauggcugccaucggccccgucauccuuauucaucagauccugcagcaaacagaacgcaccuccgggaaagugugggugggaauuggccucugcaucgcgcuguuugccacggaguucaccaaggucuuuuucugggcucuugccugggcuauuaauuacagaacagccauccggcugaagguugcgcucagcacccugguguuugagaaccuggugucuuucaaaacacucacccacauuuccgucggcgaagugcugaauauccuuagcucugacuccuauagccuguuugaggccgcucucuucuguccucugcccgccacgaucccuauucuuaugguguuuugcgcugccuacgccuucuucauccuggggcccacagcucucauuggaaucucuguguaugucauuuuuaucccggugcagauguucauggcgaagcugaacuccgccuuucgcagaagcgcuauccugguuaccgauaaacgggugcagacaaugaaugaguuccucaccuguauuagacugaucaagauguacgccugggaaaaauccuuuaccaacacaauucaggacauccgccggagagagcgcaaacuucuggaaaaggccggcuucguccaaucugggaauagcgcucucgccccuauuguguccacgaucgcgaucguccugacccuuagcugccauauucugcuccggagaaaacugacagcucccguggccuuuucuguuaucgccauguucaacgugaugaaguuuuccauugcuauccugccuuucagcauuaaagccauggcugaggccaaugucucucuccgccggaugaagaaaauccugauugauaagagcccucccuccuacaucacccagcccgaagacccggacacagugcuucugcucgcgaacgccacccugacgugggagcacgaggcuucuagaaaaagcacacccaagaagcugcagaaucagaaacgccaucuuuguaagaaacaacgguccgaagccuauagcgagagaucuccucccgcuaagggagccaccggcccugaggaacaguccgauagccucaaaucuguucugcacuccaucagcuuugugguccgcaaggggaagauucugggaaucugcggcaacgugggcuccgggaaaucuagccuccuggcggcccuucugggacagaugcaacuccagaagggcgugguugcugucaaugggacccuggccuacgugucccagcaggcuuggauuuuccacggaaacgugcgggaaaacauccuguuuggcgagaaauaugaccaucaaagauaccagcacacaguccgggugugugggcuucagaaggaucucucuaaucugcccuauggagaccugaccgaaauuggcgagcgcggccucaaccugagcgggggacagagacaacggaucucccuugccagagccguuuacagcgaucgccagcuguaucuccuggacgauccgcugucugcuguggacgcgcaugucggcaaacacguguucgaggaaugcaucaagaagacacuucgggggaaaacgguugugcucgucacccaccagcugcaguuccuggaguccugugaugaagugauucuccuggaggacggagaaaucugcgagaagggcacacauaaagagcuuauggaagagagagggcgcuacgccaagcugauucacaaucucagaggccugcaauuuaaagauccugaacaucuguacaacgcugccaugguugaggccuucaaggagagccccgcugaacgggaggaagacgccggaaucauugugcuugcgccuggcaaugagaaggacgaagggaaagagucugagaccggauccgaauuugucgauacaaaggugcccgagcaccagcucauccagaccgaaagcccucaggagggcacggugaccuggaaaacauaucauaccuacaucaaggcuucugggggauaucugcugagccucuucacagucuuucuguuccuucugaugauuggcuccgccgccuuuagcaacugguggcucgggcuguggcuggacaaaggcucucgcaugaccugcggaccccaaggcaauagaacgaugugugaaguuggggcugugcuugccgauaucggacagcacguguaccagugggucuauacagcguccaugguguucaugcugguuuuuggcgugaccaagggguucgucuuuacaaaaaccacccucauggcuagcuccucucugcacgacacaguguucgauaagauucucaagagcccgauguccuuuuucgacacgaccccuacaggacggcugaugaaccgcuucucuaaagauauggacgagcuugauguuagacugcccuuucaugccgagaauuuccuccaacaguuuuucaugguggucuuuauccuggugauucuggccgcuguuuuccccgccgugcuucuggucguggcuagccucgccgugggcuuuuucauccugcuccggaucuuucaccgcgggguccaggaacugaagaaaguugagaacguguccagaucuccuugguucacccauauuacaagcuccaugcagggccuuggaaucauucacgcguacggcaagaaagaaagcugcaucaccuaucaucugcucuacuuuaauugugcccugcggugguucgcucugcgcauggacgugcuuaugaacauucugacguucacagucgcccuccuggugacccucucuuuuuccagcaucucuaccuccagcaaggggcugucucuuuccuacauuauccaacugagcggacugcuccagguuugcgugagaacaggcaccgagacacaggcuaaguucacguccgucgaacugcuucgggaguauaucagcaccugugugccggagugcacacacccccugaaaguugggaccuguccuaaggauuggcccucuagaggagaaauuacauuucgcgacuaccagaugcgguauagagauaauaccccucucgugcuggacagccucaaccugaauauccaauccggccagacggucgggauugugggccgcaccggaucuggcaaaagcucccuugggauggcccuguuccggcuggucgagcccgccucuggaacaaucuuuauugacgaaguggauaucugcauccucagccuggaggaccuuagaaccaagcugacaguuauuccucaggaucccguucucuucgucggcaccgugcgcuacaaccuggacccguuugagucccacacagaugaaaugcucuggcagguucuggagcggaccuucaugagagacacgaucaugaaacuuccugaaaagcugcaagcugaggugacagaaaacggggagaauuuuucugucggagagcgccagcugcucuguguggcgcgggcccugcuuagaaacagcaagauuauccugcucgaugaagcuaccgccuccauggacagcaaaaccgauacacuggugcagaauaccauuaaggacgccuucaaaggcugcacgguucucacaaucgcucaucggcugaacaccguccuuaauugugaucacgugcuggugauggagaacggcaaggucaucgaauuugacaaacccgaggugcuggccgaaaagccugauucugcguucgcuaugcuccuggccgccgagguucgccuuuga

SEQ ID NO: 65338 - RNA, 4596 nt, Artificial Sequence
  derived and/or modified sequence opt5 from ABCC1__Homo_sapiens__NP_004987
auggcccugagaggcuucugcagcgcugacggguccgauccccucugggacuggaacgugaccuggaauacaucuaacccugauuuuacgaaguguuuccagaauaccguccugguuugggugccgugcuuuuaccuuugggccuguuuccccuuuuauuuccuguaccucagccggcacgaccgcggauauauccaaaugacaccucugaacaaaaccaagacagcgcuuggcuuucugcucuggauugugugcugggcugaucuguucuacuccuuuugggagagaucucgggggaucuuccuggcccccgucuuucucgugagcccuacccugcuuggaauuacaaugcugcucgccaccuuccugauccagcuugaacgcagaaaaggcguucaguccucugggauuaugcugacguuuuggcucguggcucuggucugugcccuggcuauccuccggagcaagaucaugaccgcccugaaagaggacgcucagguggaucuuuuccgcgacauuacauucuauguuuacuuuucccugcuccugauccaacuugugcugagcugcuucucugauagaagcccccucuuuuccgaaaccauucaugacccuaauccgugucccgagucuuccgccagcuuccugucucggaucacauuuugguggauuaccggacugaucguccgcggcuauagacagccucucgaaggcuccgaucuguggagccuuaacaaggaggacacguccgaacagguggugcccguccugguuaagaauuggaaaaaggaaugcgcuaaaacacggaagcagccugugaaaguggucuacucuagcaaggaucccgcccaaccgaaggaguccagcaaaguggacgcuaacgaagagguugaggcccucauugugaagucuccucagaaagaauggaaucccucccuguucaagguccuuuacaaaaccuuugggccuuauuuccugaugagcuuuuucuuuaaggcgauccacgaccucaugauguucucuggaccccagauccugaaacugcucauuaaguuugugaacgauacaaaggcccccgacuggcagggcuacuucuauaccguucugcuuuucgugaccgcuugucugcaaacacucguccugcaucaguacuuucacaucugcuucgugagcgggaugcgcauuaaaacggccgucaucggagcuguguauagaaaggcccugguuauuaccaauuccgcccggaaaucuagcacagugggcgagaucgucaaccuuauguccguggaugcucagcgcuuuauggaccucgcgaccuacaucaauaugauuuggagcgccccucugcaaguuauccuggcucucuaucugcuuuggcugaaccucgggccgucugugcuggccggagucgccgugauggugcugaugguucccgucaaugcugugauggccaugaagacaaaaaccuaccagguggcgcauaugaaguccaaggauaacagaauuaaacuuaugaacgaaauccucaauggcauuaagguccugaaacuguacgcuugggagcucgccuucaaggacaaagugcuggccauccggcaggaggagcuuaagguucugaagaaaagcgcuuaucucucugccgugggcacguuuacaugggucuguaccccuuuccugguggcucugugcaccuuugccguuuacgugacaaucgaugagaacaauauucuugacgcgcagaccgccuucgucucccucgcucuguuuaacauccugagauucccccucaauauucugccuauggugaucagcuccauuguucaagccucugugagccuuaagcgccugcggaucuuucucucccacgaggaacuggaacccgauucuauugagagacgcccggucaaagacgggggaggcacaaacagcaucacggugcggaaugcuaccuucacaugggccagauccgauccucccacccugaacgggaucacauuuagcauuccugaaggagcgcuuguggccgucguuggccagguggggugcggaaagucuucccuccugagcgcucugcucgccgagauggacaaaguggagggccacgucgcuaucaagggcucuguggccuauguuccccagcaggccuggauucaaaaugacucccugcgcgaaaacauccuuuucgggugucagcuggaggaaccuuacuaucggagcgugauucaggcuugcgcgcuccugcccgaucuggagauccuuccgucuggagacagaaccgaaaucggcgagaagggggucaaucugagcggaggccagaaacaacgcgugucccucgcccgggcuguuuacagcaacgccgauauuuaucuguucgacgauccucucucugccguggacgcucaugucgggaagcacaucuuugagaaugugauuggccccaaaggaaugcugaagaacaaaacgagaauccuuguuacccauuccaugagcuaccugccccagguggaugucauuaucgugauguccggcgggaagaucucugaaaugggaagcuaccaggagcuccuggcccgcgacggcgcguucgcugaauuucugcggacauaugccuccaccgagcaggagcaagaugccgaagagaauggggugacaggagucucuggcccugggaaagaagcuaagcagauggagaacggcaugcuuguuaccgacagcgccggaaagcagcugcaaagacagcucuccucuagcuccagcuacucuggcgauauuucccggcaccacaacagcacggcggaacugcagaaagcugaggccaagaaagaggaaacauggaagcucauggaggccgacaaagcucagaccgggcaagugaagcugucuguguauugggauuacaugaaggccaucggacuuuucauuuccuuucugagcaucuuccucuuuauguguaaucaugucucugcucuggccuccaacuauuggcugagccuuuggacagacgacccgauugugaauggcacccaggaacacaccaaaguucgccuguccguguacggggcgcucggaaucagccagggcaucgccgucuucggguauucuauggcugugagcauuggcggaauccuggccuccagaugccuccauguugaucugcuucacucuauucugcggagccccauguccuuuuucgagagaacaccuucuggcaaccuggugaaucgcuuuagcaaggaacucgacacggucgauuccaugauccccgaggugauuaaaauguucauggggucucuguucaacgucaucggagcuuguauugugauccuucuggccaccccuaucgccgcuauuaucauucccccucucggccugaucuacuuuuucguucagcgguuuuacguggcgagcuccagacaacucaagcgccuggagagcgucucuagaucccccguguauagccauuucaaugaaacacuucuggggguuucugugauucgggccuuugaggaacaggagcgcuucauccaccaguccgaccugaaagucgaugaaaaccagaaggcuuacuauccgagcaucguggccaauagauggcucgccgugcggcuggagugcguuggaaacuguauuguccuuuuugcugcccuguucgcggugaucucccgccacucucucagcgcuggccugguggggcucuccgucagcuacucucugcaagugaccacauaucuuaauuggcugguuagaauguccagcgagauggaaaccaacauuguggccgucgagcggcugaaggaauacucugagacggagaaagaagccccuuggcagauccaggagacagcucccccuagcuccuggccccaagugggccgcguugaauuuagaaauuauugccuccgguaccgcgaggaccuggauuucgugcuuagacauauuaacgucaccaucaauggaggcgaaaagguggggaucguuggacggaccggcgccgggaaaucuagccugacacucggacuguuuagaauuaacgaguccgcggagggcgaaaucauuaucgacggcauuaacaucgcuaagauugggcuccacgaucugcgcuucaaaaucaccaucauuccgcaggacccugugcuguuuucuggaagccuucggaugaaucuggaucccuucucccaguacagcgacgaggaagucuggacaucucucgagcuggcccaucuuaaggauuucguguccgcccugccugacaagcucgaccacgaaugugcugagggcggggagaaccugagcgugggacagagacaacuggucugccucgcccgcgcgcuucugcggaaaacgaagauccugguucucgaugaagccaccgcggccguggaccuggagacagaugaccuuauucaguccaccaucagaacacaguuugaagauuguaccgugcugacgauugcucaccgccucaauaccaucauggacuauacacgggucaucgugcuggauaaaggcgagauucaggaauacggggcccccucugaccugcuccaacagagaggacuuuucuauagcauggcuaaggaugccggccugguuuga

SEQ ID NO: 65339 - RNA, 4638 nt, Artificial Sequence
  derived and/or modified sequence opt5 from ABCC2__Homo_sapiens__NP_000383
augcuggagaaguucugcaacagcaccuuuuggaauagcucuuuccucgacagccccgaagccgaucugccucuuuguuuugagcagacagugcuggucuggaucccgcucggcuuccuguggcuucuggcucccuggcaacuccugcacguuuacaaauccagaacgaagcggucuagcaccacaaaacuguaucucgccaaacagguguuugugggguuccugcuuauucuggcggcuaucgaacucgcccugguccuuaccgaggacuccggacaggccacagugccugcuguucgcuacaccaaccccucucuguaucucggcacauggcugcuggugcuccugauucaguacagcagacaauggugcguccagaaaaauuccugguuucuuagccuguucuggauccucucuauucugugugggaccuuucaguuccagacgcuuauccggacccugcuccaaggagauaacuccaaucuggccuauagcugccuguuuuucaucucuuacggcuuucagauucucauccugauuuucuccgcuuucagcgaaaacaaugagucuuccaacaauccuagcuccaucgccucuuuucuuagcuccauuacauauagcugguacgacucuaucauucugaagggguacaagcgcccccucacccuggaggaugugugggaaguugacgaggaaaugaaaacaaagacccuuguguccaaauucgagacgcauaugaagagagagcugcagaaagcgcggcgcgcccuccagagacggcaagaaaagagcucucagcagaacagcggagcucgccugccuggccugaauaagaaccaaucccagucucaggaugcccucguccuggaggacguggaaaagaagaaaaagaaaagcggcacaaagaaagaugugccgaaguccuggcuuaugaaggcucuguuuaaaaccuucuauaugguccuccugaaguccuuucugcuuaaacucguuaaugacaucuucacauuugugucuccccagcugcugaagcuccugaucuccuucgccagcgauagagacaccuaccuuuggauuggguaucugugugcgauccuccuguuuaccgccgcucugauucaaucuuucugccuucaguguuacuuucagcucugcuucaaacugggagugaagguccggacagccaucauggcuuccguguauaagaaagcccugacgcucagcaaccuggcccgcaaggaguacaccguuggcgaaacagugaaucuuauguccgucgaugcucagaaacugauggacgugaccaacuuuaugcacaugcucuggucuagcguucugcaaauugugcuguccaucuucuuccuuuggagagagcucgggccuucuguccuggcgggagugggcgucauggugcugguuauccccauuaacgccauccucagcacaaaguccaaaaccauucaggugaagaauaugaagaacaaagacaagcggcugaaaaucaugaaugagauucuuagcgggaucaagauccugaaauauuuugcuugggaaccuucuuuccgcgaucagguccagaaccucagaaagaaggagcugaaaaaucugcuugccuuuucccaacuccagugugugguuauuuucguguuucagcugacgcccguccuggugagcgugguuacauucucugucuacgugcucguggacuccaacaauauccuggaugcccagaaggcuuuuaccagcauuacccuuuucaacauccugcgguuuccgcucucuaugcugccuaugaugauuagcuccaugcugcaagccagcgucucuacagaaagacuugagaaauaccugggaggcgacgaucucgacaccuccgcgauccgccaugauugcaauuucgacaaggcuaugcaguuuagcgaagccuccuucacaugggagcacgauucugaggccacggugcgggacguuaaccuggauauuauggcuggccagcucguggccgucaucgggcccgugggaagcggcaaauccucucugaucagcgcuaugcuuggggaaauggagaauguucauggacacauuaccaucaagggcacaaccgccuaugugccucaacaguccuggauucagaacgggacaaucaaagacaauauucuguuuggaaccgaguucaacgaaaagagauaccagcaaguccucgaagcgugugcccugcugcccgaccuugagaugcugcccggcggcgaucucgcugagaucggggaaaagggaaucaaucugucuggcgggcagaaacagcgcauuagccucgcccgggcuacguaucagaaccuggacaucuaccuucuggaugacccucucuccgccguggaugcgcacguuggaaagcauauuuucaacaaagugcugggcccgaaugggcugcuuaagggcaaaaccagacugcucgucacacacagcaugcauuuucugccccaaguggacgagaucgugguccucggaaacggcaccauuguugaaaaggggucuuauuccgcccugcuugcuaagaaaggagaguucgccaagaaucugaaaacauuucugcgccacaccggcccugaggaagaggcuacggugcacgaugggagcgaagaggaagacgaugacuacggacucaucucuuccguggaggagauccccgaagaugccgccagcauuacaaugcggagagagaacucuuuccgccggacccuguccagaagcucccgcagcaauggccggcaucuuaagucucugagaaacagccucaaaacacggaaugucaacucccugaaggaagacgaggaacucgugaaggggcagaaacugaucaagaaagaguuuauugagaccggcaagguuaaauucucuaucuaucuugaauaccugcaggcuauuggacuguuuagcaucuucuuuaucauucucgcguucgugaugaacuccgucgccuuuaucggcucuaaucuguggcuuagcgcuuggaccuccgauucuaagauuuucaauagcacagacuacccugccucccagcgcgacaugagaguggggguuuauggagcccugggccucgcucaagggaucuucguguuuauugcccacuucuggagcgcguuuggauucguccaugcuucuaacauccugcacaagcagcuccugaauaacauucuucgggcccccaugagauuuuucgauacgaccccgacaggccgcaucgugaaucgguuugccggggacaucuccaccguugaugacacacugccucagagccugagaucuuggauuaccugcuuccucggcaucauuuccacgcuggugaugaucugcauggcuacacccgucuuuaccauuaucgugaucccucuuggaauuaucuacgugagcguccaaauguucuauguuuccaccucucgccagcugagacggcucgauagcgugacacgcucccccauuuacagccauuuuucugagaccguguccggccugccugucaucagagccuucgaacaccagcagcgguuucucaaacacaacgaggugcgcauugacacaaaccaaaaguguguuuucagcuggaucacgucuaauagauggcuggcgauccggcuugaacugguggggaaccugaccgucuucuuuagcgcucucaugauggugauuuaucgcgauacacuguccggagacaccguuggcuucgugcuuucuaaugcccugaacaucacacagacccucaauuggcuggucagaaugacgagcgagauugagaccaacaucguggccgucgaacggauuacagaguacaccaaaguggaaaaugaggcucccuggguuacagauaagcgcccgccucccgacuggcccuccaaagggaagauccaguuuaacaauuaucaggugagauaccggccugagcuggaucucguccuuagaggaauuaccugcgacaucggcucuauggagaaaaucggggugguuggccgcacaggagccggcaagagcucccugaccaacugucuguuccggauucucgaagcugccgggggacaaaucauuaucgauggcguggacauugcgagcaucgggcugcaugaccuuagagaaaagcugacgaucauuccgcaggaucccauccucuuuucuggaucccugcgcaugaaucuggacccuuucaacaauuacagcgaugaggaaauuuggaaagcccucgagcuugcucaccugaaguccuuugucgccucucugcagcucggccugagccaugaggugacagaagcuggcgggaaccuuuccaucggacagcggcaacugcucugccugggcagagcccugcuccgcaaaucuaagauucuugugcuggacgaggccaccgcugcgguugaucuggaaaccgacaaucucauccagacaaccauccagaacgaguucgcccacuguacggucauuacaaucgcucaccggcugcauaccauuauggauagcgacaaagugauggugcuugauaacgggaagaucauugaaugcggaucccccgaggagcugcuccagaucccuggccccuuuuauuucauggccaaggaagccgggauugagaaugucaacagcacaaaauuuuga

SEQ ID NO: 65340 - RNA, 1719 nt, Artificial Sequence
  derived and/or modified sequence opt5 from ABCC3__Homo_sapiens__NP_001137542
auggacgcccugugcggcagcggggagcucggauccaaguucugggauucuaaccugagcgugcacaccgaaaaucccgaccuuacaccuuguuuucagaacucccugcucgcuugggucccgugcaucuaccuguggguugcccuucccuguuaucugcucuaccugagacaucacugccggggcuauauuauccugucucaucucagcaaacugaagauggugcuuggggugcugcucuggugugucuccugggcggaucuguucuacucuuuucacggacuugugcauggccgcgcuccugcccccguuuucuuugugacgccucuggucguggggguuaccaugcuccuggccacacugcucauucaauaugagagacugcagggagugcagagcuccggcguccuuaucauuuucugguuucugugcguggugugugcuaucguccccuuccggagcaaaauccuccuggccaaggcugaaggcgagauuucugacccuuuucgcuucaccacauuuuacauccacuucgcccuuguucuguccgcgcucauucuggccugcuuuagagaaaaaccgcccuucuucagcgcuaagaauguggauccuaaccccuauccugagaccucugccggguuucugucccgccucuucuuuuggugguucacaaagauggcuaucuacggauaccggcacccccuggaggaaaaagaccuuuggagccugaaggaggaagauagaucucagauggugguccaacagcuccuggaggccuggcggaaacaggagaagcagaccgcgcgccauaaagccuccgcugccccgggcaagaaugcuagcggggaagacgaggugcuucugggagccagaccucggccccgcaagccuuccuuucucaaagcccugcuggcuacguucggcucuagcuuucucauuuccgcguguuucaagcugauccaagaucuucugagcuuuauuaacccccagcuccugucuauccugaucagauucauuuccaaucccauggccccuagcugguggggguuucuuguugcuggacucauguuccugugcucuaugaugcagagccugauccuccagcacuauuaccauuauauuuuugugaccggcgucaaauuccggacaggcaucaugggggugauuuaccgcaaggcccugguuaucaccaacuccgugaaaagagccucuacagucggagaaaucgugaaucuuaugagcgucgacgcucaacgguucauggaucuggccccguuucucaaccugcugugguccgcgccccuucagauuauccucgcuauuuauuuccuguggcagaaucugggcccuagcgugcucgccgggguugccuuuauggugcugcuuaucccccugaacggagcugucgccgugaagaugagagcuuuccaaguuaaacagaugaagcucaaggacucucgcauuaaacugauguccgagauccugaauggcaucaaggugcuuaaacucuacgccugggaaccuagcuuucugaagcaggucgaggggauucggcagggagagcugcaacuccugagaaccgcggccuaucuucacacgacaaccacauucaccuggauguguucucccuuucuggugcgccucggcaccggccuggggccgugccugcagggauccggcugcccugggauggcucgggcccacuggacacuucccuga

SEQ ID NO: 65341 - RNA, 2580 nt, Artificial Sequence
  derived and/or modified sequence opt5 from ABCC4__Homo_sapiens__NP_001098985
augcugcccguguaccaggaggucaagccuaacccgcuccaagacgccaaucugugcagcagaguuuucuuuugguggcuuaacccccuguucaaaaucggccacaagcggcgccucgaagaggaugacauguauuccgugcugccugaagauagaucucagcaucuuggggaggaacugcagggauuuugggacaaagaggugcuccgggcugagaaugaugcccagaagcccagccugacccgcgcgauuaucaaauguuacuggaaguccuaucugguccucggcauuuucacacugaucgaagagucugcuaaggugauucaaccuaucuuucuugggaaaaucauuaacuacuucgaaaauuaugaccccauggauagcguugcccugaacacggccuacgcuuaugccaccgugcucacauuuugcacccugauccuugcuauucugcaccaucucuacuucuaccacguccagugugccggaaugagacugcggguggcgaugugccauaugaucuaucgcaaggcccugagacucuccaauauggcuaugggcaaaacaaccacagggcagauuguuaaccugcuuucuaaugacgugaacaaguuugaucaggucaccguguuccugcacuuucucugggccggaccucugcaagcuaucgccgugacggcgcuucuguggauggagauuggcaucagcugucucgccggcauggcuguccugaucauucugcucccgcugcaguccugcuucgggaaacuuuuuagcucucugcgguccaagaccgccacauucaccgacgcucgcaucagaacaaugaaugagguuauuaccggaauccggauuaucaagauguacgccugggaaaaaucuuucagcaaccucaucacgaaucugcgcaagaaagagauuuccaagauccuuagaagcucuugucugcggggcaugaaccucgccuccuuuuucagcgcuuccaaaauuaucguguuugugacauucaccacauauguccugcuggggucugugauuaccgcgagccgcguuuuuguggccgucacccucuacggagcugugagacugacaguuacgcuuuucuuucccuccgccaucgaacgggugagcgaggccaucgucucuauuagacgcauccagaccuuccugcuccuggaugaaauuucccagcggaauagacaacugccuagcgacggcaagaaaauggugcacguccaggauuuuacagcuuucugggacaaggccucugagacccccacacuucaggggcucagcuuuaccgugcgcccuggagagcugcuggcgguugugggccccgucggcgcugggaaguccucucuccugagcgccgugcuuggagaacuggccccgucccauggccucguuagcgugcacgggcggaucgcuuaugucucucaacagccuuggguguucuccggaacgcugagaagcaacauucuguuuggcaaaaaguacgagaaagaacgcuaugagaaggugaucaaagccugcgcucuuaagaaggaccuccagcugcuggaagauggggaccucacaguuauuggagaucggggcaccacccugucuggcgggcagaaagccagagucaaccuugcgcgcgccguguaccaagacgcugauaucuaccugcucgacgauccccuguccgccguggacgcugaggucagccggcaucuguucgagcuuuguaucugccagauucuccacgaaaagaucacaauucuggugacccaccagcugcaguaucucaaagccgcgucccaaauccugauucuuaaggauggaaaaaugguucagaagggcacauacacggaguuccugaagucugggaucgacuuuggaagccuccugaaaaaggauaaugaagaguccgaacagccucccgugcccggcaccccuacacugagaaaccgcaccuucucugagagcuccgucuggagccagcaaucuucccggccgagccuuaaagacggggcccucgagucucaggacacagaaaaugugcccguuacccuguccgaggaaaacagaagcgagggcaaggugggauuucaggcuuauaaaaauuacuuccgggccggcgcucauuggaucgucuuuauuuuccugauccuccugaacacggccgcccagguggcuuauguucuucaagauugguggcugucuuacugggcgaauaagcagagcaugcucaacgugaccgucaaugggggaggcaacgugacagagaagcuggaccugaauugguaucuugggauuuacuccggacugaccguggccacaguccucuuuggcaucgcucgcagccugcucguuuucuacgugcuggugaacucuucccagacccuucacaauaaaauguuugaaagcauucugaaggccccuguccucuucuuugauagaaaccccaucgggcggauccugaauagauucuccaaagacauuggccaucuggaugaccuucugccucucacguuucuggauuucauccaacgcugggaccucgccgugcugucuuggcuuguuagcaacuccuga

SEQ ID NO: 65342 - RNA, 627 nt, Artificial Sequence
  derived and/or modified sequence opt5 from ABCC5__Homo_sapiens__NP_001018881
augaaggacaucgauauuggcaaagaguacaucauucccagcccuggguauagauccgugcgggaacgcaccucuacaagcggaacgcacagagaccgggaggauuccaaguuccgcagaacccggccgcuggaaugccaggacgcccucgagacagcugcccgcgcggaaggccugucucuugaugcuagcaugcauucccaacugagaauccucgacgaggagcaccccaaagggaaguaccaucacggacugucugcccuuaaaccuauucggaccacaagcaagcaucagcaccccgucgauaacgccggccuguuuuccuguaugaccuucagcuggcucucuucccuggcucgcguugcccacaagaaaggggaacugagcauggaggacguguggucucucuccaagcaugaaagcucugaugugaauugcagacggcuggagcgccuuuggcaggaggaacugaacgaggucggaccugacgcugccucccucagacgggugguuuggaucuuuugucgcacaagacugauccuuagcauugugugccugaugaucacccagcucgcgggcuucuccggccccaauuuucaagauggguguauucugcggucugaauga

SEQ ID NO: 65343 - RNA, 300 nt, Artificial Sequence
  derived and/or modified sequence opt5 from ABCC6__Homo_sapiens__NP_001072996
auggccgcucccgccgagccuugcgcgggccaggggguguggaaccaaaccgaaccggagcccgcugccacaagccugcucucccuguguuuccuuagaacggccggagucuggguuccucccauguaccugugggugcucggcccuaucuaucugcuuuuuauucaccaucacgggcggggauaccugcgcaugucuccccucuucaaggcuaaaaugguggccgcuaucccuggcagccuggaaccggggaaugucagaggacggcagggcaccggcuggaaccuggugaaguccuga

SEQ ID NO: 65344 - RNA, 4746 nt, Artificial Sequence
  derived and/or modified sequence opt5 from ABCC8__Homo_sapiens__NP_000343
augccccuggccuucugcggcagcgagaaccacuccgcugccuacagaguggaccaggggguccucaauaacggauguuuuguugaugcgcugaauguggugccucaugucuuccuucuguuuaucaccuucccgauucucuuuaucggcugggggucucaaagcuccaaggugcacauucaucacucuacauggcugcauuuccccggacacaaccuucgguggauccugacguuuaugcuccuguucguucuggugugcgaaauugcugagggcauccucagcgacggggucaccgaaucccaccaucugcaccuuuauaugccugccggaauggccuuuauggcugccgugacaucuguuguguacuaucauaauaucgagaccagcaacuuccccaaacugcucauugcucugcuugucuacuggacacuggccuuuaucaccaagacaauuaaauucgugaaguuucucgaucacgcgaucggcuucucccagcugcgcuucugucugaccggccuccuggugauucuuuaugggaugcugcuccuggucgaaguuaaugugaucagagugcggcgcuacauuuucuucaaaacgccuagagaggucaagcccccugaggaccuucaggaucugggagugcgguuucuccagccguucguuaaccugcugagcaagggcaccuauugguggaugaaugccuuuaucaaaacagcucacaagaaacccaucgaccuccgcgccauugggaagcugccuaucgcuaugagagcccuuaccaacuaccaacggcugugcgaagcguucgaugcccaggugcgcaaagacauucagggaacacagggcgcuagagccaucuggcaagcucucucucaugccuuugggcggcgccugguccuuuccagcaccuuccggauucuggccgaucuccugggauuugcuggcccccuguguaucuucggcaucguggaccaccucgggaaggagaaugauguuuuucagccuaagacgcaguuccugggaguguacuuugucucuucccaggaauuucuugcgaacgccuaugugcuggcuguccuccuguuccuggcccuucuccugcaaagaacauuucugcaggccagcuacuauguggcuauugagaccggcaucaaucuccgcggggccauucagacaaaaaucuacaacaagauuaugcaucugucuaccuccaaucuuagcaugggagagaugaccgcgggccaaaucugcaaccugguugcuaucgacacaaaccagcucaugugguucuuuuuccugugucccaaucugugggccaugccggugcagauuaucgucggggugauucuucucuauuacauccugggaguuuccgcccugauuggcgcugccgugaucauucuccuggcuccuguccaguauuuuguggccacgaaacuuucucaagcgcagagaagcacccuggaauacuccaacgagcggcucaagcagacaaaugaaaugcugagaggcaucaaacugcuuaagcucuacgccugggagaacaucuuccgcacccggguggaaacaaccagacgcaaagagaugacgagccugcgggcuuuugccauuuauacaucuaucuccauuuucaugaauaccgcuauccccauugccgcgguucugaucaccuuugucgggcacgugagcuucuuuaaggaggccgauuucucuccuagcguggcuuuugccucccucucucuguuccauauccuugucacaccccuguuccuccugagcuccgugguuagaagcaccgugaaggcucuggucucugugcagaaacuuuccgaauuucucagcucugccgagauucgcgaggaacaaugcgcuccccacgaaccuacaccgcagggacccgcuuccaaguaccaggcgguuccucugcggguggucaacagaaaacgccccgcccgggaggacuguagaggccugacggggccucuccagagccuggugcccuccgcugacggagaugccgacaauugcuguguucaaaucaugggcggguauuucaccuggacaccggauggcauuccuacccuuucuaacaucacaauucgcaucccccggggacagcugaccaugaucgugggccaggucgggugcggaaagagcucccuccugcuggccgcucuuggcgagaugcagaaagugucuggggccguguuuuggagcucccugccugacagcgaaauuggagaggaucccucuccugaaagagagacggcgaccgaccucgauauccggaagcgcggccccgucgcuuacgccucccaaaagccguggcugcucaaugccacaguugaagagaacauuaucuucgagagcccuuuuaauaaacagagauauaagauggugauugaagccugcucucugcagcccgacaucgauauccuuccccacggggaccaaacccagauuggcgagcggggaaucaaccuguccggcgggcagagacagcgcauuagcguggcccgggcgcucuaccaacaugcuaaugucguguuccuggaugacccuuuuucugcccuggacauccaccuuagcgaucaucugaugcaggccggcauucucgaacugcucagagacgauaaacgcacaguugugcuggucacccacaaacuucaguaucugccgcacgcugacuggaucauugccaugaaggauggaacgauccagagagaggggacacucaaggacuuccaacgguccgagugucagcuguuugaacauuggaagacccugaugaaccgccaggaucaggagcuugaaaaagagacagugaccgaaagaaaggcuaccgagcccccucaaggacugagccgggccaugucuucccgcgacggccuccugcaggaugaggaagaggaagaggaagaggcggccgagagcgaagaggacgauaaucucuccucuaugcugcaccagagagcugaaauccccuggcgggccugcgcuaaauaccuuagcuccgccgggauucugcugcucucucugcuuguuuucagccaacugcucaagcauauggugcuggucgccaucgacuacuggcucgcuaaauggacagauuccgcgcugacgcuuaccccugccgcucgcaacuguucucugagccaggagugcacacuggaccagaccguguaugccaugguuuuuacagugcucuguucccugggcauuguccuuugccuggugaccagcgugacggucgaauggacaggacucaagguugccaagagacugcaccggucucuccugaaccgcaucauucuugcucccaugagauucuucgagaccaccccucugggcuccauccugaaucgguuuagcucugacuguaacacaaucgaucagcauauucccuccacccucgagugccugagcagaucuacacuucuguguguguccgcccucgcggugaucagcuacgucacgccgguguuccugguugcucuccugccucuugccauugugugcuauuuuauccaaaaauacuuccgcgucgccucccgggaccugcagcagcuggaugacaccacacagcucccccugcuuagccacuuugcugaaaccguggaggggcugacaaccauuagagccuuccgcuaugaagcgcgguuucaacagaagcuccuggaguacacggauucuaauaacaucgcuagccuguuccucaccgccgccaauagauggcuugagguucgcauggaauauaucggagcuugugugguccugauugccgcugugacauccaucucuaacagccugcaccgggagcucuccgccggccuggucgggcuuggacugaccuacgcgcucauggugucuaauuaccugaacuggaugguuagaaaucuggccgacauggaacuccagcuuggcgcugugaaacgcauucaugggcugcugaagacagaggccgaaagcuaugagggccuccuggcuccuucccuuauccccaaaaacuggccggaucagggaaagauucaaauccagaaucugucuguccgguacgacagcucccucaaaccugugcugaagcacguuaacgcccugauugcccccggccagaagaucgggaucugcggaagaaccggcagcgggaaaucuuccuuuagccucgcuuucuuucggaugguggauacauucgagggacauauuaucauugacggcaucgauauugcgaaacuuccucugcacacccugcgcucuagacucuccaucauccugcaggaccccguccuuuuuagcggcacgauucgguucaaucuggaucccgaacgcaagugcuccgacucuacacucugggaggcccuggaaaucgcucaacugaagcucguggugaaagcccuuccugggggacuggacgccauuaucaccgagggcggggaaaacuucagccagggacagagacaacuguuuugucucgcucgggccuucguuagaaagaccuccauuuuuaucauggaugaggcgacagcuagcaucgacauggccaccgagaauauucugcagaaggucgugaugacggccuucgcugaucgcacaguggucaccaucgcccaucgggugcacacaauucuuucugcggaccugguuaucgugcucaaaagaggcgccauucuggaauuugauaagccggagaaacugcucucccgcaaggacagcgucuucgcuucuuuugugcgggccgauaaauga

SEQ ID NO: 65345 - RNA, 4650 nt, Artificial Sequence
  derived and/or modified sequence opt5 from ABCC9__Homo_sapiens__NP_005682
augagccuguccuucugcggcaacaauaucucuagcuacaacauuaaugacggggugcuccagaacuccuguuuugucgaugcccugaaucuuguuccccacguguuccugcucuuuaucaccuucccuauucuguuuaucggauggggcucucaaagcuccaaggugcagauucaucacaacacauggcuucauuucccggggcacaaucugagauggauccucacguuugcucugcuguucguccaugugugcgagaucgccgaaggaauuguuucugacagccggcgcgaguccagacaccuccaccuguuuaugcccgcggugaugggcuucgucgcuaccacaaccagcaucguguauuaccauaacauugaaacaucuaauuuuccuaaacuucugcucgcccuguuccuuuauuggguuauggccuuuaucaccaagacaauuaaacuggugaaguacugucaguccgggcucgauaucagcaaccugcgguucugcauuaccggaaugauggucauccugaauggccuccugauggcuguggagaucaacgugauucgcgucagacgguauguuuucuuuaugaauccccagaaagugaagccucccgaagaccuucaagaucugggcgugcgcuuccuccagccuuuugucaaccugcuuucuaaggccacguacugguggaugaauacccugaucauuuccgcucacaaaaagccgaucgaccucaaagccauugggaagcugcccaucgcgaugagagccgugacaaacuauguuugucugaaagaugcuuacgaggagcagaagaagaaaguggccgaccauccuaaccggacccccagcaucuggcucgcuauguaccgcgccuucggaagaccuauucugcuuucuuccacauuucgguaucuggcggaucuccugggcuucgccgggccccuuugcaucagcggaauuguccagcgcgugaaugaaacccaaaacggcacgaauaacacaaccgggaucuccgagacacugucuagcaaggaauuucucgagaaugcuuacguucuggccgugcuucucuuccuggcucuuauucugcagagaaccuuucuccaggccuccuauuacgucaccaucgagacaggaaucaaccugcggggcgcccugcuugcuaugauuuauaauaaaauccuccgccugagcacgucuaaccuguccaugggcgaaaugacccucgggcagauuaauaaccugguggcgaucgagacaaaucaacuuaugugguuccuguuucucuguccgaaccugugggccaugccuguccagauuaucaugggagugauucugcuuuacaaucuccugggcagcucugcucugguuggggccgccgugaucguccuccuggcucccauccaguauuucauugccaccaagcuggcggaagcucaaaagagcacacuggacuacuccaccgagagacucaagaaaacgaacgaaauccugaagggaauuaagcugcuuaaacucuacgccugggagcacaucuuuugcaagucuguggaggaaacacggaugaaagagcugagcucccugaagaccuucgcccucuauaccagccugucuauuuucaugaaugcugccaucccuaucgcugccguucuugcgacauuugugacccacgccuacgcuuccggcaacaaccugaaacccgccgaagccuucgcuagccucucucuguuucauauucuggucacaccccuuuuccuccuguccacgguggugagauuugcgguuaaggccaucauuagcguccagaagcugaaugaguuccuccuguccgaugaaaucggggacgauucuuggcgcaccggagagagcucccuuccuuuugagucuuguaaaaagcacacaggcgugcagccgaaaaccauuaaccggaagcagcccggcagauaucaucuggacagcuacgaacaauccacacgccggcucagaccugcugagaccgaagacaucgccaucaaagugacgaauggguauuucagcuggggaucuggccuggcuacccuguccaacauugauauccgcauucccacagggcagcuuaccaugaucgucggacaggugggcugcgggaaaagcucucugcuccuggccauucucggcgagaugcagacacuggaaggaaagguucacugguccaaugugaacgagagcgagccuucuuuugaagccacccggagcagaaaucgcuacuccgucgcuuaugcggcccaaaaacccuggcuucugaacgcuacgguggaggaaaauaucacauucggcagcccguuuaacaagcagcgguacaaagccguuaccgacgccuguucucuccagccugauaucgaccugcugcccuucggggaucagacagagauuggagagagaggcaucaaucuuuccgggggacaacgccagcggauuugcguggcuagagcccuguaccagaacaccaauaucgucuuucucgacgauccuuucagcgcgcuggacauucaucucuccgaucaccugaugcaggaaggcauccuuaaguuccugcaagacgauaaacggacccucgugcugguuacacacaagcugcaguaucuuacgcaugcugacuggauuaucgccaugaaggacgggucugugcugcgcgagggcacccucaaagauauccagacaaaggacgucgaacuguacgagcacuggaaaacccucaugaacagacaagaucaggaacuggagaaggacauggaggccgaucagacaacccuugaacggaaaacgcugagacgcgcuauguauagccgggaggccaaggcgcagauggaagacgaggaugaagaggaggaagaggaagaggacgaagaugacaauauguccacagugaugagacugcgcaccaaaaugcccuggaagaccugcuggagauaccucacaucuggaggcuuuuuccugcuuauucugaugaucuuuagcaagcuccugaaacauuccgugauugucgcuaucgauuauuggcucgccaccuggacaucugaguacagcauuaacaacacggggaaggccgaccaaaccuauuacguugcuggauucuccauccuguguggcgccgggaucuuucuuugccuggugacaagccugaccguggaguggaugggacucacagcugccaaaaaucugcaccacaaccuucugaauaagauuauccucggcccuauucgguucuuugauaccacgccccuggggcucauccugaaccgcuucucugcggacaccaauauuaucgaccagcauaucccgccuacacuugaaucccugaccagaagcacacugcucugucugucugccauuggcaugaucuccuacgcuacccccgucuuucuuguggcccugcucccccugggaguugcuuucuauuuuauucagaaauacuuccggguggccagcaaggaucuccaggagcuggacgauucuacacaacuuccucugcugugccacuucuccgaaaccgccgagggccucacgacaauccgcgcuuuuagacaugagacccgguucaagcagcgcaugcuggaacuuaccgacacaaacaauauugcguaucuguuucucagcgccgcuaacagauggcuggagguccggaccgauuaccugggggccuguaucgugcucacggccuccauugcuagcaucucuggaagcuccaauucuggccuuguugggcugggacugcucuaugcccugacaaucaccaacuaccuuaauugggugguccgcaaccuggcggaccucgaagugcagaugggcgcuguuaaaaaggugaauagcuuccugacaauggaguccgaaaacuaugaggggaccauggauccgucucagguccccgagcacuggccucaagaaggcgagauuaaaauccaugaccugugcgugagauacgaaaauaaccucaagcccgugcuuaaacacgucaaggccuacauuaagccuggacagaaaguuggcaucugugggcggacaggaagcggcaaguccucucugagccuggccuuuuucagaaugguggauauuuuugacgggaaaaucgugaucgauggaauugacaucuccaagcucccccugcacacccuucgcagccggcugucuauuauccuccaggauccuauucuguucuccggcagcaucagauuuaaccuggaccccgagugcaaauguacggacgaucgccucugggaagcucuugagaucgcccaacugaagaauauggucaagucucugccgggcgggcucgacgcggugguuaccgagggaggcgaaaacuucuccguggggcagcggcagcuguuuugccuugcuagagccuucguccgcaaaagcuccauucugaucauggaugaggccacagcuucuauugacauggccaccgaaaauauccuccagaaggugguuaugacagcuuuugccgaucggaccguggucacgauugcgcauagagugagcuccaucauggacgccggacugguccugguguucagcgagggcauucucguugaaugugauacagugccuaaccuucuggcucacaaaaaugggcuguucucuacccucgucaugacaaacaaguga

SEQ ID NO: 65346 - RNA, 2238 nt, Artificial Sequence
  derived and/or modified sequence opt5 from ABCD1__Homo_sapiens__NP_000024
augcccgugcugagcagaccucggccguggcgcggcaacacccucaagagaacagccguccugcuugcucuggccgcguacggggcucacaaaguuuauccccucgugcggcagugccuggccccugcccgcggacuucaagcucccgccggcgagccuacgcaggaggcuuccgggguggccgcggccaaggcuggaaugaauagagucuuccugcagcggcuccuguggcugcuccgccugcuuuuucccagagugcugugucgggagaccggccuccuggcccuucauucugcugcccugguuagccgcacauuccucuccguguacgucgcgagacuggacgggcggcuggcccgcugcaucgugagaaaagauccucgggcuuuuggauggcagcuccugcaauggcuucugauugcccucccggcuaccuucguuaacucugccauccgcuaucuggaaggccagcuugcccugagcuuuagaucccggcucguggcucacgcguacagacuguauuucucucagcagacauacuaucgcgucagcaauauggacggccggcugagaaaccccgaucaaucccucaccgaggacgugguggccuuugcugccagcgucgcccaucuguacucuaaucuuacaaagccucugcucgauguugcugugaccuccuacacgcugcuucgcgccgcgcggagcagaggggcuggaaccgccuggcccucugccauugcuggccugguggucuuccucacagccaacgugcugcgcgcuuuuuccccuaaauucggggaacugguugccgaggaggcgcggagaaagggagaacuccgcuauaugcacagccggguggucgccaauucugaggaaaucgcuuuuuacggcgggcaugagguggagcuggcccuucugcagagauccuaucaggaccucgcuagccagauuaaccugauccugcuugaacgccucugguacguuaugcuggagcaauuccugaugaaguaugugugguccgccucuggacuccugauggucgcggugcccaucauuaccgccacaggcuacagcgaauccgaugcugaggccgucaaaaaggcugcccuugaaaagaaggaggaggaacuggugagcgagcggaccgaagccuuuacgaucgcuagaaaucuccugacagcggccgcugacgccauugagcggaucaugucuuccuauaaagaaguuaccgagcuggccggcuacacagcucgcgugcacgagauguuccaggucuucgaagaugugcagagaugucacuuuaagcggccgagagagcuugaagacgcccaagcggggagcggaaccauuggccgcucugggguucggguggagggaccucucaagaucagaggccaggucguggauguggaacaggggauuaucugcgagaacauccccauuguuaccccuagcggagaggucgugguggcuucccugaauauccgcgucgaagagggcaugcaucugcucauuacaggccccaacggguguggaaaaucuagccuguucagaauccuuggcgggcuguggcccacguacggaggcgugcucuauaagccuccgccccagcggauguuuuacauuccucaacgccccuauauguccguugggagccugagagaccaggugaucuacccugauucugucgaagacaugcagcggaaaggcuauuccgagcaggaccuggaggccauccuugaugugguucaccuccaucacauucugcaacgcgaaggaggcugggaggccaugugcgacuggaaggaugugcugagcgggggagaaaaacagagaaucggcauggcucggauguucuaccaccgccccaaguaugcccuccuggacgaguguaccucugcggucuccauugauguggaagggaaaaucuuucaggcugccaaggacgccggaauugcccuucugagcaucacacauagaccgucccucuggaaguaccacacccaucugcugcaguucgauggcgaagggggcuggaaauuugagaaacuugacucugcugcucggcucagccugacagaagagaaacaacgccuggaacagcagcucgccggaaucccuaagaugcagagacggcugcaagagcuuugccagauucugggcgaagcgguugcccccgcucacgugccugcccccuccccucaggggcccggaggccuccaaggggcuucuaccuga

SEQ ID NO: 65347 - RNA, 2223 nt, Artificial Sequence
  derived and/or modified sequence opt5 from ABCD2__Homo_sapiens__XP_011536329
augacccacaugcugaacgccgcugccgacagagugaaguggacacggagcuccgcggcuaaacgcgccgccugccucgucgcugccgcuuacgcccugaagacgcuuuaucccaucauuggcaaaagacugaagcagucugggcauggcaaaaagaaggcggccgcuuacccugccgcugagaauaccgaaauccuccacuguacagagaccauuugcgaaaaaccgagccccggaguuaacgccgauuucuuuaagcaacugcuugagcugcggaaaauccucuucccuaagcuggugacaaccgaaacaggguggcugugucuccauuccguggcgcugauuucucgcaccuuucuuagcaucuaugucgccggacuggacggcaaaaucgugaaguccauuguugagaagaaacccagaacguucaucauuaagcucaucaaauggcugaugauugcuaucccugccaccuuugucaauucugcuauucgguaccuugagugcaagcuggcccucgccuuccgcacaagacugguggaucacgcuuaugaaaccuacuuuacaaaccagaccuauuacaaagugaucaauauggacgggcggcuggcgaaccccgaucagagccucacggaggacaucaugauguucucccagagcguugcccaucuguacucuaaucuuacaaagccuauucuggaugugaugcucaccuccuauacacugauccaaaccgcuaccagccgcggagccucuccgauuggccccacacuucuggccggccucgucguguacgcuacggccaaagugcugaaggcguguuccccuaaguuugggaaacuggucgcugaagaggcccacagaaagggauaucuccgguacguucacagccgcaucauugccaacguggaggaaaucgcuuucuauagaggccauaaaguggagaugaagcagcugcagaaaucuuacaaggcccuugcugaccagaugaaucugauccucuccaagcggcugugguauauuaugaucgaacaauuucuuaugaaauacgucuggagcuccucugggcugauuaugguggccauccccauuaucaccgcgacaggauucgccgauggcgaggacgggcagaagcagguuauggugagcgaacgcaccgaggcuuuuacaaccgccagaaaccuccuggcuuccggagccgaugcgaucgagcggauuaugagcucuuacaaagaagucacggagcuggccggcuauacagcuagaguguacaauauguucuggguuuucgacgaagugaagcgcggcaucuauaaacggaccgccgucauucaggaguccgaaagccacucuaagaacggggcuaagguggagcucccucugagcgauacccuugccaucaaaggaaaggucauugacguggaccauggcaucauuugcgagaauguucccaucaucacaccggccggggaaguggucgcuuccagacugaacuuuaaaguggaggaaggaaugcaccuccugauuaccggcccuaauggguguggaaagucuagccuguuccgcauccuuuccggccucuggcccguuuacgagggcgugcuguauaaaccuccuccccaacacauguuuuacauuccccagcggccguauaugagccuggggucucucagagaucaggucaucuaccccgacuccguggaugacaugcaugauaagggauacacagaccaagaucuggaacgcauucuucacaacgugcaucuguaucacaucguucagcgggagggcgggugggacgcggucauggauuggaaggacgugcucagcggaggcgagaaacagagaauggggauggcccgcauguucuaccauaagccuaaauaugcucugcuggaugaaugcacgucugccguguccaucgacgucgagggcaagauuuuucaggccgcuaaaggagccggcaucagccuucucuccauuacccaccggcccucucuguggaaguaccacacacaucugcuccaauucgacggggaaggaggcuggagauuugagcagcuggauaccgcgauccgccuuacacugagcgaggaaaaacagaagcucgagucccagcuggcugggauuccuaagaugcaacagcggcugaacgaacuuuguaaaauccucggagaggacucugugcugaagaccaucaaaaaugaagaugagacgagcuga

SEQ ID NO: 65348 - RNA, 1044 nt, Artificial Sequence
  derived and/or modified sequence opt5 from ABCD3__Homo_sapiens__XP_011540179
augggcuucaucgacagcauuaucgccaaguaccuggcuaccguggucggguaucucguuguguccagacccuuucuggaucuuucucacccucggcaucugaaaagcacacacuccgagcuccuggaagacuacuaucagucuggacgcaugcuucugagaaugagccaagcccucggccggauugugcuggcggggcgcgagaugacgagacuggcuggauucaccgcccggaucacagaacucaugcagguccugaaggaucuuaaccauggcaaauacgagcgcaccauggugucccagcaggaaaaggggauugagggaguucaagugaucccgcugauccccggcgccggcgagauuaucauugcugacaauaucauuaaauuugaucacgucccucucgccacacccaacggggacgugcugaucagagaucuuaauuucgaaguucggucuggagcuaacgugcugauuugcggcccuaauggguguggaaagagcucccucuuucgcguccugggcgagcuguggccccucuucgggggaagacugaccaagccugaacggggcaaacuguuuuaugugccgcagcgccccuacaugacacuuggcacccucagagaccaggugaucuauccugaugggcgggaggaccagaagcgcaaaggaaucagcgaucugguccuuaaggaguaccuggacaacguucaacucggccauauucuggaaagagaagggggaugggauucugugcaggacuggauggacgugcuguccggcggggagaaacagcggauggccauggcgagacucuucuaccacaagccccaguuugccauccuggaugagugcacgagcgcugucucuguggacguugaaggauauauuuacucccacugucgcaaggugggcaucacccuuuucacagucagccaucggaaaucucuguggaagcaccaugaguauuaccuccacauggauggcagagggaauuaugaguuuaaacaaauuaccgaagacacaguggaguucggauccuga

SEQ ID NO: 65349 - RNA, 1821 nt, Artificial Sequence
  derived and/or modified sequence opt5 from ABCD4__Homo_sapiens__NP_005041
auggccguggcuggccccgccccuggggcgggagcuagaccgcggcuggaccuccaguuccugcaacgcuuucuucagauccugaagguccucuuccccagcugguccucucagaacgcccugauguuucuuacccugcucugccugacacugcucgagcaguucguuauuuaccaagugggccugaucccuagccaguauuacggggugcuuggaaauaaagaucuggaaggcuuuaagacgcucaccuuccuggccgucaugcuuauugugcugaacuccacacucaaaucuuuugaccaguucaccuguaaucugcuguauguuagcuggagaaaggaucucacagagcaucugcaccggcuuuacuuucgcgggagagcuuauuacacccugaacgugcuccgggacgauaucgacaaucccgaucagcgcauuucccaagacgucgaaagauucugccggcagcugucuagcauggccuccaaacuuaucaucagcccuuuuacacugguguauuacaccuaccaguguuuccagucuacgggauggcucggccccguuuccauuuuuggcuauuucauccuggggaccguggucaacaagacacugaugggaccuauugugaugaagcucgugcaccaagagaaacuggaaggcgauuuccgcuuuaagcauaugcagaucagagucaaugcugagccggccgcguucuaccgggccgggcacguugagcauaugcgcaccgacagacggcuucagcgccugcuccaaacacagagagaacugaugagcaaagagcuuuggcuguauauuggaaucaacaccuuugauuaccucggcucuauucuguccuauguggugaucgcuauccccauuuucagcggggucuacggagaccugucuccugccgaacucuccacgcuggugagcaagaaugcuuuuguuugcaucuaucuuauuuccuguuucacacagcugaucgaucucucuaccacacugagcgacguggccggcuacacccaccggauuggccagcugagagagacccuucucgacaugucccugaaaagccaagauugcgagauccugggggaaucugaguggggacucgacacacccccuggcuggcccgcggccgaaccggcugauacggccuuucugcuugagcgcgucuccaucagcgcuccuucuagcgacaagccccugauuaaggaucucucccugaaaaucucugaagggcagagccugcuuauuaccggaaacacaggcaccgggaagacaucccuccugcgggugcugggaggccucuggaccagcacgagaggcucuguucagaugcugacagacuucgggccucacggagugcuuuuucugccccagaaacccuucuuuaccgauggcacccuccgcgagcaagucaucuacccucugaaggagguguauccggacuccgggagcgccgaugacgaacggauucugagauuccuugagcucgccggacugucuaaucuggucgcucgcacagaaggccucgaucaacagguggacuggaacugguacgacguucugucccccggggagaugcagcggcuuagcuuugcgagacuguucuaucuccagccuaaauacgccgugcuggaugaagcuaccuccgcccugacagaggaggucgaaucugagcuuuaucgcaucggccagcagcucggaaugacguucaucagcgugggccaucggcagucccuggaaaaguuucacucucugguucucaaacugugugggggaggcagaugggagcuuaugcgcauuaagguggaauga

SEQ ID NO: 65350 - RNA, 1800 nt, Artificial Sequence
  derived and/or modified sequence opt5 from ABCE1__Homo_sapiens__NP_002931
auggccgacaagcugaccagaaucgcuauugugaaccacgauaaaugcaagcccaaaaagugucggcaggagugcaaaaagagcuguccugucguucgcaugggcaagcucugcaucgaagugacaccgcaauccaaaauugccuggaucucugagacgcuguguauugggugcggaaucuguaucaagaaaugccccuucggcgcgcuuagcauugugaaucugccuuccaaccucgaaaaggagaccacacauagauauugugcuaaugccuuuaaacugcaccggcuucccaucccucgccccggggaaguccugggacucgugggcaccaacgggauuggaaagucuacagcccugaagauccuggcuggcaaacagaagccuaaucucggcaaauaugacgauccgcccgacuggcaggagauucugaccuacuucagagggagcgagcuucagaacuauuuuacaaagauccuggaagaugaccucaaagccauuaucaagccucaauacguugaucagauccccaaagcugccaagggaaccgugggcuccauucuggaccggaaggaugagacgaaaacccaggcgaucgucugccagcaacuugaccugacacaucucaaggaacgcaauguggaggaucugucugggggagagcugcagagauucgccugugcuguugugugcauucagaaagccgacaucuuuauguucgaugaaccuagcuccuaucucgacgucaagcagcggcugaaagcugccauuaccauccgcagccuuaucaaccccgacagauacauuaucgugguggagcacgaucugucuguccucgacuaucuguccgauuuuauuugcugucuuuacggcguuccgagcgcguacgggguggugacaaugccuuucucuguccgggaaggaaucaauauuuuucuggacggcuaugugcccaccgagaaccuccgcuucagagaugccucccugguuuuuaagguggcugaaacggccaaugaggaggaagucaagaaaaugugcauguacaaguauccuggcaugaaaaagaaaaugggggaguucgaacuggcuaucguggccggagaguuuacagacagcgaaaucaugguuaugcucggcgagaacgggaccggaaagacaaccuucauucggaugcuggccggccgccuuaagcccgaugaagggggagaggugcccguccugaaugugucuuacaaaccucaaaagaucuccccgaaaagcaccggcuccgucagacagcuccugcaugagaagauucgggacgcuuauacacacccccaguucgugacggauguuaugaaaccucuucaaaucgaaaacauuaucgaccaggaggugcagacccugucuggcggggaacuccagagagucgcgcuggcccugugucucggaaagcccgcugauguguaccugauugacgagccuagcgccuaucuugacuccgagcaacgccugauggccgcucggguugugaagagauuuauccuccacgccaaaaagacagcguucgucguggaacaugauuuuaucauggcuaccuaccuggccgaccgcgugauuguuuucgauggcguccccagcaaaaauacaguggccaacucuccgcagacccugcuugcugggaugaacaaguuucucucccagcuggagaucacguuccggagagacccuaauaacuaccgcccccggauuaauaaacugaacagcaucaaggauguggaacagaaaaagucuggaaauuacuuuuuccucgacgauuga

SEQ ID NO: 65351 - RNA, 2538 nt, Artificial Sequence
  derived and/or modified sequence opt5 from ABCF1__Homo_sapiens__NP_001020262
augcccaaggccccuaaacagcaaccgcccgagccugaauggaucggcgacggggagagcaccucccccucugauaagguggucaaaaagggaaagaaggacaagaaaauuaagaaaacauucuuugaggagcuggcuguugaagauaagcaggccggcgaggaggaaaaagugcucaaggagaaggaacagcagcaacagcagcagcaacagcagcagaaaaagaaaagagacacgcggaaggggcgccggaaaaaggauguggacgaugacggagaggagaaagaacugauggagagacuuaagaagcugagcgucccuaccuccgaugaagaggacgaagugcccgcgccuaaaccgcgcggcgggaagaaaacaaagggaggcaacguuuucgcugcccucauccaagaucagucugaggaggaagaggaagaggaaaaacaucccccuaagcccgccaagccugagaaaaauagaauuaacaaggcugugagcgaggaacagcaacccgcccugaaaggcaagaaagggaaggaggaaaaguccaaaggaaaggcuaaaccgcagaauaaguuugccgcgcuugacaacgaggaagaggauaaagaggaagagaucauuaaggaaaaggagccucccaaacagggcaaggagaaagccaagaaagcugaacaggggucugaggaagagggagaaggcgaggaggaagaggaagaagggggagaaagcaaggccgacgacccuuacgcucaccuguccaaaaaggagaagaaaaagcucaaaaagcaaauggaguaugaacggcaggucgccagccugaaagcggccaaugcugccgagaacgauuucucugugucccaggcugaaaugagcucucgccaggccaugcuggagaaugccuccgacaucaagcucgaaaaguuuagcaucucugcucacggcaaagagcuguucguuaacgcggaucuuuacauuguggccggcagacgguaugggcuggucggacccaauggcaaggggaaaaccacacuccugaagcauaucgcuaaccgcgcccuuuccauucccccuaauaucgacgugcugcucugcgagcaagaaguggucgccgaugagaccccggcuguucaggccgugcugagagcggacacaaaacggcugaagcuccuggaagaggagcgcagacuucagggacagcuggaacaaggcgaugacaccgcugccgagcggcucgaaaagguguacgaggaacugcgcgccacgggggcugccgcugccgaggcgaaagccagacggauucuugcuggacugggcuuugaucccgagaugcagaacagaccuacccagaaguucagcggcggguggcgcaugcgggucucccucgccagagcucuguuuauggaacccacacugcucaugcuggacgagccuaccaaucaccuugaucugaacgccgugaucuggcucaauaacuaucugcagggauggcgcaaaacacuucugauuguuucucaugaccaaggcuuccucgacgauguguguaccgacaucauccaccuggaugcgcagcggcugcacuacuauagagggaacuacaugacguuuaagaaaauguaccagcaaaagcagaaggaacuccugaaacaguaugagaagcaggaaaagaaacuuaaagagcugaaggccggaggcaaaagcacaaagcaagcugagaagcagaccaaagaagcccucacacgcaagcagcagaaaugccggagaaagaaucaagacgaggaaucccaggaggcucccgaacugcugaaacgcccgaaggaguacaccguccgguucaccuuuccugaucccccuccccuuagcccucccgugcucgggcugcauggcguuacauucggauaucagggccagaagccgcuguucaaaaaccucgacuuugggauugauauggacucuagaaucuguauugugggaccuaauggcgucgggaaguccacgcugcuucugcuccugaccggaaaacugacacccacccacggcgagaugcgcaagaaccaucggcuuaaaaucggguucuuuaaucaacaguacgccgaacagcucagaauggaggaaacacccaccgaguaucugcaacggggcuucaaccugccuuaccaggaugcccgcaagugccucggaagauuuggccuggagagccacgcucacacgauucagaucuguaaacuuucugggggacagaaagcgcggguggucuucgccgaacuggcuugcagagagccggacgugcucauccuggaugaacccacaaauaaccuggacauugagagcaucgaugcccuuggcgaagccauuaaugaguauaagggggcuguuaucguggucucccaugacgcccgccucauuaccgagaccaacugucaacugugggugguugaggaacagucugugagccagaucgacggagauuuugaagacuacaaacgggagguccuggaagcgcucggcgaggugaugguguccagaccucgcgaguga

SEQ ID NO: 65352 - RNA, 1905 nt, Artificial Sequence
  derived and/or modified sequence opt5 from ABCF2__Homo_sapiens__NP_005683
augcccagcgaccuggccaagaaaaaggcugccaaaaagaaagaggcggcuaaggccagacagcggccucgcaagggccacgaagagaacggggauguggucaccgaaccgcaaguugccgagaaaaaugaagcuaacggaagagagacaacggagguggaccuccugaccaaggaacuugaggauuucgaaaugaaaaaggccgcugcccgggcggugacaggcguccuggccucccaucccaauucuaccgacgugcacaucauuaaccucagccugacauuucaugggcaggagcuucuguccgauaccaaacucgagcuuaauucuggacgcagauacggccugaucgggcucaacggaauuggcaagagcaugcugcuuuccgcuaucggcaagcgggaaguuccuauucccgagcacaucgacaucuaucaucugacacgcgaaaugccucccucugauaaaaccccucuccacugcgugauggaggucgacacggaaagagccaugcuggagaaggaggcugaacggcuugcccacgaggaugcggaaugugagaaacugauggaacucuacgagcgccuggaggaacuggacgccgauaaggcugagaugagagccagccggauucuccaugggcugggauucaccccggcuaugcagcgcaaaaagcugaaagacuuuuccggcggguggagaaugcggguggcccuggcccgcgcucucuucaucagacccuuuaugcugcuucuggaugaaccuacaaaucaccucgaccuggacgcgugcguuuggcuggaggaggaacucaagaccuucaagcggauucuggugcuugucagccauucucaggauuuucugaacggaguguguacaaauaucauucacaugcacaacaaaaagcucaaauauuacaccggcaauuaugaccaauacgugaagacgagacuggagcuugaagagaaccagaugaaacgcuuccauugggaacaggaucagaucgcccacaugaagaauuauauugcucgguuugggcauggauccgccaagcuggccagacaagcucagagcaaagagaagacacuccagaaaaugauggccucuggccugaccgagcgcgucguuuccgacaagacacugagcuucuacuuucccccuugcggcaaaauucccccgccugugaucauggugcagaacgucucuuucaaguacaccaaggaugggcccuguaucuauaauaaccucgaauuuggaaucgaccuggauacccggguggcgcuuguuggcccuaacggggcuggaaaauccacacugcucaagcugcugacgggcgagcuucuccccaccgacgggaugauuagaaaacacagccaugugaagaucggacgcuaccaccaacaucugcaggaacagcuggaucucgaccugucuccccuugaguauaugaugaaaugcuacccugaaauuaaggagaaggaggaaaugcggaaaaucaucggcagauauggccugacagggaagcaacaggucuccccgauucgcaaucucagcgauggacagaaaugucgggugugccuggccuggcuggccuggcagaacccccacaugcuuuuccucgacgagccuaccaaucaccuggacaucgaaacaauugaugcucuggccgacgcuaucaacgaguucgaaggcgggaugaugcucguuucccaugauuuuagacugauucaacagguggcccaggagaucugggucugugagaagcagaccaucacgaaauggcccggagacauucuugcguacaaggaacaccugaaaagcaagcucguggaugaggaaccucaacugacaaagcgcacccacaaugucugcacccugacacuugccucucucccccggccguga

SEQ ID NO: 65353 - RNA, 2037 nt, Artificial Sequence
  derived and/or modified sequence opt5 from ABCG1__Homo_sapiens__NP_004906
auggccugccugauggcugccuucagcgugggcaccgcgaugaacgcuuccucuuacagcgccgagaugacagaacccaaguccgucuguguuucuguggacgagguggucagcuccaauauggaagccacggagaccgaucuccugaacgggcaccuuaaaaagguggacaauaaccugacagaagcucagagauuuucuagccucccucggcgcgccgcuguuaauaucgaguucagagaucuguccuauagcgugccggagggacccugguggcggaaaaagggcuacaaaacccuucugaaggggauuucuggaaaguuuaacuccggcgaacucgucgccaucauggggccuagcggagcgggcaaaucuacacugaugaauauucuggccggcuaucgcgagaccgggaugaagggagcugugcucaucaacggccugcccagagaccuucggugcuuccgcaaaguuuccuguuacauuaugcaagaugacaugcugcucccucaucugacagugcaggaagccaugauggucagcgcucaccuuaagcugcaggagaaagaugaggggagacgggaaauggugaaggagauccucaccgcccugggacugcucucuugcgcgaauacgcgcaccggcucccugagcgggggacagagaaagcggcuugccaucgcucuggaacucgugaacaaucccccugucauguuuuucgacgagccgacauccggccuggauucugccagcuguuuucaaguugugucccuuaugaaaggccuggcucaagggggacgcagcauuaucugcaccauucaucagcccucugccaaacucuucgaacuguuugaccagcuguaugugcucucccagggccagugugucuacagagggaaggugugcaaccugguuccuuaucuucgggaucugggacucaauugucccacauaccacaacccugccgacuucgugauggaggucgcuagcggcgaguacggggaucaaaauucucgccuggugagagcgguucgggaaggaaugugcgacagcgaccauaagagagaucuuggcggcgacgccgaggugaaccccuuucuguggcaccgcccguccgaagaggucaaacagaccaagcggcucaaagggcugagaaaggauucuagcuccauggaaggaugucacagcuucucugcuuccugccugacgcaguuuugcauccucuucaagcgcacauuccugagcauuaugcgggacucugugcuuacccaucugagaaucacaucccacauuggcaucgggcuccugaucggacugcuuuaucucggcauugggaacgaggccaaaaagguccugagcaauuccggcuuucuguucuuuucuaugcuuuuccugauguuugccgcucuuaugccuaccgugcugaccuucccccucgagaugggaguuuuucugcgcgaacaucugaacuacugguauagccuuaaagccuacuaucucgcgaagacaauggcugaugugccuuuccagaucauguuucccgucgccuacuguuccauuguguauuggaugacgucucagcccagcgacgccguucgguucgugcuguuugcugcccugggcaccaugacaucccucgucgcucaaagccuggggcuucugaucggagccgcgucuaccucccuccagguggccacauucgugggcccuguuaccgcuauuccgguccugcuguuuagcggguucuucgugucuuuugauacgauccccacauaccuucaguggauguccuacaucagcuaugugagauacggauucgagggcgucauucucucuaucuaugggcuggaccgcgaagaucugcacugcgacauugaugagaccugucacuuucagaaaagcgaagccauccuccgggagcuggacguggagaaugcuaagcucuaccuggacuucauuguucucggcaucuuuuucaucucccugagacugauugccuauuuugugcuucgcuacaagauccgggcggaaagauga

SEQ ID NO: 65354 - RNA, 1836 nt, Artificial Sequence
  derived and/or modified sequence opt5 from ABCG2__Homo_sapiens__NP_001244315
augagcuccucuaacguggaggucuucauccccguuagccagggcaauaccaacggguuuccugccacagcuuccaaugaccugaaggccuucacggaaggagcggugcucucuuuucacaacauuugcuacagagugaaacugaaguccggcuuccuuccgugucggaaacccgucgagaaggaaauccuguccaauauuaacgggaucaugaaaccuggacucaaugcuauucugggccccaccgggggaggcaagucuagccuucuggaugugcucgccgcccgcaaggacccuuccggccugagcggggauguucugaucaacggagcucccagaccugccaauuuuaaaugcaacucuggcuaugugguccaagacgaugugguuauggggacacucaccgugcgggagaaucugcaguucuccgcugcccuucgccuggcgacaaccaugacaaaccaugaaaagaaugagagaaucaaccgggucauucaggagcucggacuggacaaaguggccgauagcaaggugggcacccaguuuauccgcggggucucuggaggcgaaagaaaacggacguccauuggcauggagcuuaucaccgacccgagcauucuguuccucgaugaacccacaaccgggcuggacucuuccacagcuaaugccguucugcuccugcuuaagcgcaugagcaagcaaggaagaaccaucauuuuuagcauccaccagccucgguacucuaucuucaaacuguuugauagccucacgcugcuugcuuccggccgccugauguuccaugggcccgcccaggaggcgcucggauauuuugagagcgccggcuaccacugugaggcuuauaacaacccugccgacuucuuccuggauauuaucaauggggacucuacagcuguggcccugaacagagaagaagacuuuaaggccaccgagauuaucgaacccuccaaacaggauaagccgcucauugagaaacuggcugagaucuacgugaauagcucuuucuauaaggaaacaaaagcggagcuucaucaacugagcggaggcgaaaagaagaaaaagaucaccgucuuuaaagagauuuccuacaccacaucuuucugccaccagcuccggugggugagcaagcgcuccuuuaaaaaccugcuuggcaauccucaggccagcaucgcucagauuaucguuacggugguccuggggcucgugauuggagccaucuacuucggccugaagaacgacucuaccgggauccaaaauagagccggaguucuguuuuuccucacaaccaaccaguguuuuuccagcgugucugcugucgaacuguucguggucgagaagaaacuuuuuauucacgaguauaucuccggcuacuaucgggugagcuccuacuuccuggggaagcuccugucugaucugcuucccaugagaaugcucccuagcauuaucuuuacaugcauuguuuauuucaugcugggccugaaacccaaggccgacgcguucuuugugaugauguucacccucaugauggucgcuuacuccgccucuagcauggcccuggcuaucgccgcuggacaguccgugguuagcguggccacgcuucugaugacaauuuguuuugucuucaugauggugugcuggucuaucucccaaccccuccaucugggcugucacggguuuagcaccucugcguuccaugauauggaccugcgccuuugcuccaucaugaauuuuugggauaaaaccagcgcccaggacucuaugcagcaggaaacaauucucgugaccaugcaacacguucuggcuaagaacaucugguga

SEQ ID NO: 65355 - RNA, 1941 nt, Artificial Sequence
  derived and/or modified sequence opt5 from ABCG4__Homo_sapiens__NP_001135977
auggccgagaaggcucuggaagccgugggcugcgggcucggacccggcgcggucgcuauggccguuacccuggaggacggggccgaaccuccggugcuuacaacgcaccugaaaaagguggagaaccauaucaccgaagcucagagauucagccaccuccccaaacgguccgccgucgauauugaguuuguggagcugucuuacagcguucgcgaaggaccuuguuggagaaagcggggcuauaaaacacuucugaagugccucuccgggaaguucugucgcagagagcugaucggaauuaugggccccucuggcgcugggaaaagcaccuuuaugaauauccuggccggauaccgggaauccggcaugaaggggcaaauucucgugaacggacgcccuagagagcugcggacauuccgcaaaaugucuugcuauaucaugcaggacgauaugcuucugccccaucucaccguccuggaggcgaugauggugagcgccaaucuuaagcuguccgaaaaacaggagguuaagaaggaacucgugacagagauccugaccgcucugggccucaugagcuguucucacacgagaaccgcccugcuuuccgggggacagcggaaacgccuggcuauugcccucgaacuggucaacaauccuccggugauguuuuucgacgagcccacaagcggccuugauucugcguccugcuuucaaguggucagccugaugaagucucucgcccagggcgggagaaccaucauuuguacaauccaucagccuuccgcuaaacuguucgagauguuugacaagcuguacauucucagccagggacaaugcaucuucaaaggcguugugaccaaccugauucccuaucuuaaggggcugggacuccacuguccuacguaccacaaucccgccgauuuuaucaucgaaguggcuuccggcgaguauggggaccugaacccgaugcuuuuccgggccguccagaauggacugugcgccauggcugagaaaaagucuagcccugaaaagaacgaagugcccgcgccuuguccucccugucccccggagguugaucccauugagucccauacauuugccaccagcacacucacccaguucugcauccuguucaaacgcaccuuucugucuauucucagagacacagugcugacgcaccuucgguucaugucccaugucgugaucggcguucugauuggccuccuguaccugcacaucggggaugacgcuagcaagguguuuaauaacaccggaugccuuuucuuuucuaugcuguuccugauguuugccgcccugaugccuacaguccucaccuucccccuggaaauggcuguguuuaugagagagcaccuuaauuacugguauagccugaaagccuacuaucucgcgaagacaauggcugaugucccuuuccaggugguuugccccguggucuacuguuccaucguguauuggaugaccggccaaccggccgaaacgucucgcuuucugcuguucagcgcccuugcuacagccaccgcucucguugcccagucccuggggcugcucauuggagcggccagcaacucucuccagguggcuaccuuugucggcccugugacagccauccccgugcuucuguucuccggguucuuuguuagcuucaaaaccauuccuacauaccuccaauggucuuccuaucugagcuacguccgguacggcuuugagggagugauccugacgauuuauggcauggaaagaggggaccuuaccugccucgaggagcgcugucccuuccgggaaccucaguccauccugagagcucuggacguggaggaugccaagcucuacauggacuuucugguccuuggaaucuucuuucuggcgcuccgccugcuggccuaucuugugcuccgguacagaguuaagucugaacgcuga

SEQ ID NO: 65356 - RNA, 1956 nt, Artificial Sequence
  derived and/or modified sequence opt5 from ABCG5__Homo_sapiens__NP_071881
augggcgaccugagcucccucacccccgggggaucuaugggccuccaggugaacagagggagccaauccucucuugagggagccccugcuacagccccggaaccccacagccugggcauccuccaugcguccuacucugucagccaccggguucgcccuuggugggauauuacguccugcagacagcaguggacccggcagauccugaaggacgugagccuuuauguggagucugggcaaauuauguguauccugggauccagcggcucuggcaaaacaacccuccuggaugcuauguccgggcgccugggcagagccggaacauuccucggggaagucuacgugaauggacgggcccugcgcagagagcaguuucaggacugcuucagcuauguucuucagucugauacccugcucuccagccugacagugcgggaaacccuucauuacacggcucugcucgccauucgcagaggcaaccccggguccuuucaaaagaaagucgaggcugugauggccgagcugucucugagccacguugcggaccggcucaucggaaauuauucccugggcggcaucagcaccggggaacgcagacgggugucuauugccgcucagcuucugcaggauccuaaggucaugcuguucgacgagcccacaaccggacuggauuguaugacagccaaccagaucguggugcuucuggucgaacucgcucgcagaaaucggauuguugugcugaccauccaucaaccuagauccgagcuguuucagcuuuucgacaaaauugccauccugagcuuuggcgagcuuauuuucugcgggacgccggcggaaaugcuggauuucuucaacgacuguggauaccccugcccugagcacucuaaucccuuugauuucuauauggaccucacaagcguggacacccaguccaaggaacgcgagaucgaaacaucuaagcggguccaaaugaucgagagcgccuacaaaaaguccgcuauuugucacaaaacccugaagaacaucgagagaaugaaacaucuuaagacccugccuauggugcccuuuaagacaaaagauagcccgggcguuuucucuaagcucggggugcugcugcgccgggucacgagaaaucucgugcgcaacaaacuggccguuauuacccggcuucugcagaaucucaucaugggacuguuccugcucuuuuucgugcucagaguccgcuccaacgugcugaagggcgcuauucaggaccgggucggccugcucuaccaguuugugggggccacaccuuauaccggaaugcugaaugccguuaaccuuuuccccgugcugagagcugucagcgaucaagaaucucaggacggccucuaccagaaauggcagaugaugcuggcguaugcccugcacgugcuuccuuuuuccguuguggcuacaaugaucuucagcuccgucugcuacuggacccucgggcugcaucccgagguggcccgcuuuggauauuucucugccgcucugcucgcgccccaccugaucggcgaauuucuuacgcuggugcuccuggggauuguucaaaauccuaacaucgucaacagcgugguggcccugcuuuccauugcuggcguccucgugggaucuggcuuccugcggaauauccaggagaugccgauucccuuuaagaucaucagcuacuucacauuucagaaauauuguuccgaaauucugguugugaacgaguucuacgggcucaauuuuaccugcggaagcucuaacgucuccgugaccacaaauccuaugugugccuuuacccagggcauccaauucauugagaagacaugccccggggccacgagcagauuuaccaugaacuuccugauccuuuacucuuuuauuccugcucugguuauccucggaauuguggucuucaagauccgggaucaccugaucucccgcuga

SEQ ID NO: 65357 - RNA, 2022 nt, Artificial Sequence
  derived and/or modified sequence opt5 from ABCG8__Homo_sapiens__NP_071882
auggccggcaaggcugccgaggaaagagggcugcccaaaggagcgaccccucaggacacaagcggccuccaagaucggcuguucuccucugagagcgacaacucccuuuacuuuacguauucugggcagccgaauacccuggaagugcgcgaucucaacuaccaggucgaccuggcuagccagguucccugguucgagcaacuugcccaguuuaagaugccuuggacaucccccucuugccagaauagcugugaacugggaauccagaaccucuccuucaaagugagaagcggccaaaugcuggccauuaucgggucuuccggaugcggccgggcuagccugcucgaugugauuaccggccgcgggcacggaggcaagaucaaaucugggcagauuuggaucaauggacagccuuccagcccccagcuggucagaaaguguguggcccauguucggcaacacaaccagcuucugccuaaucucacagugcgcgagacccuggcuuuuaucgcccagaugagacuuccgcggacauucucucaagcgcagcgcgacaagagagucgaggaugugauugccgaacugcggcuccgccagugcgcugacaccagaguuggcaacauguaugugcgggggcuguccggaggcgagcgcagacgggucagcaucggcgugcagcugcucuggaaucccgggauucugauccuugaugaaccuacguccggacuggacucuuuuaccgcccauaaccucgugaaaacacugagcagacuugcuaagggcaaucgccugguccucauuucccugcaccaaccccggagcgauaucuucagacuguuugaccucguucugcuuaugaccucugggacaccuauuuaccugggagccgcgcagcauauggugcaguauuucaccgccaucggcuaccccuguccgcgcuauuccaacccugcugauuuuuacguggaccucacgagcaucgaccggagaucucgcgagcaggagcuggccacacgggaaaaagcucaaagccuugccgcccuguuccucgagaaggucagagaucuggacgauuuucuguggaaagcugaaaccaaggaccucgaugaggacacaugcguggaauccucuguuacaccccuggauaccaauugucuuccuagccccaccaagaugcccggggcggugcagcaguucacgacccugauucgccggcagaucuccaacgacuucagagaucucccuacacugcugauucacggagccgaggcuugccuuaugagcaugaccaucggcuuucucuacuucggccacgggucuauucaacuguccuuuauggacacagccgcccuccuguucaugaucggagcucugaucccguuuaaugucauucuugaugugaucagcaaauguuauucugagcgcgccaugcuguacuaugaacucgaggacggccuguacaccacggggcccuauuucuuugcgaagauucugggagaacuuccugagcauugcgcuuacaucauuaucuauggcaugcccacauacuggcucgccaaccugcggccugggcugcagcccuuccuccugcacuuucuucugguuuggcucguggucuucuguugcagaaucauggcccuggcugccgcugcccugcuuccgaccuuucauauggcguccuucuuuagcaacgcccucuacaauuccuucuaucuggcuggcggauucaugauuaaccugucuagccucuggaccgugccugccuggaucuccaaagucucuuuucugcgguggugcuucgaaggccuuaugaagauucaguuuagccgcagaacauacaaaaugccccuggggaaucucaccaucgcuguguccggagacaagauucugagcguuauggagcuggauucuuauccucuuuacgccaucuaucucauugugaucggccuguccgggggauucaugguccuguacuaugugagccuccgguuuaucaaacagaagcccucucaagacugguga

SEQ ID NO: 65358 - RNA, 1089 nt, Artificial Sequence
  derived and/or modified sequence opt5 from ABHD12B__Homo_sapiens__NP_001193602
auggacgcccaggauugccaagcugccgcgagccccgagccuccggggcccccugcuagauccuguguggccgccuggugggacauggucgaucggaaccugcgcuacuucccccacucuugcagcaugcucggcagaaagaucgcugcccuguaugacuccuuuaccucuaaaagccuuaaggaacauguuuuccugccucucauugauaugcugaucuacuuuaauuucuuuaaagcucccuuccuuguggaccugaagaaaccugagcucaagauuccgcacacagugaacuuuuaucugcgggucgaacccggagugaugcugggcaucuggcauacgguuccuuccugucgcggggaggaugccaagggaaaagacugcuguugguacgaagcggcccucagagauggcaaucccauuaucguguaucugcacgggucugcugagcaucgggccgcuagccaccgccuuaagcuggucaaagugcucuccgacggaggcuuccacguucugagcguggauuacagaggcuuuggggacucuaccggaaagccuacagaggaaggccuuaccacagaugccaucugcgucuaugaguggaccaaagcgcgguccgggauuacacccgugugucuguggggacauagccucggcaccgggguggccacgaacgcugccaagguccuggaagagaagggaugcccgguugacgcuaucgugcuggaggccccuuucaccaauauguggguggccucuauuaacuacccccuccugaaaaucuaccgcaauauuccuggcuuucuuagaacacugauggacgcucuccggaaggauaaaaucauuuuccccaacgacgaaaaugucaaguuucuguccagcccccuucugauccuccacggcgaggaugaccgcaccgugccucuggaauaugggaaaaagcuguacgagaucgcgagaaacgccuaucggaauaaagaacgcguuaagauggugauuuucccgcccggauuccagcauaaccuccuguguaagucuccuacacuucugaucaccgucagagauuuucucuccaaacaguggagcuga

SEQ ID NO: 65359 - RNA, 1197 nt, Artificial Sequence
  derived and/or modified sequence opt5 from ABHD12__Homo_sapiens__NP_001035937
augagaaagcggaccgagcccguggcccuggaacacgagcgcugcgcugccgcgggcagcuccucuagcggguccgcugccgccgcucucgacgccgauuguagacugaaacagaaccuucggcugacaggaccugcugccgcggaaccgcgcugcgccgcugacgccggcaugaagagagcucucgggcggcgcaaaggagucuggcugagacuucggaagauccuguucuguguucucggccuguacauugccauccccuuucugauuaaacucugcccugggauccaagcgaagcugauuuuccuuaauuuugugcgcgugcccuauuucaucgaucugaagaaaccucaggaccagggacucaaccauacguguaauuacuaucugcagcccgaggaagaugucaccaucggcguguggcacacaguuccugccgugugguggaagaacgcucaaggcaaagaccagaugugguacgaggaugcccuugcuucuagccauccgauuauccuguaucuccacgggaaugccggaaccagaggcggggaccaucgggucgagcuguacaaggugcuguccucucucggauaucacguugugacauuugauuaccgcggcuggggagacagcgucgggacccccuccgaaagaggcaugacauacgaugcccugcacguguucgacuggauuaaagcucggagcggcgauaacccuguguauaucugggggcauucucuuggaaccggcgucgcgacgaaucugguucgcagacucugcgagcgggaaacacccccugacgcccugauucuugagucccccuuuaccaacaucagagaggaagcuaagagccacccguucucugugauuuaccgcuauuuuccuggguucgacugguuuuuccuggaucccaucaccuccagcggaaucaaguuugccaaugacgagaacgugaaacauauuucuuguccucuccugauccugcacgccgaagaugaccccgucgugcccuuccagcucggccggaagcuguacuccauugcugccccugcgcgcagcuucagagauuuuaaaguucaguucgugccguuucacuccgaccuuggguaucggcauaaguacaucuauaaaucucccgagcugccucgcauucucagagaguuccugggaaagagcgaacccgagcaccaacauuga

SEQ ID NO: 65360 - RNA, 1578 nt, Artificial Sequence
  derived and/or modified sequence opt5 from ABHD16A__Homo_sapiens__NP_001170986
augcccccuccggcccuguuccucagcucccuguaccccagacuugaguuucagaacgacuucuaucggucuugcauccgcagaagcuccccucaacccccucccaaucuggcuuggcggccugaaucucucuacagcggcgagcuggccgggggaggcuaucuuucccugucuaagguggucccguuuagccacuacgcggggacccuccugcugcuccuggcuggaguugccugucuucgcggcauugggagauggacaaacccccaguaucggcaguucaucacgauucuggaagccacccaucgcaaucaguccagcgagaacaaaagacaacucgcuaauuacaacuuugauuuccggucuuggccuguggacuuucacugggaggaacccuccagccgcaaggagucuagaggaggcccuucccggcgcggcguggcccugcuuagacccgaaccgcugcaucgggggacagcugauacccuccugaaucgcgucaaaaagcugccuugccagaucacaagcuaucucguggcccacacccugggaagacggaugcuuuaccccggcucuguuuaccugcuccagaaagcgcugaugccugugcuucugcaggggcaagccagacucgucgaggaauguaacggacgccgggcuaagcugcuggccugcgacggcaaugagauugauacaauguucguggacagacgcgggaccgcugagccccagggacagaagcucguuaucuguugcgaaggcaacgccggcuuuuaugagguggggugugucuccacgccccuggaagcgggauacagcgugcuuggcuggaaucauccuggguucgccggauccaccggcgugccguuuccccagaacgaggcuaaugccauggaugucguugugcaauucgcuauccaccggcugggguuucagccucaggacauuaucauuuaugccuggucuaucggaggcuucacagccaccugggcugcgaugagcuaccccgauguguccgccaugauucucgacgcuagcuucgaugaccuggucccucuugcccugaaagugaugcccgauucuuggagaggccucguuacacgcaccgugcggcaacaccugaaccugaauaacgccgaacagcucugcagauaucaggggccgguccugcuuauccgccggacgaaggacgagauuaucacaaccacagugccugaggacaucauguccaacagaggaaaugaucugcuccugaaacugcuucagcaucgcuacccccggguuauggcugaagagggccucagagugguccggcaauggcuggaagccagcucucagcuggaggaagcgagcauuuauucccgcugggagguggaggaagacuggugucucucuguccugagaagcuaccaggcugagcacgggccugauuuucccugguccgugggagaagacaugagcgccgauggccggagacagcuugcccuguuccucgcucgcaagcaucugcacaacuuugaggccacccacugcaccccucugcccgcucaaaauuuccagaugccguggcaucuuuga

SEQ ID NO: 65361 - RNA, 867 nt, Artificial Sequence
  derived and/or modified sequence opt5 from ABHD17B__Homo_sapiens__NP_001020951
augaacaaucugagcuucuccgagcucugcugucuguuuugcugucccccuugcccgggcaagaucgccucuaaacuugcuuuccugcccccugaccccaccuacacacucaugugugaugaaagcggguccagauggacgcugcaccuuucugagcgggccgacuggcaguauagcucccgcgaaaaggaugcgauugagugcuuuaugaccagaacaucuaaaggaaaccggaucgcuuguauguucgugcgcugcagcccuaaugccaaguacacccugcucuuuucccauggcaacgccgucgaccuggggcaaaugagcucuuucuauauuggacugggcuccagaaucaauuguaacauuuuuagcuacgauuauucuggguacggagcuuccagcggcaaacccacagaaaagaaucucuaugccgacaucgaggcugccuggcuggcgcuucggacccgcuacggcaucagaccugagaacguuauuaucuacgggcagucuauuggaacagugccguccguggaucuggccgcucgguaugaaagcgccgcugucauccuccacucuccccugaccuccggcaugcgcguggccuucccugacacgaagaaaaccuacugcuuugaugcguuccccaauauugacaagaucagcaaaauuacauccccuguucuuaucauccaugggaccgaggaugaagugauugacuuuagccacggacuggcccucuucgagagaugucagcggcccgucgagccgcuguggguggaaggcgcugggcauaacgauguugagcuguauggacaguaccucgaacgccugaagcaauuugugucucaggagcuugucaaucuguga

SEQ ID NO: 65362 - RNA, 1278 nt, Artificial Sequence
  derived and/or modified sequence opt5 from ABHD2__Homo_sapiens__XP_005254890
augaacgccaugcuggagacccccgaacucccugcuguguucgacggcgucaagcuggccgcgguugcugccgugcuuuacgugaucgucagaugccugaaucucaagagcccgacagcucccccugaucuguauuuucaggacuccgggcuuucucgguuccugcucaagagcuguccccugcugacgaaagaguacauuccuccccucaucuggggaaaguccggccacauucaaaccgcucuguaugggaaaaugggacgcgugagaucuccucauccguacggccaccggaaguuuaucacaaugagcgauggggccaccuccacauucgaccuuuuugaaccccuggcugagcauugcguuggagaugacauuaccauggugaucuguccuggcaucgccaaccacucugaaaagcaguauauucgcacauucgucgauuacgcgcagaaaaauggcuauagaugcgccgugcucaaccaucugggggcccuucccaauaucgagcugaccagcccucggauguuuacguacggauguaccugggaguucggcgccaugguuaacuacauuaagaaaacauauccccucacccagcugguggucgugggguuuucccugggaggcaauaucgugugcaaguaccucggggaaacacaagcuaaccaggagaaaguccuguguugcguuagcgugugucagggauauucugcccuucgcgcgcaggaaaccuucaugcaaugggaccagugcagacgguuuuacaauuuccugauggccgauaacaugaagaagauuauccucucccaccgccaggcucuguuuggcgaccacgugaaaaagccgcagagccuugaggauacggaccugucuagacucuauacagccaccucccugaugcaaauugaugacaaugucaugcggaaauuccauggcuacaacagccugaaggaguauuacgaagaggaaucuuguaugcgcuaccuccacagaaucuaugugccucugaugcuuguuaaugcugccgacgauccccuggugcaugagucccuccugacaaucccuaaaagccuuuccgaaaagcgggagaacgucauguucgugcugccccuccacgggggacaccugggcuuuuucgaggggucuguucuguuucccgaaccucucaccuggauggacaaacugguggucgaguacgccaaugcuauuugccagugggaacgcaacaaacuucagugcagcgauaccgagcaaguggaagcggaccuggaguga

SEQ ID NO: 65363 - RNA, 1050 nt, Artificial Sequence
  derived and/or modified sequence opt5 from ABHD5__Homo_sapiens__NP_057090
auggccgcugaggaagaggaaguggacagcgccgauaccggcgagagauccggguggcugacaggauggcuccccacguggugcccuaccucuaucagccaccugaaggaagcggaggagaaaaugcuuaagugugucccgugcacauacaaaaaggaacccguucggauuuccaacggcaauaaaaucuggacccugaaguucucucauaacauuagcaauaagacaccucucgugcugcuucacggguuuggaggcgggcugggacucugggcucugaacuucggcgaccuguguaccaaucgccccguguaugccuuugaucuccugggcuucgggagauccucucggccucgcuuugacagcgaugccgaggaagucgagaaccaguucguggaguccaucgaagaguggagaugcgcucuuggacuggacaaaaugauucuccugggccauaaucuugggggauuucuggccgcugccuacagccucaaguaucccucucggguuaaccaccugauccugguggaaccuuggggcuucccggagcgccccgaucucgcggaccaagauagaccuauccccgucuggauucgggcccugggggcugcccuuacaccuuuuaauccccuggcuggacuccgcaucgccggcccguucggccugucccuugugcagagacugcggccugacuuuaaacgcaaguacagcucuauguucgaagaugacaccguuacggaguauauuuaccauuguaacgugcagacccccuccggggagacagcguuuaaaaauaugaccaucccuuauggaugggccaagagacccaugcuccagcggauuggcaagaugcaccccgauaucccugucagcgugauuuucggggcucgcucuugcaucgacggaaacuccggcacaagcauccaaucccugagaccgcacucuuacgugaaaaccauugccauccugggggcuggacauuacgucuaugccgaccagcccgaagaguucaaucagaagguuaaagaaauuugugauacgguggacuga

SEQ ID NO: 65364 - RNA, 1014 nt, Artificial Sequence
  derived and/or modified sequence opt5 from ABHD6__Homo_sapiens__NP_065727
auggaccuggauguggucaacauguucguuaucgccggcgggacccucgcuauucccauccuggccuuuguggcgagcuuccuucuguggccuuccgcucucauuagaaucuacuauugguacuggcggcgcacacugggaaugcaagugagauauguccaccaugaggacuaccaguuuugcuauucuuuccggggccgcccggggcacaagcccagcauucuuaugcugcauggauuuuccgcccacaaagauauguggcucucugugguuaaguuccugccuaaaaaucugcaucucgugugugucgacaugcccggccacgaagggacgaccagaagcucccuggaugaccuuucuaucgauggacaggugaagcggauccaccaguuuguugagugccugaaacucaacaagaagccuuuccaucuggugggcacaagcaugggcgggcaggucgccggaguguacgcugccuauuaccccuccgacgugagcucucuuugucuggucugcccugcuggccuccaauacuccaccgauaaucaguuuguucagcgccugaaagaacugcaggggagcgccgcgguggagaagauuccgcucauccccucuacaccugaagagauguccgagaugcugcaacuuuguagcuaugugagauucaaagucccccagcagauucugcagggacucguggacguucggaucccucacaacaauuuuuaccgcaagcuguuccuugaaauugugucugagaaauccagauauagccugcaucaaaacauggauaagaucaagguccccacccagauuaucuggggcaaacaggaccaagugcucgauguuuccggggccgacaugcuggcuaagucuaucgccaauugccagguggaacugcucgagaacuguggacacagcgucgugauggagcggccgcgcaaaacagcuaagcugauuaucgacuuucuugccuccguccacaauaccgauaacaauaaaaagcuggacuga

SEQ ID NO: 65365 - RNA, 1446 nt, Artificial Sequence
  derived and/or modified sequence opt5 from ABI1__Homo_sapiens__NP_001012768
auggccgagcugcagaugcuccuggaagaggaaauccccagcggcaagagagcucuuauugaguccuaccaaaaccugacccggguggccgacuauugcgaaaauaacuacauccaggcgacagauaaacgcaaggcucucgaggagacgaaagccuauaccacacagucucuggccagcgucgcuuaccagauuaaugcccuugcuaacaauguucugcaacuccuggacauccaggccucccagcugagacggauggaaucuagcauuaaccacaucucccagaccguggauauccauaaggagaaaguggcgcgcagagaaauugggauccucacaaccaauaagaacacaucucggacccacaagauuaucgccccugcuaauauggagcgcccggucagauauauucggaaacccaucgacuacacggugcuggaugacguuggacauggcgugaaguggcuuaaagccaagcacgggaacaaucaaccugcucgcaccggaacacugagcagaaccaaucccccuacacagaaacccccuuccccgcccaugagcggccgggggacccucggacgcaacacgccuuauaagacacuggagcccgucaagccucccaccgugccgaacgauuacaugacaucuccugccagacuuggcucccagcauagccccggccggaccgcgucucugaaucagcgcccuagaacccacuccgggagcucuggaggcuccgggagccgggaaaacuccggaucuagcuccauuggcauccccaucgccguucccacaccuagcccgcccacgauugggccugcugcccccggaucugcuccuggcucccaauacggcaccaugacaagacagaucagccgccacaacucuaccacaagcuccaccucuagcgggggauaucggagaacgcccuccgugacagcccaguucagcgcccaaccgcaugucaauggcgggccucucuacucucagaacuccauuagcaucgcucccccucccccucccaugccgcagcugaccccucagauuccccugaccggauuuguggcgcgcgugcaagagaauaucgccgacucucccacaccuccgcccccucccccucccgaugacaucccuauguucgaugacuccccgcccccucccccucccccgccugucgauuaugaagacgaggaagcugccguugugcaguacaacgaccccuaugccgauggcgacccugcuugggcccccaaaaauuacauugagaagguggucgcgaucuaugauuacaccaaagacaaggaugacgagcucagcuuuauggaaggggcuauuaucuacgugauuaaaaagaacgaugacggaugguaugagggcguuuguaaucgggugacaggccuguuccccgggaacuacgucgaauccaucaugcacuauacggauuga

SEQ ID NO: 65366 - RNA, 1542 nt, Artificial Sequence
  derived and/or modified sequence opt5 from ABI2__Homo_sapiens__NP_001269854
auggccgagcugcagaugcuccuggaagaggaaauccccggcgggagacgggcucuuuucgacagcuacaccaaccuggagcgcguggccgauuauugcgaaaauaacuacauucaauccgcggacaagcagagagcucucgaggagacaaaagccuauacgacccagucucuggccagcgucgcuuaccuuaucaauacacuggccaacaauguucuccagaugcuggauauucaggcuucccaacugcggcgcauggaaucuagcaucaaccacauuucccagaccguggacauccauaaggagaaaguggccagacgggaaaucggcauucucacaaccaauaagaacacaucucgcacccacaaaaucauugcgccugccaaucuggagagaccgguccgguauauccgcaagcccauugauuacacgauccuugacgauauuggacauggggugaaguggcugcucagauuuaaaguuagcacccagaacaugaagaugggaggccugccucggacaacaccucccacccaaaaaccgcccuccccucccaugagcgggaagggaacccuuggccgccacucucccuauagaacgcuggagcccgugcggccucccgucgugccgaaugacuacguuccuucccccacacgcaacauggcuccuagccagcagucucccgugagaaccgccuccgucaaucagcggaacagaacauacucuagcuccggcagcuccgggggaucucaucccagcucccgcucuagcucccgggaaaauagcggcucugggagcgugggagugccuaucgcugucccgacccccuccccucccucuguuuucccugcccccgcgggcagcgccgggaccccgccucuccccgcuacauccgccagcgcuccugcuccccuggugccugccacggugcccucuuccaccgccccggaugcggccgcuggaggcgcccaaacacuggccgacggcuuuaccagcccuacaccucccgucgugucuuccaccccuccgacggggcaccccguucaguucuauagcaugaacagaccugcuucccgccacacacccccuaccaucggaggcucucuccccuaccggagaccucccagcauuaccucccagacaucucugcaaaaccagaugaaugggggaccguuuuauagccagaacccuguguccgauacacccccucccccgccucccgucgaggaaccuguguucgacgagucucccccucccccgcccccucccgaagauuacgaggaggaagaggccgcgguuguggaauauagcgacccuuacgcugaggaagaucccccuugggccccgcgcuccuaucuugagaaagucguggccaucuacgacuacaccaaggacaaggaggaugaacugagcuuucaggagggcgcuauuaucuaugucauuaaaaagaaugacgaugggugguacgaaggagugaugaacggcguuacgggccucuuccccgggaauuauguggagucuaucaugcauuacuccgaauga

SEQ ID NO: 65367 - RNA, 3228 nt, Artificial Sequence
  derived and/or modified sequence opt5 from ABI3BP__Homo_sapiens__NP_056244
augagaggcgggaagugcaacaugcugagcucccucggaugucugcuucugugcggcucuaucacccucgcccuggggaaugcucagaaacuucccaagggaaaacggccuaaccugaaggugcacauuaauacaacgagcgacuccauccuccugaaauuccugcgcccgucucccaacgucaagcucgagggccugcuucugggguacggaagcaauguuuccccuaaccaauauuuuccccucccugccgaaggcaaguucaccgaggcgauuguggaugcugaacccaaauaccugaucguggucagaccugccccgcccccuucucagaagaaaagcuguuccggcaagacacggagccgcaaaccccuucagcuggugguugggacccucacaccuucuuccguguuucugagcuggggauuccugauuaauccccaucacgacuggacccucccgucucauugcccuaacgauagauuuuauacaauccgguaccgcgagaaggacaaggaaaagaaguggaucuuccagauuugucccgccaccgagacgaucgucgagaaucugaaaccuaacaccguguaugaauuuggcguuaaggauaauguggaagggggaauuugguccaaaaucuucaaccacaagacagucgugggcagcaaaaaggugaaugggaagauucaaucuaccuacgaccaggaucauacaguccccgcuuauguucccagaaaacuuaucccuauuaccaucaucaaacaggugauucagaacgugacgcacaaagacuccgccaagagcccggaaaaagcuccccugggaggcgucauccucgugcaccugauuaucccuggccuuaaugagacaaccguuaagcugcccgccucccucauguuugagauuucugaugcgcugaagacacaacuggccaaaaacgaaacccucgcucugccugccgagagcaagacccccgaaguggagaaaaucuccgcucggccgacaacggucaccccugaaacagugccccgcagcaccaagccuacaaccucuuccgcccuugacguuagcgagacgacacuggcgucuagcgagaaacccuggaucgugccuaccgccaagauuuccgaagauucuaagguccuccagccccagaccgcuacauacgacguguucagcuccccgaccacaagcgaugagccugaaaucucugacuccuacacggccaccagcgaccggauucuggauucuaucccucccaaaacauccagaacccuugagcagccccgcgcuacacuggccccgagcgaaacccccuuugucccucaaaagcucgagauuuucacgucccccgagaugcagccuaccacacccgccccucagcaaaccacaucuauccccagcaccccgaaaagacggccucgccccaagccucccagaacgaaaccggaacggacaaccuccgcugggacaaucaccccuaagauuucuaagagccccgagccuaccuggacaacgcccgcgcccggaaaaacccaguuuaucucccugaagccuaaaauuccgcugagccccgaagugacacauaccaagccugcccccaaacagacaccuagagcucccccuaagccgaaaaccucuccccgcccucggaucccccagacgcaaccuguucccaaggugccgcagagagucacagccaagccuaaaaccucccccagccccgaggugucuuauaccaccccugcccccaaggacguucuccugccucacaaaccguaccccgaagugucccagagcgagccugcuccccuugagacacgcggcauuccuuucauccccaugauuucuccgagcccuucccaggaggagcugcaaacaacgcucgaagagaccgaucagagcacacaggagcccuucaccacaaagaucccucggaccacggaacuggccaaaaccacacaggcgccccauagauuuuauaccacaguccgcccucggaccucugacaagccccacaucagaccgggggugaagcaagcuccucgccccuccggagccgaucggaacgugagcguugacuccacacaccccaccaaaaagccuggcacgagacgcccgccccugccuccccggccuacacaucccagacggaaaccucuuccgcccaauaacgucaccgggaagccuggaucugccggcauuaucagcuccggccccauuaccacaccuccccuccgcucuaccccgagaccuacggggacaccccuggagcggaucgaaaccgauauuaaacagcccacagugccugcuagcggagaggaacuggagaauaucaccgacuucuccucuagccccacaagagagaccgauccucucggcaagccgcgcuuuaaggggccccacgugcgguacauccagaaaccugacaacucccccugcagcauuacggauucugucaagagauucccuaaagaagaggccaccgaaggaaaugcuacauccccgccccagaacccucccaccaaucugacagugguuaccguggagggcuguccuagcuuugucauccuugacugggaaaagccccugaacgacacggugacagaguaugagguuauuucucgcgaaaauggguccuucagcggcaaaaacaagucuauccaaaugaccaaucagacauuuuccaccguggagaaccucaagccuaauaccagcuacgaguuccaggucaaacccaagaacccgcugggagaaggcccuguguccaauacaguugccuuuagcacggaaucugcggaucccagagugagcgagcccgucuccgccgggcgggacgcuauuuggaccgagcgcccuuucaacucugauagcuauuccgaaugcaaaggaaagcaauacgugaaaagaacaugguacaagaaauuugugggcguccagcuguguaacucucuucgguauaagaucuaccucagcgacucccugaccgggaaguucuauaauaucggagaucagcgcggccauggggaggaccacugccaguuuguugauucuuuccuggacggcagaacaggacaacagcucaccagcgaucagcugccgauuaaagaaggcuacuuccgggccgugcgccaggagcccgugcaauuuggggagaucggaggccauacgcagauuaacuauguccagugguacgaaugugggacaaccaucccuggaaagugguga

SEQ ID NO: 65368 - RNA, 1083 nt, Artificial Sequence
  derived and/or modified sequence opt5 from ABI3__Homo_sapiens__NP_001128658
auggccgagcugcagcaacuccaggaauucgagauccccaccggcagagaagcucugcgggggaaccacagcgcccuucugcgcguggcggacuacugcgaggauaauuauguccaggcuacagacaagagaaaagcccucgaagagacgauggccuuuaccacacaggcucuggccuccguugcuuaccaagugggaaaccuugccggccauacccugcggaugcucgaucugcagggggcggcccugcgccagguggaggcuagaauggucaauaugcacauggaaaagguggcccggcgcgagauuggaacacucgcuaccguucagagacugccuccgggccaaaaagugaucgcccccgaaaaccuuccuccccugacaccuuauugucggcgcccccucaauuucgggugccuggacgauauuggacauggcaucaaggaccuuucuacccagcugagcagaacgggcacccucucccggaaaucuauuaaggcgccugccacaccggcuagcgccacccuggggcgccccccuagaauccccgagccuguccaccugcccgugguuccggauggacggcucuccgcugccucuagcgccuccagccuggcuucugcgggcuccgccgagggggugggaggcgcuccuacacccaaggggcaggccgccccucccgcucccccucuuccgagcucucuggaccccccucccccucccgccgcggucgaaguguuucagcgcccgccuacccucgaggaacugucccccccucccccugaugaggaacuuccccugccgcucgaccugccuccccccccuccgcuggauggagacgagcucggccugcccccucccccucccggcuucgggccugaugagcccagcugggugccggcuucuuaccuugaaaaagucguuacgcuguauccuuacacaucccaaaaggacaacgagcucagcuuuuccgaaggaaccgugaucugugugacaagacgguauucugacggcuggugcgagggggucagcuccgaaggaaccggcuucuuucccgggaauuacguggagccuagcuguuga

SEQ ID NO: 65369 - RNA, 3393 nt, Artificial Sequence
  derived and/or modified sequence opt5 from ABL1__Homo_sapiens__NP_005148
augcuggagaucugccucaagcuggugggcuguaaaagcaagaaagggcuuuccucuagcuccucuugcuaccuggaagaggcccuccagagacccgucgcuagcgacuucgaaccucaaggacuguccgaggccgcgcgguggaacucuaaggaaaaucuucuggcuggcccgagcgagaacgaucccaaucucuuuguugcccuguaugacuucguggccuccggggauaacacccugagcauuacaaaaggagagaagcuccgcgugcugggcuacaaucacaacggggaauggugugaggcucagacgaagaauggacagggcugggucccuucuaacuauaucacccccguuaauucccuugaaaaacauagcugguaccacggcccugugucuagaaacgccgcugaguaucugcucuccagcgggauuaauggaucuuuucuggugcgggaguccgaaagcucccccggccagcgcucuaucagccuuagauacgaggggcgggucuaucauuaccgcauuaacacagccuccgacggaaagcuguacgugagcucugaauccagauucaauacccucgcggagcugguucaccaucacagcacaguggccgauggccugaucaccacacuccacuauccugcuccgaaacggaacaagcccaccgucuacggggugucuccuaauuaugacaaaugggaaauggagcgcacggauaucaccaugaagcauaagcugggaggcggccaauacggggagguguaugaaggagucuggaaaaaguacagccuuacaguugccgugaaaacccugaaggaggacacaauggaaguggaggaauuucucaaagaggcugccgucaugaaggagauuaaacaccccaaccuggugcagcuucugggcguuugcaccagagaaccucccuucuauaucauuacggaguuuaugacauacgggaaccuccuggauuaccugcgggaauguaaucgccaggaggugaacgcggucgugcuccuguauauggccacccagaucuccucugcuauggaauaccuugagaagaagaauuucauucauagagaccuggccgcucggaacugccucguuggagagaaucaccuggugaaagucgccgauuuuggccuuagccgccugaugacaggggacaccuauaccgcccacgcuggagcgaaguucccgaucaaauggacagccccugaaucccucgcuuacaacaaguuuagcauuaaaucugaugugugggccuucggcguccugcugugggagaucgccacguauggcaugucccccuacccugggaucgaccucagccaaguguaugaacugcuugagaaggacuacagaauggagcggcccgaaggaugucccgagaagguuuacgaacugaugagagcuugcuggcaguggaauccuucugaucgcccguccuuugccgagauucaucaggcguucgaaaccauguuccaggagagcuccaucucugacgagguggaaaaagagcucggcaagcaagggguccggggagcugugagcacacugcugcaggcccccgaacuuccuaccaaaacaagaaccucccgccgggccgcugagcacagagauacgacagacguucccgaaaugccucauucuaagggccagggggagagcgauccccucgaccacgagccggccguguccccucugcugccccgcaaagaacggggcccucccgagggaggccucaacgaagaugagagacugcuuccuaaggacaagaaaaccaaucuguuuagcgcucucauuaagaaaaagaaaaagaccgcccccacaccgccuaagcggucuuccagcuuccgcgaaauggaugggcaacccgagagacgcggagcgggcgaggaagaggggcgggacaucucuaacggagcccuggcuuuuacaccccuggauaccgccgacccugcuaaauccccgaagcccagcaauggcgccggggucccuaacggcgcgcuuagagaaucuggaggcagcggguuccggagcccccaucucuggaaaaaguccucuacgcugaccuccagccgccuggccacaggagaggaggaaggcgggggauccucuagcaaaagauuucuccgguccuguucugcuagcugcgugccucacggcgccaaggacaccgaguggagauccgugacacugccccgcgaucuucagucuaccgggcggcaguucgacagcuccacguuuggcggacacaaaagcgaaaagccugcucugcccagaaagcgcgccggcgagaauagaucugaucagguuacccgggggacagucaccccgccuccccgccucgugaaaaagaacgaagaggccgcugacgagguguucaaagauauuauggaauccagcccuggaucuuccccgcccaaucugacaccuaagccccugagacggcaagucaccguggcgccugccagcggccuuccccauaaagaggaagcugggaagggaucugcccucggcacgcccgccgcugccgagccuguuacaccgaccuccaaggcggggagcggcgcucccggaggcacauccaaagggccugccgaagagagccgcgugagacggcacaagcauucuagcgagucccccggacgcgacaaaggcaagcugucuagacugaaaccugcucccccuccgcccccugccgccagcgcggggaaggcuggaggcaagcccucccagucuccuagccaggaagccgccggcgaggcuguccucggggccaaaaccaaggcuaccucccugguggaugccguuaacucugacgcggccaaacccagccagccgggagaaggccuuaagaaaccugugcugcccgcuacacccaagccucaauccgccaagcccagcgggacgccuaucucuccggcucccgucccuuccacccuccccagcgccucuuccgcccuggcuggagaucagccuagcuccacagcguuuaucccccugauuucuacccgggugagccuucgcaaaacaagacagccgccugagcggaucgccuccggcgcuauuaccaaggggguugugcucgacagcacggaagcccugugucuggccaucucuagaaacuccgagcagauggcuagccacucugccguccucgaggcgggcaaaaaucuguauacauucugcgugagcuacguggauuccauucaacagaugcgcaacaaguuugcuuuccgggaagccaucaauaaacuugagaacaaucugagagaacuccagaucugccccgccaccgcuggaucuggcccugccgcgacccaggacuuuagcaagcugcuguccucugucaaagagauuagcgauaucguucaacgcuga

SEQ ID NO: 65370 - RNA, 3195 nt, Artificial Sequence
  derived and/or modified sequence opt5 from ABL2__Homo_sapiens__NP_001129472
auggugcugggcaccguccuccugcccccuaacagcuacgggagagaccaggauacaucccuuugcugucugugcacggaggccucugaaagcgcucucccggaccugaccgaucacuucgccuccuguguugaggacggauuugaaggcgauaagacagggggaucuagccccgaggcgcuucaucggccuuauggcugcgacguggaaccccaagcucugaaugaggccauccgcugguccucuaaagagaaccuccugggggccaccgaaagcgauccuaaucuguucguggcucucuacgacuuugucgccuccggagauaacacacugagcauuaccaagggcgagaaacuuagagugcugggcuauaaucagaacggggaauggucugagguucgguccaagaauggacagggcugggugcccagcaacuacaucacaccugucaauucucucgagaaacacuccugguaucaugggccggugagccgcucugcugccgaauaccugcuuuccagccugauuaacggauccuuccucguuagagagucugaaagcucccccggccagcugagcaucucucugcgguaugaggggcgcguguaccacuacagaauuaauaccacggcggacggaaaggucuaugugaccgccgaaucccgguuuagcacacucgcugagcuggugcaucaccacucuaccgucgccgauggccuuguuacaacccugcauuacccugcucccaaguguaacaaaccuacgguguauggcgugagccccauccacgacaagugggagauggaacgcacagauaucaccaugaaacauaagcucgggggaggccaauacggggaggucuaugugggaguuuggaaaaaguacucccugacaguggccgucaagacccuuaaagaagacaccauggagguggaagaguuccugaaggaggcggccguuaugaaagaaauuaagcacccgaaucucgugcagcugcugggcgucugcacacucgagccucccuuuuauaucgugacggaauacaugccuuacgggaaccugcuugacuaucugagagaguguaaucgggaagaggucaccgcugugguucuccuguacauggccacacagauuucuagcgcuauggaguaucuugaaaagaagaacuucauccaccgcgaucuggccgccagaaacugccucgugggagagaaucaugucgugaaaguugcugacuuuggccugucccggcugaugaccggcgauacauacaccgcgcacgccggggcuaaguuccccauuaaguggacggcccccgaaagccucgccuauaacacauuuucuaucaaauccgacgugugggcuuucggaguccugcuuugggagauugccaccuacggcaugagcccuuauccggggaucgaucugucucagguguacgaccuccuggagaagggauaccgcauggaacaacccgagggcuguccucccaaaguguaugaacugaugagagcgugcuggaagugguccccugcugaucggcccagcuuugccgagacccaucaggccuucgaaacaauguuccacgacuccucuaucagcgaggagguugcugaggagcuugggagagccgcuuccucuagcuccgucgugccguaccucccucgccugcccauucugccuagcaaaacccggacacucaagaaacagguggaaaauaaagagaacaucgaaggcgcccaggaugcgacggaaaauucugccuccagccuggcucccggauuuauuagaggcgcccaggcuucuuccgggagcccugcccuuccccgcaagcaacgggacaaaucuccgagcucccugcucgaggaugcgaaggaaaccuguuucacaagagaccgcaaaggaggcuuuuucagcucuuuuaugaagaagcggaacgccccuaccccgcccaaaagauccagcuccuuccgcgagauggaaaaucagccucauaagaaauaugagcugacagggcugccggaacaagaccggauggcuaugacccuucccagaaacugccagcgcucuaagcuccagcuggagcggacggucagcaccuccucucagccugaggaaaauguggauagagccaacgacaugcugcccaaaaagagcgaggaauccgcugccccuucucgggagcgccccaaggccaaacuccugccuagaggagcuacagcgcuuccccugcggaccccgagcggcgaucucgccaucacagagaaggacccucccgggguuggcguggcuggagucgccgccgcuccuaaaggcaaggagaaaaaugggggagccagacugggcauggcgggggugcccgaagauggagaacaaccgggcuggccuucccccgcuaaggccgccccuguucugcccaccacgcacaaccacaaagugcccguccuuauuagcccuacacucaagcauaccccggcugacgugcagcugaucgggacagauucucagggcaauaaguuuaaacugcucuccgagcaccagguuaccagcucuggagacaaggaucgcccccggagagugaaaccuaagugcgcgcccccucccccuccggucaugcgccugcuucaacaucccuccaucuguagcgacccuaccgaggaacccacagcccugacggcuggccagucuaccuccgagacacaggaagggggcaaaaaggccgcccucggagcugugccuauuagcgggaaggccggaagacccgugaugccgccuccccaggucccccugccuaccuccagcaucucucccgcuaaaauggccaacggcacagcggggaccaagguugcccugcggaaaacgaagcaagcugccgagaaaauuagcgcugauaagaucuccaaggaagcccuucucgagugcgccgaccugcugucuagcgcucucacagaaccugugcccaauucccagcugguggauaccggccaccagcuucuggacuacuguucuggauaugucgacugcauuccccagacccgcaacaaauucgcguuuagagaggccgugagcaagcucgagcugucccugcaagaacuucagguuucuagcgcugccgccggcgugccugggacaaaccccguccugaauaaccuccuguccugugugcaggagaucagcgauguugugcaacgguga

SEQ ID NO: 65371 - RNA, 2157 nt, Artificial Sequence
  derived and/or modified sequence opt5 from ABLIM1__Homo_sapiens__NP_001003407
augcuuaugacccucgagaugacagaacugacggacccccaccauaccaugggcgauuacaagguggcccacccucaggacccgcaucaccccagcgagaaaccugucauccauugccacaaguguggggaacccugcaaaggagagguucuuagagugcaaacaaagcacuuccauauuaaauguuuuaccugcaagguguguggcugcgaucuggcucaagggggauucuuuaucaagaacggcgaauaucucuguacacuggacuaccagcggauguaugggacccgcugccacggauguggcgaguucgucgagggcgaagugguuacagcccuugggaaaaccuaccauccuaauugcuuugcguguacgauuugcaagagacccuucccuccgggagaucgggugaccuuuaacggccgcgacugccugugucagcucugcgcucagcccauguccucuagcccuaaagagacaaccuucuccucuaauugugccgggugcggaagagauaucaagaacggccaggcccugcuggcucucgacaaacaguggcaccugggguguuuuaagugcaagagcuguggaaaaguccuuacaggcgaauauauuuccaaggauggcgcccccuacugcgagaaagacuaucaggggcuguucggagugaagugugaggcuugccaccaauuuaucaccggcaaaguucucgaagccggggauaagcauuaccacccuucuugugcgcggugcagccgcugcaaucagauguucacggagggagaagagauguaccugcagggcuccacaguguggcaucccgacuguaaacagagcaccaagacagaagagaaacuuagaccgacccggaccucuuccgagagcaucuauucucgcccuggguccagcauucccggaucuccuggccacacaaucuacgccaaggucgauaacgaaauucuggacuauaaggaccucgcugccauccccaaagugaaggcuauuuacgauaucgagagacccgaccugauuacguaugaaccuuuuuacaccuccggcuaugaugacaaacaagagcggcagagccugggggaauccccgcgcacacucucucccaccccuagcgccgagggauaccaggaugugagagaccggaugauccaucgcuccacaagccaaggcucuaucaauucccccgucuacagcagacacucuuauaccccuacgacaagccggucuccccagcacuuccauagaccggggaacgagccuuccagcggacgcaauagcccccugccuuaccggcccgauuccagaccucuuacccccaccuaugcgcaggccccgaagcacuuccauguuccugaccagggcauuaacaucuaccgcaagccucccauuuauaaacaacacgcugcccuggcugcccagucuaaguccagcgaagauaucauuaaauuuucuaaguuccccgccgcucaggcgccggaccccuccgagacaccuaaaaucgaaaccgaucacuggcccgggccucccagcuuugccguggugggcccugacaugaagcggagauccucuggacgcgaggaagacgaugaggagcuccugcggagacgccagcuucaagaggaacagcugaugaagcucaauagcggccuggggcagcugauccucaaagaagagauggagaaggaaucccgggagagaucuagccugcuugcuucccgcuacgacagccccauuaacucugccucccauaucccgagcucuaaaacagccucccugccuggauauggccggaaugggcuccacagacccgucagcacggauuucgcucaguacaacucuuacggagacgugagcggcgggguucgggauuaucaaacccugccugacggccauaugcccgccaugcgcauggauagaggaguguccaugccgaauaugcuugaaccuaagauuuuucccuacgagaugcugauggucacaaaccggggcagaaacaaaauccuccgcgaaguggaccggaccagacuggagcgccaccuggcgccugagguuuucagagaaauuuuugggaugagcauccaggaguucgaucggcucccccuguggcgcagaaaugacaugaagaagaaagcuaagcuguuuuga

SEQ ID NO: 65372 - RNA, 1938 nt, Artificial Sequence
  derived and/or modified sequence opt5 from ABLIM2__Homo_sapiens__NP_001123555
augagcgccgugucccagccccaagcugccccuucuccgcuggaaaagagccccuccaccgcgauccucugcaacacauguggcaaugucugcaaaggggaaguucugagagugcaggacaaguacuuccacauuaaauguuuugugugcaaggcuuguggaugcgaucuugccgagggcggguucuuuguccggcagggagaauauaucuguacgcuggacuaccagcgccucuauggcaccagaugcuucucuugugaucaauuuauugagggggaagugguuagcgcccugggaaaaacauaccauccugacugcuucgugugugcugucugccggcuucccuuuccucccggcgaucgcgugaccuucaacggcaaggagugcaugugucagaagugcucccugccuguuucuguggggagcuccgcccaccucagccagggacugagaucuuguggcgggugcggaacagagaucaaaaauggccaggcucuggucgcccucgacaagcauuggcaccugggguguuuuaaaugcaaguccuguggaaaacuucugaacgcggaauauauuagcaaggauggccucccguacugcgaggccgacuaucaugcuaaguucggcauccggugugauucuugcgaaaaauacaucaccgggcgcgugcuggaggccggagagaagcacuaccaccccuccugugcucuuugcgugagaugcggccaaauguuugccgaaggggaggaaauguaucugcagggaagcucuauuuggcauccugcgugucggcaggccgcucgcacagaggacagaaauaaagaaacccggacguccagcgaguccaucauuucuguccccgccagcuccaccagcggcucuccuucccgcguuaucuacgcuaagcucgggggagagauucuggauuauagagaccuggccgcccuccccaaaagcaaggcuaucuacgauauugaccggccggacaugaucucuuauagcccuuacaucucccacucugcgggcgaucgccagagcuauggcgaaggggaccaagaugacagauccuacaaacagugccggacaagcucucccuccagcaccggaucugugucccugggcagauacacaccuaccagccgcucuccccagcauuauucccggcccgccgggacggugagcgucggaacauccucuugucuuagccugucccaacacccuagcccgaccucuguguucagacaccauuacauucccuauuuucgcggcuccgagagcgggcggucuacaccuucccucagcguucugucugauagcaagcccccucccuccaccuaccagcaggcuccgagacacuuccaugugccugacaccggcgucaaggauaacaucuaucgcaaacccccuauuuaccggcagcacgccgccagacgcagcgacggagaagauggcucucuugaccaagauaaucggaagcagaaauccagcuggcugaugcucaagggggacgcugacacaagaacgaacucccccgaucuggacacccagucucugagccauuccucuggaacagaucgcgacccucuccagcggauggccggcgauagcuuccacuccagauuucccuauucuaaaagcgacccgcugccugggcacggaaagaauggccuugaucaacggaacgcgaaucuggcucccugcggggccgaccccgaugccuccuggggcaugcgcgaguacaagaucuacccuuaugacagccucauugugaccaacagaauccggguuaaacugccgaaggauguggacagaacacgccuugaacggcaucugucucccgaggaguuccaggaagucuuuggaauguccaucgaggaguucgauagacucgcucuguggaaacgcaaugaccugaagaaaaaggcccuccuguuuuga

SEQ ID NO: 65373 - RNA, 1065 nt, Artificial Sequence
  derived and/or modified sequence opt5 from ABO__Homo_sapiens__NP_065202
auggccgaggugcugagaacccucgcuggcaagcccaagugccacgcccugcggccuaugauccuuuuccugauuaugcucguccugguucuuuuuggguacggagugcugagcccgcgcucccucaugcccggcucucuggaaagaggguucuguauggcggugcgggagccugaccaucugcagcgcgucagccuccccagaaugguguauccucaacccaagguucugacaccuugccggaaagaugugcuugucgugacgccguggcuggcucccaucguuugggaaggaaccuuuaacauugacauccucaaugagcaguuccgccugcagaacacaaccauuggccuuacaguguuugccaucaagaaauacgucgccuuccugaagcucuuucuggaaaccgcugagaagcacuucaugguggggcauagagugcacuauuacgucuuuacagaucagccugccgcuguuccccgggugacccugggaacgggccgccaacucuccgugcuggaggucagagccuauaaacgguggcaggacgugucuaugcgcagaauggaaaugaucagcgauuucugugagcggcgcuuucuuuccgaaguugacuaccuggugugcgucgauguggacauggaguucagagaucauguuggcguggagauucucaccccucuguuugggacacuucaccccggauucuauggcucuagccgggaagcguucaccuacgagagacgcccgcagucccaggccuacaucccuaaggacgaaggggauuuuuauuaccugggaggcuucuuugggggaagcguccaagaggugcagcggcucacaagagcuugucaccaggccaugauggucgaccaggcuaauggcauugaagccguguggcaugaugagucucaccugaacaaauaucugcuccgccauaagcccaccaaaguucuguccccugaguaccuuugggaccaacagcugcucggcuggcccgcggugcugcggaaacuuagauucacggccguccccaagaaucaccaggcugugcgcaacccuuga

SEQ ID NO: 65374 - RNA, 1146 nt, Artificial Sequence
  derived and/or modified sequence opt5 from ABRA__Homo_sapiens__NP_631905
auggcccccggcgagaaggaaagcggggagggaccugcuaaauccgcccugagaaagauccggaccgcgacacucgugauuucucuggcucgcggcuggcagcaaugggccaacgaaaauagcaucagacaggcccaggagccgacgggguggcuucccggaggcacccaggacuccccucaagcucccaaaccuauuacacccccuaccucucaccagaaggcccagagcgcuccgaaaucucccccucggcugcccgaagggcauggagauggccaguccagcgagaaggccccugaggucucccacaucaagaaaaaggaaguuagcaaaacaguggugucuaagaccuacgagcgcggcggggacgucucccaucucagccacagauaugaacgggaugcgggagugcuggagcccggccaaccggagaacgacauugaucgcauccuucauucucacggguccccuacaagacggcgcaaaugcgccaaucugguuagcgaacucaccaagggauggagagugauggagcaggaggaacccacguggcggucugacuccgucgauaccgaagacagcggcuacgggggagaggcugaggaacgcccugagcaggauggcgugcagguugccguggucagaaucaagcggccccugcccucccaagugaaccgcuucacagaaaaacugaauuguaaggcucagcagaaauauucuccugugggcaaccucaaggggagauggcaacagugggccgacgagcacauucagagccagaaacugaauccguuuuccgaagaguucgauuacgagcuugcgaugagcacccggcugcauaagggagacgaaggcuaugggagacccaaagagggaacaaagaccgccgaacgcgcuaagcgggccgaggaacacaucuacagagagaugauggauaugugcuuuauuaucuguacgauggcucgccaucggagagacggcaaaauucaagucacauucggggaccucuuugaucgcuauguucggaucucugacaagguggugggcauucugaugagagcccgcaaacacggacuugucgauuucgagggcgaaaugcuguggcaggggcgggacgaucacgugguuaucacccuccugaaguga

SEQ ID NO: 65375 - RNA, 2442 nt, Artificial Sequence
  derived and/or modified sequence opt5 from ABR__Homo_sapiens__NP_001153218
augcccuacaucgacgagagcccuaccauguccccgcagcugucugccagaagccaaggcgggggagauggcgugucccccacaccucccgaagggcucgcuccuggagucgaggccggcaaggggcuggaaaugcggaaacuuguucugucuggauuccucgcgagcgaggaaauuuauaucaaccagcuggaggcccuucugcuccccaugaagccucugaaagcuacggccaccacaucccagccggugcugaccauucagcaaaucgagacaaucuuuuacaagauucaggacaucuaugaaauucacaaagaguucuacgauaaucucugccccaaggugcagcagugggacucucaagucaccaugggccaucuguuucagaaacuugcuagccagcugggcguguauaaggccuucguugauaacuacaagguggcucucgaaacagccgagaaauguucccagagcaauaaccaauuucagaagaucucugaggaacugaaagucaaggggccuaaggacuccaaagauagccacaccucugugacgauggaggcgcuucuguauaagcccauugaccgcguuaccagauccacacucgugcugcaugaucugcucaaacacaccccugucgaccaucccgauuacccgcugcuucaggacgcccugcggaucagccaaaauuuccucucuuccauuaacgaagauaucgacccucgcagaacagcugugaccacgcccaagggagagacacggcagcuggugaaagacggcuuucuugucgaaguuagcgaguccucucgcaagcugagacacguguuccucuuuaccgaugugcugcugugcgccaaacucaagaagacaagcgcugggaaacaccagcaguacgacuguaagugguauauuccucuggccgaucuugucuuccccucccccgaggaaagcgaggcgucuccucaagugcauccguuucccgaccacgaacuggaggauaugaaaaugaagaucuccgcccucaaaagcgaaauccagaaggagaaggcuaauaaaggacagucucgggccauugagcgccugaagaaaaagauguucgaaaacgaguuucuucugcuccugaauagcccuaccauccccuuccggauucauaacagaaauggcaaauccuaccuguuccuccugucuagcgacuaugaacgcuccgaguggagagaagcuauccagaaacuucaaaagaaggaucugcaggccuuuguucucagcucuguggagcugcagguccugaccggguccugcuucaaacuucggacagugcacaacauuccuguuacgagcaauaaggacgaugacgagucucccggacucuacggcuuucugcacgugaucguccauuccgccaagggcuucaaacagagcgcuaaccuguauuguacccucgaaguggauuccuuuggguacuucgucucuaaggcgaagacacgcguguuuagagacaccgccgagccgaaaugggacgaagaguucgagaucgaacuggagggaagccaaucccuucggauucugugcuaugaaaaguguuacgauaaaacaaagguuaauaaagacaacaacgagaucguggauaagauuaugggcaaagggcagauccagcucgacccucagaccgucgaaacgaagaauuggcacacagaugugauugagaugaacggaaucaagguugaguuuucuaugaaauucaccagcagagacaugucccugaagcgcacccccagcaaaaagcaaacaggcguguuuggggucaaaaucucuguggugaccaagcgggaaagauccaagguuccuuacauuguccgccagugcguggaggaaguggagaaacggggaaucgaagaggucggcauuuauagaaucagcggcguggcuacagauauucaggcccugaaggccguuuucgacgcuaauaacaaagauauccuucucaugcugucugacauggauauuaaugccaucgcggggacgcugaagcucuacuuucgcgagcugcccgaaccucuucugaccgaccggcucuaucccgcuuucauggagggaaucgcccuguccgauccggccgcuaaagaaaacuguaugaugcaucugcuuagaagccucccugaccccaaucugauuacauuccuguuucuccuggagcaccuuaagcgcguggccgaaaaggagcccaucaacaaaaugucucugcauaaucucgcuaccgucuucggcccuacacugcugcggccgagcgagguggaauccaaggcccaccuuaccagcgcggccgacauuuggucucacgauguuauggcucaagugcagguccuccuguacuaucugcagcaucccccuaucuccuuugccgagcucaaaagaaacacgcuguacuucagcaccgacguguga

SEQ ID NO: 65376 - RNA, 819 nt, Artificial Sequence
  derived and/or modified sequence opt5 from ABT1__Homo_sapiens__NP_037507
auggaggccgaagagagcgaaaaggcugccaccgagcaggaaccccuggagggcacagagcaaacgcucgacgcggaagaggaacaggaggaguccgaagaggcugccugcgggucuaaaaagagaguggucccuggaaucguuuaccugggccacauuccgccccgguuccgcccucuucaugugagaaaccugcucagcgccuauggggaagugggacgggucuuuuuccaggcugaggaucgcuuugugagacggaaaaagaaagccgcugccgcggccggcgggaagaagcgcuccuacaccaaagacuauacagaaggauggguugaguucagagauaagcggaucgcuaaacgcguggccgcuucucugcacaauacccccaugggcgccagacggcgcagcccuuuuagauacgaccuuuggaaccugaaguaucuccaucgguucacauggucccaccugucugagcaucuggcguuugaacgccaggucagacggcaaagacuccgcgccgagguggcucaggccaaacgggaaaccgauuucuaccugcagagcguugagagaggccagcgcuuucuugcugccgacggggaucccgcccggccugacggauccuggacauucgcucaaagaccgaccgaacaggagcugcgcgcgcggaaggccgcuagacccggcgggcgcgagcgggccagacucgccacggcucaggauaaggcccgcagcaauaaaggacugcuugcgcggauuuuuggcgcuccucccccuucugaauccauggaggggcccagccuggugagagacucuuga

SEQ ID NO: 65377 - RNA, 996 nt, Artificial Sequence
  derived and/or modified sequence opt5 from ACAA1__Homo_sapiens__NP_001123882
augcagagacugcaagugguccucggccaucugcgggggcccgccgacagcggauggaugccucaggcugccccgugccuuuccggcgcgccccaggcuucugccgccgauguuguggugguccacgggcgcagaaccgcuaucugucgggccggacgcggcggguucaaggacacaacgccugaugagcugcucagcgcugugaugaccgccguucugaaagacgugaaccuuagacccgaacagcugggagauauuugcgucggcaaugugcuccaaccuggcgcgggggccaucauggcucggauugcccaguuucuguccgacauccccgagacaguuccucugucuaccgugaaccgccaguguagcuccggacuccaggcugucgccucuauugcgggcgggaucagaaauggaagcuacgauaucggcauggccugcgggauuacauccgaaaacguggcugagcgguucggaaucagccgcgaaaagcaagacaccuuugcccuggcuucucagcagaaagccgccagagcucaguccaagggcuguuuccaagcggagauugugccggucacaaccacgguucacgaugacaaaggcaccaagcggagcaucacagugacccaggaugaggggauucgccccucuacaaccauggaaggacuugccaagcugaaaccugcuuuuaagaaagacggcuccacgacagccgggcucaccgugagcgaugucgacaucuucgagauuaaugaagccuuugcuucucaggccgcguauugcguggagaagcugagacuucccccugagaaaguuaacccccugggaggcgcuguggcccucgggcauccgcugggauguacaggcgcccggcaagucaucacccugcucaaugaacugaagcgcagaggcaagcgggcuuacggggugguuuccaugugcaucggaaccggcaugggggccgcugccguguucgaguauccuggaaacuga

SEQ ID NO: 65378 - RNA, 1194 nt, Artificial Sequence
  derived and/or modified sequence opt5 from ACAA2__Homo_sapiens__NP_006102
auggcccugcucagaggcguguucgucguugcugccaagcggacccccuuuggggcguacggaggccugcuuaaagacuucacagcuacggaucugagcgaguuugccgccaaggcugcccucuccgcugggaaagugucuccugaaaccguggacagcgucaucaugggaaacgugcugcaguccucuagcgaugccauuuaucuugcgcgccacguuggccugagaguggggaucccgaaggagacacccgcccucaccauuaaucggcugugcggauccggcuuccaaucuaucgucaacggcugucaggaaauuugcgugaaagaggcugaaguugugcugugugggggaacagagagcaugucccaggccccuuacugcguccgcaaugugagauuuggcaccaagcucgggagcgacaucaagcuggaggauucucuuugggugucccugacagaccagcauguccaacuccccauggcuaugaccgccgaaaaccuggcgguuaaacacaagaucagccgggaggaaugugauaaauaugcccuucagucucagcagcgcuggaaggcugccaaugacgcuggauacuucaacgaugagauggccccuauugaggugaaaacgaagaagggcaaacaaaccaugcaaguggacgaacaugccagaccccagacaacccuggagcagcuccagaagcugccuccggucuuuaaaaaggaugggacagugaccgcuggaaaugcguccggcguugccgacggcgcuggggccgugaucauugccagcgaagaugcugucaaaaagcacaacuucacgccccuggcccggaucgugggauauuuuguuucuggcugcgacccuuccauuauggggaucggacccgugccugcgauuagcggcgcucucaaaaaggccgggcugucccuuaaggacauggaucuggucgaggugaaugaagccuucgcuccccaguaccucgccgucgagcgcucucuggaccuugauaucagcaaaacaaacgugaauggaggcgcuaucgcccugggccauccgcucgggggauccggcagcagaauuaccgcgcaccugguucacgagcugcggcgcagagggggaaaguaugccgugggcucugcuuguaucgggggcggacagggcauugccgucaucauucaauccacagcuuga

SEQ ID NO: 65379 - RNA, 7152 nt, Artificial Sequence
  derived and/or modified sequence opt5 from ACACA__Homo_sapiens__NP_942131
augugguggagcacccugauguccauccucagagcccggucuuucuggaaguggauuagcacacagacggugcgcaucauuagagcuguccgggcccacuuuggcgggaucauggacgagcccuccccucuggcgcaaccgcuugaacugaaccagcauucucgcuucauuaucggaagcguuuccgaggauaauucugaagacgagaucagcaaccucgugaaacuggaucuucuggaagagaaggagggcucccucagccccgcuucugugggguccgacacccugagcgaucugggaauuucuucccuccaggacggccuggcccuucacaucagaagcucuauguccgggcugcaucucgucaaacagggacgggaucgcaagaaaauugacagccaaagagauuuuacaguggccuccccugcugaauucguuacccgguuuggcggcaauaaggugaucgagaagguccugauugccaacaaugggaucgcugccgugaaaugcaugcgcucuauuagacgguggagcuacgaaauguuccgcaacgagagagcgauccgguuuguugugauggucacacccgaggaccuuaaggccaaugcugaauauaucaaaauggccgaucacuacgugccugugcccggaggcccuaacaauaacaauuaugcuaacgucgagcugauucucgacaucgccaagcgcauuccgguucaggcggugugggccggguggggacaugcuuccgaaaaucccaaacugccugagcugcuccugaagaacggcaucgccuucauggggcccccuagccaggcuaugugggcccuuggagauaagauugccucuuccaucguggcucagaccgcgggcauccccacacugccguggagcggcucugggcucagagucgacuggcaagaaaaugacuuuagcaaacggauucugaacgugccucaggagcuuuacgagaagggauauguuaaagauguggacgauggccugcaggccgcugaagaggucggguaccccgugaugaucaaggccuccgaaggaggcgggggaaaaggcauuagaaagguuaacaaugccgacgauuucccuaaccucuuucgccaggugcaagcugagguccccggcucucccaucuucgugaugcggcuggccaaacagagcagacaccuggaaguccagauucucgcggaccaauaugggaaugcuaucucccuguuuggacgcgauuguagcgugcagcggagacaccagaagaucauugaggaggccccugccaccaucgcuacgccggccguuuucgaacauauggagcagugcgcugugaagcuugccaaaauggucggcuacgugucugcggggaccguugaauaccuguauucccaagacggaagcuucuacuuucucgagcugaacccccgccuucagguggaacacccuuguacagagauggucgccgaugugaaucugcccgcugcccagcuccagauugcuaugggcaucccucuguaucggauuaaggacaucagaaugauguacggggugucucccuggggcgauuccccgauugacuucgaggacagcgcccauguuccuugcccccgcggacacgucaucgcggcccggaucaccuccgaaaacccugaugagggcuuuaaacccucuagcgggacagugcaagaacugaauuucagauccaacaagaauguguggggauauuuuucugucgcugccgcuggcgggcuccacgaguucgccgacagccaguuuggacauuguuucuccuggggcgagaaccgcgaagaggccauuagcaauauggugguugcucugaaagaacuuucuauccggggggauuuuagaaccacgguggaguaccugauuaagcuccuggaaacagaguccuuccagaugaaccggaucgacaccggcuggcuggaucgccuuauugcggagaagguccaggccgaaagaccugacacaaugcucggagugguuugcggcgcucugcacguggccgaugucagccugcggaauucuguguccaacuuucuccauagccuggagagagggcaaguucuucccgcccacacccugcucaauaccguggacgucgaacugaucuaugagggagugaaauacgugcugaaggucacacgccagucuccgaacagcuacguugugaucaugaacggcuccuguguggaagucgaugugcaucggcuuagcgacgggggacuccugcugucuuaugauggcuccagcuacacgaccuauaugaaagaggagguugacagauaccgcauuacaaucgggaauaagaccugcguguucgaaaaagagaacgauccuuccgucaugagaucucccagcgcuggcaagcucauucaguauaucguggaagacggaggccacguuuuugccgggcaguguuacgcggagauugaagugaugaagauggucaugacacugaccgcuguggaguccggaugcauccacuauguuaaacggcccggcgccgcccuugacccugggugugugcuggcuaagaugcaacucgauaauccgucuaaaguccagcaggccgagcugcauacgggaagccugccccgcauccaauccacagcgcuuagaggcgaaaagcuccaccggguguuccauuacgugcuggacaaccuggucaauguuaugaacggguacugccucccugaucccuucuuuucuagcaaagugaaggacuggguggagcgccugaugaagacccuuagagauccuucccugccccuccuggaacugcaggacauuaugaccagcgucucuggccggaucccucccaauguggagaaauccauuaagaaagagauggcucaguaugccagcaacaucacaucuguucuuugccaguucccgucccaacagauugccaauauccucgauagccacgcugccacccugaaccgcaagucugaaagagagguguuuuucaugaauacacaguccaucguccagcuggugcaacgguaccgcagcggaauuagaggccacaugaaagcuguugugauggaccuccugcggcaguaucuuagagucgaaacgcaguuucagaacgggcauuacgauaaguguguguucgcccugcgcgaggaaaauaaauccgacaugaacaccguccucaauuauaucuuuagccacgcgcaagugacaaagaagaaccugcugguuaccaugcuuauugaucagcugugcggacgggacccuacacucaccgaugagcugcucaacauccugacggagcuuacccagcugucuaaaacaaccaaugccaagguggcucucagagcccgccaaguccugauugcuagccaucugcccuccuacgaacuucggcacaaccagguggagucuaucuuccugagcgccauugacauguauggccaucaguuuuguaucgaaaaucuccagaaacugauccucuccgagacaucuauuuucgacguucugccuaacuuuuucuaccacagcaaucaaguggucagaauggccgcucuugaaguguacgugcgccgggcguauaucgccuacgagcugaacuccguucagcacagacagcucaaggauaauaccugcgucguggaguuucaguucaugcugcccacgucucauccgaaccgcgggaauauuccuacacugaaccggaugagcuucuccagcaaucuuaaccacuauggaaugacccauguggcuucugucuccgacgugcugcucgauaauagcuuuacacccccuugucaaagaaugggcggcaugguuucuuuccggaccuuugaagacuucgugcgcaucuuugaugaggucauggggugcuucuccgacagccccccccaguccccuaccuuuccggaagccggacacacaucucuguacgaugaggacaaagugcccagagaugaaccuauucauauccucaacguugccaucaagacggacugugauauugaggacgaccggcuggcugccauguuccgcgaguuuacccagcagaauaaggcgacacuuguggaucacggcaucagacggcugaccuuccuggucgcucaaaaagacuuuagaaagcaggugaacuaugaaguugaucgccgguuccacagagaguuccccaaauuuuucacauuucgcgcccgggacaaguucgaagaggauagaauuuaccgccaucucgagccugcccuggcuuuucagcuugaacugaaccggaugagaaauuucgaccucaccgccauccccugcgcgaaccacaaaaugcaucuguaucucggggcugccaagguggaggucggaacggaagugacagauuaccgcuuuuucgugagagccauuauccggcacagcgaccuggucaccaaggaggcuuccuuugaauaccuucagaaugagggcgagcgccugcugcucgaagccauggaugagcuggaaguugcuuucaacaauaccaacgugagaacagacuguaaucacaucuuucuuaacuucgugccuaccgucauuauggauccgagcaaaaucgaggaaucugugcgguccaugguuaugcgcuaugggagcagacuguggaagcuccgggugcugcaagccgagcucaaaauuaauaucagacugacacccacgggaaaggcgauuccuauccgccuuuuucugaccaacgagucuggcuacuaucuggacauuagccucuacaaagaagucacagauucccggaccgcccagaucauguuccaggcuuauggcgacaagcaagggccccugcauggaaugcuuaucaauacaccuuacgugaccaaggaccugcuccagucuaaaagauuccaggcccagagccugggcacgaccuauauuuacgauauccccgagauguuucgccaaucccucauuaagcugugggaaucuaugagcacacaggcuuuccuuccguccccuccccugcccagcgacaugcugaccuacacagagcucguucuggaugaccaggggcagcuugugcacaugaaccggcugccuggaggcaaugaaaucgggauggucgccuggaaaaugaccuuuaagucucccgaguauccugagggaagagauauuaucgugaucggcaacgacauuacauaccggaucggcuccuucgggccgcaagaagaucuccuguuucugcgcgccagcgagcucgcuagagcggaaggaauuccccggaucuaugucuccgccaauucuggcgcucgcauugggcuugccgaggagaucagacauauguuccacguggccuggguugacccugaagaucccuacaaaggauaucgguaccuguaucugaccccucaggacuacaagcgcgugagcgcucucaacuccgugcauugcgagcacgucgaagaugagggcgaaucuagauacaaaaucacggacauuaucgggaaggaggagggaauuggccccgaaaaucugcggggcagcgggaugaucgccggagaguccagccuugcguauaacgaaauuaucacaauuucucugguuaccugucgcgcuaucggcaucggggccuaccucgugagacugggacagcggaccauucagguggagaacucccaccugauccucacaggcgccggggcucuuaauaagguccugggaagagaaguguauaccagcaacaaucaacugggcggcauucagaucaugcauaacaaugggguuacgcacugcacagugugcgaugacuuugagggagucuucaccgugcuccauuggcugucuuacaugccgaaauccguccacagcucugugccucuucugaacagcaaggaccccauugaucgcaucaucgaguuuguuccuacaaaaacccccuaugacccucgguggaugcucgccggcagaccccacccgacacagaaggggcaauggcuguccggauucuuugauuacggcucuuucagcgaaauuaugcagccuugggcgcagaccguggucguggggcgcgcccggcugggaggcauccccguuggcguggucgcuguggagacgagaaccguggaacucuccauucccgccgacccugcuaaucuugauagcgaggccaaaaucauucagcaagcugggcagguuugguuuccggacuccgccuucaagacauaucaggcgaucaaggauuucaaccgcgaaggacugccccugauggucuuugccaauuggcggggcuucucugggggaaugaaagacauguacgaucaggugcucaaguuuggcgcuuacaucguggacgggcugagagaguguugccaaccuguccuuguuuauauucccccucaggccgagcugcgcggaggcagcuggguggugaucgauuccucuauuaacccccggcauauggaaauguacgcugacagagagagccgcggcuccguccucgaaccugaggggaccguggagaucaaauuccggagaaaggaccugguuaaaacaaugcgcagaguggauccggucuauauucaccuggccgaacggcucggaacccccgagcuuucuacggccgaacgcaaggagcuggaaaauaagcugaaagagagagaggaauuucucaucccuauuuaccaucagguggcuguucaguucgcggaccugcacgauacacccggccggaugcaagagaagggggugaucagcgacauccuugauuggaaaaccuccagaacauuuuucuauuggcggcugcgcagacuccugcuggaagaccucgucaagaaaaagauucauaacgccaauccugagcuuaccgauggacagauccaggcuaugcugcggcgcugguuuguggaaguggagggcaccgucaaggccuacguuugggacaacaauaaagaucuggccgaguggcucgaaaagcagcugacagaggaagacggggugcacagcgugauugaggaaaacaucaaauguauuucuagagauuauguccuuaagcaaauccggucccuggugcaggcuaaccccgagguugccauggacagcaucauucacaugacgcagcauaucucuccgacccaacgcgcggaggugauuagaauccucuccacaauggauagcccuucuaccuga

SEQ ID NO: 65380 - RNA, 7377 nt, Artificial Sequence
  derived and/or modified sequence opt5 from ACACB__Homo_sapiens__XP_011536564
augguccugcuccugugccuuagcugucugaucuucuccugccucaccuuuucuuggcugaagauuuggggcaagaugacagacagcaagcccaucacgaaauccaagucugaggccaaccuuauuccuagccaggaaccguuccccgcuuccgauaauucuggggagaccccucaaagaaacggcgaaggccacacacugcccaaaaccccuagccaggccgagcccgcgucccacaaggggccuaaggacgcuggacggcgcagaaauagccucccgcccucucaccagaaaccuccccggaacccucuguccagcucugaugccgcccccuccccggaacugcaggcuaauggcacagggacccaaggacucgaggccacagacaccaacggccuguccucuagcgcucgcccucagggccagcaggccgggagccccuccaaggaggauaaaaagcaagcgaauaucaaaagacagcuuaugacgaacuuuauucugggaucuuucgacgauuacagcuccgacgaagauagcgucgccggaucuucccgggagagcacccgcaaggggucuagagcuagccucggagcccugucccuugaggcuuaucugacaaccggcgaggccgagacacggguuccuaccaugcgccccucuaugagcgggcuccaucuggugaagagaggacgggaacacaaaaagcuggaccuccaucgcgauuuuacgguggcgucccccgccgaguucgucacaagauuuggcggcgaccgggugaucgaaaaaguucugaucgcuaauaacgggauugccgcugugaaguguaugcgcagcaucagacggugggccuacgagauguucagaaaugaacgcgccauucgguuugucgugaugguuaccccugaggaucuuaaagcuaacgcggaguauaucaagauggccgaccacuacgugccgguccccggaggcccuaauaacaauaacuaugcuaacguggaacugauuguggacaucgccaaaagaaucccgguccaggccguuugggcuggguggggacacgccucugagaauccuaagcuccccgaacugcuuugcaagaacggcguggcguuccuggggccgccuuccgaggcuaugugggcccucggagauaaaaucgccagcacaguggucgcucagacccugcaagugcccacccugccuuggucuggcuccggccucacaguugaauggacggaggacgaucugcagcaggggaagcgcaucagcgugcccgaggacgucuacgauaaaggaugugugaaggacguugaugaaggccuugaggccgcugaacggauuggguuuccucugaugaucaaagccuccgagggaggcgggggcaagggaauuagaaaggcggaaucugccgaggacuuccccauccucuuucgccaagugcagagcgagauuccgggcuccccuaucuuccugaugaaacuugcucagcaugcccggcaccuggaaguccagauccucgcugaucaauaugggaaugccgugucucuguucggaagagacugcagcauucagcgccggcaucagaagaucgucgaggaagcgcccgccaccauugcuccccuggccaucuuugaguucauggagcagugugcuauuagacucgccaaaacagugggcuacguuuccgccgggaccguggaauaccuguauagccaagauggaucuuuucacuuccuugagcugaacccucgccuccaggucgaacacccgugcacagagaugaucgcugacgugaaucugcccgcggcccagcugcagaucgcuaugggcguuccucuucaucggcucaaggacauuagacugcuguacggggaaucccccuggggcgugaccccuaucagcuuugagacgcccucuaacccuccccucgcccggggacacgucauugccgcucgcaucacauccgagaauccggaugaaggcuucaaaccuagcucugggaccgugcaagagcugaacuuuagaagcuccaagaauguguggggauauuucagcguugccgcgaccggcgggcuucaugaauuugcugacucucaguucggacacuguuuuuccuggggcgagaaccgggaagaggccauuagcaauauggucguggcccugaaggagcucuccaucagaggggauuuccgcacaaccguggaauaccugauuaaccugcuugagacagaaucuuuucagaauaacgacaucgauacgggcuggcucgacuaucugaucgcugagaaaguccaggccgaaaagcccgauauuaugcugggagugguuugcggcgcgcucaauguggcugacgccauguuccggaccuguaugacagauuuccugcauagccuugagagagggcaaguccugccugccgacucccuccugaaccugguggauguugagcuuaucuacggaggcgugaaauauauucucaaggucgcucgccagucucugaccauguuugugcugaucaugaacgggugccacauugaaaucgacgcccacagacucaaugauggaggccugcuucugagcuacaacggaaauuccuacacaaccuauaugaaagaggaaguugacucuuaccggaucacgauuggcaacaagaccugcguguucgagaaggagaaugaccccacaguccuccgcagcccguccgcuggaaaacugacccaguauacaguggaagauggcgggcauguggaggccggaagcucuuacgcggaaauggaggucaugaagaugaucaugacccugaacguucaagaaagaggccgggugaaauauauuaagcgcccuggggccgugcuugaggcuggaugugucguggccagacucgagcuggacgaucccuccaaaguucacccugcugaacccuuuacgggcgagcugcccgcccagcagacacucccuauccugggcgaaaaacuucaucagguguuccacagcguccuggagaaucucaccaacgugaugucuggguuuugccugccggaacccguuuucuccauuaaacugaaggagugggugcaaaaacuuaugaugacacugcggcacccuagccucccccugcucgagcugcaggaaaucaugaccucugucgccggacgcaucccugcucccguggagaaguccguuagacgggugauggcgcaguacgccagcaauauuaccuccguccuuugucaguuuccuagccaacagaucgcuacaauucuggacugccaugccgccacgcuccagcgcaaggcugauagagaaguguucuuuaucaacacccagucuauugugcaacugguccagcgguauagaagcggcauccgcggguacaugaaaacaguugugcuggaccuucugcggagauaccuccgcguggagcaccauuuccagcaagcccacuaugauaagugugucaucaaucugcgggaacaguuuaaaccggacaugucccaggugcucgauugcauuuucucucaugcgcagguugcuaagaagaaccaacuggugaucaugcuuauugacgagcuguguggacccgauccuagccucuccgacgagcugaucucuauucugaaugaacuuacccagcugagcaaauccgagcacugcaaggucgcccucagagcccgccagauccugauugcuucucaccuccccagcuacgaacugcggcauaaccagguggaguccaucuuucuuagcgccaucgauauguauggccaccaauucuguccugagaaucugaaaaagcugauucucucugaaacaaccaucuucgacguucugcccacguuuuucuaccaugcgaacaaaguggucugcauggcuucccuugagguguaugucagacgcggguacauugccuaugaacugaacagccuccagcaccggcagcugccggacggaacaugugugguugaguuucaguucaugcucccuucuucccaucccaauagaaugaccgugcccaucagcauuaccaacccugaucugcuucggcacuccacagaacuguuuauggacucuggcuucagcccccugugccaacgcaugggcgccauggucgcuuuuagacgguucgaggauuuuacccgcaauuucgacgaggugaucuccugcuuugccaacguuccuaaggauacaccccucuucagcgaagcuagaacgucucuguacuccgaggacgauuguaagagccuucgggaagaacccauccacauucugaaugugucuauccagugcgccgaccaucucgaagaugaggcgcuggucccuauucucagaaccuucgugcagagcaaaaagaacauccugguggacuacgggcuucgccggauuacauuucugaucgcccaggagaaagaguuccccaaguuuuucaccuuuagagcucgcgaugaguucgccgaagaccggaucuauagacaccuggagccugcucucgccuuucaacuggaacuuaaucgcaugcggaacuucgaccugacagccguucccugugcuaaucauaaaaugcaccucuaccugggagcggccaaggucaaggagggcguggaggugaccgaucacagauuuuucauucgcgcuaucauuagacauuccgaccucaucacgaaagaagccucuuuugaguaucugcagaacgaaggggagcggcuucugcuggaggccauggaugaacucgaggucgcuuucaauaacaccagcgugcgcacagacugcaaucacauuuuucugaacuucguuccgaccgugaucauggauccuuucaagauugaagaguccgucagauacauggugaugcgguauggaucucgccuuuggaaacugagaguucuccaggccgaagugaagaucaauauccggcaaacaaccacaggcagcgcgguccccauuagacuguuuaucaccaacgaguccggguacuaucuggacauuagccucuacaaagaggugacggauucucgcuccggaaacaucauguuccauagcuuuggcaauaagcagggcccucagcacgggaugcuuauuaacacacccuacguuaccaaagaccugcugcaggcuaagcgguuccaagcccagacccucggaacaaccuauaucuacgauuuuccugaaauguucagacaggcccuguuuaaacuuuggggcucccccgacaaauauccgaaggauauccugacguacacagagcucgugcuggacucucaggggcaacuggucgaaaugaaucgccucccuggaggcaacgagguggggaugguggcuuucaaaaugcgguuuaagacccaggaauaucccgagggaagagaugucauuguuaucggcaaugacauuacauuccggaucggcagcuuugggcccggagaggaccuucuguaccugcgcgccuccgaaauggcgagagccgagggcauuccuaaaaucuauguggcugccaacucuggggcucggaucggaauggccgaagagauuaagcauauguuccacguggcuugggucgauccggaagacccccacaagggcuuuaaauaccucuaccugaccccucaggauuauacacgcaucagcucccuuaauagcgugcauuguaagcacauugaggaaggcggggaaucuagauacaugaucaccgacauuaucgggaaagaugacggccuggggguugagaaccuccggggauccggcaugauugccggggaaagcucucuggcguaugaggagaucgugacgaucucccuggugaccugccgcgccauuggaaucggcgcuuaccucgugagacuugggcagcggguuauucaaguggaaaauagccauaucauucugacaggagccucugcucugaacaagguccucggccgcgagguguauaccagcaauaaccagcugggcgggguccagaucaugcacuacaauggagugucccacaucacaguucccgaugacuucgaaggcguguauaccauucuugaguggcugucuuacaugccuaaagauaaccauagccccgugccuaucauuacgccgacagaccccaucgauagagaaauugaguuccucccuucccgggcccccuacgacccuagauggaugcuggccgggcgcccccacccgacccugaagggaacauggcaaagcggcuuuuucgaucauggguccuuuaaggagaucauggcuccuugggcgcagaccgucguuaccggacgggccagacucggcggcauccccgugggggugauugcugucgaaacacgcacgguggagguugccgugcccgccgacccugcuaaucuugacucugaagccaaaaucauucagcaggcgggacaagucugguuccccgauagcgccuauaagaccgcucaggccgugaaagacuuuaaccgggagaagcugccucugaugaucuucgcuaauuggagaggcuuuuccgggggaaugaaagauauguacgaccagguccucaaguucggcgccuauauuguggaugggcugcgccaguacaagcaaccgauccuuauuuauauucccccuuacgcggaacugcggggcggaucuuggguugugaucgacgccacaauuaacccccucuguaucgagauguaugcugauaaagagagcagaggcgggguccuggaaccugagggaaccguggaaauuaaguuucgcaaaaaggaccugaucaaauccaugcggagaauugaucccgccuacaagaagcucauggagcagcuuggcgaaccggaccugucugauaaagaccgcaaggaccuggaggggcggcucaaagcuagagaggaucugcuucugccuaucuaccaccagguugccgugcaguucgcugacuuucaugauacacccggacgcaugcucgaaaagggcgucaucagcgacauucuggaguggaaaaccgccagaacguuccuguauuggcggcuccgcagacuucugcuggaagaucaagugaagcaggagauccuccaggcguccggggagcugagccacgugcacauucagucuaugcuucggagaugguuuguugaaacagagggcgccgucaaggcuuaccugugggacaacaaucaaguggugguccaguggcucgaacagcauuggcaagccggagauggcccucgguccaccauccgcgagaacauuaccuaucugaagcacgacagcguucugaagacaaucagagggcucguggaagagaaucccgagguggcugucgauugcgugaucuaccuuucucagcauauuuccccugccgaacgggcccagguugugcaucugcugagcaccauggacucucccgcguccacauga

SEQ ID NO: 65381 - RNA, 3273 nt, Artificial Sequence
  derived and/or modified sequence opt5 from ACAD10__Homo_sapiens__NP_001130010
augugcgugagaagcuguuuccaguccccucggcugcaaugggucuggcgcaccgccuuucucaagcacacacagagacggcaucagggcucucaccgcuggacgcaucuugggggaagcaccuacagagcuguuaucuucgacaugggcggggugcuuauucccuccccgggacggguggccgcggagugggaaguccagaaccgcauccccucuggcacaauucugaaagcucucauggaagggggagaaaauggcccuuggaugagauuuaugcgggccgagaucaccgccgaaggcuuccugcgcgaguuugggagacuuugcagcgagaugcugaagacauccgugcccguugauucuuucuuuagccuccugaccuccgaacggguggcuaaacaauucccugucaugacagaggccauuacccagauccgcgcuaagggacugcagacggccgugcucagcaacaauuuuuaucugcccaaccagaaaucuuuccuuccucuggacagaaagcaauuugauguuaucguggaauccuguauggagggcauuugcaagccggacccccggaucuacaaacucugucuggagcagcuugggcugcagccuagcgaaucuauuuuccucgaugaccugggaaccaaucugaaggaggcggcccgccucggcauccacacaauuaaaagacagggguuugcuguccugcccaagcugguguccaacagcugggcccaagcuaucuauccucccuacccgccuaaagugguccggcugcagguuaaugaucccgaaaccgccgugaaggagcucgaagcgcugcuuggauucacacugagagugggcgucccuaacacccgccccgugaagaaaacgauggagauucccaaggacucucuccagaaauaucugaaggaucugcucggcauccaaacaaccgggccucuggagcuucugcaguucgaccauggacaguccaauccgacauacuauauccggcucgccaacagagaucugguucuucgcaaaaagcccccuggcacccugcuccccagcgcucacgccauugaacgggaguuuagaaucaugaaagcucuggccaaugccggggugccuguccccaacgugcuggaccucugcgaagauuccucuguuauuggaaccccguucuacgugauggaguacuguccuggccugaucuauaaggaccccagccuuccugggcuggaacccucccaccgccgggcuauuuacacagcgaugaauacgguccucugcaagauccauagcguggaccugcaggccgucggacuggaggauuauggcaaacaaggcgacuacaucccuagacaggugcgcaccuggguuaagcaguaucgggcuucugagacauccaccauucccgccauggaaagacuuaucgaguggcucccgcugcaucugccucgccagcaacggacaaccgugguccacggggauuuuagacucgacaaccugguguuccaccccgaggagcccgaaguucuugccgugcuggauugggagcucagcacgcugggagacccucuggcugaugucgccuacucuugucuugcgcacuaucucccgagcuccuuucccgugcugcggggcauuaaugacugcgaucugacacagcucgggaucccugcugccgaggaauacuuccgcauguacugucugcagaugggacuucccccuaccgagaacuggaacuuuuauauggccuucagcuuuuucagaguggcugccauucugcagggcguuuacaaacggagccucaccgggcaggcuuccagcacauaugccgaacaaaccggcaagcugacagaguuugucucuaaucuggcgugggacuucgccgugaaagagggauuuagaguguucaaggaaaugcccuucacgaacccucuuacccgcuccuaccauacaugggcucggccccagagccaguggugcccgaccggcucuagauccuauagcuccgucccugaggccucucccgcucacacaagccgcgggggacucgugaucuccccugaaucucugucucccccgguuagagagcuguaccaucggcucaagcacuuuauggaacaacgcguguauccugccgagcccgagcugcagucccaucaggcgagcgccgcuagauggucuccuagcccccuuaucgaagaucugaaagagaaggccaaagcugaaggccucuggaaucuguuccugccccuugaggccgacccugaaaagaaauacggggccggacucaccaacgucgaguacgcucaccugugcgagcugaugggcacgucccucuaugcgccggaaguguguaauugcucugcccccgacaccgggaacauggagcugcuuguucgguacggcacagaagcucaaaaggcccgcuggcugauuccucuccuggagggaaaggccagauccuguuuugcuaugaccgaaccccagguggccagcucugaugcgacaaauaucgaggcuagcauucgggaggaagacuccuucuaugucaucaacggccacaaaugguggauuaccgggauccuggauccucgcugccagcuuuguguguuuaugggaaagacggacccccaugccccuagacaccggcagcaaagcguucugcucgugccgauggauacacccggcauuaaaaucauccgcccucugaccgucuacgggcucgaggacgcccccggaggccauggggaagugagauucgagcacgugcgggucccuaaggagaauaugguucugggccccggaagaggcuuugaaauugcucaggggcgccuuggaccgggccggauccaccauugcaugagacugauuggguucucugagcgcgcccucgcgcugaugaaagcucgggugaaguccagacuggccuuuggaaagccucuuguggaacagggcacaguccuggccgauaucgcucagagccgcguggagauugaacaagcccggcuccugguucucagagcugcccaccugauggaccuugcggggaacaaagccgcugcccuggauaucgcuaugaucaagaugguggcccccuccauggccucucgcgucauugaccgggcuauccaggcguucggcgccgcuggacucagcuccgauuauccccuggcccaguuuuucaccugggccagagcucugcgguuugccgacggcccugaugaggugcaucgcgcgaccguugcuaaacuugagcugaagcacagaauuuga

SEQ ID NO: 65382 - RNA, 1248 nt, Artificial Sequence
  derived and/or modified sequence opt5 from ACAD8__Homo_sapiens__NP_055199
augcuguggagcggcugcagacgguucggggcccgccucggaugucugcccggcgggcuuagagugcugguccagaccggacaccggucccucacaucuugcaucgacccuagcaugggccugaacgaggaacaaaaggaguuucagaaaguugcuuucgauuuugccgcgcgcgaaauggcuccgaauauggccgagugggaccagaaggaacuuuuccccguggaugugaugagaaaagccgcucagcugggguuuggaggcgucuacauucaaacggacgugggcggguccggacucucucggcuggauaccagcguuaucuucgaggcccuggcuacaggcuguaccuccacaaccgccuauauuucuauccauaacaugugcgcguggaugauugacagcuuugggaaugaggaacagcgccacaaguucuguccuccccucugcacaauggagaaauuugccuccuacugucugaccgaaccuggaagcggcucugaugcugccucccuucugacgagcgcuaagaagcagggggaccauuauauccucaacggaucuaaagccuucaucuccggcgcgggcgagagcgauauuuacguggucaugugcagaaccgggggacccggcccuaaggggaucucuuguauugugguugagaaaggaacaccgggccuguccuuugggaagaaagaaaagaaggugggauggaauagccagcccacccgggccgucaucuucgaggacugcgcugugccuguggccaaccgcauuggcuccgaaggccaaggguuucuuaucgcugucagaggacugaauggcgggcggauuaacaucgccucuuguagccucggagccgcucacgcguccguuauccugacacgcgaucaucugaaugugagaaaacaguucggcgagccccucgccagcaaccaguaucugcaguucacccuugcugacauggccacgcggcugguggccgcucgccucauggucagaaaugccgcgguggcucugcaagaggaacggaaggaugccguugcccuuugcucuauggcuaaacuguuugccacagacgagugcuucgcuauuuguaaccaggcccuccagaugcacgggggcuacggauaucugaaggacuacgcggugcaacaguacgucagagauucccgcgugcaccagauccuggaaggcagcaaugagguuaugcggauucucaucucuagaagccugcuucaggaauga

SEQ ID NO: 65383 - RNA, 1866 nt, Artificial Sequence
  derived and/or modified sequence opt5 from ACAD9__Homo_sapiens__NP_054768
augagcggcugcgggcuguuccucagaaccacagccgcugcccgggcgugucgcggacugguggucuccacggcuaacagacggcuucugcgcaccucucccccuguuagagccuuugccaaggaacucuuccugggcaaaaucaagaaaaaggaaguguuuccguuccccgaggugagccaggacgaacuuaaugagauuaaccaauuucuggggccugucgaaaaauucuuuacagaggagguggauucccggaagaucgaccaggaaggaaagauucccgaugagacccucgaaaaacugaagucucugggccucuucgggcugcagguuccugaggaguacggaggccuuggcuuuagcaauacaauguauucccgccugggggaaaucauuucuauggacggaagcaucaccgugacacucgcugcccaccaggcuaucggccugaaagggauuauccuugccggaaccgaggaacaaaaggcgaaauaccugcccaagcucgccuccggcgagcauauugcugccuucugccugacggaaccugcuagcgggucugaugccgcguccaucagaagccgggccacccugucugaggacaagaaacacuauauucucaacggauccaaggucuggaucacaaauggcggccuggcuaacauuuuuaccguguucgccaaaacagagguuguggauagcgacgggucugucaaggauaaaaucaccgcuuuuaucguggaacgcgacuucggaggcgugacgaaugggaagccggaggauaaacuuggaauuagaggcuccaacacaugugaaguccauuucgagaauaccaagauccccguugaaaacauucugggggaggugggagacggcuuuaagguggccaugaauauccucaacagcggccgguucuccauggggucugucguggccggacugcuuaaacgccugauugagaugacagcugaauacgcgugcaccagaaagcaguuuaauaaacggcucagcgaguucggccugauccaggaaaaguuugcccugauggcucagaaagccuauguuauggaguccaugaccuaccucacagccgggaugcuggaucaaccuggauuccccgacuguagcaucgaagcugccauggugaaggucuuuucuuccgaggcggcuuggcagugcgugagcgaggcccuucagauucugggcgggcucggcuauacgcgcgacuacccuuacgaaagaauccugcgggauacccgcauucuucugaucuucgagggaacaaacgaaauucucagaauguauaucgcccugaccggccugcagcacgcugggcggauccucacaacccgcauucaugagcugaagcaagccaaaguuucuacggugauggacacagucggaagacggcuuagagauagccugggccgcaccguggaccucgggcugaccggaaaucacggcgucgugcaccccucccuggcugauucugccaacaaguuugaggaaaacacauacuguuucgggcggaccguugagacacuucuccugagauuuggcaaaacgaucauggaggagcagcuggugcucaagcgcgucgcgaauauucugaucaaccuuuauggaaugaccgccgugcugagccgggcuuccagaagcauucgcaucggccuccggaaucaugaccacgaaguucugcuggccaacacauucugcguggaggcuuaccuucagaaucucuuuucucugucccaacuggauaaauaugccccggagaaccucgacgaacagauuaagaaggucagccagcagauccuggagaaaagagcguacaucugugcccauccucuugaucggaccugcuga

SEQ ID NO: 65384 - RNA, 1293 nt, Artificial Sequence
  derived and/or modified sequence opt5 from ACADL__Homo_sapiens__NP_001599
auggccgcuagacugcuccggggcagccugcgcgugcuugggggacacagagcuccccggcagcugccugcggcucgcugcucccauucuggcggggaggaaagacucgagaccccgagcgccaagaaacugacagacaucggcauucggcgcaucuucucccccgaacacgauauuuuuagaaagucuguccggaaauucuuucaagaggaaguuaucccucaucacagcgagugggagaaggccggagaagugucccgcgaggugugggaaaaagcugggaagcagggacuucugggcgucaacauugccgagcaucucggcgggaucggaggcgaccuguacucugcugccaucgugugggaggaacaggcguauagcaauuguuccgggcccggauucagcauucacucuggcaucguuauguccuacauuacgaaccacgggagcgaggaacagaucaagcauuuuauuccucaaaugaccgccggaaaaugcaucggcgcuauugccaugacagagcccggcgcugggucugaucugcagggaaucaagaccaaugccaaaaaggacggcuccgauuggauccucaacgggagcaaaguguucauuucuaauggaucccugagcgacgucgugaucguuguggcggucacaaaccacgaagccccuuccccggcucauggcauuucucuuuuucugguggagaaugggaugaagggauucaucaagggcagaaaacuccacaagaugggccugaaagcccaggauaccgcugagcuguuuuucgaagacauucggcuucccgccagcgcccuccugggggaggaaaacaagggauuuuauuacaucaugaaagagcugccucaggaacgccuccugaucgcugauguggcgauuuccgccagcgaguucauguuugaggaaacaagaaauuaugucaagcaacggaaagccuucggcaagaccguugcccaccuucagacggugcagcauaagcuggccgagcucaaaacccacaucugugugacacgcgcuuucgucgacaacugccugcagcuucaugaagccaagagacuggauucugcgaccgcuuguauggccaaauacugggccuccgagcuccaaaauagcguggcuuaugacugcguucagcugcacgggggauggggcuacaugugggaauaccccauugccaaggcuuauguggaugcccggguccagccuaucuacgggggcacaaacgagauuaugaaagagcugaucgcgagagaaaucguguuugacaaguga

SEQ ID NO: 65385 - RNA, 1299 nt, Artificial Sequence
  derived and/or modified sequence opt5 from ACADSB__Homo_sapiens__NP_001600
auggagggccuggccgugagacuccugcgggggagccgccuucugagacggaacuuccuuaccugccuguccucuuggaagauucccccucacgucagcaaauccucucagagcgaagcucuccugaauaucacaaacaauggaauccauuuugccccgcuccaaacguucaccgacgaggaaaugaugauuaaguccucuguuaaaaaguuugcgcaggagcagaucgcuccccuggugagcacaauggaugaaaacuccaaaauggaaaagagcgugauucagggccuguuccaacaggggcucaugggaaucgaggucgacccugaguacggcgggaccggagccucuuuucuguccacagugcuuguuaucgaggaacuggccaagguggaugcuagcgucgccguguucugugagauucagaauacccucaucaacacacugauucgcaaacacggcaccgaggaacagaaggcuacguaucuuccccaacugaccacagagaaaguuggcucuuuuugccucuccgaagccggggcgggaagcgacucuuucgcccugaagaccagagcugauaaagagggcgacuacuaugugcugaauggguccaagauguggaucagcuccgccgaacaugcuggacucuuucuggucauggccaacguggauccuacaauuggcuacaaggggaucaccucuuuccuuguggaccgggauacgcccggacugcacauuggcaaaccugagaauaagcucggccugcgcgcgagcuccacauguccgcuuaccuuugagaacgucaaaguucccgaagccaauauccuggggcagaucggacauggcuauaaguacgcuauugggagccucaacgagggaagaaucggcauugccgcucagaugcuggggcuggcccagggaugcuucgacuauacaaucccuuacauuaaagaacggauccaauuuggcaagcgccucuucgauuuccagggccugcagcaccaaguggcccacguggcuacccagcuugaggcggccagacugcucaccuacaaugcugcccggcugcuugaagccgggaaacccuuuaucaaggaggcuucuauggccaaguauuacgcguccgagauugcuggacagacaacgagcaaauguaucgaauggaugggcggggucggauauaccaaggacuacccuguggagaaauauuuccgcgaugccaagauuggcacaaucuacgaaggggccucuaacauucagcugaauaccaucgcuaaacauaucgacgccgaguauuga

SEQ ID NO: 65386 - RNA, 1239 nt, Artificial Sequence
  derived and/or modified sequence opt5 from ACADS__Homo_sapiens__NP_000008
auggccgcugcccugcucgcgagagcuagcggccccgcccggcgcgcccugugcccuagagcuuggcggcagcuucacaccaucuaccaauccguggagcugccggaaacacaucagaugcuccugcagacgugucgcgacuucgccgagaaggaacuuuuucccauugcugcccaggucgauaaagagcaccuguucccugcggcccaaguuaagaaaaugggagggcucggccugcuggcuauggacgugcccgaggaacucgggggagccggccuggauuaucuugcuuacgccaucgcgauggaggaaauuucuagagggugcgccagcaccggagugaucauguccgucaacaauucucuguaucucggcccuauucugaaguuuggcagcaaagagcagaagcaggcuugggugacacccuucaccuccggggacaagaucggauguuuugcccuuucugaaccuggcaacgggagcgaugcuggagccgccuccacaaccgcucgggcggagggcgacagcuggguucugaaugggacaaaagccuggaucaccaacgcuugggaggccucugccgcuguggucuucgccuccacggaucgcgcgcuccagaauaagggaauuagcgcuuuucuggugccgaugcccaccccuggccugacacucggcaaaaaggaagacaaacuggggaucagaggaucuuccaccgccaaccuuauuuucgaggauugccggauccccaaggacagcauucugggcgaaccugggaugggauuuaagaucgccaugcaaacacucgauaugggccgcauugggaucgcuucucaggcccugggaaucgcucagaccgcccuugacugugcgguuaauuacgccgagaacagaauggcuuucggcgcuccccugacgaaacuccaggugauucaauuuaagcuggccgauauggcccuggcgcucgaauccgcccggcugcuuacauggcgcgcugccaugcugaaagacaauaagaaaccguucaucaaggaggcugccauggccaaacucgcugcgagcgaggccgcuaccgccauuucccaucaggccauccagauucugggcgggaugggauaugucacagaaaugccugcugagagacacuaccgggacgcccgcaucaccgaaaucuaugagggcaccucugaaauucaaagacuugugaucgcggggcaucugcuccggagcuacagauccuga

SEQ ID NO: 65387 - RNA, 1968 nt, Artificial Sequence
  derived and/or modified sequence opt5 from ACADVL__Homo_sapiens__NP_000009
augcaggccgcuagaauggccgcgagccugggccggcaacuccugcgccuugggggaggcuccucuagacugaccgcucuccuggggcagccccggccuggaccggcccgcagacccuacgccggcggggcugcccagcuugcucuggacaagagcgauucccacccuucugacgcccucacacggaaaaagcccgcgaaagccgagagcaaguccuucgcugugggaauguuuaaaggccagcugacgaccgaucaagucuucccuuaucccucuguucugaacgaagaacagacacaguuucucaaggaacugguggagccugugagccgcuucuuugaagaggucaaugacccggccaagaacgaugcucuugagaugguggaagagaccacauggcagggccugaaagaacucggggccuucggacugcaaguucccuccgagcuuggcggggugggacugugcaauacccaguacgcgagacucgucgagaucgugggcaugcaugaccuggggguuggaauuacacugggcgcccaccagagcaucggcuuuaaggggauucuccuguucggaaccaaagcucagaaggaaaaauaucuuccuaagcuggccucuggcgagacgguggcugccuuuugucucaccgaacccuccagcgggucugaugccgcuuccauccggacaagcgcggucccuucucccugcggaaaguacuauacccugaacggcuccaaacuuuggauuagcaaugggggacuggccgacaucuucacaguguuugcuaagaccccggugacggauccugccacaggcgccgucaaagagaagaucaccgcuuucguuguggaacgcggcuuugggggaauuacacaugggcccccugagaaaaagauggggaucaaagccuccaacaccgcggagguguucuucgacggagucagagugcccucugaaaauguucucggcgagguggggagcggcuuuaaggucgcuaugcacauucugaacaauggacgguucggcauggccgccgcucuggccgggaccaugcgcggaaucauugcuaaggccguggaucaugcgacaaacagaacgcaauuuggcgagaaaauccacaauuucgggcucauucaggagaagcuggcccggaugguuaugcuucaguacgugaccgaauccauggcuuauauggucagcgccaacauggaccaaggagcuacagauuuucagaucgaggccgcgaucucuaaaauuuucggcuccgaggccgcuuggaaggugaccgacgaauguauccagauuaugggcggcaugggauuuaugaaagagcccggcgucgaacgcgugcugagagaccuccggaucuucagaauuuuugaggggacaaaugauauccugcgccuuuucguugcccugcagggaugcauggacaagggcaaggaacucagcgggcugggaucugcucugaaaaacccuuuuggcaaugccgggcuccugcuuggcgaggccggaaagcaacugcggagacgcgcuggccucgggagcggacugucccugucuggccuugugcacccggagcucagccgguccggggaacuggcggucagagcccuggagcaguucgcuaccgugguugaagccaaacucaucaagcauaaaaagggaauugugaacgagcaguuucugcuucagcgccuggccgauggcgcuaucgaccucuacgccauggucguggugcugagccgggcgucuagaucccugagcgaggggcaccccacggcucaacaugaaaagaugcuuugugauacauggugcauugaggccgccgcucgcauccgggaaggcauggccgcgcuccagucugacccuuggcagcaggagcuguacagaaacuucaaauccauuagcaaggcucugguugaacgcggaggcgucgugaccuccaauccccucggguucuga

SEQ ID NO: 65388 - RNA, 7296 nt, Artificial Sequence
  derived and/or modified sequence opt5 from ACAN__Homo_sapiens__NP_001126
augaccacccugcucuggguguucgugacgcugagaguuaucaccgccgcugugacaguggagaccuccgaccacgauaacucccuuucugucagcauuccccagccuuccccgcugcgggugcuccugggcacaucucuuaccauccccugcuacuuuauugacccuaugcaccccguuacaaccgccccuagcacggcgccccuggcuccucgcaucaagugguccagagugucuaaagaaaaggaggucgugcuccugguugccaccgaagggcgggugcgcgucaauagcgccuaucaagauaaagugucccugccgaacuaccccgcuauuccuagcgacgccacacucgaggugcagucucugagauccaaugauagcggagucuaucggugugaaguuaugcacggcaucgaggacucugaggcuacccuugaagugguggucaaggggaucguguuccauuaccgcgccauuuccacaagauauacccuggauuuugaccgggcgcagcgcgccugccuccagaacagcgcuaucauugccacgcccgagcaacugcaggcugccuacgaagauggauuccaccagugugacgcgggcuggcuugccgaucagacaguuagauauccuauccauacaccccgggaggggugcuacggagacaaagaugaguuuccgggcgugcgcacauacggcauuagagacaccaaugaaaccuaugacgucuacuguuucgcugaggaaauggagggggaaguguuuuaugccacaucuccugagaaguucacguuucaagaggcugccaacgaaugccggcgccugggagccagacucgcuaccacaggccagcuguaccuggcguggcaggccgggauggauauguguuccgcuggauggcucgccgaccggagcguuagauaucccaucuccaaggcccgcccuaauugcggcgggaaccugcuuggagugcggaccgucuacgugcacgcuaaucagacaggcuaucccgaucccucuagcagauacgacgccauuuguuacaccggcgaggauuucgucgacaucccugaaaacuuuuucggggugggaggcgaggaagauaucacgguucaaacagugaccuggccggacauggagcugccccucccucgcaauauuaccgagggggaagcgcggggauccgucauccugacagugaaacccauuuuugagguuagcccuucuccccuugaaccggaggaaccuuucaccuucgcucccgagaucggcgccacagccuuugcugagguggaaaacgagacgggggaagccaccagaccuuggggauuccccacaccuggccugggccccgcuaccgccuuuacauccgaggaucucgucguccaggugaccgcgguuccggggcagccucaucugcccggaggcgucguguuccauuaucgccccgggccuacgcgguacagccugaccuuugaggaagcccaacaggcuugccucagaacaggagccgugauugcuucuccggagcagcugcaggccgcguaugaagccggcuacgagcaaugugacgcuggguggcuucgcgaucagaccguccgguaucccaucgugagcccuagaacacccugcguuggcgacaaggacuccucuccuggagugcgcaccuacggcguccggcccagcacggaaacauaugauguguacugcuucguugacagacuggagggggagguguuuuucgccacccggcucgaacaguuuacauuccaggaggcucuggaauuuugugagucccacaaugccacccuugccaccacaggacaacuguacgcugcguggagccgcggccucgauaaaugcuaugccggguggcuggcugacggaucucugagauacccuaucgucacgccccggccggccuguggcggggauaagccuggcgugagaaccguuuaucucuaccccaaccagacaggacugccugacccccuuucccgccaucacgccuucugcuuucggggcauuagcgcugugccgucuccuggggaagaggagggaggcacccccacauccccuagcggggucgaagaguggaucgugacccaggugguccccggaguugccgcggugcccguggaagaggaaacgacagcugucccuuccggcgagaccaccgccauucuggaguucacaaccgaaccggagaaucagacagaaugggagcccgccuauacgccuguggggaccucuccccucccuggcauccugcccacauggccuccgaccggagcugccacagaggaaagcaccgagggccccuccgcgacggaaguuccuucugcuagcgaggaacccuccccuagcgaggugcccuucccgucugaggaaccuucccccagcgaggaacccuuuccuucugucagacccuucccuuccguggagcuguuuccgagcgaagaacccuucccuucuaaagagcccagcccuuccgaggaacccagcgccucugaagaacccuacaccccuucucccccuguucccagcuggacagaacuuccuuccucuggggaggagagcggagcccccgauguguccggcgacuuuaccgggucuggagaugucagcggccaccucgacuucuccgggcaacugucuggcgaucgcgcuagcggacugccguccggcgaccucgauagcucugggcugacauccaccgugggaagcggccuuccuguugaaucugggcugcccuccggagacgaggaaagaauugaguggcccagcacaccuaccgugggcgagcucccgucuggcgccgaaauccuggagggguccgcuagcggagucggcgaccuguccgggcuucccagcggagaagugcucgagacgucugccagcggcgugggggaucuguccggacugccuucuggcgaaguccucgagacaaccgcgcccggcguugaggacaucagcgggcugccuuccggagaagugcuugagaccacagcccccggcguggaagauauuucugggcugccuagcggagagguccucgaaaccacggcuccgggcguggaggacaucuccgggcugcccucuggagagguucuggaaacaaccgccccuggcguggaggauauuagcggccuucccuccggggaaguccucgagacaaccgcuccuggaguggaagacaucagcggccugcccucuggggagguucuggagacaaccgccccgggaguggaagauauuuccggccucccuagcggggagguccuggaaacggccgcucccggaguggaggacaucucuggccuucccuccggcgagguccuggaaaccgcggccccugggguggaggauauuagcggacuccccuccggcgaaguucuggagacagcugccccugggguggaagacaucucuggacugccgagcggcgagguccuugagaccgccgcucccgggguggaagauaucuccggacucccuagcggcgagguucuggaaacagccgcgcccggcguggaggacauuucugggcugccuuccggagaaguccucgagaccgcugcccccggcguggaggauaucagcgggcugccgucuggagaagugcuugagacggccgcuccuggcguugaagacauuagcgggcugcccuccggagagguccucgaaacagccgcgccuggcguggaggacaucucuggccugcccagcggggaggugcuggaaaccgcugccccuggagucgaggauauuuccggccuucccucuggggaagugcuggagacagccgcuccgggaguugaggacaucagcggccucccuuccggggaagugcuggagaccgccgcucccggagucgaagauaucagcggccuccccucuggcgaggugcuggaaaccgccgcgccugggguugaggacauuuccggacuuccgagcggcgaggugcuggaaacagccgcucccggggucgaggauaucuccggacucccuucuggcgaagugcuggagacggccgcucccgggguugaagacauuagcggccugccuuccggagaggugcuugagaccgccgcccccggcgucgaagauaucucugggcugccuagcggagaggugcucgaaacagcugcgcccggcguggaggacauuuccgggcugccgagcggagaaguccucgagaccacagccccuggcguugaggaaaucucugggcugcccuccggcgaggugcuugaaaccacggcuccuggaguggaugagaucagcggccugcccucuggggagguccucgaaacaaccgccccgggaguggaggaaauuuccggccugccuagcggggagguucuggaaaccucuacaagcgccgugggagaccuuuccggccugcccucugggggcgagguccucgagaucagcguguccggaguugaagauauuagcggccugcccuccggggagguggucgaaaccucugcuagcggaaucgaggacguguccgaacucccuucuggcgaggggcuggagacaagcgccuccggagucgaagaccuuucucggcugcccagcggcgaggaagugcuggagauuuccgcgagcggcuuuggggaucucucuggacugccuuccggcggggaaggacuugagacgagcgcuucugagguuggcaccgaccuguccgggcucccgagcggacgcgaaggccuggagacaucugccuccggcgccgaagaucucagcgggcugcccuccggaaaggaggaccuugugggcagcgcuucuggggaucuggaccugggaaagcucccuagcggcacccugggguccggacaggcccccgagacaucuggccuuccuagcggcuucuccggggaauauucuggaguggaucugggcagcgggcccccuuccggacucccggacuuuucuggccugcccagcggguucccuaccgucucccucguugauagcacgcugguggagguggucaccgcgucuacagccuccgaacuugagggaagaggcaccaucggcaucagcggggcuggagaaauuucuggccugcccuccagcgagcuggacaucuccgggcgggccucuggacucccuagcggcacagagcuguccgggcaggcuagcggaucucccgauguguccggcgaaauuccgggccuuuuugggguuagcggacagccuucuggcuuccccgacaccagcggggagacauccggagugacggaacugucuggccucagcuccgggcaacccggaaucucuggcgaggccagcggcguccuguacgggaccucccagccuuuuggaauuacagaucucagcggcgaaaccucuggggugcccgaccuguccggacagccuagcggccuuccgggguucuccggagcuaccucuggcguccccgaccuggugagcggcacaacguccgggucuggagagagcuccggcaucaccuucguugauacaagccugguggaggucgccccuaccacauuuaaagaagaggaagggcucggaucuguggagcuguccggccuucccagcggggaagcggaccugucuggcaaguccggaaugguugaugugagcggccaauucucugggaccgucgacuccagcggauuuacgucucagacaccugaguucagcggccuccccuccgggauugccgaggugagcggagaauccucucgcgcugagaucggcagcucccugccgucuggggccuacuauggcagcggaaccccuuccucuuuucccaccgugagccugguugauagaacacucgucgaauccgugacccaggcuccuacagcccaggaggccggcgaggggcccagcggaauccuugaacugucuggcgcucauuccggggcgccggacaugagcggagagcacucuggcuuccuggaucucuccgggcugcaaagcggccuuauugaaccuucuggagagccgcccggcaccccuuacuuuuccggggacuucgccagcacgacaaacgugucuggagaauccagcgucgcuaugggcaccagcggggaggccuccggacugcccgagguuacacucaucaccucugaauuuguggagggcgugacggaaccuaccauuagccaggagcuggggcagcggccgcccgucacacauaccccucagcuguucgaauccucuggcaaagugagcacagccggagauaucuccggcgcuacccccguucucccugggucuggaguggaggucagcuccgugcccgagagcagcuccgaaacaagcgccuauccugaggcgggcuuuggggccucugcugccccggaggcuucccgcgaggacagcggaucccccgaucuuucugaaaccacgagcgccuuccacgaggcgaaccuggagagauccucuggccugggcguuagcggguccacacucaccuuccaagaaggagaggccagcgcugccccugaagugucuggcgaguccaccacaaccagcgacgucgggacagaggcucccggacugccuucugccacgcccaccgcuagcggcgaucggacagaaauuuccggggaccuuucuggacauaccagccagcugggcguggugaucuccacaagcaucccggagucugaauggacccagcagacgcaacgcccugccgagacccaccucgaaauugaguccagcucccugcuguacucuggcgaggaaacacacaccgucgagacagcgaccagccccacggacgccuccauccccgcuucuccugaauggaagagagagagcgaauccacagccgcugaucaggagguuugugaggaaggguggaauaaauaucagggacauugcuaccggcacuuucccgacagagagaccuggguggaugccgaacgccgguguagagagcaacagucucaucucagcuccauugugacaccugaggagcaggaguucgucaacaauaacgcccaggacuaucaauggaucggccuuaaugaucgcaccauugaaggggacuuucgguggagcgauggacacccgaugcaguucgagaacuggagacccaaucagccugacaacuuuuucgcggcuggcgaagauugcgugguuaugaucuggcacgagaagggggaguggaaugacgugcccuguaacuaccaucugccuuuuaccugcaaaaagggaacagccacgaccuacaagcgccggcugcagaaaagaucuucccgccacccccggagaagccggccgucuacagcucauuga

SEQ ID NO: 65389 - RNA, 1284 nt, Artificial Sequence
  derived and/or modified sequence opt5 from ACAT1__Homo_sapiens__NP_000010
auggccgugcuggcugcccuccugagaagcggcgcgcggucccgcucuccccuucugagacggcucguccaggagauccgcuacguugaaagaagcuauguguccaagccuacccugaaggagguggucauugugucugcuacacggacgccgaucgggagcuuccuuggaucccugucucuccugcccgccaccaagcugggcagcauugccauccaaggggcuauugaaaaagccggaaucccuaaggaggaaguuaaagaggcuuacaugggcaacgugcuccaagggggagagggccaggcccccacacgccaggcgguccugggcgccgggcuuccuaucuccacccccugcacaaccauuaauaaggugugugcuagcggaaugaaggccaucaugauggcuucucagucccugaugugcggccaccaggacguuaugguggccgggggaauggaaagcaugucuaacgucccuuaugugaugaauagaggcuccacaccguacgggggagugaaacucgaggaucugauugucaaggacggccuuaccgauguuuauaacaaaauccauaugggcagcugugcggaaaauacggccaagaaacugaacauugcucggaaugagcaggacgccuacgcuaucaacucuuauacccgcuccaaggccgccugggaggcugggaaguuuggaaaugaagugauucccgugacagucaccgugaaaggccagccugauguuguggucaaggaggacgaagaguacaaaagaguggauuucagcaagguucccaaacucaagacaguguuucaaaaagaaaacgggaccgucacggcggccaaugcuuccacacugaacgacggagccgccgcucuggugcucaugaccgccgaugcggcuaagcggcugaaugucacaccucuugcccgcaucguggccuucgcugacgccgcuguugagcccaucgauuuuccgauugccccuguguacgcggccucuaugguccugaaggacgugggccucaaaaaggaggauaucgcuaugugggaaguuaacgaggccuucagccuggugguccuugcuaauauuaaaaugcuggaaaucgacccccagaaggugaacauuaacgggggagccgugucccucggccacccuaucggcaugagcggggcgagaaucguuggacaucugacccacgcccugaaacagggcgaguaugggcucgcuucuauuugcaauggaggcgggggcgccuccgcuaugcugauccagaaacuuuga

SEQ ID NO: 65390 - RNA, 1281 nt, Artificial Sequence
  derived and/or modified sequence opt5 from ACAT2__Homo_sapiens__NP_001290182
augggcagccaccccgugcugagaaucugggggaaccggcgcgccaccgcugccucccucggaagaucuggcgggcggcugagcuccccucgccuucugagagucguugcgccgacacucacguucgcucagaccucucggugcagcuuuaauggagcccuggccgcugugcccgugcaagaccuuggcuccacagucauuaaggaggugcugaaacgcgccaccguugcuccugaagaugugucugaggucaucuucgggcaugugcucgccgcgggauguggccagaaccccguuagacaggccagcgugggcgcugggauuccuuacuccguccccgccuggagcugccagaugaucuguggaucuggccugaaggcugugugccuggccgugcaauccauugggaucggagacagcucuaucgucguugcgggcgggauggaaaauauguccaaagccccucaccucgcuuaucugcggacaggagugaagauuggcgagaugccgcuuaccgauagcauccugugugacggccucacagaugccuuucauaacugccacauggggauuaccgcugaaaauguggccaaaaaguggcaggucucucgcgaggaccaggauaagguggccguucugucccagaacagaacggagaaugcucaaaaagcgggacauuucgacaaggaaaucgugcccguccuugugagcacccggaaaggccugauugagguuaagacagaugaauuuccucgccacggguccaacaucgaggccaugucuaaacucaagcccuacuuccugaccgacggaacaggcaccgugacgccugcuaaugccagcgggauuaacgauggagccgcugccgucgugcugaugaagaaauccgaggcggacaagagaggccucacaccccuggcucggaucgucagcuggucucaggugggcguugaaccguccaucauggggauuggaccuauccccgccauuaaacaggccgugaccaaggcuggcuggagccuugaggaugucgacaucuuugaaauuaaugaggccuucgcugccgugucugcggccaucguuaaagaacuggggcucaacccugagaaggugaauaucgagggaggcgcuauugcccuggggcacccccuuggcgcuagcggaugucgcauccuggucacacuccugcauacccuggaaagaaugggccgguccagagggguggccgcgcucugcauuggaggcgggaugggaaucgccaugugugugcagcgcgaguga

SEQ ID NO: 65391 - RNA, 1587 nt, Artificial Sequence
  derived and/or modified sequence opt5 from ACBD3__Homo_sapiens__NP_073572
auggccgcugugcugaacgccgagagacucgaagucagcguugacggccugacccuuucccccgauccugaggaacggccgggggcggagggagcuccccugcucccucccccucugcccccuccgucucccccuggcagcgggcgcggacccggcgccuccggggaacagccugagcccggagaggccgcugccggcggcgcugccgaagaggcgagacggcuugaacaacgcuggggguucggacuggaggagcucuacggccuggcccugagauuuuucaaggaaaaagacgggaaggcuuuucacccgacauaugaggaaaaacucaagcugguggcccuucauaaacaggugcugaugggaccuuacaaucccgauacgugcccugaggucggcuucuuugacgugcucgggaacgaucggcgcagagaaugggcugcccugggaaauaugucuaaggaggacgcgaugguugaguucgugaaacuucugaaccgguguugccaccucuuuagcaccuaugucgccucccauaagaucgaaaaggaggaacaggagaaaaagcgcaaagaagaggaggaaagacggcgcagagaggaagaggaacgggagcgccugcagaaggaggaagagaagagacggagagaagaggaggaacgccugcggagagaggaagaggaacgccggagaauugaggaggaacgccuccggcuggagcaacagaaacagcagaucauggcugcccuuaauucucaaacagcugugcaguuccagcaguacgccgcccaacaguaucccggcaacuacgaacagcaacagauucugaucagacagcuccaggagcaacacuaucagcaguacaugcagcaacuguaccagguucagcuugcucagcaacaggcggcccugcagaagcagcaagaaguggucguggcuggcagcucccuccccaccagcucuaaagugaaugccacagucccuuccaacaugaugagcguuaaugggcaggccaagacccauacagauucuuccgagaaagagcuggaaccggaggcugccgaagaggcgcuggaaaacggacccaaggagagccucccugugauugcugcccccucuauguggacccgcccucagaucaaagacuuuaaggagaagauccaacaggaugccgacuccgugauuacggucggcagaggggaagugguuaccgugcggguccccacacacgaggaaggaagcuaucuguucugggaguuugcuaccgauaauuacgacaucggcuucgggguguauuuugaguggacagauuccccgaacaccgccguuucugugcacgucagcgaauccagcgacgacgaugaggaagaggaagagaauauuggaugugaggaaaaagcuaagaaaaacgccaauaagccucuucuggacgagaucgugcccgucuaccgccgggauugccaugaagagguguaugcgggcucucaccaguacccuggcagagggguuuaucuccugaaauucgacaacuccuacagccuuuggcggucuaagagcguguacuaucgcgucuacuauacgagauga

SEQ ID NO: 65392 - RNA, 1026 nt, Artificial Sequence
  derived and/or modified sequence opt5 from ACBD4__Homo_sapiens__NP_001129176
augggcaccgagaaggaaagccccgagccugacugccagaaacaauuccaggccgcuguguccgucauccagaaccugccgaagaaugggucuuacagacccagcuaugaagagaugcuccgguuuuacuccuauuacaaacaggccacaaugggaccuugucugguuccccgcccuggcuucugggaucccauugggagauauaagugggacgcguggaacucucuuggaaaaaugagccgggaagaggcuauguccgccuacaucacggagaugaagcugguggcccaaaaggugauugauaccgucccucucggcgaaguggcugaggacauguuuggguauuucgaaccgcuguaccagguuauccccgauaugccuagacccccugagacauuucuucgccgggugaccggauggaaagagcaggucgugaauggcgacguuggcgccgugucugaacccccgugccugccuaaggagcccgcuccucccagccccgccucccucugggcggucacacugccuaccccgccccagagcccuauucaccccgggacauggaccccucgcuucucugugauccccugguccagcuggucucuguccugguuuggacaaagcucuggccagcaucucgaagaguccgugaucccggggacggccccuugucccccucagagaaaacggggaugcggcgcugcccgcagagggccccggagcuggaccuguggaugcuggggccaguucgaacacuaccgcagagcuugucggcgcugcagacggggcuguagagccuggcgcgcgugcccugggccccugucccggggaagaucuccgggcccuguccuugggcauggaccccugggcagccgcgggccccgguguuccucuagcuccugcggaccuagcucuagcuccggcucuagcgagugcuuuggcccgaagagaggggauugucaauggcgcggacucugcucccagcugcggcuuagcuguugcgcccugucucuccccagaguuuga

SEQ ID NO: 65393 - RNA, 1473 nt, Artificial Sequence
  derived and/or modified sequence opt5 from ACBD5__Homo_sapiens__NP_001035938
auggccgacaccagaagcgugcacgagacacgguucgaagcugccgucaagguuauccagucccugcccaaaaacggcucuuuucaaccuacgaaugagaugaugcucaaguucuacagcuuuuauaaacaggcgaccgaagggccgugcaagcugucccgccccggauucugggauccuauuggcagauacaaaugggacgcuuggucuagccuuggggauaugacaaaggaggaagccaugaucgccuauguggaggagaugaagaaaauuaucgaaaccaugcccaugacagagaagguggaggaacugcuccgggucauuggaccuuuuuacgagaucguggaagacaaaaaguccggccgcucuagcgauaucaccuccgaccuggggaacguucuuacaagcacccccaaugcuaaaacggugaacggaaaggccgagucuuccgauagcggcgcugaaucugaggaagaggaggcccaggaagaggucaagggcgcggaacaguccgacaaugauaaaaagaugaugaaaaagagcgccgaccauaaaaaccuggaggugauuguuaccaauggguaugauaaggacggauucgugcaagauauccagaacgacauucacgcuucuuccagccucaauggcagauccacagaagaggucaaaccuaucgacgagaaccuggggcagaccggaaagucugccguguguauucaucaggauaucaaugacgaucacguggaagacgucacaggcauucaacaucugaccagcgauuccgacagcgagguuuacugcgauucuauggaacaguuugggcaggaggaaucccucgacagcuucacgucuaacaauggaccguuucaguauuaccugggcggccacagcucccaacccauggagaacucuggguuccgggaggauauccaggugccucccggaaauggcaacaucgggaacaugcaaguggucgcuguggaaggaaagggcgagguuaaacacgggggagaagacggccgcaauaacagcggcgccccucauagagagaagcgcgggggagagacagaugaauuuuccaaugugcggagaggccgggggcaccgcaugcagcaucuuagcgagggaaccaaaggcagacaggucgggucuggcggagacggcgaacgguggggguccgaccgcggaagcagaggcucucugaacgagcagauugcgcucgugcugaugcggcuucaggaagauaugcaaaauguucugcagagacuccagaagcuggagacacugaccgcccuccaggcuaaauccagcaccuccacacugcaaacggcuccccagccgaccucucagcgcccuagcugguggcccuucgagauguccccuggggugcuuacauuugccaucauuuggcccuucaucgcccaguggcuggucuaccucuauuaccaacggagacgccggaagcugaacuga

SEQ ID NO: 65394 - RNA, 849 nt, Artificial Sequence
  derived and/or modified sequence opt5 from ACBD6__Homo_sapiens__NP_115736
auggccagcuccuuccugcccgcuggcgccaucaccggggacucuggaggcgagcucagcuccggggaugacucuggagaaguggaguuuccucacagcccggaaauugaggaaacauccugccuggcggagcuuuucgagaaggcugccgcccaucugcagggccucauccaagucgcuucuagagaacagcugcuuuaccuguaugcccgguacaaacagguuaagguggggaacuguaauacgcccaaaccuagcuuuuucgauuuugagggaaagcagaaaugggaggcuuggaaggcccucggcgacuccagccccucucaagcgaugcaggaauauauugccguggucaagaaacuggauccuggcuggaacccccagaucccugagaagaaagggaaggaagcuaauaccggauucggcgggccggugauuuccagccuguaccacgaggaaacaauccgcgaggaagacaaaaacaucuuugauuauugcagagagaauaacauugaccauaucaccaaggccauuaagucuaaaaauguugaugugaacgucaaggacgaggaaggacgggcucuccugcacugggccugugaucgcggccauaaagagcuugugacaguucugcuccagcacagagcggacaucaauugccaagauaacgaagggcagaccgcccugcacuacgcuuccgccugugaguuccuugacauuguggaacugcuccugcagagcggagcugaccccacacugcgggaucaggacggcugccucccugaggaggucaccggcuguaagacggugucucuggugcuucaacgccauaccacagggaaagccuga

SEQ ID NO: 65395 - RNA, 1506 nt, Artificial Sequence
  derived and/or modified sequence opt5 from ACCS__Homo_sapiens__NP_115981
auguucacccugccccagaaggacuuuagagccccuacaacgugccucggcccgaccuguaugcaagaucuggggagcucccacggagaggaccuugaaggcgagugcucucggaaacuggaucagaagcuccccgaacugcgcggggugggagacccugcuaugaucagcuccgauacaucuuaccuuagcuccagaggccggaugauuaaaugguucugggacucugccgaggaaggguaucgcaccuaccauauggaugaguaugacgaggauaagaaccccagcggaaucauuaaucugggcacauccgaaaacaaacucuguuuugaccugcugagcuggagacucucucagcgggauaugcagcgcgucgagccuucccugcuucaauacgcggacuggagaggccaccuguuccuccgggaagagguugcuaaguuucugagcuucuauugcaagucucccgugccucuucgcccggagaauguggucgugcugaacgggggagccucccucuuuagcgcccuggcuaccguucugugugaagccggcgaggcuuuccucauccccacaccuuacuauggggccauuacccagcaugugugccuguacggaaauaucagacuugcguacgucuaucuggauucugaagugacgggccucgacacccggcccuuucagcugacaguugagaaacuugaaauggcccugcgcgaggcucacuccgagggggugaaggucaaaggacucauccugauuagcccucagaacccccugggcgacguguacuccccggaagaacuccaagaauaucugguguucgccaagagacaucggcuucacgucaucguugaugagguguacaugcugucuguguuugagaaaagcgucggcuaucgcuccgugcucagccuggagagacuuccugacccccagcggacccacguuaugugggcuacaucuaaggauuucgggauguccggacugagauuuggcacccucuacacggagaaucaggacguggccacagcggucgccagccugugucgcuaucaugggcugucuggacucgugcaguaccaaauggcucagcugcuucgggauagagacuggauuaaccagguuuaccugccugaaaaucacgcccgccucaaggcugcccauaccuaugugagcgaggaacugcgggcccugggcauccccuuccuuuccagaggggcuggauucuuuauuugggucgaucuccgcaaauaccugcccaagggcacauucgaggaagagaugcugcucuggcggagauuucuggacaacaaagugcuucugucuuucggcaaggcguuugagugcaaagaaccugggugguuccgcuuugucuucagcgaucaagugcaccggcucugucugggaaugcagagaguucaacaggugcuggccggcaagucccaggucgcugaggacccgcgccccagccagucucaggaaccuuccgaucagcggagauga

SEQ ID NO: 65396 - RNA, 1635 nt, Artificial Sequence
  derived and/or modified sequence opt5 from ACD__Homo_sapiens__NP_001075955
augcccggcagaugccagagcgacgccgcuaugcgggugaacgggccugccucccgcgcgccggcuggauggaccucuggcagccugcacacagggcccagagccggacggccucgcgcccaagcuagaggcguccgggggcgcggacuccugcuuagaccccggccugccaaggagcugccccucccucgcaaaggcggcgcuugggccccggcggggaaucccggaccucugcauccccuuggcguugccguggggauggcuggauccggcagacuggugcuccggccuuggauccgcgaacugauucuggggucugagacgcccagcuccccgagagccggacagcuccuggaaguccuucaggaugcugaggccgcgguggccggcccuucucacgcucccgacaccagcgauguuggcgccacacugcucguguccgacgggacccauagcguccggugucuggugacacgcgaagcucuugauaccucugacugggaggagaaggaguucggauuuagaggcacagaggggcggcugcuccugcugcaggauugcggaguucacgugcaagucgccgaaggcggggccccugcugaguucuaccuccagguggacagauuuucccugcuucccaccgagcagccccgccugcgggugccuggauguaaccaggaucucgacguccagaaaaagcuguaugauugccuugaagaacaucugagcgaaucuacguccagcaaugcgggccucucucugucccaacugcucgacgagaugagagaagaucaggagcaccagggcgcccugguuugucuugcugagagcugccugacccucgaagggccguguacagcucccccugugacccacugggccgccucccgcugcaaagccacaggagaggcgguguacaccguccccucuagcaugcuguguaucuccgaaaacgaccaacuuauucugagcucucucggcccuugccagcggacgcaggggcccgagcugccgccucccgacccugcucugcaagaucucucccugacacuuaucgccucucccccuagcagccccuccucuagcggaaccccggcccugccuggccauauguccagcgaagagucugggacauccauuagccuccugcccgcucugucucuugccgcucccgacccuggccagagauccagcucccagccgucucccgccaucuguagcgcgccugccacccucacaccccgcuccccucacgcuucucggacccccagcuccccucugcagagcugcacgcccucucuguccccgagaagccaugugccuucuccccaccaagcccucguuacccgcccucagaagcccucccuggaguucaaggaauuugugggacuuccgugcaaaaaucggccucccuucccuagaacaggcgcuacccgcggggcccaggagcccuguagcgucugggaacccccuaagcggcacagagauggaucugcguuucaguaugaguacgaaccgcccugcacaagccugugugcccgggugcaagcuguucgccucccuccccagcugauggccugggcucugcauuuccuuauggacgcccagccuggcuccgagcccaccccuauguga

SEQ ID NO: 65397 - RNA, 2418 nt, Artificial Sequence
  derived and/or modified sequence opt5 from ACE2__Homo_sapiens__NP_068576
augagcuccucuagcuggcugcuccugucccuuguggccgucaccgcugcccagucuacaaucgaggaacaagcgaagacguuccuggacaaauuuaaccacgaggcugaagaucucuucuaccagagcucccuggccucuuggaauuauaacaccaauauuacagaggaaaacguucagaauaugaacaaugccggcgacaaguggagcgcuuuucuuaaagagcaguccacccuggcccaaauguacccccuccaggagauccagaaccugacagugaagcugcagcuccaagcucugcagcagaaugggagcucugugcuuuccgaagauaaaagcaagagacugaacaccauucucaauacaaugucuaccaucuauuccacgggaaaggucugcaacccugacaauccgcaggagugucugcuucuggaacccggccucaacgagauuauggccaauagccuggauuacaacgagcggcugugggcgugggaaucuuggcgcuccgagguggggaaacaacucagaccucuguaugaagaguacguugugcuuaagaacgaaauggcccgggcuaaucauuaugaggacuacggagauuacuggcgcggcgacuaugaggucaacgggguggauggauacgacuauagcagaggccagcugaucgaagauguugagcacaccuucgaagagaucaaaccccucuacgaacaucugcacgccuaugugcgggcuaaacuuaugaaugccuacccuuccuauauuucucccaucggcugccugccugcgcaucuccugggggacauguggggacgcuuuuggacaaaccuguacagccucaccgucccguucggccagaaacccaauauugaugugacagacgccaugguggaccaggcuugggaugcccaaagaaucuuuaaggaggcugagaaguucuuugucuccguugggcugccuaacaugacccagggauucugggaaaauagcaugcuuacggaccccggcaacgugcagaaagccgugugucacccuacagccugggaucuggggaagggagacuuucggauucucaugugcaccaaagucacaauggaugacuuccugaccgcucaccaugagaugggccacauccaauacgauauggcguaugccgcucagcccuuucuucugcgcaauggcgccaacgaaggguuccaugaggccgugggagaaauuaugucucucuccgcugccaccccgaagcaccugaaaagcaucggccugcucucuccugacuuccaggaggauaaugagacagaaaucaacuuucugcuuaagcaggcgcugacgauuguugggacccuccccuucacauacaugcuggagaaauggagauggaugguguuuaagggagaaaucccuaaggaccaauggaugaaaaaguggugggagaugaaacgggagauugucggcgugguugaacccgugccccacgaugagaccuauugugacccugcuagccuguuccaugucuccaaugacuacucuuuuauccgcuauuacacaagaacccuuuaucaguuccaguuucaggaagcccucugccaagccgcuaagcacgaggggccgcugcauaaaugugauauuagcaacuccacggaagccggacagaagcuguucaauaugcuccggcugggcaagagcgagcccuggacacuugcucuggagaacguggucggcgccaaaaacaugaaugugcgcccucuccugaacuacuuugaaccccuguucaccuggcuuaaggaccagaauaaaaacucuuuuguugggugguccaccgauuggagcccuuacgcggaccagucuaucaaggugagaaucucccucaaaagcgcccugggagauaaggcuuaugaguggaaugacaacgaaauguaccuguuccgguccucugucgccuaugcuaugagacaauacuuucucaaggugaaaaaucagaugauucuguucggcgaggaagauguucgcguggccaaccuuaagccccggaucagcuucaauuucuucgucacagcgccgaaaaacguguccgacauuaucccuagaaccgagguggagaaggccauucgcaugucucggagcagaaucaaugaugcuuuucgccugaacgacaauucccucgaauuucuggggauccagcccacacugggaccucccaaccaaccucccguuagcauuuggcuuaucgucuuuggcguggugaugggggucauugugguuggcaucgugauucucaucuucacgggcauucgggauagaaagaagaagaauaaagcccgcucuggagagaacccguaugcuuccaucgacaucagcaagggggaaaacaauccuggauuucagaacaccgaugacguccagacaucuuucuga

SEQ ID NO: 65398 - RNA, 3921 nt, Artificial Sequence
  derived and/or modified sequence opt5 from ACE__Homo_sapiens__NP_000780
augggcgccgcuagcgggagacggggacccggccugcuccugccucuuccgcugcuccugcuucugcccccucagcccgcccucgcgcuggacccugggcugcaacccggaaacuucuccgcugaugaggccggcgcccagcucuuugcucagucuuacaauagcuccgccgaacaggugcuguuccaaucugucgcugccagcugggcgcacgacaccaacaucacagccgagaaugcucgcagacaggaagaggccgcccuucugucccaggaauuugcugaggcgugggggcagaaggccaaagagcucuaugaaccuauuuggcaaaacuucacggauccgcagcugcggcgcaucauuggagcuguuagaacccuuggcucugccaaucugccccucgcuaagcggcagcaguacaacgcccugcugagcaauaugucccgcaucuauagcacagccaaagugugccucccuaacaagaccgcuacauguuggucucuggaccccgaucuuaccaauauucuggcguccagcagaucuuacgccaugcuccuguuugcuugggagggcuggcauaacgccgccgggaucccucuuaaaccccuguaugaagacuucacagcucucuccaaugaggccuacaagcaagauggauuuaccgacacgggcgcguauuggcggagcugguacaacucuccgaccuucgaggaugaccuggaacaccuguaccagcagcucgagccucuguaucuuaaucugcaugcuuuugugcgcagagcccuccaccggcgcuacggggauagauauaucaaccugcggggacccauuccugcccaucuucugggcgacaugugggcucaauccugggaaaauaucuacgauauggucgugcccuuccccgacaagccuaaccucgacguuacaagcaccaugcugcagcagggguggaacgccacacacauguuucgcguggcugaggaguucuuuaccucccuggaacucucuccgaugcccccugaguucugggaaggaagcaugcuggagaaacccgccgauggcagagaagucgugugccacgcguccgccugggacuucuauaaucggaaggauuuuagaauuaaacaguguacgcgcguuacaauggaccaacuuagcaccgugcaucacgagaugggccauauccaguacuaucugcaguacaaggaucucccugucucucugcggagaggggcuaaccccggauuccacgaagccauuggcgacgugcuggcucuuuccgugagcacaccggagcaccuccauaaaaucgggcugcuggaucgcgucaccaaugacaccgagucugauauuaacuaccuccugaagauggcccuugaaaagaucgcguuucugccuuucggauaucucguugaccaguggcgguggggcguguuuagcgggagaacacccccuucccgcuacaauuucgauuggugguaucugcggacgaaauaccaaggaaucugucccccugugaccagaaacgagacacacuuugacgccggcgcuaaguuccauguccccaaugugaccccguauauucgcuacuuuguuucuuucgugcugcaguuucaguuccacgaagcccuuugcaaagaggcuggcuaugaagggccucuccaucagugcgacaucuaccggagcacaaaggccggagccaaacugagaaagguccugcaagcuggcuccagccgccccuggcaggaggugcucaaagauaugguugggcuggacgcgcuugaugcccagccccugcucaaguacuuucagccugugacccaauggcugcaggagcagaaccaacagaauggagaaguccugggcuggccggaguaucaguggcaucccccucuucccgacaacuacccugaagggauugaucucgugacggacgaggcugaggccucuaaguucgucgaagaguaugaucggacaucccaggugguuuggaaugaauacgccgaggcuaacuggaauuauaacaccaauaucaccacagaaaccagcaaaauucugcugcaaaagaacaugcagaucgccaaccacacacucaaauacggcacgcaggcgagaaaguucgacgugaaucagcugcaaaacaccacaaucaaacggauuaucaagaagguccaggaucuugagcgcgcugcccugcccgcccaggagcucgaagaguauaauaaaauucugcuggacauggaaaccacauacucuguggcuaccguuugucacccuaacggauccugccuucagcucgagcccgaucugacgaaugugauggccaccagcagaaaguacgaagaccugcucugggcgugggagggcuggcgggauaaagcugggagagccauccugcaauuuuauccgaaguacgucgagcuuauuaaccaggccgcucgccugaauggauauguggacgccggcgacuccuggcggucuauguacgaaacaccuagccucgagcaggaucuggaaagacuguuccaagagcuucagccccuguaucucaaccugcacgcuuacgugcgcagagcccuccaucggcacuauggggcgcagcacaucaaucuggaaggaccuauccccgcccaucuucugggcaacaugugggcucagaccugguccaauauuuacgaccucguugucccguuuccuucugcccccagcauggauacaaccgaggcuaugcugaaacaaggguggacgccucgcagaauguucaaggaggccgacgacuuuuucacaucccugggccuucugcccgugcccccugaauuuuggaacaagagcaugcucgagaaaccgaccgauggacgggaaguggucugucacgccucugcuugggauuucuacaauggcaaggacuuucgcaucaaacagugcacaaccgugaaccuggaggaucucguuguggcgcaucacgagauggggcauauucaguauuucaugcaguacaaggaccugcccgucgcccuuagagaaggagcuaauccuggcuuucacgaggccaucggggaugugcuggcccucuccguuagcacccccaaacaccuucauucucugaaccuucuguccagcgaaggaggcucugacgagcacgauauuaacuuccucaugaagauggcucuggacaagaucgccuuuauuccuuucagcuaucucguggaccaauggcgguggcgcgucuucgauggguccaucacaaaagaaaauuacaaccaggagugguggagccugagacuuaaguaucagggccugugucccccugugccgcggacgcagggagacuuugaucccggcgcgaaauuccauaucccuucuuccguucccuacauucgcuauuuugugagcuucaucauucaauuucaguuccacgaggcucugugccaggccgccgggcauaccggaccucuccacaagugcgacaucuaccaguccaaagaagcuggccaaagacuggccacagcgaugaagcugggguuuucucggcccuggccggaggcuaugcagcugauuaccggacagccuaauaugagcgccuccgccaugcucucuuacuucaaaccccugcucgauuggcugagaacagaaaacgagcuucacggcgaaaagcugggguggccccaauauaauuggaccccuaacagcgcucgcuccgagggcccccugccugacucuggacgggucagcuuucucggccuggaucuugacgcccagcaggcuagaguggggcaguggcugcuccuguuccucggaaucgcccugcuuguggcgacgcugggccugucccaacgccucuuuagcauccggcauagaucucugcaccgccauucccacgggccgcaguucggaagcgaggucgaacuucggcacucuuga

SEQ ID NO: 65399 - RNA, 828 nt, Artificial Sequence
  derived and/or modified sequence opt5 from ACER2__Homo_sapiens__NP_001010887
augggcgcuccccacuggugggaccagcugcaagccgggagcuccgagguggauuggugcgaagacaacuacaccaucgucccugccauugcggaguucuauaauacaaucucuaacguucucuuuuucauucugccgcccaucuguaugugccuuuuuagacaguacgcuacguguuucaauagcggaauuuaucugaucuggacccuccuggugguggucggcaucggguccguguacuuucaugccacacuuucuuuccugggacagaugcucgaugaacuggccguucugugggugcucaugugcgcucuggccaugugguuuccucggcgcuaucuucccaagauuuucagaaacgaccggggccgcuuuaaagucgugguuagcgugcuguccgcugucaccacaugucucgccuucgugaagccugcgaucaauaacauuucucugaugacccuuggggugcccugcacagcccugcucaucgcugagcugaaaagaugugauaauaugcgggucuuuaagcugggacucuucagcggccugugguggacccuugcccuguuuugcuggauuuccgaccgcgcuuucugugaacuccugagcucuuucaacuuuccuuaccuucacugcauguggcauauccugauuugucucgccgcguaucugggcugcguuugcuucgccuacuuugaugcugccuccgagaucccggagcaggggcccgugaucaaauucuggccuaaugaaaagugggcuuuuauuggagugcccuacgucagccugcucugugccaacaagaaaucuuccgugaagaucacguga

SEQ ID NO: 65400 - RNA, 693 nt, Artificial Sequence
  derived and/or modified sequence opt5 from ACER3__Homo_sapiens__NP_001287882
auggcccccgcugccgacagagagggcuacugggggccuaccacaagcacgcuggauuggugcgaagagaacuauuccgugaccugguacaucgcggaguuccucgucggaaugggcucuugguguuuucacaugacacugaaguaugaaaugcagcuucuggacgaacucccgaugauuuacagcugcuguaucuucguuuauugcauguuugaguguuucaaaauuaaaaauuccgugaacuaccaucugcuuuuuacccugguccucuucucucugaucgucacaaccguguaucugaagguuaaggagcccauuuuucaccaagugauguacgggaugcucgucuucacacuggugcuucggagcaucuacaucguuaccuggguguauccuuggcugcgcggacucggcuacacgucccuggggauuuuucuucugggauuccucuuuuggaauaucgauaacauuuucugcgaaucucugagaaauuuucggaaaaaggugcccccuaucauuggcaucaccacacaguuccaugcuugguggcacauucugaccggccucgggagcuaucugcauauccuuuucucccuguacacacgcacccucuaucugagauaccggcccaaggugaaauuucuuuucggaaucuggccugugauucuguuugagccgcuccgcaagcacuga

SEQ ID NO: 65401 - RNA, 1581 nt, Artificial Sequence
  derived and/or modified sequence opt5 from ACHE__Homo_sapiens__NP_001269378
augagacccccucagugccugcuccacaccccgagccuggccucuccccuucugcuccugcuucuguggcuccugggcgggggagugggcgcugaggggcgggaagacgccgagcugcucgucacaguucgcggaggcagacugcgggggauccgccuuaagacgccuggaggccccguguccgcguuccugggcauuccuuuugcugaacccccuauggggccgagacgguuccugcccccugagcccaaacaaccuuggagcggaguggucgaugccaccacauuucaguccguguguuaccaguauguugacacccucuaccccggcuucgaagggacagagauguggaacccgaaucgcgagcuuucugaagauugccuguaucucaacguguggaccccuuaccccagaccuacaagccccacccccguccugguguggaucuauggaggcggguuuuacuccggagccucuagccuggacguuuaugauggccgguuccucgugcaggcugagcgcacgguccugguguccaugaauuacagagugggcgccuuuggguuccuugcucugccuggaagccgggaagccccgggcaacgucgggcuccuggaccaacgccuugcgcugcaguggguucaggagaauguggccgcuuuuggaggcgaucccaccucugugacacucuucggggaguccgccggagcugccagcgucggcaugcaucugcugucuccucccuccagaggccucuuucaccgggcggugcugcagagcggggccccuaacggacccugggcuaccguuggcaugggggaagcccgcagacgggcuacacaacuugcccaucuggugggauguccgccuggcgggaccggcggaaaugacacggagcucgucgccugccugagaacacgccccgcucaggugcuuguuaaccacgaauggcaugugcugccucaggagucugucuuccgguuuuccuucgugcccgucguggauggcgacuuccucagcgauaccccugaagcgcugauuaaugccggggacuuucacggacugcagcucgcuggcagacuggccgcccaaggggcucgcguuuacgccuauguguucgagcaccgggcguccacacuuucuuggccccuguggaugggagucccgcauggcuacgagaucgaauuuauuuucgggaucccucucgaucccagcagaaacuauaccgcugaggaaaagaucuuugcccagcgccugaugcgguacugggccaauuucgcuagaaccggcgaccccaacgagccucgcgacccgaaagcuccccaguggccucccuauacagccggagcccaacaguacgugucccuggaucuucggccucucgaaguuagacgcggccugcgggcgcaggccugugcuuuuuggaauagauuccugcccaagcuccugagcgccacggacacccuugaugaggcugagcggcaguggaaagccgaauuucaccgcuggucuuccuauauggugcauuggaagaaccaauucgaccacuacagcaagcaggauagaugcucugaccuguga

SEQ ID NO: 65402 - RNA, 3987 nt, Artificial Sequence
  derived and/or modified sequence opt5 from ACIN1__Homo_sapiens__NP_001158286
auguggagacggaagcacccccgcaccagcggcgggacaagaggagugcuguccggcaacagaggggucgaguacggaucuggccgcgggcaucucggaacguucgaaggcagauggcggaaacugccuaagaugccggaggccguuggcaccgaccccagcacaucccgcaaaauggcugaacuugaggaagugacccuggaugggaagccucuccaggcccugagagugacagaccuuaaagcggcucuggagcaacggggacucgccaagucuggccaaaagagcgcccuggucaaacgccugaagggggcucucaugcuggagaaucuucagaaacacuccacaccccaugccgcuuuucagccuaacucucagaucggagaagagaugagccaaaauuccuucauuaagcaguaucuggaaaaacagcaggagcuccugagacagcggcuugagcgcgaagccagagaggcggccgaacuggaggaagcuagcgccgagucugaggaugaaaugauccaccccgagggcguggcuucccuccugccuccggacuuucagagcucucuggaacggcccgagcucgaacugucccgccauagcccuagaaagucuuccagcauuuccgaggagaagggggauucugacgaugaaaaaccccggaagggagagagacgcagcucccggguuagacaggcccgcgcggccaaacuuagcgaaggcucucaaccugcugaggaagaggaggaccaggaaacccccucccggaaccugagagugcgcgccgaucggaaucucaagaccgaggaagaggaggaagaggaagaggaagaggaggaagacgaugaggaagaggaaggcgacgaugaggggcagaaaagcagagaggcuccgauccugaaggaguucaaagaggaaggagaggaaauuccucgcgucaagcccgaggagaugauggacgaacggccuaagacgagaucucaagagcaggaagugcuugagcgcggcgggcgguuuaccagaagccaggaggaagcccggaaaucccaccuggcccgccagcaacaggagaaggaaaugaaaacaaccucuccccucgaggaagaggagagagaaaucaagagcucccagggacugaaagaaaagagcaagucucccuccccuccgcggcugacagaagaccggaaaaaggcuagccucguugcgcugcccgagcagaccgccucugaagaggagacgccucccccucuucugacaaaagaggcuuccagcccgcccccucacccccaacuccauuccgaagaagagaucgaaccuauggagggccccgccccucccgugcugauucagcuuucuccgccuaacaccgaugccgacacacgcgagcugcucgucagccagcacaccgugcagcuggucgggggacugagcccccucucuagccccuccgauaccaaggcugaaagcccugccgagaaagugccggaagagucuguucugccccuugugcaaaaguccacacuggcggacuacagcgcucagaaggaucucgagccugaaucugaccgguccgcccagccccugccucugaaaaucgaggaacuugcccucgcuaagggcauuacggaggaaugccugaaacagcccagccuggagcaaaaggagggcagacgcgccucucauacccuccugccuagccacagacuuaaacaguccgcugauuccucuuccagccgguccucuagcuccucuagcuccucuagccgcuccagaagccggucucccgacuccagcgggucucgcucccacagcccgcugagaucuaagcagcgggauguggcccaagcgcgcacacaugccaauccuagaggacggcccaagaugggcucccgcagcaccuccgaaagcagaucucggagcagaucccgcucucggagcgcuuccucuaacagcagaaaaucccucucuccuggggucagccgcgacuccagcacaucuuauaccgagacgaaggaucccuccagcggacaggaaguggccacaccgccuguuccccagcuucaggugugugagccuaaagaacggaccucuaccuccagcuccucuguccaagcuagacgccugagccagcccgaguccgccgagaagcacgugacacagcggcugcagcccgaaagaggcagcccuaaaaagugcgaggcggaagaggccgaaccgcccgcugccacccaaccucagacaucugagacgcagaccucccaucuccccgagagcgaacgcauccaccauacaguugaggaaaaagaggaggugaccauggacacaucugaaaaucggccugagaacgacguccccgaaccuccgaugcccauugcugaucaggugagcaaugacgauagaccugagggguccgucgaagacgaggagaagaaggaaucuagccugcccaaauccuucaagcggaaaaucucugugguuagcaccaagggcgugccugccggaaacuccgauacggagggcgggcaacccggacgcaaaagacgguggggcgccagcaccgcuacaacccagaagaagccgucuauuuccaucacaaccgaaagccugaaagaggcggucguggaccuccacgccgaugacucccgcaucucugaagaugagacggagagaaauggggacgauggaacacacgacaagggccugaaaauuugucggaccguuacacagguggucccugcugaagggcaagagaacggccagagagaagaggaagaggaggaaaaggagcccgaagccgagcccccugugcccccucaggugagcguugaggucgcccuuccgcccccugcugaacaugaggugaaaaaggugacccugggagauacccucacacgccgguccaucucucagcaaaagagcggcgucuccauuacgaucgacgaccccgugagaaccgcccagguuccuucucccccgcgcgggaaaauuagcaauaucgugcacaucuccaaccugguccggccuuuuacacugggacagcuuaaggaacuccugggcagaaccgggacacugguggaggaagcguucuggauugauaaaaucaagagccauugcuuuguuaccuacucuacgguggaggaggcugucgccacacgcaccgcccuccacggagugaaauggccccaguccaacccuaaguuccugugugcugacuaugccgaacaagaugagcuugacuaccaccggggccugcucguugauagacccagcgaaaccaagacagaggaacaggggauuccucgcccccugcauccgccucccccucccccggugcagcccccucagcaccccagagcggagcaacgggagcaggaacgcgcugucagagagcagugggccgaacgggagcgcgaaauggagagacgggagagaacccgcucugaacgggagugggacagagauaaagugcgcgaaggcccucggagcagaucccggucucgcgacagacggcgcaaggagagagccaaaagcaaggagaaaaaguccgagaaaaaggaaaaggcucaggaggaacccccugccaaacugcuugaugaccucuuucggaagacaaaagcugccccgugcaucuauuggcugccccugacggauagccaaauugugcagaaggaagcggagcgcgccgagagagcuaaagaacgggagaagcgcagaaaggaacaggaggaagaggagcaaaaagaacgggagaaggaagccgagagagaacgcaaucggcagcucgagagagagaaacgccgggaacauuccagagagcgcgaccgggaaagagagcgcgagcgggaaagagaucgcggagaccgggacagagaucgcgagagagaccgggaacgcggcagagagcgggauagacgggacaccaagcgccacucuagaagccggucccgcucuacaccugucagagaucgcgggggacggagauga

SEQ ID NO: 65403 - RNA, 1017 nt, Artificial Sequence
  derived and/or modified sequence opt5 from ACKR1__Homo_sapiens__NP_001116423
auggccagcuccggcuacgugcugcaggcugagcucucucccagcaccgaaaacuccucucaacuggacuucgaggaugucuggaauagcuccuaugggguuaacgacucuuuuccugauggagacuacggcgccaaucuugaagcggcugccccgugccacagcuguaaccugcucgaugacuccgcccugcccuucuuuauccuuacaagcgugcuggggauucucgcuucuuccacggugcuguucaugcuguuuagaccucucuuccgguggcagcugugccccggauggccuguccuugcccagcuggcugugggcagcgcccucuuuucuaucguugugcccguccuggcgccugggcuuggauccacccgcagcucugcccuguguucccucggcuauugcgugugguacggcagcgcuuucgcccaggcucugcugcucgggugucaugccucccugggacacagacuuggcgcggggcaaguuccgggacugacacucggccugaccguggggauuuggggagucgccgcccuucugacacuccccgugacccuggcuucuggcgcuagcggcgggcugugcacacucaucuauuccaccgagcugaaggcccuucaggccacgcauaccguggcuugucuggcgauuuuuguccuccugccucuuggacuguucggcgccaaagggcucaagaaagcucugggaaugggccccgggccuuggaugaauauccugugggccugguuuaucuucugguggccccacggaguugugcucggccuggauuuucuugugcggagcaagcugcuccugcugucuacaugccuugcccagcaggcucucgaccugcugcucaaccuggccgaagcgcuugcuauucugcauugugucgccaccccgcuccugcuggcccuuuucugccaccaagcuacacgcacccuccugccuucccugccccucccugagggcuggagcucucaccuggauacgcuugggagcaaauccuga

SEQ ID NO: 65404 - RNA, 1155 nt, Artificial Sequence
  derived and/or modified sequence opt5 from ACKR2__Homo_sapiens__NP_001287
auggccgcuaccgccagcccccagccucuggcgacagaggacgcugauuccgaaaacucuagcuucuacuauuacgacuaucucgaugagguggccuuuaugcugugcagaaaggacgccgucguuuccuucggcaaaguguuucuuccgguguucuacucucugaucuuuguccucgggcugagcggaaaucuucugcuccugauggugcugcuccgguauguuccccgcagacggaugguggaaauuuaccugcuuaaccuggcuaucuccaaucuccuguuccuugucacgcugccuuuuuggggcauuucuguggccuggcacuggguuuucgggagcuuucucuguaagaugguguccacccuguauacaaucaacuucuacagcggaaucuuuuucauuucuugcaugucccuggauaaauaccucgagaucguccaugcucaacccuaucaccgccugagaacccgggccaagagccuucugcucgcgacaauugugugggccgugucucuggcugucuccaucccugacaugguuuuugugcagacccaugaaaaucccaaaggcguguggaacugucacgccgauuucgggggacauggcacaauuuggaaacuuuuccugcgcuuucagcagaaucuccugggcuuccugcucccucugcuugcuaugaucuuuuucuacagcagaauugggugcguccuggugcggcuccgcccggccggacaaggcagagcgcugaagaucgccgcugcccuuguuguggccuuuuucguccugugguuucccuauaaccucacccuguuccugcacacgcuccuggaccuucagguguuugggaauugugagguuucucagcaccuggauuacgcucuccaggugaccgaguccauugccuuccugcauugcuguuuuagcccuauccuguaugcuuucuccucucaccgguuucgccaauaccuuaaggcguuccucgccgcuguccugggauggcaucuggcccccggcacagcccaggcuagccucuccagcugcucugaauccagcauccugaccgcccaggaggaaaugacagggaugaacgaccuuggagagagacagucugagaauuauccuaacaaggaagaugugggcaauaaaagcgcguga

SEQ ID NO: 65405 - RNA, 1089 nt, Artificial Sequence
  derived and/or modified sequence opt5 from ACKR3__Homo_sapiens__XP_005246155
auggaccugcaccucuucgauuacagcgagcccggcaacuuuuccgacaucucuuggccuugcaauagcuccgauuguauuguggucgacaccguuaugugcccgaacaugcccaauaagucugugcugcuuuauacacugagcuucaucuacauuuuuaucuucgugauugggaugaucgccaacuccgucgugguuugggugaauauccaggcuaaaacgaccggauaugauacacauuguuacauucucaaccuggccaucgcggaccuuugggucgugcugaccauuccuguuuggguggucucucucgugcaacacaaucaguggcccaugggcgaacugacaugcaaggugacccaucugaucuuuagcauuaaccucuucggguccaucuuuuuccugacauguaugagcgucgauagauaucuuucuauuaccuacuuuacgaauaccccuuccagccggaaaaagaugguucgcagaguggugugcauccuggucuggcuccuggcuuucugugugucucuucccgacacauauuaccugaaaaccguuacauccgccagcaacaaugagaccuacugccggucuuuuuauccugaacacuccaucaaggaguggcucauuggaauggaacuggugagcgucgugcugggcuucgccguuccguuuuccaucauugcuguguucuacuuccuccuggcccgcgcuaucucugccagcuccgaucaggagaagcauagcucuagaaaaauuaucuuuuccuaugucguggucuuccuuguguguuggcugcccuaccacguugcggugcuccuggacaucuuuagcauucuucacuauaucccuuucacgugccggcuggagcaugcccucuuuacagcucugcacgucacccagugucugucucucgugcauugcugcguuaaccccgugcuguacagcuucauuaaucgcaacuauagauacgaacuuaugaaggccuuuaucuucaaauacuccgcuaagacagggcugaccaaacucauugaugccucucgggucagcgagaccgaauauuccgcgcuggagcaaagcacaaaguga

SEQ ID NO: 65406 - RNA, 1053 nt, Artificial Sequence
  derived and/or modified sequence opt5 from ACKR4__Homo_sapiens__NP_848540
auggcccuggagcagaaccaaagcaccgacuacuauuacgaagagaaugaaaugaacggcacauaugauuacucccaguaugagcucaucugcauuaaggaagacgugagagaguucgcuaaagucuuucugcccguuuuccuuacgaucguguuugugauugggcuggccggaaauucuauggucguggcgaucuacgcuuauuacaagaaacagcggaccaagacagauguuuacauucucaaccuggccguggccgaccuucugcuccuguucacccugccuuuuugggcugucaaugccgugcacggcuggguucucgggaaaaucauguguaagaucacaagcgcucuguauacccuuaacuucguguccggaaugcaguuucuggccugcauuucuaucgaucgcuacgucgcggugacaaaggugccgagccaauccggcgucgggaaacccuguuggauuaucugcuucuguguuuggauggccgcuauucuccugucuaucccucagcuuguguuuuauaccgugaaugacaacgccagaugcauucccaucuucccucgguaccugggaacgagcaugaaggcucucauccagaugcuggagauuuguaucggcuuugucgugcccuuccugauuaugggcguuugcuauuuuaucaccgcccgcacacucaugaaaaugccuaauauuaagaucuccagaccgcugaaagugcuucugaccgucgugaucguuuucauugugacacagcuccccuacaacaucgucaaguucugucgggcgauugauaucauuuauagccugaucaccucuugcaauauguccaagcgcauggacaucgccauucaagugacggaaagcaucgcucuuuuucauucuugucugaacccuauucucuacgucuucaugggggccuccuuuaaaaauuacgugaugaagguugcuaaaaaguauggaagcuggagacggcagcgccagucuguggaggaguuccccuuugauuccgaaggcccuacagagcccaccagcacauucuccaucuga

SEQ ID NO: 65407 - RNA, 3468 nt, Artificial Sequence
  derived and/or modified sequence opt5 from ACLY__Homo_sapiens__NP_001290203
augggcgccggaaagagccccgcuggaccuggccagaaaccggaccccgggaagcugccugccgcgggagugcucagaauccugcggggcuccucugggcuuuggaaaaagcgcagagcucggaccagcgccgagacaggacgcgccggccuguccgcugccaugucugcuaaagccauuagcgaacaaacgggcaaggagcuccuguacaaguucaucugcaccacauccgcgauucagaacagauuuaaauaugcccgggucacccccgauacagacugggcucgccuucugcaggaucacccuuggcuccugucucagaaucugguugugaagcccgaccaacucaucaaaagacgggggaagcugggacuugugggcgucaaccugacccucgauggggugaaaagcuggcugaagccucgccuuggacaggaagccacaguuggcaaggcuaccggguuccugaaaaauuuucucauugagccguucgugccccauucccaggccgaagaguuuuacgucuguaucuaugcgacgagagagggagacuacgugcuguuccaccaugaaggcggcguugaugugggggacgucgaugccaaggcucagaaacugcucgugggaguggacgagaagcugaacccugaagauaucaaaaagcaccuucugguccaugcccccgaggacaaaaaggagauucucgcuagcuuuaucucuggccuguucaauuuuuaugaagaucuuuacuucaccuaucuggagauuaacccucucguugugacaaaggacgggguguacguccuggaccuggccgccaaaguggaugcuaccgcggacuacaucugcaagguuaaauggggagauauugaauuucccccgccuuucggccgggaggccuaucccgaagaggcuuacaucgccgaccucgaugccaaguccggggcuagccugaaacuuacacugcucaauccuaagggacgcauuuggaccaugguggccggcggcggggcgucugucguguauuccgacacgaucugugaucugggaggcguuaacgagcuugcuaauuacggggaauauagcggagcccccucugagcaacagacauacgacuaugccaagaccauccugucccucaugacaagagaaaaacaccccgauggcaagauucugaucauugggggcagcaucgcuaacuuuaccaauguggccgcuaccuucaaaggaauuguccgggccauccgcgacuaccagggcccucugaaggagcacgaagugacaaucuucgucagaagagggggaccgaacuaccaggagggccuccgggugaugggggagguuggaaaaacgaccggcauucccauccauguguuugggacagaaacccacaugacagcgauugucggcauggcccugggacaucgcccuauccccaaucaaccucccaccgcugcccacacggcuaacuuccuucugaaugccuccggcucuacaagcaccccggcgccuucccggaccgccagcuuuucugaguccagagcugaugaaguggcccccgcuaagaaggccaaaccugccaugccccaggacagcguuccuucuccccgcagccuccaggggaaguccacaacccuguucucucggcacacaaaagcuauuguguggggaaugcaaacgagagcgguccagggcaugcuggacuuugauuaugugugcagccgcgacgagccguccguggccgcuaugguuuacccuuucaccggggaucauaagcagaaauuuuauuggggacacaaggaaauccuuauccccgucuucaagaacauggccgacgccaugcggaaacaucccgagguggaugugcucauuaacuuugcuagccugagaucugccuacgacuccacaauggagaccaugaauuaugcgcagauccgcacaauugcuaucauugccgaaggcaucccugaggcccugacccggaagcucauuaaaaaggcugaucaaaaaggggucacgaucaucggcccggccaccgugggaggcauuaagcccggguguuucaaaaucggaaacacaggcgggaugcuggacaauauucuugcgagcaagcuguacagaccuggaucuguugcuuaugugucccgcagcggcgggauguccaacgaacucaauaacaucauuucucggaccacagauggcgucuacgagggaguggccaucggcggggacagauaccccggaagcaccuuuauggaucacguucugcgguaucaggacacgccuggcgugaagaugaucgucgugcugggggagauuggaggcacagaagaguacaaaaucugccgcggcauuaaggaagggagacuuaccaaacccaucguuuguuggugcauuggaacaugugccaccauguucuccucugaggugcaguuuggccaugcuggggccugcgcuaaucaggccagcgaaaccgcggucgccaagaaccaagcucucaaagaggccggaguguucgugccucgguccuucgaugagcugggcgaaaucauccagagcgucuaugaggaccugguugcuaauggggugauugugcccgcccaggaagucccgccucccacagugccuauggacuacucuugggccagagagcucggacugauccgcaagcccgcuuccuuuaugacgagcauuugugaugaacggggccaggagcuuaucuaugcgggcaugccgauuaccgagguuuucaaggaagagauggggaucggaggcgugcuggggcuccugugguuucaaaagagacugccuaaguacucuugccaguucaucgaaaugugccuuauggucacagccgaccacggacccgcuguguccggcgcccacaacaccauuaucugugcccgcgcugggaaagaucucguuagcucucugacaagcggacugcucaccauuggcgacagauuuggcggggcccuggaugcggcugccaagauguucuccaaagccuuugacagcggaaucauuccuauggaguucgugaauaagaugaagaaagaaggcaaacuuaucauggggauuggacaucgggucaaaucuaucaacaaucccgauaugcgcgugcagauccugaaggacuauguuagacagcacuuucccgcuacgccucuccuggauuacgcccuggagguggagaaaauuacaaccuccaagaagccgaaccuuauccucaaugucgacggccugauugggguggcguucguggauaugcugcggaacugcgggagcuuuacccgcgaagaggcugacgaauacaucgauauuggcgcccucaacggcaucuucguccuggggagauccaugggauuuaucggccauuaucuugaccaaaaacggcugaagcaggggcucuaccgccaccccugggacgauauuucuuauguucugccugagcacaugagcauguga

SEQ ID NO: 65408 - RNA, 1011 nt, Artificial Sequence
  derived and/or modified sequence opt5 from ACMSD__Homo_sapiens__NP_612199
augaagaucgacauucacagccauauccugcccaaagaguggccugaucucaagaaaagauucggcuacgggggaugggugcagcugcaacaccauuccaagggcgaagccaaacuucugaaggacgggaaggucuuucggguugugcgcgagaacugcugggauccggaagugcggauuagagagauggaccagaaaggagucaccgugcaggcucucucuacaguucccgugauguucagcuauugggccaagccugaagauacgcugaaucuuugucagcugcucaacaaugaccuggcguccaccgucgugucuuacccccgcagauuuguuggccuggggacacucccuaugcaagcucccgagcuggccgugaaagagauggaacggugcgucaaggagcuuggauucccuggcgugcagaucggcacccacgugaacgaaugggaucugaaugcccaggagcucuuuccggucuaugcugccgcugagcgccugaaauguagccuuuucguucaucccugggacaugcagauggaugggagaauggccaaguacuggcugccuuggcucgugggaaugcccgcggaaacaaccauugccaucugcuccaugaucaugggcgggguguuugagaaguucccuaaacugaaggucuguuuugcucacggaggcggggccuuccccuuuacagugggacggauuucucacggcuucagcaugcgcccggaccugugcgcucaagauaacccuaugaaucccaaaaaguaucucggcuccuuuuacaccgacgcccugguucaugauccucuuagccugaaacuccugacggacgugaucgggaaggacaaagucauucuuggaaccgauuaucccuucccccugggcgaacucgagccugggaagcugaucgaaucuauggaggaguucgacgaagagacaaagaacaaacugaaggcgggaaaugcccucgcuuuucugggccuugaaagaaaacaguucgaguga

SEQ ID NO: 65409 - RNA, 2670 nt, Artificial Sequence
  derived and/or modified sequence opt5 from ACO1__Homo_sapiens__NP_002188
augagcaaccccuucgcccaccuggcugagccucucgacccggugcagcccggcaagaaauuuuucaaucugaacaaacuugaagauuccagauacgggcggcugccuuuuucuauccgcguccuccuggaggccgcgauuagaaauugcgacgaguuccuuguuaaaaagcaagauaucgaaaacauucugcauuggaaugugacccagcacaaaaacaucgaagugcccuuuaagccugcucgggucauucuccaggacuucacaggagugcccgccguuguggauuuugccgcuaugcgcgacgccgucaagaaacugggcggggauccugagaagaucaauccggugugucccgcugaccugguuaucgaucauagcauucagguggacuucaacagacgggccgauucccuccaaaagaaucaggaccuggaguuugaacgcaacagagagcgguucgaauuucuuaaguggggaucucaggcguuccacaauaugcgcaucauuccucccggcagcgggaucauucaucaggucaaccuggaguaucucgccagagugguguuugaucaagacggauacuauuacccugacucccuggucggcacggauucucacaccacaaugaucgacggccuugggauucugggauggggcguugggggaaucgaggcugaagccgugaugcucggccagcccaucagcauggugcugccgcaggucauuggguaucggcugaugggaaaaccucacccccucgugaccuccacagauaucguucugaccauuacaaagcaucuucgccaggugggcgucgugggcaaguucguugaguucuuugggccuggaguggcucaacugagcaucgccgacagagcgaccauugccaauaugugccccgaauacggcgcuacggccgcuuucuuucccgucgaugaggugucuaucaccuaucucguccagacagggcgggacgaagagaaacugaaguacaucaaaaaguaccuucaggccgugggaauguuccgcgauuuuaacgacccuucccaagauccggacuucacccagguuguggagcuggaucucaaaacagucgugcccuguugcagcggcccuaagagaccccaggacaaaguugccgugucugacaugaagaaggauuuugaauccugucugggggcuaaacagggauucaagggcuuucaagucgcgccugagcaccauaaugaccacaaaaccuucauuuaugauaacacggaauuuacacuggcccacggcagcguggugaucgcugccauuaccucuugcacaaacaccuccaaucccagcguuaugcucggggccggacugcuugcuaagaaagccgucgacgcgggccugaacgugaugccguacaucaagaccucccucucuccugggagcggaguggucacauauuaccugcaggaguccggcgugaugcccuaucuuagccagcugggguucgauguugugggcuacggauguaugacgugcauuggcaauucugggccucuccccgaaccugucguggaggcuaucacccagggagaccugguugccgugggcguccuguccgggaaccggaauuuugagggaagagugcaucccaacacacgcgccaauuaucucgcuagcccgccucugguuaucgccuacgcuauugccggcaccauccggauugauuucgaaaaggagccccuuggggugaacgcgaaaggccaacaggucuuccugaaggacaucuggcccacaagagaugaaauucaggccguggagcgccaguacgugaucccuggaauguuuaaagaagucuaucaaaagauugagaccguuaaugagucuuggaacgcucucgccacgccgagcgacaaacuguucuuuuggaacuccaagucuacauacaucaagagcccucccuucuuugaaaaucugacccuugaucuccagcccccuaaauccaucguggacgcuuaugugcugcugaaucucggcgauagcgucaccacagaccacauuucucccgccgggaacaucgcgagaaauuccccugccgcucgguaccugaccaaccgcggacuuacaccccgggaguucaacagcuauggcucuagacgcgggaaugacgccgugauggcucggggaacguuugccaacauuagacugcucaaucgcuuccugaacaagcaggccccgcagaccauccaucugccuuccggcgaaauucuugauguuuuugacgcugcggagcgguaccaacaggccgggcucccccugaucgugcuggcuggcaaagaguauggagccggcagcuccagagauugggccgcuaaggggccuuuccuccugggaaucaaagccguccuugcggaaucuuacgagcggauucaccgcagcaaucuggugggcauggggguuaucccccucgaauaccugccgggagagaacgcugacgcccugggccuuacagggcaggaaagauauaccauuaucauuccugagaaucucaagccccaaaugaaggugcaggucaaacuggauacaggcaagaccuuucaggccgugaugcgguucgacacggauguugagcugaccuacuuucucaacggaggcauccugaauuauaugaucagaaaaauggcuaaguga

SEQ ID NO: 65410 - RNA, 2343 nt, Artificial Sequence
  derived and/or modified sequence opt5 from ACO2__Homo_sapiens__NP_001089
auggcccccuacagccugcucgugaccagacugcagaaggcucuuggcguccggcaauaucacguugccuccgugcugugccagcgcgcgaaaguggcuaugucucauuucgagccuaacgaauacauccacuaugaccuccuggagaagaauauuaacaucgucagaaaacggcuuaaucgcccgcugacacucagcgaaaagauuguguacgggcaucuggaugaccccgccucccaggagaucgaaagaggaaaaucuuaucugcggcuccgcccugauagaguugccaugcaggacgcuacggcccaaauggcuaugcugcaguuuauuagcuccggccuuucuaagguggccguccccagcaccauccacugugaucaucugaucgaggcgcagguugggggagagaaggaccuccggcgcgccaaagauauuaaccaggaaguguacaauuuccuggcuacagccggcgcuaaguauggggugggauuuuggaaaccuggcuccggcaucauucaccaaaucauucuugagaacuacgccuaccccgggguccugcucaucggaaccgacagccacacaccuaauggcgggggacugggcgggauuugcaucggagugggcggcgcggaugccguggacgucauggcugggaucccgugggaacugaagugucccaaaguuauuggagugaagcucaccggcucucuguccggguggagcucuccuaaggaugugauccuuaaagucgccggcauucugacagugaagggagggaccggagcuaucguugaguaucauggccccggcguggacuccauuagcugcacggggauggccaccaucuguaacaugggagccgagaucggcgcuacaaccucugucuucccuuacaaucacagaaugaaaaaguaucucuccaaaacagggcgggaagauauugcgaaccuggccgacgaguuuaaggaccaucuugugcccgauccgggaugccacuacgaccagcugaucgaaauuaaucucagcgagcugaaaccucacaucaacggccccuucaccccugaucuggcucaucccguugccgaaguggggaaggucgccgagaaggagggcuggccccucgacauucgcgugggacugaucggcuccuguacgaauagcagcuaugaagauauggggagauccgcugccgucgcgaaacaggcucuugcccacggacugaagugcaaaagccaguuuacaaucaccccuggcucugagcaaauucgggccacaaucgaacgcgacggguacgcucagauucucagagaucugggaggcaucgugcuugccaacgcuugugggccgugcauuggccagugggaccggaaggauaucaaaaagggagagaagaauaccauuguuaccuccuauaacagaaacuucacaggccgcaaugacgccaaccccgaaacgcaugcguuugugaccagcccugagaucgucacagcccuggcuaucgccgggacccucaaauucaaucccgagacagauuaccugaccggaacggacggcaagaaauuucggcuggaagcuccugacgccgaugagcuccccaagggggaguucgacccgggacaagauacauaccagcacccucccaaagacucuagcggccagcauguggauguuuccccuaccucucagagacugcaacuucuggaacccuuugacaagugggaugggaaggaccucgaagaucugcagauucugaucaaagugaagggcaaauguaccacagaccacauuagcgcggccggaccuuggcuuaaguuccgcggccaccucgauaacaucuccaauaaccugcugauuggggcuaucaauaucgagaacggaaaagccaauagcguccggaacgcugugacccaggaguucggccccgugccggacacagccagauauuacaagaagcaugggauucgcuggguugucaucggagaugaaaauuauggcgaggggucuucccgggaacacgccgcucucgagccuagacaucugggcggacgcgcgauuaucacgaaaucuuuugcccggauucacgagaccaaccuuaagaaacagggccugcucccccugacauucgcugaccccgccgacuacaauaagauccacccuguggauaaacugaccauccaagggcuuaaggacuuuacaccgggaaaaccccucaagugcauuaucaagcauccuaacggcacccaggaaacgauucugcugaaucacaccuucaacgagacacagaucgaaugguuuagagccgggucugcucucaaccgcaugaaagagcugcagcaauga

SEQ ID NO: 65411 - RNA, 354 nt, Artificial Sequence
  derived and/or modified sequence opt5 from ACOT13__Homo_sapiens__NP_001153566
auggugagaaagaucacccuggucagcgccgcucccggcaaaguuauuugcgagaugaagguggaagaggaacacacaaacgccaucgggacgcuccauggaggccugaccgcgacacuuguggacaauauuuccaccauggcucugcucuguacagagcgcggggccccuggagucucuguggauaugaacaucaccuacaugagcccggccaaacugggcgaagacauuguuaucacagcucacgugcuuaagcaggggaaaacccuggccuucacguccgucgaucucaccaauaaggcuacaggaaagcugaucgcccaaggccggcauaccaaacaccugggcaacuga

SEQ ID NO: 65412 - RNA, 1266 nt, Artificial Sequence
  derived and/or modified sequence opt5 from ACOT1__Homo_sapiens__NP_001032238
auggccgcuacccugauccucgagcccgccggcagaugcuguugggacgaaccugugcggauugcgguccgcgggcuggcuccggagcagcccguuacacuuagagccagccugcgggaugaaaagggagcccucuuccaagcucacgcccgcuacagagcugacacgcugggcgagcuugaucuggaacgggccccugcgcucgggggauccuuugccggccuggagcccauggggcugcucugggcucuggagccugaaaaaccccuugugcgccuggugaagagagacguccggaccccucucgccguggagcuggaaguucuugauggacaugacccggaucccggccgccugcucugcagagugcggcacgagcgcuauuuccugccucccggcgucagacgggagccugugcgcgcugggagaguucggggaacacuguuucugcccccggaaccuggccccuucccugggaucguggacauguuuggaaccggcgggggacugcuugaguacagagccucucugcucgcgggcaaaggcuucgccgucauggcucuggccuauuacaacuaugaagaucuucccaagacaauggagacccugcaucucgaauacuuugaggaggcugugaauuaucugcugagccaccccgaagugaaagggccuggagucggccuccuggggauuuccaagggaggcgagcuuugucugucuauggccagcuuccucaaggggaucacagccgcuguugugauuaacggauccguggcgaaugucggcggcacccugcgcuacaaaggggaaacgcuuccgcccgugggaguuaaccggaauagaaucaaggugaccaaagacggcuacgccgauaucgucgacgugcugaacucuccucucgaggggcccgaucaaaagagcuuuauuccuguugaacgcgcugaguccacauuccuguuucuggugggacaggacgaccauaauuggaaaagcgaguucuaugccaacgaagccugcaagcggcuccaggcucacggcagacgcaagccccagaucauuuguuacccggagaccgggcacuauaucgaaccucccuacuuuccucugugccgggccucucuucaugcgcuggucggcucccccauuaucuggggaggcgagccuagagcucacgccauggcccagguggaugcuuggaaacagcuccagacauucuuccauaagcaccucgggggacacgaaggcaccauucccagcaaagucuga

SEQ ID NO: 65413 - RNA, 1452 nt, Artificial Sequence
  derived and/or modified sequence opt5 from ACOT2__Homo_sapiens__NP_006812
augagcaacaagcugcucagcccccacccucauucugugguccugagaagcgaguucaaaauggccuccucuccggcuguucuucgggccagccgccuguaccaguggucccucaagucuagcgcgcaauuucugggcagcccccagcuuagacagguggggcagaucauucgggugccugcucgcauggccgccacccugauccucgaacccgcuggaagaugcuguugggacgagccuguccggauugccgugcgcggccuggcucccgaacaaccuguuacacugagagccucccuccgggaugagaaaggggcgcuguuccaggcccacgcucgcuauagagccgacacgcuuggagaacuggaucucgagcgggcuccggcccugggcgggucuuuugcgggacuugagcccaugggccugcucugggcccuggaaccugagaagccccuggugcgccucgucaaaagagacgugcggaccccucuggcuguugaacuugaggugcuggauggccaugaccccgauccggggcgccuccugugccagacaagacacgagcgguacuuccuuccucccggagucagacgcgaaccugugcgggugggcagaguccgcgggacccuguuucucccucccgagcccggaccguuccccggcaucguugacauguuugggacaggaggcggccugcuggaauaucgggccucccuccuggcugggaagggauucgccgugauggcccuugcuuacuauaauuacgaggaucugccuaagaccauggaaacacuccaucuggaguauuuugaggaagcgaugaacuaccuucugagccaccccgaggugaaaggcccuggggucggacuccugggcauuucuaaagggggagaacugugucucuccauggccagcuuccugaagggcaucaccgcugccgugguuaucaauggcucuguggccaacgucgggggaacgcuucacuacaagggcgagacccugcccccgguggggguuaauagaaaccgcauuaaagugacaaaggacggauaugcugauaucgucgacgugcucaauuccccucuggaaggccccgaucagaaguccuuuauuccugucgagcgggccgaguccaccuuccuguuucuuguggggcaagacgaccauaacuggaaaucugaauuuuacgcgaaugaggcuugcaagagacuccaggcccacggccgccggaaaccccagaucauuuguuauccugaaacaggacauuacaucgagcccccguauuucccucugugcagagccagccugcacgcucucguuggcucccccauuaucuggggaggggaaccccgcgcccacgcuauggcccagguggaugcguggaagcaacugcagaccuucuuccauaaacaccuuggcgggcaugagggaacgaucccuagcaaggucuga

SEQ ID NO: 65414 - RNA, 1320 nt, Artificial Sequence
  derived and/or modified sequence opt5 from ACOT9__Homo_sapiens__NP_001028755
augagacgggccgcucugcgccucugcgcccugggcaaggggcagcuuacccccggaagaggccugacacaagggccucagaacccgaaaaagcagggaaucuuccacauucaugaggugcgggacaaacuccgcgaaaucgucggcgcgagcacgaauuggagagaucacguuaaggcuauggaggaacggaaacugcuucauuccuuucuggccaagucucaggacgggcugcccccucgcagaaugaaggauagcuacauugaggugcugcugccccucggauccgaaccugagcugcgggagaaauaucuuaccgugcaaaacacaguccgcuucggcagaauccuggaagaccucgauucucugggcgugcuuauuuguuacaugcacaauaagauccauagcgccaaaaugucuccccuguccaucguuaccgcucucguggacaagauugauaugugcaaaaagagccuguccccugagcaggacaucaaguuuagcgggcacgucucuugggugggaaaaacauccauggaaguuaagaugcagauguuccagcugcacggcgaugaguuuuguccggugcucgacgccaccuucgucaugguggcucgggauagcgagaacaaagggcccgccuuugugaauccucugauucccgaaucuccugaggaagaggaacuuuuccgccaaggagagcugaacaagggcagacggaucgcguuuuccagcacaucucuccugaaaauggcccccuccgcugaggaacgcaccacgauucaugagauguuccuuagcacccuggacccgaagacaaucuccuuuagaucucggguccucccuagcaaugccguuuggauggaaaacuccaaacucaagagccuggagauuugccacccccaggaaagaaauaucuucaaccgcaucuuugggggauuccucaugcggaaggcuuaugagcuggccugggcgaccgccuguucuuucggcggcuccagaccuuuugugguggcugucgaugacauuauguuccagaaacccguggagguugggagccuucuguuucucucuagccaggugugcuucacacaaaauaacuacauccagguccgcgugcauuccgaaguugccucucugcaggagaagcaacacaccacgacaaauguguuucacuucaccuuuaugagcgaaaaagaggucccccuuguguucccuaagacauauggagaauccaugcuguaccucgacggccagcggcauuuuaacagcaugucugggccggcuacccugagaaaagauuaucuggucgagcccuga

SEQ ID NO: 65415 - RNA, 1869 nt, Artificial Sequence
  derived and/or modified sequence opt5 from ACOX1__Homo_sapiens__NP_001171968
augauccugaacgaccccgauuuccagcacgaggaccucaauuuucugaccagaagccaacgguacgaaguggccguccgcaaguccgcuauuaugguuaaaaagaugagagaguucggcaucgccgauccugacgaaauuaugugguuuaaaaacuucgugcaucgggggcgcccggagccccuugaucugcaccucggaauguuucugccuacacuucugcaucaggcgacggcugaacagcaggagagauucuuuaugcccgccuggaaucucgagaucauuggcaccuaugcccaaacagaaauggggcacggaacccaucugcggggccuggagacaaccgcuacauacgacccugaaacccaggaguucauccucaacucucccacggugaccagcaucaagugguggccugggggacugggcaaaacauccaaucacgccauuguccuugcucagcugaucaccaagggcaagugcuaugggcuccacgccuuuauugugccgauccgcgagauuggaacacauaaaccccugccuggcaucaccguuggggauauuggacccaaguucggcuacgacgaaaucgauaacggguaucuuaaaauggacaaucacagaaucccucgggagaacaugcugaugaaguacgcucaggugaaacccgauggaacguaugucaagccgcucucuaauaagcugacauacggcaccaugguguuuguucgcagcuuccuggugggcgaagccgcuagagcccucuccaaggcuuguacaauugccauccgguacucugcgguccgccaucaaagcgagauuaagccuggggaacccgagccucagauccuggacuuucagacccagcaauauaaacuuuucccccugcucgccaccgcuuacgccuuccaguuugugggagcuuauaugaaggagacauaccacagaauuaacgaaggcaucgggcagggagaucuguccgagcuucccgaacugcacgcccucacggccggccugaaggcuuucaccagcuggacagcgaauaccgggaucgaggccugccggauggcuuguggaggccauggcuauucucacugcuccgggcugccuaacauuuacgugaauuuuacaccgagcuguaccuucgaaggagagaacacggucaugaugcuccaaacagcccgcuuucugaugaagucuuaugaccagguucauuccggcaaacuugugugcgggauggugagcuaccugaaugaccuccccucucagagaauccagccucaacaggucgccguguggcccaccaugguugauauuaacuccccugagagccugaccgaagcguacaaacuucgggccgcgagacugguggagaucgcugccaagaaccuccagaaagaagucauucaccgcaaguccaaagagguggccuggaaucugacaucuguugaccuggugcgggcuagcgaagcccauugucacuaugucguggucaaacucuucuccgagaaacugcuuaagauccaggauaaggcuauccaagccgugcugagaagccucugccugcuguacucucuuuauggaauuucccagaacgcgggcgacuuucuccaggggagcaucaugaccgagccccagauuacacaaguuaaucagcgcgugaaagaacugcugacgcucauccggucugaugccgucgcucugguggacgccuucgauuuucaggacguuacccuuggcagcgugcugggaagauacgauggcaacgucuaugagaaucucuucgaaugggcuaagaacuccccgcugaauaaagccgaggugcacgagucuuacaagcaucugaaaagccuucaguccaagcucuga

SEQ ID NO: 65416 - RNA, 2046 nt, Artificial Sequence
  derived and/or modified sequence opt5 from ACOX2__Homo_sapiens__NP_003491
augggcagccccgugcacagagucucccugggggacaccuggucucggcagaugcauccugauaucgagagcgaacgcuacaugcaauccuucgacguugagagacucacaaacauucuggauggaggcgcccagaauacggcucugcggcgcaagguggaaucuaucauucacagcuauccggaguuuuccugcaaagacaacuacuucaugacccagaaugaaagauauaaggccgcgaugcggcgcgcuuuucauaucagacugauugcccggcgccucggguggcuggaggauggaagagagcuuggcuacgccuaucgggcucugucuggggacguggcccucaacauccaccgcgucuucgugagagcucugcggagccugggauccgaagaacagaucgccaaaugggauccccucuguaagaauauucaaaucauugcgacauacgcccagaccgaacugggccauggcacauaucuucaggggcuggagaccgaggcuacauacgacgccgcuacccaggaauuuguuauccacagcccuacgcucaccgccacaaaaugguggcccggagaucugggccgcucugcgacccacgcccuugugcaagcucagcugauuugcuccggggccagacggggaaugcaugcuuucaucgucccuauuagaagccuccaggaccacacaccccugccuggcaucaucauuggggauaucggaccgaagauggacuuugaucagaccgacaacggcuuccugcaacucaaucaugugcgcguuccccgggagaacaugcugucuagauuugcccaggugcuuccugacggcacguacgucaagcuggggacagcccaguccaauuaucuccccaugguggugguccgcguugaacugcuuagcggagagauucugccuauccuccaaaaggcuugugugauugcgaugcgguacucugugaucagacgccagucccggcugagacccagcgauccggaagccaaaguccuggacuaucagacccagcaacagaaacucuucccucagcuggcuaucuccuacgccuuucacuuccuugccgugucucugcucgaguuuuuccagcacagcuauacagcuauucugaaccaagauuucuccuuucuucccgagcugcaugcccucagcaccggcaugaaggcgaugaugucugaguucugcacccagggggcugagaugugucgccgggccugcggaggccacggguacuccaaacugagcggacugccuucucucguuacaaagcugagcgccuccuguacguaugaaggcgagaauaccgugcuuuaccugcaggucgcuagauuucucgugaagucuuaccugcagacacaaaugagccccggcuccacaccccagcgcagccugucuccuuccguugccuaucuuaccgcuccggaccucgcccggugccccgcgcagagagccgcugauuuccuguguccugaacuguacaccacggccugggcucauguggccguccggcucaucaaagacagcgugcagcaccuucaaacacuuacccagucuggggcggaucagcaugaggccuggaaccaaaccacagucauucaucugcaggcugccaaggugcacugcuauuacguuaccgugaaaggauuuacagaggcucucgaaaagcuggagaaugaacccgccauccagcagguccugaaacgccuuugugaccuccacgccauucacggcauccugacgaacuccggggauuuccugcaugacgcuuuucucagcggagcgcaaguggauauggccagaaccgcuuaucuggaccuucugcggcucaucagaaaggacgccauucugcugacagaugccuucgacuuuaccgaucagugccuuaauuccgcucucggcugcuacgacgggaacguuuaugagcgccuguuccagugggcccagaaaucuccuacaaacacccaagaaaaucccgcguacgaggaguacauccggccgcugcuccagagcuggagauccaagcuguga

SEQ ID NO: 65417 - RNA, 1875 nt, Artificial Sequence
  derived and/or modified sequence opt5 from ACOX3__Homo_sapiens__NP_001095137
auggccagcaccguggagggcggggacacagcucugcuccccgaguucccuagaggaccgcuggaugccuaccgggcgcgcgcuuccuuuucuuggaaggaacuugcccuguucacggaaggcgaggggaugcucagauuuaaaaagaccaucuucagcgcccuggaaaacgacccccuuuuugcucgguccccuggagccgaucugucucucgagaaauaucgcgagcugaauuuccugagaugcaagcggauuuuugaauacgacuuccucagcgucgaggauauguuuaaaucuccccugaagguuccugcucuuauccagugucugggcauguaugacuccagccucgccgcgaaguaccugcuucacucccugguguucgggagcgccguguauucuuccggaagcgaacgccaucucacauacauucaaaagaucuuuagaauggagauuuucggcugcuuugcucugaccgagcugucucacggcuccaacacaaaggccauccggaccacagcucauuaugaucccgccaccgaagaguucaucauucacagcccugacuucgaagcggccaaauuuugggucgggaauaugggaaagacggcuacccaugccgugguuuucgcuaaacucugugugccgggcgaucagugccacgggcugcaccccuuuaucguccagauucgcgacccuaagacacuucugcccaugccuggagugaugguuggcgauaucgggaagaaacucggacagaacggccuggacaauggcuucgccauguuucauaaggugagagucccccggcaaucucuucugaaccgcaugggggaugugaccccggagggaacauacguguccccuuucaaagacgucagacagcgguuuggcgccagccucgggucccugucuagcggacgcguuuccauugugagccuggcuauccucaaucugaaacuugcgguggccauugcucugagauucucugccacccggagacaguuuggccccacggaagaggaggaaaucccuguccucgaguaccccaugcagcaauggcgccugcuucccuaucuggccgcuguguacgcccucgaccacuucuccaaaagccuguuucuggaucucguugaacugcagcgggggcuugcgucuggagacagaagcgcucgccaggccgagcugggccgggaaauccaugcccucgcuuccgccucuaagccucuggcuagcuggacaacccagcaaggcauucaggaguguagagaggccugcgggggacacggcuaucuggcgaugaaccgccuuggggugcuccgggaugacaaugauccgaacuguacauacgaaggagacaauaacauccugcugcagcaaaccuccaauuaucuccugggccuucuggcccaccagguccaugauggggcuugcuucagaagcccccucaaaucuguggacuuucuggaugccuacccuggcauucuggaccagaaguucgagguuuccagcguggcugauugucuugacucugccgucgcgcucgccgcuuauaaguggcuggugugcuaccugcuccgcgaaaccuaccagaaacugaaccaagagaagcgguccggaagcuccgacuucgaagccagaaauaaaugucaggucucucacggccgcccccuugcucuggccuuuguggagcucacaguugugcagcgguuccaugagcacguccaucagccuagcgugcccccgucccugagagccguucuggggcggcuuucugcucucuaugcgcuguggagccugucccgccacgccgcucuccuguacagagccgaacggagaugcagcugcccuggacgccgggauagaucuuccuga

SEQ ID NO: 65418 - RNA, 1743 nt, Artificial Sequence
  derived and/or modified sequence opt5 from ACOXL__Homo_sapiens__NP_001136279
augagagcccugaccgugcagcgggucaaguucgcuauggaccucccccugcuuaaacgcgccggccaagaucuggcggagaagacaaagaacuuuguuagcagaucccucgugaucggggaagugcugucuauggcugacauggccacgggagucaagugcggcauuaucuacuggcuuuucgggggagccauucggaaucugggcagcccugagcacgugaccaaaugguuucagccgcuccaggaacagaaguauacagggauguucgcuaugaccgagcgcggacauggcuccaacgccagaggcauccaaacagaagcuaccuuugaucugucugcccaggaguucguuauugacacacccugugagaaugcggaaaagauguacaucgggaacgccauguauggaaauuacgcugccguguuugcucagcugaucauugauggccggagccaggggccucacugcuucaucguccccgugcgcgacgagaacggaucccucuauccuggcguuaccgccauugauaugauguacaaagaagggcugcauggaguggacaauggcauccuuauuuuugauaaggucagaaucccccgggagaaccugcucgacaaauucggcucuguggcgccugaugggcaauaucacagcccgauucgcaauaaguccgccagauuuaacgcuaugcuggccgcucuuacgcccagccggcuggccguggccuuccaggcuaugggagcgaugaaacucggccugaccaucgccauccgcuacucucauuccagacggcaguuugggccuaagacaaaggaggaagucaaaauuaucgagcaccagacccaaacacugcgccucaugccccaccuggcuaccgcccuugcccugacguucguuagcagauacgcuggagcccuccuggacgaagauguguuccagggcaaggagcuugucaauucucggucccugcaggcgcucguggcugggcugaaagccuauagcacaugggaaaacauuagaugucugcaagacugccgcgaguguaccggaggcauggugguuggccgggagcuccuggcccaguacacaaagcaguaugaagagaaaccucuuuuugggcugcuccagaauugggcugaaucugugggagacaagcugagaaccuccuuccuugccuuuaacauggauaccgucgacgaucuggcuuuccuccugaaagccgugaaguuucgcgagcggguucugcaaagaggccucguggcgcgcaucuacuauaaggucaaaacaaagaaagaagacuucuuucaugccuggaauagcugccugcaccauguggcuucccuuucucuggcccacacgcaccgggucacccucgagcaguucagccuggcugugaaguccugucccgaucaggaggaccagacacugcuuaugaaauuuugccuccuguacgggaccaagcugguuuuccaagaaagagccugguaucucgagcauaaguaccugacaccgauggcgagcacccgcauucggaaccagcuucuggaucucugugacucugugaaagaugacgccagacgcgucaucuccacguuuaacaucccucacacauaccugcaugcucccauugccggaaucagcaauccucgggcugccugggccuucuaucccgcuccccugcagccuagaccgcgggaagaggcgcgcucuagacggcccaaacuuggcgccaaacucuga

SEQ ID NO: 65419 - RNA, 339 nt, Artificial Sequence
  derived and/or modified sequence opt5 from ACP1__Homo_sapiens__NP_001035739
auggccgagcaggcuaccaagagcgugcuguucgucugccucggcaacaucuguagaucccccauugccgaagcgguuuuucggaaacuggugacagaccaaaauaucucugagaacuggcgcguggauagcgcugccacguccggguacgaaauuggaaauccuccggacuauagaggccagucuugcaugaagcggcacgggauccccaugagccaugucgcccgccaggugccuucccuugaucugaaacucuguguucugugcuucucuggaagccuuaccgcugugcuguuucucacaggcaccugggccgggccccagacacaagagcuguga

SEQ ID NO: 65420 - RNA, 1176 nt, Artificial Sequence
  derived and/or modified sequence opt5 from ACP2__Homo_sapiens__NP_001289419
auggccggcaagagaagcggguggucccgggcugcccugcuccagcugcuucugggagugaaccucgucguuaugcccccuacccgcgcgagaucucugcgguucgugacacuugagggcaugcugcaacacugggaacucgggcaggcucugcgccagagauaccauggauuucugaauacgagcuaucaccggcaggagguguacguccgcuccaccgacuucgauagaacacucaugucugccgaagccaaccuggcuggccuuuuuccgcccaaugggaugcaacgguucaacccuaauaucagcuggcagcccauuccugugcauaccguucccaucacagaggaccgccugcucaaauuuccucugggaccgugccccagauaugaacagcuucagaacgagacccggcaaacaccugaguaccagaaugaauccucucgcaacgcccaguuccuggauaugguggcuaaugagaccggccucacggaccugacccuggaaacagucuggaacguguaugauacccucuuuugugagcagacacacggccugagacuucccccuugggccagcccccaaaccaugcagcggcugucccgccucaaggacuucagcuuuagauuccuguuugggauuuaccagcaagcggagaaagcccggcuucagggaggcguucugcucgcucagaucagaaagaaucugacgcugauggccacaaccucucagcucccgaaacugcuuguguauuccgcucaugauacaacccuggucgcccuccaaauggcgcuggacguguacaacggggaacaggccccuuacgcuagcugccacauuuucgagcuuuaucaggaagauucuggaaauuuuuccguggagauguacuuccgcaacgaaagcgacaaggcccccuggccucugucucuccccggcuguccccaccggugcccucugcaggauuuccugagacucaccgagccggucguucccaaggacuggcaacaggagugucagcuggcuuccgggccugccgauacagaagugaucguggcccuugcugucugcggaagcauccuguuucuccugauugugcugcuucucacgguucuguuccgcaugcaggcgcaacccccuggcuaucggcauguggccgacggcgaggaccacgcuuga

SEQ ID NO: 65421 - RNA, 978 nt, Artificial Sequence
  derived and/or modified sequence opt5 from ACP5__Homo_sapiens__NP_001104506
auggacauguggaccgcccugcucauccugcaggcccuucugcuccccagccuggcugauggcgcgacgccugcucuuagauucguggccgucggggacuggggaggcguuccgaacgcccccuuucacacagcucgggagauggccaaugcuaaggaaauugcccgcaccgugcaaauccugggggcggauuucauucucucccugggagacaacuuuuacuucacaggcgugcaggauaucaaugacaaaagauuucaggagaccuucgaagaugucuuuucugaccggagccugcgcaaggugccuugguauguucucgccgggaaccaugaucaccugggaaauguguccgcucagauugccuacucuaaaaucagcaagagauggaacuuccccuccccuuuuuaucggcuucauuucaaaaucccccaaacaaaugucucuguggcuauuuuuaugcuggacaccguuacacucugcggcaacagcgaugacuuccugucccagcagccugagcgcccgagagaugugaaacuugcccggacccagcugagcuggcucaagaagcaacuggcggccgcucgcgaagacuacguccugguggccggccacuaucccguguggucuaucgcugagcaugggccuacgcacugucucgucaagcagcugagaccccuucuggccaccuacggaguuacagccuaucucugcggccacgaccauaaucugcaguaccuucaggaugagaacggggugggauacgugcuguccggcgcugggaauuuuauggacccuagcaaacggcaccaacgcaagguccccaacggauaucucagauuccauuacggcaccgaagauucucugggcggguucgcguauguggagauuuccagcaaagaaaugacaguuaccuacaucgaggccucuggaaagucccuguuuaagacgcggcucccgcgcagagcucggccuuga

SEQ ID NO: 65422 - RNA, 1206 nt, Artificial Sequence
  derived and/or modified sequence opt5 from ACP6__Homo_sapiens__XP_011507903
augaucaccggcguguucagcaugagacuguggacacccgucgggguucucacgucccuggccuacugccuucaccagcggcgcguggcucuggccgagcuccaagaagcggacggacaguguccuguggauagaucucugcuuaagcugaaaaugguccaggugguuuuucggcauggcgcucgcagcccgcucaagccccugccucuggaggaacagguggaguggaacccccaacuccuggaagucccuccccagacccaguucgacuauacagugaccaaucuugccgggggaccuaaaccguacucccccuaugauucucaguaccacgagacaacccugaagggcgggauguuugccggacaacucacaaaaguuggcaugcagcagauguucgcucugggcgagagacuucggaagaacuauguggaagacauuccuuuucugagccccaccuucaauccucaggaggucuuuauccgcuccacgaacauuuucagaaaucucgaaucuacccggugccugcuggccgggcucuuucaaugucagaaggagggacccaucauuauccauacagaugaggcugacagcgaagugcuguacccgaacuaucaguccugcuggagccuucgccaaagaacccggggccgcagacagacagccucucugcagccugggaucuccgaggaucucaaaaaggugaaagaccggaugggaauugauagcucugacaaggucgauuucuuuauccugcuugacaauguugcggccgaacaggcucacaaccugcccuccuguccuaugcucaaacgcuucgccagaaugauugagcaacgggcuguggauaccagccuguacauccugcccaaggaagacagagagucucuccagauggccgugggccccuuucugcauauucuugaguccaaucugcucaaggcgauggacagcgccacggcuccugauaaaauccgcaagcuguaccuuuaugccgcucacgacgucacauucauuccgcugcucaugacccuggggaucuucgaucacaaauggcccccuuuugccguggaccugacaauggaacucuaccagcaucuggaguccaaggaaugguucguucagcuuuauuaccacggaaaagaucugcaaguggccucuaucaccggcaugaagaaaauucucggccuguuucagccccauuga

SEQ ID NO: 65423 - RNA, 1161 nt, Artificial Sequence
  derived and/or modified sequence opt5 from ACPP__Homo_sapiens__NP_001090
augagagccgcuccccugcuccuggcccgggcggcuagccuuucccugggcuuccucuuucugcuuuucuuuuggcuggaccgcucugugcucgccaaggagcugaaauucgucacccugguuuuuagacacggggaucggagcccuaucgacacauucccgacggaucccauuaaggaauccucuuggccucagggauuuggccaacucacccagcuggggauggagcagcauuacgaacuuggagaguauauccgcaaaagauaccggaaguuccugaacgaaagcuauaaacacgaacagguguacauucgcuccacagacguggauagaacccucaugucugccaugacaaaucuggcugcccuuuuucccccugagggcgucagcaucuggaaccccauucugcucuggcaaccuaucccggugcauaccguuccccuguccgaagaccagcugcucuaucugccuuuccggaauugcccccgcuuucaggagcuugaaagcgagacacugaagucugaggaguuccagaagagacuccacccuuacaaagauuuuaucgcuacccuggggaaacuuuccggacugcauggccaagaccucuucggcauuuggagcaagguguaugauccccuguacugugagucuguccacaacuucacgcugccguccugggccaccgaagacacaaugaccaagcuccgggagcugagcgaacuuucucugcucucccuguacgggauccacaaacagaaggaaaagagccgccuucagggaggcgugcugguuaaugagauucucaaccauaugaaaagagcgacacagaucccuuccuauaagaaacugauuauguacucugcccacgauaccacggugagcgggcugcaaauggcucucgacgucuauaauggacugcuucccccuuacgccuccugccaucugacagagcucuauuuugagaagggcgaauacuucguggagauguauuaccggaacgaaacccagcacgagcccuacccccugaugcugccuggguguagcccgucuugcccccuugagcgcuuugcugaacucgugggaccugucaucccccaggauugguccacagaguguaugaccaccaauagccaccaaggcacagaagacucuacggacuga

SEQ ID NO: 65424 - RNA, 1632 nt, Artificial Sequence
  derived and/or modified sequence opt5 from ACRBP__Homo_sapiens__NP_115878
augagaaagcccgccgcuggcuuccugccuagccuccugaaagugcuucugcucccgcuggcccccgcggcugcccaggacuccacccaagccucuacaccugggagcccccuuuccccuacggaguacgaacgguuuuucgcucugcucacccccacauggaaggccgagaccacaugccgccugagagcuacccacggaugucggaacccuacacugguccagcucgaucaguaugaaaaucauggccugguuccggacggggccgugugcucuaaccuucccuacgcgagcugguuugaguccuucugucaguuuacccacuaucgcugcucuaaucauguguacuaugccaaaagaguccuguguagccaaccuguguccauccucagccccaacacgcugaaggaaauugaggcuucugccgagguuuccccuaccacaaugaccagccccaucucuccgcacuucacagugaccgaacggcagacguuucagccuuggcccgagcgccuuuccaauaacgucgaagaacugcuccagagcucucugucccugggaggccaagagcaggcuccugaacauaaacaggagcaggggguggaacacagacaagagcccacacaggaacacaagcaggaggagggacaaaagcaggaggagcaggaagaggaacaggaggaggaaggcaaacaagaggaaggccaggggaccaaggagggacgggaagccguuagccagcuccagacagauuccgagcccaaauuccauucugagagccuguccagcaauccuucuuccuuugcgccgcgcgugagagaagucgagagcacccccaugauuauggaaaacauccaagagcuuauucggucugcccaggagaucgacgaaaugaaugagaucuacgaugaaaacagcuauuggcgcaaucagaacccuggcucccugcuccagcugccccacaccgaggcccuucuggugcucugcuacucuauuguggaaaauacauguaucauuacgccuaccgcuaaggcuuggaaauacauggaggaggaaauccugggguucggaaagagcgucugcgacucccugggcagacggcauaugagcacaugugcccucugcgauuuuuguucucugaaacuugagcaaugccacuccgaagccagccugcagcgccagcagugcgacaccucucacaagacacccuucguuuccccgcuccuggcuagccaaucccuuucuauugggaaccaggugggaagcccugaguccggcagauuuuauggccuggaucucuacgggggacugcauauggacuucuggugugcgcggcuggccaccaagggcugcgaagaugugagagucucuggguggcuccagacggaguuccugagcuuucaagacggagauuuccccacaaaaaucugugacaccgacuauauucaguacccuaauuauugcuccuuuaagagccagcagugucuuaugcgcaaccggaacagaaaagugucucgcaugcggugccugcaaaaugagaccuacuccgcucucagccccggcaagucugaagauguugugcugagauggucccaggaguucagcacacugacccuugggcaguuuggauga

SEQ ID NO: 65425 - RNA, 2076 nt, Artificial Sequence
  derived and/or modified sequence opt5 from ACRC__Homo_sapiens__XP_011529367
auggacggcugcaagaaagagcugcccagacuccaggaaccugaggaagaugaggacuguuacauccugaacgugcaaagcuccucugaugacaccagcggguccucugucgcccggcgcgcuccgaagagacaggccagcugcauucuuaauguucagucccggucuggagauacaagcggcuccagcguggcgcgcagagcucccaaacggcaggccucuuccguggucgugaucgacagcgauucugacgaagagugucacacgcaugaggaaaagaaagccaagcugcucgagauuaacuccgaugacgaaagcccugagugcugucacguuaagcccgcuauccaagagccucccauugugaucucugaugacgauaaugacgacgauaacgggaaugaccuggaagucccugaugacaacuccgaugacagcgaggccccggaugacaauuccgaugacucugaagcucccgaugacaacagcgacgauuccgaggccccugacgauaauagcgacgauucugaagcgcccgacgauaacuccgacgauagcgacgugccugaugacaauucugaugacagcuccgacgauaacucugacgauagcuccgacgauaauagcgacgauucugacguucccgaugacaaauccgaugacagcgaugugccggacgacucuuccgaugacagcgaugucccugacgauuccucugacgauagcgaggcccccgacgauuccucugacgauagcgaggcuccugacgacuccagcgaugacucugaagcccccgaugacuccagcgaugacucugaggcucccgaugacuccagcgaugacucugaagccagcgaugacuccagcgaugacucugaggcguccgacgauagcuccgacgauucugaagccccugacgauaagagcgacgauuccgacgugccggaggauaaaucugacgauagcgacgugcccgaugacaacuccgacgaucuugaggucccuguucccgcugaagaccugugcaaugagggacagaucgccucugaugaagaggaacucguggaggcugccgccgcugugagccagcaugacuccagcgaugacgcgggcgagcaggaucugggggaaaaccugucuaagccucccuccgacccggaggccaacccugaagucagcgagcgcaaacuccccaccgaggaggaaccugcucccgugguugaacaaucuggaaagagaaaguccaaaacaaagaccauuguggagccuccccggaaacgccagacaaagaccaaaaauaucgucgaaccgccuagaaagcggcagacaaaaaccaagaacauuguggagccccugcgcaagagaaaagccaagacgaaaaauguuagcgugacccccggccacaagaaacggggcccuucuaagaagaaaccgggggccgcuaaggucgagaaacgcaagacaagaacccccaaauguaaggugccuggaugcuuccuucaggaucuggaaaaguccaaaaaguauagcggcaaaaaccucaagcggaauaaagacgagcugguccaaagaaucuacgaucuuuuuaaccgcuccgugugugacaagaagcugcccgaaaaacuccggauuggguggaauaacaagaugguuaaaacagccggacugugcagcaccggcgagaugugguauccuaaguggagacgcuucgcgaaaauccagauugggcugaaggugugugacucugcugaucggaucagagacacgcucauccaugaaaugugccacgccgccagcuggcugauugauggaauccacgacucccauggcgaugcuuggaaauacuaugcccgcaagucuaaucggauucaccccgagcuuccuagagucacacgcugccauaacuacaagaucaauuauaaagugcacuacgaguguaccggcugcaagacacggauuggguguuacaccaaaagccuggacaccuccagauuuaucugcgcuaaguguaaaggaucucucguuauggugccccugacacagaaggauggcacgcgcaucgucccgcacguguga

SEQ ID NO: 65426 - RNA, 1266 nt, Artificial Sequence
  derived and/or modified sequence opt5 from ACR__Homo_sapiens__NP_001088
augguggagaugcugcccaccgccauccuccugguccuugcuguuagcgugguggccaaggacaacgcgacaugcgauggcccuugugggcugagauuccggcagaauccgcaaggaggcguccgcauuguugggggaaaagcugcccagcacggcgccuggcccuggauggugucccuccagaucuuuacguacaacucucauagauaucauaccugcgggggaagccugcuuaauucccggugggugcugacagcugcccacuguuucgucggcaagaacaaugugcacgacuggcgccucguuuuuggcgcuaaagaaauuaccuacgggaacaauaagccugugaaagcgccccugcaggagagauaugucgaaaagaucauuauccaugagaaguacaacucugccacagaaggaaaugauaucgcccugguggagauuaccccucccaucagcugcggccgguucauugggccuggaugucucccgcacuuuaaagcuggccugccccgcgggucccaaucuugcuggguggccggauggggcuauaucgaggaaaaggcuccuagacccagcuccauucuuauggaggcccgggucgaccugaucgaucucgaccuguguaacagcacacagugguacaauggccgcguucagccuaccaacgugugcgcgggguaucccgugggaaaaauugauacgugucagggcgacucugggggaccgcuuaugugcaaggauuccaaagaaagcgccuacgucgugguuggcaucaccucuuggggaguggggugugcuagagccaagcggccuggcaucuacacagcuaccuggcccuaucugaauuggauugccuccaagaucggcagcaacgcccuccgcaugauucaaucugcuacaccucccccucccaccacgagaccgcccccuauccggcccccuuucucccaccccauuagcgcgcaucugccgugguacuuucagccucccccucgcccccugccucccagaccgccugccgcucagccccggcccccuccgucucccccucccccucccccucccccggccuccccucugcccccucccccgccucccccuccucccacacccagcuccaccacaaaacucccgcaggggcuuagcuucgccaagagacugcaacagcucaucgagguccugaaaggaaagaccuauucugacggcaaaaaucacuacgauauggagaccacagaacuucccgagcugacguccaccagcuga

SEQ ID NO: 65427 - RNA, 798 nt, Artificial Sequence
  derived and/or modified sequence opt5 from ACRV1__Homo_sapiens__NP_001603
augaacagauuccugcuccugaugagccuuuaccugcucggcuccgcccgggggaccucuagccaacccaaugagcuguccggaucuaucgaccaccaaacaagcgugcagcagcuuccuggcgaauuuuucucccuggagaacccgucugaugcugaagcccucuaugagacgagcuccgggcugaauacccugagcgaacauggaucuuccgagcacggcagcucuaagcauacagucgcggagcacaccuccggggaacaugcugagagcgaacacgccucuggagagcccgccgcuacagagcacgccgaaggcgagcauaccguuggcgaacagccuuccggggagcaacccagcggagaacaccucuccggcgagcagccucugucugagcuugaaagcggggagcagcccuccgacgaacagccuagcggagagcauggcucuggggaacaaccguccggagagcaggcuagcggcgagcagcccucuggcgaacacgccagcggggagcaggcguccggagccccuauuucuagcacauccaccggcacgauccugaacugcuacaccugugcuuauaugaaugaucaagggaaaugccuccgcggagaaggcacauguauuacccagaacagccagcaaugcaugcugaagaaaaucuuugaagggggaaaacuucaguucauggugcagggcugugagaauaugugccccucuaugaaccuguuuucccacggcacaagaaugcagauuaucuguugccggaaucagagcuucuguaacaagaucuga

SEQ ID NO: 65428 - RNA, 2175 nt, Artificial Sequence
  derived and/or modified sequence opt5 from ACSBG1__Homo_sapiens__NP_055977
augcccagaaacagcggcgccggguacggaugcccucacggcgacccguccaugcuggauucucgggagacaccccaggaaagccgccaagacaugaucgugagaaccacgcaggagaagcucaaaaccuccucucugacagaucggcagccucuuagcaaggaaucccugaaucaugcucucgagcugucuguccccgaaaaaguuaacaaugcccagugggacgcgccugaggaggcucuuuggaccacacgcgccgaugggagagugcggcugcgcauugaccccagcuguccucaacucccguauaccgugcacagaauguucuacgaagcccuggauaaguauggagaccugaucgcucucggcuuuaaacggcaggauaagugggagcauauuuccuacagccaguauuaccugcuugcccgcagagcugccaagggguuccugaaacucggacugaagcaggcgcacucugucgccauccuuggcuuuaacucccccgaaugguucuuuagcgcugugggcacaguuuucgccgggggaauugugaccggcaucuauacgaccucuuccccugaggcuugccaauacaucgccuacgacuguugcgcgaaugucauuaugguggauacacagaaacagcuggagaagauccucaaaauuuggaagcagcugccccaucugaaggccguugugaucuauaaagaaccucccccgaacaagauggcuaaugucuacaccauggaggaauuuauggagcucgggaacgaagugccugaggaggcccuggacgcuauuaucgauacacaacagcccaaucaguguugcgugcuugucuauaccagcggaacgacaggcaacccuaaagggguuaugcugucucaagacaauauuaccuggacagcccgguacggaucccaggccggcgacauccgccccgcugaagugcagcaggagguggucgugagcuaucucccccugucccacaucgcggcccaaauuuacgaucuuuggaccggcauccaguggggagcucagguuuguuucgccgaaccugacgcccugaaggggucucucgugaacacccugagagaggucgaaccgacaagccacaugggcgugccccggguuugggagaaaauuauggagcgcauccaggaaguggcugcccaauccggguuuauuagacggaagaugcugcucugggcgaugagcgucacgcuggagcagaaucuuaccugcccuggaucugaucugaaacccuucacaaccagacucgcugacuaucuggugcuugccaagguccgccaggcccugggcuuugcuaagugucagaaaaacuucuacggggccgcuccuaugauggccgaaacacaacauuucuuccucggacugaauauccggcuguacgcgggcuauggccucuccgagaccagcgggccccacuucaugucuagcccguacaacuauagacuguacuccucuggaaaacuugugccuggcugccgcguuaagcuggugaaccaggaugccgaagggaucggagagauuugucucuggggccggacgaucuuuaugggguaucugaauauggaggacaagacaugcgaagcuauugaugaggaaggcuggcugcauaccggagacgccggcagacuugaugcugacggguuccucuacaucaccggacgccugaaagagcugauuaucacagccggcggggagaacgugcccccuguccccaucgaagaggcgguuaagauggaacucccuauuaucagcaaugccaugcugauuggagaucagcggaaguuucuuuccaugcugcucacccugaaaugcacacuggaccccgacacgagcgaucagaccgacaaccuuacagagcaagcuauggaauuuugucagagagugggcucucgcgccaccacagucuccgagaucauugagaagaaagaugaagcuguguaucaggccaucgaggaagggauucggagagugaauaugaacgccgcugcgcgcccguaccacauccaaaagugggccauccucgagcgggacuuuagcauuucuggcggagaacugggcccuaccaugaaacugaagagacucacgguucuggagaaguacaaagggaucauugauuccuucuaucaggagcagaagauguga

SEQ ID NO: 65429 - RNA, 2001 nt, Artificial Sequence
  derived and/or modified sequence opt5 from ACSBG2__Homo_sapiens__NP_001276107
augaccggcacacccaagacgcaggagggggccaaagaccuggaaguggauaugaacaagaccgaggucacaccuagacucuggaccacaugccgggacggagaaguucugcuucgccugagcaaacacggcccggggcaugagacccccaugacaaucccugaguucuuuagagaauccgugaaucgguucggaaccuaccccgcucucgccucuaagaacggcaaaaagugggagauucugaauuuuaaccaauauuacgaagcgugucgcaaggcugccaaaagccuuaucaagcuggggcucgagagauuccacggagugggcauucugggcuuuaauuccgccgaaugguucaucacggcugucggggccauucuggcuggaggccucugcguggggaucuaugccaccaacucugcggagguuugucaguacgugaucacacaugccaaagucaauauucugcuuguggagaacgaucagcagcugcaaaagauccucagcauuccucaguccucucuggaaccccuuaaagcuaucauucaguaucggcugccuaugaagaagaauaacaaucucuacagcugggacgauuuuauggagcugggacgcuccaucccggacacccagcuggaacaaguuauugagagccagaaagccaaccagugcgcugugcucaucuauacaucuggcaccacggggauccccaagggagucaugcugucccacgauaauauuacauggaucgccggcgcggugaccaaagacuucaagcucacagauaaacaugaaaccguggucagcuaccugccucucucucacauugccgcucagaugauggacaucuggguucccauuaagaucggcgcccugaccuacuuugcucaagccgaugcccuuaaagggacacugguguccacgcucaaggaggugaagccuaccgucuucaucggagugccccagauuugggagaaaauccacgaaaugguuaagaaaaacagcgcuaagucuaugggccugaaaaagaaggcguuugugugggccagaaauauuggguucaaagucaacuccaagaaaaugcugggaaaguauaacacaccggugagcuaccggauggcuaaaacccucguguuuuccaagguuaagacaucucugggccuugaccauugucacagcuucaucuccgggaccgccccucugaaucaggagacggccgaguucuuucucagccuggauauucccaucggagaacuuuauggccugucugaauccagcggcccucauacaaucucuaaccaaaauaacuaccgccuccugagcugcgggaaaauucugaccggauguaagaauaugcuuuuccagcagaacaaagacggcaucggggagauuugccuguggggaagacacaucuuuaugggcuaucuugaguccgaaaccgagacaaccgaagcuauugacgaugagggguggcugcacucuggcgaccucggacagcuggauggccugggguuccuuuacgucacaggacauaucaaggaaauucucaucacggccggcggggagaaugugccucccauccccgucgagacccuggugaaaaagaagauuccgaucauuagcaacgcgaugcugguuggagacaaacucaaguuucuguccaugcuucugacacucaaaugugaaaugaaucaaaugagcggcgagccccuggauaagcugaacuucgaagcuaucaauuuuugccgggggcuuggcucucaggccuccaccgugacagagauugucaaacagcaggacccucucguguauaaggccauccaacagggaaucaacgcuguuaaucaggaggccaugaacaaugcucagcgcauugaaaaaugggugauccuggagaaggauuucagcauuuacggcggggaacugggacccaugaugaagcucaaaagacacuuugucgcccaaaaguacaaaaagcagaucgaccauauguaucacuga

SEQ ID NO: 65430 - RNA, 1731 nt, Artificial Sequence
  derived and/or modified sequence opt5 from ACSF3__Homo_sapiens__NP_777577
augcugccccacgugguccucaccuucagacggcugggcugcgcccuugcuagcugucgccuggccccugcgagacaucggggguccggacuccugcacacagcuccgguugcccgcucugacagaagcgcccccguguuuacgcgggcucuugccuucggcgaucgcaucgcucugguggaccagcaugggagacacaccuaccgggagcucuauucccgcucucugagacugagccaagaaauuugccggcucuguggaugcgucggcggggaucugcgcgaggaaagaguguccuuucuuugugccaacgacgcgucuuacguuguggcccagugggcuagcuggauguccggaggcgucgccgugccucuguaucggaagcaucccgcugcccagcucgaguacguuaucugcgauagccagucuuccgugguccuggcgagccaagaauaucuugagcugcucucuccuguggugcgcaaacugggcgucccccugcucccucugacaccggccauuuacaccggggcuguugaggaacccgccgaggugccugugcccgaacagggauggagaaauaagggcgcuaugaucauuuauacauccgggaccacaggacggccuaaaggcguccuuagcacccaccagaacaucagagccgugguuacggggcuggugcacaagugggccuggaccaaagacgaugucauccuccaugugcugccccuucaccauguucacggaguggucaaugcucugcucuguccgcugugggugggcgcgacaugcgucaugaugccugaguucucuccccagcaagugugggagaaguuucuguccagcgaaaccccucgcauuaacguuuucauggccgugcccacaaucuacaccaagcucauggaguacuaugaccggcacuuuacgcagccccaugcucaggauuuccugagagccgucugugaagagaaaauucgccuuaugguguccggcucugccgcucugccucucccgguucuggaaaaguggaaaaauaucacagggcacacccuucuggagcgguacggaaugacagagauuggcauggcccucagcgggccccugaccaccgcggugagacugccuggauccgucggcacaccccucccugggguucaggugcgcaucgugagcgaaaacccccaacgggaggcuugcucuuauacgauucaugccgaaggagacgagagaggcaccaaggucacaccgggcuuugaagagaaagagggggaacugcuugugcgcggaccuuccguguuccgggaguacuggaauaagcccgaagagaccaagagcgccuuuacacuggauggcugguucaaaaccggggacacggucguguuuaaggauggacaguauuggaucagaggccgcacaucuguugacaucauuaaaaccgggggcuacaaggugagcgcucucgaagucgaguggcaucugcuggcccacccuuccaucaccgacguggcuguuauuggagugcccgauaugacauggggccagcgggucaccgccgugguuacacuuagagaggggcacucucucagccaccgggaacugaaagagugggcgcgcaacgugcuggccccuuaugcuguccccuccgaacucgugcugguggaggagaucccgagaaaucaaaugggaaagauugacaaaaaggcccuuauccggcauuuccacccuagcuga

SEQ ID NO: 65431 - RNA, 1995 nt, Artificial Sequence
  derived and/or modified sequence opt5 from ACSL1__Homo_sapiens__NP_001273640
augcaggcccacgagcuguucagauacuuucggaugcccgaacucguggacuuccgccaauaugucagaacccugccuacaaacacgcuuaugggcuuuggggcuuucgccgcgcugaccacauuuugguacgcuacccggccgaagccccucaaaccucccugcgaucugagcaugcaguccguugagguggccggaucuggcggggcccgcagaagcgcgcuucuggacuccgaugaaccucucguguauuucuacgacgaugucacaacccuguaugagggauuucagcggggcauccaggugucuaauaacgggcccugucugggaagccgcaagccugaccaaccguacgaauggcucuccuauaaacaguggguuauuaucgagcagggcugcuucgccuacucuauggugauugucccccuguacgauacacuuggcaaugaggcuaucaccuauauugugaacaaggccgaacugagccucguuuuuguggacaaaccugagaaggcgaagcugcuucuggaaggggucgagaauaaacucauccccggacugaagaucauuguggugauggaugccuacggcuccgagcuggucgaaagagggcagcgguguggaguugaggugacgagcaugaaagcuauggaagaccucggccgcgccaacagacggaagccuaaacccccggcuccugaggaucuggccgugaucugcuucaccucugggacaaccggaaaucccaagggcgcgauggucacacaucgcaacauuguguccgacuguagcgccuuuguuaaggcuaccgaaaauacggugaacccuugccccgaugacacacuuaucucuuuccugccccucgcccacauguuugagagagucguggaguguguuaugcugugccauggcgcuaaaauuggguucuuccaaggagacauccggcuucugauggaugaccucaaggugcugcagccuaccgucuuuccgguggucccccgccugcucaauagaauguucgaucggauuuuuggccaggccaacacaacccugaaaagauggcuucuggacuucgccuccaagcgcaaagaagcugagcuccggagcgggaucaucagaaauaacucucugugggaucgccuuauuuuucacaaggugcaguccagccugggaggccggguuagacucauggugaccggggcggccccugucuccgcuacagugcugacguuccugcgcgccgcccucggaugucaauuuuaugaaggcuacggccagaccgagugcacagcuggguguugccugaccaugcccggagacuggacagccggccauguuggggcgccuaugcccugcaaucuuaucaaacugguggaugucgaagagaugaacuauauggcugccgagggagaaggcgaggugugugugaaggggccgaacguuuuccagggcuaccucaaggacccugccaaaaccgcugaagcccuggauaaggacggauggcugcacacgggcgauauugggaaauggcuucccaauggaacacucaagaucauugaccggaaaaagcacaucuuuaagcuggcucaaggcgaguauaucgccccugagaaaauugaaaacaucuacaugagaucugagcccgucgcucagguguucgugcauggggaaagccugcaggccuuucucauugcuaucgucgugccugacguugagacccugugcuccugggcccagaagcgcggauucgaaggcagcuuugaggagcuuugucggaauaaagaugugaagaaagcuauucuggaagacauggucagacucgggaaggauucuggccugaagcccuucgagcaagugaaaggaaucacccugcacccggaacuuuucuccaucgacaacggccuccugacaccuaccaugaaggccaaacgccccgagcugcggaauuacuuuagaagccagauugaugaccucuauucuacaaucaagguuuga

SEQ ID NO: 65432 - RNA, 2163 nt, Artificial Sequence
  derived and/or modified sequence opt5 from ACSL3__Homo_sapiens__NP_976251
augaacaaucacgugagcuccaagcccucuaccaugaaacugaagcauacaaucaacccuauucuccuguacuucauccacuuucuuauuagccuguauacgauccucaccuacauuccguucuacuuuuucuccgagucuagacaggagaaaagcaaucggaucaaggccaaacccgucaacuccaagccugacucugcuuaucgcagcguuaauucccuggauggccuugccagcgugcuguaucccgggugcgacacacucgauaagguguuuaccuacgcgaaaaacaaguucaaaaauaagagacugcugggaacacgggaaguccucaacgaagaggacgaagugcaaccuaauggcaaaaucuuuaagaagguuauucuggggcaguauaacuggcuuucuuacgaggauguguucguccgcgcuuuuaauuucggaaacggccugcagaugcucgggcagaaacccaagaccaauaucgccaucuuuugugagacaagagccgaauggaugauugcugcccaagccugcuucauguacaacuuucagcuggugacccuuuaugccacgcugggaggcccugcgauuguucaugcccucaaugagaccgaagugacaaacaucauuaccuccaaagagcugcugcagacaaagcucaaagacaucgucagccuggugccgcggcuucgccacaucauuaccguggauggcaagcccccuacguggucugaguuccccaaagggaucauuguccauacaauggcugccguugaagcucugggagccaaggcguccauggagaaccagccucacagcaagccccucccgucugacaucgccgugauuauguacaccuccggcagcacagggcugccuaaaggagugaugaucucccacucuaauaucauugcuggcaucaccgggauggccgaacggauucccgagcuuggagaagaggaugucuauaucggcuaccugccucucgcucaugugcuggagcugagcgccgaacucguuugucugucccacggcugcagaauuggguauagcucuccccaaacccuugccgaccaguccagcaagaucaaaaagggaucuaaaggcgauacaagcaugcugaagcccacgcucauggcugcggugccugagaucauggaccgcauuuacaagaacgucaugaauaaaguguccgaaaugucuagcuuccagagaaaccuguuuauccuugccuauaauuacaagauggagcagauuuccaaagggcggaacaccccgcugugugauagcuucguuuuucgcaaggugagaucucuccugggaggcaauauccggcugcuccugugcgggggagcuccccuuuccgccacaacccaacgcuucaugaacauuuguuuuugcuguccugucggccagggcuacgggcugacagaaagcgccggagcuggcaccaucucugaggugugggacuauaauacggggagagucggagcuccccucgugugcugugagauuaaacugaagaacugggaagagggcggguacuucaauacagacaagccucauccccggggcgaaauccugaucggaggccaguccguuaccaugggguauuacaaaaacgaggcgaagaccaaagcugacuuuuucgaagaugagaauggacaaagauggcuuugcacaggcgauauuggggaguuugaaccggacggaugccucaagaucauugaucgcaaaaaggaccuggugaagcugcaggccggcgaguaugucagccucgggaaaguggaagccgcucugaagaaccuuccucugguugauaauaucugugccuacgcuaacuccuaucacucuuacgugauuggcuucgucgugcccaaccagaaagagcucaccgagcuggcccggaagaaaggacugaagggcacaugggaggaacuuugcaauagcugugaaauggagaacgaagugcucaaaguucuguccgaggcggccaucucugcuagccuggagaaguuugaaaucccugucaagauuagacucucccccgagccuuggacgcccgaaaccgggcuggugacagacgccuucaaacuuaagcgcaaagagcugaagacccacuaccaggcugauaucgaacggauguauggaagaaaauga

SEQ ID NO: 65433 - RNA, 2220 nt, Artificial Sequence
  derived and/or modified sequence opt5 from ACSL5__Homo_sapiens__NP_057318
auggacgcccugaagcccccuugccucuggagaaaccacgagcggggcaaaaaggaucgcgacagcugugggcggaaaaauuccgaaccgggaucuccccauagccuggaggcucuuagagaugccgcgccuucccagggccugaacuuccuccugcuuuuuaccaagaugcuguucaucuuuaauuuccucuuuucuccccugccuacacccgcucugauuugcauccucacguucggggccgccauuuuucuguggcuuaucacccgcccucaaccggugcugccccuccuggaccuuaacaaucagagcgucggaauugaaggcggggcuagaaaaggaguuucccagaagaacaaugaucugacaucuuguugcuucagcgacgccaagaccauguacgagguguuucagcggggccucgcuguguccgauaacggcccuugucugggguaucgcaaacccaaucaaccuuacagauggcugagcuauaagcaggucucugaccgggccgaauaccucggauccugccugcuucacaaaggcuauaagagcucucccgaucaguucguggggaucuuugcgcagaaccgcccggaguggaucauuuccgagcuggccuguuacacauauagcaugguugcugugccucucuacgacacccugggacccgaagccaucguccauauugugaauaaagcugauaucgccaugguuauuugcgacacaccucaaaaggcgcuugugcugaucggcaacgucgagaagggguucacccccucucucaaagugauuauccugauggaucccuuugacgacgaucugaagcagagaggagaaaaauccggcaucgagauucucagccuguacgacgccgagaaucuuggcaaggaacacuuccggaaaccugugccgcccuccccugaggaucugucugucaucuguuucacgagcgggaccacaggagaccccaagggcgcuaugauuacccaucagaacaucguuuccaaugccgcugccuuucucaaaugcguggaacacgccuaugagccuacacccgaugacguggcuauuagcuaccugccgcuugcgcacauguucgaacgcaucguccaggccgugguuuauucuuguggggcuagagugggauuuuuccaaggcgauauccggcugcucgccgacgauaugaagacccugaagccuacgcuguuucccgccgucccucgccuccugaacagaauuuacgacaaagugcagaacgaggcuaagacaccccuuaaaaaguuccugcucaaacuggccguuuccagcaaguuuaaggagcugcagaaagggaucauucggcaugauucuuucugggacaaacuuaucuuugcgaagauucaagacagccucggaggcagagugcgcgucaucgugaccggcgcugccccuauguccacaucugucaugaccuucuuucgggccgcuauggggugccagguguaugaagccuacggacagaccgagugcacaggcggguguacguucacccugcccggagauuggacaagcggccacguuggggugccgcuggcuugcaauuaugucaagcucgaagacguggccgauaugaacuacuuuaccguuaauaacgagggcgaaguguguaucaaaggaacaaaugucuucaagggcuaccugaaggacccugagaaaacccaggaggcgcuugauuccgacggguggcugcauacgggagauauuggcagauggcuccccaacgggacacugaagaucauugaccgcaaaaagaauaucuucaaacuggcccaaggagaauauauugcucccgagaagaucgaaaacauuuacaaucggagccagccugugcuucagaucuuugugcacggcgagucucucagauccagccugguuggggucguggugccggauaccgacguccugcccucuuucgccgcuaagcucggcgugaaaggauccuuugaggaacugugccagaaccaaguugugcgcgaggccauccuugaagaucugcagaagauuggcaaagagagcgggcucaagaccuucgaacaggucaaagcgaucuuucugcacccugagcccuucuccauugagaauggacugcuuacaccuacccucaaggccaaacggggcgaacugucuaaguauuuuagaacacagaucgacagccuguacgagcauauucaagauuga

SEQ ID NO: 65434 - RNA, 2169 nt, Artificial Sequence
  derived and/or modified sequence opt5 from ACSL6__Homo_sapiens__NP_001009185
augcugaccuucuuucucgugagcggcgggucccuguggcuuuucgucgaguuuguucugucucuccuggaaaagaugcagacacaagagauccuucggauucugagacuccccgaacugggagaccugggccaguucuuucgcagccucuccgccacgacccuggugucuaugggggcucuugccgcgauccuggcuuacugguucacacacagaccuaaagcccuccagccgcccugcaaccugcuuaugcagagcgaggaaguggaggauuccggaggcgcccggcgcucugucauugggagcggaccucaacugcucacccauuauuacgacgaugcuagaacaauguaucagguguuucggcgcggccuguccaucagcggcaaugggcccugucugggauucagaaagccuaaacagcccuaccaguggcucucuuaucaagagguugccgaccgggcugaauuucugggcuccgggcuucugcagcacaacugcaaggccuguaccgaucaguucauuggaguguuugcgcagaaucgcccugaguggaucaucgucgaacucgccugcuacacauauagcauggugguugugccgcuguacgacacccuuggccccggggcuauuagauacaucauuaacacggccgauaucucuaccgucauuguggacaaaccucaaaaggcugugcugcuccuggagcaugucgagcggaaggaaacacccggacugaaacucaucauucugauggauccuuucgaggaagcccuuaaggagcgcggccagaaauguggcguugugaucaaguccaugcaggcgguggaagacugcgggcaagagaaucaccaggcccccgucccgccucagcccgaugaccugagcaucguguguuuuaccucuggaacaaccggcaacccuaaaggggcuaugcucacgcauggaaauguuguggccgauuucuccggcuuccugaaggucacagagaaggugauuuuucccagacaggacgacguucuuaucagcuuccugccccucgcucacauguuugaacgggugauucaauccgucguguauugccacgggggacgcgucggcuucuuucagggcgauaucagacugcugucugacgauaugaaagcccucuguccuaccauuuucccggugguuccccggcugcuuaacagaauguacgacaagaucuuuagccaggccaauacaccucugaaacgcuggcuccuggaguucgcugcgaagcggaaacaggccgaagugagauccgggaucauucgcaacgauagcaucugggacgagcuguuuuucaauaagauucaggcuucucuuggaggcugcguccggaugaucgugaccggggccgcccccgcuuccccuaccguucucggauuucugagagccgcgcugggcugucaaguguaugaaggguacggccagacagagugcacggcuggaugcaccuucacaacccccggcgauuggacaagcgggcaugucggagccccgcucccuuguaaccacauuaaacugguggacguggaggaacuuaauuauugggccugcaagggcgagggggaaaucuguguucgcggacccaacgucuuuaagggcuaccugaaagauccugaccggaccaaggaggcucucgauucugacggguggcugcauacgggcgacaucggaaaauggcugcccgccggcacacuuaagauuaucgaucgcaaaaagcacauuuucaagcucgcucagggggaauauguggccccugagaaaaucgagaauauuuacaucagaagccaacccguggcgcagauuuacguccacggagacucccugaaggccuuccuggugggcaucguugugccggauccugaagucaugcccucuugggcucagaaacgggggaucgagggaaccuaugccgaccucugcaccaacaaggaucugaaaaaggcuauucuugaagacauggugagacugggcaaggagagcgggcuccauuccuuugagcagguuaaagccauccacauucauagcgauauguucucugugcaaaacggccugcugacacccacccuuaaggcgaaacgcccugaacuccgggaguacuuuaagaaacagaucgaggaacuguauuccauuagcauguga

SEQ ID NO: 65435 - RNA, 1734 nt, Artificial Sequence
  derived and/or modified sequence opt5 from ACSM1__Homo_sapiens__NP_001305819
augcaguggcugaugagauuccggacccucuggggcauccacaagagcuuucauaacauucaccccgccccuucccaacugcgcugcagaucucuuagcgaguucggggcuccgcgguggaaugacuacgaagugcccgaggaauuuaacuucgccuccuauguccuggauuacugggcgcagaaagagaaggaaggaaaacgcggcccuaaucccgcuuuuugguggguuaacgggcagggagacgaggugaaguggucuuucagagagaugggcgaucucacacggcgcguggccaaugucuuuacgcagaccugugggcugcaacagggagaccaucuugcccugaugcucccuagagugcccgaaugguggcugguugcugugggcugcaugcggacaggcaucauuuucaucccugccaccauucugcucaaagcuaaggauauccuguaucgccuucagcugagcaaggccaaagggaucgucacaauugacgcgcucgccuccgagguggauucuaucgcuagccaguguccgucccugaagaccaaacuucugguuagcgaccacucuagagaaggauggcucgauuuucggucccuggucaagagcgccucucccgagcauacaugcgugaaauccaagacccuggacccuauggugauuuucuuuacgagcggcaccacaggguuccccaagauggcuaaacacucucacggacucgcccugcaaccuuccuuucccggcagccgcaaacuuagaucccugaagaccucugaugugagcuggugucucuccgacagcggguggaucgucgcgacaauuuggacccugguugagccguggacggccggaugcacaguguucauccaucaccuuccucaguucgauaccaaggugauuauccagacacugcucaaauaccccaucaaccauuuuuggggcgucucuuccauuuaucggaugauccugcagcaagacuucaccagcauucgcuuuccugcucuggaacacuguuacaccggcggggaggugguucuccccaaggaccaggaagaguggaaaagacggacaggacugcuucuguaugaaaauuacggccagucugagacggggcucaucugcgccaccuacuggggaaugaagauuaagcccggcuucauggggaaagcuacaccuccguaugaugugcaagucaucgacgauaagggaagcauccugcccccuaacaccgagggcaauauuggcaucagaauuaaacccgugcgcccuguuucccuuuuuauguguuacgaaggggaccccgagaagacagccaaaguggaaugcggagauuucuauaacaccggcgaccgggggaagauggaugaggaaggauacaucuguuuucugggcagaucugacgauauuaucaaugccagcggguaucgcaucggcccggcugaggucgaguccgcgcucguggaacacccugccgucgcugagagcgccgugguuggaucucccgacccuauucggggcgaaguggucaaggccuucaucgugcugacgccccaguuucugucccaugauaaagaccagcucacaaaggagcugcagcaacacguuaaaagcgugaccgcuccuuacaaguaucccagaaaagucgaguucgugucugaacuuccgaagaccauuacagggaagaucgagcgcaaagaacugcggaagaaagagaccggacagauguga

SEQ ID NO: 65436 - RNA, 1734 nt, Artificial Sequence
  derived and/or modified sequence opt5 from ACSM2B__Homo_sapiens__NP_001098539
augcacuggcugagaaaggugcagggccucugcacccugugggggacacaaaugagcucccggacgcuuuacaucaacucucgccagcuggucagccuccaguggggacaucaggagguucccgccaaauucaauuuugcuuccgacgugcuggaucacugggccgacauggaaaaggcgggcaaaagacuuccuucuccggcucuguggugggugaacgggaagggaaaagagcucauguggaauuuccgggaacugagcgagaacucccaacaggccgccaauauucugucuggcgcuugugggcuccagcgcggagauagagucgccgugaugcugccccggguuccugaaugguggcuugugauccugggcugcauucgcgcuggccucaucuuuaugcccgggaccauucagaugaaaagcacagacauccuguauagacuucaaauguccaaggccaaagcgaucgucgccggagaugaggugauucaggagguugacaccguggcuagcgaauguccuucucugcggaucaagcuccuggucuccgagaaaagcugcgauggcuggcugaacuucaagaaacuccugaaugaagccucuacaacccaucacuguguggagacagggucccaggaggcuagcgccauuuacuuuaccucuggaacguccggccuucccaagauggcggaacauagcuauuccucucuggggcucaaggccaaaauggacgcuggauggaccggccugcaggccagcgauaucauguggacaauuuccgacaccggcuggauccuuaacauucuggggagccuccuggagucuuggacacugggagcuugcaccuucgugcaccuccugccuaaguuugauccgcuugucauccugaaaacgcucuccagcuaccccaucaagucuaugaugggcgccccuauuguuuaucgcaugcugcuucaacaggaccugagcuccuacaaauucccccaccuccagaauugucuggccgggggagaaucucugcucccugagacacuggaaaacuggagagcucaaaccggccuugauauccgggaguuuuaugggcagacagagaccggacugaccugcauggugagcaagacaaugaaaauuaagcccggcuacaugggcacggcggccuccuguuacgacgugcaggucaucgacgauaaggggaaugugcucccgccuggaaccgaaggcgacauugggauccgcguuaaacccaucagaccuauuggaaucuucagcggcuauguggagaaccccgauaagacagcugccaauauucgcggggacuuuuggcugcugggcgaucggggaaucaaagacgaagauggcuacuuccaguuuauggggagagccgacgauauuaucaacucuuccggauaucggaucggccccagcgaggucgaaaaugcucuuaugaagcauccugccgugguugagaccgcggugauuucuuccccggaccccgucagaggggagguggucaaggcuuucgugauccucgccagccaauuccugucccacgauccugaacagcugacaaaggagcuccagcagcauguuaagucugugaccgcccccuacaaauauccucgcaagauugaauuuguccugaaccuucccaaaacggugacaggaaagauccaacggaccaaacugagagacaaggaguggaagaugagcggcaaagcucgcgcccaguga

SEQ ID NO: 65437 - RNA, 1761 nt, Artificial Sequence
  derived and/or modified sequence opt5 from ACSM3__Homo_sapiens__NP_005613
augcuggccagagugacccggaagaugcuccgccacgcuaaaugcuuccagagacuggccaucuuuggcagcguccgggcgcuucauaaggacaaccgcacagcuacgccccaaaauuucuccaacuacgagucuaugaaacaggauuuuaagcuggggauuccugaauauuucaauuuugccaaagacguucucgaucaguggaccgacaaggagaaggccggcaaaaagccgagcaaccccgcuuucugguggaucaauagaaacggagaagagaugcggugguccuuugaggaacuggggucucuuagccgcaaauucgccaauauucuguccgaggcuuguucucuccagagaggagaucgggugauccugauucugccucgcgugcccgaaugguggcucgccaacgucgcgugccugagaacaggcaccgugcuuaucccugggacaacccaacugacacagaaggacauccucuaccggcugcagagcuccaaagccaauuguauuaucaccaacgauguucuugcucccgccguggacgcugucgccagcaagugcgagaaucugcacucuaagcucauuguguccgaaaacagccgcgagggauggggcaaucugaaagagcugaugaagcaugcgucugauucccacacguguguuaaaaccaagcauaacgaaaucauggccaucuuuuucacaagcggcaccucuggguauccuaaaaugacagcucacacccacuccagcuuuggacucggccuguccgugaaugggagauucuggcuugaccugacgccgucugaugucauguggaacacaagcgacaccggaugggccaaguccgcuuggagcucuguguuuucccccuggauucagggcgccugcguguucacacaucaccucccucgguucgagcccaccagcauucugcaaacccuuucuaaauacccuaucacagucuuuuguagcgcccccacgguuuaucgcaugcuggugcagaacgauaucaccuccuacaaguucaagucucucaaacauugcgugagcgcuggggaaccgauuacaccugacgucaccgagaaguggagaaauaaaacaggacuggacaucuaugaaggcuacggccagaccgagacggugcugauuugugggaacuuuaagggaaugaaaaucaagcccggcuccauggggaagccuagccccgcguucgauguuaaaauuguggacgucaauggaaacgugcugcccccuggccaggagggggauaucggaauccaaguucucccgaaucggcccuuuggccuuuucacacacuacguggacaacccuucuaagaccgccuccacccugagaggcaauuuuuauauuacaggggaucgcggauacauggacaaagauggcuauuucugguuugucgcucgggccgacgaugugauccucagcucuggguacagaauuggacccuucgaagucgagaacgcccugaaugaacacccuuccguggcugagagcgccguuguguccucucccgacccgauccgcggcgaagucgugaaggcguuuguugugcuuaacccugauuauaaaagccaugaccaggagcagcugauuaaggagauccaagaacacgucaagaaaaccacagcucccuacaaguauccucggaaaguggaguucauccaggaacuccccaagacgauuuccgggaaaaccaagagaaaugagcugcgcaagaaagaauggaagacaaucuga

SEQ ID NO: 65438 - RNA, 1707 nt, Artificial Sequence
  derived and/or modified sequence opt5 from ACSS1__Homo_sapiens__NP_001239605
augagacggcgcaaggagagacagcccugggaccgguuccacuuucugcauuucgccccucacggccgcgaacuccuggagaccacaugcagacuugcuaacacgcugaaacggcauggggugcaccgcggagauagagucgccaucuacaugccgguuagcccccucgcgguggcugccaugcuggccugugcucggauuggcgccgugcauaccgucaucuuugcuggguucuccgccgaaucucuugcgggacgcauuaaugacgccaagugcaaagugguuaucacauuuaaccaaggccugagagggggacggguggucgagcucaagaaaauuguggaugaagcuguuaagcacuguccuaccgugcagcacguccugguggcccaucgcacagacaauaaggugcacaugggcgaucuggacgucccccucgagcaggagauggcuaaagaagauccuguuugcgcccccgagagcaugggcuccgaagacaugcuguucaugcuuuauaccucugggagcacaggaaugccuaagggcaucgugcauacccaggcgggguaccugcucuaugccgcucugacgcacaaacuuguguuugaucaccaaccgggagacaucuucggcugugucgccgauauuggguggaucaccggacauuccuacgugguuuauggcccccugugcaacggcgcuacaucugugcucuuugagagcaccccugucuaccccaaugccgggagauauugggagacaguggaacggcugaagauuaaccaguucuacggagccccuaccgcuguucgccugcuccugaaauacggcgacgcgugggugaagaaguaugauagauccagccuucggacgcuggggucugucggagagcccaucaauugugaagccugggaguggcuccacagaguggucggcgacucccgcugcacacugguggacaccugguggcagacagaaaccgggggaauuuguaucgcuccgcggccuagcgaggagggcgccgaaauucuucccgccauggcuaugagacccuuuuucggcaucguuccugugcugauggaugagaaagggucugucguggaaggauccaacguuagcggcgcccucugcaucucucaggcguggcccgggauggcucgcaccauuuacggagaccaucaacgguuuguggaugccuauuucaaggccuacccuggcuauuacuucacaggggacggcgcuuauagaacggagggaggcuacuaccagaucaccgggcgcauggaugacgucauuaauaucuccggacaccggcugggcacagccgaaauugaggaugcuaucgccgaccauccggcggugcccgagagcgccgugaucggguauccucacgauauuaaaggagaagcugccuuugcuuucaucguugucaaggacuccgccggcgauucugacguggugguccaggagcugaaaagcaugguggcgaccaagauugccaaauacgcuguucccgacgaaauccucguggucaagagacugccuaagacacgcuccgggaaagugaugcggagacuucugcgcaagauuaucaccagcgaggcccaggaacucggcgauacgacaacccuggaggaccccucuaucauugcugagauccuuuccguuuaucaaaaauguaaggauaaacaggccgccgcuaaguga

SEQ ID NO: 65439 - RNA, 2145 nt, Artificial Sequence
  derived and/or modified sequence opt5 from ACSS2__Homo_sapiens__NP_001070020
augggccugcccgaggaaagagugcggagcggguccggaucucgcggccaggaggaagccggggcuggaggcagagcccggagcugguccccuccgcccgaggucucucgcagcgcgcacguuccuucccuccaaagauaccgggaacugcaucgcagaucuguggaggagccccgggaguucuggggagacaucgcuaaggaguuuuauuggaaaaccccuugccccggaccuuuccuucgcuacaacuuugaugugacaaagggcaaaauuuucaucgaauggaugaagggcgccacgaccaauauuuguuauaacguccuggacagaaaugugcacgagaaaaagcucggggauaagguugccuuuuacugggagggaaacgaaccgggcgagacaacccagaucacauaucaucagcugcuugugcaggucugccaauucagcaaugugcugcggaaacaggggauucagaagggagaccgcguugcuaucuacaugcccaugaucccugaacucguggucgccaugcuggcuugugccagaauuggcgcgcugcacuccaucguguuugccggguucagcucugagucccucugcgaacggauucuggauagcucuuguucccuucugaucaccacagacgcuuuuuaucgcggagagaaacucgugaaccugaaggagcuugccgaugaagcucugcagaaaugccaagagaagggcuuccccgucagauguugcauuguugugaagcaucucggccgggccgaacuggggaugggagacagcaccucucaguccccucccaucaaaagaagcuguccggaugugcagggcaagcugaaagagaaguccaaacgcguccagccucaaauuucuuggaaucaggggaucgaccucugguggcacgaacugaugcaggaggcgggagaugagugcgaacccgaguggugugacgccgaagauccucuuuuuauccuguacacgagcggcuccaccgggaagcccaaaggagugguucacacagugggcggcuacaugcucuaugucgcuaccacauucaaguacguguuugacuuccaugccgaggacguuuucuggugcaccgcugauauuggguggaucacgggacacagcuaugugacauacggcccccuggccaacggggccaccucuguccuuuuugaagggauuccuacauauccggacgugaaucggcugugguccaucgucgauaaguacaaagugaccaaguucuauaccgcucccacagcgauuagacuccugaugaaauuuggcgacgagccuguuacgaagcauagccgcgccucucugcaagugcucgggaccgucggcgagcccaucaacccugaggcuuggcugugguaccaccgggugguuggagcccagagaugccccaucguggauacauucuggcagaccgaaacaggcgggcacaugcuuaccccgcugccuggagccacgcccaugaaaccuggcagcgcuacauuucccuucuuuggggucgccccugcgauucucaaugaauccggagaggagcuggaaggcgaggcugaaggguaccuuguguucaagcagcccuggccgggcaucaugcgcaccguguauggaaaccaugagcgguuugaaaccacauacuucaagaaauuuccuggcuauuacguuaccggggacggaugucaaagagaucaggacggcuauuacuggauuacagggcgcaucgaugacaugcugaaugucucuggacaccuccugagcacggccgagguggaguccgcccugguggaacaugaggcugucgccgaagcugccgugguuggccacccccaucccgugaagggggagugccucuauuguuucgucacccugugcgauggccacacauuuagcccuaaacuuaccgaagaacugaagaaacagauucgggagaagaucggaccgaucgcgacacccgacuacauucagaacgccccuggccuccccaagaccagaucugggaaaaucaugcgccgggugcugagaaagauugcucaaaaugaccacgaucugggagacauguccacgguugccgauccuagcgugaucucucaucuuuucucccaccggugucucaccauucaguga

SEQ ID NO: 65440 - RNA, 2061 nt, Artificial Sequence
  derived and/or modified sequence opt5 from ACSS3__Homo_sapiens__NP_078836
augaagcccagcuggcugcagugcagaaaagugaccuccgccggcgggcucggaggcccucugccggggucuagccccgcucggggagccggcgcggcucuccgcgcccuggucguuccugggcccagaggaggccucggcgggcggggaugucgcgcccuguccucuggcagcggguccgaguacaagacacacuucgcugccucugugacggacccugaaagauuuuggggaaaagcugccgagcaaaucagcugguauaagcccuggaccaaaacacuugaaaacaagcauuccccuagcacccggugguucguggagggcaugcugaauauuugcuacaacgcggucgaucgccacaucgaaaaugggaagggagacaaaauugccaucauuuaugauucuccggugacaaacaccaaggcuacauuuaccuacaaagagguucucgaacagguguccaagcuggccggcguccuggugaaacauggcaucaagaagggggacacgguugugaucuauaugcccaugauuccucaggcuauguacaccaugcucgccugugcgagaaucggagccauucacagccugaucuucggcggguuugcuucuaaagaacuuuccagccggauugaucaugucaagcccaaagugguggucacagccucuuucggaaucgagccuggccgcagaguugaauaugugccccugguggaggaggcucucaagauugggcagcacaaaccggacaagauccugaucuacaaucggccuaacauggaagccgucccccuugccccuggacgcgaucuggacugggaugaggaaauggcuaaagcgcaaucccacgacugcgugcccguucucagcgagcauccccuguacauucuguauaccuccggcacaaccggccucccuaagggggugaucagaccgacgggaggcuacgccgucaugcugcacuggucuaugagcuccauuuaugggcuucagcccggagaaguguggugggcugccagcgaucugggcuggguuguggggcauucuuacaucuguuauggcccucuccugcacggaaauacaaccguccuuuacgagggcaagcccguggggacaccugacgccggagcuuauuuucggguccuggccgagcacggcguggcggcucucuucaccgcccccaccgccauucgcgcuaucagacagcaggauccgggggccgcucugggaaaacaauacucccugacacgguuuaagacgcuuuucguugccggcgaaagaugcgacguggagacccuggaauggagcaaaaacgucuuucgcgugccuguucuugaccauugguggcagacagagaccgggucucccaucacagcgagcugugugggccugggaaauuccaagaccccucccccuggccaggccgggaaaucuguccccggauacaacgugaugauucucgaugacaauaugcagaagcugaaggcucggugccuuggcaacaucgugguuaaacugccgcucccucccggggccuucagcggacuguggaagaaucaagaggcuuuuaaacaccuguauuucgagaaguuccccggcuacuaugauacgauggacgccggguacauggaugaggaaggcuaucucuacgucauguccagaguggacgaugugauuaacgucgcgggacaucgcaucagcgccggcgcuauugaggaaucuauccugucccacgggacaguggccgacugugcuguugugggaaaagaggauccucuuaagggccaugucccgcuggcccucugcgugcugcggaaggacaucaaugccaccgaggaacagguucuggaggaaauugugaaacacgucagacagaacaucgggcccguggcugcguuucgcaacgccguuuucgugaagcaacuuccuaaaacccggagcggaaagauucccagaucugcucucuccgccaucgucaauggcaaaccuuauaagauuacaagcaccaucgaggaucccuccauuuuugggcacguggaagagaugcugaagcaggccuga

SEQ ID NO: 65441 - RNA, 1134 nt, Artificial Sequence
  derived and/or modified sequence opt5 from ACTA1__Homo_sapiens__NP_001091
augugcgacgaggaugaaaccacagcccuggugugugacaacggcagcgggcucgucaaggcuggauucgccggcgaugacgcgcccagagcuguuuuuccuuccaucguggggcggccgcgccaccagggagugauggucggcauggggcaaaaagauucuuacgugggagacgaggcccagagcaagagaggcauucugacgcuuaaauaucccaucgaacauggcauuaucaccaauugggaugacauggagaagauuuggcaccauacauucuacaacgaacugcggguugccccugaggagcaccccacccuccugacagaagcuccucuuaaucccaaagccaaccgcgagaagaugacccagaucauguuugaaacauucaaugugccugcuauguaugucgccauccaggcggugcugucccucuacgccucugggagaaccacgggaauuguucuggauagcggcgacggggugacccauaacgucccgaucuaugagggauacgcucugccccacgccauuaugcggcucgaucuggcuggccgcgaccuuacagauuaucugaugaagauccucaccgagagaggguacuccuuugugacaaccgccgaacgggagauugugcgcgacaucaaagaaaagcugugcuacgucgcgcuugacuucgagaaugaaauggccacggcugccucuagcuccagccuggagaaaucuuaugagcucccugauggacaaguuauuacaaucggcaacgaaagauuucggugucccgagacccuguuccagccuuccuuuaucggcauggaaagcgcugggauucacgagacaaccuacaauucuaucaugaagugcgacauugauauccgcaaagaccuguaugccaacaaugugauguccggaggcaccacaauguaccccgggauugccgauagaaugcagaaggaaaucacggcucucgcgccgagcaccaugaagaucaaaauuaucgccccucccgagcggaaguauucuguguggauuggaggcuccauccuggcuagccuuuccacauuccagcaaauguggauuaccaaacaggaguacgacgaagccgggccuucuaucguccaucgcaaguguuuuuga

SEQ ID NO: 65442 - RNA, 1134 nt, Artificial Sequence
  derived and/or modified sequence opt5 from ACTA2__Homo_sapiens__XP_011538318
augugcgaggaagaggacagcaccgcccuggugugugauaacggcuccgggcucugcaaggcuggauucgccggcgacgaugcgcccagagcugucuuuccuucuaucguugggcggccgcgccaccagggagugauggugggcauggggcaaaaagacagcuacgucggagaugaagcccaguccaagagaggcauucugacacuuaaauaucccaucgagcauggcauuaucacgaauugggacgauauggaaaagauuuggcaccauucuuucuacaacgagcugcggguggccccugaggaacaccccacccuccugacagaggcuccucuuaaucccaaagccaaccgcgaaaagaugacccagaucauguuugagacauucaauguuccugcuauguauguggccauccaggcgguccugagccucuacgccuccgggagaaccacaggaauugugcuggacucuggcgaugggguuacccauaacgugccgaucuaugagggauacgcucugccccacgccauuaugcggcucgaccuggcuggccgcgaucuuacggacuaucugaugaagauccucaccgaaagaggguacagcuuugucacaaccgccgagcgggaaauugugcgcgauaucaaagagaagcuguguuacguggcgcuugacuucgaaaaugagauggccacagcugccuccucuagcucccuggagaaaagcuaugaacucccugacggacaagucauuaccaucggcaacgagagauuucggugccccgaaacgcuguuccagccuucuuuuaucggcauggaguccgcugggauucacgaaacaaccuacaauagcaucaugaagugugauauugacauccgcaaagaucuguaugccaacaauguucucucuggaggcacaaccauguaccccgggauugccgacagaaugcagaaggagaucaccgcucuggcgccguccacaaugaagaucaaaauuaucgccccucccgagcggaaguauagcguguggauuggaggcuccauccuugcuucucugagcacguuccagcaaauguggauuuccaaacaggaauacgaugaggccgggccuagcaucgugcaucgcaagugcuuuuga

SEQ ID NO: 65443 - RNA, 1128 nt, Artificial Sequence
  derived and/or modified sequence opt5 from ACTB__Homo_sapiens__NP_001092
auggacgaugacaucgccgcucugguggucgauaacggcagcgggaugugcaaggccggauucgcgggcgacgaugcucccagagccguuuuuccuuccauuguggggcggccgcgccaccagggagugauggucggcauggggcaaaaagacucuuacgugggagaugaggcccagagcaagagaggcauccucacccugaaauaucccauugaacauggcaucguuacaaauugggacgauauggagaagauuuggcaccauacguucuacaacgaacuucggguggcuccugaggaacaccccguccugcucaccgaggccccucugaaucccaaagcuaaccgcgagaagaugacacagaucauguuugaaaccuucaauaccccugccauguauguggcgauccaggccguucuuucccuguacgcuucugggagaacaacaggaauugugauggacagcggcgauggggucacccauacggugccgaucuaugagggauacgcccucccccacgcuauucugcggcuggaccucgccggccgcgaucugaccgacuaucuuaugaagauccugacagaaagaggguacuccuuuaccacaaccgcggagcgggagauugugcgcgacaucaaagaaaagcucuguuacgucgcccuggauuucgagcaagaaauggcuacggccgcuucuagcuccagccuugagaaaucuuaugaacugccugacggacagguuauuacaaucggcaacgagagauuucggugccccgaggcccucuuccagccuuccuuucugggcauggaaagcugugggauccacgagaccacauucaauucuauuaugaagugcgauguggacauccgcaaagaucuguacgccaacaccgugcucuccggaggcaccacaauguaucccgggauugcugacagaaugcagaaggaaaucacggcgcuggccccgagcaccaugaagauuaaaaucaucgcuccucccgagcggaaguacucugucuggauuggaggcuccauccuugccagccuguccacauuucaacagauguggauuucuaaacaggaauaugaugagagcgggccuuccaucgugcaucgcaaguguuucuga

SEQ ID NO: 65444 - RNA, 1131 nt, Artificial Sequence
  derived and/or modified sequence opt5 from ACTBL2__Homo_sapiens__NP_001017992
augaccgacaacgagcugagcgcccucguggucgauaauggcuccgggaugugcaaggcuggauucggcggggacgaugcccccagagcgguuuuuccuucuaugaucggacggccgcgccaccagggcgugaugguggggaugggacaaaaagacuguuacgucggcgaugaagcucagagcaagagaggcgugcugacacuuaaauaucccauugagcaugggguugugacgaacugggacgauauggaaaagaucugguaccacaccuucuauaaugagcugcgggucgccccugacgaacaucccauucuccugacagaggccccucuuaaccccaaaaucaaucgcgagaagaugacccagauuauguuugaggcuuucaacacacccgccauguacguggcuauccaggccguucugucccucuaugcgucuggaagaaccacaggcaucgugauggauagcggggacggagucacccacauugugccgaucuacgaaggcuaugcccugccccaugcuauucugcggcucgaucuggccgggcgcgaccuuacggauuaccugaugaagauccucaccgaaagaggauacaauuuuacaaccacagcugagcgggagauugugcgcgacgucaaagaaaagcugugcuauguugcccuugacuucgagcaagaaauggugagagcggccgcuuccucuagcccugagcgguccuacgaacugcccgauggccaggugaucaccauuggcaacgagcgcuuuagauguccugaggccaucuuccagcccagcuuucucgggaucgaaucuuccggcauucacgagacgacauucaauagcaucaugaaaugcgacgucgauauucggaaggaccuguaugcuaacaccgugcugucuggaggguccacaauguacccgggaaucgccgaucgcaugcagaaagaaauuaucacccucgccccuagcaccaugaagaucaagauuaucgcucccccugagagaaaauauucuguuuggauuggcggguccauccuggcgagccuuuccacauuucaacagauguggauuucuaagcaggaauacgacgaggccggaccucccaucgugcaccggaaauguuucuga

SEQ ID NO: 65445 - RNA, 1134 nt, Artificial Sequence
  derived and/or modified sequence opt5 from ACTC1__Homo_sapiens__NP_005150
augugcgacgaugaggaaaccacagcccuggugugugacaacggcagcgggcucgucaaggcuggauucgccggcgaugacgcgcccagagcuguuuuuccuuccaucguggggcggccgcgccaccagggagugauggucggcauggggcaaaaagauucuuacgugggagacgaggcccagagcaagagaggcauucugacgcuuaaauaucccaucgaacauggcauuaucaccaauugggaugacauggagaagauuuggcaccauacauucuacaacgaacugcggguugccccugaggagcaccccacccuccugacagaagcuccucuuaaucccaaagccaaccgcgagaagaugacccagaucauguuugaaacauucaaugugccugcuauguaugucgccauccaggcggugcugucccucuacgccucugggagaaccacgggaauuguucuggauagcggcgacggggugacccauaacgucccgaucuaugagggauacgcucugccccacgccauuaugcggcucgaucuggcuggccgcgaccuuacagauuaucugaugaagauccucaccgagagaggguacuccuuugugacaaccgccgaacgggagauugugcgcgacaucaaagaaaagcugugcuacgucgcgcuugacuucgagaaugaaauggccacggcugccucuagcuccagccuggagaaaucuuaugagcucccugauggacaaguuauuacaaucggcaacgaaagauuucggugucccgagacccuguuccagccuuccuuuaucggcauggaaagcgcugggauucacgagacaaccuacaauucuaucaugaagugcgacauugauauccgcaaagaccuguaugccaacaaugugcucuccggaggcaccacaauguaccccgggauugccgauagaaugcagaaggaaaucacggcucuggcgccgagcaccaugaagaucaaaauuaucgccccucccgagcggaaguauucuguguggauuggaggcuccauccuugcuagccuguccacauuccagcaaauguggauuucuaaacaggaguacgacgaagccgggccuagcaucguccaucgcaaguguuuuuga

SEQ ID NO: 65446 - RNA, 1128 nt, Artificial Sequence
  derived and/or modified sequence opt5 from ACTG1__Homo_sapiens__NP_001605
auggaggaagagaucgccgcucuggugauugacaacggcagcgggaugugcaaggccggauucgcgggcgaugacgcucccagagccgucuuuccuuccaucguugggcggccgcgccaccagggagugauggugggcauggggcaaaaagauucuuacgucggagacgaagcccagagcaagagaggcauucucacccugaaauaucccaucgagcauggcauugugacaaauugggaugacauggaaaagaucuggcaccauacguucuacaacgagcuucggguugcuccugaggaacaccccgugcugcucaccgaggccccucugaaucccaaagcuaaccgcgaaaagaugacacagaucauguuugagaccuucaauaccccugccauguaugucgcgauucaggccgugcuuucccuguacgcuucugggagaacaacaggaaucguuauggauagcggcgacggggugacccauacggucccgauuuaugagggauacgcccucccccacgcuauccugcggcuggaucucgccggccgcgaccugaccgauuaucuuaugaagauucugacagaaagaggguacuccuuuaccacaaccgcggagcgggaaaucgugcgcgacauuaaagagaagcucuguuacguggcccuggauuucgaacaagagauggcuacggccgcuucuagcuccagccuugagaaaucuuaugaacugccugacggacaggucaucacaaucggcaacgagagauuucggugccccgaagcccucuuccagccuuccuuucugggcauggagagcugugggauucacgaaaccacauucaauucuaucaugaagugcgacguugauauucgcaaagaccuguacgccaacaccgugcucuccggaggcaccacaauguaucccgggaucgcugauagaaugcagaaggagauuacggcgcuggccccgagcaccaugaagaucaaaaucauugcuccucccgagcggaaguacucuguguggaucggaggcuccauucuugccagccuguccacauuucaacagauguggaucucuaaacaggaauaugacgagagcgggccuuccauuguccaucgcaaguguuucuga

SEQ ID NO: 65447 - RNA, 1002 nt, Artificial Sequence
  derived and/or modified sequence opt5 from ACTG2__Homo_sapiens__NP_001186822
augugcgaggaagagaccacagcccuggugugugacaacggcagcgggcucugcaaggcuggauucgccggcgaugacgcgcccagagcugucuuuccuuccaucguugggcggccgcgccaccagauuuggcaucacucuuucuacaaugaacugagaguggcccccgaggaacauccuacgcuucugaccgaggcuccccucaacccuaaagccaaucgggagaagaugacacaaaucauguuugaaaccuucaacgugcccgccauguaugucgcuauucaggccgugcugagccuuuacgcguccggacgcacaaccggcaucguucuggauucuggggacggagugacacacaaugucccuauuuaugagggcuacgcccucccgcaugcuaucaugagacuggaucuggccggccgggaccucaccgauuaucugaugaaaauccuuacggaacgcggguacagcuuugugaccacagcugagagagagauuguucgggacaucaaggaaaaacuguguuauguggcccucgauuucgagaacgaaauggcgaccgccgcuuccucuagcucccuggaaaagagcuacgagcuucccgacggacaggucauuacaaucggcaaugagcgcuuuagaugcccugagacccuguuccagcccucuuuuauugggauggaauccgccggaauccacgagacgacauacaacagcauuaugaagugugauaucgacauccggaaagaucucuaugcuaauaacgugcugucuggcgggaccacaauguacccuggaauugccgaccgcaugcaaaaggaaaucaccgcccuggcucccuccaccaugaaaauuaagaucauugcgccgccugagagaaaauauagcguguggaucggcggcucuauccucgccucccugagcacauuccagcagauguggauuuccaagcccgaauacgacgaggcugggccuucuaucguccaccggaagugcuuuuga

SEQ ID NO: 65448 - RNA, 1290 nt, Artificial Sequence
  derived and/or modified sequence opt5 from ACTL6A__Homo_sapiens__NP_004292
augagcggcgggguguacggaggcgacgaggucggggcccugguuuucgauaucggauccuauaccgugagagcuggcuacgccggggaagacugccccaagguggauuuuccuacagcgauuggaauggucguggagcgggacgauggcucuacgcucauggaaaucgacggcgauaaagggaagcagggaggcccgaccuauuacauugacacaaacgcucugcgcguucccagagagaauauggaagccaucagcccucuuaaaaacgggaugguggaggauugggacuccuuccaagccauucuggaucacaccuauaagaugcaugucaaaucugaggcuagccuccaccccgugcugauguccgaagccccuuggaauacacgggcuaagcgcgagaagcucaccgaacugauguuugagcauuacaacauccccgccuucuuucucuguaaaacagcgguucugaccgccuucgcuaauggaagaucuacgggccugauccucgacagcggggccacccacacaaccgcuauuccugugcaugauggauauguccugcagcagggcaucgugaaguccccgcuugccggcgacuuuauuacaaugcagugccgggagcuguuccaagaaaugaacaucgagcucgugcccccuuacaugauugcgagcaaagaagccguccgcgaggggucucccgcuaauuggaagagaaaagaaaagcugccucagguuacccgguccuggcacaacuacauguguaauugcgugauccaggacuuucaggccagcgugcuucaagucucugauuccacguaugacgaacagguggcugcccagaugcccacaguucacuacgaguucccgaacggauauaauugugauuuuggcgccgagcgccugaagauuccugaggggcuuuucgaccccagcaacgugaaaggacugucuggcaauaccaugcugggggucucccaugugguuacaaccagcgugggaaugugcgauaucgacaucagaccuggccucuacggcuccgucauuguggcugggggaaacacccugauccagucuuuuacagaucggcuuaaucgcgaacugagccaaaagacgccucccuccaugagacucaaacugauugcgaacaacaccacagucgagcggcgcuucagcucuuggaucggcggguccauucuugccagccugggaaccuuccagcagauguggaucucuaagcaagaauaugaggagggcgggaaacaguguguggaaagaaagugccccuga

SEQ ID NO: 65449 - RNA, 1281 nt, Artificial Sequence
  derived and/or modified sequence opt5 from ACTL6B__Homo_sapiens__NP_057272
augagcggcgggguguacggaggcgacgaggucggggcccugguuuucgauaucggauccuuuucugugagagcuggcuaugccggggaagacugccccaaggcggauuucccuaccacagugggacuccuggcugccgaggaaggcggcgggcuugagcuggaaggagacaaagagaagaaaggcaagauuuuucacaucgauacgaacgcccuccaugucccgcgggacggggcugaggugaugagcccccugaaaaauggaaugauugaagauugggaguguuuccgcgccauccuugaccacaccuacuccaagcauguuaagucugaaccuaaccugcaccccgugcucaugagcgaggcuccuuggaauacaagagccaaacgggagaagcugaccgaacugauguuugagcaguauaacauucccgcguucuuucucugcaaaacagccguccugaccgcuuucgccaauggccgcuccacagggcuugugcuggauucuggagcuacccauacgaccgccaucccuguucacgacggcuacgugcuccaacagggcaucgucaagagcccgcuggcgggggauuuuauuuccaugcaguguagagaacuuuuccaggagauggccaucgacauuauucccccuuauaugauugcugccaaagaacccgugcgggagggagcuccucccaacuggaagaagaaagagaagcugccgcaagugagcaaaucuuggcacaauuacaugugcaacgaagucauccaggauuuucaggccuccguucuccaggugagcgacucuccuuaugacgagcaaguggccgcucagaugcccacaguccauuacgaaaugccuaauggcuacaacaccgauuauggggcggagcgccugagaauccccgaaggacuguucgaccccuccaaugugaagggccucagcgggaacacaaugcugggaguuggccacguggucaccacgucuaucggcaugugugauaucgacauucggccugggcuuuacggauccgugaucguuacaggcgggaauacccugcuccagggauuuacagaucgccugaacagagagcuuagccagaaaaccccgcccuccaugcggcugaagcucauugccucuaauagcaccauggagcgcaaauucuccccuuggaucggcgggagcauucuggcuucucugggcacauuccaacagauguggaucuccaagcaggaauaugaggaaggaggcaagcaaugcguggagagaaaaugucccuga

SEQ ID NO: 65450 - RNA, 1176 nt, Artificial Sequence
  derived and/or modified sequence opt5 from ACTL8__Homo_sapiens__XP_011540513
augagccugcugcccccuagagaguccccggccgcuucuagcuccaccucugugcccccuacaagcgccuccgcgauggcugcccggacggucaucauugaccacggcucuggguuccucaaggccggaaccgcuggcuggaacgaaccccagaugguuuuuccuaauaucgugaacuaccuucccugcaaagagaauccugggccgagcuaugcccgcagacgggugucccugggaauugauaucugucaucccgacacauucagcuacccuauugaacgcggcagaauccucaacugggaggggguccaauaucuguggucuuuugugcuugaaaaucaccggcgcgagcaggagguucccccugugaucauuaccgaaacaccccugagagagccggcugaucggaagaaaaugcucgaaauccuguucgagcugcuccaugucccuuccgugcugcuugccgaccagcugcagaugagccucuacgcgucuggacugcuuaccggcguuguggucgauuccggcuaugggcugacacgcgugcaacccuuucaccagggaagaccucuccccgccagcggcaagacccuggaguucgcugggcaggaccugucugccuaccuccugaaaucccuuuuuaaggaagauugcgaccggcgcugucuguuccagcucgagacgguggcugucacccaaaugaacaagugcuauguuccccagaaucugggagaagcccuugauuuuagagagcggcagcagagcgcgcuggacgaauccaacacauaccaacucccugauggcucucgcguggagcugaccccgaugcagagaguggcccccgagauguucuuuagcccucaggucuucgaacaacccgggccuuccauuccccgggcuaucguggagagcguugaaucuugugagauuucccugagaccgcuccuggugagccaugucauggccugcggaggcaauacacuuuacccuggcuuuaccaaacgccuguuccgggaacucaugggggaccacgugucuagcacgaaggcuacaguuugggagggauccaacagaaauuucucuguguggcugggcgccagcgucguggcccaccuuuccaccuaucagagcgaguggaugucucgcgaagaguacggggaacauaugcggauguga

SEQ ID NO: 65451 - RNA, 1251 nt, Artificial Sequence
  derived and/or modified sequence opt5 from ACTL9__Homo_sapiens__NP_848620
auggacgccagcagacccaaguccucugagagccaguccucucuggaagcuccucggccgggccccaacccuagccccaauguggucaacaaaccucuccaacgcgauucccccgggaugguugccgacagacugccuccgaagaccggagcgguggugaucgauaugggcacagggacgugcaaagucggauucgcuggccaggccucucccaccuacacaguggccaccauucuugggugucagccuaagaaacccgcuacaagcggacaguccggccugcaaaccuuuaucggcgaggccgcucggguucucccugaacugacacuugugcagccccugcgcagcgggauugucguggacugggaugccgcggagcucaucuggagacaccuucuggaacaugaccuccggguugccacccacgaucauccgcugcuuuucucugacccucccuuuuccccugcuacgaaucgcgagaagcugguggaggucgccuucgaaagccucagaucucccgcuauguauguggccucccagagcgugcugucugucuacgcgcacggacggguuuccggccuugugguggauaccgggcauggagucacauauaccgugcccguuuuucagggcuacaaccugcuccacgccacagagcgccuggaccuggcugggaauaaccucaccgccuuccuggcugaaaugcuucugcaagccggacucccucugggccagcaggaucuugaccugguggagaauauuaagcaccauuauugcuacgucgccagcgauuuucagaaagagcaagcuagaccggaacaggaguauaagcggacgcucaaacugcccgacggccgcacagugacccuggggaaggaacucuuccaguguccugagcugcuuuuuaaucccccugaaguucccggacuguccccggugggccucucuacaauggcgaaacaaagccugagaaagcugucccuggagaugcgggccgaccucgcucagaacguccugcugugcgggggaagcucucucuucaccggcuuugaggggcgcuucagagccgaacugcuucgggcccugccugcugagacccacguggucguggccgcgcagcccacaagaaacuuuuccguuuggaucggaggcagcauccucgcuucucugcgcgccuuccagagcuguugggugcugcgggaacaauacgaggaacagggcccuuacauugucuauagaaagugcuacuga

SEQ ID NO: 65452 - RNA, 2679 nt, Artificial Sequence
  derived and/or modified sequence opt5 from ACTN1__Homo_sapiens__NP_001093
auggaccacuacgauagccagcaaaccaacgacuauaugcagcccgaggaagauugggacagagaucugcuccuggacccugccugggagaagcagcagcggaaaacauucacggcuuggugcaauucccaucuucgcaaggccggcacccaaaucgaaaacauugaggaagauuuuagagacgggcugaaacucaugcugcuucuggaggugaucucuggagagcggcucgcgaagccggaacgcggcaaaaugagaguccacaagauuagcaauguuaacaaggcucuggauuucaucgccuccaaaggggugaagcuggugucuauuggagccgaggaaaucgucgacggcaaugugaaaaugacacucgggaugaucuggaccauuauccugcgguuugcuauucaggauaucagcguugaggagacauccgccaaggaaggacuucugcucuggugucagcgcaaaaccgcucccuacaagaacgugaauauucagaacuuccauaucucuuggaaggacggccugggcuuuugcgcccuuauucacagacaucggccugagcugaucgauuaugggaaacuccgcaaggacgacccccugacaaaucugaacaccgcguucgaugucgccgaaaaauaccucgacaucccuaagaugcuggaugcugaggacauugugggaacggccagacccgaugaaaaagcuaucaugaccuauguuagcuccuuuuaccacgccuucagcggcgcgcaaaaggccgagacagcugccaaucggauuuguaaagugcuugcugucaaccaggagaaugaacagcugauggaggacuaugaaaagcucgccucugaucugcuugaguggauccgcagaaccauuccuuggcuggaaaaccgggugccggagaauacaaugcacgccaugcagcaaaagcucgaggacuuucgcgauuacagacggcugcauaaacccccuaaggugcaggaaaaaugccagcuggagaucaacuucaacacccuccaaacgaagcugagacuuuccaaucgccccgcuuuuaugccuagcgaagggcggauggucucugacaucaacaaugcguggggaugucuggagcagguugaaaaaggcuacgaggaguggcuccugaacgaaauuagacgccuugagcggcuggaucaccucgccgaaaaguucagacagaaggcuuccauccaugaggccuggacagacgggaaagaggccaugcugcgccagaaggacuaugaaaccgcuacacugagcgagauuaaagcccuccugaagaaacacgaagcguuugagucugaucuugcugcccaccaagaccggguggaacagaucgccgcuauugcccaggagcugaaugagcucgauuacuaugacucccccagcgugaacgcuagaugccagaagaucugugaucaaugggacaaucugggagcccugacccagaagcgccgggaagcgcuugagagaaccgaaaaacuccuggagacaaucgaucagcuguaccucgaauaugccaagcgcgcugccccguucaacaauuggauggagggcgcuauggaggaccugcaggauacguucauuguccauaccaucgaagagauucaaggccuuacaaccgcccacgaacaguuuaaagcgacacugccugacgccgauaaggagcggcucgcuauccuggggauucauaacgaaguguccaaaaucguucagaccuaccacgugaauauggccggaacgaaccccuauacaaccauuaccccucaggagaucaauggcaagugggaccaugucagacaacuggugccccggcgcgaucaggcucuuacagaggaacacgccagacagcaacacaacgagcggcucagaaagcaguucggggcccaggcuaauguuaucggacccuggauucagaccaaaauggaagagaucggccgcauuucuaucgagaugcaugggacacuggaagaccaacugagccaccuccggcaguacgagaaguccauugugaacuacaaaccuaagaucgaccagcuggaaggagaucaucagcuuauccaagaggcgcugauuuuugacaacaaacacacgaauuauaccauggaacacaucagagucggcugggagcagcuccugacaaccauugcccgcacaaucaacgagguggaaaaucagauucugaccagagaugcuaagggcaucagccaggagcaaaugaacgaguuccgggccucuuuuaaucauuucgaccgcgaucacuccgggacgcuuggaccggaagaauuuaaagccugccucaucagccugggcuacgacauugggaacgauccccagggagaggcugaguucgccagaaucaugucuauugucgacccuaaucggcugggcgugguuaccuuucaggcguucaucgauuuuaugagccgcgaaacagcugacaccgauacagccgaccaagugauggccuccuucaagauucucgcuggggauaagaacuauaucaccauggacgagcugagacgggaacuucccccugaccaggccgaguacuguaucgcgcgcauggcucccuauacgggcccggauucugucccuggagcccuggacuacaugagcuuuuccacagcccucuauggcgaaagcgaucuguga

SEQ ID NO: 65453 - RNA, 2685 nt, Artificial Sequence
  derived and/or modified sequence opt5 from ACTN2__Homo_sapiens__NP_001094
augaaccagaucgagcccggcgugcaauacaauuaugucuacgacgaagaugaguauaugauucaggaagaggaaugggacagagaucugcuccuggacccugccugggagaagcagcagcggaaaaccuucacagcuuggugcaacagccaccuucgcaaggccgggacgcaaaucgagaauauugaagaggauuuuagaaacggacugaaacucaugcugcuucuggaaguuaucuccggcgagcggcucccgaagcccgaccgcgggaaaaugagauuccauaagauugcgaaugugaacaaggcucuggauuacaucgccucuaaaggagugaagcuggucagcaucggcgccgaggaaauuguggacgggaauguuaaaaugacccucggaaugaucuggacaauuauccugcgguuugcuauucaggauaucuccguggaggaaaccucugccaaggagggccuucugcucuggugucagcgcaaaacagcuccuuauagaaacgucaauauucagaacuuccacaccagcuggaaggacggccuggggcuuugcgcccugauccaucggcaccgccccgaucucaucgacuacuccaagcugaauaaagaugacccuauuggaaacaucaaucuggcgauggaaauugccgagaagcaucucgacauccccaaaaugcuggaugcugaggacauugugaacacaccuaagccggaugaaagagccaucaugaccuauguuucuuguuuuuaccacgcuuucgccggcgcggagcaagccgaaacggcugccaaucggaucugcaaagugcuugcugucaaccaggagaacgaacgccugauggaggaguacgaaagacucgccagcgagcugcuugaauggauucggcgcaccauccccuggcuggagaauagaacaccugaaaagaccaugcaggccaugcagaaaaagcucgaggacuuucgggauuauagacgcaagcacaaacccccuaaggugcaagagaaaugucagcuggaaauuaacuucaauacacugcagaccaagcuccggaucuccaacagacccgcuuuuaugccgagcgaggggaaaauggugucugacauugcgggagccuggcaacgccuggaacaggcugagaagggcuacgaggaauggcuucugaaugagauccggagacucgaacgccuggagcaucuugccgaaaaguuccggcagaaagccuccacgcacgagacaugggcuuaugggaaggagcagauccugcuccaaaaagauuacgaaagcgccucucugaccgaggucagagcgcugcuccgcaagcaugaggcuuuugaguccgaccuggccgcccaccaggaucggguugaacagauugcugccaucgcucaggagcuuaacgagcuggacuaucacgaugccgugaaugugaacgacagaugccaaaagauuugugaccagugggaucgccucggaacacugacccagaagcggagagaagcgcuggagcggauggaaaaacuucucgagaccaucgaccagcugcaucuggaguucgccaaacgcgcugccccuuuuaauaacuggauggagggcgcuauggaggaucuccaagacauguucauuguccacagcaucgaagagauucagucucugaucacagcccaugaacaguucaaggcgacgcuucccgaggccgauggcgagagacaguccaucauggcuauucaaaaugaaguggagaaaguuauccagagcuacaacauucggaucuccucuagcaauccuuauuccaccgugacaauggacgaacugagaaccaagugggauaaagucaagcagcucgugcccauucgcgaccaaagccugcaggaggaacuggcccggcagcacgcuaacgagagacuucgcagacaguuugccgcccaagcuaaugcgaucgggcccuggauccagaacaagauggaggaaauugcccggucuuccauccagauuacaggagcucucgaggaucagaugaaccaacugaaacaguacgaacauaauaucauuaacuacaagaauaacaucgacaaacuggagggcgaucaccagcucauccaggaagcccugguuuucgacaauaagcacaccaacuauacgauggagcauauucgcguggggugggagcuucugcucacaaccaucgccagaaccauuaaugaagucgagacacaaauccugacccgggaugcuaaaggaauuacacaggaacagaugaacgaguuucgcgccagcuucaaucacuuugacagacggaagaacggccugauggaccaugaagauuuccgcgcgugccuuaucucuaugggguacgaccucggagaggcugaguuugccagaaucaugacgcugguggauccuaauggccaaggcaccgucacauuccagagcuuuauugacuucaugacccgggaaacagccgauaccgacacggcugaacaggugaucgccuccuuucgcauucuggcgucugauaaaccguauauccucgcugaagaacugagacgggagcuucccccugaccaggcccaauacuguauuaagagaaugcccgccuauagcgggccuggauccguucccggcgcucuggauuacgccgcuuucagcucugcccucuauggggaauccgaccuguga

SEQ ID NO: 65454 - RNA, 2706 nt, Artificial Sequence
  derived and/or modified sequence opt5 from ACTN3__Homo_sapiens__NP_001095
augaugauggugaugcagcccgagggccugggggccggagaaggcagauucgcugggggaggcgggggaggcgaguacauggaacaagaggaagacugggaucgggaccuccugcuugauccugccugggagaagcagcagcgcaaaaccuuuacagcguggugcaacagccaccugagaaaggcuggcacgcagaucgagaauauugaagaggacuuccggaacgggcucaaacugaugcuucugcucgaagucaucuccggagagcgccugccgagacccgauaagggcaaaaugcgguuucauaagauugccaauguuaacaaggcccuggacuucaucgcuucuaaaggggugaagcucgugagcauuggagccgaggaaaucgucgauggcaaucugaaaaugacccuugggaugaucuggacaauuauccugcgcuuugcuauucaagacaucuccguggaggaaaccucugccaaggagggacuccugcuuuggugucagagaaaaacagcgccuuaucggaacguuaaugugcagaacuuccacaccagcuggaaggauggccuggcccucugcgcucugauucaucgccacagacccgaccugaucgauuacgccaagcuccggaaagacgauccuauuggcaaucugaacacagcuuuugaagucgccgagaaguaucuugacauccccaaaaugcuggacgcggaggauaucgugaauaccccuaagccggacgaaaaagccauuaugacguacguuuccuguuucuaucaugcuuuugccggggcugagcaggccgaaaccgccgcuaaccgcaucugcaaggugcucgcggucaaucaagagaacgaaaaacugauggaggaguacgaaaaacuugccucugagcugcucgaauggauuagacggacagugcccuggcuggagaaucgcgugggagaaccuagcauguccgcuaugcagagaaagcuggaggauuuccgggacuauagacgccuccacaagcccccucggauccaggagaagugucagcuggaaauuaacuuuaacacccuucaaacaaaacugagacucagccaccgccccgccuucaugccgucugagggcaagcuggucuccgauaucgccaaugcuuggcgggggcuugaacagguugagaaaggauacgaggacuggcugcucagcgaaaucagacgccugcagcggcugcaacaucucgccgagaaguuuagacagaaggcgucucugcacgaggcuuggacccgcggcaaagaggaaaugcuuucccagcgggauuacgacagcgcccugcuccaggaggugagagcccugcugcgccggcaugaggcuuucgaaucugaucuugccgcucaccaagacagaguggagcacauugccgcgcucgcccaggaacugaacgagcuggauuaucaugaagcugccuccgucaauagccggugccaggcuaucugugaccagugggacaaccucgggacgcugacacaaaagcgcagagaugcccuugagcggauggagaaacugcucgaaaccauugacagacugcagcuggaguucgcgcgccgggccgcuccuuuuaauaacuggcuugauggagccguggaagaccuccaggauguuuggcuggugcacuccgucgaggaaacacagucucugcucaccgcucaugaccaauucaaggccacccugcccgaggccgauagagagcgcggcgcuaucaugggcauucagggggaaauccagaaaaucugccagacauacggacuuagaccuuguagcacgaaucccuauauuacccugagcccccaagacaucaacacaaagugggauauggugcggaagcucguuccuuccugcgaccagacccugcaggaggaacuggcgcgccaacaggugaaugagagacuucggcgccaguuugccgcucaggccaacgccauuggcccguggauccaagcuaaagucgaggaaguggggagacucgccgcgggacuggcuggcucucuggaggaacagauggccgggcuccggcagcaggagcaaaauauuaucaacuacaagacaaauauugaucgccuggaaggcgaccaccagcuucugcaggagucccucgucuucgauaacaaacauaccguguauagcauggagcacaucagaguuggaugggaacagcugcugacgucuaucgcccggacaauuaaugagguggaaaaccaaguccuuacccgcgacgcuaagggccucagccaggagcagcugaacgaauuuagagccuccuucaaucacuuugaccggaaacaaaacgggaugauggagcccgaugacuucagagcgugucugaucucuaugggauacgaucucggcgagguggaauuugcucgcauuaugaccaugguugacccuaaugccgccgggguggucacauuccaggcuuuuaucgauuucaugacccgggagacagccgaaacggacaccacagaacaggugguggcuagcuuuaagauucuggccggagauaagaacuauaucacccccgaggaacuuagacgcgagcugccugcgaaacaggccgaauacugcauccggagaaugguucccuacaagggcuccggggcuccggccggcgcucucgacuaugucgccuucagcucugcccuguacggagaguccgaucuguga

SEQ ID NO: 65455 - RNA, 2736 nt, Artificial Sequence
  derived and/or modified sequence opt5 from ACTN4__Homo_sapiens__NP_004915
augguggacuaccacgccgcuaaccagagcuaucaauacggccccuccucugccgggaauggagcgggcgggggaggcagcaugggggauuauauggcucaggaggacgauugggacagagaucugcuccuggacccugccugggaaaagcagcagcggaaaaccuucacagccuggugcaacucccaucuucgcaaggcuggaacgcaaaucgagaauauugaugaagacuuuagagauggccugaaacucaugcugcuucuggaggucaucucuggcgaacggcucccgaagcccgagcgcgggaaaaugagaguucacaagauuaacaaugugaacaaggcccuggacuucaucgcuagcaaaggagugaagcuggucuccauuggcgccgaggaaaucguggaugggaaugcgaaaaugacccucggaaugaucuggacaauuauccugcgguuugccauucaggacaucucuguugaggaaaccagcgcuaaggagggccuucugcucuggugucagcgcaaaacagccccuuacaagaacgugaauguccagaacuuccauauuuccuggaaggaugggcuggcuuuuaaugcccuuauccacagacaucggcccgagcugauugaauaugacaaacuccgcaaggacgauccugugaccaaccugaauaacgcguucgagguugccgaaaaauaccuggacauccccaagaugcucgaugcugaggacaucgugaauacagccagaccugaugaaaaagcuauuaugaccuaugucagcucuuuuuaccacgccuucuccggagcccaaaaggcugagacggcggccaaccggaucugcaaagugcuggcugugaaccaggagaaugaacaccuuauggaggacuacgaaaagcuggccagcgaucuccuggaguggauucgcagaaccaucccguggcuugaagaccgggucccccagaagacaauucaggagaugcaacagaaacuggaggauuuucgcgacuauagacggguucauaagccucccaaagugcaggaaaagugucaacucgagaucaacuucaauacccugcagacaaaacugagacucucuaaccgcccugccuuuaugcccuccgaaggcaagauggugagcgauaucaauaacggcuggcagcaccuggagcaggcugaaaagggguacgaggaguggcuucugaaugaaauucggagacucgagcgccuggaccaucuugccgaaaaauuccggcaaaaggcgucuauccacgaggcuuggaccgacggaaaagaggccaugcugaagcacagagauuaugaaacggccacacucuccgacauuaaagcucugauccgcaagcaugaggccuuugaaagcgaucuggcugcccaccaggaccgggucgagcagauugcggccaucgcucaggaacucaacgagcuggauuacuaugacucccauaaugugaacaccagaugccaaaagaucugugaucagugggacgcccuuggcucucugacacacagccgccgggaggcucucgagaaaaccgagaagcagcuggaagccauugaucagcugcaucuugaguacgcgaaaagagccgcuccguucaauaacuggauggaauccgccauggaggaccuccaagauauguucaucguucacaccauugaggaaaucgaggggcugauuagcgcucacgaccaguuuaagucuacacugccugaugccgaccgcgaacgggaggccauccucgcuauucauaaagaagcgcagagaaucgccgaguccaaucacaucaagcugagcggaucuaaccccuauacgaccgugacaccucagauuaucaauagcaagugggagaaaguccaacagcuugugcccaagcgggaccaugcucugcucgaagaacaguccaaacaacagucuaacgaacaucugcgcagacaguucgccagccaggccaacguugugggccccuggauucaaaccaagauggaggagaucgggcggauuuccaucgaaaugaauggaacacuggaggaucagcuuagccaccucaaacaguacgaaagaucuaucgucgacuacaagccuaaccuggaucugcucgagcagcaacaccagcugauucaggaagcucuuaucuuugacaauaaacacaccaacuauacgauggagcauauucgcgugggcugggagcagcugcucacaaccaucgcccggaccauuaaugaagucgagaaccaaauccugacaagagaugcgaagggcaucucccaggaacagaugcaagaguuccgcgcuagcuuuaaucacuucgacaaggaucaugggggagcccugggcccggaagaguuuaaagccugccuuauuucucucggguacgacguggagaacgauagacagggagaagcugaguucaaucggaucaugucccugguugaccccaaccacagcggccuggugaccuuucaggccuucauugauuuuaugucccgcgaaacaacggacaccgauacagcggaccaggucaucgcuucuuucaaggugcucgccggggacaaaaauuuuauuaccgccgaggaacugagacgggagcuuccucccgaucaagcugaguauuguaucgcccgcauggcuccuuaccagggccccgacgccguuccgggagcgcuggauuauaagagcuucuccacagcccucuacggcgaaucugaccuguga

SEQ ID NO: 65456 - RNA, 1131 nt, Artificial Sequence
  derived and/or modified sequence opt5 from ACTR1A__Homo_sapiens__NP_005727
auggagagcuacgacgugaucgccaaccagcccgucguuauugauaauggcuccggggugaucaaggcuggauucgccggcgaccaaauuccuaaauauugcuuuccgaacuacguggggagacccaagcacguccgggugauggcgggagcucuggaaggcgauaucuucauugggccuaaagccgaggaacaucgcggacuccugucuaucagauaucccauggagcacggcaucguuaaggacuggaaugauauggaacggauuuggcaguacguguauagcaaagaccagcuucagaccuuuuccgaggagcauccuguccugcucacagaagcuccccugaacccucgcaagaauagagagcgggccgccgaaguguucuuugagacguucaacguuccggcucuuuuuaucucuaugcaagccgugcugagccucuacgcgaccggccgcacaaccggggucgugcuggauuccggagacggcgugacacacgccguccccauuuaugagggguucgcuaugccucauucuaucaugagaauugauaucgccggacgggacguuagccgcuuucugagacucuaccugcggaaggaaggcuacgauuuccacuccagcucugaguuugaaauugugaaagcuaucaaggagcgcgccuguuaucuuuccaucaauccccagaaagacgaaacccuggagacagagaaggcgcaguacuaucucccugaugggagcaccauugaaaucggacccucuagauuccgggccccggagcugcuuuuucgcccugaccugauuggcgaagaguccgaaggcauccacgaggugcucgucuucgcuauucagaaaagcgacauggaucugagacggacgcuguucucuaacaucgugcucuccgggggaagcacccuguuuaagggcuucggggacagacuucuguccgagguuaagaaacucgcccccaaggaugugaaaauccgcauuucugcuccucaagaacggcuguacagcacauggaucggaggcuccauucuugccagccuggacaccuuuaagaaaaugugggucucuaagaaagaguaugaagaggauggggccagauccauccaucgcaagacauucuga

SEQ ID NO: 65457 - RNA, 1131 nt, Artificial Sequence
  derived and/or modified sequence opt5 from ACTR1B__Homo_sapiens__NP_005726
auggagagcuacgacaucauugccaaccagcccguggucaucgauaauggcuccgggguuauuaaggcuggauucgccggcgaccaaaucccuaaauauugcuuuccgaacuacguggggagacccaagcacaugcgggugauggcgggagcucuggaaggcgaucucuucauugggccuaaagccgaggaacaucgcggacugcuuaccaucagauaucccauggagcacggcgucgugcgggacuggaaugauauggaacgcaucuggcaguacguuuauucuaaggaccagcugcagacauuuagcgaggagcauccugugcuccugacggaagcuccccuuaacccuuccaaaaauagagagaaggccgccgaagucuucuuugagaccuucaacgugccggcucuguuuauuucuaugcaagccguucucagccuguacgcgacaggccggaccacaggggugguccuggauuccggagacggcgugacccacgccgugcccaucuaugagggguucgcuaugccucauucuauuaugcgcgucgauaucgccggaagagacguuagccgguaccuccgccugcuucugagaaaggaaggcguggauuuucacacauccgcugaguucgaagugguccggaccauuaaagagcgcgccuguuaccucagcaucaauccccagaaggacgaagcgcuggagacggagaaagugcaguauacccuuccugaugggucuacacuggacguuggacccgccagauuucgggcuccggaacuccuguuccagccugaccuggugggcgaugaguccgaaggccuccacgaggucguggccuuugcuauucauaagagcgacauggaucugcgcagaacccuuuucgccaacaucguucugucugggggauccacacucuucaaaggcuuuggggaccggcugcuuagcgaagugaagaagcuggcccccaaagauaucaagauuaaaaucucugcuccucaagagagacucuacuccaccuggauuggaggcagcauccuggcgucccuggacacguucaagaaaaugugggucucuaagaaagaguaugaagaggaugggagccgcgccauucaccggaagacauuuuga

SEQ ID NO: 65458 - RNA, 1200 nt, Artificial Sequence
  derived and/or modified sequence opt5 from ACTR2__Homo_sapiens__NP_001005386
auggacagccagggcagaaagguggucguuugcgauaacgggaccggauucgugaaauguggcuacgccggguccaauuuucccgagcacaucuucccugcucuggugggacggccgauuauccgcucuacaacgaaggucggcaacauugaaaucaaaaauaacaagaaaauggaccucauggugggggaugaggccagcgaacugagauccaugcuugagguuaauuaucccauggaaaacggaauugugcggaauugggacgauaugaagcaucugugggacuacaccuuuggcccugagaagcucaacaucgauacacgcaauugcaaaauccugcuuaccgagcccccuaugaaccccacaaagaauagagagaaaauugucgaagugauguucgaaaccuaucaauuuucuggcguuuacguggcgauccaggcuguccugacacucuaugcccaggggcugcugaccggagugguggucgacagcggcgaugggguuacgcacauuuguccuguguacgagggauucucccucccgcaucugacccggcgccuugacaucgccggcagagauauuacacgguaucugaucaagcuccugcuucugcgcggguacgcuuuuaaccacucugccgacuucgagaccgugagaaugauuaaagaaaagcucugcuacgucggauauaauaucgagcaggaacaaaagcuggcucuggagacaaccgugcucguugaaagcuacacgcugcccgauggccggaucauuaaagugggcggggagcgcuuugaggccccugaagcgcuuuuccagccccaucugaucaacgucgagggagugggcguugccgaacuccuguuuaauacaauucaggcugccgacaucgacaccagauccgaguucuauaagcacauugugcuuagcgggggaucuacaauguacccuggccugcccucccggcucgaacgcgagcugaaacagcuguaucucgagagaguccugaagggggauguggaaaaacuuagcaaguuuaaaauccggaucgaggacccgccuagacgcaagcacauggucuuccugggaggcgcugugcucgccgauauuaugaaggacaaagauaacuucuggaugacccggcaagaauaccaggagaagggcguuagagugcuggaaaaacuuggggucaccgugcgcuga

SEQ ID NO: 65459 - RNA, 1047 nt, Artificial Sequence
  derived and/or modified sequence opt5 from ACTR3B__Homo_sapiens__NP_001035225
auggccggcagccugcccccuugcguggucgacugugggaccggauacacaaagcucggcuaugcugggaacacggagccgcaguucaucauucccuccugcaucgccauuagagaaucugcgaaaguuguggaucaagcucagcggcgcgugcugagaggagucgacgaucuugacuuuuucaucggcgaugaggccauugacaagccuaccuacgccacaaaauggcccauccggcacgggaucauugaagauugggaccugauggagcgcuuuauggaacaggugguuuucaaguaucucagagcugagccugaggaucauuacuuucugaugaccgaacccccucuuaauacaccggagaaccgggaauaucuggccgagaucauguucgagagcuuuaaugugcccggacucuacauugcuguccaggccgugcuggcgcuggccgcuuccuggaccucucgccaaguuggcgaaagaacacucaccggcaucgugauugacagcggggauggagucacgcacgugaucccuguggccgagggcuaugucauuggguccuguaucaaacauauccccauugcuggacgggacaucaccuacuucauucagcagcugcuucgcgaaagagagguuggcaucccucccgaacagucucuggagacagccaaggcgauuaaggagaaauacugcuauaucuguccggauaucgugaaggaauuugccaaauacgacguggacccucggaaguggauuaaacaauauaccgggaucaacgcuauuaaucagaagaaguucgucaucgaugugggauacgagcgcuuucucggccccgaaauuuucuuucacccugaguucgccaaccccgacuucauggaaagcaucuccgauguuguggacgaggucauccagaauugccccauugaugugagacggccucuguauaaaccggaguuuuuccagguuugucauacaaagaaagacuacgaagaguauggccccagcaucugccgccacaacccuguguuuggggucaugucuuga

SEQ ID NO: 65460 - RNA, 1104 nt, Artificial Sequence
  derived and/or modified sequence opt5 from ACTR3__Homo_sapiens__NP_001264069
augaagggcguggacgaucuggacuucuuuaucggggaugaggccauugaaaaacccaccuacgcuacaaaguggccuaucagacacggaauugucgaggacugggaucucauggaacgguucauggagcagguuaucuuuaaauaucugcgcgccgaaccggaggaccauuacuuccuucugacggagcccccucucaacacccccgaaaauagagaguauacagcggaaauuauguuugagagcuucaacgugccuggccuguacaucgcugugcaagccguccuugcccuggcugccuccuggaccucucgccaggugggggagcggacacucaccggaacaguuaucgauagcggcgacggggugacccacgucauucccguggcugaaggauauguuaucggcuccugcauuaagcauaucccuauugccggcagagauaucacguacuuuauucagcagcugcugcgggaccgcgagguggggaucccgcccgaacaaucucucgagaccgcgaaagccgucaaggaaagauauagcuacguguguccugaucuggugaaggaguucaauaaauacgacacagauggauccaaguggaucaaacaguauaccggcauuaacgcuaucucuaagaaagaguuuagcauugacgucggguacgaacgguuccuuggacccgagaucuuuuuccacccugaauuugccaaucccgacuucacacagccgauuuccgagguuguggaugaagugauccagaacugcccuaucgacguccgcagaccccuguauaagaauauugugcucagcggcgggucuaccauguuccgggauuuuggacgcagacugcaacgggaccuuaagcgcacgguugaugcuagacugaaacucuccgaggagcugagcggcggccggcugaagccuaaacccaucgacgugcaggucauuacacaucacaugcagagauacgccgugugguucgggggaucuaugcucgcguccacccccgaauuuuaucagguuugucacacaaagaaagauuacgaggaaaucggcccuagcauuugccgccauaacccgguguucggggucaugucuuga

SEQ ID NO: 65461 - RNA, 1824 nt, Artificial Sequence
  derived and/or modified sequence opt5 from ACTR5__Homo_sapiens__NP_079131
auggccgcuaacguguuccccuuuagagacgcccgggcggcuccugauccgguccuggaggccggccccguugcccacgggccucuccccgugccucuggugcuugacaauggcagcuuccagguccgcgcuggaugggccugccccgggcaagauccuggaccggaacccagacugcaguuucgggcugugugugcccgcggcagagggggagcgcggggcgccuccggcccucagguugggaacgcucucggaucucuggagccccuucgcuggaugcugagaagcccuuucgaccggaaugugcccgucaaccucgaacugcaggagcugcuccuggauuacuccuuucaacaucuuggcgugucuagccaggggugcguugaccacccgaucgugcugaccgaagccgucuguaauccucucuauucccgccagaugaugucugagcugcuuuucgagugcuacggcauucccaagguggcuuauggaaucgauagccuguuuuccuucuaccauaacaaaccuaagaauagcauguguucugggcucauuaucuccagcggauaucagugcacacacgugcugcccauucuggaaggcagacucgacgccaaaaacuguaagcggaucaaucugggcgggucucaagcggccggauaccuucagcgccugcuccagcugaaauaucccggccaucuugcugccaucacgcuguccagaauggaggaaauucuccacgagcacagcuacaucgcugaggauuacgucgaagaacugcauaaguggcggugcccugacuauuacgaaaacaauguucacaagaugcagcugccguuuucuuccaaacuccuggggagcacccuuacauccgaggaaaagcaagagcgcagacagcagcaacugcggagacuccaggagcugaacgcccgccggagagaagagaaacuucagcuggaucaggaacgccucgaccggcugcuguaugugcaagagcuccuggaagauggacagauggaccaguuccauaaggcccuuauugagcugaauauggacucucccgaggaacuccagagcuacauccaaaaacuguccauugcuguggagcaggcgaagcagaagauccugcaggccgaagucaaccuugagguggauguuguggacagcaaaccugaaacccccgaucucgagcaacuggagccuucucuggaagacgucgaguccaugaaugauuuugacccccucuucagcgaagagacaccgggcguggagaagccuguuaccacagugcagcccgucuuuaaccuggcugccuaucaccagcuuuucguggggaccgaacgcauuagagccccugagaucaucuuccagcccucucugauuggagaggagcaagcuggcaucgccgaaacgcuccaguacauucuggaucgguauccuaaagacauccaggagaugcugguccaaaacguguuucuuaccggcgggaauacaauguaccccggaaugaaggcgagaauggagaaagaacuccuggagaugcgcccguuccggagcuccuuucagguucagcuggcuucuaacccugugcucgaugccugguacggcgccagagacugggcucugaaucaccuugaugacaacgaagucuggauuacccgcaaggaguaugaagagaaagggggagaguaccugaaggaacauugugccagcaauaucuaugugcccauccggcuccccaagcaggcuuccagaagcucugacgcccaagcguccagcaaaggcucugccgcugggggcggaggcgccggggagcaggcuuga

SEQ ID NO: 65462 - RNA, 1131 nt, Artificial Sequence
  derived and/or modified sequence opt5 from ACTRT1__Homo_sapiens__NP_612146
auguucaacccccacgcccuggacgugccugcugucaucuuugauaauggcagcgggcucugcaaggccggacuguccggcgagauugggccgagacauguuaucucuagcgugcuuggacacuguaaauucaacgugccccuggcgcggcucaaucagaaguacuuugucggccaagaagcucuguauaaauacgaggcccuucaucugcacuauccuauugaacgcgggcucgugaccggaugggacgauauggagaagcuguggaaacaucuguucgaaagagagcucggcguuaagcccucccagcagccugugcugaugacagagcccucucuuaacccucgggaaauccgcgagaagcuggccgaaaugauguuugagacguucagcgucccgggcuuuuaccucuccaaucacgcuguggccgcucuguaugccucugcgugcguuaccgggcuuguggucgacagcggagauggcgugacauguaccgugcccauuuucgagggguacucccugccucacgccgucacaaaacucugcauggcuggaagagacaucaccgaacaucugacacggcugcucuuugccagcggcuucaacuuucccuguauccugaauaaggcuguugugaacaauauuaaagagaaacuuugcuauaucgcccuggaaccugagaaggaacuccgcaagucuagaggggaggugcugggagcguaccggcuucccgauggccacgucauucauuucggcgacgagcuguaccaggugccggaaguucucuuugccccugaucaacuggggauccacucccccggacugagcaagauggugucuuccagcauuaugaaaugugacaccgauauccagaacaagcucuaugcugacauuguccugucuggcgggacgacccuucugccuggacucgaggaacgccugaugaaagagguggaacagcuugccuccaagggcacacccaucaaaaucaccgcuagccccgauagaugcuucuccgccuggauuggggccucuaucaugacaagcauguccagcuucaagcagauguggguuaccucugcugacuuuaaagaguacggaacguccgugguccaacggcgcuguuucuga

SEQ ID NO: 65463 - RNA, 1518 nt, Artificial Sequence
  derived and/or modified sequence opt5 from ACVR1B__Homo_sapiens__NP_004293
auggccgagagcgcuggcgccuccucuuucuuuccccuggugguccuccugcuugcggggagcggaggcuccgggccuagaggaguucaggcucugcucugcgccuguaccucuugccugcaagccaacuacacaugugaaacggacggcgcuugcauggugagcaucuucaaucuugaugggauggagcaccaugugcggaccuguauuccgaaggucgaacuggugcccgccggaaaaccuuuuuauugccucuccucugaggaccugcgcaacacacacuguugcuacaccgauuauuguaauagaaucgaccugcggguucccagcggccaucucaaggaaccugagcaccccuccauguggggcccuguggagcuggucgggauuaucgcuggaccgguguuccuucuguuucucauuaucaucauuguuuuccuggugaucaacuaccaucagcgcgucuaucacaauagacagcggcuugauauggaagaccccagcugcgagaugugucugucuaaagauaagacacuccaggaccugguguacgaucuguccaccagcggcucuggguccggacucccucuguuugugcaacgcacagucgccagaaccauuguucuucaggaaaucauuggcaaagggcgguucggagagguguggcgcggcagauggcggggcggggacguggcggucaagaucuuuagcucucgcgaggaaagauccugguuccgggaggccgaaauuuaucagacggugaugcugcgccacgagaacauccucggauuuaucgcugccgauaauaaggacaacggcaccuggacacagcuguggcuuguuagcgauuaccaugaacacgggucccuguucgacuaccucaauagauauaccgugacaauugagggaaugaucaaacuggcucugucugccgcgagcggccucgcccaucugcacauggagauugucgggacccaaggaaagcccggcaucgcucaccgggaccuuaaauccaagaacauucuggugaaaaagaauggcaugugcgccaucgcugaucucgggcuggccguuagacaugacgccgugacggauacaaucgacauugcuccuaaccagcgcgucggaaccaagcgguacauggcgcccgaagugcuugaugagacaaucaauaugaaacacuuugacagcuucaagugcgccgauauuuaugcucugggccucgucuacugggaaaucgccagacgcuguaacucugggggagugcaugaggaauaucagcugccguacuaugaccugguuccuuccgaucccagcauugaggagaugcggaaaguggucugcgaccagaagcucagaccuaauauccccaacugguggcaaucuuacgaagcccugcgcgugaugggcaaaaugaugcgggaguguugguacgcuaacggggccgcgagacuuaccgcucugcgcaucaagaaaacccucagccagcuguccguucaggaagaugugaagauuuga

SEQ ID NO: 65464 - RNA, 1332 nt, Artificial Sequence
  derived and/or modified sequence opt5 from ACVR1C__Homo_sapiens__NP_001104501
augcugaccaacggcaaggaacaggugaucaaaagcugcgucucccuccccgagcugaaugcccaaguuuucugucacucuagcaacaaugugacaaagacggagugcuguuuuaccgacuucugcaacaauauuacacuucaucugccuaccgcuuccccgaacgcccccaaacucgggccuauggaacuggcgaucauuaucacagugcccgucugucuucugucuauugcugccaugcucaccgugugggccugccagggaagacaguguagcuaccggaagaaaaagcgcccuaauguugaggaaccccuguccgagugcaaccuggugaaugcuggcaagacacucaaagaucugaucuaugacgucaccgccucugggagcggauccggccuuccucugcucgugcagagaacgaucgcucggaccauuguucugcaagagaucguggggaagggacgcuuuggcgaagucuggcacggcagaugguguggggaggauguggccgugaaaauuuucagcucucgggacgaacgcuccugguuuagagaggcggagaucuaccagacagucaugcuucggcaugaaaacauucugggauucaucgccgcugauaauaaggacaacggcaccuggacacagcucuggcugguuagcgaguaucacgaacaggggucucuguacgauuaucucaaucgcaacauugugaccguggccggaaugaucaaacuggcucuuuccaucgccagcggccuggcgcaucuccacauggagauugucgggacgcaaggaaagccggccaucgcucacagagacauuaagucuaaaaauauccuggugaagaaaugcgaaacaugugccauugcugaucuuggccuggccguuaagcaugacuccauccucaacaccaucgauauuccccagaacccuaaagugggcacaaagcgguacauggcccccgagaugcuggacgauaccaugaaugucaacaucuuugagagcuucaaacgcgcugacauuuauuccguggggcugguuuacugggaaaucgcgagacggugcucugugggaggcauugucgaggaauaccagcucccuuauuacgacauggugcccagcgauccguccaucgaggaaaugcgcaaggucgugugcgaccagaaguuuagaccuagcauccccaaucaauggcagucuugugaggcccugcggguuauggggagaauuaugcgcgagugcugguaugcuaacggagccgcccggcuuaccgcucugagaaucaaaaagacaauuucccagcucugugugaaagaagauugcaaggccuga

SEQ ID NO: 65465 - RNA, 1530 nt, Artificial Sequence
  derived and/or modified sequence opt5 from ACVR1__Homo_sapiens__NP_001096
augguggacggcgucaugauccugcccguucucauuaugaucgcccugccuagcccguccauggaggaugaaaagcccaaagugaacccuaaacuuuacaugugcgugugugaggggcugucuugcggaaaugaagaccacugugagggccagcaaugcuucagcucccucucuauuaacgauggguuucaugucuaucagaagggauguuuccagguguacgaacagggcaagaugaccugcaaaacacccccuagccccgggcaagcuguugaguguugccagggagacugguguaauagaaacaucacggcccagcugccuaccaagggcaaguccuuuccgggcacacagaauuuccaccuugagguggggcugauuauccucucugucguguuugcgguuugccugcuggcuugucuccugggaguggcccuucggaaauucaagcgcagaaaccaagaacggcugaauccccgcgaugucgaguauggcaccaucgaagggcucauuacaaccaacgugggagacagcacacuggccgaucuucuggaccauuccugcaccagcggcucuggguccggacucccuuuucuggugcagagaacggucgcucggcagaucacccugcucgagugcguuggcaaaggccgcuacggggagguguggagaggaagcuggcagggcgaaaauguggccgucaagauuuucucuucccgggaugagaaaagcugguuucgcgaaacagagcuguauaacaccgugaugcuuagacacgaaaauauccugggguucauugcuucugacaugacaucccggcauagcuccacccaacucuggcugaucacgcacuaccacgagaugggaucucuuuaugauuaccugcagcucacaacccuggacacaguuagcugucugcgcauugugcucuccaucgccagcggccuggcgcaucuucacaucgagauuuuugggacccagggaaagcccgccaucgcucauagagaucugaagucuaaaaacauucucgucaagaaaaauggccaaugcuguaucgccgaccugggccuugcugugaugcacucccagagcaccaaccagcuggacguugggaauaacccucgggugggaacaaagcgcuacauggcccccgaaguccucgaugagacgauucagguggacugcuucgauucuuauaaaagagucgacaucugggcguuuggccuggugcugugggaaguugcccggagaauggugagcaacgggaucgucgaggauuacaagccgccuuucuaugacgugguucccaaugauccuuccuucgaagacaugcgcaaaguggucuguguggaucaacagcggcccaacauucccaauagaugguuuucugacccuacccucacaagccuggcuaaacuuaugaaggagugcugguaccagaacccguccgcccgccugaccgcucuccggaucaagaagacacugaccaaaauugauaauagccuggacaaacuuaagacggacuguuga

SEQ ID NO: 65466 - RNA, 1542 nt, Artificial Sequence
  derived and/or modified sequence opt5 from ACVR2A__Homo_sapiens__NP_001265508
augggcgccgcugccaagcuggcguucgcuguguuucucaucagcugcuccucuggggccauucugggaagaagcgagacccaggaaugucuuuucuuuaacgccaauugggagaaagaccggacaaaccaaacgggcgucgaacccugcuacggggauaaggacaaacgcagacacuguuucgcuaccuggaagaauaucuccggaucuauugagaucguuaaacagggcugcuggcuggaugacauuaacuguuaugaucggacagacugcguggaaaagaaggauagcccugagguguacuuuuguugcugugaggggaauaugugcaacgaaaaauucuccuauuuuccggagauggaagucacccagcccacaucuaauccugugacccccaagccucccuacuauaacauccuccuguacagccuuguuccucugaugcucaucgccggaauugugaucugugcuuucugggucuaucgccaucacaaaauggccuacccgcccgugcugguuccuacacaggaccccggcccucccccgccuagcccccugcucggccugaagccucuucaacugcucgaggugaaagcgagagggcgguuuggaugcgucuggaaggcccagcugcuuaaugaguacguggcugugaagauuuuccccauccaggauaaacaguccuggcaaaacgaauaugaggucuacucucugcccggcaugaagcaugaaaauauucuccaguuuaucggggccgagaaacgcggaaccuccguugacguggaucuguggcugauuacggcuuuccacgaaaagggcagccucucugacuuucugaaagccaacguggucuccuggaaugagcuuugccauaucgcggagaccauggccagagggcuggcuuaucuccacgaagauaucccuggacugaaggacggccacaaaccggccauuagccaucgggacaucaagucuaagaacgugcuucugaaaaauaaccucacagcuuguauugccgauuucggccuggcccugaaguucgaggcugggaaauccgcgggagacacccacggccagguugggacacgcagauacauggcccccgaagugcucgagggagcuaucaacuuucagcgggaugccuuccugcgcauugacauguaugccaugggccuuguccugugggaacucgcuagcagaugcaccgccgcggaugggccuguggacgaguacaugcugcccuuugaggaagagaucggacaacauccuucccuugaagauaugcaggagguugugguccacaagaaaaagcggcccgugcugcgcgacuauuggcagaagcacgcuggcauggccaugcucugugaaacgaucgaggagugcugggaucaugacgccgaagcuagacugucugccggcugugucggggagcggauuacacaaaugcagagacugaccaauaucauuacaaccgaagauaucgugaccguugugacaauggucacgaacguggacuucccgccuaaagagagcucccucuga

SEQ ID NO: 65467 - RNA, 1539 nt, Artificial Sequence
  derived and/or modified sequence opt5 from ACVR2B__Homo_sapiens__NP_001097
augaccgcccccuggguggcucuggcccuccuguggggcagccuuugcgcgggguccggaagaggcgaggcugaaacacgggaguguaucuacuauaacgccaauugggaacuggagcgcacgaaccagucugggcucgaaagaugcgagggagagcaagacaagcggcugcacuguuacgccagcuggcgcaauuccucuggcaccauugaacuugucaaaaaggggugcuggcuggaugacuucaacuguuaugauagacaggagugcguugcuacagaagagaauccucagguguacuuuuguugcugugagggaaacuucugcaaugaacgguuuacccaucucccggaggccggcggccccgaagugacauaugagccucccccuaccgcucccacacugcugaccguccucgccuacagccugcuuccuaucgggggacugucccucauugugcugcuugcguucuggauguaucgccacagaaaaccgcccuacggccauguugacauccacgaagauccugggcccccucccccgucuccucuggugggacucaagccccugcagcugcucgagauuaaagcccggggccgcuuugggugugucuggaaggcucaacugaugaacgacuucguggccguuaagaucuuuccucuucaggauaaacagagcuggcaguccgagagagaaaucuucagcacgcccggaaugaagcaugagaaucugcuccaauuuauugcugccgaaaaacggggcucuaaccuggagguggaacuuuggcugaucaccgcguuccacgacaagggcucccucacagauuaccugaaagggaauauuaucaccuggaacgagcugugccacgucgccgagacaaugagccgcggacucucuuaucugcaugaagacgugcccuggugcagaggcgaggggcacaagccuuccauugcucaucgggauuuuaagagcaaaaaugugcuucugaagucugaccucaccgccguccuggcugauuucggacuugccguucgcuuugaaccgggcaaacccccuggggacacgcacggacaggugggcacaagacgguacauggcccccgaggugcuggaaggcgcuaucaacuuccagagagacgcguuccuccgcauugauauguaugccauggggcugguccugugggagcucgugucccgguguaaggcugccgacggaccuguugaugaguacaugcugcccuuugaagaggaaaucggccagcacccgagccuugaggagcugcaagaaguggucgugcauaaaaagaugagaccuaccaucaaagaccacuggcucaagcaucccgggcuggcccagcugugcguuacaauugaggaauguugggaucacgacgcugaggcccgccuuuccgcgggaugcguggaggaacgggucucucucaucagacgcagcgugaauggcaccaccuccgauugucuggucagccuggugacaucuguuacgaacguggaccucccucccaaggaguccagcauuuga

SEQ ID NO: 65468 - RNA, 1512 nt, Artificial Sequence
  derived and/or modified sequence opt5 from ACVRL1__Homo_sapiens__NP_001070869
augacccugggcagccccagaaaggggcuccugaugcuucugauggcccucgugacacagggagacccugucaaaccgucccggggcccccugguuacgugcaccugugagucuccucacugcaaggggcccacaugucgcggagcuuggugcaccguggugcuugucagagaagagggccggcauccucaagaacaccgcggguguggaaaccugcauagagagcucugccggggccgccccacagaguucgugaaucacuacuguugcgauagccaucuguguaaccacaauguuucccuggugcucgaagccacccagccuccgucugagcagcccggcacagacgggcagcuggcgcuuauccugggaccuguccucgcucugcuugcccugguggcccucggcguucuggggcuguggcacgugagacggcgccaagaaaaacagagaggacuccauagcgagcugggcgaauccucucuuauucugaaggcuagcgagcagggggauuccaugcucggagaccugcuugauagcgacugcaccacgggcucuggcuccgggcugcccuuucucguccagcggaccguggcccgccaaguggcucuggucgaguguguuggaaaaggcagauauggggaaguguggcggggacuguggcacggcgagagcguggccgucaagaucuucucuucccgcgaugaacagagcugguuuagagagacagaaauuuacaacaccgugcuccugcggcaugacaauauccuuggguucauugcgucugauaugacauccagaaacagcuccacccagcuguggcucaucacgcacuaucacgagcauggaucucuguacgacuuucuucagcgccaaacacuggagccucaccucgcccugcggcuggcuguuagcgccgcuugcggccucgcccaucugcacguggaaaucuucggcacccaggggaagcccgcgauugcccauagagauuuuaaaucccgcaauguccuuguuaagagcaaccugcagugcuguaucgcugaccucggacuggccgugaugcacucucaaggcuccgauuaucuggacauugggaauaacccgcgggugggaacaaaaagauacauggcuccugagguccuugacgaacagauccgcaccgauugcuucgagagcuauaaguggaccgacauuugggccuuuggccucgugcugugggaaaucgcccggagaacaauugucaaugggaucguggaggauuaccggcccccuuucuacgacguugugcccaacgaucccucuuuugaggacaugaaaaaggucguguguguugaucagcagacgccuaccaucccgaaucgccuggcugcggaccccgugcucagcggccuggcccaaaugaugagagaaugcugguauccuaaccccuccgcucgccuuacagcccugcggauuaagaaaacccuccagaagaucucuaauagcccugagaaacccaaggucauucaguga

SEQ ID NO: 65469 - RNA, 1227 nt, Artificial Sequence
  derived and/or modified sequence opt5 from ACY1__Homo_sapiens__NP_001185824
augaccagcaagggccccgaggaggaacacccuuccgugacacuguucagacaguaccuccggauccgcacgguccaaccgaaacccgacuauggggccgcuguugccuuuuucgaagagaccgcgagacagcugggacuuggcugccagaagguggaaguggcuccuggguacgucgugacaguucugaccuggcccggaacaaacccuacccucucuagcauucugcuuaauucccauacagaugugguccccguguuuaaagagcacuggucucaugacccuuucgaggccuuuaaggauagcgaaggcuauaucuacgcccgcggggcucaggacaugaaauguguuuccauucaauaucuggaggccgugcggagacucaaggucgaaggacaccgguucccgcgcaccauccauaugacguuugugcccgaugaggaggugggcggccaccaggggauggaacuguucguccagagaccugaguuucacgcucugcgggccggauucgcgcucgacgaaggcauugccaaccccaccgaugcuuuuacaguuuucuacucugagcgcagcccuuggugggugagagugaccuccacagggcggcccggacaugccagccgcuuuauggaagacaccgcugccgagaagcugcacaaagucguuaauucuauccuugcguucagagagaaggaauggcagcggcugcaauccaacccgcaucucaaagagggcagcgugacgucugugaaucugacaaaacuugaagggggagucgccuauaacgugaucccugcuaccauguccgccagcuucgauuuucgcguugcucccgacguggauuucaaggccuuugaggaacagcugcagucuuggugccaggccgcuggcgagggcgucacacucgaguucgcgcaaaaguggaugcacccucaggugacccccaccgacgauuccaaucccuggugggccgcuuuuagcagagucuguaaggacaugaaccugacacuggaaccugagauuaugccggccgccacggacaaucgguacaucagagcuguggggguucccgcccucggauucuccccuaugaaccgcacccccgugcugcuucacgaucaugacgaacggcugcacgaggcggucuuucucagaggcguggauauuuacacacgccugcuuccugcucuggccucuguucccgcccucccgagcgacuccuga

SEQ ID NO: 65470 - RNA, 960 nt, Artificial Sequence
  derived and/or modified sequence opt5 from ACY3__Homo_sapiens__NP_542389
augugcagccugcccgugccuagagagccgcuccggcgcgucgccguuaccggcgggacacacggaaacgaaauguccggcguguaccuggcuagacauuggcuucacgcccccgcggagcugcagcgggcuucuuucagcgccgugccuguccucgccaaucccgcugccacguccgggugucgcagauauguggaccaugaucugaaccggaccuuuacaucuagcuuccuuaauucccgcccuacccccgacgauccuuacgaaguuacaagagcucgggagcugaaccaacuccugggaccgaaggccucuggccaggcguuugacuucgugcuggaucuccacaauaccacagccaacauggggaccugccugaucgcuaaaagcucccaugaagucuuugccaugcaccuuugucgccaucugcagcuccaguaucccgagcugagcugccaaguguuccuuuaccagagaucuggagaggaauccuauaaucuggacagcguugcuaagaacggccucggccuggagcuggggccucagccccagggagugcuccgggccgauaucuuuucucgcaugagaacgcuggucgcgaccgugcuugacuucauugaacuguuuaaucaaggcacagccuucccugcuuuugagauggaggccuaccggcccgugggggucguugauuucccgcgcaccgaagcuggacaccucgccggcacagugcacccucagcugcaggacagagauuuucagccccuucaaccuggggcccccauuuuccagauguucuccggagaggaccugcucuaugaaggcgagagcaccguguaccccgucuuuaucaacgaagcugcguacuaugagaaaggcguggccuucguucagacggagaaguuuacauucaccgugccugcuaugccggcccugacacccgccccuucucccgcuuccuga

SEQ ID NO: 65471 - RNA, 300 nt, Artificial Sequence
  derived and/or modified sequence opt5 from ACYP2__Homo_sapiens__NP_612457
augagcaccgcccagucccugaagucuguggacuacgaggucuucggcagaguucaaggggugugcuuucggauguauacagaagaugaggcucgcaaaaucggaguggucggcugggugaagaacacgagcaaagggaccguuacaggacaggugcagggccccgaagacaaggucaauuccaugaaaucuuggcucagcaaggugggguccccuucuagcagaauugaucggaccaacuucuccaaugagaagacaaucagcaaacuggaauacucuaacuuuuccauucgcuauuga

SEQ ID NO: 65472 - RNA, 1698 nt, Artificial Sequence
  derived and/or modified sequence opt5 from ADAD1__Homo_sapiens__NP_001152757
auggccagcaacaaucacugguuccaguccucucaagugcccagcuuugcucagaugcugaagaaaaaccucccuguccagccggccaccaagacaaucacgacccccacaggcugguccucugagagcuacgggcuguccaaaauggcgucuaagguuacccaggugacaggaaauuucccugaaccccuucugagcaaaaaccucuccagcauuucuaauccugugcugcccccuaagaagaucccgaaagaguuuauuaugaaguauaaaagaggcgaaaucaaccccgucuccgcucugcaucaauucgcccagaugcagcgggugcagcuggaccucaaggagaccguuacaaccgggaaugugaugggaccuuacuuugccuucugcgcugucguggauggcauucaauauaaaacggggcugggacagaacaagaaggaaagccgcucuaaugccgcuaaacuggcccucgacgagcugcuucagcuggaugagcccgaaccuagaauccucgagaccuccgggcccccgccuuuucccgcggaaccuguugugcugagcgagcuugccuacgucucuaaggugcacuaugagggccggcauauccaguacgcuaaaauuucccaaaucgugaaggaacgcuucaaccagcugauuagcaauagauccgaguaucucaaauacucuagcucccuggccgcuuuuaucauugaacgggccggccagcacgaggucguugcgaucggaacaggcgaauacaacuauagccaagacauuaagcccgaugggcgcgugcugcaugacacccacgccguggucacagcuagacggucucuccuguccaaaaaucccgccaugauggaaaagagcaucuucuguaccgagccuacgucuaaccuucugacacucaagcagaauaucaacauuugccuguacaugaaccagcuuccgaaaggaagcgcucagaucaagucccaacugcgccucaauccccacucuauuagcgccuuugaggccaacgaggaacugugucugcauguggcuguugagggcaaaaucuaucucaccguguacugcccuaaggauggggucaauagaauuuccagcaugucuuccagcgacaaacugacacggugggaagugcuuggaguucagggcgcgcugcucucucacuucauccagcccguguauaucuccagcauucugaucggcgaugggaacuguuccgacacccgcggacuugagauugccaucaagcagagagucgaugacgcucugaccucuaagcucccuauguuuuaccuggugaaucggccccauauuagccuggucccguccgccuauccucuccaaaugaaccuggaguacaaauuccuuucucugaauugggcccagggcgaugugagccucgaaaucguugacgggcuguccggaaagaucacagagagcucucccuucaaauccggcaugagcauggcuucucgccugugcaaggccgcgaugcuuuccagauuuaaccuccuggcuaaagaagccaagaaggagcugcucgaagccgggacguaccacgcugccaaauguaugagcgcuucuuaucaggaggccaagugcaaacuuaagagcuaccuucagcaacacggauauggcuccuggauugugaaaagcccuuguaucgagcaguucaauauguga

SEQ ID NO: 65473 - RNA, 1092 nt, Artificial Sequence
  derived and/or modified sequence opt5 from ADA__Homo_sapiens__NP_000013
auggcccagacccccgcuuucgacaagcccaaaguggagcugcacguccaucucgauggcagcaucaagccggaaacaauucuguacuaugggagacggcgcggaaucgcccuucccgcgaacacggcugagggccugcucaauguuauugggauggacaaaccucugacccuucccgauuuucuggccaaguucgacuacuauaugccugccaucgcuggaugcagagaagccauuaaacggaucgcuuacgaguuuguggaaaugaaggccaaggagggcguggucuauguggagguucgcuacucuccccaccuccuggcgaacuccaaaguggaaccuaucccguggaaucaagccgagggggaucugacacccgacgaagucguggcucucguuggacagggccugcaggagggcgagagagauuucggggugaaggcccggagcauucuuuguugcaugcgccaucagccuaacuggucccccaaagucguggaacuguguaagaaauaucaacagcagaccguggucgcuaucgaccucgccggagaugagacaauuccuggcucuagccugcuucccgggcacguucaggcguaccaagaagccgugaaguccggaauccauagaaccgugcacgcuggcgaggucgggucugccgaagugguuaaggaggcuguggacauucugaaaacagagcggcucggacacggcuaccauacccuggaagaucaggcccuguauaaucgccucagacaggagaacaugcacuuugaaaucugcccguggagcuccuaccugacgggcgccuggaagccugacaccgagcaugcugucauucggcuuaaaaaugaucaggcgaacuauagccugaauacagacgacccccucaucuucaagucuacccuggauacagacuaccaaaugaccaaacgcgauaugggguuuacggaagaggaguucaagagacuuaacaucaaugccgcuaaauccagcuuucugccugaagacgagaagcgggaacuccuggaucugcucuauaaggccuacggaaugccucccucugccuccgcuggccagaaccuguga

SEQ ID NO: 65474 - RNA, 2247 nt, Artificial Sequence
  derived and/or modified sequence opt5 from ADAM10__Homo_sapiens__NP_001101
auggugcugcucagaguccugauccuucugcucagcugggccgcuggcaugggaggacaguacggcaacccccugaauaaguauauucggcacuacgaggggcuuuccuauaacguugacucucugcaucaaaaacaccagcgcgccaagagagcggugagccaugaagaucaguuccuccggcuggacuuucacgcucauggacgccacuucaaucugagaaugaaacgggauaccucccucuuuucugacgaguucaagguggaaacaagcaacaaaguccuggauuacgacacgucccacaucuauaccggccauauuuacggggaggaaggaucuuuuagccacggcuccgugaucgauggccgcuucgagggguuuauucagacaagaggaggcaccuucuauguugagccugccgaacgguacaucaaggaccgcacacuuccguuucauagcgugaucuaccacgaggaugacauuaauuauccccacaaguacgggccucaaggaggcugcgccgaucauucugucuucgaaagaaugcggaaauaucagaugaccgggguggaggagguuacacagaucccccaggaggaacacgcugccaacggaccugaacugcuccgcaagaaaagaaccacguccgcugagaagaauaccugucaacuguacauucagacagaccaucuguuuuucaaauauuacggcacccgggaagccgugaucgcgcagauuagcucucacgucaaggccaucgauacaauuuaucagaccacggacuuuuccggcauccgcaacaucagcuucauggugaagcggauuagaaucaauacaaccgcugacgagaaagaucccacaaacccuuucagauuuccgaauauugggguggagaaguuccuugaacucaacucugagcaaaaucaugacgauuacugccuggccuacgucuuuaccgaccgcgauuucgacgauggaguucugggccucgcuugggugggggcccccuccggaagcuccggcgggaucugugaaaaaucuaagcuguauagcgacgggaaaaagaaaucccuuaacaccggcauuaucacagugcagaauuacggcagccacgucccucccaaggugucucacaucacguuugcgcaugagguugggcacaacuucggauccccucaugauagcggcaccgaaugcacacccggggagucuaagaaccugggacagaaagagaauggcaacuauauuauguacgcccgggcuaccagcggggacaagcucaauaacaauaaauuuucccuguguucuaucagaaacauuagccaagugcuugaaaagaaacgcaauaacugcuucgucgaguccggccagccgaucuguggaaauggcaugguggaacagggggaggaaugcgauuguggauauagcgaccagugcaaggacgaguguugcuuugaugccaaccaaccugagggccggaagugcaaacugaagcccgggaaacaguguucuccuucccagggacccugcuguacagcucagugcgccuucaagagcaaaucugaaaaguguagagacgauuccgacugcgcccgcgagggcauuuguaauggguuuaccgcucucugccccgcgagcgauccuaagccgaacuucacggacuguaaucggcacacacaaguuugcaucaacggccagugugccggauccaucugcgaaaaauacggccuggaggagugcaccugugcuucuagcgaugggaaggacgauaaagaacugugccacguguguugcaugaagaaaauggaccccuccaccugugccucuacaggaagcguccagugguccagacauuuuagcggccgcaccauuacacuccagccugggucucccugcaaugauuuccggggauauugugacguguucaugagaugccgccuggucgaugccgacggcccucuugcucggcugaagaaggccaucuuuucccccgagcucuacgaaaacauugcggaguggaucguggcucacuggugggccguucugcuuauggggauugcccugaucaugcucauggcuggcuucauuaaaaucuguagcgugcauacgccgucuuccaacccuaagcugcccccucccaaaccucugcccggaacccucaagagacggcgcccgccucaacccauccagcagccccagagacaacggccuagagaaagcuaccagaugggccacaugcgccgguga

SEQ ID NO: 65475 - RNA, 2310 nt, Artificial Sequence
  derived and/or modified sequence opt5 from ADAM11__Homo_sapiens__NP_002381
augagacugcuccggcgcugggccuucgcugcccugcuucugagccuccugcccaccccuggccuugggacacagggaccggcgggcgcucugagauggggagggcucccccaacugggcgggccuggagcccccgaggugacggaaccuucccggcugguccgcgagucuagcggcggcgaaguuagaaagcagcagcucgacacccgggugcgccaggagcccccugggggaccgcccgugcaccuggcccaagucuccuuugugaucccugcuuucaacucuaauuuuacacuugaucuggaacucaaccaucaccuccuuagcucccaguacguugagagacauuucucucgggagggcaccacacagcacagcaccggggccggagaccauugcuauuaccagggcaaacugcgcgggaauccccacuccuuugcugcccucagcacaugucaaggacugcacggcguguucucugauggcaaccugaccuauauugucgaaccucaggagguggcggggcccuggggagccccgcagggcccucucccccaucugaucuacagaacgccucuucugcccgacccccucgggugccgggaaccuggaugucuguuugcuguuccggcccaguccgcucccccuaaucgccccagacuucggcgcaagagacaagugcggagaggccacccuaccguccauagcgagacaaaauauguggagcugauugugaucaacgaucaccagcuguucgaacagaugcgccaaucugucguucugaccuccaauuuugccaagagcguggugaaccuggcggacgucauuuacaaagagcagcucaauacacggaucgugcugguugccauggaaaccugggcugauggggacaagauccaggugcaggaugaccuucuggagacgcucgccagacugauggucuaucgccgggaaggacuucccgagccgucugaugcuacacaccuguucuccggcagaaccuuucaaagcacauccucuggcgccgccuacguugggggaauuugcagccucucccauggcgggggagugaacgaguacggcaauaugggggcuauggcggugacccuggcccagacccugggccagaaccucggaaugauguggaauaagcaccgcagcucugcuggcgacuguaaaugcccugauaucuggcugggguguauuauggaagacacaggauucuaucuuccccggaaguuuuccagaugcagcaucgacgaguacaaccaguuccugcaagaaggcgggggaucuugucucuucaauaaaccucugaagcugcuugaucccccugagugcggcaacggguuugucgaagccggcgaggagugugacugcggaagcgugcaggaaugcucccgcgccggcgggaacuguugcaaaaaguguacgcucacccaugaugcuaugugcucugacggacuguguugccggagauguaaguaugagccccgcggcgucagcugccgggaagccgugaaugagugugauauugcggaaacaugcaccggggacuccagccaguguccgccuaaccugcacaaacucgauggauacuauugcgaccaugagcagggcagaugcuacgggggccgguguaagacacgcgauagacaaugccagguucuguggggacacgcugccgccgaccgguucuguuaugagaaacuuaauguggaaggcaccgagagagggucuugcggacgcaagggcuccggguggguccaguguagcaaacaggaugugcugugcggauuucuccuguguguuaacaucucuggcgcuccccggcugggggaccuugugggcgacauuuccagcgucacguucuaccaccaaggaaaggaacucgauugcagaggcgggcaugugcagcuggccgacggauccgaucugucuuacguggaggacggcacagcuugugggcccaauaugcucugccuggaucaccgcugucuuccugccagcgcguuuaacuucucuaccugcccgggauccggcgagagacggaucugcagccaucacggcguuuguuccaaugaagggaaaugcaucugucagcccgacuggaccggaaaggauugcagcauucacaacccucugcccacaucuccucccaccggcgagacagaacgcuauaaggggccuuccggaacgaauaucauuaucggcagcauugccggggcuguccucguggccgcuaucgugcugggaggcaccggcuggggguuuaaaaacaucagacggggacgcucuggcggggccuga

SEQ ID NO: 65476 - RNA, 2208 nt, Artificial Sequence
  derived and/or modified sequence opt5 from ADAM12__Homo_sapiens__NP_001275904
auggccgcuagaccccugccugugagcccggcccgggcgcuccugcuugcucuggccggcgcccuccuggcucccugcgaggcccgcggggucucccuuuggaaccaggggagagcugacgaaguugugucugccagcgugggcuccggggaucuguggaucccugucaagucuuucgacagcaaaaaucaccccgaggugcucaacauucggcugcaacgcgaauccaaggagcugaucauuaaucucgaaagaaacgagggacugaucgcgucuagcuuuaccgagacacauuaccuucaggauggcacggacguuucccuggcccggaauuauaccgggcacuguuacuaucauggacacgugcgcggcuacagcgauucugcugucucccucagcacaugcucuggccugagagggcuuauuguguucgaaaacgaguccuauguucuggaaccuaugaaaagcgccaccaaucgguacaagcucuuucccgcuaaaaagcugaagucugugcgcggauccuguggcagccaucacaacacaccuaaucuggccgcgaaaaacgucuucccgcccccuucccagaccugggccagacggcacaagcgcgagacacucaaagcuaccaaguauguggagcuggugaucgucgccgacaauagagaauuucagcggcaagggaaagaucuugagaagguuaagcagcgccugaucgaaauugcuaaccauguggacaaauucuacagaccccucaauauccggauugugcuggucggaguggagguuuggaacgauauggacaagugcucugugagccaggauccuuuuacgucccuucacgaguuccuggacuggagaaaaaugaagcuccugccccgcaaaagccaugauaaugcccagcuggucucuggcguguacuuucaagggaccacaaucggaauggccccgauuauguccauguguaccgcugaccagagcggcggcaucguuauggaccacucugauaacccucucggggcggccgugacacuggcucacgaacuuggacauaacuucggcaugaaucacgacacccuggaucgggggugcagcugucagauggccgucgagaagggaggcugcauuaugaacgccuccacgggguaucccuuuccuaugguguucucuagcuguuccagaaaagaccucgaaacaagccuggagaagggaaugggcgucugccuuuuuaaucugcccgaagugcgcgagucuuucggcgggcagaaguguggaaaccgguucguugaagagggcgaggaaugcgauugcggggagcccgaagaguguaugaauagaugcuguaacgcuaccacaugcacccucaaaccugacgccgugugugcgcauggacugugcugugaagauugccaacugaagccggcuggcaccgccugucgcgacuccagcaauucuugcgaucuccccgaguuuuguacaggggccuccccucacugccccgcuaacgucuaccugcaugacggccacagcugccaggauguggacggauauuguuacaauggcaucugccagacgcacgagcaacaguguguuacccuuugggggccuggagccaaacccgcuccgggcaucugcuucgaacgggugaacuccgccggggacccuuauggaaauuguggcaaggucucuaaaagcuccuuugcgaagugcgagaugagagaugccaagugugggaaaauucagugccagggcggagcuucucgccccgugaucggcacaaacgccgugagcauugaaaccaauaucccucugcaacagggaggacggauucucuguagaggcacacauguuuaccugggggacgauaugcccgacccuggacugguccuugcuggcaccaagugcgccgaugggaaaaucugucucaaccgccagugccagaauaucuccguguucggcgugcacgagugcgcgaugcaaugucauggacggggcgucugcaacaacagaaagaauugucacugcgaggcccacugggcucccccguuuugugacaaauucggguuuggaggcagcacggauucugggccuauucggcaggccgaagcucgccaggaggccgccgaauccaacagagagcggggacagggccaagaacccguggggagccaggagcaugcuucuacagcgucccugacccugaucuga

SEQ ID NO: 65477 - RNA, 2475 nt, Artificial Sequence
  derived and/or modified sequence opt5 from ADAM15__Homo_sapiens__NP_001248393
augagacuggcccuccugugggcucuuggccugcucggggccggaagcccccugccuuccuggccgcuucccaacaucgugcugucuuggggcguccucgggccugcgggaggcaccgaggaacagcaagcugagagcgaaaaggcuccccgggagccucuggaaccccagguucugcaggacgaucucccuaucucccugaaaaaggugcuucagacaucucugccggagccccuccgcaucaaacuggagcuugacggggauagccacauucuggaacuccugcaaaauagagagcuggugccuggacggcccacgcucgucugguaccagccugacggcacccgcgugguuuccgaaggccauacacuggagaacugcuguuaucaggggagagugcggggauacgccggcucuugggucagcaucugcaccuguuccgggcuucgcggacuggugguucucacacccgagagaagcuauacccuggaacagggcccgggggaucuucaaggaccucccauuaucucucggauccaggaccugcaccucccuggccauacaugcgcucuguccuggcgcgagagcgugcacacccagaagccucccgaacauccccugggccagagacacauucggcgcagacgggaugucgugacggagaccaaaacaguggaacucgucaucguugccgaccacucugaggcucaaaaguaccgcgauuuccagcaucugcuuaauagaacccuggagguggcccuccugcuugacacauuuuuccggccgcugaacgugagagucgcgcucguggggcuggaagccuggacccagcgcgaucugguugagauuucccccaauccugcugugacgcucgaaaacuuucugcacuggcggagagcccaucuucugccccgccucccucacgacagcgcucaacuggucacaggaaccucuuucuccggccccacaguggggauggccauccagaauagcauuuguuccccggauuuuucuggaggcguuaacauggaccacagcaccuccauccuggggguggcgagcucuauugcccaugagcuuggacacucccucggccuggaccaugaucugccuggcaauagcugccccuguccugggcccgcuccugccaagaccugcaucauggaagccucuacagacuuccuccccggacugaacuuuagcaauuguucccggagagcccuugagaaagcccugcucgauggcauggggucuugccuguucgagcgccugccgagccuuccucccauggcugcguuuuguggaaacauguucgucgaacccggcgagcagugcgacugcggguuucucgaugacuguguggauccuugcugugacucccugacgugccagcugcggccgggcgcccaaugugcuagcgauggacccugcugucagaauugccagcucagaccuucuggcuggcagugucgccccacccggggcgacugcgaucugccugaguucugucccggagacuccagccaaugcccucccgacgucucucuuggcgauggggaaccgugcgccggaggccaggccguguguaugcacgggagaugcgcuuccuaugcccagcagugucaaagccuguggggcccuggagcgcagcccgcugccccucucugccugcagacagccaacacccgcggcaaugcuuuuggguccuguggacggaaccccucuggcagcuacguuuccugcacaccgagagacgccaucugugggcagcugcaaugccagaccggacggacgcagccucuucucggcucuauucgcgaucugcugugggaaacaaucgacgugaacgggaccgagcucaauuguagcuggguccaucuggaucuuggcuccgacguggcucaaccccugcucacccugccuggaacagccugcggccccgggcugguuuguauugaucacagaugccagcggguggaccuucucggagcgcaggagugcagaagcaagugucacggccauggggucugcgauucuaaccgccacuguuauugcgaagagggaugggcucccccugacuguaccacacagcugaaagccacguccagccugaccacaggccuccugcuuucucugcucgugcugcuggugcuuguuaugcugggggccuccuacugguaccgggcuagacuccaucaacgccugugccagcucaagggcccgaccugucaguauagagccgcgcagagcggacccucugaacggccugggcccccucaacgcgcccugcuugcuagagggacaaaaagccagggacccgccaagccuccgcccccucggaagccccugccugcugauccccagggccgcugcccguccggggaccucccuggacccggcgccggcauucccccucuggucgugcccagcagaccugccccgcccccucccaccgugucuucccuguaccuuuga

SEQ ID NO: 65478 - RNA, 2475 nt, Artificial Sequence
  derived and/or modified sequence opt5 from ADAM17__Homo_sapiens__NP_003174
augagacagagccugcucuuucugaccuccgugguccccuuuguucuugccccucggccgcccgacgauccuggcuucgggccccaccaacgccuggagaagcucgacucucugcuuagcgauuacgacauccugucccucucuaacauucagcagcauagcgugagaaaacgggaucugcagacauccacgcacguggaaacccugcucacauuuucugcucugaagcgccauuucaaacuuuaucugaccagcuccacagagagauuuagccaaaauuucaaggucgugguuguggacggaaagaacgaaucugaguacaccgucaaguggcaggauuucuucacaggccacgugguuggggaaccugacucccgggugcucgcccauauccgcgaugacgaugucauuaucagaauuaauaccgacggagcggaguauaacaucgagccccuguggcgguuugugaaugauacgaaggacaaacgcaugcuuguguacaagagcgaagacaucaaaaacgucucuagacugcaguccccuaagguuugcggcuaucucaaaguggauaaugaggaacugcugccgaaggggcucguggaccgggagcccccugaggaacugguccaccgcgugaagagacgggcugaucccgacccuaugaaaaacaccuguaaacuucugguuguggccgaucaccgcuucuacagauauaugggacggggcgaggaaagcacaaccacaaauuaccucauugagcugaucgacagagucgaugacauuuaccgcaacaccucuugggauaaugccggcuuuaaaggguauggaauccagauugaacaaauccggauucuuaagagcccccaggaggugaaaccgggcgagaagcauuacaacauggcuaaauccuauccuaaugaagagaaggacgccugggauguuaagaugcugcucgaacaguucuccuuugacaucgcugaggaagccucuaaagugugccuggcgcaccuguucacguaccaggacuucgauauggggacacucggacuggccuaugucggcagccccagagcuaacucccaugggggaguguguccuaaggccuacuauagccccgucggcaaaaagaauaucuaccuuaacucuggccugaccuccaccaaaaacuacgggaagacaauucucaccaaggaggcugaccuggugacaacgcacgagcuuggacacaauuuuggcgccgaacaugaucccgacgggcuggcggagugcgccccuaacgaagaucaaggaggcaaauauguuauguacccgaucgcugugagcggggaccacgagaauaacaagauguucucuaauuguagcaaacaguccauuuauaagaccaucgaaucuaaagcccaggagugcuuucaagagcgcagcaacaaggucuguggaaauucccggguggaugaaggcgaggaaugcgaccccggcauuauguaccucaacaaugauacauguugcaacagcgacuguacccugaaggaggggguucagugcucugauagaaauuccccuugcuguaaaaacugccaguucgagacagcucagaagaaaugucaagaagccaucaaugcuaccugcaagggagugagcuauuguacgggcaacucuuccgagugucccccucccgggaaugccgaagacgauacagucugccuggaccucggaaaaugcaaggacggcaaguguaucccguuuugcgagcgcgaacagcagcuggagagcugugcgugcaacgagaccgauaacuccugcaaaguguguugccgggaccuuucugggagaugugugccuuacguugaugccgaacagaagaaucuguuccuccgcaaaggcaagcccugcaccgucggauuuugugacaugaacggcaaaugcgagaagcgggugcaagaugugauugaaagauucugggacuuuaucgaucagcugagcauuaauacauucgggaaauuucuggcugacaacaucgucggauccgugcuuguuuucucucucaucuuuuggauuccuuucagcauccuggugcauugugucgauaagaagcuggacaaacaguaugagucccucagccuguuccaccccucuaauguggaaaugcuuuccagcauggauucugccuccguucgcauuaucaagccuuuucccgccccgcagaccccuggccggcugcaacccgcucccgugauuccuagcgccccggcggcucccaaacucgaccaucagagaauggauacaauccaggaggacccuucuacggacagccacauggaugaggacggguucgaaaaggaucccuuuccuaacuccagcaccgccgccaaaucuuucgaggaccugacagaucaccccgucacccgguccgaaaaggcugccagcuuuaagcugcagcgccaaaauagaguggacuccaaagagacagaaugcuga

SEQ ID NO: 65479 - RNA, 2757 nt, Artificial Sequence
  derived and/or modified sequence opt5 from ADAM19__Homo_sapiens__NP_150377
augcccggcggggccggagcugccagacugugccuccuggcguucgcccuucagccucugcggccgcgcgcugccagagagcccggcuggacccgggggagcgaagagggauccccuaagcuccaacacgaacugaucauuccccaguggaaaacaucugagagcccugugcgcgaaaagcauccccuuaaagcugagcugagagucauggccgagggccgggaacucauccuggaccuggagaagaacgaacagcucuuugcuccuuccuacacggagacccacuauacaucuagcgggaauccgcagaccacaacccgcaaacuggaggaucauuguuucuaccacggaacaguuagagaaaccgagcuuuccucugugacgcugagcacaugccggggcauucgcggccucaucaccguguccagcaaccugucuuaugucauugaaccccuuccugacuccaaggggcaacaucugaucuacagaagcgagcaccucaagcccccucccggaaauuguggcuuugaacacucuaaaccgaccacacgggauugggcccugcaguucacccagcagacgaagaaacgcccuagacggaugaagcgcgaggaccugaacuccaugaaauauguggagcucuaccugguugcggauuaucuugaauuucaaaagaauagacgggaccaggaugccacaaagcauaaacugaucgagauugcuaacuacguggacaaguucuacagaagccucaauauccgcauugcccuggucgggcuugaaguguggacccacggaaacaugugcgagguuucugaaaaucccuauuccacacuguggagcuuucucuccuggcggagaaaacugcuggcucagaaguaccaugauaacgcccagcucaucaccggcaugucuuuccacgggaccacaauuggacuggcgccucuuauggccauguguagcguguaucaauccggcggcgucaauauggaccacagcgagaacgcuaucgggguggccgcuacgauggcccaugagaugggacacaauuuuggcaugacccaugauucugccgacugcuguuccgcuagcgcggccgaugggggaugcauuauggcugccgccacaggccaccccuuccccaaaguguuuaacggguguaaucgccgggaacuggacagauaccuccagucuggaggcggcaugugccugagcaacaugccugacacccgcaugcuuuaugggggacggagauguggcaacggguaccuggaggauggagaagagugcgacugcggcgaagaggaggaauguaauaacccgugcuguaaugcuuccaacugcacacuccgccccggggccgagugugcgcauggcucuugcugucaccagugcaagcugcuggcuccuggaacccucugucgggaacaagccagacagugcgaucugcccgaguucuguacgggcaaaagcccucacugccccacaaauuuuuaucagauggacgggaccccgugcgagggaggccaggccuacuguuacaacgggaugugccuuaccuaucaagaacagugucagcagcuguggggaccuggcgcucgccccgccccugaucucugcuucgagaaggucaauguugcuggggacacauucggcaacuguggaaaggauaugaauggcgaacaucggaaaugcaacaugagagacgccaagugugggaaaauccaaugccaguccagcgaggcgcggccccuggaaucuaaugccgugccuaucgauaccacaauuaucaugaacggacgccagauucaguguagaggcacgcacguguaccgggggcccgaggaggaaggagacaugcuggauccgggccuugucaugaccgggacaaagugcggcuauaaucauaucuguuuugagggacaaugcagaaacaccuccuucuuugaaacagagggcugcgggaaaaaguguaauggacacggcgugugcaacaacaaucagaacugucacugccucccugggugggcuccucccuucuguaauacccccggacauggcgggagcauugacucuggcccgaugcccccugaauccguuggacccguggucgccggcgugcugguugcuauccuggugcucgccguccugaugcuuauguacuauugcugucgccagaacaauaagcuggggcagcucaaaccuagcgcgcugcccuccaagcugcggcaacaguuuucuugcccuuucagagugagccagaacuccggaacgggccacgccaaucccaccuuuaaacuucaaacaccgcaggggaagcgcaaagucaucaacaccccugagauucucagaaagcccucucagccucccccgcggccucccccugacuaccugcgcggaggcagcccucccgcuccccugccggcccaucucuccagagcugcccggaauagccccggcccugggucucagaucgagcgcacagaauccagcagacggcccccucccucucgcccuauuccgcccgccccuaacuguaucgugucccaagauuucagcagaccccggccuccccagaaggcucugccggcgaauccuguucccggacgcagaucucuuccccggccuggcggggccagcccccugagaccuccgggagcuggcccccagcagucccgcccucucgccgcccuggcucccaaauuuccugaguaucggagccaaagagccgggggaaugauuucuuccaagaucuga

SEQ ID NO: 65480 - RNA, 2331 nt, Artificial Sequence
  derived and/or modified sequence opt5 from ADAM20__Homo_sapiens__XP_005268209
auggugcagcugcaccaagacaccgauccccagaucccuaagggccagccgugcacacucaacagcuccgaagggggagccagacccgcugucccucauacgcuguucucuagcgcccuugaccgguggcugcacaaugauuccuuuauuauggcgguuggcgagccccucgugcauauccgcgugacccugcuucugcucugguucgggauguuucugucuauuagcggacacucccaggcuagaccuucucaauacuucacaagccccgaggucgugaucccucugaaaguuauuucccggggccgcggggccaaggccccgggauggcucagcuauucucugagauuuggcggccagcgguacaucgugcauaugcgcgucaacaaacuucuguucgcugcccaccuccccguguuuaccuauacagaacagcacgcucugcuucaggaccaaccuuucauccaggaugacuguuacuaucauggguacguugagggagugcccgaaucccuggucgcccucucuaccugcagcggcggguuucugggaaugcugcagauuaaugaucucguguaugagaucaagccuauuuccgugagcgcgacauucgagcaccuggucuacaaaaucgacucugaugacacccaguuucccccgaugagauguggccuuacggaagagaagauugcccaucaaauggaacugcagcucuccuacaacuucacccugaagcagagcuccuuuguugggugguggacacaccaacgguucguggagcuuguggucgugguugauaauauccgcuaucuguucucucagagcaacgcuaccacagugcagcacgaggucuuuaaugugguuaacauuguggacuccuucuaccauccucucgaagucgaugugauccugaccggaaucgacauuuggacggccagcaauccccugccuacaucuggcgaccucgauaacguccuggaggacuuuuccaucuggaaaaauuauaaccuuaauaacagacugcagcacgauguggcucaucucuucauuaaggacacccaaggcaugaaacuggggguugccuacgugaagggaaucugccagaaucccuuuaacacaggcgucgauguguucgaagacaaccggcuuguuguguuugcgauuacccuggggcacgagcucggacauaaucugggcaugcagcacgauacccaguggugugucugcgaacugcaaugguguaucaugcacgccuaucgcaaagugacaacgaaguucagcaacugcucuuacgcucaguauugggacagcaccaucuccucugggcucuguauucagcccccuccguaccccggaaauaucuuuagacugaaguacugcggcaaccuugugguugaggagggcgaagagugugauugcgggacaauucggcagugcgccaaagacccuuguugccugcucaauuguacccugcaucccggagcugccugcgccuucggcaucuguugcaaggauuguaaauuucugccuagcgggacacuuugccgccaacaggucggagaaugugaccuccccgaguggugcaacggcaccucccaccaguguccggacgauguguaugugcaggacgggauuagcugcaaugucaacgcuuucugcuacgaaaagacguguaauaaccaugauauccaaugcaaagagaucuuuggccaggacgcgagaucugccucccagagcuguuaucaagagauuaauacacagggaaaccgguucggccacugcgggaucgugggaaccaccuacguuaaguguuggacaccugauauuaugugcggcagagugcagugugaaaaugucggggugauccccaaccugauugagcacucuaccguucagcaauuccaucugaaugacacaacgugcuggggaaccgauuaucaccucggcauggcuaucccugacauuggggaagugaaagauggcacagucuguggacccgagaagaucugcauccgcaagaaaugugccuccauggugcaucugagccaggccugccagccuaagaccugcaacaugcggggcauuuguaacaauaaacagcacugccauuguaaccacgaaugggcucccccguacugcaaggacaaaggguauggaggcuccgccgauucugggccuccucccaagaauaacauggagggacuuaauguuaugggcaagcugagauaccucagccugcugugucuucucccccugguggcguuucuccuguucugccugcacguccuuuuuaaaaagcgcacaaaauccaaggaggacgaagagggguga

SEQ ID NO: 65481 - RNA, 2169 nt, Artificial Sequence
  derived and/or modified sequence opt5 from ADAM21__Homo_sapiens__NP_003804
auggccguggacggcacccuggucuacaucagaguuacacuccugcuucuguggcucgggguguuccugagcauuuccggauauugccaggcuggccccucucaacacuuuacgagcccugagguggucaucccgcuuaaggugauuucccgggggcgcucugccaaagcgcccggauggcugagcuacucccucagauucggcgggcagaagcauguugugcacaugcgggucaaaaagcugcuggugucucgccaucucccuguuuuuaccuauacagaugacagagcucugcuugaagaucagcuguucauccccgacgauuguuacuaucacggauacguggaggccgccccugaaagccucgucguguuuuccgcuugcuucggcggcuuucggggagugcugaaaauuagcggacuuaccuaugagaucgaacccauccgccauucugccacauucgagcaccuggucuacaagauuaacuccaaugagacccaguuuccugcuaugagauguggccucacagaaaaggagguugcccggcaacagcuggaguucgaagaggcggaaaacagcgcccuggagccgaaaucugcuggggacugguggacccacgccugguuucucgaacuggugguggucgugaaucaugauuucuuuaucuacucccagagcaacauuucuaagguucaggaggacguguuccuugucgugaauaucguugauuccauguauaaacaacugggaacguacauuauccucauuggcaucgaaaucuggaaccaggggaauguguuccccaugaccagcauugagcagguccugaacgacuuuucccaguggaagcaaaucucucuuagccagcugcagcacgaugcugcccauauguucauuaaaaauucccucaucagcauucugggacuggcguauguggccggcaucugccgcccucccaucgacuguggcgucgauaacuuucaaggggacacauggucucucuucgcuaauaccguggcccacgagcugggacacacacuuggcaugcagcaugacgaagaguuuugcuucuguggggaaagaggaugcauuaugaacaccuuucggguuccugcugagaaguucacgaauuguuccuacgccgauuuuaugaagacaacccugaaccagggcagcugccuccacaaucccccgcgccugggggaaaucuucaugcuuaaaagauguggaaacggcguggucgagcgggaggaacagugcgacugcggcucugugcaacagugugagcaggaugccugcugucugcucaacugcacacugcgcccuggggcugcgugugccuuuggacugugcuguaaggacugcaaauucaugcccagcggcgaacucuguagacaggagguuaaugaaugcgaucugccugagugguguaacgggaccucccaucaaugccccgaggaccgguaugugcaggaugggauucccugcucugacagcgcuuacuguuaucagaagagaugcaauaaccacgaucagcauugucgcgaaaucuuuggcaaagacgccaaguccgccagccaaaauugcuacaaagagauuaacucucaggggaaucgguucggccacuguggaaucaacggcaccacauaccuuaagugccacaucuccgaugucuucugugggagagugcagugcgaaaaugugcgcgacauuccucugcuccaggaccauuuuacgcugcaacacacccauaucaacggaguuacauguuggggcauugauuaucaucugcggaugaauaucagcgacauuggggaggucaaggauggaaccgugugcggcccggggaaaaucuguauucacaagaaaugcgugucucuuuccguccucagccacgugugccugcccgagacauguaacaugaagggcaucugcaauaacaaacaccauugucacugcggauacggcugguccccucccuauugucagcauagaggguacggaggcucuaucgacagcgggccugcuuccgccaagcgcggaguuuuccugccccucauugugaucccgucucugagcguccuuaccuuucuguucacggugggccuccugauguaucugcggcagugcuccgggccuaaggaaacaaaagcgcacagcucuggcuga

SEQ ID NO: 65482 - RNA, 2613 nt, Artificial Sequence
  derived and/or modified sequence opt5 from ADAM22__Homo_sapiens__NP_057435
augcaggccgcuguggccgucagcguucccuuccugcuccugugcgugcuuggcaccuguccuccggcgagaugcgggcaagcuggagacgccucccugauggagcucgaaaagcggaaagagaaccgcuuuguggaaagacagucuaucgucccccugcggcuuauuuaccgcagcggcggggaggaugaauccagacacgacgcccuggauacacgggugcgcggagaccucggcgggccucagcugacgcauguugaucaggcuucuuuccaaguggacgccuuuggaaccagcuucauccuggaugucgugcucaaucacgaccugcuuuccucugaguauauugagagacauaucgaacacggcggcaagacaguugaggugaaagggggagaacauuguuacuaucagggccacauucgggggaaccccgauagcuuugucgcucuguccacaugccacggacuccauggcauguucuacgacgggaaucacaccuaucugaucgagccugaggaaaacgauaccacacaggaggacuuucauuuccacagcguguacaagucucgccuuuuugaguucucccuggaugaccuccccagcgaauuucagcaagugaauaucaccccuucuaaauucauucugaagccgagacccaagcgguccaaacgccagcugagacgguauccucgcaacgucgaagaggagacgaaguacaucgaacucaugauuguuaaugaccaccugauguuuaaaaagcauagacuuagcguggugcacaccaacacauacgccaaaucugucgugaauauggcggaucugaucuauaaggaccagcucaagacccggauuguucugguggccauggagacaugggcuaccgauaacaaauucgccaucuccgaaaauccccuuauuacgcugagagaguucaugaaguaccgccgggacuuuaucaaagaaaagagcgaugcuguccaucucuucuccggaucucaguuugagagcuccagaagcggcgccgcguauaucggcgggauuuguucucugcugaaaggaggcggggugaacgaguucggaaagacagaccucauggccguuacccuggcucaaucccuugcccacaauaucggcauuaucagcgauaaacgcaagcuggcuucuggggaaugcaagugugaggacacauggagcggaugcauuaugggcgauaccggcuacuaucucccuaaaaaguuuacccaguguaacaucgaagaguaccaugacuuccuuaauuccgggggaggcgccugccuguuuaacaaacccucuaagcugcucgauccgccugaaugugggaacggauucaucgagacaggcgaggaaugcgacugcgggacgcccgccgagugugugcuggaaggcgcugagugcuguaaaaagugcacccugacacaggacagccaauguuccgauggacucugcuguaagaaaugcaaguuucagccuaugggcaccgucugucgggaggcggugaaugacugcgauauuagagaaacauguagcgggaacucuucccagugcgcccccaauauccacaaaauggacggauauagcugcgauggcguccaggggauuuguuucggaggccgcugcaagacccgggacagacaauguaaauacaucugggggcagaaggugacggcuucugauaaguacugcuaugagaaacugaacauugaaggcacagagaagggaaauuguggcaaagacaaggauaccuggauccagugcaacaaacgcgacguucuuuguggguaccugcucugcaccaauaucggaaacauuccccggcugggcgaacuggauggggagaucacauccacccuugugguccagcaaggaagaacacucaauuguagcggcgggcacgugaagcuggaggaagacguugaucugggcuauguggaggacggaacgccuugcggcccgcagaugaugugucucgaacaucgcugccugcccgucgccuccuuuaacuucucuaccugccuuagcuccaaggaggggacaauuuguucuggaaauggcgugugcagcaacgaacugaaaugugugugcaaucggcacuggaucggguccgacuguaacaccuacuuuccucauaaugaugacgccaagacaggaauuacccucagcggcaacgggguugcuggcacgaacaucauuaucggaaucauugccggcaccauccugguccuggcgcuuauucucgggaucacagcuuggggauauaaaaauuacagagagcagcggucuaacggccugucccacagcuggucugagcgcauucccgauaccaagcacaucuccgacaucugcgaaaaugggagaccucggagcaacucuuggcagggaaaucugggcggcaacaaaaagaaaauuagagggaagcgcuuccggcccagaagcaauuccacagagacccucagcccggccaagucuccuuccagcuccacgggaucuaucgccagcucccgcaaauaucccuacccuaugcccccucugcccgaugaagacaagaaagugaacagacaaucugcucggcuuugggagacaagcauuuga

SEQ ID NO: 65483 - RNA, 2499 nt, Artificial Sequence
  derived and/or modified sequence opt5 from ADAM23__Homo_sapiens__NP_003803
augaagcccccuggcagcuccucuagacagccgccccuggccgggugcagccucgcuggagccuccuguggcccucaacgggggcccgcgggaucugugccugcuagcgcccccgcccgcaccccuccgugcagacugcuucugguccuccugcuucugcccccucucgcugccuccucucggccccgcgcuuggggcgccgcggccccuagcgcuccccacuggaacgagacagccgagaaaaaucuggggguucuggcugacgaagauaacacgcuccagcaaaauuccagcucuaacaucuccuacagcaaugccaugcagaaggaaauuacccugccgucuagacuuaucuauuacauuaaccaggacuccgagagcccuuaucaugugcuggauacaaaagcgcggcaccagcagaagcauaauaaagccgugcaccucgcucaggccucuuuccaaaucgaggcuuuuggauccaaguucauucuggaccuuauccugaacaauggccuccugagcuccgauuacgucgaaauccauuaugagaacggcaagccccaguacucuaaagggggagaacacuguuauuaccacggcagcauucgcggggugaaggacuccaaaguugcccugagcacaugcaauggacuccauggcauguuugaggaugacaccuucguguacaugaucgaaccucuggagcuuguccacgaugagaagucuaccgggagaccccauauuauccagaaaacacuggccggacaguauuccaagcaaaugaagaaccucaccauggaacggggcgaccaguggcccuuucugagcgagcuucaguggcugaaacgcagaaagcgggcugugaauccuucucgcggcauuuucgaagagaugaaauaccucgaacugaugaucguuaacgaucacaagacguauaaaaagcacagaagcucccaugcgcacaccaauaacuuugccaaaucuguggucaaccugguggacagcauuuacaaggagcaacucaauacacgggugguccugguugcuguggagaccuggacagaaaaggaucagaucgacaucaccacgaacccggugcagaugcuucaugaguucuccaaauaucgccagagaauuaagcaacacgccgacgccguccaucugaucagccgggugacauuucacuacaaaagaucuucccucagcuauuucgggggaguuuguucucgcacccggggcgugggggucaaugaauacggacugcccauggcuguggcccagguucuuucccagagccuggcgcagaaccucggcauucaaugggagccuuccucuagaaagcccaaaugcgauuguacagaaagcuggggagggugcaucauggaggagaccggcgugucccacucucgcaaguuuagcaaguguuccauucuggaauaccgggacuuccugcagagaggcgggggagcuugccucuuuaaucgcccuaccaaacuguucgagcccacagaauguggcaacggguaugucgaggccggagaagagugcgauugcggcuuccauguggaguguuacgggcuuugcuguaagaaaugcagccugucuaauggcgcccacuguuccgacggaccgugcuguaacaauacgagcugccucuuucagccucggggcuaugaauguagagaugcugucaacgagugcgacaucaccgaauacuguacaggggauucuggacagugucccccuaaucugcauaagcaagacggcuaugccugcaaccagaaucaggggcgcugcuacaacggagagugcaaaacccgggauaaucagugucaauauaucuggggcacaaaggcugccggguccgacaaguucugcuacgagaaacugaacaccgaaggcacggagaagggaaacuguggcaaagauggggacagauggauucagugcagcaagcacgacguguuuuguggauuccuucucugcacaaaucugacccgcgcgccccggaucggccagcugcaaggggaaauuaucccuaccucuuuuuaccaccagggaagaguuauugauuguagcggcgcccaugugguccucgacgaugacacagaugugggguauguugaggacggcacccccugcggaccguccaugaugugucuggaucggaaaugccuucagauccaggcucugaacaugagcucuugcccucucgacuccaagggcaagguguguagcgggcacggagucugcuccaaugaagccacauguaucugcgauuucacgugggcuggcaccgacuguucuauucgcgaucccgugagaaaccugcaucccccuaaagacgaggggccgaagggacccagcgccacaaaucugaucauuggcuccaucgcgggggccauucuuguggcugccaucguucucggcggaaccggcuggggguuuaaaaacgucaagaaacggagauucgauccuacacaacagggacccauuuga

SEQ ID NO: 65484 - RNA, 2328 nt, Artificial Sequence
  derived and/or modified sequence opt5 from ADAM28__Homo_sapiens__NP_055080
augcugcagggccuccugcccgugagccuucugcucuccgucgccguuucugcuaucaaggagcugccuggggugaaaaaguacgaaguggucuauccgauuagacuucacccccugcauaaacgggaggccaaggaaccugagcaacaggaacaguucgagaccgagcucaaauacaagaugacaaucaacggaaagauugcggugcuguaucugaaaaagaauaaaaaccuccuggcucccggcuacacggaaaccuauuacaauagcacagggaaggagaucaccacauccccucagauuauggacgauugcuauuaccaaggacacauccuuaacgaaaaaguuucugacgccagcaucuccaccugucgcggccugagaggguacuuuucucagggagaucagcgguauuucauugagccccucagcccuauccaucgcgacggccaggagcacgcccuguuuaaguacaauccggaugaaaagaacuaugacuccacaugcggcauggauggggugcuuugggcucaugaccugcaacagaauauugcccuccccgcuaccaaacuggucaagcugaaagauagaaaggugcaggagcacgaaaaauacaucgaguauuaccucguucuggacaacggagaguucaagcgguauaaugagaaccaggaugagauucgcaaaagaguguuugaaauggccaauuacgucaacaugcuuuacaagaagcugaauacgcacguggcgcucgugggcauggagaucuggaccgacaaagauaagauuaaaaucacaccuaacgccagcuucacccuggaaaauuuuucuaaguggcggggguccguccuuagccgcagaaaacggcaugacaucgcucaacugauuacagccaccgagcucgcuggaacgacaguuggccuggccuucaugucuaccauguguucccccuauagcgugggggugguccaggaccacucugauaaccugcuccgcguggcgggaacaauggcccaugaaaugggccacaacuuuggcauguuccacgacgauuacuccugcaaguguccuagcaccaucugcguuauggacaaggcucuguccuuuuauauucccaccgauuucucuagcuguuccagacuuagcuacgacaaauuuuucgaggauaagcugucuaauugccucuucaacgccccgcugccuacagacaucauuuccacgcccaucugugggaaucagcuuguggagaugggagaagauugcgacuguggcaccagcgaggaaugcacaaacaucugcugugaugcuaaaaccugcaagauuaaagccacauuucaaugugcccugggggagugcugugaaaagugccaguucaagaaagcuggaauggucugucggccugcgaaggacgagugcgaccuccccgagauguguaauggcaaaucugggaacugccccgaugaccgcuuucaggugaauggauucccuugucaucacggcaagggccauugccugauggggaccugcccgacgcugcaggaacaauguacagagcucuggggacccggcaccgaaguugccgauaaaagcugcuauaacagaaaugaagggggauccaaguacggcuauugucggagaguggacgauacccugaucccuugcaaggcuaacgacacaaugugugggaaacuguuuugccagggcggaucugauaaucuucccuggaagggccgcauugucaccuuccucacauguaaaacguuugacccugaggauaccagccaggaaaucgggaugguggccaacggaacaaagugcggcgacaauaaagucuguauuaacgccgagugcguggauaucgaaaaggcuuacaaauccaccaauuguagcucuaagugcaaggggcacgccguuugcgaccaugagcugcagugucaaugcgaagagggauggauucccccggauugugacgacuccagcguggucuuccacuuuucuaucgugguuggcgugcuguucccuauggcggucaucuuuguggugguugcuauggucauucggcaccaguccagcagagagaaacagaagaaagaucagcgcccccuuuccacaaccgggacgcggccucauaagcagaaaagaaagccccaaauggugaaggccgugcagccucaggaaaugucucaaaugaaaccccacgucuacgaccucccgguggagggcaacgaaccucccgccagcuuccauaaggauaccaacgcucugcccccuacaguuuuuaaagacaauccgguguccacccccaaggauucuaacccuaaagccuga

SEQ ID NO: 65485 - RNA, 2463 nt, Artificial Sequence
  derived and/or modified sequence opt5 from ADAM29__Homo_sapiens__NP_001265056
augaagaugcugcuccugcuucacugccugggcguguuccucagcuguuccgggcauauccaggacgagcacccccaauaccauucuccuccggaugucguuauucccgugagaaucaccggaacaacgcggggcaugaccccucccggguggcugagcuauauucuuccuuuuggaggccagaaacacaucauucauaucaaggugaaaaagcugcuguucuccaaacaucugcccgucuuuacauacaccgaccagggggccauccuggaagaucagccuuucgugcaaaacaauugcuauuaccacggauauguugagggcgacccggaaucucucgugagccuguccacauguuuuggcggguuccagggcauucuucagaucaacgauuuugcuuacgagauuaagccccuggccuucucuaccacauuugaacaccucgucuauaagauggacagcgaggagaaacaguucuccaccaugcgcagcggauuuaugcaaaaugaaaucacgugcagaauggaguucgaagagauugauaacucuacccagaagcaguccagcuacguggggugguggauccacuuucggauuguugagaucguggucgugaucgacaauuaccuguauauucgcuacgaaagaaacgauucuaaacuucuggaggaccucuaugugaucgucaauauuguugauuccauccuggacgugauuggagugaagguccuccucuucggccuggaaaucuggacaaacaaaaaucuuaucgugguugaugacgugcgcaagagcguccaucuguacuguaaguggaaaucugagaacauuaccccucggaugcagcacgacacaucccaccucuucaccacgcuggggcuuagaggacugagcggcaucggcgcguuucgggggaugugcacaccccaucgcuccugugcuauugugaccuucaugaauaagacacucggaaccuuuucuaucgccguugcccaccaucugggccacaaccuggggaugaaucaugaugaagauaccugcagauguagccaaccucggugcauuaugcacgagggaaaucccccgaucacaaaauucuccaacuguagcuauggcgacuuuugggaguacacgguggaacgcaccaagugccuccuggagacaguccacaccaaagacaucuucaacgugaagagaugcgggaacggagucguggaagagggcgaagagugugauugcggcccucuuaaacauugugcuaaggaccccugcugucugucuaauugcacacucaccgauggguccacgugugccuuuggacugugcuguaaggacugcaaauuccuuccuagcggcaagguuugucggaaagaggugaacgaaugcgaucugcccgaguggugcaaugggacaucucacaagugucccgacgauuuuuaugucgaagacggcauuccuugcaaagagcgcggauacuguuacgaaaagagcugccaugacagaaacgagcagugucggagaaucuucggggcuggcgccaauaccgcguccgagaccugcuauaaggaacucaacacacugggagaucgcgugggccacugugggauuaaaaaugccaccuacaucaagugcaacauuucugacguucaguguggacggauccaaugcgagaaugugacagaaauuccgaacaugagcgaucacacgaccguccauugggcuagauuuaaugacaucauguguugguccacagauuaucaccugggcaugaaagggcccgacaucggagaggugaaggauggcaccgagugcgggauugaccauaucugcauucaccgccauugugugcacaucacaauucucaacagcaauugcucuccugccuucuguaacaaacggggcaucugcaauaacaagcaccauugucacugcaacuaccugugggaucccccuaauugucuuaucaagggauauggcggguccguugacagcggacccccgccuaaaagaaagaaaaagaaaaaguuuugcuaccuguguauucuccugcugaucguccuuuucauucuccugugcugucuguaucgccucugcaagaaaucuaagcccaucaaaaagcagcaggaugugcagaccccuuccgcuaaagaagaggaaaagauucaacggagaccccaugagcugccuccccagagccagccgugggugaugccuucccagucucaaccgcccgucacgccuagccagucccacccccaggugaugcccucucagagccaaccucccguuaccccuucccagagccagccccgcgugaugccuucucagucccaacccccggucaugccuagccagucucauccccagcuuacaccuucccaaagccagcccccggugaccccuucucagcggcagccccaacugaugccuagccagucccagccucccguuacacccagcuga

SEQ ID NO: 65486 - RNA, 2151 nt, Artificial Sequence
  derived and/or modified sequence opt5 from ADAM2__Homo_sapiens__NP_001265042
auguggagagugcuguuccuccugagcggccuugggggacugcggauggacuccaacuuugauucucuccccguccagaucaccguuccugagaagauucgcagcaucauuaaagaaggcaucgagucccaagccucuuacaagauugugaucgaagggaaaccguauacagugaaucugaugcagaagaacuuccuuccccacaauuuuagagucuacagcuauuccggaacgggcaucaugaaaccucuggaccaggauuuccagaacuuuugccauuaccaaggguauauugagggauaccccaagucugugguuauggugagcaccuguacaggccuccggggcguccugcaguucgaaaauguguccuaugggaucgagccucuggagagcucuguuggauuugaacacgugauuuaccaggucaagcauaaaaaggcugacgugucccucuacaacgagaaagauaucgaaagccgcgaccugucuuucaagcugcaguccguggaguauaaucacaugggcagcgauaccacagucguugcccaaaaaguguuucagcugauugggcucaccaacgcgaucuucgugucuuuuaauauuacaaucauccuguccagccuugagcuguggauugacgaaaacaagaucgcuaccacgggagaggccaaugaacuccugcauaccuuccugagauggaagacauccuaccucguccugcggccccacgauguggccuuucuucugguuuaucgcgagaaaucuaacuacgugggcgcuaccuuccaggggaagaugugcgacgccaauuaugcuggaggcgucgugcuccacccuagaacaauuagccuggaaucccuugccguuauccuggcgcagcuccugagccugucuaugggcauuaccuacgaugacaucaacaaaugucaaugcuccggggccguguguaucaugaauccggaggcuauucauuucagcggagucaagaucuuuucuaacugcagcuucgaggauuuugcccacuucauuuccaaacagaagucucagugucuccauaaccaaccccggcuggaccccuuuuucaaacagcaggcugugugcggcaaugccaaacuugaagcgggggaggaaugugacugcggaacggagcaggauugugcccugaucggcgaaacaugcugcgacauugcuaccugucgcuuuaaggccgggagcaacugcgcugagggacccuguugcgagaauugucucuucauguccaaggaaagaaugugccggccuagcuuugaggaaugugaucugcccgaguauugcaacgggucuuccgccagcuguccggaaaaucacuacguccaaacaggccacccuugcggccuuaaccaguggaucuguaucgacggagugugcaugucuggcgauaagcagugcaccgacaccuucgggaaagagguugaguuuggacccuccgaauguuacagccaucuuaauuccaagacagaugugucuggcaacugcgggauuagcgacuccggcuauacgcagugugaggccgauaaucuccaaugcggaaaacugaucuguaaguacgucggcaaguuccugcuccagauuccucgcgcuaccaucauuuaugcgaacaucucugggcaccugugcauugccguggaauuugcuagcgaccaugccgauucccagaaaauguggaucaaggacggaacaagcuguggcucuaauaaaguuugcagaaaccagcgguguguguccagcucuuaccuuggguaugacugcaccacagauaaguguaaugaccgcggagucugcaacaauaaaaagcacugccauuguuccgccagcuaccugccucccgauugcucugugcaaagcgaccucuggccuggcggguccaucgauagcggcaacuucccgcccguggcuauuccugccagacugcccgagcggagauauaucgagaacauuuaccacucuaagccuaugcgcuggcccuucuuucuguucaucccguuuuucauuaucuuuuguguucuuaucgcgauuauggucaaagugaauuuccagcggaagaaauggagaaccgaagacuacuccagcgaugagcagccugaauccgagucugaacccaagggauga

SEQ ID NO: 65487 - RNA, 2439 nt, Artificial Sequence
  derived and/or modified sequence opt5 from ADAM33__Homo_sapiens__NP_001269376
augggcuggagaccccggcgcgccagagggaccccucugcuccugcuucugcuccugcuucugcucuggccggugcccggagcuggcguccugcaggggcacaucccuggacaacccguuacaccucauugggugcuggacggccagcccuggcggacggugagccucgaggaaccugucuccaagccggauauggggcugguggcccuugaggcggaaggacaggagcugcuccuggaacuugagaaaaaccaccgccugcucgcucccggcuacauugagacccauuauggcccugacgggcagcccguugugcuggccccuaaucacacagaucauugccacuaccaaggaagaguccggggcuuccccgacucuugggugguucuguguaccugcagcgggauguccggacucaucacacugucucgcaacgccagcuauuaccuuagaccguggccuccccggggcuccaaggauuuuucuacccacgaaauuuuccgcauggagcagcugcucacauggaaagggaccuguggacauagagacccuggcaauaaggcuggcaugacgagccugcccgggggaccccagucccggggccgcagagaagcccggcgcaccagaaaauaucuugagcuguacaucguggcugaucacacacucuuucugacccggcauagaaaccugaaucacacaaagcagcgccuccuggaggucgccaacuauguggaccaacuucugcggacccucgauauucagguggcgcugacggggcuugaagucuggacagagagagaccgcagccggguuacccaggaugccaaugcuacacugugggccuuccuccaguggagacgcggacugugggcucaacggccucacgacucugcccagcugcucaccggcagagcguuucagggggccaccgugggacuggcuccgguggaaggcaugugccgcgccgaguccagcggcggggucucuacagaucauuccgaacuucccaucggagcugccgccacgauggcucacgagaucggccauagccuggggcucucucacgacccugacggauguugcguggaggcggccgcugaauccggcggguguguuauggccgccgcuaccggccaucccuucccucggguguuuagcgccugcuccagacgccaacugcgggcguucuuuagaaagggaggcggggcuugucugucuaacgcccccgauccgggacuuccugugcccccugcccucugcggcaauggguucguggaggcuggagaagagugugacugcggccccgggcaggaaugccgggaucuguguugcuuugcccacaacuguagccugcgcccuggcgcucagugcgcccacggagacuguugcguuagaugucuccugaaacccgcgggcgcccuuugccggcaggcuaugggggauugugaccugccggaguucugcacaggaaccuccagccauuguccucccgauguguaccuccuggacggcucucccugcgccagaggguccggauacugcugggauggcgcuuguccuacacuggagcaacagugccagcagcuuugggggccgggcagccaccccgccccugaagcguguuuucaagucgucaauucugccggagacgcucauggcaacugcgggcaggauagcgagggacacuuccuccccugugccggccgcgacgcucugugcgggaagcugcagugucagggaggcaaaccuucccuccuggcuccccacauggucccuguggacucuaccguucaucuugaugggcaagaagugacgugccggggcgcccuggcccuccccagcgcgcagcuggaccugcuuggacucggccuggucgagccggggacacaguguggaccuagaauggugugccagucccgcagaugucggaagaaugccuuccaagaacugcagcgcugccucaccgcuugccacagccauggcguuuguaacucuaaucacaacugccauugugcccccgggugggccccucccuuuugcgauaaaccgggauucggcggcuccauggacagcgggccugugcaggcugagaaccacgauaccuuucugcuugccaugcugcucucuguccugcugccccuucucccuggagcgggccuggcuugguguugcuauagacugcccggggcccaccuccaacgguguuccuggggaugccgcagagaccccgccuguagcggcccuaaggaugggccgcaucgggaccacccccugggaggcgugcauccuauggagcuuggccccacagcuaccgggcagccuuggccccuggauccugaaaauucccacgagccgucuagccaucccgaaaagccucuccccgccguguccccugacccccaggaucagguucaaaugccgcgcucuugccugugguga

SEQ ID NO: 65488 - RNA, 2265 nt, Artificial Sequence
  derived and/or modified sequence opt5 from ADAM7__Homo_sapiens__NP_003808
augcugcccggcugcaucuuccucaugauucugcuuaucccucaggugaaggagaaauuuauucugggggucgaaggacaacagcucguuagaccgaagaaacugccccuuauccagaagcgggacaccggccacacacaugaugacgauauucugaaaacguacgaggaagaacuccuguaugaaaucaagcugaaccgcaagacccucgugcugcaccuucugagaagccgggaguuccucggguccaauuacucugagacauuuuauagcaugaaaggagaagccuucacccgccauccucagaucauggaccacuguuuuuaccaaggcuccauugugcaugaguaugauucugcugccagcaucuccacaugcaacgggcugagaggauucuuucggauuaaugaccagcgcuaccuuaucgaacccgucaaguauucugaugagggcgagcaccugguguucaaauacaaccucagaguuccuuacggcgcgaauuauagcuguaccgaacugaacuuuacacggaagaccgugcccggggacaaugaguccgaagaggauagcaaaauuaagggaauccacgacgaaaaguacgucgagcuguucauuguggcugaugacacgguuuaucgcagaaacggccauccucacaauaaacuccggaaccgcaucugggggauggugaauuuugucaacaugaucuacaagacccugaauauucaugugacacuugugggaaucgagauuuggacccacgaagauaaaaucgagcuguauucuaacauugaaacaacccuccugagauucuccuuuuggcaggagaagauccuuaaaacgcggaaggacuucgaccacgucguucugcucagcggcaaauggcuguacucucaugugcaggggaucuccuauccgggaggcaugugccugcccuacuacagcacaucuauuaucaaggaucuccugccugacaccaauauuaucgccaaccgcauggcccaccaacuuggccauaaccuggggaugcagcacgaugaguuccccuguacaugcccuuccggaaagugugugauggacagcgauggcuccauucccgcucucaaauuuucuaagugcagccagaaucaguaucaucaauaccugaaagacuauaagccgaccuguaugcuuaacaucccuuuccccuacaauuuucacgauuuccaguuuugcgggaacaaaaagcuggacgagggagaggaaugugauugcggcccugcccaggagugcaccaaucccuguugcgacgcucacacauguguccucaagcccggguucacgugcgccgaaggagaguguugcgaauccugucaaaucaaaaaggcgggcagcauuugcagaccugccaaagaugagugugacuuuccggagaugugcaccggccauucucccgcuuguccuaaggaccaguuccgggugaacggguuucccugcaaaaauuccgaaggauauugcuucaugggcaaguguccuacaagagaggaucagugcagcgaacuguuugacgaugaggccaucgagucucacgacauuuguuacaagaugaacaccaaagggaauaaguucggauauugcaaaaacaaggaaaaucgcuuucugcccugugaggaaaaagauguucggugcggcaagaucuacuguacagggggcgagcucagcucccugcuuggagaagacaagaccuaccaucugaaagauccgcagaagaacgcuacggugaaaugcaagacaauuuuccucuaucacgacucuaccgauaucggccuggucgccagcgggaccaaauguggagagggcauggugugcaauaacggggagugucugaauauggaaaagguuuacauuuccacaaacugcccuagccaaugcaacgagaaucccguggacggacacggccuucagugucauugcgaagaggggcaggcgccugucgccugugaagagacccuccacgugacaaacaucacgauccuggucgugguucuggugcucgucauugugggcaucggaguucugauucuucuggugagauaucgcaaaugcaucaagcucaagcagguccaaucucccccuaccgagacacugggcguggaaaauaaaggguacuucggagaugagcagcagauucggaccgaacccauccugccggagauccauuuucuuaacaagccugcuuccaaagacagcagaggcauugccgaucccaaucagucugcuaaguga

SEQ ID NO: 65489 - RNA, 2475 nt, Artificial Sequence
  derived and/or modified sequence opt5 from ADAM8__Homo_sapiens__NP_001100
augagaggccuggggcucuggcugcuuggagccaugaugcugcccgcuaucgccccuagccggccgugggcgcucauggagcaguacgaagugguccugcccuggcgccuuccuggccccagaguucggcgcgcucugccuucccaccucgggcugcaucccgagagagugucuuaugugcugggagccaccggccacaacuucacacuccaucugcggaagaaucgcgaccuucuggggagcggauacacggaaaccuauacagccgcuaacggcuccgaggucaccgaacaaccuagaggccaggaucacugcuuuuaccaggggcauguggagggauauccggacucugccgcuagccucuccacaugugccggccugcggggguucuuucagguuggaucugaucuucaccugauugagccccucgacgaaggcggggagggaggccgccacgcgguguaccaagccgaacaucugcugcagaccgcuggcacaugcggggucagcgaugacucccucggaagccugcuuggcccuagaaccgccgcuguguuccggccccgcccuggggauucucugcccuccagagagacgcgguauguugagcucuacguggucguggacaaugccgaauuucagaugcugggaagcgaggcggccgugcgccacagaguccuugaaguugugaaccauguggauaaacuguaccagaagcucaauuuccgggucgugcugguuggccuggagaucuggaacucucaagacagauuucacguguccccggauccuagcgucacccucgaaaaucugcuuacauggcaggcucgccagcggaccagacgccaucugcacgacaacgugcagcucauuacagggguugauuucaccggaacgacagugggcuuugcccgggucucugcuauguguucccacagcuccggcgccgugaaucaagaccauucuaaaaaccccgucgggguggccugcaccauggcucacgagaugggacauaaucugggcauggaccacgaugagaacguucagggguguagaugccaggaacgcuucgaggcgggacgguguaucauggccggcagcauuggguccagcuuuccuagaauguucucugacugcucccaagccuaucuugagagcuuucuggaacgcccccagucugugugucucgccaaugcccccgaucugagccaccuggucggcggaccugugugcggcaaccucuucguugaacgcggggagcagugugacugcggaccgcccgaggauugcagaaaucgcuguugcaacuccacaaccugucagcuggcugaaggcgcccaaugcgcgcaugggaccuguugccaggaguguaaggugaaaccugcuggagaacuuugccggcccaagaaggacaugugugaucuggaggaguucugcgacggcagacacccugaaugucccgaggaugccuuucaggaaaacgggacaccgugcucuggcggauacugcuauaauggcgccuguccuacgcucgcucagcaaugccaggccuucugggggcccggaggccaggcugccgaggaaagcuguuuuuccuacgacauccugccugggugcaaagcgagccgguaucgcgccgauauguguggaguccugcagugcaagggcgggcaacagccccuuggcagagcuaucuguauuguggacgugugccaugcccucaccacagaggacggaaccgcuuacgagccuguucccgaaggcacacggugugggccggagaaagucugcuggaagggaagaugucaggaucugcacguguaucggucuuccaacugcagcgcccagugccacaaucauggcguguguaaccacaaacaagaaugccauugucacgcggggugggccccuccccauugcgcuaagcugcucaccgagguccacgccgcuucuggaucccugcccguguucguuguggucgugcuuguucugcucgccgugguccuggugacgcuggccggcaucauuguuuaccggaaggcuagaagccgcauccuuuccagaaauguggcgccuaaaacaaccauggggcggucuaacccgcucuuucaccaggccgcuagccgcguccccgccaagggcggagccccugcucccuccagaggcccucaggaacuggugcccaccacacauccugggcaacccgcccggcacccggcgucuagcguggcucugaaacgcccucccccugcucccccggucaccguuuccagcccucccuucccugugcccguguacacaagacaggcccccaagcaggucauuaaaccuacguuugcuccgcccgugccucccguuaagccuggagccggcgcggcuaaucccgggccugccgagggagccgugggcccgaaagucgcucucaagcccccuauccagcggaagcaaggcgccggggcucccaccgccccuuga

SEQ ID NO: 65490 - RNA, 2460 nt, Artificial Sequence
  derived and/or modified sequence opt5 from ADAM9__Homo_sapiens__NP_003807
augggcagcggggccagauuccccuccggaacccugcgggugcgcuggcuccugcuucugggccucgucgggccuguucugggagcugccagaccgggcuuucagcaaacaucucaccuuagcuccuacgagaucauuacgcccuggcggcugacccgcgaaagacgggaggcgccucgccccuauucuaaacaggugagcuacgugauccaggcugaagggaaggagcauauuauccaccucgaaagaaacaaggaccugcugccugaggauuucgucguguauacauacaauaaagagggaacccucauuacagaccaucccaacauccagaaucacugccauuaucggggcuacguugaaggcgugcacaacuccucuaucgcccugagcgauuguuuugggcuucgcggacugcuccaccuggagaaugccuccuauggcauugaaccucuucaaaacagcucucauuucgagcacaucauuuacagaauggacgaugucuacaaggagccgcugaaaugcgggguguccaauaaggacaucgaaaaggagaccgcuaaagaugaagaggaagaacccccuagcaugacacagcuccugcggcgcagacgggccguucugccccagacccgcuauguggagcucuuuauugucguggacaaggaaagauacgauaugaugggacggaaccagacggcugugagagaggaaaugauccugcuugccaauuaucuggacucuauguacauuaugcucaacauccgcaucguccugguuggccuugagauuuggaccaaugggaaccugaucaauauugugggaggcgcgggcgaugugcucgggaacuucguccaauggcgggaaaaauuucugaucacaagacgccggcaugacuccgcccagcuggugcucaagaaaggauucggcgggaccgcuggaauggccuuuguuggcacaguguguagcagaucucacgcugggggaauuaaugucuucggccagaucaccguggagacguuugccuccaucguugcgcacgagcugggccauaaccuugggaugaaccacgaugacggacgcgacugcagcuguggcgccaaguccugcauuaugaacucuggggcuagcggaucccggaauuucagcucuuguuccgccgaagauuuugagaagcugacacucaauaaaggcgggaacugccugcuuaauaucccuaagcccgacgaggcuuauagcgccccgucuuguggcaacaaacugguggaugccggagaggaaugcgacuguggcaccccuaaggagugcgagcucgaucccugcugugaagggagcacaugcaaacugaaguccuucgcugagugugcguacggagacugcuguaaagauugcagauuccugccuggcgggacccucugucgcggaaagaccucugaaugcgacguccccgaguauuguaauggcagcucccaguuuugccaacccgauguguucauucagaacggguacccuugucagaauaacaaggccuacugcuauaauggcaugugccaauacuaugacgcucagugucaggucaucuuuggaagcaaagccaaggccgcuccgaaagauugcuucauugaggugaacucuaagggcgaccgguuugggaauuguggauucuccggcaacgaauacaaaaagugcgccacagggaaugcgcuguguggaaaacuucagugcgagaacguucaagaaauccccguguuuggcaucgucccugcuauuauccagacgcccagcagagggaccaaguguuggggcguggacuuccagcugggaucugauguuccugaccccggcauggugaacgaggggacaaagugcggagccggcaaaauuugucgcaauuuucagugcgucgaugccuccgugcucaacuaugacugugaugugcaaaagaaaugccaugggcacggaguuugcaauagcaacaagaauugucauugcgaaaacggcugggcuccgccuaauugugagaccaagggguacggcggauccgucgacucuggccccacauauaacgagaugaauaccgcccugcgggaugggcugcuuguguucuuuuuccucaucgugccucugauugucugcgcuaucuuuauuuucaucaaaagagaccagcuguggcggagcuacuuccgcaagaaaagaucccagacguacgaaucugauggaaagaaccaggccaaucccagccggcaaccuggcuccgugcccagacacguuagcccggugacaccuccccgcgagguccccaucuaugcgaaccgguuugccgugccuaccuacgcugccaaacagccgcagcaguuccccucuagaccucccccuccccaaccuaagguuuccagccaggggaaucucauucccgcucgcccggccccugcgcccccucuguauucuucccuuaccuga

SEQ ID NO: 65491 - RNA, 1176 nt, Artificial Sequence
  derived and/or modified sequence opt5 from ADAMDEC1__Homo_sapiens__NP_001138743
augauccugaacggcgaggaaauuauccucagccugcagaagaccaaacaccuucuggggcccgacuacacagagacgcucuauuccccuagaggagaagagauuaccacaaagccggaaaauauggagcauugcuacuauaaaggcaacauccugaaugagaagaacucuguggccagcauuuccaccugugaugggcuucggggauacuucacacaccaucaccaacgcuaucagaucaaaccccugaagucuaccgacgaaaaggagcaugcugucuuuacaagcaaucaggaggaacaggauccugccaaccauaccugcggcguuaaauccacggacgggaagcaaggacccaucagaauuucucggagccucaaauccccugagaaggaagauuuccugcgcgcgcagaaauacaucgaccuguaucucgugcuggauaaugcuuuuuacaagaacuacaaugagaaccuuacccugauucggagcuucguguuugacgucaugaaucuccugaacgugaucuauaauacaauugauguucagguggcccuugucggcauggaaaucuggucugacggcgauaagauuaaagugguucccuccgccagcaccacauucgacaacuuucugagauggcacucuuccaaucucgggaagaaaauccacgaucacgcucagcugcugagcggaaucucuuucaacaaccgcagagugggccucgccgcuuccaauagccuguguuccccuucuagcgucgccgugauugaggcgaagaaaaagaacaauguggcccuugucgggguuaugucccaugaacugggacacgugcucggcaugccggacgugcccuuuaacaccaaaugcccuagcgggucuugugucaugaaucaauaccuguccagcaaguuccccaaggacuuuucuacgagcugccgggcucacuucgagcgcuaucuucugucccagaaaccuaagugucuccugcaggcccccaucccgacaaacauuaugaccacaccugugugcggaaaucaucugcucgagguuggcgaagauugugacugcggcucucccaaagaguguaccaaccugugcugcgaagcucuuaccuguaagcugaaaccugggacagauugcggaggcgacgcccccaaucacacgaccgaguga

SEQ ID NO: 65492 - RNA, 3312 nt, Artificial Sequence
  derived and/or modified sequence opt5 from ADAMTS10__Homo_sapiens__NP_112219
auggcccccgcuugccagauccugagaugggcccucgcgcugggccuugggcugauguucgaggugacccacgcuuuucggagccaagacgaguuccucuccucucuggaaagcuacgaaauugccuuuccuacacgcgucgaucauaacggagcccuucuggcuuucuccccgcccccucccagacggcagcgcagaggcacgggggccaccgcugagucucggcucuuuuauaagguugccagcccuuccacacacuuccugcugaaucucacccgcucuagcagacugcuugcgggacauguguccguggaauacuggacacgggagggccuggccuggcagcgcgcugccagaccccacugucucuaugcugggcaucugcagggacaagccucuagcucccacgucgcgaucucuaccugcggcggccuucacgggcugauuguggccgacgaggaagaguaccucaucgaaccucugcauggaggcccgaaagggagccggucccccgaggagagcggaccucacguuguguauaagagaucuucccugcgccauccccaccucgauacagcuuguggcguccgggacgaaaaaccuuggaaggggcgccccugguggcugagaacccuuaaaccgccucccgcccggccucugggaaacgagacggaaagaggccagcccggccucaagcgcagcgugucccgggagagauacguugaaacccugguggucgcugauaagaugaugguggccuaucacgggcgccgggacguggagcaguacguccuugccauuaugaauaucguugcuaaacuguuucaggauucuagccucggauccacagugaacauccuggugaccagacugauucuccugacagaggaccaacccacccuugaaaucacgcaucacgcgggcaagagccuggauucuuucugcaaauggcagaaguccauugucaaucauagcgggcacggaaacgccaucccugagaauggcguggcuaaccaugacacagccguucucauuacccgcuacgauaucuguauuuauaaaaauaagccgugcgggacacugggacuugcccccgugggcggcaugugugaacgggagagaucuugcagcgucaacgaagacaucgggcuggcuaccgccuuuaccaucgcgcacgagauuggacacacauucggcaugaaucaugauggggugggaaacuccuguggcgcucgcgggcaggacccugccaagcucauggccgcucacaucacgaugaaaaccaaucccuuuguuuggucuagcugcucccgggacuacauuaccagcuuccuggauucuggccugggacucugucugaacaauagaccuccccgccaggacuuuguguauccgaccgucgccccuggccaggcuuacgaugccgacgagcaaugccgguuccagcauggggugaaguccagacaaugcaaauauggagaagucuguagcgagcuuuggugccugucuaaguccaaccgguguaucacaaacagcauucccgcggccgaaggcacccucugccagacgcacacaaucgauaaagggugguguuacaagcgcgugugcguuccuuucggauccagacccgagggcguggacggggcuuggggcccuuggacccccuggggagauuguucucggaccugcggcgggggagucagcuccucuagcagacacugugacuccccgcgcccuacaaucggcgggaaauauugccugggagaacggagacgccauagaagcuguaauaccgaugacugcccucccggcucucaggauuuucgggaggugcagugcuccgaguucgacagcauucccuuucgcgggaaguucuacaaguggaaaacauacagaggcggaggcguuaaggccuguucucugacgugccuugcugaaggguuuaacuucuauaccgagcgggccgcggccguggucgacggaacaccgugucgccccgauaccguggacaucugcguguccggcgaauguaaacacguugggugcgauagaguccucggaagcgaccugcgggaggauaagugucgcgugugcggcggggacggcucugcuugugagacaauugaaggaguguuuagcccugccucccccggcgcuggguacgaggaugucguguggaucccuaaaggaagcguucauauuuucauccaagaccugaaucucucucugucccaccuugcccugaagggcgaucaggaaagccuccugcuggaggggcuucccggaaccccucagccccauagacucccgcuggccggcacgaccuuucagcugcggcaaggcccugaccaggugcagucccucgaagcucuggggcccaucaacgcgucucuuauugucauggugcuggcccgcacagagcucccugcucugagauaucgguucaaugcccccaucgccagagauagccugccgccuuacuccuggcacuaugcucccuggaccaagugcucugcccagugugcgggaggcagccaaguucaggcuguggagugccgcaaccagcuugacuccucugccgucgccccucacuacugcagcgcucauuccaaacuccccaagcggcagagagccuguaauacagaacccugcccuccggauugggugguugggaacuggagccuguguucucgcuccugcgacgcgggagugcggagcagaucugucgugugucaacgccggguguccgcugccgaggaaaaagcccuggacgauagcgcuugcccccagccuagacccccuguccucgaggccugucacggccccacaugcccuccggaaugggcugcccuggacuggucugaguguacgcccuccugcgggccuggacuucgccaucggguugugcuguguaagagcgcggaucacagagccacacugcccccugcucauugcucccccgccgcuaaaccgccugccaccaugcggugcaaucuccgcagauguccucccgcccgguggguggcuggcgaguggggcgaaugcagcgcgcaguguggggucggacaacgccagagaucugugcggugcacaagccacaccggccaggccucccacgaguguaccgaagcucugagaccucccacaacgcagcaaugcgaggccaagugugacucucccaccccgggggauggacccgaagagugcaaggacguuaacaaaguggccuauuguccucuuguccucaaguuucaguucugcagccgcgcuuacuuucggcagauguguugcaaaacaugccauggccacuga

SEQ ID NO: 65493 - RNA, 4785 nt, Artificial Sequence
  derived and/or modified sequence opt5 from ADAMTS12__Homo_sapiens__NP_112217
augcccugcgcccagagaagcuggcuggcuaaccucuccguggucgcccaacugcuuaauuucggcgcgcuguguuacgggcggcagccucagccgggacccguucgcuuuccugacagacggcaggagcacuucaucaagggccuccccgaauaucaugugguggggccuguccgcguggaugcuucuggacacuuucugagcuacggccuucauuaucccauuaccuccucuagacggaaacgcgaccuggaugggagcgaggacuggguuuacuauagaaucucccacgaagagaaggaucucuucuuuaaccugacagugaaucaaggauuccugucuaacagcuacauuauggaaaaacgguauggcaaucucucccaugucaagaugauggccagcucugccccucugugccaccuuuccggcacggugcugcagcaggggacccgcguuggaacagcugcccucagcgcuugucacggccugaccggguuuuuccagcuuccgcauggagacuuuuucaucgagcccgugaaaaagcacccucuggucgagggcggguaccauccccacauuguguacagacggcaaaaggugccugaaacaaaagagccgaccugcggacucaaggauucugucaacaucucccagaaacaggaacuguggcgcgagaagugggagagacacaaucugcccagccggucucucucccgcagaagcaucuccaaagaacgguggguugagacacuggugguggccgacaccaagaugauugaauaucauggcucugagaacgucgaaagcuacauccuuacgauuaugaauauggugaccggccuguuucacaacccuuccaucgggaaugcgauucauaucguuguggucagacucauucugcuugaggaggaagaacagggacugaagaucgugcaccaugccgagaaaacacucagcucuuucuguaaguggcaaaaauccaucaaccccaagagcgaucugaauccuguucaccacgacguggcuguccugcucacccgcaaagauauuugcgccggcuuuaaccggcccugugagacacuggggcuuucucaucugagcggaaugugccagccccacagauccuguaauaucaacgaagacucuggccucccucuggcuuucaccauugcccaugagcuugggcacagcuucggaauccagcacgauggcaaggagaacgacugcgaaccggugggccgccaucccuauauuaugucccggcaacugcaguacgacccuacgccccucacauggagcaaauguucugaggaauauaucaccagauuucuggaucgcggguggggauucugccuggacgauaucccuaagaagaaaggccucaaguccaaagucauugcgcccggggugaucuacgacguucaccaucagugccagcugcaauauggaccgaaugccacauuuugucaggagguggaaaacgucugccagacccuuugguguagcgugaagggcuucugccggucuaaacuggaugcugccgcugacgggacccaguguggcgagaagaaguggugcauggccggaaaauguauuacaguuggcaagaaaccugaguccauccccgggggauggggcagauggagcccuuggucccacugcucucgcacguguggggccggagugcaaagcgcugaacggcucugcaauaaccccgagccuaaguuuggcgggaaauacuguaccggcgaaagaaagcgcuaccggcugugcaauguccaucccugcagauccgaggcgccgacauuccggcagaugcaguguucugaguuugauaccgugccuuauaagaacgaacuguaccacugguuccccauuuuuaaucccgcccacccuugcgagcuuuauugucgcccgaucgacggacaguucagcgagaaaaugcucgaugcugugaucgacggcacacccugcuuugaagggggaaacuccagaaauguuuguauuaacggcaucugcaagauggucgggugugauuacgaaauugacagcaaugccaccgaggaccggugcggagugugucugggcgaugggucuuccugccaaacggugagaaaaauguucaagcagaaagagggcagcggauaugucgacaucggccugauuccuaagggggcccgcgauauccgggugauggaaauugagggagcuggcaacuuucucgccaucagaucugaagaccccgagaaguacuaucugaaugggggauucaucauucaguggaacggcaauuacaaacuugcggggacaguuuuccaguacgaucgcaagggcgaccuggaaaaacucauggcuaccggaccuaccaacgaguccguguggauccaacugcuguuucaggucacaaaccccggcauuaaguaugaguacaccauccagaaagaugggcuugacaaugauguggaacaacagauguauuucuggcaguacggacauuggacagaguguagcguuacgugcggcaccgggauuagacggcagacagcccacugcaucaagaaaggacgcggcauggugaaggccaccuuuugugacccugaaacacaacccaacggcagacagaagaaaugccaugagaaggcuuguccgccucgguggugggccggggaaugggaggcuugcucugccaccuguggaccccacggcgagaaaaagcgcacgguccucugcauccagaccauggugagcgaugaacaggcgcugccucccacagacugucaacaucugcucaaaccgaagacccugcuuuccugcaauagagauauucuguguccuagcgacuggacaguugggaacuggucugagugcuccgugagcuguggaggcgggguccggauccgcuccgugaccugcgccaagaaucacgacgaacccugcgaugugacgagaaaaccuaacucucgggcucucuguggacugcagcagugccccagcucccgcagaguccugaagcccaauaaaggcacaauuucuaacggcaagaauccuccgacccuuaaacccguuccucccccuacaagccggcccagaaugcucaccaccccuacagggccggaguccaugucuacgagcacccccgccaucuccagcccuucucccacaaccgcuuccaaggagggagaccugggcgggaagcaguggcaagauagcucuacacagccugaacuguccagccgcuaucucauuucuaccggauccacgagccagcccauccugacaucccaaagccuuucuauccagccgagcgaggaaaacguguccucuagcgacaccggcccuaccuccgaagggggacugguggccacaaccacaucuggcagcggccucuccucuagccggaaucccauuacguggcccgucaccccuuucuacaacacacugaccaaagggcccgaaauggagauccacuccggaagcggcgaggaaagagagcagccugaagauaaggacgagucuaauccggugauuuggacaaaaauccgcguucccgggaacgaugcgccuguggaauccaccgagaugccccuggccccuccccuuacgccggaccucagccgggagucuugguggccucccuuuuccaccgucauggaaggacugcugccuagccagagacccacaaccuccgagacaggcaccccucgcguggaagggaugguuacagagaagcccgcuaauacccuccugccgcuuggaggcgaucaucaaccugaacccucuggcaaaacggccaaccggaaccaccugaagcuccccaauaacaugaaucagacaaagagcuccgagccugugcugaccgaggaagacgcuaccagccugauuacagagggguuccuucugaacgccucuaauuauaaacagcucaccaacggacauggcuccgcccacuggaucgucgggaauuggagcgaauguucuacgacaugcggacugggcgcuuacuggagacgcguggaguguagcacccagauggauuccgacugcgcggccauccaacggccggaucccgcuaagagaugucaccuccggccuugcgccggguggaaaguuggaaacuggucuaaguguagccgcaauugcuccggcggcuuuaaaauuagagagauccaguguguggacucucgggaccaucgcaaccugagacccuuccacugccaguuucuugccgggauuccucccccucugagcauguccugcaauccggaacccugugaggcuuggcaggucgaaccuuggagccaaugcucucgguccuguggaggcggggugcaggagagaggaguguucugccccggcgggcucugugauuggacaaagcgcccuaccagcacaauguccugcaacgaacaucuguguugccacugggccaccggaaauugggaccuguguucuacgagcugcggcggcggguuucagaaacggaccguccaguguguucccuccgagggaaacaagacagaggaucaagaccagugccuuugcgaucauaagccgagaccucccgaguucaaaaaguguaaucagcaagcgugcaaaaagucugcugaccugcucuguaccaaagauaagcugagcgccuccuuuugccagacacucaaggccaugaaaaaguguagcgugcccaccgugcgcgcugagugcuguuucucuugcccucagacgcacaucacacacacccagcggcaaagacgccagcggcugcuucagaaauccaaggaacuguga

SEQ ID NO: 65494 - RNA, 4284 nt, Artificial Sequence
  derived and/or modified sequence opt5 from ADAMTS13__Homo_sapiens__NP_620594
augcaccagagacauccccgggcccgcugcccuccgcuguguguggcuggcauccucgccugcggguuccugcuuggauguuggggccccagccacuuucaacaguccugccugcaggcgcucgagccucaggcugucucuagcuaccugucccccggggccccucuuaagggaagacccccuucuccgggcuuccaacggcagcgccagagacagcggcgcgccgcugggggaauccugcaucucgaacugcugguugccgugggccccgacguguuucaagcucaccaggaggauaccgaaagauauguccucacaaaccugaauauuggcgccgagcuucugcgggacccuagccucggggcgcaguuccgcgugcaucugguuaaaauggugauucuuacggaacccgagggagccccuaacaucaccgcuaaucugacauccucucuccugagcgucuguggcuggucccagaccauuaaccccgaggaugacacagauccggggcacgccgaccuggugcucuacaucaccagauuugaucuggaacuuccugacggaaaucggcaaguucgcggcgugacacagcucgggggagcuugcagccccaccuggucuugucugaucacggaggauaccggcuucgaccugggcgucacaauugcccacgaaaucgggcauuccuuuggacuugagcacgauggcgcgccugggagcggaugcggccccucugggcaugugauggccuccgacggagcugcccccagagcuggccuggccuggagcccuuguucucggcgccagcuccugucccugcucagcgccggcagagcucggugcgugugggauccgcccagaccucaacccggguccgcgggacacccucccgacgcccagccgggccuguauuacucugcuaacgagcagugucgcgucgccuucgggccuaaggccguugcuugcaccuuugcccgggaacaccuugacaugugccaggcgcugagcugucauacagauccccucgaccaauccagcugcucuagacugcuugugccucugcucgauggaaccgaguguggcguggaaaaauggugcuccaaggggcgcugucggagccuggucgagcugacgcccauugcugccgugcacggcagauggucuagcuggggaccucgcucccccugcucucggagcuguggcgggggaguugugacaagacgccggcagugcaauaacccgagaccugccuucggcgggcgcgcuugugucggagccgaccuccaggcugaaaugugcaauacccaggccugugagaaaacacaacuggaguuuaugucccagcagugcgcgcggaccgauggccagccccuuagaagcucucccgggggcgccuccuucuaucauuggggagcugccgugccucacagccaaggcgacgcucugugccggcauaugugucgcgccaucggggaaucuuuuauuaugaagagaggagauuccuuccucgacggcacccggugcaugccgagcgggcccagagaggauggaacacugucccuguguguuucuggcagcugccgcacguucgggugugacggccggauggauucccaacaggugugggacagaugccaggucuguggaggcgacaacucuaccugcagcccucgcaagggguccuuuacagcggggagagcccgggaauacgugaccuuccuuacagucacccccaaucucacgagcguguauaucgcuaaccaccgcccucuguuuacacaccuggccguuagaauuggcgggcgguacguggucgcuggaaaaaugucuaucucccccaauaccaccuacccuagccuccuggaggauggccgcguggaauauagaguugcccuuacagaggaccggcugccccgccucgaggaaaucagaauuugggggccgcugcaagaggaugccgacauccagguguaccggcgcuauggcgaagaguacggaaaccugaccagaccugauauuacauucacguauuuucagcccaagccucggcaggcuugggucugggcggccgugagaggccccuguucuguguccugcggggcuggacuucgcuggguuaauuacagcugucucgaccaggcccggaaagaacuggucgagaccgugcagugccagggcucucaacagccgccugccuggcccgaggcuugcgugcuggaaccuuguccucccuauugggccgucggggauuucggacccugcagcgcguccuguggcggcgggcucagagagcgcccggugcggugcguugaagcucagggaagccugcuuaagacacugcccccugccagaugucgcgccggcgcucagcaacccgccguggcgcucgagaccugcaacccucagcccuguccugcucggugggaggucucugaaccguccagcugcacauccgccgggggagccggccuggcucuggagaacgaaaccugugugcccggggccgacggacuugaggcuccuguuacggaaggccccggcucuguggaugagaaacucccugcccccgagccgugcgucgggaugagcuguccucccggauggggccaucuggacgcgaccuccgccggggaaaaggcucccucuccuuggggaagcaucagaacaggcgcccaggcugcccacguguggacccccgccgcuggguccugcucuguuagcugcggacgcggccugauggagcuccgguuucuguguauggauuccgcgcuuagagugccuguccaggaagaacugugcggccucgccagcaagccggggucucggcgcgaagugugucaagcugugcccugcccugccagauggcaguacaaacuggccgcuuguuccgucagcugcggacggggcguugugcgccggauucuguacugugccagagcgcauggggaggacgauggagaggaaauccuucucgacacacagugccaaggccugcccagaccugagccccaggaggcuuguucucuggagccgugcccuccccgcuggaaggugaugucccucgggccuuguagcgccucuugcggacugggcaccgcccggagauccgucgcuugcgugcagcuugaccagggccaagauguugaaguggacgaggccgcgugugcugcccugguccgccccgaggccagcgugccuugccucaucgcugauuguacguaucgguggcacguugggacauggauggaaugcuccgugagcuguggagacggcauucagagacgccgggauaccugccuggggccccaggcccaggcuccggucccugccgacuucugucaacaucugcccaaacccgugacaguuagaggaugcugggcgggcccuuguguggggcagggaaccccgucucuugucccccacgaggaagccgcugccccuggccgcaccacagcuacgcccgccggcgccagccuggaguggucccaggcuagagggcuccuguuuucuccugcgccccagccucggcgccuccugccgggaccccaagagaauagcgugcaguccucugccugcggcagacagcaccuugaaccuaccgggacaaucgauaugcggggacccggccaggcugacugugccguggccauugggcgcccucugggagaggucguuacccucagagugcuggaaagcucccugaacugcucugcuggcgauaugcuucugcucuggggccggcugacauggagaaagaugugccgcaaacuccuggacaugaccuucagcuccaagacgaauacacuugugguccggcaaagaugugggcgccccggaggcggggugcugcuccgguacggaagccagcuggccccggagaccuuuuauagagaaugcgauaugcagcuguucggcccuuggggagagaucguuucucccucccuuagccccgcgaccucuaacgcuggaggcugucggcuguuuauuaauguggccccucaugcccgcaucgcuauccacgcccucgcgacaaacaugggcgccgggaccgagggagcuaaugccuccuacauucugaucagagacacacauagccuccggacgaccgcuuuccacggccaacagguccuguauugggaauccgagucuagccaggccgaaauggaguucuccgaaggguuucuuaaagcucaggccagccugcgcggacaauacuggacacugcagucuugggugcccgagaugcaggauccucaguccuggaagggcaaggaggggaccuga

SEQ ID NO: 65495 - RNA, 3672 nt, Artificial Sequence
  derived and/or modified sequence opt5 from ADAMTS14__Homo_sapiens__NP_542453
auggcuccccugagagcccuccugagcuaccuucugccucuccacugcgcccugugugcggcugccggcucccggaccccggagcuucaucugucugggaagcucagcgacuauggagugacaguccccugcuccacggauuuccgcggcagauuucugucucacguugugagcgggccugccgcugccuccgcuggaucuaugguggucgacacacccccuacccugccccggcauagcucccaccuccgcguggccagaagcccucugcauccgggcgggacccuuuggcccggacggguuggccgccacucucuguacuucaacgugacagucuuuggcaaagaacuccaccugagacuucggccuaaucgcagacuggugguucccggguccagcguggaguggcaggaagauuuccgggagcucuuucgccaaccucugagacaggaaugugucuauaccggaggcgugacagggaugcccggagcggccguggcuaucucuaacugcgacggccuggccgggcucauucggaccgauuccacggacuucuuuaucgagccgcuggagcgcggacagcaggaaaaggaggcuagcggcagaacccaugucguuuaccggagagaagccgugcaacaggagugggcggagccugauggcgaccuucacaaugaagccuucgggcugggagaucuccccaaccugcuuggccuggugggggaccagcucggagauacagagcgcaaacggagacaugcuaagccuggcucuuauuccauugaaguccugcuggugguugacgauagcgugguccgcuuucacgggaaagagcacgugcagaauuacguucucacccugaugaacaucguggacgaaauuuaucaugacgagucccuuggaguccacaucaauaucgcccuggugcggcucauuauggucggcuacagacaaucucugagccuuaucgagcgcggcaaccccucccggagccuggaacagguguguagaugggcucauucucagcagcgccaagaucccucccacgccgagcaucacgaccacguuguguuccucacacggcaggauuuugggccuagcggauacgccccggucaccggcaugugccauccccugagaucuugugcucugaaucacgaagacggguucagcuccgcguuugugauugcccaugagacgggacacguucucggcauggaacacgaugggcagggcaacggaugcgcugacgagacaucucugggcagcgugauggccccucuuguccaagccgcuuuccaucgcuuccacuggucccgguguagcaagcuggagcucucuagauaucugcccuccuacgauugccugcuugacgauccuuuugaccccgccuggccgcagccucccgaacucccugggaucaauuauagcauggaugagcagugucgguucgacuuuggaucuggcuaccagaccugccuggcguuccgcacauuugaacccugcaagcaacugugguguucccauccugacaaccccuauuucugcaaaaccaagaaagggccgccucucgauggaaccgagugugcucccggcaaguggugcuuuaaagggcacuguauuuggaaaagccccgaacagacauacggccaggacggaggcugguccucuuggacgaaguucgggagcugcuccagaucuuguggaggcggggugcggagcagaucccgcagcugcaauaacccuucuccggccuauggaggccggcugugucuugggcccauguuugaguaccaggugugcaauuccgaggaauguccuggcaccuacgaggauuucagagcccaacagugcgcuaagcgcaacagcuauuacguucaucagaacgccaagcacucuuggguccccuaugaaccugacgaugacgcucagaaaugcgagcugaucugucaauccgccgauacaggagacgugguguuuaugaaucaggucgugcacgauggcaccagaugcagcuaccgggaccccuauucuguuugugcgcgcggggagugcgugccugucggaugugauaaggaagugggcagcaugaaagccgacgauaagugcgggguuuguggaggcgacaacucccauugcagaacagugaaagggacccucggcaaggcuagcaagcaggccggagcucugaaacugguccagauucccgccggcgcgcggcacauccaaaucgaggcccuugaaaagucuccgcaucgcauugugguuaaaaaucaggugacgggguccuucauccucaacccuaagggaaaagaggcuacaagcagaaccuuuaccgccaugggccuggaaugggaggacgcugucgaggaugccaaggaaucccugaagacaucugggccccucccugaggccauugcuauccuggcgcuucccccgaccgaaggaggcccucggagcucccuggccuacaaauaugugauucacgaggaccuccugccccugaucggcucuaauaacgugcuucucgaagagauggauacauacgagugggcucucaagagcugggccccuuguuccaaagccugcgggggaggcauccaguucacgaaguacgggugucgcagacggcgcgaccaucacaugguccaaagacaccugugcgaucauaaaaagcggcccaagcccauuagacgccggugcaaucagcacccuuguucucagccgguuugggugaccgaagaguggggagcuugcagcagauccuguggcaaacugggggugcagacacgcggaauccaaugccugcuuccccugagcaacggcacccauaaggucaugccugccaaagcgugugcuggcgaccggcccgaagccagacgcccuugccuccgggugcccuguccugcccaguggagacugggggcuuggucucagugcuccgccacauguggagagggcauucagcaacgccagguugugugccggaccaaugcgaacagccuggggcacugugaaggagauagaccggacacgguccaggugugcucucuucccgcuugcggcgggaaucaccagaacuccaccguucgggccgaugugugggagcucggaacaccugagggccaaugggucccccagagcgaaccucugcaucccaucaauaagauuucuuccaccgagccguguacaggcgaccgcagcguguucugccagauggaaguucuggauagauauuguuccaucccuggguaccaccggcucugcugugugagcugcaucaaaaaggccucuggacccaaccccggcccugaccccgggccuaccagccugccgcccuuuuccacgccuggaucuccccuuccuggcccccaagauccggcugacgccgcugagccucccgggaagccuacaggaagcgaggaccaucagcacggccgcgccacccagcugcccggcgcgcucgauacauccucuccugggacccagcaucccuucgccccggaaaccccuauucccggagcuagcugguccaucucucccacaacgccuggcgggcugccguggggauggacccaaacacccaccccuguccccgaggacaaaggccagccuggggaagaucugagacaccccggaacaagccuuccugccgcuuccccggugaccuga

SEQ ID NO: 65496 - RNA, 2853 nt, Artificial Sequence
  derived and/or modified sequence opt5 from ADAMTS15__Homo_sapiens__NP_620686
augcugcuccugggcauccuuacccuggccuucgcugggagaacagccggaggcagcgagcccgaacgggagguggucguuccuauucgccucgacccggauaucaacgggagacgguacuauuggcgcggacccgaagacuccggcgaucaggggcugauuuuucaaaucacggcguuccaggaggacuuuuaccuucaccugaccccugaugcucaguuccucgcccccgccuuuucuacagaacaucugggagugccucugcagggccucaccggcgggagcuccgaccugagacggugcuucuauucuggagaugugaaugcugagcccgacagcuuugccgcugucucccuuuguggcgggcugcgcggagccuucggcuacagaggggcggaguaugugauuucuccucucccgaacgccagcgcucccgccgcucaacgcaauucccagggagcccaccuucuucagcggagaggcguuccuggcgggcccagcggagauccuacaucucggugcggcguggcguccggguggaaccccgccauccugcgcgcucucgacccguacaagccuagacgggccggauuuggcgaaagccgcucuagacggagauccgggcgcgcuaaacgguucgucagcauccccagauauguggagacccugguuguggccgaugaaucuauggucaaguuucauggagccgaccuggagcacuaccuccugacacuucuggcuaccgcggcccgccucuaccggcauccuuccauucugaaucccaucaacauugugguggucaaaguucuucugcucagagaucgcgacagcggccccaaggugacgggcaaugcugcccugacccugcggaacuucugugccuggcagaaaaagcucaauaagguguccgacaaacacccugaguauugggauacagcuauccuguuuaccagacaagaccuuugcggggccacaaccugugauacgcugggaauggcggacgucggcacaaugugcgauccgaagcgcucuuguagcgugauugaagacgaugggcuccccuccgcuuucaccacagcccacgagcugggacauguuuucaacaugccucacgacaaugugaaagucugcgaagagguguuuggcaagcugcgggccaaccauaugaugagccccacccugauccagauugauagagcuaauccuuggucugccuguuccgcugccaucaucaccgacuuccucgauagcgggcacggcgacugccugcuggaccagcccucuaaaccgauuagccucccugaagaucugcccggagcguccuacacacuuucucagcaaugugagcuggccuuuggcguugggagcaagccuugccccuauaugcaguacugcacgaagcucugguguaccggaaaagcuaagggccagauggugugccaaacacgccacuucccuugggccgacgggaccuccuguggagagggcaaacugugccugaagggggcuugugucgaacggcauaaccuuaauaaacacagaguggauggcagcugggccaagugggaccccuauggaccgugcucucggacauguggcgggggaguccagcucgcgcgcagacagugcaccaacccuacgcccgccaacggcgggaaauacugugagggagugcggguuaaguauagauccugcaaucuggaacccuguccuagcucugcuuccggcaagagcuuucgcgaggaacagugcgaggccuucaacggguacaaucauuccacaaaccggcugacccucgcuguggccugggucccgaaauacucuggcgugagccccagagauaagugcaaacugaucugucgcgccaauggaaccggcuauuuuuacguucuugcuccuaagguggucgacgggacacugugcucccccgauucuaccagcgugugugugcaaggaaaaugcauuaaggcgggcugugacgggaaccucggauccaagaaaagauucgauaagugcggcguuugugggggcgacaauaaaagcugcaagaaagucacaggacuguuuacgaagccuaugcacggcuauaacuucgugguggccauccccgcuggggccucuuccauugauauccggcagcgcggauacaagggccugaucggggacgauaauuaucuugcccucaaaaacagccagggaaaguaccugcugaauggccauuuugucgugucugcuguugagagagaccucguggucaaaggcucccugcuucgguauagcgggaccggaacagccguggaaucucugcaggcgagccgcccuauucucgagccccugaccguugaagugcuguccgucggcaagaugacaccgccuagagugcgguacagcuucuaccuucccaaagagccucgcgaagacaagucuucccaccccaaggauccgagagggccuagcguucuccacaacuccgugcugucucugagcaaucaagucgagcagcccgacgaucggccucccgcucgcuggguggccggauccuggggccccuguucugccagcugcggguccggacuccagaaaagagcuguggacugucggggcucugccggccagagaaccgucccugcgugcgaugcugcccaucgcccgguugagacgcaagccugcggggaacccuguccuaccugggagcugagcgcuuggucccccugcagcaagucuuguggacggggcuuucagagacgcucccuuaaaugcguggggcacggaggccggcugcucgccagagaccaguguaaccugcaucgcaagccucaggaacuggauuucugcgugcuucggcccuguuga

SEQ ID NO: 65497 - RNA, 3675 nt, Artificial Sequence
  derived and/or modified sequence opt5 from ADAMTS16__Homo_sapiens__NP_620687
augaagcccagagcccggggcuggcgcgggcuggcugcccucuggaugcugcuugcucagguggcugagcaagccccugccugcgcuaugggaccggccgcugccgcgcccggcagcccuuccguccccagaccucccccuccggccgaacggcccggguggauggagaaaggagaauacgaccugguuucugcuuaugagguggaucaccgcggcgacuacgugagccaugaaaucaugcaccaucagagacggcgcagagccgucccuguguccgagguugagucucuccaccuucggcuuaaggggagccgccaugauuuccacauggaccugagaaccuccucuagccucguggcucccggauuuauuguccagacacugggcaaaacgggcaccaaguccgugcagacacugccucccgaagauuucuguuuuuaucaagggagccuccggucucaccgcaacuccagcguugcccugucuaccugccagggacuuuccggcaugaucagaacagaggaagcggacuacuuccugcggccgcucccuagccaucugucuuggaaacuugggcgcgccgcucagggauccagccccucccacgugcuguauaagagaucuaccgagccucaugcccccggcgcuagcgagguccucgugacaucccggaccugggaacuggcccaccagccccugcacagcucugaucucagacuggggcuuccucaaaagcagcauuuuuguggacgccggaaaaaguacaugccgcagcccccuaaagaggaccuguucauucuccccgaugaauauaaguccugccugagacacaaacgcagccuucugcggucucauagaaaugaggaacucaacguggagacgcuggucguuguggacaagaagaugaugcagaaucacggccaugagaacaucaccacauacgugcugaccauucucaauauggucagcgcccuguuuaaagauggcacaaucgggggaaacaucaauauugcuaucgugggccuuauucugcucgaagacgagcaaccugggcugguuaucucccaccacgcggaucauacccuuucuagcuucugucaguggcaguccggacugaugggcaaggacgggacgcgccacgaccaugccauucuccugacaggacuggauaucugcagcuggaaaaacgaacccugugacacccucggcuuugcuccgauuucuggcaugugcuccaaguaccggagcuguacaaucaaugaggauaccgggcugggacuugccuucaccaucgcccacgaaucuggccacaacuuugggaugauucaugacggagagggcaauaugugcaaaaaguccgaggggaacaucaugagcccuacacuggcuggcagaaauggaguguucuccuggucucccuguagccgccaauaucuccacaaauuucuguccacggcccaggcgauuugccuggcugaucagccuaagcccgucaaggaauacaaauauccugagaagcugcccggcgaacucuacgacgccaacacccagugcaaauggcaauucggggagaaggccaaacuguguaugcuggauuucaagaaggacaucugcaaagcucucuggugucaucggauuggaagaaagugcgaaacaaaauuuaugccggccgcugagggcaccaucugugggcacgauauguggugccgcggaggccagugugugaaguauggggacgagggcccuaaacccacacauggacacuggucugauuggagcuccuggagccccugcucucggaccuguggcgggggaguuucccacagaagccggcugugcacgaauccuaagccgucucauggcgggaaguucugugaaggauccacacgcacccuuaaacugugcaacagccagaagugccccagagacucuguggacuuucgggccgcgcagugugccgagcacaacagcagacgcuuccggggcagacauuacaaauggaagccuuauacccaagucgaagaucaggaccucugcaaacuguacuguaucgcugagggguuugauuucuuuuucucccugagcaauaaggugaaggacggcacacccugcucugaggauucccgcaacgucuguauugacggaaucugcgaaagagugggcugugauaauguucuugggagcgacgccguggaggaugucugcggaguguguaacggcaauaacuccgcuugcaccauucaccgggggcucuacacaaaacaucaccacacgaaucaguauuaccauaugguuaccaucccuucuggagcccgcagcauuagaaucuaugaaaugaacguguccacaucuuacaucagcguccggaaugcgcugcgcagauauuaccugaacggccacuggaccguggacuggcccgggcgguauaaguuuuccggcacaaccuucgauuaccgcagaucuuacaaugagccugaaaaccucauugccacgggacccaccaaugagacacugaucguggagcuucuguuucagggccggaacccggggguugcuugggaauauagcaugccucgccucggaaccgagaaacaacccccugcccagcccuccuacacaugggcuauugucagaagcgaauguucuguguccugcggcgggggacagaugaccgugcgggagggcugcuauagagaccugaaguuccaggucaauaugagcuuuuguaacccgaaaacgcgcccugugacaggccugguucccugcaaggugucugccuguccucccuccuggagcgucgggaacuggucugccugcucccggaccuguggaggcggggcucaaagcagacccgugcagugcacacgccggguucauuacgauuccgaaccugugccggcgagccuuuguccccagccugcccccucuagcagacaagcgugcaauucccagucuuguccucccgccuggagcgccggaccuugggcugagugcucccacaccuguggcaaaggguggcgcaagcgggccgucgcgugcaagucuaccaacccgagcgcuagagcccagcuccugcccgacgccgugugcacauccgagccuaaaccccgcaugcacgaggcuugucugcuccagcggugccauaagccuaaaaagcugcaauggcuuguuucugccuggagccaguguuccgugacgugcgaaagaggaacccagaaacgguuccugaagugugcggaaaaguaugucagcggcaaauaccgcgagcucgcuucuaagaaaugcucccaucugcccaagccgagccuggaacuugagagagccugugccccucuccccugcccccggcacccucccuucgcugccgcuggcccuucucgcggguccugguuugccagcccguggucccaguguacagcgucuugcggaggcggggugcaaaccagaagcgugcagugucuggccggaggccggcccgcuuccgggugccugcuccaccagaaaccuagcgccucucuggcuugcaauacacauuucugucccaucgccgagaagaaggacgccuuuugcaaagauuauuuccacugguguuaccuugucccucagcacggaaugugcucccauaaguuuuacggcaaacaauguugcaagaccuguagcaaaucuaaccuguga

SEQ ID NO: 65498 - RNA, 3288 nt, Artificial Sequence
  derived and/or modified sequence opt5 from ADAMTS17__Homo_sapiens__NP_620688
augugcgacggcgcccugcugcccccucuggugcuuccgguccugcuccugcuuguuugggggcuggaucccggaaccgcugugggcgacgccgcggcugauguggaagucgugcucccuuggagaguucggcccgacgaugugcaccucccuccccugccugccgccccggggccccgcagacggcgcagaccucggacacccccugcugcuccccgcgccagaccgggagaacgggcccuccugcuucaucugccugcguucggccgcgaccucuaccugcagcuuagacgggaucugcgcuuucucagcagaggguucgaggucgaagaggccggagcugcccggcgcagaggccggcccgcugaacuguguuuuuauuccggcagagugcuggggcacccuggaucucucguuagccuguccgccugcggcgcggccgggggacuugugggccugauccaacucgggcaggagcagguccugauucagccccuuaacaauucucaaggacccuucagcggccgcgagcaucugauccggagaaaguggucccucacgccuucuccgagcgcugaagcccagcgccccgagcagcuguguaaagugcugaccgaaaagaaaaagccuacauggggccggcccuccagagacuggcgcgagcggagaaacgcuauucgccucaccagcgagcacacaguggaaacccuggucguugccgaugccgacauggugcaguaccauggggcugaggcggcccaacgguuuauccuuacagugaugaauauggucuauaacauguuccagcaccagucucugggaauuaaaaucaauauccaggugaccaagcucguucugcuuagacaacgcccugcuaagcuguccauuggccaccauggggaacggagccucgagucuuuuugccacuggcagaacgaagaguacggaggcgccagauaucuggggaauaaccaggugcccggaggcaaagaugacccgccucuggucgaugccgcuguguucguuacgcggaccgacuuuugugugcauaaggacgagcccugcgauacagucggcaucgccuaccucgggggaguguguuccgcgaaacgcaagugcguccuggcugaagacaauggccuuaaccuggccuucaccauugcccacgagcucgggcacaaucugggaaugaaccaugaugacgaucacagcucuugugcuggcagaucccauaucaugagcggggaaugggugaaaggccggaauccuuccgaccugucuuggagcuccugcagcagagaugaccuugagaacuuucucaagucuaagguuuccacaugucugcuggugaccgauccccgcagccaacacacgguccggcucccucauaaacugcccggaaugcacuauucugccaaugaacagugccagauucuuuucggcaugaacgcuacauuuugcagaaacauggagcaccugaugugugccgggcucuggugccugguggagggagacaccagcuguaagacaaaacuggauccgccucuugacggcaccgaaugcggggcggacaaguggugucgcgccggagagugcguuuccaaaacccccauccccgaacauguggauggcgacuggucuccuuggggcgcuuggagcauguguuccagaacaugcgggacgggagcccgguuccgccagagaaagugugauaauccgcccccuggccccgggggaacccacugcccuggcgcuagcgucgagcaugccgugugugaaaaccuccccugcccuaaagggcugcccucuuuccgggaccaacagugccaggcgcacgaucgccuguccccgaagaagaaaggacuccugacagccgugguugucgacgauaagccuugugagcuuuacugcagcccccugggcaaagagucuccucuccugguggcugacagagugcuggaugggacccccuguggcccguacgaaacagaccuuugcguccacggaaagugucagaaaauuggcugcgaugggaucaucggauccgccgcuaaggaggaccgguguggcgugugcagcggggauggaaagaccugucaucucguuaaaggcgacuuuucccacgcccgcgggacggcccugaaggacucuggcaaaggaagcauuaauuccgauuggaagaucgaacugccuggcgaguuccaaauugcugggacaaccgugagauauguccggcgcggacucugggagaaaaucucugcgaagggccccaccaagcugccucuucaucugauggugcuccuguuucacgaccaggauuacgggauucauuaugaauacacaguucccgugaacagaaccgccgagaaucagagcgaacccgagaaaccucaggacucccuguucaucuggacacacagcggaugggaaggcugcucuguccaauguggcgggggagagcggagaacgaucguguccugcacccgcauuguuaacaagacaaccacacuugugaaugauagcgacugcccgcaggcuucucggcccgagccucaggucagacgcuguaaccuccaccccugccagucccgguggguggccggcccuuggagccccuguucugcuaccugcgaaaaaggguuucaacauagagaggugacgugugucuaucagcugcagaauggaacccacguugccacacgcccucuguacugcccgggcccccggccugccgcggugcaaagcugugaagggcaggauugccucuccaucugggaggcuagcgaauggucucaguguuccgccagcugcggaaagggcguguggaaaagaaccgucgccuguacaaacucccagggcaagugcgacgcuucuacccgcccccgggccgaggaggcgugcgaagauuauagcggguguuacgaguggaagacgggagacugguccacaugcucuagcaccuguggcaaagggcugcaauccagagugguucagugcaugcauaaggugacaggacggcacggcucugaauguccugcucuuagcaaacccgccccguaccgccagugcuaucaggaggucuguaaugauagaauuaacgccaauaccaucaccuccccucggcuggcugcccucacauacaagugcacgcgcgaccaauggaccguguauuguagaguuauucgggagaaaaaccugugccaggauaugagaugguaccagcgcuguugccagacaugccgggacuucuaugcuaauaagaugagacaacccccucccaacagcuga

SEQ ID NO: 65499 - RNA, 3666 nt, Artificial Sequence
  derived and/or modified sequence opt5 from ADAMTS18__Homo_sapiens__NP_955387
auggagugcgcccugcuccuggcuugugccuuccccgcggcuggcagcgggccuccgagaggacuugccggccuggggcggguggccaaggcucuccagcugugcugucuuugcugugccuccgucgcugccgcgcuggccucugauagcuccucuggagcuagcggccucaacgaugacuacguuuuugugacccccguggaagucgauuccgccgggucuuauaucagccacgacauucugcauaauggacgcaaaaagagauccgcucaaaacgcccggagcucucugcacuaccgcuucuccgcguuuggccaggagcuccaucuggaacuuaaaccuagcgccauccugucuucccacuucauugugcagguucucggcaaggauggggcuagcgagacacagaaacccgaagugcaacagugcuuuuaucagggauucaucagaaaugacucuuccagcuccgucgccgugucuacgugugcuggccugagcgggcuuauucggacccgcaagaacgaguuucugaucuccccucucccccagcugcuggcccaagagcauaauuacagcucuccugccggacaccacccgcauguucucuauaagagaacagcugaagagaaaauccagcgguaccgcggcuaucccggguccggaagaaacuacccuggcuacagccccucucacauuccucaugcgagccagucccgggaaaccgaguaucaccaccgcagacugcagaagcaacauuucugcggccggcgcaaaaaguacgcccccaaaccgccuacagaggauaccuaucuuagauuugacgaauacgggucuagcggacggcccagacgcuccgcuggcaagagccagaaggggcugaauguggagacacucgucguggccgauaaaaagaugguggaaaaacacggaaagggcaacgucaccacguauauccugaccguuaugaauauggugucugggcuuuucaaagacggaacaauuggcuccgauaucaacguggucgugguuagccugauucuccuggagcaggaaccuggcgggcugcucaucaaucaucacgccgaccaaucucugaacuccuuuugucaguggcagagcgcucuuauuggaaagaauggcaaacggcaugaucacgccauccugcucaccggguucgacaucugcuccuggaagaacgagcccugugacacacugggauuugcgcccauuucuggcaugugcagcaaguacagauccugcaccaucaaugaggauacggggcuuggccuggcuuucacaauugcccacgaaucuggacauaacuucggcaugauccacgacggggagggaaacccuugucgcaaagccgaaggcaauauuaugagcccgacccucacagggaacaauggaguguuuuccuggagcucuugcucccggcaguaucugaagaaauuccugagcacaccccaagcuggcugucucgucgaugagccuaagcaggccgggcaguacaaauaccccgacaagcugccuggccagaucuaugaugcugacacccaaugcaaguggcaguuuggagccaaagcgaagcuguguucucugggcuucgugaaagauaucugcaagucccucuggugucauagaguugggcaccgcugcgaaaccaaauuuaugcccgccgcugagggaacgguguguggccugagcauguggugccggcaggggcagugugucaaguucggagagcugggcccgagaccuauucacgggcaauggucugccuggagcaagugguccgaaugcagcagaaccugcggcggaggcgugaaauuucaggagcggcauuguaacaaucccaagccucaguacgggggacuuuucugccccggaucuuccagaaucuaucagcucuguaacauuaauccuugcaacgaaaauagccuggacuuucgcgcucaacagugugccgaguacaacuccaaacccuuccgggggugguuuuaucaguggaagccguacacaaaagucgaagaggaggauagaugcaagcuguauuguaaggcggaaaauuucgaguuuuucuucgccaugucuggaaaagugaaggacggcaccccuugcagccccaacaaaaaugauguuuguaucgacggggugugcgaacucgucggcugugaccacgagcugggauccaaggcugugucugaugccugcggcguuugcaaaggggacaacagcacauguaaguuuuacaaaggacuuuaccugaaucaacauaaggcuaacgaguauuaccccgugguccucauuccugccggcgcccgguccaucgaaauccaggagcuucaggugucuagcuccuaucuggcugugcgcagccuuucucagaaguacuaucucaccgggggaugguccauugauuggccgggcgaguuccccuuugcgggcacgacauucgaauaccaacgcagcuuuaaccggccugaaagacuguaugcccccgggccuaccaaugagacccugguuuucgagauccucaugcagggcaaaaaccccggcauugcuuggaaguacgcccugccuaaagucaugaaugggacacccccggccaccaagcgcccugcuuacacauggucuaucgugcaguccgaaugcagcgugucuuguggaggcggguauauuaacgucaaagccaucugccuucgggaccagaauacgcaagugaacuccagcuuuuguuccgcgaagaccaagcccguuacagagccuaaaauuugcaaugcuuucagcugucccgccuacuggaugccgggagaauggucuaccugcagcaaggccugugcuggcggccagcaguccagaaaaauccagugcgugcaaaagaaaccuuuucagaaggaggaagccguccugcacucucucugucccgugagcacaccuacccagguucaagcgugcaacucccaugcuugcccuccccaguggucucuggggcccuggagccaguguuccaagacgugcggacgcggcgugagaaaacgggagcugcuuuguaaggggucugccgccgagacccucccggaaagccagugcacaucccugccccgcccugagcugcaagaaggauguguccucggcagaugccccaaaaauagccggcugcaguggguggcuucuuccuggagcgaguguucugcuaccugcgggcuuggaguucgcaagagagaaaugaaauguuccgagaagggcuuccagggcaagcugaucacauuuccugagcggcgcugcagaaacauuaaaaagcccaaucucgaucuggaagagaccuguaaccggcgcgccugcccugcccacccgguguauaauauggucgcggggugguacagccugcccuggcagcaaugcacggugacauguggaggcggggugcagaccagauccguccacugcguucagcagggacggccuucuagcuccugucuucuccaucaaaaacccccugugcugagagccugcaacacaaauuucugucccgcuccggaaaagcgcgaggacccuagcugcguggacuuuuucaacuggugucaccuggucccccagcauggcgugugcaaccacaaauucuaugggaagcaguguugcaaaucuuguacccggaagaucuga

SEQ ID NO: 65500 - RNA, 3624 nt, Artificial Sequence
  derived and/or modified sequence opt5 from ADAMTS19__Homo_sapiens__NP_598377
augagacugacccacaucugcuguugcugucuccuguaccagcuuggcuuccugagcaacgggauuguguccgagcuccaauuugcccccgaccgggaagagugggaagucguuuucccugcucuguggcgcagagagccgguggaucccgccggaggcucugggggaagcgcggacccuggcugggugcgcggggucggaggcggcggguccgcucgggcccaggccgcuggaucuagcagagaagugcgguccguugcccccgugccucuugaggagcccgucgaaggccgcucugagagcagacugcggccuccgcccccuuccgaaggggaggaggaugaggaacucgaaagccaggagcugccccgcggaucuuccggcgcugccgcgcugagcccuggggcccccgcuucuuggcagccgccucccccuccccaacccccuccgagcccuccucccgcccagcaugcugaacccgacggagaugaggugcuccugagaauccccgccuuuucccgggaccuuuaucugcuccugcgcagagauggccgguuccuugcgccgcgcuuugccguugagcagagaccuaaucccggcccugggcccacaggagcugccucugcuccucagcccccggccccucccgacgccggcugcuucuacacgggggcugugcugcggcaccccggaucccucgcgagcuuuuccaccuguggcgggggacugaugggcuucauucaacugaacgaagauuuuaucuucauugagccucucaaugacacaauggccaucaccggccauccgcacagagucuaucgccagaagcggucuauggaagagaaagugacagaaaagagcgcucugcauucccacuacugcgggaucauuagcgauaaaggaagaccccgcucucggaagaucgccgaguccggcagagggaaacgcuauagcuacaaacuuccucaggaguauaacauugaaaccguggucguugccgaccccgcuauggugucuuaccacggagccgaugcggcucggagauuuauccugacaauucucaauaugguguucaaccuguuucagcauaagagccuuuccguccaagugaaucugcgcguuaucaagcucauucugcugcacgagaccccucccgaacucuacaucggccaucacggggagaagaugcuggaaucuuucuguaaauggcagcacgaggaguucggcaagaaaaacgacauccaucuugaaaugagcacgaauuggggagaggacaugaccuccguggaugccgccauucugaucacacggaaggacuuuugcguccacaaggaugaaccuugugacaccgugggcauugcuuaucucagcgggaugugcucugagaaaagaaaguguaucauugccgaggauaacggacugaaucuugcuuucacaaucgcccaugaaaugggccacaacauggggaucaaucaugacaacgaucaccccuccugcgcggacggacugcacauuaugagcggcgaguggaucaaagggcagaaucucggcgauguuucuuggucccgcugcagcaaggaagaccuggagcgguuucugagauccaaagccucuaacugucuccugcaaaccaacccgcagagcgucaauuccgugauggugccuucuaaacuucccggaaugacguacacagcugaugaacagugccagauucuguucggcccucucgccagcuuuugucaagagaugcagcaugucaucugcaccgggcugugguguaagguggagggagaaaaggagugccggacaaagcuggaucccccgauggacggcaccgacugugaccuugggaaauggugcaaggcuggagaauguaccucccgcacaagcgccccugagcaccucgcgggcgaauggucucuguggucccccugcagcagaacguguucugccgggauuuccagccgggagagaaaaugcccuggccuggauucugaggcucgcgacugcaacggaccccggaagcaguauagaaucugugaaaaucccccuugcccggccggccuccccggguuccgcgauuggcagugucaggcuuacagcguuagaaccuccagcccuaaacauauccugcaauggcaggccgugcuugacgaggaaaagcccugcgcccuguuuuguucuccugucggaaaggagcagcccauucuccuguccgaaaaagugauggauggcacaagcugcggguaucaaggacuggacaucugugcuaacggccggugccagaagguugggugugauggccuucucggaucccuggcgcgcgaggaccacugcggcguguguaaugggaacggaaaaucuugcaagauuaucaaaggcgauuucaaucacaccagaggggccggauacgucgaggugcuggugauuccugcuggcgcccggcgcaucaagguugucgaagagaagccggcccauagcuaucucgcucugagagacgccggcaaacaguccauuaacucugauuggaagaucgaacacagcggggcguuuaaucuugcuggaacaaccgugcauuacgugcggcgcggccugugggagaaaaucuccgccaaggggcccacgacagccccucuccaucugcugguccuucucuuccaggaccaaaacuacggacugcacuaugaguacaccauucccucugacccucugcccgaaaaucagagcuccaaagcuccggagccucucuuuauguggacccacacaagcugggaagauugcgacgccaccuguggcgggggagagagaaagacaacggugucuugcaccaagaucauguccaaaaacauuagcaucguugauaaugaaaaguguaaauaucugacaaagcccgagccccagauucggaaaugcaacgagcaaccuugucagacccgcuggaugaugacagaauggacccccugcucuagaacguguggcaagggcaugcaguccagacagguggcgugcacccaacagcuuagcaaugggacacugauccgggcucgcgagcgggacuguaucggaccuaaaccggccucugcccagagaugcgaaggccaggauuguaugaccgucugggaggcuggggugugguccgaaugcagcguuaagugcggaaagggcauucgccaccggacagugagauguaccaacccccgcaaaaagugcguccucuccacgcggccuagagaggccgaggacugugaagauuacagcaaaugcuauguguggcgcaugggggacuggucuaaguguagcaucacaugcggaaaaggcaugcaaucccggguuauucaguguaugcauaagaucaccggcagacacgggaacgagugcuucucuagcgaaaagcccgcugccuaccggccuugucaucugcagcccugcaaugagaaaauuaacgugaauacaaucaccuccccgcgccuggcggcccuuaccuuuaagugucucggagaucaguggccugucuauugcagagugauccgggagaaaaaccugugccaagacaugcgcugguaccagagauguugcgaaacaugucgggauuucuacgcucagaagcugcaacagaaaucuuga

SEQ ID NO: 65501 - RNA, 2904 nt, Artificial Sequence
  derived and/or modified sequence opt5 from ADAMTS1__Homo_sapiens__NP_008919
augcagagagccgugcccgagggcuucgggcggcgcaagcugggaagcgacaugggcaacgcugaaagagccccugggucccggucuuuuggaccgguccccacccuccugcuucuggcggcugcccuccuggccguuagcgaugcucuuggccgcccuuccgaggaagacgaggaacugguggugcccgagcucgagagagccccugggcacggaacaacgcggcugcgccugcaugcuuucgaucaacagcucgaccuggaacuuagacccgauucuagcuuucuggccccuggcuucacccuccagaaugucggccggaaauccgggucugagacaccgcugcccgaaaccgaccuugcgcacugcuuuuacagcggaacagugaacggcgauccuuccagcgccgcugcccugucucucugugaggggguucgcggagcuuucuaucugcugggcgaggccuacuuuauccagccccucccugcggccuccgaaagacuggcuaccgccgcucccggggagaagccgccugcuccccuucaauuccaucugcuccggcgcaauagacagggagacgugggcggcacaugcggggucguggaugacgaaccucggcccaccggaaaagccgagacggaagaugaggacgagggcaccgaaggggaggaugaaggagcccaguggagcccccaggacccugcgcugcaaggcguugggcagccgacaggaaccggcucuauucgcaagaaaagauuuguguccagccaccgguaugucgagacaaugcuuguggccgaccagucuauggcugaguuccauggcuccgggcugaagcacuaccuccugacccuguuuagcguggccgccagacucuauaagcaccccuccauccgcaacucugucagccugguuguggugaaaauucuugucauccaugaugagcagaagggaccugaggugacguccaaugcugcccugacacuccggaacuucuguaauuggcaaaaacagcacaaucccccuagcgacagagaugcggaacauuacgacaccgcuauucuguuuacacgccaggaucuuugcggcucucaaaccugugacacccuggggauggccgauguuggaacagugugcgaccccucccggagcuguucugucaucgaggaugacggccuccaggccgcuuucacgaccgcccacgaacuggggcacguguucaacaugccgcaugaugacgcuaagcagugcgccagccugaacggcguuaaucaggacucccacaugauggcgucuaugcucagcaaccuggaucauucccaaccuuggagccccuguucugccuauaugaucacauccuuucuugacaauggacacggcgagugccugauggauaaaccucagaaccccauucagcucccuggggaccugcccggaaccagcuacgaugcuaauagacagugucaauucacauuuggcgaagacucuaagcauugcccggaugccgcuuccacgugcagcacccugugguguacagggaccuccggaggcgugcuugucugccagaccaagcacuucccuugggccgacgggacaucuuguggcgagggaaaauggugcaucaacggcaagugugugaacaaaaccgaucgcaagcacuuugacacacccuuccaugggagcuggggaauguggggccccuggggagauugcucccggacgugugggggcgggguccaguacaccaugagagagugcgacaauccugugccgaaaaacggcggaaaguauugugaaggcaaacgcguucgguacagaucuugcaaucucgaggauugucccgacaacaaugggaagacauuucgcgaagaacagugcgaggcgcacaacgaguucagcaaggccuccuuuggaagcggcccugcuguggaauggauucccaaauaugccggggucucuccuaaggaccggugcaaacugaucugucaagcuaagggaauuggcuacuucuuugugcugcagcccaaaguuguggaugggaccccuugcucccccgacagcacaucugucugugugcagggccagugcgugaaggccggaugugauagaaucauugacuccaagaaaaaguucgauaaaugcggcguuugugggggaaauggcucuaccugcaagaaaaucagcgggagcgucacguccgccaagccgggauaucaugacaucauuaccaucccuacaggcgcuaccaacauugaagugaagcaacggaaucagcgcggcagcagaaacaaugggucuuuucucgcgaucaaagccgcugauggaacauacauucugaacggcgacuauacccuuuccacgcuggagcaggauaucauguacaagggggugguccuccgguacagcggauccucugccgcccuggaaagaauccgcagcuucuccccucugaaagagccccuuacaauucaagugcucaccguuggcaaugcucugcggcccaagaucaaauauacauacuucgugaagaagaaaaaggagucuuuuaacgccauuccgaccuucagcgcgugggucaucgaagaguggggagaauguuccaaaucuugcgagcugggguggcagagacgccucguggaauguagagacauuaauggccagccugcuagcgagugcgccaaggagguuaaacccgccuccacccggccuugcgcugaucaccccuguccccaguggcaacugggcgaauggagcucuugcuccaagacaugugggaaaggauauaagaagcgcagccuuaaaugccugucucacgacggcggggugcucucccaugagagcugugauccucugaagaaaccgaagcacuuuaucgacuucugcacgauggccgaauguucuuga

SEQ ID NO: 65502 - RNA, 5733 nt, Artificial Sequence
  derived and/or modified sequence opt5 from ADAMTS20__Homo_sapiens__NP_079279
auguggguggccaaguggcugaccggccuccuguaccaccuuagccuguucaucacaagauccugggaggucgacuuucauccccggcaagaagcucucguucgcacgcugaccucuuaugagguggugaucccugaaagagucaacgaguucggggaaguguuuccgcaaagccaccauuucucccggcagaaacgcucuagcgaggcccuugagcccaugccuuuuagaacacacuaccgguucaccgcguauggacagcuguuucagcucaaucugacagcugaugccuccuuccuggccgcuggcuacaccgaaguucaucucgggacacccgagcgcggagccugggaaucugacgcuggcccuagcgaucugagacacugcuuuuaucgggggcaagugaacucccaggaggacuacaaggccgucgugagccuuuguggaggccugaccggcacguucaaagggcagaauggagaguauuuucucgaacccaucaugaaggcggauggcaacgaguacgaagacgggcacaauaaaccucaucugauuuaccgccaggaucuuaacaauucuuuccugcaaacccucaaguauugcuccguuagcgagucucagaucaaggaaacaucccugccguuucacaccuacagcaacaugaaugaggaccugaacgugaugaaagagagaguccucggacauacaucuaagaaugugccccugaaagaugaacggcgccacuccagaaagaaacggcuuauuagcuauccucgcuacaucgagaucauggugaccgccgacgcuaaggucguuuccgcccacggcucuaaccugcagaauuauauucucacgcugaugagcaucguggcuacaauuuacaaggaucccuccaucgggaaccuuauucauaucguggucgugaaacugguuaugauucacagagaagaggaaggaccugugaucaauuucgacggcgccaccacacucaagaacuucuguagcuggcagcaaacccagaacgaucuggacgacguccaucccucucaccaugauaccgcggugcugaucacacgggaggacauuugcuccagcaaagagaaguguaauaugcucggccugucuuaucuugggacgaucugcgauccgcugcagagcuguuuuauuaacgaagagaaaggacucaucuccgccuucaccauugcucacgaacugggccacacacuugggguucaacaugacgauaauccuagaugcaaggagaugaaagugaccaaguaccacgucauggcccccgcucugucuuuucauaugagcccuugguccuggagcaacuguucucgcaaguacgugacagaguuccucgacaccggauauggcgagugccugcuggauaaacccgacgaggaaaucuacaaucuccccuccgagcugccugggagccgguaugauggaaacaagcagugugaacuugccuuuggcccgggcucucagaugugcccccacaucaauauuugcaugcaccugugguguacguccacagagaaacuccauaaggggugcuucacccagcacgucccucccgccgacggaaccgauuguggcccugggaugcauugcagacacggacugugugugaacaaagagacagaaacccgccccguuaauggcgagugggggccgugggaaccuuacagcuccugcucucggacauguggcggaggcaucgagagcgcuacgagacgcugcaaccggcccgaaccuagaaaugggggaaacuauugugugggccgccggaugaaguuuagauccugcaauaccgacucuugucccaaggggacacaagacuuccgcgagaaacagugcagcgauuuuaacggaaagcaucuggacauuuccggcaucccuagcaauguccgguggcuucccagauacucugggauuggcaccaaagaucggugcaagcucuauugucagguggcgggaacaaacuacuucuaccugcugaaagacaugguugaggauggcaccccgugcgggacggaaacccacgacaucugugugcagggacaaugcauggccgcuggcugugaucacguccucaacuccagcgccaagaucgacaagugcgggguguguggaggcgauaauucuuccugcaaaacaauuaccgggguguuuaacagcucucauuauggcuacaauguugucgugaagaucccugccggagcuacaaacguggacauucgccaguauagcuacuccggccagcccgaugacagcuaucuggcccuuucugaugcggaggggaauuuccuguuuaacggaaauuuccuccuguccaccagcaaaaaggaaaucaacguccagggcacgagaacagugauugaguacuccgggucuaauaacgcuguugaacggaucaauagcaccaacagacaagagaaagagcugauucuucaggugcucugugucggaaaucuguauaaccccgacgugcacuacuccuucaauaucccucuggaagaacgcucugacauguuuacaugggauccguacggccccugggaagggugcaccaagaugugucagggccuccagcggagaaacauuaccugcauucauaagagcgaccacuccguugugucugauaaagagugcgaccaucugccucuucccagcuucgucacacaauccuguaacacggauugcgaacugcgcuggcacgugaucggaaagagcgaguguucuucccagugcggccagggguauagaacccucgacauucacuguaugaaauacagcauccaugagggacaaacaguucagguggaugaccacuauugcggcgaucagcugaagccucccacccaggaacugugucaugggaauugcgucuuuacacgguggcacuacucugaguggucccaauguagccgcucuugcggaggcggcgaaagaucccgggagagcuauuguaugaacaauuucgggcaccgccuugccgacaacgagugccaggaacucuccagagugacccgggagaauugcaacgaauuuagcuguccuucuugggccgcuagcgagugguccgaaugccuggugacguguggaaaaggcacaaagcagcgccaggucuggugccaacugaauguugaucaucucucugacggguucuguaacagcuccaccaaacccgagucucugagcccgugcgagcuucacaccugugccuccuggcaagugggaccuuggggccccugcacaaccacaugugggcauggauaccagaugagagaugugaagugcgucaaugaacuggcuucugccgugcucgaggacacggaaugucacgaggcgagccggccuuccgaccgccagagcugcguucugacccccugcucuuuuauuuccaagcuggaaacagcccuucucccgaccgugcugaucaaaaagauggcucaguggagacauggcagcuggacaccuuguucugucuccugcggccgggggacccaggccagauaugugagcugucgcgaugcucuggaccggaucgccgaugaguccuacugcgcgcaccuccccagaccugccgagauuugggacuguuucacgcccugcggagaauggcaggcuggcgauuggucucccuguagcgccuccugcgggcacggaaaaaccacacgccaaguucuguguaugaacuaccaucagccuaucgacgagaauuauugcgauccggaagugcggccccuuauggagcaggaauguagccuggcugccugcccucccgcccacucucauuuuccuuccagccccguccagccuucuuacuaucucagcaccaaccugccgcugacacaaaaacuugaggacaaugagaaccaggugguucaccccuccgugagaggcaaucaguggcgcaccgggccuuggggaucuugcagcuccucuuguagcggcggccugcagcaccgggcugucgugugccaagaugaaaacgggcaguccgcgagcuacugugacgccgcuucuaaacccccugagcuccagcagugcggacccggcccguguccucaauggaacuaugggaauuggggagaaugcucccagacauguggcgggggaauuaagagcagacuggugaucugccaguuccccaacggccagauucucgaggaucauaauugugagaucgucaacaagcccccuuccguuauccaaugccacaugcaugccugucccgccgacgugucuuggcaccaggaaccuuggaccagcugcuccgcuucuuguggcaaagggcgcaaguaccgggagguguuuugcauugaccaguuccaaagaaaacuggaagauacgaauugcagccagguccagaagccgcccacacauaaagccugucgguccgugcgcugcccuagcuggaaggcgaacucuuggaaugaguguuccguuaccugcggaagcggcgugcagcaaagagacgucuauugucggcuuaagggggugggacagguuguggaagagaugugcgaucagucuacccgccccuguucccagagacggugcuggagccaagacuguguccagcacaaaggcauggagagagggcgccugaacugcucuacaagcugugaacggaaggauucccaccagagaauggagugcaccgacaaucagauccgccaagugaacgaaauugucuacaauucuagcacgaucucccucacaagcaaaaacugccggaauccucccuguaacuacauugugguuaccgcugauuccucucagugcgccaauaacuguggauuuagcuauagacagcgcaucacauacugcaccgagaucccguccacaaagaaacauaagcugcaccggcugagaccuauuguguaucaagaaugucccgucgugccuucuagccagguuuaccagugcaucaauuccugucuucaucuggccaccuggaaggugggcaaauggucuaagugcagcgucacguguggcauugggaucaugaaacgccaggugaagugcauuaccaaacacggacucuccagcgaccugugucucaaccaccugaagcccggcgcucagaagaagugcuaugccaacgauugcaagucuuucacaaccuguaaagagauccaggugaagaaucauauuagaaaagacggggauuacuaucuuaacaucaagggacggaucauuaaaaucuacugcgcggacauguaccuggagaauccuaaggaauaucucacacugguucagggcgaggaaaacuucuccgaggucuacggguuucgccugaagaaucccuaucaguguccguucaacggaagcagacgggaagauugcgagugugacaauggccaccuugcugccggcuacaccguguuuucuaaaauucgcaucgaccugacguccaugcaaauuaagacaaccgaucuccuguucagcaaaacaaucuuugggaacgccgugccuuucgcuaccgccggagacugcuauucugcuuuuagauguccccagggccaguucuccaucaaucucagcgggaccggaaugaagauuuccagcacagccaaauggcugacgcagggcucuuacaccagcgucuccauccggagaucugaggaugggacacgcuuuuucggaaagugcggcggcuauugugggaagugccuuccccauaugaccacaggacugccuauucaagugaucuga

SEQ ID NO: 65503 - RNA, 3636 nt, Artificial Sequence
  derived and/or modified sequence opt5 from ADAMTS2__Homo_sapiens__NP_055059
auggacccucccgccggcgcugccagacggcugcucugcccggcgcugcuucugcuccugcuucugcugcccccuccccugcugccucccccuccgcccccugcuaacgcccgccucgccgcugccgcugaucccccugggggaccccugggccacggggccgagagaauccuugcggugccgguccggaccgacgcccagggacgccugguuagccaugugguguccgcugccacaucuagagcuggcguccgggcccgcagagcggccccugugcggacgcccagcuucccugggggaaaugaagaggaacccggcucccaccucuuuuacaacguuaccguguucggccgcgaucugcaucuuagacugcggcccaaugcucgccucgucgccccuggggcuacaauggaguggcaaggagaaaagggcaccacaagaguggagccgcugcuggggucuugucucuauguuggagacguggccggccuggccgaggcuagcuccgucgcgcuuucuaacugcgaugggcuggccggacucauucggauggaagaggaagaguuuuucaucgagccccuggaaaaaggccuugcugcccaggaggccgaacagggccgcgugcacguggucuacagacggccucccaccagcccuccccucgggggaccgcaggcucucgacacaggcgccucccuggauagccuggacucucucuccagagcgcuggggguucuugaggaacaugcuaauagcucucgccggagagcccgccggcacgccgcugaugacgauuauaacauugaggugcugcucggaguggacgauuccgucgugcaauuucacggcaaggagcauguucagaaauaccugcuuacccugaugaauaucgugaacgaaauuuaucacgacgagagccucggggcccauaucaaugucgugcugguuagaaucauucugcucucuuacggaaaguccaugagccugaucgaaauuggcaacccuucccagucucuugagaaugugugucgcugggcuuaucugcagcaaaaacccgacacgggccacgaugaauaccacgaccaugccaucuuccucacccggcaggauuuugggccuagcggaaugcagggcuacgcgcccgucacagggaugugccacccugugagauccuguacccugaaccaugaggacggauucagcucugccuuugucguggcucacgagacaggccauguucuggggauggaacacgauggccagggaaaucgcugcggcgacgaggugcggcuuggguccauuauggcuccccucguccaagccgccuuccacagauuucauuggagccgcuguucucagcaggaacugagccgguaucugcacuccuacgauugccuccuggacgauccguucgcgcaugacuggccugcccuuccccaacugcccggacuccacuauucuaugaacgagcaguguagauuugauuucggccugggguacaugaugugcaccgcuuuccggacguuugacccuuguaagcagcuguggugcagccacccggacaaucccuauuucugcaagaccaaaaagggaccuccccuugauggcaccaugugugccccugggaaacauugcuuuaagggccacuguaucuggcucacacccgacauucugaaacgcgauggauccuggggcgcuuggagcccuuucgggucuugcuccagaaccuguggaaccggcgugaaguuucggacaagacagugcgacaacccccauccggccaacgggggacgcacguguagcggccuggccuacgauuuccaacucugcucucggcaggacuguccugauucccuggcugacuuuagagaggaacagugccgccagugggaucuuuauuucgagcacggggacgcgcaacaucacuggcugccccacgaacauagagaugccaaggagcggugucaccucuacugcgaaagccgcgagaccggcgagguuguguccaugaaaagaaugguccaugacggaacacggugcucuuacaaggaugcuuuuagccugugugugcgcggcgacugcagaaaaguggggugugacggaguuaucggcuccucuaagcaggaagauaaaugcggggucuguggaggcgacaauagccacugcaagguggugaaagggaccuucacacgguccccuaagaagcauggcuauaucaaaauguuugagauucccgccggagcccgccaucugcuuauccaggaagucgaugcuaccagccaccaccucgccgugaagaaccuggagacgggcaaauucauucugaaugaagagaacgacguugaugcgucuuccaagacauuuaucgcuauggggguggagugggaauacagagacgaggauggacgggaaacccuccagaccaugggcccgcugcacgggacaauuaccguccuugugaucccuguuggagacacacgcgugagccugacguauaaauacaugauccaugaggauucucucaaugucgacgauaacaaugugcuggaagaggacuccguuguguaugagugggcccugaagaaguggagccccuguucuaaaccuugcggcggcgggagccaauucaccaaguacggauguagacggagacuugaucacaaaaugguccaccgcggcuucugcgccgcucucuccaagcccaaagccauucggagagcguguaacccccaggaaugcagccagccugugugggugacaggggagugggaaccgugcucucagaccuguggacgcacaggcaugcaaguccgguccguuagaugcauccagccccugcaugacaauaccacgcgcagcgugcacgcuaagcauuguaacgacgcccggccugaguccagacgcgccugcucucgggaacugugucccgggagauggcgggcuggaccuuggagccagugcuccgugaccuguggcaauggcacacaagagcgccccguccucugcagaaccgccgaugacucuuuugggauuugucaggaggaacggccugagacagcucgcacaugcagacugggaccguguccccggaacaucagcgauccuuccaagaaaucuuaugugguucaguggcuuagcagacccgacccugauucccccauucgcaagaucagcucuaaaggccacugccagggggacaaguccaucuucugccggauggaagugcugagcagauacuguucuauuccgggauacaauaaacucugcuguaaguccugcaaccuguauaauaaccugacgaacgucgagggccgcaucgagccuccucccgggaagcauaaugauauugacguguuuaugcccacacuucccguuccuaccguggccauggaaguccggccgagccccucuacaccucuggaggugccccucaacgcguccagcaccaaugccaccgaagaucacccugagacaaacgcuguugacgaacccuacaaaauccacggacuggaggaugaggugcaaccgccuaaucucauucccagacgcccuucccccuaugaaaagacgcggaaccagagaauccaggagcugauugacgaaaugcgcaaaaaggagaugcuuggcaaauucuga

SEQ ID NO: 65504 - RNA, 3618 nt, Artificial Sequence
  derived and/or modified sequence opt5 from ADAMTS3__Homo_sapiens__NP_055058
auggugcugcucagccuguggcuuaucgccgcugcccuggucgagguuagaaccuccgcggacggccaggcugggaacgaagagauggugcaaauugaucuccccaucaagcgguaccgcgaauaugagcuggugacaccugucucuacgaaucuugaaggaagauaccugagccacacccucuccgccucucauaaaaagcggagcgcccgcgacguguccucuaacccggagcagcuguucuuuaauauuacagcuuucggcaaagauuuucaccugagacucaagcccaacacccagcugguugccccuggggcuguggucgaguggcaugaaacaagccuugugcccggaaauaucaccgacccuauuaacaaucaccagcccggcuccgccacauaucggauccgcagaaccgagccucugcaaacgaacugcgcguacguuggggauaucguggacauuccgggaaccagcgucgccaucucuaauugugauggccucgcuggcaugauuaaauccgacaacgaagaguauuucaucgagccccuggaacgggggaagcagauggaggaagagaagggacgcauucaugugguguacaaaagaagcgccgucgaacaggcuccuaucgauaugucuaaggacuuucacuaucgggaguccgaucuugagggccuggacgaucucgggacaguuuacggaaauauucaccagcaacugaacgaaaccaugcgcagacggcgccaugccggcgagaaugacuacaacaucgaagugcugcucgggguggacgauagcgucgugagauuccacggaaaagagcauguucagaauuaucugcuuacacugaugaacaucgugaacgaaauuuaccacgacgagucucucggcguccacaucaaugugguucuggugcggaugauuaugcuuggcuaugcgaaguccaucagccugauugagagagggaaccccucccgcucucucgaaaaugucugccggugggccagccagcagcaaagauccgaucugaaccauagcgagcaccaugaccacgcuaucuuucugacccgccaggauuucggaccugccggcaugcagggguacgcucccgugacgggaaugugucauccgguccggucuugcacacucaaucacgaagacggcuuuuccagcgccuucgugguugcccacgagaccgggcaugugcugggaauggaacacgauggccaaggcaacagauguggggacgagacagcuaugggaucugucauggcgccucuugugcaggccgcuuuucaucgcuaucacuggagccggugcuccggccaggagcugaaaagauacauccacucuuaugauugucuccuggacgaucccuucgaccaugacuggccuaaacuucccgaacugcccgggauuaauuacagcauggaugagcagugccgcuuugacuucggaguuggcuacaagauguguaccgccuuccggaccuuugauccuugcaaacaacucugguguucccacccggacaaccccuauuucugcaagacaaagaaggggccuccccuggauggcacggaaugcgccgcuggaaaaugguguuacaagggccauugcauguggaaaaaugccaaccagcagaagcaggacgggaauuggggaagcuggaccaaguuuggcucuuguuccagaacaugcgggaccggagugcgcuuccggacaagacaauguaacaauccuaugcccaucaacggcgggcaggauugcccgggcgucaauuuugaguaucagcuguguaacaccgaggaaugccagaaacacuucgaggacuuucgggcgcaacagugucagcagcgcaacagccauuucgaauaccaaaauacgaagcaccacuggcucccuuaugagcaucccgauccuaaaaagagaugccaccuguacugucagucuaaagaaacaggagacguggcuuauaugaagcagcuugugcaugauggcacccacugcuccuacaaggaccccuacagcauuugcguuagaggggagugugucaaagugggaugcgauaaggagaucggcuccaacaaaguggaagacaaguguggggucugcggaggcgacaauucucauuguagaaccgugaaagggacauuuacccgcacaccucggaagcugggcuaucucaagauguucgauauucccccgggagccagacacguucugauccaagaggacgaagccagcccucacauccuggcuauuaaaaaccaggccacgggccauuacauccuuaaugggaagggagaggaagcuaaaucccgcaccuuuauugaucucggcguggagugggacuauaacaucgaggaugacauugaaucucugcacacagaugggccccugcaugaccccgucaucgugcucauuaucccucaggagaaugauaccagaagcucccugacauacaaguauaucauucacgaagacagcguuccgaccaucaacucuaauaacgugauucaggaggaacuugauacguucgagugggcccugaaauccuggagccaaugcucuaagcccuguggaggcggguuucaguacaccaaguauggcugccggcgcaaauccgacaauaagaugguccaccggagcuucugugaggcgaacaaaaagccuaaacccauccggcgcaugugcaauauucaggaauguacacauccucucuggguggccgaggaaugggagcacugcaccaagacaugcggaucuagcggcuaccagcugagaaccguucggugucugcaaccccuucucgaugggacgaaccgcuccgugcauagcaaauacugcaugggagacagaccugagucucggcgccccuguaauagagucccgugcccugcucaguggaagacaggccccugguccgaauguagcgugaccugcggggagggaacagaagugcggcagguccuguguagagccggcgaccacugcgauggcgagaagccugaauccguucgcgcuugucagcugcccccgugcaacgacgagccuugucucggggauaaaucuaucuucugccaaauggaggugcuggcccgguauugcagcauccccggauacaacaaacuuuguugcgaauccuguucuaagagaagcuccacccugccuccucccuaucuccuggaggcggccgaaacccaugacgaugugauuucuaaucccagcgaccugccgcgcucccuugucaugcccacaagccucgugccuuaccacucugagacgcccgcuaagaaaaugucccugagcucuaucuccagcguuggcgggccuaacgccuaugcugccuuucggcccaauucuaagccugauggagccaaccugagacagcgcuccgcucagcaagcgggcagcaagaccgugcggcucgucacagugccguccucucccccuaccaaaagaguucaccugagcagcgccucccagauggcugccgccucuuucuuugcugccagcgacuccauuggggcgucuagccaggcucgcacauccaagaaagauggaaagaucauugacaaucggagacccacccggucuagcacgcuugaacgcuga

SEQ ID NO: 65505 - RNA, 2514 nt, Artificial Sequence
  derived and/or modified sequence opt5 from ADAMTS4__Homo_sapiens__NP_005090
augagccagaccggcucccaccccgggagaggacuggccggccgguggcucuggggagcucaaccuugccugcuucugccgaucgugccccucucuuggcuggucuggcuucugcuccugcugcucgccagccugcuuccuuccgcgcgccuggcuucuccccucccuagagaggaagagauuguuuuccccgaaaagcugaacgggagcgugcuuccuggcuccggggccccggcccggcugcucugucgccugcaggcuuuuggagagacacugcuccuggaacuugagcaggacucuggcgugcaggucgagggccugacggugcaauaccucgggcaggcccccgaacugcuuggaggcgcugagccugggaccuaucugacaggaaccaucaauggcgaucccgaaagcguugccucccuccauugggacgggggagcgcugcugggcgugcuccaguacagaggcgccgagcugcaccuucagccucuggaagggggaacacccaacagcgcuggcgggccgggagcccauauucuccggcgcaaaucuccugcuuccggccaagggcccaugugcaaugucaaggccccucugggaagccccucucccagaccucggcgcgcgaaaagauucgccucccuuagccgguuuguggaaacccugguuguggcugaugacaagauggccgcuuuccacggcgccggccucaaacgcuaucugcugacagucauggccgcugcggccaaggcuuuuaagcauccgucuaucagaaaccccgugucccucguggucacccggcugguuauucuugggagcggagaggaaggcccucagguggggcccuccgccgcccagacgcugcgcucuuucugugcuuggcagagaggacucaauaccccugaggauagcgaccccgaucacuuugacacagccauccuguucacccggcaagaucugugcggcguguccacaugugacacccuugggauggcggaugucggcacggugugcgacccggcuagaagcugugccaucguugaagaugacggacuccagucugccuuuacagcugcccacgagcugggccauguguucaacaugcugcacgacaauuccaaaccuugcauuagccucaacgggccccugucuaccagccgccaugucauggcuccugugauggcccacguugaucccgaggaaccuuggucccccuguucugcgcgguuuaucacagacuuccuugauaauggauacggccacugccugcucgacaagccggaggccccucugcaucugcccgugaccuuucccgggaaagauuaugacgcugauagacagugucaacuuaccuucggaccugacagccgccacugcccgcagcugcccccucccugcgccgcucucugguguuccggccaucugaacgggcacgccaugugccagacaaagcauagcccuugggcggauggcacgcccuguggaccugcccaggcuugcaugggcgggcggugucuccacauggaccaacugcaggauuucaauauuccccaggccggaggcugggggccguggggaccuuggggcgacugcucuagaaccugugggggcggaguccaguuuuccagccgcgacugcacacggcccgugccuagaaacggcgggaaauacugugaaggacgccggaccagauuccgcucuugcaauacagaggauugucccaccggcuccgcucuuacguuucgggaggagcaaugcgccgccuauaaccacagaacagaccuguucaagagcuuuccggggccuauggauugggucccccgguacaccggaguggcuccucaggaccagugcaagcucaccugucaggcgcaagcccugggcuacuauuacguucuggagccccgcguggucgaugggacacccugcuccccugacucuagcuccguguguguucagggcagaugcauccaugcuggaugugaucggauuaucggcucuaaaaagaaauucgacaagugcauggugugugggggagauggcagcgggugcuccaaacagagcggaucuuuuagaaaguuccgcuauggcuacaauaacgucgugaccauuccggccggcgccacacacauccuugugcggcagcaagggaaccccggacauagauccaucuaucucgcucugaaacugccugacggcagcuacgcccucaauggggaauauacgcugaugcccucuccuaccgauguuguccuucccggagcggugucccugcgcuacagcggcgcuacagccgccucugagacccucagcgggcacggaccucuggcucagccgcugacacuucaggugcucgucgccggcaacccccaagacaccagacugcgguacuccuuuuucgugccucgccccacgccuagcacccccagaccgacaccucaggauuggcugcaccggcgcgcgcagauucucgaaauccugagacggcgccccugggcuggcagaaaguga

SEQ ID NO: 65506 - RNA, 2793 nt, Artificial Sequence
  derived and/or modified sequence opt5 from ADAMTS5__Homo_sapiens__NP_008969
augcugcucggcugggccagccugcuucugugcgcuuucagacucccccuggccgcgguggggccugcugccaccccggcccaggacaaggcuggacaacccccuacagccgcugccgcggcccagccccggcgcagacagggcgaggaaguccaggagcgggcugaaccucccgggcacccucauccgcuugcccaacgcagacgguccaaaggacugguucagaacaucgaucagcucuacucuggcgggggaaaggugggcuaucugguguacgcuggcgggcgcagauuucugcucgaccuggagcgggauggaagcgucggcauugccggguucgugcccgcgggaggcgggacguccgccccuuggcgccacagaucucauuguuuuuaucggggaaccguugacggcagcccccgcucccuugcuguguucgaucugugcggcgggcucgacggauuuuucgccgucaaacacgcuagauacacacugaagccucuucugcggggccccugggccgaagaggagaaagggcgcguguauggagauggcucugccagaauccuccauguuuacacccgggaaggguuuagcuucgaggcucugccgccuagagcguccugugaaacacccgccagcaccccugaggcucacgagcacgcccccgcccauucuaaucccuccggacgcgcugcccuggcgagccagcuccuggaccaaucugcucuuuccccugccggcggcagcgggccgcagacaugguggcggagacgccggagaucuauuucccgcgccagacagguggaacugcuccuggucgcugaugccagcauggcucggcuuuauggacgcggccugcagcacuaccuccugacccuggccuccaucgcgaaccggcucuacucucaugccagcauugagaaucacaucagacuggcuguggugaaggucguugugcuuggggacaaggauaaaucccuggaagugagcaagaacgccgcuacgacccucaaaaauuuuugcaaguggcaacaccagcauaaccagcugggagacgaucacgaggaacauuaugacgccgcgauccuuuucacacgcgaggaccuguguggccaccauucuugcgauacccucgggauggccgacgucggcacaauuuguucccccgagcggagcugcgcugugaucgaagaugacggacugcacgccgcuuuuaccguugcccacgagauuggccaucugcucgggcugucucacgaugacagcaaauucugugaagagacguuuggauccacagaagauaagagacuuaugucuagcauccugaccuccauugacgccagcaagccuuggucuaaaugcacauccgcuaccaucaccgaguuccucgaugacggccaugggaauugucugcuggaucuuccccggaagcaaauucucggaccugaggaacugcccggccagacauacgacgcgacgcagcagugcaaccugaccuucgggccggaguauagcgugugcccuggcauggacgucugugcccgccucuggugcgcugugguuagacaaggacagauggugugucugacaaagaaacuucccgccgucgaaggcaccccuugcgggaaaggacggaucugucugcagggcaagugcguggauaaaacaaagaagaaauacuauucuaccuccagccacgggaauuggggauccuggggcucuugggggcaguguagcagauccugcggcggaggcguccaauuugccuaccgccacuguaacaaucccgcuccucggaacaaugggagauauugcacgggaaagcgcgccaucuacagaucuuguagccucaugcccugcccgccuaacggcaaauccuuccggcaugagcagugcgaagcgaagaauggguaccagagcgacgcuaaaggagugaagacauuuguugagugggugcccaaguaugccggcguccugcccgccgauguguguaaacugaccugccgcgcuaaggggaccggcuacuauguuguguucucuccuaaagucacagacggaaccgaguguagacuuuacuccaacagcgugugcgugcggggcaaguguguucgcacagggugcgauggaauuaucggcucuaaacuccaguaugacaaguguggggucugcggaggcgauaacuccagcuguacgaagauugugggcaccuuuaauaaaaagucuaaaggguacacagacguggucagaaucccggaaggagccacccacauuaaggugcggcaauucaaagcgaaggaucagacacgcuuuaccgcuuaucuggcccugaagaaaaagaacggcgaguaccucaucaaugggaaauacaugaucagcacguccgaaaccauuaucgacauuaacggaacaguuaugaauuauagcggcuggucucauagagaugacuuccugcacgggaugggauacuccgccaccaaggagauccuuauugugcagauccuggcuacagaucccaccaaaccucucgacguccgguauagcuuuuucgugcccaagaaauccacgccuaagguuaacucugugacaagccauggcuccaauaaggucggcucucacaccagccagccccaaugggugacagggccuuggcuggccugcucccgcaccugugacaccggauggcacacaagaacgguucagugccaggauggcaaccggaaacuggcuaaggggugcccccuuucucaaagaccgagcgccuuuaaacagugucuccugaagaaaugcuga

SEQ ID NO: 65507 - RNA, 3354 nt, Artificial Sequence
  derived and/or modified sequence opt5 from ADAMTS6__Homo_sapiens__NP_922932
auggagauccuguggaagacccucacauggauucugagccuuaucauggccuccucugaguuccacagcgaccauagacuguccuacucuagccaggaagaauuucucacguaucuggagcacuaccaacuuaccauucccauccggguggaucagaacggcgcuuuccuguccuuuacagucaaaaaugacaagcauucucgcagacggcgcagcauggauccuauugacccgcagcaggccguuuccaaacucuucuuuaagcugagcgcguaugggaaacacuuccaucugaaccucacccugaauacagauuuugugucuaagcacuucaccguggaauacuggggaaaggacggcccccaauggaaacacgauuuucuugacaacugccauuauacaggguaccugcaggaucagagauccaccacgaaggucgcucucagcaauugugugggacugcacggcguuaucgccaccgaggacgaggaauauuucaucgagccucuuaaaaacacaaccgaagauucuaagcauuuuuccuacgagaaugggcacccccacgugauuuacaaaaagagcgcccugcagcaacggcaucucuaugaccacucucauugcggagucuccgauuucacacgcagcggcaagccuugguggcugaacgacaccuccacggugucuuacagccugcccaucaauaacacacacauucaucacagacagaaacgguccguuagcaucgagcgcuuuguggaaacccucgucguggcugacaagaugauggugggcuaucacgggagaaaagauauugagcauuacauccugucugucaugaauauuguugccaaacuuuaucgggacuccagccugggaaacguggugaauaucaucgucgcucgccucauugugcugacagaagaucagccuaaccuugagaucaaucaccaugccgacaagucucuggauagcuucuguaaguggcagaaauccauucucucucaccaaagcgacggcaacaccaucccggaaaacgggauugcgcaccaugauaaugccguucugaucaccagauacgacaucugcacauauaagaacaagcccuguggaacgcugggccucgcuuccguggccgggaugugcgagccugagcggagcuguucuauuaaugaagauaucggacugggcuccgcuuucaccauugcccacgagaucggccauaacuuugggaugaaucacgacggaauuggcaacagcugcgggacaaaaggacaugaagcggccaaacuuauggcugcccacaucaccgcuaauacaaaccccuucucuugguccgccuguagccgcgauuacaucaccuccuuucuggacucuggcagagggacgugccucgacaaugagccucccaagcgggauuuccuguacccggccgucgcuccuggacagguguaugacgcggaugaacaguguagauuucaauacggcgccacaagccgccagugcaaguauggcgagguuugccgggagcuuuggugucuguccaaaucuaacagaugcgugaccaauagcauucccgcugccgaagggacccucugucagacaggaaacaucgagaagggcuggugcuaccagggggacugugucccuuucggaaccuggccccaauccauugauggcggguggggccccuggagccuguggggagaaugcucucgcacauguggcgggggaguguccagcucucugcggcacugcgacuccccugccccgagcggcgggggaaaguauugucucggcgagagaaaacgcuaccggucuugcaauacggaucccuguccucuggggagcagagacuuucgcgaaaagcagugcgcugauuucgacaacaugcccuuucggggcaaauauuacaauuggaagccuuacaccggaggcggggucaaacccugcgcccuuaacugucuggcggagggauauaacuucuacacagagagagcuccggccgugaucgauggcacccagugcaaugccgacucccucgauauuuguaucaacggggaaugcaagcauguuggaugugacaauauucugggcagcgacgcucgcgaggaucggugcagagugugugggggcgacggaucuacaugcgaugccaucgaaggcuuuuucaacgacucccugccucgcgggggauauauggaggucgugcagaucccccggggcagcguucacauugaggugagagaagucgcuauguccaagaauuacaucgcccuuaaaucugagggggaugacuauuacauuaacggagcguggaccaucgauuggccucggaaguuugacguggccggcacggcuuuccauuauaaaagacccaccgaugaaccugagagccucgaagcccuggggcccacauccgagaaucugauugugaugguucuccugcaagagcagaaccuuggcauccgcuacaaguucaaugucccgaucacccggacaggaucuggcgacaacgaagugggguuuaccuggaaucaccagccuuggagcgaguguuccgcuacgugcgccggaggcgugcagagacaagaagucguguguaaacgccuggaugacaacucuauuguucagaauaacuacugcgaucccgacagcaagcccccugagaaucagagagcgugcaacacagaaccgugucccccugagugguucaucggggacuggcucgagugcuccaagaccugugauggaggcaugcggacacgcgccgugcugugcauuagaaaaaucggccccagcgaagaggaaacccuggacuauucugggugucuuacccaucggccugucgagaaggaacccugcaacaaucaguccuguccuccccaauggguggcucucgauuggagcgagugcacaccgaaauguggaccuggcuuuaagcaccgcauuguucugugcaaaucuuccgaccugagcaagacguuccccgccgcucaguguccugaggaaucuaaacccccggugagaauccggugcucccucgggcgcugcccucccccuagaugggucaccggagauuggggccaguguagcgcccaaugcgggcugggacagcagaugcggacagugcagugucuuuccuacaccggccaagccagcucugacugccuggagacaguucgcccucccagcaugcagcagugugaauccaagugcgauucuacccccaucagcaacacggaggaguguaaggacgugaauaaagucgcuuauugcccgcucgugcugaaguuuaaauucuguuccagagcguacuuucggcagaugugcuguaagacaugccaaggccacuga

SEQ ID NO: 65508 - RNA, 5061 nt, Artificial Sequence
  derived and/or modified sequence opt5 from ADAMTS7__Homo_sapiens__NP_055087
augcccggagggccuucccccagaucccccgccccucugcuccggccccugcuucugcuccugugcgcucuugccccuggagcccccggcccugcuccggggcgcgccaccgagggcagagccgcucuggacaucgugcaccccguccggguugaugccggcgggucuuuccucagcuacgaacuguggccucgcgcucugagaaagcgggacguguccgugcgcagagaugcccccgcguuuuaugagcuccaguaccggggacgcgaacugagauucaaccuuacagccaaucaacaucugcucgcuccuggcuuugucucugagacgcggcgcagaggcgggcugggacgggcccacauucgcgcucauacccccgccugucaccuucugggcgaagugcaggacccggagcucgaagggggacuggcggccaucagcgcuugcgauggccugaaagggguuuuccagcucuccaacgaagacuauuuuauugagccucuggauucugcccccgcuagaccuggacaugcccagccccacguggucuacaagcggcaagcccccgaaagacuugcucagcgcggcgacagcuccgcgccuagcacauguggcgugcagguuuauccggagcuggagucucggagagaacgcugggagcagcggcaacaguggagacgcccccggcucagacgccugcaccagcgguccgugagcaaagaaaagugggucgagacccuugugguggccgaugcuaaaauggucgaauaccaugggcagccucaaguugagucuuaugugcugacaaucaugaauaugguggccggacucuuccacgaccccuccauuggcaacccuauccauaucaccauugucagacuggugcugcucgaggaugaagaggaagaccugaagaucacacaccacgccgauaauacccuuaagagcuuuugcaaauggcagaagucuauuaacaugaaaggggacgcucauccccugcaccaugacacggccauccuccugacccgcaaggaucuuugugcggcuaugaaucggccgugcgagacacugggacucucccacguugccggcaugugucagccucauagaagcugcuccauuaacgaagacaccgggcugccccuggccuucacaguggcucacgagcucggacacucuuuuggcauccaacaugauggcagcgggaaugacugugagccugucggaaaacggcccuucauuauguccccucagcugcuuuacgaugccgcuccccugaccuggagccgcugcucuagacaguacaucacgcgguuucucgacagaggcugggggcugugucuggaugacccgccugccaaggauaucauugacuuccccuccgugcccccuggaguucuuuaugaugugagccaccagugccgccuccaauacggcgcguauucugccuuuugcgaagacauggacaacgucugucauacacuguggugcagcguggggaccacaugucacuccaagcuggaugcugccgucgacggcacccggugcggagagaauaaauggugucucucuggcgaaugcgugccgguuggguucagacccgaggcuguggauggaggcuggagcgggugguccgccuggagcaucuguucucgcuccugcggaaugggcguccagagcgcggaaagacaguguacccagccuacacccaaguacaaagggcgguauugcgugggcgagcgcaagagauuccggcuguguaaccuucaagccugcccugcuggacgccccucuuuuagacacguucagugcucccauuucgacgccaugcuguacaaaggccagcuccacacgugggugccugucgugaaugaugugaaccccugugagcugcauugccggccggcuaaugaauauuuugccgagaagcugcgcgacgccguugucgaugggaccccuuguuaccaggugagagcuagccgggaccuuugcauuaacggaaucuguaaaaacgugggcugcgauuucgaaauugacuccggggcgauggaggaucgcuguggagucugccacggcaaugggucuacaugucauaccgugagcggcacauuugaggaagccgagggacucggcuacguugacguggggcugauccccgcuggagccagagaaauccggauucaagaggucgccgaagcugccaacuuccuggcgcucagauccgaggauccugagaaguauuuucugaauggcggguggaccauccaguggaacggagacuaccagguggcuggcacgacauucaccuaugcccgccgggggaauugggaaaaccuuaccucucccggcccgacaaaggagccuguuuggauucagcugcucuuucaagaaagcaaucccggagugcacuacgaguauaccauccacagagaagccggcgggcaugacgaggucccuccgcccguguucuccuggcacuacggaccuuggacaaaaugcacgguuaccuguggccgcggggugcagcggcagaacgucuauugccuggagagacaagcuggaccgguggaugaggaacacugcgacccccugggccgcccugaugaccagcagcggaaguguagcgaacagcccugcccugccagauggugggcgggcgaguggcaacuuuguucuuccagcugcgggcccggaggccucucucgccgggcugugcuguguauuagauccgucgggcuggaugaacagagcgcccucgagccuccggccugcgagcaucugccccggccucccacagaaaccccuuguaaucgccauguucccugcccggcuacaugggccgugggaaacuggucucaguguagcgugaccugcggcgaggggacgcagagacggaauguccuuuguaccaacgacacaggagugccuugcgaugaagcucaacagcccgccuccgagguuaccugcagccugccccucugucgcuggccucugggcacacugggccccgaggggucuggauccggcagcuccucucacgaacuuuuuaaugaggcggacuucaucccucaccaucucgccccgagacccagcccugcuuccucucccaaaccugggaccaugggaaacgccaucgaagaggaagcucccgagcuggaucugccgggcccuguguuugucgacgauuucuacuacgacuauaauuucauuaacuuucacgaggaucucagcuacgggcccuccgaggagccugaccuggaccuugccggaacgggcgaucggacacccccuccccauucucacccggccgcuccuagcaccggcucccccgugcccgcgacagaaccuccggccgcuaaggaggaagggguucugggacccuggagcccuucucccuggccuucccaggccggcagaucucccccuccgcccuccgagcagaccccugggaacccccucaucaauuuccugccugaggaagacacccccauuggagccccggaucugggccuuccuucccugagcuggccccgcgugucuacagacgggcuccaaacgcccgcuaccccugagucccagaacgauuuucccgucggaaaagacagccagucccaacugccuccgcccuggcgggauagaacaaaugaaguguucaaggacgaugaggaaccuaagggccgcggcgcgccccaccucccuccccggccgagcucuacccugccuccccuuagcccuguuggguccacacauucuagccccuccccugacguggcggagcuguggaccggaggcacggucgcuugggagcccgcccucgaagggggacugggcccgguggauucugagcuguggccuacagugggggucgccagccuucugccgcccccuaucgcuccgcuccccgaaaugaaaguuagagacuccucucuggagccuggaacccccagcuuuccuacccccggcccuggcuccugggaccuccagacaguggccgugugggggaccuuccugcccacaacgcuuaccggacugggccacaugccggagccugcgcucaaccccgggccuaagggacagcccgaaagccugucuccggaggucccucuguccagccgccuucugucuacacccgcuugggauucccccgccaauagccaucgggugccugaaacccagccccucgccccuucccuggcugaggccggcccgcccgcugacccucucguugugagaaacgccggguggcaagcgggaaauuggucugaaugcagcacaaccuguggccugggcgccgucuggcgccccgugagaugcuccagcgggcgggaugaggacugugcuccugccggacgcccccagccugcuagacggugccaccuucgcccgugugccacguggcauucuggcaacugguccaaaugcagcagaucuugugggggaggcagcuccguucgggaugugcagugcgucgacaccagagaucugcgcccccugcggccuuuucacugucagcccgggccugccaagcccccggcucacagaccuugcggagcgcaacccugccucucuugguauacaagcuccuggcgcgaguguucugaagccugcggcggcggggagcagcagcggcuggugaccugucccgaaccuggacuuugcgaggaagcucugagacccaauacaacccggccuuguaacacacauccgugcacccagugggucgugggccccugggggcaauguagcggaccuugcggcgggggcguucagcgcagacucgugaaaugugucaauacgcagacaggacugcccgaggaggacuccgaucagugcggccacgaagccuggccugagagcucucggcccugugggaccgaagacugcgagccgguggaaccuccccgcugcgagagagaucggcucuccuucggauuuugugagacccugcgccuucugggcagaugccaacugccuacaauucggacccaguguugccgcagcuguagcccucccucucauggggcccccagcagaggacaccagcggguugcuagacgcuga

SEQ ID NO: 65509 - RNA, 2670 nt, Artificial Sequence
  derived and/or modified sequence opt5 from ADAMTS8__Homo_sapiens__NP_008968
augcugcccgccccugcugccccgagauggcccccucuccugcuucugcuccugcuucugcucccccuggcgcggggcgcuccugcccgccccgccgcugggggacaggccagcgagcugguggucccuaccagacucccgggcuccgcuggggaacuggcccuucaccugucugcguucggaaagggcuuuguucuccggcuggcccccgacgauagcuuccuugcuccugaguuuaaaaucgaacgccuugggggauccggcagagccacaggcggggagcggggacuccgcggcugcuucuuuucugggacggugaacggagaacccgagagccuggcugccgugucccuguguagaggccucucugggagcuuccugcuugacggagaggaauuuaccauucaaccucagggcgcgggcgggucccuggcccagccccaucggcuccagcgcuggggaccggcuggcgccagaccucugccccgggggccugagugggaagucgagacaggagagggccaacgccaggaaagaggggaucaccaggaggacagcgaagaggaaucucaggaggaggaagcugagggagccuccgaacccccucccccgcuuggcgccaccagccggacaaagcgcuucgugucugaggcuagauuuguugaaacccugcucguggcggaugccuccauggcugccuucuacggcgccgaccugcaaaaucauauccugacacucaugagcgucgcugcccggauuuauaaacaccccucuaucaagaacuccauuaaucugauggugguuaaagugcuuaucgucgaggaugagaagugggggccugaagugagcgacaacggaggccugacccucagaaauuuuugcaacuggcagcgccgguucaaucagcccuccgauagacauccugagcacuacgacacggcgauccugcuuacccgccagaacuuuugugggcaagaaggacugugcgauacacucggcguggcugacauugggaccaucugugaucccaauaagucuugcagcgucauugaggacgaaggccugcaggccgcccacacacuggcucaugagcucggacacguucuguccaugccgcaugacgauagcaaaccuuguacccggcuuuucggccccauggggaagcaccacgugauggccccucuguucgugcaucucaaccagacgcugcccuggucuccuugcuccgcuauguaucugacagagcuucucgacggaggccacggggauugucugcuggacgcccccgcggccgcucucccgcugccuaccggacuucccggcagaauggcccuguaccaacucgaucagcagugccgccagaucuuugggcccgacuuccggcauuguccuaauacaagcgcucaagaugucugcgcccagcuguggugccacaccgacggcgcggaaccgcugugucauaccaaaaacggaucucuucccugggccgauggcacaccuugcgggcccggacaccucuguagcgagggcuccugccugccugaagaggagguggaaagacccaagccuguugcugacgggggaugggcccccuggggcccguggggcgaguguucucgcacgugcgggggaggcgugcaguuuagccaccgggaauguaaagauccugagccccagaaugggggaagauauugccugggccgccgggcuaaguaccaauccugucauaccgaagagugcccucccgacggaaagagcuucagagagcagcagugugaaaaauauaacgccuacaauuacacagacauggaugggaaccuccugcagugggucccgaaguaugccggcgugucuccucgggaccgcugcaaacuguuuugcagagcucgggggagauccgaguucaagguuuuugaagcgaaagugauugauggcacccuguguggacccgagacacucgccaucugcguccgcggccaaugugugaaggcugggugcgaccacgucguggauagcccucggaaacuggacaaguguggaguuugcggcgggaagggaaacucuuguagaaaaguguccggcagccugacccccacgaauuacggcuauaacgauauugucacaauccccgccggggccaccaauaucgacgugaagcagcgcucccauccuggaguucagaacgauggcaauuaccuugcucucaaaaccgccgacgggcaguaucugcugaacggaaaucucgcgauuucugcuaucgaacaagauauucuggugaagggcacaauccuuaaauacagcggguccauugccacccuggagagacuccagucuuuccggccgcugcccgagccucugacaguccagcuucucacggugcccggagaaguguuuccucccaagguuaaguauaccuucuuugucccuaacgacguggauuucagcaugcaauccagcaaagagcgcgccacaaccaauaucauccagccgcugcugcacgcucagugggugcucggcgacuggucugaaugcuccagcacauguggcgccggguggcagagacggaccgucgagugccgcgaccccucuggacaagcguccgcuacguguaacaaggcccugaaaccugaagaugccaagcccugcgagagccagcuuugcccucuguga

SEQ ID NO: 65510 - RNA, 5808 nt, Artificial Sequence
  derived and/or modified sequence opt5 from ADAMTS9__Homo_sapiens__NP_891550
augcaguucgugagcugggccacccugcucacacugcuugugagagaccuggcugagaugggcucccccgaugccgccgcugccguucggaaggacagacuccacccuagacaagugaagcugcuugaaacgcugucugaguacgaaauugugagcccgauucgggucaacgcccucggggagcccuuuccuaccaaugugcauuucaagcgcacaagacgguccaucaacucugcuaccgaucccuggccugccuuugcuagcuccucuagcuccagcacaucuucccaggcccacuaucgccugagcgcguucggacagcaguuucuguucaaucucaccgccaacgcuggcuuuauugcgccccuguucacaguuacccuucuggggacgccuggagugaaucaaaccaaguuuuacucugaagaggaggcugaacucaagcauugcuucuauaagggcuacgucaacacaaauuccgagcacaccgccgugaucagccuguguucugggaugcuuggaacauuuagaucccaugacggcgauuauuucauugaaccgcugcagagcauggacgagcaggaggaugaagaggaacagaacaagccccacaucaucuaccggcgcuccgcgccucaaagagagcccucuaccggccggcacgccugcgacacgagcgaacauaagaaucgccacuccaaggauaagaaaaagacaagagcucggaaauggggagaacgcauuaaccucgccggagacguugcugcccugaauagcggccuggccaccgaggcuuuuucugcguaugggaacaagacagauaauaccagagaaaagcggacccauagacgcacaaaacgguuccucuccuacccuagauucguggagguccuggugguggccgacaaccgcauggucagcuaccacggagaaaaucuucagcacuauauccugacgcucaugucuauuguugcuagcaucuacaaggaucccuccauuggcaaccugaucaacauugugaucgugaaucuuaucgucauucauaacgagcaggacgggccgucuaucagcuuuaaugcccagaccacacugaaaaacuucugucaauggcagcacuccaagaauagcccuggaggcauucaucacgacaccgccgugcuccugacacggcaggauaucugcagagcucaugacaaaugugauacccugggccucgccgaacuggggacgauuugcgaccccuaucgcucuuguuccaucagcgaggauucuggacuuuccacagcguuuaccaucgcucacgagcugggccacguuuucaacaugccucaugacgauaauaacaagugcaaagaagagggggucaagagcccccaacacgucauggcccccacccucaauuuuuacacaaacccuuggaugugguccaaguguucucggaaauauauuaccgaguuccuggacacaggauacggcgagugccuucugaaugaaccggagagcagacccuauccucuccccgugcagcugccugggauccuguacaacguuaauaagcagugugagcucauuuuuggacccggcucccaggugugcccguacaugaugcaaugccgccggcugugguguaacaaugucaacggcgugcauaaagggugcagaacgcagcacaccccuugggccgauggaacagaaugugagcccggcaagcacugcaaauauggguucugugucccuaaggaaauggacgugcccguuaccgauggaucuuggggcagcugguccccuuuugggacaugcagccgcaccuguggcggaggcaucaagacggcuauucgggagugcaacagacccgagccgaaaaaugggggaaaguacugugugggccggcgcaugaaauucaagucuugcaacaccgaaccuugucuuaaacagaagagagacuuucgggacgagcagugcgcccauuucgaugggaagcacuuuaauaucaacggacugcuccccaaugucagaugggugcccaaauauuccggcauccugaugaaggaccgcugcaaacuguucugucggguugcugggaacacagccuacuaucaacuuagagaucgcgugauugacggcaccccuugcggacaggauacaaaugacaucuguguccagggccucugcagacaggcggggugugaucaugugcugaacagcaaggcccggcgcgacaaaugcggaguguguggcggggauaauucuuccugcaagaccguugcuggaacguucaacacaguccacuacggcuauaauaccguggugcgcauuccggccggggcuacaaacaucgacguccggcaacauagcuuuucuggcgaaaccgaugacgauaauuaccuggcccucagcuccagcaagggagaguuccugcuuaacggcaauuuugugguuaccauggcgaaacgcgaaauuagaaucgggaacgccguggucgaguacucuggauccgagacagcuguggaacggauuaacagcacggaccgcaucgagcaggaacugcuccugcagguucuguccgugggcaaacuuuauaaucccgacgucagauacucuuucaacaucccuauugaggauaaaccccagcaauuuuauuggaauagccacgggccuuggcaggccuguuccaagcccugccagggagaacggaaacgcaagcucguguguaccagagagucugaccaacugacaguuagcgaucagcggugcgacagacugccucagcccggccacaucaccgagccgugcgggacagauugugaccuccgcuggcauguggcuucccggucugaaugcagcgcccaguguggccugggauacagaacccuugauauuuauugcgccaaauacucccgccuggacggcaagacggagaaggucgaugacggguucuguagcucucacccuaaacccuccaaccgggaaaagugcagcggagaguguaauacaggcggguggagauauucugcuuggaccgaaugcuccaaaagcugugauggaggcacccaacgccggagagcgaucugcgugaacacacgcaaugacgugcucgaugacucuaaguguacccaucaggagaaagucacaauucagcggugcuccgaguuuccuugcccccaguggaaaagcggcgacugguccgaaugucugguuacgugcgggaagggacacaaacauagacaaguguggugucaguucggcgaggaucggcugaacgaccgcaugugcgauccggaaaccaagccuacaagcaugcagaccugucagcaacccgagugcgccucuuggcaggcugggccuuggggacaguguagcgugacaugcggccaaggguaccagcuuagagccgucaaauguaucaucggaaccuacauguccgugguugacgauaaugacugcaacgccgcuacgcggcccaccgauacacaggacugugagcuccccucuugccacccuccgcccgccgcgccugaaacccgcagaagcacauauuccgcuccccggacccaguggagauuuggcucuuggacaccuugcagcgccaccuguggcaaggggacgcgcaugcgguacguguccugcagagaugagaauggaucugucgccgacgaaagcgcuugugccacacugccccgcccuguggcgaaagaggaaugcuccguuaccccguguggccaauggaaggcucuggauuggagcucuugcuccgugaccugugggcagggacgggccacaagacaggucaugugcgugaacuauagcgaccacguuauugaccgcucugagugugaucaggacuacauccccgagaccgaucaagacugcuccaugagcccuuguccccagcggacgccugauuccggccucgcccagcaucccuuccagaaugaagacuauagaccgcgcucugcuagcccuuccagaacacacgugcugggcgggaaccaauggcggaccgggcccuggggcgccugcagcucuacaugcgcugggggaucccagcgcagagucguggugugucaggaugagaauggcuacaccgccaacgacugcgucgaacggauuaagcccgaugagcagcgcgcgugugaaagcgggccuugcccccaaugggccuauggaaacuggggcgaguguacaaaacuuugcgggggaggcaucagaacccggcugguugugugucagagaucuaauggcgagcgcuuuccugaccucagcugcgaaauucuggauaagccgcccgaccgggagcaguguaacacgcaugcuugcccucacgaugccgcuugguccaccgggcccuggucuagcuguuccgugucuugcggaagaggccacaaacaacgcaaugucuacuguauggccaaggacgggagccaucuggaauccgacuacugcaaacaccuugccaagccucauggacaccggaagugcagaggcgggcggugucccaaauggaaggcuggagcguggagccagugcucuguguccuguggccgcggcguucagcagagacauguggggugccaaaucggaacacacaaaaucgcccgggagaccgaauguaacccguauacacgcccugagagcgagagagauugccagggcccccgguguccucucuacaccuggcgcgcugaagaguggcaggaaugcacgaagacauguggggagggauccagauaucggaaagucgugugcguugacgauaauaagaacgaggugcacggcgcccgcugugacgucucuaaaagacccguggaucgggaaagcugcucccugcagccuugcgaguacgucuggauuaccggggaauggucugaguguagcgugacaugcggaaagggcuauaagcaaagacugguuuccuguagcgaaaucuacaccggcaaagagaauuaugaguacucuuaccagaccacaauuaacugccccgggacgcagccgccuuccgugcaucccuguuaucuccgcgacugccccgucagcgccaccuggcgggugggaaauuggggcucuuguuccguuagcugcggggugggagucaugcagagaucugugcaaugucugacaaacgaagaucagccuagccaccuuugccauaccgaccugaagccggaggaacgcaaaacaugucggaauguguacaacugcgagcucccccagaauugcaaggaaguuaaaagacugaagggcgcuuccgaggauggggaguauuuccugaugauccgcggaaaacuucugaaaaucuuuugugccggcaugcacucugaccacccuaaggaauacgucacccucgugcauggcgauagcgagaacuucuccgaaguguaugggcaccggcugcauaaucccacggagugcccuuacaacggaagcagacgcgacgauugucaaugccggaaagacuauacagcggcuggcuucuccucuuuucagaagaucagaaucgaccucaccagcaugcagauuaucaccacagaucugcaguucgcccgcaccuccgaagggcaccccgucccuuuugccacagcuggagacuguuacucugccgcgaaaugcccgcaaggccgguucagcauuaaucuuuacgggacgggccugucccucaccgagucugcuagauggaucagccagggaaacuaugccguguccgauauuaaaaagagccccgacggcacacgcguuguggggaaauguggaggcuacugcgggaaguguaccccuucuuccggaacaggccuggaggucagagugcuguga

SEQ ID NO: 65511 - RNA, 5289 nt, Artificial Sequence
  derived and/or modified sequence opt5 from ADAMTSL1__Homo_sapiens__NP_001035362
auggagugcuguagacgggccacccccggcacacugcugcuguuccuugcuuuucugcuccugagcucccgcacggccagaucugaggaggaccgggacgggcuuugggacgcguggggaccuuggagcgaaugcucccgcaccuguggcgggggagcuucuuacagccugagacggugccucuccucuaagagcugugagggccgcaacauuagauaucggacaugcuccaauguggauuguccgcccgaagccggggacuuccgcgcccagcaaugcagcgcucacaacgaugucaagcaucacggacaguuuuacgaguggcugccuguuucuaaugaccccgauaacccuuguucccugaagugccaggccaaaggcaccacacucgugguggagcuggcucccaagguccuugacggcaccagauguuauacagaaagccuggauaugugcauuucugggcucugccagaucgugggaugugaccaucaacugggcuccaccguuaaagaggauaauugcgggguguguaacggagacggcagcacgugccggcuuguccgcgggcaguacaagucucagcuguccgccaccaagagcgaugacacagugguugcgauuccuuauggauccagacacauccggcucgugcugaaaggcccggaccaucuguaccucgaaaccaagacacugcagggcaccaaaggggaaaauucucuuagcuccacgggaacauuccuggucgauaacagcucuguggacuuucaaaaguuccccgauaaagagauucuccgcauggccggcccucugaccgcugacuuuaucgugaagaucagaaauuccgggagcgccgauucuacaguccaguucaucuuuuaucagcccaucauucaccgguggagagaaaccgacuucuuuccuuguagcgcuaccugcggaggcggguaccagcuuacauccgccgaguguuacgaucugcgcucuaaccggguuguggcggaccaauauugccacuacuaucccgaaaauaucaagccgaaaccuaagcuccaggaguguaaccuggaucccugcccugccagcgacggauacaaacagauuaugcccuaugaucuguaccauccccucccuagaugggaagcuacgccguggaccgccuguuccagcucuugcggcggcgggauccaaucccgcgcugugagcugcgucgaggaggacauucagggacacgugacaucuguugaagaguggaaguguauguauacccccaaaaugccuaucgcccagcccugcaauaucuucgacuguccuaaguggcuggcccaggaauggucccccugcacagugaccuguggccaagggcuucgguacagagucgugcugugcauugaucaucgcggaaugcacacgggcggguguagcccgaaaacaaagccucacaucaaggaggaaugcauuguucccaccccuuguuacaaacccaaggagaaacucccuguggaggcuaagcugcccugguuuaaacaggcgcaggaacuugaggaaggcgccgcugucuccgaggaaccgucuuucaucccugaggccuggagcgccugcaccgugacauguggagucggcacccaggugcggauuguuagaugccaagugcugcucuccuucucucagagcgucgcugaccugcccaucgaugagugcgaagggcccaagccugccucccagcgcgcguguuaugcuggaccgugcagcggcgagauccccgaauuuaacccugacgagacagaugggcuguucggaggccuccaggacuuugaugagcuguacgacugggaauaugagggguucacgaaguguucugaauccugcggcggaggcgugcaagaggccguugugagcugucuuaauaaacagacccgggaacccgccgaggagaaccugugcgucacaucuagacgcccuccccagcuccugaaguccuguaaccuggauccuugccccgcucggugggaaauugggaaauggagcccguguucucuuaccugcggagugggccuccagacaagagacguguuuuguagccaucugcugucccgggagaugaaugaaaccguuauccucgccgaugagcugugccgccaaccuaagcccagcacgguccaggcuugcaacagauucaauuguccucccgccugguacccggcgcaguggcaaccuugcucucggaccugugggggaggcgugcagaaaagagaagugcuuugcaagcagcgcauggccgacggguccuuucuggagcuccccgagacauucuguagcgcuuccaagccugccugccagcaggcuugcaaaaaggaugacugccccucugaauggcugcugagcgacuggaccgaguguuccacaucuugcggcgaaggaacccaaacgcggagcgccauuuguagaaaaaugcuuaagacaggccucuccaccgucgugaacucuacacugugucccccucugccguuuagcuccagcauccgccccugcaugcucgcgaccugugccagaccugggcggcccucuaccaaacacuccccucauauugcugccgcucgcaagguuuauauccagacaagacggcagcgcaagcugcacuucguggucggaggcuuugccuaccuucugcccaaaacggccgugguucucagaugcccugcucggcgcgugagaaagccgcugaucaccugggagaaagaugggcaacaucugauuagcucuacacacgucaccguggcgcccuucggauaucuuaagauccaccggcucaaaccuuccgacgccggcguuuacacauguagcgcugggcccgcccgcgaacauuuugugauuaagcugaucggcggaaauagaaaacuggucgcccggccucucucucccagauccgaggaggaagugcuggcuggccgcaaagggggaccgaaggaggcccuucagacccacaaacaucagaacggcauuuucagcaauggguccaaggcggaaaaacggggacuggcugccaacccuggcagcagauacgaugaccucgugucucgccugcuggagcagggcggguggcccggagagcuucucgccagcugggaagcucaagauuccgccgagcggaauacgacaucugaagaggaccccggcgcggaacagguccugcugcaccucccuuucaccaugguuaccgagcagagacgccuggaugacauccuugggaaccugagccaacagcccgaggaacuccgggaucuguauuccaagcaccugguggcucagcuugcccaggagauuuuuagaucucaucuggaacaccaagacacacuccugaaaccuagcgagcgccggaccuccccggugacacucucuccccauaagcacgucagcggauucuccagcucucugagaacguccagcaccggcgaugccgggggaggcucucggcgcccucauagaaagcccacaauccuucggaaaaucuccgcugcccagcagcugagcgcuuccgaagugguuacccaccucggccagacaguggcccuggcgucugggacccugagcguccuucugcacugcgaggccauuggacauccucgccccacgaucuccugggcuagaaauggcgaggaagugcaauuuagcgaccggauucuccugcagccggaugacucucuccagauccuggccccuguugaggcugacgugggguucuacaccuguaacgccacaaaugcccuuggauaugauuccgucagcauugcugugacccuggcgggcaagccccucguuaaaacaucuagaaugaccgugaucaacacagaaaagccugccgucaccguggacaucgggagcacgauuaaaacagugcagggagucaauguuaccaucaacugccaaguggcuggcgugcccgaggccgaagucaccugguuucgcaacaaguccaagcugggcucuccucaccaucugcacgaggggagccuucugcucacaaauguguccucuagcgaucagggacuguacuccugucgggccgcuaaccuccauggcgagcugaccgaaagcacgcagcuucugauucuggaucccccgcagguuccuacacaacucgaggauaucagagcccugcuugcggcuaccgggcccaaucugcccucugugcucacauccccucugggaacccagcucguccuggacccgggcaacagcgcccuucuggggugccccauuaaaggacacccugugcccaauaucacaugguuccacggcggccagccuaucguuaccgccacggggcugacccaucacauucucgcugccggacaaauccuccagguggcgaaccuuuccggcgggucucagggagaauuuagcugucuggcucagaaugaggccggcguccucaugcaaaaggccucccuggugauucaggauuauugguggucugucgaccgccucgcuacaugcagcgccuccugugggaaccggggagugcagcagcccagacugcgcugccuucugaauagcaccgagguuaacccugcucauugcgccggcaaagugcggccggcgguccaacccaucgccuguaauagacgcgauugcccuucuagauggauggugacauccuggagcgcuuguacccggucuugcggcgggggaguucagacgcgcagagugacaugucagaagcugaaagccuccggcauuagcacccccgucucuaacgacaugugcacacagguggcuaagcggccuguggauacccaagccuguaaucagcagcucugcguugaaugggccuucagcuccugggggcaauguaacggacccugcaucggcccgcaccuggcuguccagcaccgccagguguuuugucagaccagagacgggaucacacuuccuucugagcaaugcagcgcgcugccccggcccguguccacgcagaauuguuggagcgaagccugcuccguccauuggagagugucucucuggacccugugcacagcuaccuguggaaacuacggcuuccagagccgccggguugagugcgugcacgccagaacaaacaaggccgucccugaacaucucuguuccuggggcccccgcccugcuaauuggcagcggugcaacauuaccccgugugagaauauggagugcagagacacgacacgguauugugaaaaagugaagcaacugaaacuuugccagcugucucaguuuaagagccgcuguugcgggaccuguggaaaagccuga

SEQ ID NO: 65512 - RNA, 2856 nt, Artificial Sequence
  derived and/or modified sequence opt5 from ADAMTSL2__Homo_sapiens__NP_001138792
auggacggccgcuggcagugcagcuguugggccugguuccugcucgugcuggcugucguugccggggauaccguguccacaggaucuacggacaacagccccaccuccaauucucuugagggcgggacagaugcgaccgcuuuuugguggggagaauggacaaaguggaccgccugcagccgguccuguggcgggggagugacaucucaagagcgccacugccugcagcagagacggaaaagcgucccuggcccgggcaaccgcaccuguacggggaccuccaagagauaccagcucugccgggugcaagaaugucccccugacggacgcagcuucagagaggaacagugcguuucuuuuaauucccauguguauaacggccggacacaccaguggaaaccccuguacccugaugacuauguccauaucagcucuaagcccugugaucuucacugcaccacaguggacgggcagcgccaacugaugguuccugccagagauggaaccuccuguaaacucacggaccugcggggcgugugcgucagcgggaagugcgagccgauuggaugugauggcgugcuguucucuacacauacccucgacaagugcggcaucugucagggggauggauccagcugcacacacgugaccggcaauuaccgcaaagggaacgcucaccugggauauucccuugucacccauauucccgccggcgcuagagacauccagauuguugagcggaagaaaucugccgacgugcuggcgcucgccgaugaagcuggguacuauuucuucaauggaaacuacaagguggacagcccuaaaaauuuuaacaucgccggcacagucgugaaguaccgcagacccauggauguuuaugagacgggcaucgaauacauuguggcucaggggccuaccaaucaaggacugaacgucaugguguggaaucagaacggcaagucccccagcaucacauucgaguauacccuucugcagccgccucacgagucucggccccaaccuauuuacuauggguuuuccgaaagcgccgagucucagggacucgacggcgcggggcugaugggcuucguuccccauaauggaagccuguacggccaggccuccucugaaagacucgggcuggauaaccgccuuuuuggacaccccggccuggacauggagcucgggccuagccagggacaagaaacaaacgaggugugugagcaggcuggcgggggcgccugcgaaggaccgccccggggcaaaggguucagagaucgcaaugucaccggaacgccucugacaggcgacaaggaugacgaggaaguggauacccacuuugcuucccaggaguucuucagcgccaacgccaucucugaccagcuucugggggcuggauccgaccucaaagauuuuacccugaaugaaacagucaacagcauuuucgcgcaaggcgcuccccggucuucccuggcugagagcuuuuucguggacuaugaggaaaaugagggggccggcccuuaccuccugaacggauccuaccuugaacugucuagcgauagaguugccaauuccucuagcgaggcucccuuuccgaacguguccaccagccuccugacaucugccggcaaucgcacgcauaaggcgcggaccagaccuaaagcucgcaagcagggggucucccccgccgacauguaucgguggaaacuuagcucucacgaaccuuguuccgccacaugcaccacaggagugaugagcgcuuacgccauguguguuagauaugauggcguggaggucgacgauucuuacugcgacgcucugacccgccccgagccugugcaugaauuuugugccgggcgggagugccagcccagaugggaaacgagcuccuggagcgagugcucucggaccuguggagagggcuaucaguuucgcgugguuagaugcuggaagaugcucuccccgggguucgauagcuccgucuacucugaccugugugaagcggccgaggcugugcggccugaagagagaaagacaugccgcaaccccgccuguggcccccaaugggaaaugagcgagugguccgagugcaccgcuaaauguggagaacggucuguggucacaagagauauccgcugcagcgaggacgaaaagcugugugauccuaauaccagaccggugggcgagaaaaacugcacggggcccccuugugaccggcaguggacaguuuccgacuggggacccugcucuggcagcugcgggcagggacgcaccauuagacacguguauuguaagacauccgauggccgggucgugccugaaagccagugccaaauggagaccaaaccccucgccauccauccuuguggcgacaagaauugccccgcgcacuggcuggcccaggauugggagcgcuguaacaccacaugcgggagaggaguuaagaaacggcuugugcuguguauggaacucgcuaauggcaagccgcagacgcgcucugggccugagugcggacuggccaaaaagcccccugaagaguccaccuguuuugaaagacccugcuucaaaugguacacaagcccguggucugaguguaccaagacaugcggcgucggggugcggaugcgcgacguuaagugcuaccaaggaaccgauaucgugagaggcugugacccucuggucaaacccgugggccggcaggcuugcgaucuucagccuugucccacggagcccccugacgauuccugccaggaccaaccggggacaaacugugcccucgccauuaaggugaaccugugcggacacugguauuacagcaaagccuguugcagaucuuguagacccccucauuccuga

SEQ ID NO: 65513 - RNA, 5076 nt, Artificial Sequence
  derived and/or modified sequence opt5 from ADAMTSL3__Homo_sapiens__NP_997400
auggccagcuggaccagccccuggugggugcugaucggcauggucuucaugcacucuccucucccgcagacaacggcugaaaagucccccggggccuacuuucugccugaguucgcccuuagcccccaaggaucuuuucuggaagauaccacaggcgaacaguuccucaccuaucgguacgaugaccagacaagccggaacacccgcuccgaugaggacaaagaugggaauugggacgcuuggggagauuggucugacugcagccggacauguggcgggggagccuccuauagccugcggcgcugccuuaccggcagaaacugugaaggccagaauauucgguacaagacgugcucuaaccaugauuguccucccgacgccgaggauuuucgcgcucaacagugcuccgccuauaaugacguucaguaccaggggcacuauuacgaguggcugccuagauacaacgauccggcugcccccugugcgcucaagugccaugcccaaggacagaaucuggugguggaacuggcuccuaagguccucgacggcacccgguguaacacagacagccuggauaugugcaucucugggauuugucaggccgugggaugcgaccgccagcuuggcuccaaugcuaaagaggauaacugcgggguuugugccggagacggcucuaccugcagacuggugcggggccaauccaagucccacgucagccccgaaaagcgcgaggagaaugugaucgcgguuccucucggguccagaucugugcggauuacagucaaaggacccgcccaucuguucaucgaaagcaagacccuucagggcuccaaaggggagcacagcuuuaacucuccgggaguguuccugguggaaaauacgacagucgaguuucagcgcggcuccgaaagacaaaccuucaagaucccugggccccucauggcugauuuuauuuucaaaacacgguauaccgccgcuaaggacagcguugugcaguuuuucuucuaccagccuaucucucaccaguggagacaaaccgacuuuuuccccuguacagugacgugcggaggcggcuaucagcugaacagcgccgagugugucgacauucgccugaagcgggugguucccgaucauuacugccacuauuacccugagaaugugaaaccgaagcccaaacucaaggaauguuccauggacccuugccccucuagcgauggguuuaaagagaucaugccuuaugaccauuuccagccccugccgagaugggaacacaacccuuggaccgccuguuccgucagcugcggaggcgggauucagcgccggucuuuuguguguguugaggaauccaugcacggagagauccuucaaguggaggaauggaagugcauguacgcucccaaaccuaaggucaugcagacaugcaaccuguucgacugucccaaguggauugcgauggaguggagccagugcaccgugacauguggcagagggcuccgcuaccgggucgugcugugcaucaaucauagaggcgaacacguuggaggcuguaacccucagcuuaaacugcauaucaaggaggaaugcgugauucccaucccguguuauaaaccuaaggagaaaucucccgucgaggccaagcuccccuggcugaagcaagcucaggaacuggaggaaacccgcauugccacggaggagccuacauuuaucccggaacccugguccgccugcagcaccaccugugggccuggagugcagguucgggaggugaaaugcagaguccuccugacauucacccagacagaaacggagcuucccgaagaggagugugaaggcccuaagcugcccaccgagcgcccuugccuccuggaggcuugcgaugagucccccgccucucgggaacuugacauuccgcugccugaggauagcgagacaaccuacgacugggaauaugcgggguuuacacccuguaccgcuacgugcgugggaggccaccaagaggccaucgccgugugucuccauauccagacccagcaaacaguuaaugauucccugugcgacaugguccacagaccucccgcuaugucucaggccuguaacaccgaaccgugcccuccccgguggcacguggggagcuggggcccuuguuccgcuacaugcggagugggcauucagacccgcgaugucuacugucugcaucccggggagacgcccgccccuccggaagagugcagagacgagaaaccccacgcgcuccaggccuguaaucaauucgauugcccucccggauggcauaucgaagaguggcagcagugcagccggacauguggcgggggaacccagaacagacgcgugacaugccggcaacugcuuaccgacggcucuuuucugaaucucuccgaugaacugugucaggggccuaaggcuagcucucacaaauccugcgccagaaccgacugucccccucaccuggcuguuggcgauuggagcaagugcucugugagcuguggagucggcauucagcgcagaaaacaggugugccaacggcuugccgcgaaagggcgcagaaucccgcucuccgagaugaugugucgggaccugcccggacugccucucguucgcagcugccagaugcccgaguguucuaagauuaaauccgaaaugaagacaaaacugggcgagcaggggccucaaauccuuagcgugcagagagucuauauccagacgcgggaagagaagcgcauuaaccugaccaucggauccagagccuaccuccugcccaauacaucugugauuaucaagugcccgguucggcgcuuccagaaaagccugauucaaugggaaaaggacggcagaugccuucagaacuccaaacggcucgggaucaccaagucuggcagccugaaaauucauggacuggcugccccugauaucggcguguauagauguaucgcuggguccgcccaggagacagucgugcucaagcugauuggaaccgacaaucgccuuaucgcccggcccgcucugagagagcccaugcgcgaauacccuggcauggaucacucugaggcgaacagccucggggugacguggcauaaaaugcggcagauguggaauaacaagaaugaccuguaccuggaugacgaucacauuuccaaccaacccuuucuuagagcccuccugggacauugcagcaacucugcuggcuccacaaauagcugggaacugaagaacaaacaguucgaggccgccgucaagcagggcgcuuauucuauggacaccgcccaguucgaugaacucauccgcaauaugucccaacugauggagaccggggagguuagcgacgaucuugcgucucagcugauuuaccagcucguggcugaacuggccaaagcccagccuacacacaugcaauggcggggaauccaggaggaaaccccgcccgcugcccagcugagaggcgagacaggguccgugagccaauccagccacgcgaagaacucuggaaaacuuacguuuaagccuaagggccccguccucaugcgccagagccagccucccuccaucucuuucaauaaaaccauuaacagccggaucgggaauacaguguauauuaccaagagaacagaaguuaucaacauucugugugaccugaucaccccguccgaggcuacguacaccuggacaaaagauggaacccuccugcagccuucugugaagaucauucuugacggcacaggcaaaauccaaauucagaaucccacccggaaggagcaggggaucuaugaaugcagcgucgccaaccaucugggauccgacguggagucuagcuccguucucuacgccgaagcuccugugauucugagcgucgagcgcaauaucacaaagcccgagcacaaccaucugucugugguugugggcgggaucgucgaagccgcucuuggagccaaugugaccauuagauguccugugaaaggcgucccccagccgaacaucacguggcugaagagagggggaucccucagcggcaauguuucucugcucuuuaacggcucccugcuucugcaaaacgugagccucgagaaugaagggacauaugugugcauugcgaccaacgcccugggaaaagcugucgccaccuccgugcugcaccuucuggagcgcagauggccugaaucucggaucguuuuccuccagggccauaagaaauacauucugcaggcuacaaauaccagaacgaacagcaaugaucccacaggggagcccccuccgcaggagcccuuuugggaaccuggaaacuggucccacuguagcgcgaccugcggccaccucggggcccgcauccaacggccccagugugugauggcuaauggacaggaggucucugaagcgcugugcgaccaucuucaaaagccucuggccggcuucgagcccuguaacauuagagauugcccugcucgcugguuuacauccguguggagccagugcucuguuagcuguggcgaaggguaccacuccagacaggugaccugcaagagaacaaaagccaauggaaccguccagguggucucuccgcgcgccugugcucccaaggaccggccucucggcagaaaacccugcuucgggcauccuugugugcaaugggagcccggaaaccgcugcccgggcagauguauggggcgggccguucgcaugcagcagagacacacggcgugccagcacaauagcuccgauucuaacugugacgaucggaagcgcccuacccugagacggaauugcacaagcggagcuugugacgugugcuggcauaccggccccuggaaacccuguacagccgccugcggcagaggguuucaaucccgcaaggucgauugcauccacacccggagcuguaaaccuguggcuaagagacauugcguucagaagaaaaagcccaucucuuggcgccacugucugggaccuuccugcgaccgggauuguacggacacaacccauuauugcauguucgugaaacaccuuaaccuguguagccucgacagauacaagcagcggugcugucaguccugccaagagggcuga

SEQ ID NO: 65514 - RNA, 3393 nt, Artificial Sequence
  derived and/or modified sequence opt5 from ADAMTSL4__Homo_sapiens__XP_011507946
augcuggcccccagacgggcuccuagcaccccgcgcugccucagauccuucugugaccagucugcccccgcgagcccuuggggcucccgcgggggagcuauggagaacuggacaggccgccccuggcuguaccuucugcuccugcuuucucugccucaacucugccuggaucaggaagugcugagcgggcacucccuccagacgcccaccgaggaaggacagggcccugagggggucuggggaccguggguucaaugggccucuuguagccagcccugcggcgugggcgugcagagacggucccgcacaugucagcugccuaccguccaacuucaucccagccugccucugcccccgagaccuccccggcacccugaagcccuccuuccccgcgggcagggacccagaccucagacaucuccggagacccugccccucuaucggacacagucccgcggcagagggggaccucugcggggccccgcuagccaucuggggcgcgaggaaacccaagagaucagagccgcucggagaucucgccuccgggacccuauuaagcccggaauguuuggcuacggcagagugccguucgcccugccucuucaccgcaaucggagacauccccgcuccccuccccggagcgaacugucucucaucuccagcagaggggaggaggcgauuccuucccccacgccgcgcgccgaaccuuuuucugcuaacggaagcccccagaccgagcugcccccuacagaacuuuccguucacaccccgagcccccaggccgagccucugucucccgaaacagcucaaaccgagguggccccucggacgagacccgcgccucuccgccaccauccccgggcccaggcuuccggcacagagccgccuagccccacccacucucugggggaaggaggcuucuuuagagccagcccucagccccggcgcccguccucucaggggugggcuagcccucaagucgccggaagacggcccgauccuuuccccuccgugcccagaggccgcggccagcaggggcagggaccuuggggcacagggggaaccccgcauggcccccggcuggagccugacccccaacacccuggggccuggcucccccugcuuagcaauggcccucacgcuucuucccuguggagccucuuugcgccgucuucccccaucccuagaugcagcggagaauccgagcagcugcgcgccuguucucaggcucccugcccucccgaacagccggauccuagagcccuucaaugugccgcuuucaacagccaggaguuuaugggccagcuguaucagugggagcccuucaccgaagcgccccuccugccucugcggcaugccuuuuuccuccugcccggggcuggauccggcgacucuacagggguucaaggaagccagcgcugcgagcuuaauuguagaccucggggcuuucgcuucuacgugagacacacggaaaaaguccaggaugggacccugugccaaccgggcgcccccgacauuugcguggccggacggugucucuccccuggcugcgaugggauccugggaagcggccgcagacccgacggguguggagugugcggcggggaugacucuacaugucggcuggucuccggcaaccuuaccgaucgcggaggcccucucggguaucagaagauccuguggauucccgcuggagcccugagacuccagaucgcucagcugcggccgagcucuaauuaccuugcccugagaggcccugggggacgcuccauuaucaacggcaauugggcgguugaucccccugggagcuaucgggccggcggaacaguguucagauacaaccggcccccucgggaggaaggcaaaggggagucucucagcgcugagggacccaccacgcaaccgguggacgucuacaugauuuuucaggaagagaauccuggcguguucuaucaguacguuaucuccagcccuccgcccauucuggaaaaccccacacccgagccucccgugccucagcugcaacccgagauccuuagagucgaaccuccgcucgcccccgcuccucgccccgcccggaccccugggacccugcagagacaggugcgcaucccccagaugccggcgccuccccauccccggacaccucugggaucucccgccgcuuauuggaagagaguuggccacuccgccugcagcgcuuccuguggcaaagggguguggcggccuauuuuucucugcaucucucgcgagagcggagaggaacuggacgaaagauccugugccgccggcgcucggccgcccgcgucuccugagcccugccaugggaccccuugucccccguacugggaggccggagaauggacaagcugcucccgcucuugcggcccugggacgcaacacagacagcuucagugucggcaagaguucggaggcggcgggagcuccgugcccccugaaagaugcggacaucugccccgcccuaauauuacccagagcugucagcuccggcugugcggccacugggaggucgggucucccuggucccaguguagcgucagaugcggacgcggccaacggucuagacaggugcgcuguguugggaacaauggagacgaaguguccgagcaggagugcgcuagcggcccgccucagccucccucucgggaagccugugauaugggccccugcacaaccgccugguuucacuccgacuggagcuccaaguguagcgcugagugcgggacaggaauccaaagacgcucugucgugugccugggcagcggggccgcgcuuggaccgggccagggggaagcuggagccggcaccggccaguccugucccacggggucuagaccucccgauaugcgggccugcagccucggaccuugugagcgcaccuggagaugguauacaggccccuggggagaaugcuccucugagugugggagcggcacccagcggcgcgacauuaucugcguuuccaagcuggggacagaguucaacgugaccucuccuagcaacuguucccaucugcccagaccgccugcucuccaacccugccagggacaggccugucaggaucggugguuuagcacgccuuggucucccugcuccagaagcugucaaggcggcacacagacccgcgaaguccagugccugucuacaaaucaaacccuuuccacccggugcccgccucagcugagacccagccgcaaacggcccuguaacucccagccuugcucucagagacccgacgaucaauguaaggacagcuccccucacugcccgcucguggugcaggcgcggcuguguguuuaccccuauuacacagcuacgugcugucgcagcugcgcccacguccuggagagaucuccucaggaucccuccuga

SEQ ID NO: 65515 - RNA, 1416 nt, Artificial Sequence
  derived and/or modified sequence opt5 from ADAMTSL5__Homo_sapiens__NP_998769
auggacagcgccccucuguucccuagaccgcaccucuuucagaaccugcuucuguuccucugggcucugcuuaauugcggccuggggguguccgcccaaggacccggcgaguggaccccuugggucucuuggacacgguguagcuccucuugcgggcgcggaguuagcgugagaucccggcgcugucucagacugcccggcgaggaaccuugcuggggagauucucaugaauaccggcugugucagcuccccgacugcccuccgggggcggugcccuuucgcgaucugcagugugcucuuuauaacggcagaccuguccugggcacgcagaagaccuaccaaugggugcccuuccacggggccccuaaucagugcgaccucaacugucuggccgagggacaugcuuuuuaucacagcuucggccggguucuugaugggacagccugcucccccggagcucagggcgugugugucgccgggcgcugccugagcgcgggaugcgacggccuccugggcucuggggcccuggaagauagauguggacggugcggcggggcuaaugacuccugucucuuugugcagcgcguuuucagagaugccggagcuuuugccggcuacuggaacgugacccugaucccggagggggcgcggcauauucgcgucgagcacagaagccggaaucaccuugcccugaugggaggcgacggcagauaugugcucaacgggcauuggguggucucuccucccggaacauacgaagcugccggcacccacguuguguauacacgcgauaccgggccucaagagacgcugcaggcugccggacccaccucccaugaccuucugcuccaggugcugcugcaggaacccaauccuggcaucgaguucgaguuuuggcucccgcgggaaagauacagccccuuccaagcccgcguccaggcucugggguggccucuucggcagccccaaccuagaggcguggagccccagccgccugcggcccccgcuguuacacccgcccagacccccacacuggccccugaucccugcccgccuugucccgacacccgcggacgggcucacagacuccugcacuacugcggcucugacuuuguguuccaggcccgcguccuugggcaucaccaucaagcgcaggaaacgcgguaugaggugcgcauucagcugguuuacaaaaacagaagcccccuccgggcuagagaauaugugugggccccuggacacuguccgugccccaugcuggccccucaucgggauuaccugauggcuguccagcgccucgugucccccgacggcacacaagaucagcugcuucugccucacgccggguaugcuagacccugguccccugccgaggacucucggaucagacucaccgcgcgccggugucccggauga

SEQ ID NO: 65516 - RNA, 1158 nt, Artificial Sequence
  derived and/or modified sequence opt5 from ADAP1__Homo_sapiens__NP_001271237
auguuccaguuuguguucagcagagucuacugcaucaaccccgcccggcgcaaguggaaagaguuugaaaagaugcugggcugugcugaggaagggcacgccucccucggaagagacccugauugggcgucuuauacccugggcguuuucauuugccuuagcuguuccgggauccaucggaauauuccgcaagugucuaaagucaagagcgugcgccuggacgcuugggaggaagcccagguggaguuuauggccucccacggaaacgaugcugccagagcucgguucgagucuaaaguucccagcuuuuacuaucgcccuacacccuccgacugccagcuccugagagaacaguggauccgggccaaguacgagcgccaagaguucauuuauccugaaaagcaggagcccuacagcgcgggcuauagagaaggguuucuuuggaaacggggacgcgauaauggccaguuccugucuagaaaguuugugcucacggagcgggaaggcgcccugaaauacuucaaccgcaaugacgcuaaggagccuaaagccgucaugaagaucgaacaucugaacgcuaccuuucagccggccaagaucgggcacccccauggacuccaagugacauaccugaaagauaauuccaccagaaacauuuucaucuaucacgaggacggcaaggagauuguugauugguucaaugcgcuucgggccgcuagauuucacuaccuccagguggccuucccuggggcuagcgacgccgaucugguccccaaacugucucgcaacuaucuuaaggaaggauacauggagaaaacaggcccuaagcagaccgaaggguuucggaaaagaugguucacaauggacgaucgccggcugauguauuuuaaggacccccucgacgccuucgcuagaggagagguguuuaucggcuccaaggaaagcggcuacaccgugcugcauggguucccgccuucuacgcagggacaccauuggccccacggcauuaccaucgucacaccugaucgcaaauuucuguucgcgugugagaccgaguccgaccaacgggaauggguugccgcuuuucagaaggccguggauagacccaugcucccccaggaguaugccguggaagcucacuucaaacauaagccuuga

SEQ ID NO: 65517 - RNA, 1146 nt, Artificial Sequence
  derived and/or modified sequence opt5 from ADAP2__Homo_sapiens__NP_060874
augggcgacagagagcggaacaagaaacgccugcucgaacugcuuagagcccccgauaccgggaaugcucacugcgccgacuguggagcggcugauccugacugggccagcuacaagcugggcaucuucauuugccucaacuguugcggggugcaucggaauuuuccggauaucucccgcgucaaaucuguuagacuggacuucugggaugacagcauuguggaguuuaugauccacaacggaaaucuucgggugaaggccaaauucgaagcucgcguccccgccuuuuauuacauuccucaggcuaacgauugucuggugcucaaggagcaauggaucagagccaaguaugaacggcgcgaguucauggcggacggcgagacaaucucccugcccgggaauagagaaggauuucuguggaaacggggccgcgauaacucucaguuccucagacggaaguuuguucugcuugcccgcgagggccugcucaaauacuucacgaaggaacaggggaaaagcccuaaggcugugauuuccaucaaggaccugaaugccaccuuucagacagagaaaauuggacauccccacggccuucaaaucaccuauagacgggaugggcauacaagaaaccuguucgucuaccacgagucuggaaaggaaauuguggacugguuuaaugcucuccgcgccgcgcggcugcaguaucugaaaauggccuucccugagcucccggaaagcgagcugguucccuuccuuaccagaaacuaccugaagcagggcuuuauggagaaaacagggccuaagcagaaagaacccuucaagaagcgcugguuugcucucgacugccacgagcggagacugcuuuacuauaaaaauccucuggaugccuucgaacaaggacagguguuucucggcaacaaggagcagggcuacgaggcuuaugaagaccugcccaaagggauccgcggaaaucgguggaaggccggccugaccauugucacgccggaaagacgcuucgugcucaccuguccuuccgagaaagagcagcaagaauggcuggagagccuuagaggggugcugucuagcccccucacaccucugaaccggcuuaccgccuccacagaaucuggacgcuccagccgguga

SEQ ID NO: 65518 - RNA, 2145 nt, Artificial Sequence
  derived and/or modified sequence opt5 from ADARB1__Homo_sapiens__NP_056649
auggacaucgaggaugaagagaacaugagcuccucuagcaccgacgugaaggaaaauagaaaccuggauaaugucucccccaaagacggcucuacaccugggccgggagagggcagccagcucuccaacgggggaggcgggggacccggccggaagcgcccucuggaagagggcucuaaugggcacagcaaauacagacuuaagaaacggcgcaagacgcccggaccuguucugcccaagaacgcccucaugcaacugaaugagauuaaaccuggccuucaguauacccugcucucccagacagggccggugcaugcuccccuguucgugaugagcgucgaagugaacggacagguuuuugagggcucugggccuaccaagaaaaaggccaaacugcacgcggcugaaaaggcccucagauccuucgugcaauuucccaaugccagcgaggcucaucuggccaugggacggacacuuucugucaacaccgauuucacauccgaccaggcugauuuuccugacacccuguucaauggcuuugagacgcccgauaaggccgaaccgccuuucuacgugggcagcaacggggacgauucuuuuuccagcuccggagaccucucucugagcgcgucccccguuccugccagccuugcucagccuccccugcccgugcucccgcccuucccucccccuucuggcaaaaaucccgucaugauccugaacgagcugcgcccggggcucaaguaugauuuucuguccgaaagcggagagucucacgccaaauccuucgugaugagcguggucguugacggccaguuuuucgaagggucuggaagaaauaagaaacuugcuaaggcccgggcggcccaaagcgcucuggccgcuauuuucaaccuccaucuggaccagaccccuucccgccagcccaucccuagcgagggccuucagcugcaccucccccaagugcuggccgaugccgugucuagacugguccucggcaaauuuggggaccugacagauaacuucuccagcccucacgcucggcgcaaggugcuugcgggaguugugaugaccacaggcaccgacgucaaggaugccaaagugauuucuguuuccacggggacaaagugcaucaauggagaguacaugagcgacagaggccuggcucucaacgauugucaugccgaaaucauuucccggcgcucucugcuuagauuucuguauacccagcucgagcuguaccugaauaacaaagacgaucagaagcggagcaucuuccaaaaauccgaaagagggggcuuucgccucaaggagaaugugcaguuccaccuguauauuucuacaagccccugcggagacgcccggaucuuuuccccgcaugaaccuauucuugagggcagcagaucuuacacccaggcugggguccagugguguaaccacggaucccugcaacccagacccccuggccuccugagcgauccgucuaccuccacauuccagggggccggaacgaccgagcccgcggaccggcacccuaauagaaaggcucgcggccagcugcggacaaaaaucgaaagcggggagggcaccauucccgugagaucuaacgccagcauccagacaugggacggaguccuucaaggcgaacgccuccugaccauguccugcagcgauaagaucgcccgguggaaugugguugggauucagggaucucugcucuccaucuuuguggagccuauuuacuucagcuccaucauucugggcucucuuuaucauggggaccaccugagcagagcuauguaccagcgcaucuccaacaucgaagaucugcccccucucuauacgcugaauaaaccccuucucucuggaauuagcaacgccgaggcucggcagccgggcaaggccccuaauuuuuccgucaacuggacagugggggacucugcgaucgagguuauuaaugccaccaccggcaaagaugaacugggacgcgcuagccggcuguguaagcaugcccucuacugccgcuggaugagagugcacggcaagguccccucccaucugcuucggagcaaaaucacaaagccuaacguguaucacgagucuaaacuggcugccaaggaauaccaagcggccaaagugcacuga

SEQ ID NO: 65519 - RNA, 2220 nt, Artificial Sequence
  derived and/or modified sequence opt5 from ADARB2__Homo_sapiens__NP_061172
auggccagcgugcugggcuccgggagaggaucuggcgggcucagcucccagcugaagugcaaaucuaagcggcgcagacggcgcagaagcaaacggaaggacaaagucuccauccuuucuaccuuccuggcucccuuuaagcaccucagcccuggaauuacaaacacggaggaugacgauacccuguccacaagcucugccgaaguuaaggagaaucgcaacgugggcaaucuugcggcuagaccgcccccuuccggggaccgggcccgcggaggcgcccccggcgcuaaaagaaagcggccucuggaagaggggaacggaggccaucucuguaaacugcaacugguguggaagaaacucagcuggucugucgcccccaagaaugcucuggugcagcuucacgaacugcgcccugggcuccaguacagaaccguuucccagacaggaccggugcaugcccccgucuucgcgguggccguugaggugaacggccugaccuuugaggggacaggaccuaccaagaaaaaggcuaaaaugcgggccgcugaacuugcccugcgcagcuucguccaauuucccaaugcgugccaggcccaccucgcuaugggcggcgggccuggacccggcacggauuucaccucugaccaggccgauuuuccggacacacuguuccaggaguuugaaccucccgcuccuagacccgggcuggccggaggccggcccggggaugccgcucuccuguccgcggccuauggaagacgccggcuucuguguagagcucucgaccuggugggcccuaccccggccacacccgccgcuccuggcgagcgcaaccccgugguccuucugaaucggcucagagccgggcugcgcuacguuugccuggcggagccugcugaacggagagcccgcagcuucgugauggccguguccgucgauggacggaccuuugagggcucugggagaagcaagaaacucgcucgcggacaagccgcucaggccgcgcugcaggaacuuuucgacauccagaugcccggccaugccccggggcgggcuagacggacgccuaugccccaagaguuugccgauuccauuagccagcuggugacacagaaguuccgcgaaguuaccacagaccucaccccuaugcacgcuagacacaaagcccuggcgggcaucgugaugaccaagggacuugacgcccggcaagcucaggucguggcccugucuuccggcacaaaguguauuagcggggagcaucucucugaucagggacugguugugaacgacugccacgcugaggucguggccagacgcgccuuccugcauuuucucuauacgcagcuggaacuucaccugagcaaacggagagaggauuccgaacgcucuaucuucgucagacucaaggagggcggguaccggcugcgcgaaaauauccuguuucaccuuuaugugagcaccucccccuguggagacgcuagacuccauagcccuuacgagauuacaaccgaucugcacucuuccaaacaucugguucggaaguuccgcggccaccucagaacaaaaaucgagagcggggaaggcaccgugcccguccggggaccgucugcggugcaaacgugggacggcguucugcuuggggagcagcugauuacaauguccugcaccgauaagaucgcccgcuggaacgugcucggacugcagggcgcucugcuuagccauuuugucgaaccuguguaucuccaguccauugugguugggucucugcaccacaccggacaucuggccagagucaugagccaccggauggagggcguggggcaacuccccgccuccuaccgccauaauagaccccugcuuucuggcgugagcgacgcugaagcccggcagccuggaaaguccccgcccuucagcaugaacugggucgugggcucugcggaucuggagaucauuaaugcuacaaccgggagacgcuccuguggaggcccuagccggcucugcaaacacguucugucugccagaugggcccgccuguacgggcggcuuuccacaagaacgcccagcccuggagacacccccucuauguauugugaggcuaagcucggcgcccacacauaccagagcgugaaacagcaacuguuuaaggcguuccagaaagcugggcugggcaccuggguccgcaagccucccgaacagcagcaauuucuccugacacuuuga

SEQ ID NO: 65520 - RNA, 2796 nt, Artificial Sequence
  derived and/or modified sequence opt5 from ADAR__Homo_sapiens__NP_001020278
auggccgagaucaaggaaaagauuugcgacuaccuguucaacgugagcgauuccucugcucucaaucuggccaagaacaucggccuuaccaaagcgagagacauuaaugcuguccugaucgauauggagcggcagggggacguuuaucgccaaggaacaacgcccccuauuuggcaccucaccgauaagaaaagagaacggaugcagaucaagcgcaacacaaauagcgugccggagaccgcccccgccgcuaucccugaaacaaagagaaacgccgaguuucugaccuguaauauucccacauccaacgcuucuaauaacauggugaccacggagaaagucgaaaauggccaggagccugugaucaaacuugaaaaccggcaggaggcccgccccgagccugcgagacugaaaccgcccguucauuacaaugggccuagcaaggccggauauguggacuucgaaaacggccaaugggcuaccgaugacauucccgaugaccucaauuccauccgggccgcuccuggggaguuucgcgccauuauggaaaugcccucuuucuacagccacggacugccgagaugcuccccuuauaaaaagcugacagagugucagcucaagaaccccaucagcggccugcuugaauacgcgcaguuugccucucagaccugcgaguucaacaugauugagcaauccggcccuccccaugaaccccgguuuaaauuccaggucgugaucaaugggcgcgaguuuccuccggcugaagccggaagcaagaaaguugcuaagcaggaugccgccaugaaagcuaugacaauccugcucgaggaagcgaaggccaaagacucuggcaaguccgaggagagcucucacuauuccaccgaaaaggagagcgaaaagacggcugagucccagacacccaccccuucugccacgagcuucuuuuccgggaaaagccccgugaccacccugcuugaauguaugcauaaacugggaaacucuugcgaguucagacuccuguccaaggagggcccugcccacgaacccaaauuucaauacugugucgcugugggggcccagacauucccgagcgugucugcgccuagcaagaaggucgcuaaacagauggccgccgaggaagcuaugaaggcccugcacggagaggcuacaaauuccauggccucugauaaccaacccgagggcaugauuagcgaaucccucgacaaucuggagagcaugaugccuaacaaaguucggaagaucggcgaacuugugcgcuaccugaauaccaaccccgucgggggacuccuggaguaugcgagaucucauggcuucgccgcugaauuuaaacuuguggaccaguccgggccuccccacgagccgaaguucguguaccaggccaagguuggaggccggugguuuccugcugugugcgcccauagcaaaaagcaggggaaacaagaggcggccgaugcugcccugagaguccucauuggagaaaaugagaaggcugaacgcaugggcuucacagaggugacccccguuacaggcgccucucugcggagaaccaugcugcuccugucccgcagccccgaagcccagccuaaaacgcuuccgcugacaggguccaccuuucacgaccagaucgcuaugcucucucaccgguguuucaacacccugacaaauagcuuucagcccucccuucugggaagaaagauucucgcggccaucaucaugaagaaagauucugaggacaugggcguggucgugagccuggggaccggaaaccgcugcgucaagggcgauucccugagccucaaaggggagacagugaaugacugucaugcugaaauuaucucucggagaggcuucauucgcuuucuguauuccgagcuuaugaaguacaacagccaaacggccaaagauucuaucuucgaaccugccaagggaggcgagaaacugcagauuaagaagaccguuuccuuucaccucuauaucagcacagcucccugcggggacggagcccuguucgauaaaucuugcagcgaccgggcgauggaauccaccgagagcagacauuacccuguguuugagaaucccaagcagggcaaacugcgcacaaaggucgaaaacggggagggaaccaucccuguggaaucuuccgauauuguucccacgugggacggcauccggcuuggggagagacuccggaccaugagcuguuccgacaaaauucugcgcuggaacgugcugggccuccagggagcucugcuuacacacuuccugcaaccgaucuaucucaagucugucacccugggcuaccuguucagccaggggcaucuuacaagagccauuugcugucgggugaccagagauggauccgccuuugaggacggccuccgccacccuuucaucgugaaucaccccaagguugggcgggucucuauuuacgauagcaaaagacaguccggaaagacgaaagaaacaucugugaacuggugccuggcugacggcuaugaucuggagauccucgacgggacccgcggcacaguggauggaccuagaaaugaacugagccgggucuccaagaaaaacaucuuucuucuguucaagaagcucuguagcuuucgcuacagacgggaccugcugcgccuuucuuauggcgaggccaaaaaggcggcuagagauuacgaaaccgccaaaaauuauuucaagaaagggcucaaggacaugggauacggcaacuggauuuccaagccccaggaggagaaaaauuuuuaucugugcccgguguga

SEQ ID NO: 65521 - RNA, 435 nt, Artificial Sequence
  derived and/or modified sequence opt5 from ADAT2__Homo_sapiens__NP_001273188
augguguacaacaaugaggucguuggcaaggggagaaacgaagugaaucagaccaaaaacgccacacggcacgcugagaugguggccaucgaccaaguccuggauuggugccgccagagcggaaagucccccucugaaguguucgagcauacgguucucuaugugaccgucgaaccuuguauuaugugcgcggcugcccugagacuuaugaaaaucccgcuggugguuuacggcugucagaaugagcgguuugggggaugcggcagcgugcucaacauugccuccgcugaccugcccaauacagggcgcccuuuccaguguauccccggauauagagccgaggaagcugucgagaugcuuaagaccuuuuacaaacaagaaaacccuaaugcccccaagucuaaggugcggaaaaaggagugccagaaaagcuga

SEQ ID NO: 65522 - RNA, 1104 nt, Artificial Sequence
  derived and/or modified sequence opt5 from ADAT3__Homo_sapiens__NP_612431
augauccugugcagcagacucugucugccccaguccgccucucuucggauggagccugcuccgggccugguggaacaacccaagugccucgaggccgggagcccugaacccgagccugcgcccuggcaggcucugccuguccuuuccgaaaaacagucuggagacguugagcuggugcucgccuacgccgcuccggugcuggauaagcgccagaccagcagacugcucaaagaggucuccgcccugcacccccuuccugcucaaccccaucugaagcgggugcgcccuucuagagacgccggcagcccccacgcgcucgaaaugcugcuuugucuggccgggccggcuuccggaccucggagccucgccgagcugcugccccgcccugcuguugaucccagaggccucgggcagcccuuccuggugccugucccggcccggcccccucuuacacgcggacaguuugaagaggcgagagcccauuggcccacgucuuuccacgaggacaaacaggugaccuccgcucuggccggccggcucuuuagcacacaagaacgcgcugccaugcagucucauauggagagagccguuugggcugcgcggcgcgccgcugccagaggccugcgggccgugggggcugucgugguggauccugccuccgacagaguccuugcgaccggacacgauugcagcugugcugacaacccccugcuccacgccguuauggugugcguggaucuggucgcccgcggccaggggcggggaacauaugacuucagaccguuuccugcuuguucuuucgcccccgcugccgcgccucaggccgugcgcgcuggcgccguucggaagcuggaugcugacgaagaugggcuccccuaccugugcaccggauaugaccuuuacgugacaagagagccuugugccaugugcgcgauggcccugguccaugcucgcauucuccggguguuuuauggcgcccccuccccggacggcgcucuggggaccagauuccgcauccacgcccggccugaucuuaaucauagauuucaaguuuuccgcggagugcuggaggaacagugucgguggcucgaccccgauacguga

SEQ ID NO: 65523 - RNA, 1944 nt, Artificial Sequence
  derived and/or modified sequence opt5 from ADCK3__Homo_sapiens__NP_064632
auggccgcuauccugggcgacaccauuaugguggccaaggggcucgucaaacugacacaggcggcuguugagacgcaccuucaacaucugggaaucggcggggaacucauuauggccgccagagcucugcagagcaccgccguggagcagaucggaauguuccuuggcaaggugcaggggcaagauaaacacgaagaguacuuugcugaaaacuucggaggccccgagggcgaguuucauuucuccgucccucacgccgcgggggccucuacagacuuuagcuccgcuucugccccggaucagagcgcucccccuucccugggacaugcccacucugaaggccccgcgccugccuauguggcuagcgggcccuuccgggaggccggauuuccuggccaggcuuccagcccgcucgggcgcgccaauggaagacuguucgccaacccccgggacucuuuuuccgcuaugggcuuccagcgcagauuuuuccaccaagaucagagcccuguuggcgggcugaccgcggaagacauugagaaggcccggcaggcuaaagcccgccccgagaauaagcagcauaagcaaacacucucugaacacgccagagagcggaaagugccugucacccgcaucggaagacuggcuaacuuuggcgggcuugccgugggacugggcuucggggcgcucgcugaaguugccaagaaaucccugcggagcgaggaucccucuggaaagaaagccgugcuuggcuccagcccguuccuguccgaagcuaaugccgagcgcaucgucagaacacucugcaaggugcggggcgcugcccugaagcuggggcagaugcucucuauucaggacgaugcguuuaucaacccucaucuggccaaaauuuucgagcgcgugagacaaagcgcugacuuuaugccccuuaagcagaugaugaaaacccugaauaacgaucucggaccuaauuggcgggacaagcuggaauacuucgaggaaagacccuuugccgcugccuccaucggccagguccaccuugcgcgcaugaaagggggacgggagguugccaugaagauucaguaucccggcguggcucaaagcaucaacucugaugugaauaaccugauggccguccucaauauguccaacaugcugccugaagggcuguucccggagcaccucauugacgugcugagacgcgagcuugcucuggaaugugacuaccagcgggaggccgccugcgcuagaaaauuucgcgaucuccugaagggccaucccuucuuuuauguuccugaaaucguggacgagcuuuguagcccccacguccugacgaccgaacucgugucuggauucccucuggaucaggcggagggccugagccaggagauccggaaugaaauuugcuacaacauccucguucugugucuuagagagcuguuugaguuccauuuuaugcaaacagaccccaacugguccaauuucuucuaugauccgcagcagcacaagguggcccuccuggacuuuggggcuacccgcgaauacgaucggucuuucacagaccuguacauucagaucauuagagccgccgcugaucgcgaccgggagaccgucagagccaaaagcaucgaaaugaaguuucuuacgggauaugaggugaaagucauggaagaugcgcaucucgacgcuauccugauucugggcgaggccuucgccuccgacgaaccuuuugauuucgggacacaaagcaccacagagaagauccacaaccucauucccgugaugcugcggcaccgccuuguuccucccccugaggaaaccuacucucugcauagaaaaaugggaggcuccuuucucaucugcagcaagcugaaggcucgguuccccuguaaagccauguuugaggaagcguauucuaauuacugcaagagacaggcucagcaguga

SEQ ID NO: 65524 - RNA, 1512 nt, Artificial Sequence
  derived and/or modified sequence opt5 from ADCK4__Homo_sapiens__NP_001136027
auguggcugaaggugggcgggcuccugagaggaaccggcgggcagcuuggacaaacagucggcuggcccugcggggcccugggaccuggcccgcaccgguggggccccugugggggaagcugggcucagaaauucuaccaggacggcccugggcgcggacucggcgaggaagauaucagacgggcccgcgaggcgagaccccggaagacgccucgcccccagcuguccgacagaucucgggaacgcaaaguuccugcuagcagaauuucccggcuugccaacuuugggggacuggccgugggccucggccugggggugcuggcugagauggccaagaaaucuaugccgggaggccgccuccaaagcgauaauuccuucaucucuccccagcugcagcauauuuuugaaagaguccggcagagcgcugacuucaugccucgcuggcaaaugcuuagagugcuggaggaggaacucgggcgggauuggcaggccaagguugcgucccuggaggaagugcccuuugccgcugccagcaucggacagguccaccagggccuucugagagacgggaccgagguggcuguuaagauucaauauccuggaaucgcccagucuauccaguccgaugugcaaaaccuccuggcgguccugaaaaugagcgccgcucuccccgccggccuguucgcugagcagucucuucaggcccugcagcaagaacucgccugggagugcgacuaccgccgggaagcugcgugugcccagaauuuuagacagcugcuugcuaacgauccguucuuucgcgugccugccguggucaaggagcugugcacaacccggguucucggcauggaacuggccgggggagugccccuggaccagugucaaggccucucccaggaucugagaaaucagauuugcuuccagcuucugacacucugucugcgcgagcuuuuugaguuccgguuuaugcaaaccgacccuaacugggcuaauuuccuguaugaugccagcucucaucaggugacacuccuggacuucggggcguccagagaauuuggaaccgaguucacggaccacuacaucgaagucgugaaagcugccgccgauggcgaccgcgauugcguucugcaaaagagccgggaccucaaauuucugaccggguucgagacaaaggcuuuuuccgaugcccauguggaagcugucaugauucuuggcgagcccuucgccacccagggacccuaugacuuuggcucuggggagacagcgagacgcauccaggaucugauuccugugcuccugcggcacagacuguguccgcccccugaagagaccuacgcccuucaccggaagcucgcuggagccuuccuggcuugcgcccaucugcgcgcgcacaucgccuguagagaccucuuucaggauacguaucaucgguacugggcuagcagacagcccgacgccgcuacagccggcucccugccuaccaaaggggauagcuggguugaccccucuuga

SEQ ID NO: 65525 - RNA, 4374 nt, Artificial Sequence
  derived and/or modified sequence opt5 from ADCY10__Homo_sapiens__NP_001161221
augcugguguucggcgacgaaacccacagccauuuucucgucaucgggcaggccguugaugacgugagacuggcucaaaacauggcccagaugaaugaugugauucuuucccccaacugcuggcagcugugugaccggucuaugaucgaaauugagagcgucccugaucagcgcgcggugaagguuaauuuccucaaaccgcccccuaacuuuaauuucgacgaauuuuucacaaagugcacgaccuuuaugcacuacuaucccuccggagagcauaaaaaccugcuuagacuggcuuguacacucaagccugaucccgaacuggagaugucucugcaaaaauacgugauggagagcauccucaagcagauugacaauaagcagcugcagggcuaucuuuccgaacugcggccugucaccaucguguucguuaaccucauguuugaggaucaagacaaagccgaagagaucgggccggccauucaggaugcuuacaugcacaucacaucugugcugaagauuuuccagggacagaucaauaaagucuuuauguucgacaagggcugcagcuuucuuuguguguucggguuccccggagagaaagugccugaugaacugacccaugcccucgagugcgcuauggacauuuuugacuucuguucccaaguccacaagauccagacaguuagcauuggcguggccucuggcaucguguuuugcgggaucgucggacacaccgugcgccaugaauauacgguuauuggccagaaggugaaccuggcggccagaaugaugauguacuaucccgggaucgucaccugugauuccgugacauacaauggaagcaaccugccugcuuacuucuuuaaagagcuccccaagaaaguuaugaagggcguggccgacucugggccgcuguaucaauacuggggacggaccgaaaaagucauguucggcauggcuugccuuauuuguaaucgcaaggaggauuauccucugcucggcagaaacaaagagaucaauuacuuuauguauacaaugaagaaguuccugauuuccaacagcucucaggugcuuauguacgaagggcugcccggauauggcaaaucccagauccucaugaagaucgaguaccuggcccaggggaaaaaccaccggauuaucgcgauuagccugaauaagaucuccuuucaucaaaccuucuacacgauucagauguuuauggccaacguccucggacuggacacaugcaaacacuauaaggaacgccagaccaaucuuagaaacaaggugaugacacugcucgaugagaaauucuacugccugcuuaaugacaucuuucacguucaguucccuaucucucgggaaauuagccgcauguccacccugaagaaacaaaagcagcucgagauccuguucaugaaaauucugaagcucaucgugaaggaggaaagaauuaucuuuauuaucgaugaggcucaguucgucgacagcaccucuuggcgguuuauggaaaaacugauccgcacacuucccauuuucaucauuaugucccugugucccuuugugaacaucccuugcgccgcugccagagccguuauuaagaaucggaacacgaccuauaucgugaucggcgcuguccagccgaaugauauuagcaacaaaaucugucucgaccugaaugugucuugcauuagcaaggagcuggauuccuaccuuggggaaggaucuuguggcauccccuucuauugcgaggagcuccugaaaaaccuggaacaucacgaggugcucguuuuucaacagacagaaagcgaggagaagaccaauagaacauggaacaaucuguucaaguacuccauuaaacuuaccgaaaagcugaacauggucacgcuccauagcgacaaagagucugaagaggugugucaccugacauccggcgugcgccugaagaaccuuagcccucccaccucucucaaagaaaucucccugauccagcuggacagcaugcggcucucccaucagaugcuggucagaugcgcggccauuaucgggcuuaccuuuacaaccgagcuccuguucgagauucugccuuguuggaauaugaagaugaugaucaaaacacuggcuacgcuuguggaaucuaacauuuucuauugcuuccgcaauggaaaggagcuccaaaaggcccugaaacagaacgaucccagcuuugaaguucacuaccggucccugucucucaagccgagcgagggcauggaccacggggaagaggagcagcugagagaacuugagaaugaagugaucgagugucaucgcauccgguucugcaacccuaugaugcagaaaaccgccuacgaacuguggcucaaggaucaaagaaaagcuaugcaccugaagugcgcccgcuuccuggaggaggacgcgcaucggugugaucacugcagaggacgcgacuuuauucccuaucaccauuucacagucaauauccggcuuaacgcucucgauauggacgccauuaagaaaauggccaugucccacggcuuuaagaccgaagagaaacugauccugagcaauucugaaauuccugagacauccgcuuucuuucccgagaacagaagcccugaagagauccgggaaaagauucucaauuucuuugaucaugugcugaccaaaaugaagacgucugacgaggauaucaucccccuugaauccugucagugcgaggagauucuggaaaucguuauucucccgcuggcccaccauuuccuggcucuuggggagaacgacaaggcccuguacuauuuucucgaaaucgcgagcgccuaccugauuuucugugauaauuauauggcuuacauguaucucaacgagggccagaaacugcuuaagacccugaaaaaggacaaaucuuggagccaaacauuugaauccgccaccuucuacagccucaagggagaggugugcuucaauaugggccagaucguccuggcuaagaaaaugcugcgcaaggcccuuaaacugcucaacagaaucuuuccuuacaaccugauuucucucuuccugcacauccacguggagaagaaucggcauuuucacuauguuaacagacaggcgcaggaauccccuccgcccgggaaaaagcgccuugcccaacuguaccggcagacagugugucucagccugcuguggagaauuuauuccuacucuuaucuuuuccauugcaaauacuaugcucaccuggccgucaugaugcagaugaauaccgcucucgagacgcagaacuguuuucaaaucauuaaggccuaccuggacuacagccucuaucaucaccuggccggauacaagggcgugugguucaaauaugaagugauggcuauggagcacaucuuuaaucuuccccugaagggggaaggaaucgagauugucgcguacguugccgagacacugguguucaacaaacucaucaugggccaucuggaucuugcuauugaacuggggucccgcgcccuccagaugugggcccugcuccagaaucccaacagacacuaucaaucucugugccggcuuagccgcugucugcugcucaauuccagauacccucagcugauccaggugcuuggccggcugugggagcucucugucacccaggaacauauuuuuagcaaggcuuucuuuuauuucgugugccuggacauccuccuguacuccggauuuguuuaccgcacauucgaggagugccuugaauuuauucaccaauaugagaacaauagaauccugaaauuucacagcggccugcuccuggggcuuuacucuuccguggccaucugguaugcgcggcugcaggaaugggauaacuucuacaaguuuagcaaucgcgcuaagaaccuccugcccagacggaccaugacccucacauauuacgacggaauuucucgcuauauggagggccagguccugcaucuucagaaacaaaucaaggaacaguccgagaaugcccaggccagcggggaggaacugcugaaaaaccucgagaaccugguggcucagaauacgaccggaccuguuuucugucccagacuuuaccaccugauggccuacgugugcauucucaugggcgaugggcaaaaguguggccuguuucugaacacagcgcuccggcuuucugaaacccagggaaauauccuggagaaaugcuggcugaacaugaauaaggaauccugguauagcacauccgagcucaaggaggaccaguggcugcagaccauucuuagccugccuucuugggagaaaaucgucgcuggcagagugaacauccaagaucuccagaagaauaaauuccugaugcgcgccaacacgguugacaaucauuuuuga

SEQ ID NO: 65526 - RNA, 3360 nt, Artificial Sequence
  derived and/or modified sequence opt5 from ADCY1__Homo_sapiens__NP_066939
auggccggcgcucccagagggggaggcgggggaggcgggggagccggcgagccuggcggggcggaacgggcugccggaaccagccgcagacggggccugcgcgccugcgacgaggaguucgcuuguccggagcucgaagcccuguuuagaggguacacacuucggcuggagcaggcugccacgcucaaggcgcuggccgugcuuucccugcucgcuggagcccuggcucuggccgagcuccugggcgcgcccgggccugcccccggacuugcuaaaggcucucacccuguccauugcguucuguuccucgcccugcuuguggugaccaacguccgcagccugcaagugccccagcuccagcagguuggccaacuggcucugcucuuuucccugacauucgcccuucuguguugcccuuuugcccucgggggaccggcuagaggcucugcgggggccgcuggaggccccgccaccgccgaacaggggguguggcagcugcuucuggucacauucgugagcuaugcucuccugccuguucggucccugcucgccaucggauuuggccugguggucgcggcuucucaccuucuggugaccgccacacucgugcccgccaagcgcccuagacuguggcggacccuuggcgcuaaugcccugcuguucgucgggguuaacauguacggaguguuugugcgcauucugacggagagaagccagcggaaggcuuuccugcaagcccgcuccuguaucgaagauagacuccggcuggaggacgagaaugaaaaacaggagagacuucugaugagccuccugccccgcaacgucgcgauggaaaugaaagaggauuuucugaagccgccugaacggauuuuccauaagaucuauauucagagacacgacaaugugucuauccuuuuugccgauaucguuggcuucaccgggcucgcuucccagugcacagcccaagagcuggugaaacugcucaacgagcuguucggaaaguuugacgaacuugcuaccgagaaucauugucgccggauuaaaauccugggcgauugcuacuauugugucagcgggcucacacagcccaagaccgaccacgcccacugcuguguggaaaugggccuggauaugauugacacgaucacaucuguugcggaggccaccgaaguggaucugaacaugagagucggacuucauacaggccgcgugcucugcgggguccugggacugcggaaauggcaguacgacgugugguccaaugauguuacccucgcuaacgugauggaggccgcuggccugccugggaagguccacauuaccaagacaacgcuugccugccugaauggagacuaugagguggaacccggcuacgggcaugagagaaacagcuuccucaaaacccacaauaucgaaacauuuuucauuguucccucucaccgccggaagaucuuuccuggccugauccuguccgacauuaaaccggccaagagaaugaaauucaagaccguguguuaccuucucguccaacugaugcauugccgcaaaauguuuaaggcugagauccccuucagcaacgugaugacaugugaagaugacgauaagcggagagcgcugcggaccgccuccgagaaacuccgcaauagaucuagcuuuuccacgaacgugguuuauacaaccccuggaacccgggucaacagauacauuagccgccugcuugaggcucggcagacagaacuggagauggccgaccucaauuucuuuacccugaaguauaaacacguggaaagagagcagaaguaccaucagcugcaagaugaguauuucacaucugccgugguccuuacgcucauccuggcugcccuguuuggccucguguaccugcuuauuuucccccaguccguugugguccugcuccugcugguguucugcaucuguuuucuuguugcgugcgugcuguaucuccacaucacccgcguccaguguuucccugggugccugacaauucagaucagaaccgugcucuguauuuuuaucguugugcugauuuacagcgucgcucaaggaugcguggugggcugucuucccugggccuggucuagcaaaccgaacuccucucuggucguucucagcuccgggggacagcggacagcccugccuacccugcccugcgaaagcacgcaucacgcccuucugugcugucucgugggcacccugccucucgcuaucuucuuucgcgugucuucccugcccaagaugauccuucugagcgggcucacaaccucuuacauucugguccuggagcuuuccggcuauacaagaaccggaggcggggcggugagcggacgguccuacgaaccuaucguugcuauucuccucuucucuugcgcccuggcccuccacgcucgccagguggacaucagacugcggcuugauuaucugugggccgcucaggccgaggaagaacgcgaggacauggaaaaggucaaacuggauaauagacggauucucuuuaaccugcuucccgcgcauguggcccaacacuuccugaugagcaauccgcgcaacauggaccucuacuaucaguccuacucucagguuggcgugauguuugcuagcaucccuaauuucaacgauuuuuauauugagcuggacgggaauaacaugggagucgaaugucucagacugcuuaaugagaucaucgccgacuucgaugaacugauggagaaggacuuuuacaaagauauugagaagaucaaaacgauuggcuccacauacauggcugccguggggcuggcccccaccagcggcacaaaggcuaagaaaucuaucuccagccaucucucuacccuggcggacuucgccauugaaauguucgauguucuugacgagaucaacuaucaguccuacaaugauuuugugcugcgggucggaaucaacgugggccccguggucgcugggguuauuggagccagacgcccucaauaugacaucuggggcaauaccgugaacguggccagccggauggauucuacagggguccagggacgcauucaggugacggaagagguucacagacuccugcggagaugcccguaccacuucgugugucgcggcaaggucagcgugaaaggcaagggggaaaugcucaccuauuuucuggagggacggacagacggcaacgggucccaaaucagaagccuuggacuggaucgcaaaaugugccccuucggccgggcugggcugcagggaagacggccucccguuuguccuaugcccggcgugucuguccgcgccggccucccuccccauuccccggggcaguaccugccuagcgcggcugccggaaaggaggccuga

SEQ ID NO: 65527 - RNA, 3276 nt, Artificial Sequence
  derived and/or modified sequence opt5 from ADCY2__Homo_sapiens__NP_065433
auguggcaggaggccaugagacggcgcagauaccugcgggaccgcagcgaagaggcugccggcgggggagauggccuccccagaucccgggacuggcuguaugaaucuuacuauugcaugagccaacagcacccucuuaucguguuccugcuccugauugucaugggguccugucuugcgcugcucgcuguguuuuucgcccugggacuggagguugaagaucauguggccuuucucaucaccgucccgacagcucuggccauuuucuuugcuaucuucauucuugugugcaucgagucuguuuuuaagaaacugcuccgccuguucagccuugugaucuggauuugucuggucgccaugggcuaccucuuuaugugcuucgggggaacggugucccccugggaccagguuuccuuuuuccuguuuaucauuuucguggucuauaccaugcugccuuucaacaugagagaugcgaucauugccagcgugcucacauccagcucucacaccaucgugcuguccgucugucuuagcgcuacacccggcggcaaggagcaucugguuuggcagauucucgccaaugugaucaucuuuauuugcgggaaccuggcuggagccuaccacaaacaucuuauggaacuggcgcuccaacagaccuaucaggacacauguaauugcaucaagucucggauuaaacuggaguucgaaaagcgccagcaagagagacugcuccugucccuucugccugcccacaucgcuauggagaugaaggccgaaauuauccagcggcuccagggccccaaagcugggcagauggagaacaccaauaacuuucacaaucuguacgugaagcgccauacgaacgucagcauccuuuacgccgauauugugggauucaccagacuggccucugacuguuccccuggcgaacucguucacaugcugaaugagcuguuugggaaauucgaucaaaucgcuaaggaaaacgagugcaugcggauuaaaauccucggagacuguuauuacugcgugagcggccugccgauuucccuucccaaucaugcgaagaacugcgucaagaugggccuggauaugugugaggccaucaaaaaggugcgcgacgcuacagggguugauaucaauaugagagugggaguccacucuggcaacgugcucugcggggucauuggacugcagaaauggcaguaugacguguggagccacgacguuacccuggccaaucauauggaagccggcggggugccuggacggguccacaucuccagcgugacacuugagcaucucaacggcgcuuacaagguugaagagggcgauggggacauuagagaucccuaucugaaacaacaccuggugaagaccuacuuugucaucaacccuaaaggagaacgccggucuccccagcaucucuucagaccgcgccacacgcuggacggcgccaagaugcgggcguccgugagaaugacacgcuaucuugagagcuggggagcugccaagccuuuugcccaucugcaccaccgggauucuaugaccacagagaaugggaaaauuagcaccaccgacgugcccaugggccagcauaacuuccagaauagaacacuccgcacgaagucccagaaaaagcgguuugaagaggaacugaacgagagaaugauccaagcuauugaugggaucaaugcccagaaacaguggcugaagucugaagacauccaacgcauuagccuucucuucuacaacaagguucuggagaaagaguaccgggcuaccgcccugccugcguuuaaguauuacgucacaugugccugccucaucuucuucuguauuuuuaucgugcagauucuggugcuucccaaaaccuccguccugggcaucagcuucggagcugccuuucuccugcuggcuuucauccuuuuugugugcuucgccggccagcuccugcaguguucuaagaaagcgucuccccugcucauguggcugcuuaagagcucugggauuaucgccaauagaccuuggccgcggauuucccugacaaucauuaccacggcuaucauccucaugauggccguuuuuaacauguucuuucugagcgauuccgaagagacaauucccccuaccgcuaauaccacaaacaccucuuucagcgccuccaauaaccaaguggccauccugcgcgcucagaaucucuuuuuccuucccuauuuuauuuacucuugcauccugggacugauuagcuguuccgucuuccucagagugaacuaugaacugaagaugcuuaucaugaugguugcgcuggugggcuacaauacaauccuccugcacacgcacgcccauguccugggggacuauagccaggugcuuuucgagcggccuggaauuuggaaagaucugaagaccaugggcucuguuucccucagcaucuuuuucauuacacugcucgugcuggggagacagaacgaguacuacugccgccuugacuuucuguggaaaaacaaguucaaaaaggaacgggaggaaaucgagaccauggaaaaucucaacagaguccugcuggagaaugugcuucccgcucacguggccgagcauuuucuggcccgcucucucaagaacgaggaacuguaucaccaauccuacgacugugucugcguuauguucgcuagcauuccggauuuuaaagaguucuauacagaaucugacgugaauaaggaaggccucgagugccugagacuucugaacgagaucauugccgauuuugacgaucuccugagcaaaccuaaguucuccggaguggagaaaaucaagaccaucggcagcacguacauggcggcuaccgggcugucugccguccccucccaggaacauagccaggaaccugagcggcaauauaugcacauuggaacaaugguggaauuugccuucgcucuuguuggcaaacuggacgccaucaauaagcacuccuucaacgauuuuaagcuccgcguggggauuaaucauggacccgucaucgcgggcgugauuggggcucagaaaccucaguacgacaucuggggcaacaccguuaauguggccucuagaauggauagcacaggaguccuggacaagauccaggugaccgaggagacgucccucguucugcaaacacuuggcuauaccuguacaugccgggggauuaucaacgugaaaggaaagggcgaucugaaaaccuacuucgucaauaccgaaaugucucgcagccugucccagucuaacguggccagcuga

SEQ ID NO: 65528 - RNA, 3435 nt, Artificial Sequence
  derived and/or modified sequence opt5 from ADCY3__Homo_sapiens__NP_004027
augcccagaaaccagggcuucagcgagccugaauacuccgccgaguauucugcugaauacagcgugucccugccgucugaccccgaucgcggggucggacggacccacgagaucagcguuagaaauuccggcucuugccucugucugccucgguuuaugcgccuuacauucgugcccgaaagccuggagaaccucuaucaaacguacuuuaagagacagcggcaugagacccugcuugugcuggucguguucgccgcgcucuuugacugcuauguuguggucaugugugcugugguuuucuccagcgauaaacuggccucucuggccguggcugggauuggacucguccuggacaucauucuuuuugugcugugcaagaaaggccuccugccugaucgcgugacaagacggguccuucccuacguucuguggcuccugaucaccgcccagauuuucuccuaucuggggcucaauuuugcucgcgcccacgcggccagcgacacagugggauggcaaguguucuuugucuucuccuuuuucaucacccugccucuuucucugagcccgaucgugauuaucucuguuguguccugugucgugcauacacucguucugggcgugaccgucgcucagcagcagcaggaagaacuuaagggcaugcaacugcucagagaaauucuggccaacguguuccuguaccucugcgcuaucgccgucgggauuaugagcuacuauauggcggaucggaaacaccgcaaggccuuucuggaggcuagacagucccuugaggugaagaugaaucuggaagaacagucucagcaacaggaaaaccucaugcugagcauccuucccaaacauguugccgacgagaugcugaaggauaugaaaaaggacgaaucccagaaagaucaacagcaguucaauacgauguacauguaucggcacgagaacgugagcauucucuuugcugacaucgucggauucacccagcugucuuccgccuguagcgcccaagagcuggugaagcuccugaaugaacuuuuugcucgcuucgauaagcuggcggccaaauaccaccagcucagaaucaagauucugggcgacugcuauuacuguaucugcgggcugccugacuaucgggaggaucaugcuguuuguucuauucuuaugggacucgccaugguggaagccaucagcuacgucagagagaaaacaaagaccggcguggacaugcgcguggggguucacacaggaaccguccugggcggcgugcuggggcagaaacgguggcaguacgaugugugguccacggacgucacaguggcuaacaagauggaagccggaggcauucccgggagaguucauaucucucaaagcaccauggauugccucaaaggagaguuugacguggagccuggcgaugggggaucccgcugcgacuaucuggaagagaagggcaucgaaacauaccuuauuaucgcgagcaagcccgaggucaaaaagaccgcuacccagaauggccugaacgggucugcccucccgaauggagccccugcuuccagcaaaucuuccagccccgcccugauugaaacaaaggagccuaacggcuccgcucacucuagcggguccacgucugagaaacccgaggagcaggaugcccaggcggacaaucccagcuucccuaacccgcggagacgccugcggcuucaagaucucgccgacagagugguugacgcuuccgaagaugagcacgagcugaaccagcugcucaaugaagcccugcuugagcgcgaaagcgcucagguggucaagaagcggaacaccuuucugcucucuaugagauucauggaccccgagauggaaacacgcuauuccguggagaaagagaagcagagcggagccgcguuuucuuguuccugcguugugcugcuguguaccgcccuugucgaaauccucauugauccuuggcugaugacaaauuacgugaccuucauggugggcgagauccugcuccugauccuuacgauuugcagccuggcugccaucuuuccccgggcuuucccuaaaaagcucgucgccuucucuacauggauugacagaacccggugggcccgcaacaccugggcuaugcuggcgaucuuuauucugguuauggccaaugugguggauaugcuuagcugucuccaauauuacacagggcccuccaacgcuaccgccggcauggaaacagagggaagcugccuggaaaauccgaaauauuacaacuacgucgccgugcugucucucaucgcuacgauuaugcugguucaggugucccauauggucaaacuuacccugaugcuccugguggccggcgcgguugcuacaaucaaucuguaugccuggagaccuguguucgacgaguacgaucacaagcgguuuagagagcaugaccuucccauggucgcccuggaacagaugcaaggguucaacccuggacucaauggcaccgaucgccugccccucgugccuagcaaguauuccaugacaguuaugguguuucugaugaugcuuucuuucuacuauuuuagccggcacgucgagaagcuggcuagaacccucuuccuguggaaaaucgaagugcaugaccagaaggagcgcguguacgaaaugagacgguggaacgaggcccuggucacgaauaugcuucccgagcacguugcgcgccacuuucugggguccaaaaagagagaugaggagcucuauucucagaccuacgacgaaauuggagugauguucgcuagccugccgaacuuugccgauuucuacacagaggaguccaucaauaacggcgggauugaaugucuccgguuucugaacgagaucauuucugacuucgacagccuucuggauaauccuaaguuccgcgugaucaccaaaaucaagacaauuggcuccaccuauauggccgcuagcggagucacgcccgacgugaacacaaauggcuuugccucuuccaacaaagaagauaagagcgagagagaacgguggcagcaucucgcugaccuggccgauuucgcgcuggccaugaaagacacccuuacaaauaucaacaaucaaucuuuuaacaauuucaugcugcgcauugggaugaacaagggaggcguucucgcuggggugaucggagccagaaaaccccacuacgauauuuggggcaauaccgucaacguggcuucccggauggagagcaccgggguuaugggcaauauccagguggucgaggaaacacaggugauccugcgcgaguauggauuuagauucguccggagaggcccuauuuuugugaaggggaagggagaacuccugacguucuuucuuaaaggccgcgacaagcuggccaccuucccgaacgggcccucuguuacacugccucaucagguggucgauaauuccuga

SEQ ID NO: 65529 - RNA, 2736 nt, Artificial Sequence
  derived and/or modified sequence opt5 from ADCY5__Homo_sapiens__NP_001186571
augaaaagccagaaagagggcugcuguuccagaggggaccugucuauccaaaccggacccggcggggaaugggccccucggcgccucgugagcaacguccugauuuucuccugcacaaauaucguuggaguguguacgcacuacccggcugaggugucucagagacaggccuuucaggaaacccgggagugcauucaagcgcgccuucauagccagagagaaaaccagcagcaagagcggcugcuccuguccguccuuccccgccacguggcuauggagaugaaggccgauaucaaugccaaacaggaagacaugauguuccauaagauuuauauccagaaacacgauaacguuucuauccuguuugcugacauugagggcuucacaagccucgccucccaguguaccgcucaagaacuggugaugacacugaaugagcucuuugccagauucgauaagcuggcggccgagaaccauugccuucggaucaagauucugggggacuguuacuauugcgucagcggacucccugaagcucgcgccgaucacgcucacuguugcguggagaugggcauggacaugaucgaagccauuucucugguuagagaggugaccggcgucaaugugaacaugcggguggggauccauuccggacgcguccacuguggcguucuugggcugagaaaauggcaguuugauguguggagcaaugacgugacacucgcgaaccauauggaagccggaggcaaggcugggcggauucacaucaccaaagccacgcugaauuaccugaacggagauuaugaggucgagcccggcugcggcggggaacgcaaugcuuaccucaaggagcacucuaucgaaaccuuccugauucuuagaugcacacagaaacggaaggaggaaaaggccaugaucgccaaaaugaacagacaacgcaccaauuccauuggacauaacccuccccacuggggcgcugagcggccuuuuuauaaccaucucgggggaaaucaggugagcaaggagaugaaaagaaugggcuucgaagacccgaaggauaaaaacgcgcaggagucugccaaucccgaagacgagguugacgaauuucuggggcgcgcuaucgaugcccgguccauugacagacugcgcagcgagcacgugcggaaguuccuucugacauuuagagagccugaucucgaaaagaaguacuccaagcaggucgacgaucgcuucggagccuacguggcuugugccucucugguuuuccuguuuaucugcuucgugcaaaucaccauugucccccauagcaucuuuaugcucuccuucuaucugacguguagccuucugcucacacugguggucuuugugucuguuauuuacuccugcgugaaacuuuucccuagcccccugcagacccucucucggaagaucgucagaagcaaaaugaacuccacacuggugggcguuuuuaccauuacccugguguuccucgcggcuuuugucaauauguucacauguaacucucgcgaccugcuuggcugccuggcccaggagcacaauaucagcgccucccaggugaacgcuugucacguggccgaaagcgcuguuaauuauucucucggggaugagcaaggauuuugcggcuccccguggccuaacuguaauuuccccgaguacuuuacguauagcguccugcugucucuucucgccugcuccguguuccugcagaucagcuguauugggaagcuggugcucaugcuggcgaucgaacuuauuuacguccugaucguggagguuccuggagugacccucuucgacaacgccgaucugcuggucacagcuaaugccauugacuuuuucaacaauggcaccucccagugccccgaacaugcuacaaaaguggcccuuaagguugugacccccaucauuaucucugucuuugugcucgcgcuguaucugcacgcccagcaaguugagagcacggcucggcucgauuuccuguggaaacuucaggccacagaagagaaagaggaaauggaggaacugcaggcuuacaacagacggcuccugcauaacauccugccuaaggacguggccgcccacuuucuugcucgcgagagacggaaugacgaacucuacuaucaguccugcgagugugucgcggugauguucgccucuauugcuaacuuuagcgaguucuacguggaacuggaggccaauaacgaaggggucgagugccugagacuccugaaugaaaucauugccgauuuugacgagaucauuuccgaggaucgcuuccggcaacuugaaaagaucaagaccaucggcagcaccuauauggcugccucuggacugaacgacuccacauacgauaaaguuggcaagacccacauuaaggcgcucgcugacuuugccaugaaacugauggaucagaugaaguauaucaaugagcauagcuucaacaauuuucagaugaaaauugggcugaacaucggaccggugguggccggcgucauuggggcuagaaagccccaauacgacaucuggggaaauacagugaacguugccucucgcauggauuccacgggcgugccugacagaauccaggucaccacagauauguaucaggugcuugcggcuaauaccuaccagcucgaaugucggggcguugugaaagucaaggggaagggagagaugaugacauacuuccugaacggcgggcccccucugagcuga

SEQ ID NO: 65530 - RNA, 3507 nt, Artificial Sequence
  derived and/or modified sequence opt5 from ADCY6__Homo_sapiens__NP_056085
augagcugguucuccggccugcucgugcccaaggucgacgagagaaaaaccgccuggggagaacggaacggacagaagcgcucuagacggcgcggcacaagagcugggggauuuugcacgccucgguacaugagcugucugcgcgaugccgagccgcccuccccuacccccgcgggcccucccagaugcccuuggcaagacgaugcuuucauccggcgcgggggaccgggcaaaggcaaggaacuugggcugagagccguugcccucggauuugaggacacagaagugaccacaaccgcuggcgggacagccgagguggcucccgaugccgucccucggucuggacgcagcuguuggagacggcuggugcagguuuuccaguccaaacaguuucgcucugcgaagcuggagagacuguaucaacgguacuucuuucagaugaaucagagcucccucacccugcugauggccgugcucguccugcuuacggcugugcugcucgccuuccacgcugcccccgcgagaccucagcccgccuauguugcucugcuugccugcgcugccgcccuguuugugggccucauggucguguguaaccgccauagcuuccggcaagacucuauguggguggucuccuacguugugcuggggauucuggcugcggugcaggucggaggcgcccucgcugccgauccgagaagcccuucugccggccuguggugccccguguuuuucguuuauaucgcuuacacccuucugccuauucgcaugcgggccgcggugcucuccgggcugggacuuagcacacugcaccucauccuggcuuggcagcugaauagaggcgacgccuuucucuggaagcagcugggggccaacguccuucuguuccucuguaccaaugugauuggaaucugcacacauuaucccgcugaaguuucucaacgccaggccuuccaggagacccggggcuacauccaagcuagacugcaccuucagcaugaaaaccgccagcaggagcggcugcuccuguccgugcugccccaacacgucgccauggagaugaaagaagauauuaauacgaagaaagaggacaugauguuucacaagaucuacauucagaaacaugauaacgugagcauccucuucgcggacauugaaggguuuacaucccuggccucucaguguaccgcucaggagcuugucaugacacugaaugaacucuucgccagauuugauaagcuggcugccgagaaccacugccugcgcaucaagauucuuggagacuguuauuacugcgugagcggccucccugaggcgcgggccgaccaugcucacugcuguguugaaaugggcguggauaugaucgaggccaucucccuggucagagaagugaccgggguuaaugugaacaugcgggucgggauucacagcggccgcgugcauugcggggugcugggacucagaaaauggcaauucgacguuuggucuaaugaugucacccuggcuaaccacauggaggccggcgggcgggccggcagaauccauauuacacgcgcuacgcuucaguaucugaauggagacuacgaaguggagccgggccggggcggagagagaaacgcguaucucaaggaacagcacaucgagaccuuucugauucugggcgccucccagaaacgcaaggaagagaaagcuaugcuugccaagcuccaaagaacacgggccaacagcauggaagggcugaugccccgcugggugccugauagagcuuucucucggaccaaagacagcaaggccuuucgccagaugggaaucgaugacuccucuaaggauaauagaggcacacaggacgcgcugaaccccgaggaugaggucgacgaguuccucagccgggcuaucgacgcccgcuccauugaucagcugagaaaagaccaugugcggcgcuuucuucugaccuuccaaagagaagaucucgaaaagaaauacagccggaagguugacccuagauuuggggccuauguggcuugugcccugcuggucuucugcuucaucuguuuuauucagcuucucaucuucccccacucuacgcugaugcugggcauuuacgcguccaucuuucuccugcuucugaucacagugcucauuugcgcuguuuacagcuguggaucucuguucccgaaagcccugcagcgccuuucccggagcaucgugagaucccgcgcccacucuaccgcugucggcauuuuuagcgugcuccugguuuucaccuccgccaucgcuaauauguuuacaugcaaccauaccccuauucggucuugugccgcgagaaugcugaaucucacacccgccgauaucacggcuugccaccuucaacagcuuaacuauagccuggggcucgacgccccucugugugagggaaccaugcccacaugcuccuucccugaguacuuuauuggcaauaugcugcuuagccugcucgcuucuuccguguuccugcauaucagcucuaucgggaagcucgccaugauuuuuguccugggacuuaucuaucuggugcuccugcugcuugggcccccggccaccauuuucgauaacuacgaccugcuccugggggugcacggccucgcuuccagcaaugaaacauuugauggacuggacugcccugcggccggccgcgucgcucuuaaguauaugacccccguuauccugcucguguucgcccuggcccuguaccuucacgcucaacagguggagucuacggcccggcuggauuuccucuggaaacugcaggcgaccggggaaaaggaggaaauggaggagcuccaggcuuauaacagacgccugcuucauaauauucugcccaaagacgucgccgcccacuuucuggcucgggaaagacggaacgaugagcucuacuaccagagcugugaaugcguggccguuauguucgcguccaucgcuaauuuuagcgaguucuauguggaacuggaggccaacaaugagggagucgaaugucuucgccugcucaacgagaucauugccgacuuugacgaaaucauuucugaggaaagauuccggcagcuggagaagaucaaaacaauuggcuccaccuacauggcugccagcgggcucaacgcuuccacauaugaucaagugggacgcucucauaucaccgcccuggcggacuacgccaugagacuuauggagcagaugaagcacaucaaugaacauagcuuuaacaauuuccagaugaagauuggccugaacauggggccuguuguggcuggcgucaucggagcccggaaaccgcaguaugauauuuggggcaauacggugaacguuuccucuagaauggacagcacaggggugcccgaucgcauccaagucaccacagaccuguaccaggugcucgcugccaagggauaucagcuggagugccggggcguggucaaaguuaaggggaaaggagaaaugaccaccuacuuucuuaauggcggcccuuccucuuga

SEQ ID NO: 65531 - RNA, 3243 nt, Artificial Sequence
  derived and/or modified sequence opt5 from ADCY7__Homo_sapiens__NP_001105
augcccgccaagggcagauacuuccugaacgagggggaagagggaccugaccaggaugcucucuaugaaaaauaccaacugaccagccagcacggcccgcuucugcucacacugcuucugguggccgcgacggcuugcgucgcccucaucauuaucgccuuuucccagggggaccccucucggcaucaggcuauucugggaauggccuuccugguucucgcuguguuugccgcgcugagcgugcuuauguaugucgagugucugcuccgcagauggcugcgggcccuugcucugcucaccugggccugccugguggcucugggcuacguucucguguucgaugccuggacaaaggcggccugugcuugggaacaagucccuuucuuccuguuuaucguguucguuguguauacccuucugcccuuuuccaugcgcggggccgucgcugugggagccgugucuacagccagccaccuccugguccuuggcucccugaugggcggguucaccacaccuucuguuagagugggacuccagcugcuggcuaaugcggugauuuuucucugcggcaaccugaccggggccuuccauaaacaccagaugcaggacgcuagccgggaucuuuuuacguacaccgucaaguguauccaaauccgcagaaaacugcggauugagaagcgccagcaggagaaucuccugcuuuccgugcugcccgcccauaucagcaugggaaugaagcucgccauuaucgaaagacugaaagagcacggcgaccggcgcugcaugccugauaacaauuuccacucucuguauguuaagagacaucagaacguguccauucucuacgcugacaucgucggguucacacaacuggccagcgauuguucuccgaaagaacuugugguugugcugaaugagcucuuuggaaaguucgaccagauugcgaaagcuaacgagugcaugcggaucaagauccugggcgauuguuacuauugcgucuccggccugcccgugagccuuccuacccacgcccgcaauugugucaagauggggcucgacaugugccaggccauuaaacaagugagagaagcuacaggaguugauaucaacaugcgggugggcauucauucugggaauguccugugcggagugaucggccugagaaaguggcaguacgacguuuggucccacgacgugagccucgccaaccgcauggaggcugccgggguccccggacgggugcacauuaccgaagcgacgcugaaacaucuugauaaggccuaugagguggaagacggccacggccagcagagagauccuuaccugaaagagaugaauauccgcacauaucucguuaucgacccccggucccaacagccgccucccccuucucagcaucugcccagacccaagggggaugcugcccugaaaaugcgcgcuagcguccggaugaccagauaccuugaguccuggggagccgcgcgcccuuuugcccaccucaaccaucgggaaagcgugucuuccggcgagacacacgugccgaaugggagacgccccaagagcgucccucagcggcacagacggacccccgaccgcucuaugagcccuaagggaagauccgaagaugacucuuaugaugacgagaugcugagcgcuauugaaggccuguccagcacccggcccuguugcucuaaauccgaugacuucuacacauuugggagcaucuuccucgagaagggcuuugagagagaauaccgccuggccccgauuccucgggcuagacaugacuucgccugugccucucuuaucuuugugugcauucugcucguucacgugcugcugaugccccgcacggcugcgcuuggagucuccuucggccucguggccuguguucuggggcuggugcucggacugugcuuugcuaccaaauucagcagauguugcccugcccggggcacacuuuguaccaucuccgagcgcgucgaaacacaaccccugcucagacugacccuggccgugcuuacgaucgggucucuccugacaguugcuauuaucaaccugccucucaugcccuuucaggugccggagcugccugucggaaacgaaaccggccuucuggccgcgagcuccaagacccgggcucucugcgagccccugcccuauuacacauguucuugcgugcugggguucauugccugcagcguguuccuucgcaugucccuggagccuaaagucguucuccugaccguggcccucguggcuuaucugguccuuuuuaaucugagcccguguuggcagugggauugcuguggccagggacucggcaaccugacaaagcccaaugggacgaccucuggaacaccuuccugcagcuggaaggaccugaaaaccaugacaaacuucuaccuugugcuguuuuauaucacccuccugacgcucucuagacaaauugauuacuauugucggcuggacugccuuuggaagaaaaaguucaaaaaggaacaugaggaauuugagaccauggagaauguuaaccgccugcuccuggaaaaugugcugcccgcccacgucgcggcucacuucaucggcgauaaacuuaacgaggacugguaccaucaguccuacgauugugugugcguuauguuugccagcgugccugacuucaaagucuuuuauacagaaugugaugugaauaaggaggggcuggaaugccucagacugcucaacgagauuaucgccgacuucgaugagcugcuucugaaacccaaguuuucuggaguugaaaagaucaagaccauuggcagcacauacauggcugccgcugggcuguccguggccagcggccacgagaaucaggaacucgagcggcagcaugcgcacaucggagucaugguggaauuuucuauugcccugauguccaaacuugacggcaucaaccgccauagcuuuaauuccuucagacugcggguggggauuaaccacggaccugucaucgcuggcguuaucggggccagaaagccccaauaugauauuuggggaaauaccgugaacguggcuucucgcauggagagcacgggcgagcucgggaagauccaggucacagaagagaccuguacaauucugcagggccucggauacuccugcgaaugccggggccugaucaacgugaaagggaagggagagcuuagaaccuauuucguuuguaccgacacagccaaauuucaaggccuggggcugaauuga

SEQ ID NO: 65532 - RNA, 3756 nt, Artificial Sequence
  derived and/or modified sequence opt5 from ADCY8__Homo_sapiens__NP_001106
auggagcugagcgacgugagaugccucaccggcuccgaggagcuguacacaauccaccccacgccuccggccggggauggacggucugcuagccgcccccagagacuucuguggcaaaccgccguccggcauauuacagaacagcgcuucauccacggccauagagggggauccggcucugggagcggaggcuccggcaaggcgucugacccugcugggggaggccccaaccaccaugccccucagcucagcggggauuccgcccugccccuuuauagccugggaccuggcgagcgggcucacucuaccugugggacaaaaguuuuuccggaacgcuccggaagcggcucugccuccggcagcgggggaggcggggaccucggauuccugcaccuggauugcgcucccucuaauuccgacuuuuuccucaacggcggguacagcuauagaggagugauuuuuccuacccugcgcaauuccuucaagucucgggaucuugagagacuguaccagcgguauuuucucggccaacgcagaaaaagcgagguggucaugaacgugcuggacguucuuacaaagcugacccuccuggugcugcaucucucccuggccagcgcgcccauggauccucuuaaaggcauccugcucggguucuuuacgggaauugaagucgugaucugugcccugguugugguccggaaggacaccacaucucacaccuaccuucaguauuccggcguggugacaugggucgcuaugaccacgcagauccuggccgcugggcucggauacggccugcugggggauggcauuggauacguucucuucacacuguuugccaccuauagcaugcuuccccugccgcucacaugggcgauccuggccggccuugggaccucucugcuccaggugauucugcaaguggucaucccucgccuggcugugauuagcaucaaucagguuguggcccaggcuguccucuucaugugcaugaacaccgccggaauuuuuaucuccuaccugucugacagagcccagcggcaggcuuuccuugagacaagacgcuguguggaagcgcggcugagacucgagacggagaaucaacgccaggaacggcugguucugagcgugcuucccagauucgucgugcucgagaugaucaacgauaugaccaaugucgaagacgagcaucugcaacaccaguuucaccgcauuuauauccaucgguacgaaaacguguccauucuguucgccgacguuaagggcuuuacaaaucucagcaccacacugucugcucaggagcuugugagaaugcugaacgaacucuucgcccgcuuugaucggcuggcccacgaacaucacugccugagaaucaaaauucuuggggacuguuauuacugcgucuccggacucccugagccccgccaggaucaugcucacuguugcguggaaaugggccugagcaugaucaagaccauccgguauguuagaucucggacgaaacacgacguggauaugcgcauugggauccauuccggcagcguccuguguggagugcucggccugagaaaguggcaauucgacgugugguccugggauguugacauugccaauaaacuugagucugggggaauccccggccggauucacaucagcaaggcgacacuggauugccucaacggggacuacaaugucgaagagggacauggcaaggagagaaacgaauuucugcgcaaacacaacaucgagaccuaccugauuaagcagccugaagauucccuucucucucugccggaggacaucgugaaagaaagcguguccagcucugaccggagaaauuccggggcuaccuucacagagggcagcuggucucccgagcugccuuuugauaacauugucggaaagcagaauacccucgccgcccugacacgcaacuccaucaaucuucugcccaaccaccucgcucaggcccugcaugugcaaagcggcccugaagagauuaauaaaagaaucgaacacacgauugaccugcggucuggggauaaacuucgcagagagcauaucaagcccuucagccucauguuuaaggacuccagccuggagcacaaguauucucagaugcgggaugaaguuuucaaauccaaccuggugugcgcuuuuaucguccuccuguucauuaccgccauccagagccuucugccguccucucgcgugaugccuaugacaauucaguucagcauccucauuaugcugcauuccgcgcugguucuuaucaccacagccgaggacuacaagugucugccccucauccugagaaaaaccugcuguuggauuaaugaaacguaucucgcucggaacgugaucauuuuugccucuauccugauuaauuuccuuggagcuauccugaacauccucuggugcgauuuugacaagagcauuccucugaaaaaucugaccuucaacuccucugccgucuuuacagauaucuguagcuaccccgaguauuucguguuuaccggcguucuugcgauggugacaugcgccgucuuccugcgccucaauuccgugcugaagcucgcugugcugcuuauuaugaucgccauuuacgcucugcucaccgaaacggucuaugccgggcuguuucugagauacgacaaccuuaaccacagcggagaggauuuccugggcacaaaggagguuucucuccugcucauggccauguuucugcuugcuguguucuaccacgggcaacagcuggaauauaccgcgcggcuggacuuucucuggcgcgugcaggccaaagaggaaaucaaugagaugaaggaacugagagagcauaacgagaauaugcuucggaacauccugccuucccacgucgcuagacauuuccucgaaaaagaucgcgacaaugaggaacuguacagccagucuuaugacgccgugggcguuauguucgccuccauucccggauuugcugauuucuacagccaaacagagaugaacaaucagggcguggaaugucuccggcugcuuaacgagaucauugccgacuuugaugagcugcugggggaagacagauuccaggauaucgagaagauuaaaaccaucggaucuaccuauauggcggucuccggccucagcccggaaaagcaacagugcgaggacaagugggggcaccugugugcucuugccgauuuuucccuggcccucacagagagcauucaggaaaucaauaaacauucuuucaacaauuuugagcugcgcaucggaauuagccacggcuccgugguugcuggcgugaucggggccaagaaaccucaguacgacauuuggggaaagacggucaaccucgcgucucggauggauagcaccggcguguccgggagaauccaaguucccgaagagacauaucugauucuuaaagaccagggauucgcuuuugauuaccgcggcgaaaucuacgugaaggggaucucugagcaggagggaaagauuaaaaccuauuuccugcugggccggguccagcccaauccuuuuauccucccgcccagacgccugccuggccaauacagccuugccgccguggugcuggggcucguccagucccugaaccggcagagacagaagcaacuccugaaugaaaacaacaauacaggaauuaucaaaggccacuauaaccggcgcacccuucugucucccagcgggacggagccuggagcucaggccgaaggcacagacaaguccgaucugcccuga

SEQ ID NO: 65533 - RNA, 4062 nt, Artificial Sequence
  derived and/or modified sequence opt5 from ADCY9__Homo_sapiens__NP_001107
auggccucucccccucaccagcaacugcuccaucaccauuccaccgaggugucuugcgacagcuccggcgauucuaacagcgucagaguuaagaucaauccgaaacagcuguccucuaacagccaccccaagcauuguaaauacuccauuagcagcuccugcucuagcuccggggacagcggaggcgugccucggcgcgugggaggaggcgggagacuucggcgccagaagaaacugccccaacucuucgaaagagcuucuucccgguggugggauccuaaguuugacagcgucaaucuggaggaagccugucuugagcgcugcuucccccagacacagagacgguuucgcuaugcgcuguucuacaucggauuugcuugucuccugugguccauuuauuucgccgugcacaugagaucucggcugaucguuaugguggccccugcucucugcuuucugcuugucugugugggcuucuuucuguucacguuuaccaagcucuacgcccgccacuaugcuuggacaagccuggcccuuacccugcucguuuucgcgcugacacuggccgcucaguuucaggugcucaccccggucuccggcagaggggauagcucuaaccugacagccaccgcucggcccacggauaccugccuuucccaaguggggagcuucucuauguguauugaagugcuguuccuccuguacacagucaugcaucuuccucuguaucucagccugugccugggcguugccuacuccgugcucuuugagaccuucggguaccacuuucgcgacgaggcguguuuccccucuccuggagccggcgcucugcauugggaacuucugagcagagggcuccugcacggaugcauccacgccaucggcgugcaucuuuuugucaugucccaggugcggagcagaucuacauuccugaaaguuggccaguccauuaugcacgggaaggaccucgagguggaaaaagcucugaaggagcgcaugauccauagcgucaugccccggauuaucgccgaugaccugaugaaacagggagaugaggaaucugaaaauuccgugaagagacacgccaccagcuccccgaagaaccgcaaaaagaaaucuagcauucaaaaggcuccuaucgcguuucggcccuucaaaaugcagcagauugaagagguuuccauccucuuugccgacaucgugggcuucacgaagaugucugcuaauaaaagcgcccaugcccuggucgggcuucugaacgaucucuuuggaagauucgaccgccugugcgaagagacaaagugugagaagauuuccacccugggcgacugcuauuacuguguggcugggugcccugaaccccgggccgaucacgcguauuguugcaucgagaugggacuuggcaugauuaaagcuaucgaacaauuuugucaggagaagaaagaaauggucaauaugagagugggcguucacacagggaccgugcucugcggcauucugggaaugcgccgguucaaguucgacgucuggagcaacgaugugaaucuggccaaccucauggagcagcuggggguugccggaaaagugcauaucucugaggcuaccgccaaguaccuugacgauagauaugaaauggaggacggcaaggucaucgaacgccuggggcaguccgugguggcugaucaacucaaaggccugaagacauaccugauuagcggacagcgggccaaagagucuagauguuccugcgcggaagcccuucucagcggcuuugagguuaucgacgggucucaggucagcuccggaccccggggccaggggacggcuagcucuggaaauguguccgaucuggcccaaaccgugaagacauucgacaaccugaaaaccuguccuagcugcggcauuacauuugcuccgaaguccgaggccggggcggaaggcggagcuccccagaauggcugccaggaugagcacaagaacucuaccaaagccagcgggggaccuaaccccaagacgcagaauggccuccuguccccuccccaagaagagaaacuuacaaacucucagaccagccugugugagauccuccaggaaaaggggcgcugggccggagucucccuggaccagucugcucugcuuccgcucagauucaaaaauauucgggagaagaccgacgcccauuuuguggauguuaucaaggaagacagccugaugaaagauuauuucuuuaagccucccaucaaccaauucucccugaauuuucucgaccaggagcuggaaagaagcuaccgcacaucuuaccaggaggaggugauuaaaaacuccccugucaagaccuucgccagccccacauuuucuucccuucuggauguguuccucagcacgaccguuuuucugacacugucuaccacaugcuuccuuaaauaugaagcugcgaccgugccucccccgccugccgcucucgccgucuucuccgccgcucugcugcucgaggugcugagccuugccguuuccauccggaugguguuuuuccuggaagacgucauggcguguacgaagagacuccuggaguggauugcuggcuggcugccccgccacugcaucggggccauucuugugagccugcccgcccucgcuguguacucucacgucaccagcgaauaugagacaaauauccauuuuccuguuuucaccggcuccgccgcgcugauugcuguggugcacuacuguaacuuuugccaacucucuagcuggaugagauccucucuggccacagucgugggagccggcccgcuucugcuccuguauguuagccugugucccgauuccucugugcuuaccagcccucuggacgcuguccagaauuucuccagcgagcggaaccccugcaauucuuccgugccucgcgaucucagacggcccgccagccugaucgggcaggaaguugugcucgucuuuuuccugcuucugcuccuggugugguuucugaaccgcgaguucgaaguuucuuacagacuucauuaucacggagacguggaggcugaucugcaucggacgaaaauccaguccaugcgcgaccaagccgauuggcuccugagaaauauuaucccuuaccacgucgcggaacagcucaaggugagccagacauacuccaagaaccacgacucuggcggggugauuuuugccagcaucgucaauuucuccgaguucuaugaggaaaacuacgagggaggcaaagaauguuaucggguucugaacgagcuuauuggggacuuugaugagcugcugagcaagcccgacuacucuuccaucgagaaaaucaagaccauuggcgcuacauauauggccgcuagcggacucaauaccgcccaggcccaagauggcucucauccgcaggagcaucugcagauccuuuucgaauuugcuaaagagaugaugcgcgugguggacgauuucaacaauaacaugcugugguuuaauuucaagcucagagucggguuuaaccacggaccucugaccgcgggcgugauugggacaacgaagcuccuguacgacaucuggggagauaccguuaauauugccagccggauggacacaaccggcguggaaugcagaauccaggucuccgaggagucuuaucgcgugcuuagcaaaaugggcuacgauuucgacuaccgggggacaguuaacgugaagggaaaaggccaaaugaagaccuaucuguaccccaaauguacggaucacagagucaucccucagcaucagcuguccauuucucccgacauccgcgugcaagucgaugggagcauuggacgguccccgacagacgaaaucgcuaaucucgugccuagcguucaguauguggacaagaccucucugggcuccgauagcuccacccaggccaaggacgcccaccuuucucccaaaagaccuuggaaggagcccgucaaagcugaggaacgcgggcgguuuggaaaggccauugaaaaagaugacugcgaugagacaggcaucgaggaagcgaacgagcugaccaagcucaaugugagcaaguccguuuga

SEQ ID NO: 65534 - RNA, 531 nt, Artificial Sequence
  derived and/or modified sequence opt5 from ADCYAP1__Homo_sapiens__NP_001093203
augaccaugugcagcggcgccagacuggcucuccugguguacgggaucauuaugcacuccucugucuauagcucccccgccgcggcuggacuucgguucccuggcauccgcccggaggaagaggccuacggggaagacggaaacccccugccugauuuugacggcucugagcccccuggggccggaagccccgcuuccgccccuagagcugccgcggccugguaucggccggcuggccgcagagauguugcccauggcauucucaaugaggcuuaccggaaggugcuggaccagcuuucugccgggaaacaucugcaaagccucguggcgcgcggagucggcgggucccugggaggcggggccggagaugacgcugaaccccugagcaagagacacucugauggcaucuucacagacuccuauagccgguaccgcaaacagauggccgugaagaaauaucucgcugccguucugggcaagagauacaagcagcgggugaaaaacaaggggcgcagaauugccuaccuuuga

SEQ ID NO: 65535 - RNA, 1407 nt, Artificial Sequence
  derived and/or modified sequence opt5 from ADCYAP1R1__Homo_sapiens__NP_001109
auggccggcgugguccacguuagccuggcugcccuccugcuucugcccauggcgccugcuaugcauuccgacugcaucuucaagaaagagcaggccaugugucucgaaaagauucaaagagccaacgagcugaugggguuuaaugauucuagcccgggaugccccggcaugugggacaacaucaccuguuggaaaccugcucacgugggggaaauggugcuugucuccugccccgagcuguuccggauuuuuaauccugaucaggugugggaaacagagacgaucggagagucugacuucggcgauagcaacucccucgaccugucugauauggggguugugagccgcaauuguaccgaagacggaugguccgagcccuuuccucauuacuucgaugccugcggcuuugacgaauaugagagcgagacaggcgaucaggacuacuauuaccugucugucaaggcucucuauaccgugggguacuccacaagccugguuacccuuacaaccgccauggugauucuguguagauuccggaaacuccacugcacgcgcaacuuuauccauaugaaucuguucgucucuuuuaugcuuagagcgaucuccguguucauuaaggauuggauccuguaugccgaacaggacagcaaccacuguuuuauuucuaccguggagugcaaggcugucaugguuuucuuccacuacugugugguguccaauuacuuuuggcuguucaucgaaggacucuaucuguuuacacuccuggucgagaccuucuuuccggaacggcgcuacuucuauugguacacaauuaucggcugggggacccccacggugugcguuacagugugggccacccuuagacuguauuuugacgauacaggaugcugggacaugaacgauagcaccgcucucuggugggucauuaaaggcccugugguuggguccaucauggugaauuucguccuguuuaucggaauuaucgugauucuuguccaaaagcugcagucucccgacaugggcggcaacgagagcuccaucuaccuccggcuggcccgcagcacccugcuccugauuccucuuuucgggauccauuauacaguguuugcguucucucccgagaauguuuccaaaagagaacggcugguguuugagcucggacugggcagcuuccagggguucgucguggccguucuuuacuguuuucugaacggagaagugcaggcugagaucaagcgcaaauggagaucuuggaaggucaaucgguacuucgccguggauuuuaagcaccgccauccgagccucgcuuccucuggcgugaacgggggaacgcaacugagcauucuguccaaaucuagcucccagaucagaaugagcggccucccugccgacaaccuggccaccuga

SEQ ID NO: 65536 - RNA, 2214 nt, Artificial Sequence
  derived and/or modified sequence opt5 from ADD1__Homo_sapiens__NP_001110
augaacggcgacagcagagccgcuguggucaccucucccccuccgacaacggccccgcacaaggagcgguacuucgaucgcguugacgaaaauaacccugaguaucugagagaacggaauauggcgcccgaucuccgccaggacuuuaacaugauggagcagaaaaagagagugucuaugauccugcaaagcccugcuuucugcgaggaacuugaguccaugauucaggaacaguuuaaaaaggggaaaaaucccaccggacugcucgcccugcaacagaucgccgauuucaugacaaccaacgugccuaaugucuacccggcugcuccccagggcgggauggccgcccuuaacaugucucugggaauggugacaccuguuaaugaccuccggggcagcgauuccauugcguaugacaagggggagaagcugcugcgcuguaaacucgccgcuuuuuacagacuggccgaucuuuucggauggucucagcugaucuauaaccauauuaccacacgggugaauagcgaacaagagcacuuucucaucguccccuucggccugcuuuacuccgaggugaccgcuagcucucugguuaagaucaaccuccagggcgacauuguggaucgcggguccacgaaucugggagucaaccaggccggcuuuacccugcauagcgcgaucuaugccgcuagaccugacgugaaaugcgugguccacauucauacacccgccggggcugccguuucugccaugaaguguggacuccugccgaucuccccugaagcucuuagccugggcgagguggcguaccacgauuaccacgggauucucguggacgaagaggaaaaaguccugauccagaagaaucuuggacccaagucuaaagugcugauucuccggaaccauggccugguuuccgugggcgagagcgucgaggaagccuucuauuacauccacaaccuggugguugcuugcgagauccaagugcgcacccucgccuccgccgggggaccugacaaucugguccuucugaaccccgaaaaguauaaagcuaagucuagaagccccggcuccccugugggggagggaacaggcagcccgcccaaauggcagauuggggaacaggaguuugaggcccucaugcggaugcuggauaaucuuggauaccgcaccggcuauccuuacagauaucccgcgcugcgggaaaagucuaaaaaguacuccgacgucgaggugccugcuagcguuacgggcuacucuuucgccagcgauggggacuccggaacauguucuccccucagacauagcuuucaaaagcagcagcgcgagaaaacccgguggcugaacuccggcagaggggaugaagccagcgaagagggacagaauggcuccucccccaagagcaaaacaaaguggaccaaagaggacgggcaccgcaccucuacauccgcugugccuaaccuguucgucccccucaauacgaacccuaaggaagugcaagagaugcggaauaagaucagagaacagaaccugcaggauauuaaaaccgccggcccccagagccaaguucuuugcggaguggucauggaccgcucccuggugcagggcgagcucgugacagcuucuaaggccaucauugagaaagaauaucagccucacguuaucgucagcaccacagggcccaauccguucaccacgcugacagaucgggagcuggaagaguacagacgcgaaguggagcggaagcagaaaggauccgaggaaaaccuugacgaggcgagagaacaaaaggagaagucuccucccgaucagcccgccgugccucauccgcccccuagcacccccaucaaacucgaagaggaccuggucccugagcccaccacaggcgacgauuccgacgcugccaccuuuaagccuacacugcccgaucucagcccggacgaaccuucugaggcucugggguuccccaugcuugaaaaagaggaagaggcccaccgcccucccuccccgacggaggcgccuaccgaagccagccccgagccugcucccgaucccgccccuguggcugaagaggccgccccgucugcuguugaggaaggagcggccgcugaccccggcuccgaugggagcccuggcaagucucccagcaaaaagaagaaaaaguuucggacaccuuccuuccugaaaaagagcaaaaagaaaucugacuccuga

SEQ ID NO: 65537 - RNA, 1728 nt, Artificial Sequence
  derived and/or modified sequence opt5 from ADD2__Homo_sapiens__NP_001171984
augcccagacggcgcgugccuggcgccaacugcaagccgaccgggaaaaugagcgaggaaacaguccccgaggcugccuccccucccccuccccagggacaaccuuacuucgacagauuuucugaagaugacccggaguauaugcggcugcgcaauagagcggcugaucuccggcaggacuucaaccugauggaacagaagaaacgcguuacgaugauccuucagagccccuccuuuagagaggagcuggaaggccucauucaagagcagaugaagaaagggaauaacucuagcaauaucugggcccugcggcagauugccgauuucauggcuuccaccucucacgccguguuuccuacaagcuccaugaacgugagcaugaugacccccaucaaugaccuucauacagcugauucucugaaccucgccaagggagaacgccugaugagauguaagauuuccagcgucuaccggcugcucgaccuguauggcugggcgcagcuuucugauaccuacgugacacugcgcguuuccaaagagcaagaccacuuccucaucagcccuaagggggugucuugcuccgaggucaccgccagcucccugaucaaagugaauauucuuggagaaguuguggagaagggcucuagcuguuuucccgucgauacgaccggcuucugccugcauuccgcuaucuaugccgcuagaccggacgugcgguguauuauccaccuccauaccccugccacagcggccgugagcgcuaugaaaugggggcugcugcccgucucucacaacgcccuccugguuggagauauggcuuacuaugacuuuaauggcgaaauggagcaggaagccgaccgcauuaaccuucagaagugccuggggccuacauguaagauccucgugcugagaaaucacggaguggucgcccuuggcgauaccguggaggaggcuuucuacaaaauuuuucaucugcaggcggccugcgaaauccaaguuuccgcucucagcucugccgggggaguggagaaccugauccugcucgaacaggagaagcaccggccccaugaagucggcagcgugcagugggccggcuccacguucgggcccaugcaaaaaucuagacugggagagcacgaguuugaagcucuuaugcgcaugcuggacaaucucggcuaccggacaggguauaccuacagacacccuuucguucaggagaagacaaaacauaagagcgaaguggagauuccggccaccgucaccgcguucguguuugaagaggauggagcucccgucccugcccugcgccagcacgcccagaaacaacagaaggagaagacacgguggcuuaacacgcccaacaccuaucugagagugaauguugcugacgaagugcagcgcuccaugggcagcccucggcccaaaacaaccuggaugaaggccgaugaggucgaaaaaucuuccagcgggaugccgaucagaauugagaacccuaaucaguucgugccccucuacacagacccucaagagguucuggaaaugcgcaacaagauccgggagcagaauagacaggaugugaaaucugcuggaccccagucccaacugcucgccagcgucauugcggaaaagucccgcucuccuguggagcagcggcugccccuuaccggcggcgaaacgugucugccgagcggguccucugugccuggagccggccuccaggaccccuga

SEQ ID NO: 65538 - RNA, 2121 nt, Artificial Sequence
  derived and/or modified sequence opt5 from ADD3__Homo_sapiens__NP_058432
augagcuccgacgccucucagggcgugaucaccacacccccuccgcccagcaugccucacaaggagagauacuucgaucggauuaacgaaaaugaccccgaguauauccgcgaaagaaacauguccccugaucugcggcaagacuuuaauaugauggagcagcgcaaaagagucacgcagauucuccagucucccgcuuuccgggaagaucuggagugccuuauccaagagcagaugaagaaagggcauaacccuaccggacugcucgcccugcagcagauugcggacuacaucauggcuaauagcuuuuccggcuucucuagcccgccccuuucccuggggaugguuacaccuaucaacgaucuccccggagccgacaccagcucuuaugugaagggcgaaaaacugacacgcuguaagcuggccucccucuacagacugguggaucuuuuugggugggcucaccuggccaauaccuauauuagcguccggaucucuaaggagcaagaccauauuaucauuaucccucgcggacucuccuucagcgaagcuacagccucuaaccuggugaaaguuaauauuaucggcgagguggucgaucagggcuccaccaaccuuaagaucgaccacacgggguuuagcccccaugcggccauuuacuccaccagaccggaugugaaaugcguuauccacauucacacacuggcuaccgccgcugugucuagcaugaaguguggaauccucccuauuucccaggagagccugcugcucggcgacgucgccuauuacgacuaccaggggucucuggaagaacaagaagaacggauccagcuucagaaagugcugggacccuccugcaaggugcucguccugcgcaaucauggcguuguggcgcuuggggaaacacuggaggaggccuuccacuauaucuuuaacgugcaacucgcuugugaaauucagguccaggcccuggcuggagccggcggcguggauaaucugcauguucucgacuuccagaaguacaaagccuuuaccuauacgguggcugcgagcgggggaggcggggucaacaugggaucucaccaaaaguggaaagugggcgagaucgaguucgaggggcugaugagaacacuugauaaucugggauaccggaccggcuaugccuaccgccacccucucauuagagaaaagccccggcauaaaagcgacguugagauccccgcuacagugaccgccuuuuccuucgaggaugacaccgucccucugucuccgcuuaaguauauggcccagagacagcagcgcgagaaaacacgguggcugaacagccccaacacguacaugaaggugaaugucccugaggaauccagaaacggcgagaccagcccccgcacaaagauuaccuggaugaaagcugaagauucuuccaaggugagcgggggaacaccuaucaaaaucgaggaccccaaucaauucguuccgcucaacaccaauccuaacgaggugcuggaaaagcggaauaaaauuagagagcagaaccgcuacgaucugaagacggccggcccccagucucagcuccuggcggggaucgucguggacaagccucccuccacaaugcaauuugaagaugacgaccacggaccucccgcuccgccuaaucccuucagccaucuuaccgagggcgagcuggaagaguauaaacggaccauugaaagaaagcagcaggggcucgaggaugccgaacaggagcugcuguccgacgaugccucuagcguuucccaaauccagucucagacacaaagcccccagaacgugccugagaaacuugaagagaaucacgaacucuuuuccaagagcuucauuucuauggaggucccggugauggugguuaacggcaaagacgauaugcaugacgucgaagaugagcuggcuaagcgcgugucccggcugagcaccucuacaacgaucgagaauauugaaaucaccaucaagucccccgagaaaauugaagaggugcucagcccugaaggaucucccagcaaguccccuagcaaaaagaaaaagaaguuuagaacacccucuuuccugaaaaagaacaaaaagaaagagaaggucgaggccuga

SEQ ID NO: 65539 - RNA, 5004 nt, Artificial Sequence
  derived and/or modified sequence opt5 from ADGB__Homo_sapiens__NP_078970
auggccuccaagcaaaccaaaaagaaagaggugcacagaaucaacuccgcucauggcucugacaagagcaaagauuucuaccccuuuggguccaauguccaaucugggagcaccgaacagaagaagggcaaauucccucuguggccggagugguccgaagccgacauuaacucugagaagugggaugcggggaaaggagcuaaggaaaaagacaagacgggcaagagccccguuuuucacuucuuugaggauccugaggggaaaaucgaacugcccccuucccugaagauuuauagcuggaaacggccccaggacauccuuuucucucagaccccugugguggucaagaaugagauuacauuugaucuguucuccgccaacgaacaucuccugugcagcgagcuuaugcgcuggaucaucucugagauuuacgccguguggaaaaucuuuaauggaggcauucuguccaacuauuucaagggcaccagcggggaaccgccccuccugccuuggaaacccugggagcacaucuacucucuguguaaggcuguuaagggacauaugccucucuuuaauuccuauggcaaauacguggucaagcuguauuggauggggugcuggagaaaaauuacaaucgacgauuuccuucccuuugacgaagauaacaaucugcuccugccggccaccacauacgaguucgaacuuuggccuaugcugcucagcaaggcuauuaucaaacuggccaacaucgacauucacguggcggaucggcgcgagcugggagaguucaccguuauccacgcccucacgggcuggcugcccgaagugauuucccuucauccuggguacauggacaaggucugggagcugcucaaggaaauccugcccgaguuuaaacuuucugacgaagcuagcuccgagagcaagauugccgugcuggauucuaaacucaaggagcccggaaaagaaggcaaggagggcaaggaaaucaaagacgggaaggaggugaaagaugucaaggaguucaaaccugaguccagccugaccacacugaaggcuccggagaagucugacaaaguucccaaggaaaaagccgaugcgagagacaucggaaagaaacggagcaaggauggcgagaaagaaaaguuuaaguucucccuccacgggucucgcccuagcuccgaggugcaauauagcgugcagucucuguccgacuguagcucugccauucagaccucccauauggucguguacgcuacauuuacaccccuuuaucuguucgagaauaaaaucuuuagccucgaaaagauggccgauuccgcugagaaacugagagaauacggacuuucucacauuugcagccacccuguucuggugacgcggucccgcucuuguccccucgucgccccgccuaagcccccuccccugccucccuggaaacugaucagacagaagaaggagacagugauuaccgacgaagcccaagagcucaucguuaaaaagccggagcgguuccuggaaaucagcuccccuuuucuuaacuaucgcaugacacccuucaccauucccaccgagaugcauuuugugagaagccugaucaaaaagggcauuccuccggggucugaucuccccuccgucagcgaaacagacgagacggcuacccacucucagacagaccugucccagaucaccaaagcgacaagccagggaaauaccgccucucaagugauucugggcaagggcacggaugaacagacagacuucgggcuuggagaugcucaucagagcgacggccucaaccuggagcgggagaucgucucccaaaccaccgccacacaggaaaagagccaggaggaacugccuaccacaaauaacucuguguccaaagagauuuggcucgauuuugaagacuucugcguuuguuuccagaacaucuacaucuuucacaagcccagcuccuauugccugaauuuccaaaaaucugaguuuaaguucagcgaggaacgcguguccuacuaccuuuuugucgauucucugaaaccuauugagcuccugguguguuucagcgcccugguuagauggggagaauauggagcucuuacgaaggacucucccccuaucgagcccggccuccugaccgccgagacauuuagcuggaaaagccugaagccggggucccucgugcugaagauucauaccuacgcgacaaaagcuaccgucgugcggcuuccugugggcagacacaugcuccucuucaacgccuauagccccguuggacacucuauccauauuugcuccauggucagcuuugugaucggcgaugaacacgugguccugccuaauuucgagcccgaaucuugucgcuuuacggagcagucccugcuuaucaugaaggccauugggaacgugaucgcuaauuucaaagacaagggaaaacucagcgccgcucugaaggaucugcagaccgcccauuacccgguuccuuuucacgacaaggaacucacagcgcagcacuuccggguguuccaucugucucuuuggagacugaugaaaaagguccaaauuaccaaacccccucccaacuuuaaguucgccuuucgcgcuauggugcucgaucuggagcugcuuaauuccagccucgaggaaguuucccugguggaguggcuggacgucaaauauugcaugcccacaagcgacaaggaauacucugccgaggaaguggcugccgcgaucaagauucaggccauguggcggggcaccuauguuagacuccugaugaaagcucgcaucccugauacgaaggagaacaucagcguggccgacacacuucagaaagucugggcugugcuggagaugaaucucgaacaguacgccgugucccugcugcggcuuauguucaagucuaaaugcaagagccuggaguccuacccguguuaucaagaugaagagaccaagauugccuuugcugacuacacagucaccuaucaggaacagcccccuaacucuugguucaucguuuuuagagagaccuuccucgugcaccaggauaugauucuggugcccaaagucuacacaacgcucccuaucugcauucugcauaucgugaauaacgacaccauggagcaaguucccaagguguuucagaaagucgugccuuaucuuuacacaaagaauaaaaagggguauaccuucguugcggaagccuuuacaggagauaccuacguggcugccagccgcuggaagcugcggcucaucggcuccucugccccgcugcccugucugagcagagacuccccuugcaacagcuucgcuauuaaagagauccgcgauuacuauauucccaaugacaagaaaauccuuuuccgguacucugucaaggugcugacgccucagcccgccacaauucaaguuagaaccuccaaaccggaugcguuuaucaagcuccaggugcuggaaaacgaggagaccauggucagcucuacagggaagggccaggcuauuaucccugccuuccacuuucucaaauccgaaaagggacugagcucccagucuagcaaacauauccuuuccuuccacagcgccucuaagaaagagcaagaaguguaugugaagaaaaaggcugcccagggcauucagaagucccccaaagggcgggcggucagcgcuauccaggacauuggacugccccucguugaggaagagaccacaucuacgccuacccgcgaggauagcuccucuacaccccugcaaaacuacaaguauaucauucaguguagcgugcuguacaauuccuggccucuuaccgaaucucagcugacauuugugcaggcccucaaagaccugaagaaaagcaacaccaaggccuauggcgagagacacgaagaacucaucaaucugggguccccggacagccauacgaucucugaaggacaaaaguccagcgucaccuccaaaacaacccggaagggcaaagagaagucuagcgagaaagaaaagacagcuaaggagaaacaggcccccagauucgaaccucagauuuccaccgugcacccccaacaggaggauccuaacaagcccuacuggauccuucgccugguuacagaacauaaugagucugagcuguuugaagugaaaaaggacaccgagcgggcugaugaaauuagagccaugaaacaggcgugggagacgacagagccggggcgcgccaucaaggcuagccaggccagacuccacuaccuguccggcuucauuaagaaaaccagcgacgcugaaucuccucccaucuccgagagccaaaccaagccuaaagaagaggucgaaacagccgcccggggagugaaggagcccaacucuaaaaauuccgcuggcagcgagucuaaggaaaugacccagacggggagcggauccgcgguuuggaaaaaguggcagcuuacaaagggccugcgcgauguggccaaaucuaccagcuccgagagcgggggagucuccucuccuggcaaggaagagagagaacagagcacacggaaagagaacauccaaaccgggccccgcacaagauccccgaccauucucgagacgucuccucggcugauccgcaaggcucucgaauuuauggaccugagccaguaugugagaaaaaccgauacagacccccuucugcagaccgaugagcugaaucagcaacaggccaugcagaaggccgaagagauucaucaguuccggcaacaccgcacaagaguccucuccauccggaacauugaccaggaagagagacugaaacuuaaagaugaggugcuggacauguacaaggaaaugcaggacucucucgaugaggcucgccagaagaucuuugacauucgggaagaguauagaaauaagcugcucgaggccgaacaccugaaacuugagacccuggcggcucaggaagccgccaugaagcuggagacggaaaagaugacacccgcuccugauacccagaaaaagaaaaagggcaaaaagaaguga

SEQ ID NO: 65540 - RNA, 1683 nt, Artificial Sequence
  derived and/or modified sequence opt5 from ADGRA1__Homo_sapiens__NP_001077378
auggaccugaagaccgugcucagccugcccagauacccuggcgaguuccuucacccggucguuuaugccugcacagcugugaugcugcucugucugcuugccuccuuugugacguacaucguccaucagucugcgauucggaucagccgcaaagggagacacacccugcucaacuucugcuuucaugcugcccugacauucaccguguuugccggaggcauuaaucggacaaaguaucccauccugugucaagcuguugggauugugcuccacuacuccacccugucuacaaugcuuuggaucggagucaccgcccgcaacaucuauaaacaggugacgaagaaagcuccucugugccucgauaccgaccagcccccuuaccccagacagccucugcuucgguucuaucugguuagcggcggggugccguuuauuaucuguggagucacagccgcgaccaauauucgcaacuacggcacagaagaugaggacaccgccuacugcuggauggcuugggaacccucccucggcgccuucuaugggccugcugccaucauuacgcuggugacauguguguacuuucugggaaccuauguccaacucagacggcaucccggccgcagauacgagcugcggacacagccugaggagcagcgcagacuugcgacccccgaagggggacggggcauccgcccggggaccccucccgcccacgaugcuccuggagccucuguucugcagaaugaacacagcuuccaagcucagcucagagccgccgcuuuuacacuguuccuuuuuacggcgaccugggccuucggcgcucuggccgugucccagggccauuuccucgacaugguguuuagcugccuguauggggccuucugugucacacugggacucuuugugcugauucaccauugcgcuaagcgggaggauguuuggcaguguuggugggccugcugcccucccagaaaggacgcgcaccccgcucuugaugccaacggcgccgcucuggggcgcgccgcuugucuccacucuccgggacugggccaaccccggggguucgcccauccucccggaccuugcaaaaugaccaaucuucaggcggcccagggccacgcuuccugucugagccccgccacaccgugcugugcuaagaugcauugcgaaccucucaccgccgacgaggcgcacgugcaucugcaagaggaaggcgccuuugggcacgauccccaucugcacggaugucuccagggcagaacgaaaccucccuacuucucucgccacccugcugaggaacccgaguaugccuaccauaucccguccagccuggacgggucuccucgguccagcagaacagauuccccucccucuagccuugacggacccgcuggcacccacacccuggccugcuguacacagggggacccguuucccauggucacccagccugaaggcuccgauggaagccccgcccucuacucuugcccuacacaacccggccgcgaggcugcgcuggggccuggacaccuggagaugcuucggagaacgcagucccuccccuucggcgggccgagccagaacggacugccuaagggcaaacugcucgaagggcugcccuuuggcaccgacggaacaggcaauauccgcaccgggccuuggaagaacgagacaaccguguga

SEQ ID NO: 65541 - RNA, 4017 nt, Artificial Sequence
  derived and/or modified sequence opt5 from ADGRA2__Homo_sapiens__NP_116166
augggcgccgggggaagacggaugcgcggcgcucccgccagacugcuccugccucuucugccguggcuccugcuucugcucgcgcccgaggcuagaggggccccuggaugcccccugagcauccgcuccuguaagugcucuggcgaaagaccuaaagggcugagcggaggcgugcccggcccugcccggcgcagagucguuuguuccgggggagaccucccggagcccccugaacccggccugcuuccuaacgggaccgugacacugcuccugucuaauaacaagauuacgggacuucggaauggcagcuuccuggggcucucccugcuggagaaacucgaucugcgcaacaauaucauuucuaccgugcagcccggagcuuuucuuggccugggcgaacucaagagacuggaccuuagcaacaaucggaucgggugccugacauccgagaccuuccaaggacucccgcgccugcugagacucaacauuagcggcaauaucuuuucuucccugcagccuggggucuucgaugagcuucccgcccugaaagugguugaccucggaacagaauuucugaccugugauugccaccuucgguggcugcucccuugggcucagaaccgcagccugcagcugucugagcauacacucugugccuaccccuccgcgcugcacgcccaagcucuuggcagccugcaggaagcccagcucugcugugagggggcucuggagcugcauacccaccaucuuauccccucucucagacagguggucuuccaaggagaccggcugccuuuucagugcuccgccagcuaucugggcaaugauacgcggauucgcugguaccacaaccgggcgccgguggaaggcgacgagcaggccgggauccuccuggcugaaucccuuauucacgauuguaccuucaucacaucugagcugacccucagccauauuggaguuugggccuccggcgaaugggagugcacagugagcauggcucaggggaaugccucuaagaaggucgagaucguggugcuggaaaccuccgccagcuauugccccgcugagagagucgcgaacaaucgcggagacuuucgguggccuagaacgcuggccggcauuacagcuuaccaaucuugucuucaguaucccuucaccagcguuccucucgggggcggagcccccggcacacgcgccucccggagaugcgaucgcgcugggcggugggaaccgggagacuacucucacugucuguauaccaacgauaucaccagagugcuguacacauuugugcucaugccuaucaacgccagcaaugcgcugacgcuugcucaucagcugcgcgucuacaccgccgaggccgcuuccuucagcgacaugauggacgugguuuauguggcccaaaugauucagaaauuucucggcuacgucgaucagaucaaggaacugguggagguuaugguggacauggcuucuaaccugaugcuugucgaugagcaccuccuguggcuggcccagcgggaagacaaagcgugcuccagaauugugggggcccucgagcggaucggaggcgcugcccugagcccccacgcucaacauauuucugucaaugcccgcaacguggcgcuugaagccuaucugaucaagccucacuccuacguugggcucacauguaccgcuuuccagagacgggagggcggagugcccggcacaagaccugggagccccggacagaauccgccucccgaacccgagccuccggccgaucagcaacugcgcuuccggugcaccacgggcagacccaacgucucccugucuagcuuucauaucaaaaauuccguggcucuugccucuauucagcucccucccagccuguucuccagccugccugccgcucucgcgcccccuguucccccggacuguacacugcagcuucugguguuucgcaacgggagacucuuccacucucauuccaauaccagccggccuggagccgcuggccccgggaagcgcagaggcgucgccaccccugugaucuuugccggaacaucuggcugcggggugggaaaccugaccgagcccguugcugucucccugcggcacugggccgaaggcgcggagccgguggcugccugguggagccaggaagggccuggagaggccggcggguggacaucugagggcugucaacuucgcagcucccagcccaaugugagcgcucugcacugccagcaucucggaaacgucgccgugcugauggaacucucugcguucccuagagagguuggcggggcuggagccggccugcaccccguggucuaucccuguacggcccuucugcuccugugccuguuugcuaccauuaucacauacauucuuaaucauuccagcauccgggugucccgcaagggguggcacaugcugcucaaccugugcuuccacaucgccaugaccucugcuguuuuugccggaggcauuacacucaccaauuaucagauggugugucaagcggucggcaucacgcugcauuacagcucccuuucuacccugcucuggaugggggugaaagccagaguucugcacaaggaacugacauggcgggcuccuccgccccaggagggagauccugcccuucccaccccuagccccaugcugcgcuucuaccucauugcuggcgggaucccucugauuaucugcggaauuacagccgccgugaacauccauaacuauagagaccacuccccguacuguuggcucgucuggcggcccucucugggcgcuuuuuauaucccuguggcgcuuauucugcugaucaccuggauuuacuuccucugcgccgggcugagacuucgcggaccccuggcucagaauccuaaagccggcaacagccgggccucccucgaagcuggcgaggagcugagagggagcacgcgccuccggggaucuggcccccugcuuuccgauagcgggucucugcuggccacaggauccgcgagagugggcaccccggggccucccgaagacggagauagccucuauucucccggcguccaacugggcgcucuuguuacaacccauuuucuguaccucgccaugugggccuguggggcucuggccgugucccagcgcuggcucccucggguggucugcagcugucuguauggaguggcggcuuccgcccuuggccuguucguuuucacccaccacugcgccagacgccgggacgugagagcuagcuggcgggccuguugucccccugcuucuccggccgcgccccaugccccuccccgcgcucugccugccgcugccgaggacgggagccccgucuuuggagaaggcccgccuucccucaagucuagccccuccgggucuagcggacacccucuggcccuuggccccugcaaacugacaaaucuccagcuggcucagucccaagugugcgaggcgggcgccgcugccgggggagaaggcgagccugagcccgccgggacgagaggaaaccucgcucaucggcacccgaauaacguucaucacggccgcagagcccacaagucucgggcgaaagggcauagagcuggagaagccugcggcaagaaucgccugaaggcccuucggggcggggcugccggagcgcuggagcugcucagcuccgaaagcggcucucugcacaacuccccuaccgauagcuaccuugggucuuccagaaauagccccggagccggccugcagcucgagggggaacccaugcugacaccuuccgagggaucugacaccagcgcugccccgcuguccgaggcuggccgcgccggccagcggagaagcgcuucucgcgauucccucaaagggggaggcgcccuugaaaaggagagccaucggagaucuuacccccugaacgcggccagccugaauggggcuccuaaaggaggcaaguaugacgaugugacacucaugggggccgaagucgcuuccggaggcuguaugaaaaccggccuguggaagucugagacgacaguguga

SEQ ID NO: 65542 - RNA, 3966 nt, Artificial Sequence
  derived and/or modified sequence opt5 from ADGRA3__Homo_sapiens__NP_660333
auggagcccccuggcagacggcgcgggagagcccagccgccccugcuccugccucuuagccugcucgcucugcuugcccugcucggaggcgggggaggcgggggagcggcugcccugcccgccggcugcaagcacgacggccggccucgcggggcuggcagagccgcuggagccgcggaagggaaaguggucuguuccucucuggagcucgcccaaguucugcccccugauacccuuccgaaccggacagugacgcugauccucagcaauaacaagauuuccgaacugaaaaauggaucuuucagcggccuuucccugcucgagcgccuggaccugagaaacaaucucaucucuagcauugaucccggggcuuuuuggggacuguccagccuuaagcggcuggaccucaccaacaaucgcaucggcugccugaacgccgauauuuucagaggccuuacaaaucuggugcggcucaaccugucugggaaucuguuuuccagccucucucagggaaccuucgacuaccuggcuucccuucgcagccuggaauuucagacagaguaucuccugugugauugcaacauccuuuggaugcauagaugggucaaagagaagaauaucaccgugcgggacacacgcuguguuuacccuaagucucugcaggcccaacccgugaccggcgucaaacaggaacuccugacgugcgauccuccccuggagcucccguccuucuauaugaccccuagccacagacaggugguuuuugaaggggacucccugcccuuccaguguauggcgucuuacauugaucaagacaugcaagugcuuugguaucaggauggacggaucgucgagacagacgagagccagggcauuuuuguggaaaagaacaugauccauaauugcucccugauugccagcgcucucaccaucucuaacauucaggccggguccacaggaaacuggggcugucacgugcagaccaaaagaggcaauaacacgcgcacagucgacaucguugugcuggagagcucugcucaguacugcccucccgaacggguggucaauaacaagggggauuucagauggccccgcacccuggccggaaucacagccuaucuucaauguacccggaauacccauggcagcgggauuuacccuggaaacccgcaggacgagagaaaggcuuggcgccggugcgauagaggcggguuuugggcggacgaugacuacucccgcugccaguaugccaaugaugugacacggguucucuacauguucaaccagaugccccugaaucugacgaacgcuguggccaccgccagacaacuccuggcuuauacagucgaagccgcgaauuuuucugacaagauggaugugaucuucguugcugagaugauugagaaguucggccgcuuuaccaaagaagaaaagagcaaagaacuuggagacgugauggucgauaucgccuccaacauuaugcuggccgacgagcgggugcucuggcuggcucagagagaagccaaggcuuguagccggaucguccagugccugcagcgcaucgccacauacagacuugcgggcggggcccacguguauucuaccuacuccccuaauauugcucucgaggccuauguuaucaaaagcacgggauucacaggcaugaccuguaccguguuucaaaaggucgcugccucugaccggacagggcuguccgauuacggaagacgcgaccccgagggcaaccuggauaaacagcucagcuucaagugcaauguguccaacaccuuuucuagccuggcgcuuaagaacacaauuguugaagccuccauccagcugccucccucucucuucagcccgaaacagaagcgggagcugagaccuacggacgauucccuguacaaacuucaacucauugcuuuucgcaaugggaagcuguuccccgccaccggcaacagcacaaaucuggcugacgauggaaaaagacggaccguggucacaccugugauccucaccaagaucgacggcgugaacguugauacgcaccauauucccgucaaugugacccugcgcagaaucgcccacggggccgacgcuguggcggcccggugggauuuugaccuucugaacggacagggcggguggaagucugauggaugucauauucucuauuccgacgaaaauaucacaaccauucagugcuacagccugucuaacuaugcuguccugauggaccuuacaggcuccgagcucuacacccaggccgccagccugcugcacccugugguuuauacgacagcuaucauucuccugcuuugucugcucgccgugaucgucucuuacaucuaucaccauagccugauucgcaucucccugaaaagcuggcacaugcuugugaaucugugcuuccauauuuuucucaccuguguuguguucgucgggggcaucacacaaaccagaaacgcgucuauuugccaggcugugggaaucauccugcacuacuccacccucgccacaguucugugggugggcgucacggcccggaauauuuacaaacaggugaccaaaaaggcuaaacgcugucaagaucccgacgaaccgccucccccucccagaccgaugcuucgguuuuaucugaucgggggaggcauucccaucauugugugcgggaucacagccgcggcuaacaucaagaauuacggaagccgcccuaacgcccccuauugcuggauggccugggagccuucccucggcgcuuucuacgggcccgccucuuucauuaccuuugucaauuguauguauuuccugagcaucuuuauucagcugaagagacauccugagcggaaauacgaacuuaaggagcccacagaggagcagcagagacuggcugccaacgagaacggcgaaaucaaucaccaagauuccaugucucucagccugauuuccaccucugcgcucgagaacgaacacacguuccauagccagcugcuuggagccucccugacacuccugcuguauguugcucuuuggauguuuggcgcccuggcugugagccucuacuacccgcuggaccucguguucucuuuugucuucggggccaccucccugagcuuuucugccuucuuugugguucaccauugcgugaaucgcgaggauguccggcuugcuuggaucaugaccuguugcccuggaagauccagcuauucugugcagguuaacgugcagcccccuaauuccaacggcacaaauggggaagcgcccaaauguccgaacagcuccgccgagagcucuugcaccaauaagagcgcuuccucuuucaaaaacagcucccaaggauguaagcugacaaaucugcaggccgccgcugcccagugccacgcgaacucucucccucugaauagcacgccccagcuugacaacucccugaccgagcacucuauggauaaugacaucaagaugcaugucgcuccucucgaagugcaauuucgcacaaacguucacagcucccggcaucacaaaaacagaagcaagggccaucgcgccucucggcugaccgugcucagagaguacgccuaugauguccccacauccguggaaggcagcgugcagaaugggcugcccaaaucucgccuuggaaacaaugagggccacucccggagcagacgggcuuaccuggccuaucgcgaaagacaguacaacccuccgcaacaggacuccucugaugcguguagcacccugcccaaguccagccggaauuucgagaaaccugucucuacgaccuccaagaaagacgcucuccgcaagcccgccguuguggagcuggaaaaccagcaaaagagcuaugggcuuaaucuggccauucagaacggaccuaucaaaucuaauggccaggaggggccccuccugggaacagauagcaccggcaacgugagaacaggccucuggaagcacgaaaccacagucuga

SEQ ID NO: 65543 - RNA, 4755 nt, Artificial Sequence
  derived and/or modified sequence opt5 from ADGRB1__Homo_sapiens__XP_011515501
augagaggccaggccgcugcccccgggccuguguggauccuggcgccgcuccugcuucugcuccugcuucugggacggcgcgcuagagccgccgcuggcgccgacgcugggcccggaccugagcccugcgccacccucguccaaggcaaguucuuuggguacuucagcgcggccgcuguuuuuccugccaacgcuucccgguguucuuggacacugcgcaaucccgauccuagacgguauacgcuguacaugaaaguggccaaggcgccggugcccugcagcggaccuggccgcgucagaaccuaucaguucgacuccuuucucgaaucuacacggaccuaccugggcguggagagcuucgaugaaguucuucgccugugugaccccuccgccccucucgcuuuucugcaggccucuaaacaguuccuucaaaugagacggcagcagcccccgcagcacgaugggcugcgcccuagagcuggacccccuggccccacagacgauuuuagcguggaguaucucgucguggggaaccggaaucccucccgcgccgccugccaaaugcuguguagauggcuggacgcuugccucgcgggaagccggucuucccauccuuguggcauuaugcagaccccgugcgccugucugggaggagaagcuggcggccccgccgccgggccucuugcucccagaggagauguuugccugcgcgacgccguggcgggcgggccugagaacugucucacaagccugacccaggaucggggaggccacggggcuacgggaggcuggaagcuguggucucuguggggcgagugcaccagagacugcgggggaggccuccagacacgcacccggacaugucugcccgccccgggggucgaaggaggcgggugcgagggcgugcuggaagagggaagacaauguaaucgcgaggccugcggcccugcugggcggaccuccagcagaucucagucccuccgcagcacggaugcccggagacgcgaggaacugggagacgaacuucagcaauucggcuuucccgcuccucagacaggggaccccgccgcggaggaaugguccccuuggucuguguguagcucuaccugcggagagggcuggcagacacggaccagauucugugucagcuccuccuacagcacccagugcucugggccccugcgggagcaacgccucuguaacaauagcgccguuugcccggugcauggcgcuugggaugaaugguccccuuggucucuguguagcuccacaugcggaagaggcuuucgggacagaacgcggaccugccgcccuccccaguucgggggaaaccccugugagggcccggaaaaacagacaaaguucugcaauaucgcccuuugucccgggagagcuguggauggaaacuggaaugaguggagcucuugguccgccugcagcgcgucuuguucccagggccgccaacagagaacccgggaaugcaacgggccuagcuauggcggagccgagugucagggccacugggucgagacacgcgacugcuuucugcagcaaugucccguggaugggaaguggcaggcuugggccuccuggggaucuugcagcguuaccuguggcgcugggucccagagacgggaacgcgugugcucuggaccuuucuuuggcggggccgccugccagggcccccaagacgaguacagacaguguggaacgcagcggugcccugaaccccaugagauuugugaugaagacaauuucggcgcugucaucuggaaagagacaccggcgggggagguggccgcuguucgcugcccuagaaacgccaccggacucauucugcggcgcugugaacuggaugaggaaggcaucgccuacugggagcccccuaccuauaucagaugcgugagcauugacuaccggaauauccaaaugaugacaagagagcaccucgcuaaggcccagcgcgggcugcccggagaaggcgucuccgaggugauucagacccuugucgaaaucagccaggauggcacaucuuauuccggggaccugcucagcacgauugacgugcugcggaacaugaccgagaucuuuagacgcgcguacuauucuccgacaccuggagauguucaaaacuucgugcagauucuguccaaucuucucgcugaagagaaccgggacaaaugggaggaagcccagcuggccggccccaaugcuaaggagcuguuuagacucgucgaagauuucguggacguuaucggguuucgcaugaaagaucugcgggacgccuaccaggugaccgauaaccuuguccugagcauccacaagcucccugcgucuggagcuacagacauuagcuuccccaugaagggcuggagagccaccggggauugggccaaagugcccgaggaccgcgugacgguuuccaagagcgucuuuucuaccggacugacagaagcugaugaggccuccguguucguggucggcaccgugcuguaucggaaucuuggcagcuuucucgcucugcaaagaaacacaaccguucuuaauuccaaagugaucucugucacggugaagccuccgccccggagccuccgcacaccucuggagauugaguucgcccauauguacaacgggaccacaaaucagaccuguauccuuugggacgaaaccgauguucccuccucuagcgcgccuccccagcugggaccuugguccuggagaggcugccggacagugccgcucgacgcccugcgcacgagaugucugugcgaccggcuuucuaccuucgcuauucucgcccagcugagcgcugaugccaacauggaaaaagccacacugcccuccgucacccucaucgugggguguggaguuagcucucugacacuucugaugcucgugaucauuuacgucuccguguggagauauauccgcagcgagcggucugugauucugaucaauuuuugccuguccauuaucagcucuaacgcucuuauccucauuggccaaacccagacgagaaauaaggucguuugcacacugguggcggccuuccugcacuuuuucuuucucuccagcuucuguugggugcugaccgaggcuuggcaguccuacauggccgucaccgggcaucuucgcaaccggcugaucagaaaacgcuuucucugccugggauggggccugccugcccuugugguugcuauuagcgugggcuucacaaaggccaagggguauucuaccaugaauuacuguuggcugagccucgaaggaggccugcucuaugcguuugucgggcccgcugccgccgugguucuggugaacauggucaucgggauucuuguguucaacaaacugguuuccaaggacggcaucacagauaaaaagcucaaagagcgggcuggggccucucuguggagcuccugcgugguccugccucuucuggcgcucacguggaugucugcugugcuggccgugaccgacagacgcagcgcccucuuucaaauucuguucgcugucuuugauucccuugaaggauucguuaucgugauggugcacuguauccugagacgggagguccaggacgccgugaagugccgcguuguggauagacaggaagagggcaauggcgacucugggggcagcuuccagaacggacacgcucaacucaugacagauuuugagaaggacgucgaucuggccugucgguccgugcugaauaaagacauugcggccugccgcaccgcuacaaucaccgggacgcuuaagagacccagccugccggaagaggaaaaacucaagcuggcccaugcuaaaggaccucccaccaacuucaauucucuccccgccaacguuuccaagcugcaccuucauggcagcccucgguaccccgggggaccucugccggauuuucccaaucacucucugacacucaagagagacaaagccccuaaguccagcuucgugggcgacggcgauauuuuuaaaaagcuggacuccgagcuuucucgcgcucaggaaaaagcgcuggauaccagcuaugucauccuccccacagccaccgcuacacugcggccuaagcccaaggaggagccgaaauacuccauucauaucgaccagaugccucagaccagacucauccaccugagcacggcccccgaagccucucuuccugcucgcuccccucccagccggcaacccccgucugggggaccucccgaggcgcccccugcccagccgcccccucccccucccccuccgcccccucccccucagcagccccugccgccuccucccaaccuggaacccgcucccccuagccucggcgauccgggggagcccgccgcccacccuggacccuccacaggcccuucuaccaagaaugaaaacguggcuacccugagcgucuccucucuugagagacggaaaagccgcuacgccgagcuggacuucgaaaagauuaugcauacaagaaaacggcaccaagauauguuucaggaccucaaucgcaagcugcagcaugcggccgagaaagauaaggaagugcucgggcccgacuccaagccggagaaacagcaaaccccuaacaagagacccugggaaagccugcggaaagcucacggaacgccuacauggguuaagaaagagcuugagccccugcagccuucuccccuggaacuccgcuccguggagugggaaagaagcggcgccaccaucccgcuggucggccaggauauuaucgaccuucaaacagagguguga

SEQ ID NO: 65544 - RNA, 4755 nt, Artificial Sequence
  derived and/or modified sequence opt5 from ADGRB2__Homo_sapiens__NP_001281264
auggagaacaccggcuggauggggaagggacacagaaugacacccgccugcccucugcuccugagcgugauccuuucccugcggcucgcuacggccuucgacccggcgcccucugcuuguagcgcccuggccuccggcguccuuuacggggcuuuuucucugcaggaucucuucccuaccauugccagcggaugcuccuggacacuggaaaaucccgacccuaccaaauauucucuguaccuccgcuuuaacagacaagagcagguuugugcucauuucgcgccccggcugcuuccucuggaucacuaucucgugaauuuuacaugccugcgcccgagccccgaagaggccguggcccaggcugaauccgaggucggcagaccugaggaagaggaagccgaggcugccgcggggcuugagcuguguagcggaucuggccccuucaccuuucuccauuucgacaagaacuuugugcagcugugccuguccgccgaaccuagcgaggcuccccggcuccuggccccggcugcccuugccuuccgcuuuguugaagugcugcucaucaauaacaauaacucuucccaauucacauguggcguccugugcagauggagcgaggaaugugggcgggcugcgggacgcgccugcggcuuugcucagccuggguguucuugccccggagaggccggcgccggguccaccacgaccacaagcccuggaccucccgcugcccacacccuuuccaaugcgcuggugcccggcggcccggcucccccugccgaggccgaucuccauucugggagcuccaacgaccuguucacaaccgaaaugagauacggagaggaacccgaggaggaaccuaaaguuaagacgcaguggccccggagcgcugaugagccgggccuguauauggcccagacaggggacccugcugccgaagaguggucucccugguccgugugcagccucaccuguggacaaggccugcagguccgcacaagaucuugcgugagcuccccuuacgggacccuuuguucuggaccccugcgggaaacccgcccuugcaauaacagcgcgacaugucccgugcacggcgucugggaggaauggggcuccuggagccucugcucuagauccugugggcggggaagcagaucucgcaugcggacgugcguuccgccucagcacggcgggaaagccugugagggacccgagcugcagaccaaacuuugcuccauggcugccugucccguggaaggccaauggcuggagugggggccuuggggcccgugcagcacauccugcgcuaauggaacccagcagagaucucgcaaguguagcguggccggccccgcgugggccacaugcaccggggcucucacggauacacgggaauguuccaaccuggagugcccugccaccgacucuaaguggggacccuggaaugcuuggagccuguguuccaagaccugcgauacaggcuggcaaagacgcuuccggaugugucaggccaccgggacacagggauauccuugcgagggcacgggggaagaggucaaacccuguagcgaaaagagaugcccugccuuucaugagaugugucgcgacgaauacgugaugcucaugaccuggaaaaaggcugcggccggcgagauuaucuacaacaagugucccccgaacgcuucuggauccgccagccggagaugccugcuuucugcccagggcguugcuuauugggggcugccuuccuucgcccgcugcauuagccacgaguaccgguaucucuaccugucucugagagaacaucuugcgaaaggacaacggaugcucgcuggcgaggggaugagccaggugguccgcucccugcaggaacugcucgccagacggacauauuacagcggagaucugcuguuuucuguggacauccuuagaaauguuaccgacacauucaagcgcgccaccuaugugcccuccgcugaugacguccagcgguuuuuccaaguggucagcuuuaugguggaugccgagaacaaagaaaagugggacgaugcgcagcagguuuccccuggcucugugcaccuccugagagucguggaggacuucauccaccugguuggggaugcucuuaaagccuuucagagcucccucauugugacggacaaucuggucaucucuauucaacgcgagcccgugagcgccguguccucugauaucaccuucccgaugagaggccggcgcggaaugaaggacuggguuagacauagcgaagaucggcuguuucucccuaaagagguccugucccuuagcucucccggcaagccugcuacauccggggccgcuggaagccccggccgcgggagaggacccggcaccgugccuccggggcccggccacucucaucagcggcugcucccugccgaccccgacgaauccagcuacuucgugauuggagcgguccuguaccgcacacugggccuuauccucccucccccuagaccgccccuggccgugaccucucggguuaugacggugacaguccgcccucccacccagccucccgcugagccgcugauuacaguggaacucuccuauaucaucaacgggaccaccgauccucacugcgccagcugggacuacuccagagcugaugccagcucuggagacugggauacagagaauugucagacgcuggagacccaagccgcucauacacggugccagugucagcaccuuagcaccuuugcgguucuggcccaaccucccaaggaccucacacuggaacuggcuggcucccccucugugccccuugucauugggugcgccgugagcuguauggcccuccugacccugcucgcuaucuaugccgcguucuggagauucauuaaauccgagcgcucuaucauucugcuuaacuuuugccugagcauccucgcuuccaauauccugauucugguuggacagucucgggugcuuagcaagggcgucuguacgaugacagccgccuuccugcacuuuuucuuucucuccagcuucugcugggugcugaccgaggcuuggcagucuuaccucgccgugaucggcagaaugcgcacccggcuggucagaaaacgcuuucuuugucugggguggggacucccugcgcugguuguggcuguguccgucggcuucacacggaccaagggguauggaacaagcucuuacugcuggcugucccuugaaggcgggcugcucuaugccuuugugggaccggccgcuguuauugugcuggucaacaugcucaucggcauuaucguguucaauaaacugauggccagagauggcaucagcgacaaguccaagaaacagcgcgcugggucugagcggugccccugggccagccuucugcucccuuguuccgcgugcggagccguucccagcccucugcugucuuccgcuagcgccagaaacgcuauggccucucuuuggagcuccugugugguccugccccuccuggcccucacguggaugucugcugugcuggcgaugaccgaucggcgcagcguucuuuuucaagcccuguucgcuguguuuaauuccgcccagggcuucgucauuacagccgugcauugcuuccugagacgggaagugcaggacgucguuaagugucagaugggggugugccgcgcugaugagucugaagacagcccggauuccuguaaaaacggacaacuccagauccugagcgacuuugagaaggacguggaucuugccugccagaccguccuguucaaagaagugaauacauguaacccuucuaccauuacgggcacccucuccagacugagccucgacgaggaugaggaacccaaguccugccugguugggccugagggaucucuuagcuuuucuccccugccuggcaauauccuggugcccauggcggcuuccccgggccucggggaaccucccccuccccaggaggccaacccggucuacauguguggagaaggcgggcugcggcaacuugaccugacauggcucagacccaccgagccuggaagcgagggcgauuacauggugcugccccgccggacacucucccugcagccugggggaggcggcgggggaggcgaagacgcccccagagcucgcccugaggggaccccgcggagagccgcgaagacaguugcccacaccgaaggauaucccagcuuccuuucuguggaucauuccggccuggggcugggaccugcuuacggcagccuccagaaccccuauggcaugacguuucaaccucccccgccuacacccucugcccgccagguccccgagccuggggaacgguccagaaccaugccccgcaccgugccuggaagcacaaugaaaaugggcucucuggagagaaagaaacuucgguacagcgaccuggauuucgaggucaugcacacccgcaagagacacuccgaacucuaucaugagcugaaucagaaauuucacacguucgaccgguaccgcucucagagcacagcuaagagagaaaagcggugguccgugagcuccgggggagccgcugagagaucuguuugcaccgauaaaccgagccccggcgagcgcccuucccucucucaacaucggagacaccagagcugguccacauuuaagucuaugacccuggggagccuucccccuaaaccccgcgaacggcugacacugcauagagccgcggccugggagccgaccgaaccucccgacggagauuuccagacggagguguga

SEQ ID NO: 65545 - RNA, 4569 nt, Artificial Sequence
  derived and/or modified sequence opt5 from ADGRB3__Homo_sapiens__NP_001695
augaaggccgugagaaaccugcucaucuacauuuucagcaccuaucugcuugucauguuuggcuucaaugcugcccaggacuuuuggugcuccacacugguuaaaggggugaucuacggaucuuauagcguguccgagauguuccccaagaacuuuacgaauuguaccuggacacucgaaaacccugauccgaccaaauacucuauuuaucugaaguucagcaaaaaggaccuuuccugcucuaauuuuagccugcucgcguaccaauucgaucacuuuucccaugagaagaucaaagaccugcugcggaagaaccacagcauuaugcagcucuguaauucuaaaaacgcuuucgucuuucugcaguaugauaagaauuucauccagauccgcagaguguuucccacaaacuucccuggccuucagaaaaagggggaagaggaccagaaguccuucuuugaguuccugguucucaauaaagugagccccucucaguuuggaugccauguccuguguaccuggcuugaguccugccuuaagagcgagaacggccggacagaaucuugugggauuauguacaccaaaugcacguguccucagcaccucggagaguggggcaucgaugaccaaucccugauucugcucaauaacgugguucugccccuuaaugaacagaccgagggcugccugacacaggagcuccagaccacacaaguguguaaccugacccgcgaagccaagagaccuccgaaagaggaguucgggaugaugggagaucauacgaucaagagccagcggccccgcuccguccacgagaaaagagugccucaggaacaagccgacgcugccaaguuuauggcucagacaggcgagucugggguggaggaauggagccaguggucuaccugcuccgucacaugcggacagggcucucaaguucggacccgcaccugugugucccccuacgggacacacugcagcggaccucuuagagagucucggguguguaacaauacggcccugugccccguccauggcgugugggaagaguggagcccguggucccucuguucuuuuaccugcggccgcgggcagagaacacggacccgcagcuguacaccuccccaguauggaggcagaccuugcgaagggcccgagacccaccauaagcccuguaacauugcgcugugcccuguugauggacaguggcaagagugguccagcuggucucaguguuccgugacgugcagcaauggcacacagcagcggucuagacaaugcaccgccgcugcccacgggggauccgaaugucgcggcccgugggcugagagccgggaaugcuacaaccccgaguguaccgccaauggccaguggaaccagugggggcacugguccggaugcucuaaaagcugugacggcgggugggaaagacgcauccggacaugccagggagcggucauuaccggccaacagugugaggggacaggcgaggaagugagacgcugcuccgagcagcgguguccugcccccuaugaaaucugcccugaggauuaccugaugagcaugguuuggaagagaacgcccgcuggagaccucgccuucaaucaauguccgcugaacgcuaccggcacaaccagccgccggugcucccuuagccugcaugggguggccuucugggagcagccuucuuuugccagaugcaucuccaaugaauaucgccaccuccagcauagcauuaaagagcaccuggcuaagggacagcggaugcuugcgggcgacgggaugucucaagucacaaaaacccugcucgaucugacgcagagaaagaacuucuacgccggagaccugcucauguccguggaaauccugcggaaugucaccgauacauuuaagcgcgcuagcuauauucccgccucugacggcgugcagaacuucuuucagaucguuagcaaucuucuggaugaggaaaacaaagagaagugggaggacgcccaacagauuuacccuggguccaucgaacucaugcaagugaucgaggauuucauucauaucgucggcaugggaaugauggacuuccagaauagcuaccugaugaccggcaacgugguugcuucuauucaaaaacugcccgccgcguccgugcuuacagauaucaacuuuccuaugaaggggagaaaaggaauggucgacugggcucggaauagcgaagauagaguggugauucccaaguccaucuucaccccgguuucuagcaaggagcucgacgaauccucugucuuugugcugggcgccgugcuguauaaaaaccucgaccugauccuuccuacgcugcgcaauuacacagucauuaacagcaagaucauugugguuaccauccggcccgagcccaaaacaaccgauuccuuccucgagauugaacuggcccaccuggcuaaugggacccuuaacccuuauugugugcucugggacgauucuaagacaaaugagagccugggaacgugguccacccagggcugcaaaacaguccugaccgacgccagccacacaaagugucucugcgauagacugucuaccuuugcuauccuugcccagcaaccgcgcgaaauuaucauggaguccagcgggacgcccucugugacacugaucguuggcuccggacucagcugucuggcgcugauuacccuugccguggucuacgcugcccucuggagauauauccggucugaacgcuccauuauccugauuaacuucugccugagcaucaucuccagcaauauucucauccuggugggccagacccagacacauaacaagucuauuuguaccacaacgaccgcuuuucuucacuucuuuuuccuggccagcuuuugcuggguucucacagaggcguggcaguccuacauggccgugaccgggaaaaucagaacacggcugauucgcaagagauuccugugucuuggauggggccucccugcucuggucguggccaccucugugggguuuacgcggaccaaaggauauggcacagaccauuacugcuggcugagccucgaagggggccugcuuuacgcuuucgucggacccgccgccgcuguugugcuggugaauauggucaucggcauccucguguucaacaagcugguuucccgcgaugggauucuggacaaaaagcugaaacacagagcgggacaaaugucugaaccucacagcggccugacccucaagugugccaagugcgggguggucuccacaaccgcucugucugccacaaccgccagcaaugcuauggccucccucuggagcucuugcgugguucugccccuucuggcgcucacguggauguccgcugugcuggccaugacagauaaacggagcauccuguuucagauucuuuucgccgucuuugacucucugcagggauucgugaucguuauggugcauuguauucuccgcagagagguccaggaugcuuuucggugcagacugcgcaacugucaagacccuaucaaugccgauuccagcuccucuuuccccaacggccacgcgcagaucaugaccgacuuugaaaaggacguggauauugcuugccggagcgugcuccauaaagacaucggcccguguagagccgccaccauuacagggacccugucccgcaucagccuuaacgaugacgaggaggaaaagggaacgaauccugagggccugucuuauuccacacuccccgggaacgucauuagcaaaguuaucauucagcagccuaccggacugcacaugcccaugucuaugaaugaacugagcaacccgugccuuaagaaggaaaauuccgaacugcggagaacaguguaccucuguaccgaugacaaccugcgcggcgcugauauggacaucgugcauccucaagagcggaugauggagucugauuauaucgucaugcccagaagcuccgugaauaaccagccuucuaugaaagaagagagcaagaugaauauugggauggaaacacucccccacgagcgccugcuucacuacaaaguuaaccccgaguucaauaugaacccuccggugauggaccaguuuaauaugaaccuggaacagcaucuggcuccccaagagcacaugcagaaucucccuuucgaaccccggaccgccgucaagaacuuuauggccuccgagcuggaugacaacgcgggacuuagcagaucugaaacgggcuccaccaucagcauguccucucuggagcggcgcaaaagcagauauuccgaucucgacuucgaaaaggugaugcauacacggaagcgccacauggagcuguuccaggagcucaaucaaaaauuucagacccuggacagauuccgggauauuccuaacacaucuagcauggaaaaucccgccccuaacaagaauccgugggacaccuuuaaaaaccccuccgaguacccucauuauacgacaaucaauguucuugauaccgaagcuaaggacgcccuggagcugagacccgcugagugggaaaaaugccucaaccugccucuugaugugcaggagggcgacuuccagacagaagucuga

SEQ ID NO: 65546 - RNA, 2625 nt, Artificial Sequence
  derived and/or modified sequence opt5 from ADGRD1__Homo_sapiens__NP_942122
auggagaagcugcucagacugugcuguugguacagcuggcuucuucucuucuauuacaacuuucaggugcggggcgucuauucccgcucucaagaccaccccggguuccagguucuggccagcgcuucccauuacuggccucuugaaaauguggauggaauccacgagcugcaggacaccacaggcgauauuguggaagggaaagucaacaagggaaucuaucucaaagaggaaaagggcgugacgcugcuguacuaugggagauacaauucuagcugcauuuccaaaccggagcaguguggacccgagggcguuaccuuuucuuucuuuuggaagacacaaggcgaacagagccggccuauccccuccgccuacgggggacaggugauuagcaacggcuucaaggucuguucuuccgggggacgcggcagcguggagcucuauaccagagacaauucuaugacaugggaagcguccuuuagcccucccgggccuuacuggacccauguucuguucacauggaaaucuaaggagggacuuaaaguguaugucaacggcacccuguccacgagcgauccguccggcaaggugucucgggacuacggggagagcaaugugaaccucgucaucggauccgaacaggaucaagcuaaaugcuaugagaauggcgccuuugacgaguucaucauuugggaacgcgcccugacccccgaugaaaucgcuauguacuuuacagccgcuauugggaagcacgcccuucugagcucuacccucccuucccuguucaugacaagcaccgcgucucccguuaugccuacggacgccuaucaucccaucauuacaaaccugaccgaggagagaaagacauuucagagcccgggagugauccucuccuaccugcagaaugugucucuuagccugccuuccaaaagccucucugaacagaccgcucugaaccuuaccaagacauuccugaaagccgucggcgagauucuccugcugcccggguggaucgcucucuccgaagauagcgccgugguucugucucuuaucgacacgauugauaccgugaugggacacgucuccagcaaucugcacggcuccacaccucaagugaccguugagggcucuagcgcgauggccgaauuuuccguggcuaagauccuccccaaaacagucaacucuagccauuaccgguuccccgcccacgggcaguccuucauucagaucccucaugaggcuuuucaccgccacgccuggagcaccguggucggacugcuuuaucauucuaugcacuacuaucugaauaacauuuggccggcccauacgaagaucgcugaggcgaugcaccaucaagacugccuccuguucgccacaucccaccugaucagccucgaagugucucccccucccacccugucccagaaccuuagcggcucuccucugauuaccguucaccucaaacauagacugacacggaagcagcacagcgaggcuaccaauuccagcaaccgcguguuugucuacugugccuuccuggacuuuucuuccggggaaggaguguggagcaaucauggcugcgcccuuacaagagggaaccucacguauuccguuugucggugcacccaccugacaaauuucgcuauccugaugcaaguggucccccucgagcuggcccgcggccaccagguggcgcuuucuagcauuuccuacgugggauguucucugagcguucucugccuggucgcuacccuggugacauuugccgugcuuuccucugucagcaccaucagaaaccagcgguaucauauucacgccaaucucuccuucgcugugcugguugcccaggugcugcuccugaucagcuuuagacuugaaccgggcacgaccccuugccaggucauggcugugcugcuccauuacuucuuucugucugccuucgcguggaugcugguugaggggcuucaccucuacuccauggugaucaaggucuucggaagcgaggauucuaaacaucgcuauuacuauggcaugggguggggauuuccccugcugauuuguaucauuucccucagcuucgccauggacucuuacggcacauccaacaauugcuggcugagccuugcuuccggggccaucugggcuuuuguggccccugcgcuguucguuauuguggucaacaucggcauucucaucgccgugacccgggugaucagccaaauuucugcugauaauuauaagauccacggagaccccagcgccuuuaaacugacagcuaaggccgucgccguucugcuuccuauucucggcaccuccuggguguucggggugcuggcugucaacggaugugcggugguuuuucaguacauguucgccacgcucaauucucugcagggccuguuuaucuuccuuuuucacugccugcucaacagcgaagugagagcugccuucaaacauaagacaaaggucuggucccugaccucuagcuccgcccgcacaucuaaugcuaaacccuuucacagcgaucugaugaacgggacccggccgggaauggccuccaccaagcugagcccuugggacaaaucuucccauagcgcgcacagaguggaucugucugcuguuuga

SEQ ID NO: 65547 - RNA, 2925 nt, Artificial Sequence
  derived and/or modified sequence opt5 from ADGRD2__Homo_sapiens__XP_006717411
auggugaccggccccgaggaagggaacagcgagauggacgccccuuggggagcuggcgaaagauggcugcacggggccgcggucgaucgguccggaguuucucucggcccgcccccuacaccccaggugaaucaagggacgcugggaccucagguggcucccgucgccgccggcgaggugguuaagaccgcuggcggggugugcaaauucagcggacagcgccuuuccugguggcaggcccaagaaucuugugagcagcaguuuggccaucuggcucuccagccuccggacgggguccuggccagcagacuucgggaucccguguggguuggacaacgcgaggcgccucugagacggcccccucagcgcagagcccggacaaccgcugugcucgucuucgacgaacgcacagccgauagagcugcccggcugcgcucuccccugccggagcucgcggcccugaccgcuugcacacacgugcagugggacugugccuccccugaucccgcugcccuuuuuagcguggccgcuccugcgcugcccaacgcccuccagcugagagcuuucgccgaacccggcggggucguucgggccgcucuuguggugcgcggacaacaugccccuuuucuggcggcuuucagagccgacggccgguggcaccaugucugcgccaccugggagcagagaggcgggcgcugggcucucuuuuccgauggacggagacgcgccggcgcucgggggcugggagccggccacccggugcccagcgggggaauccugguucucggccaggaccaagauucucugggcgggggauucuccgugagacacgcgcuuagcggcaaucugacggacuuucaucucugggcccgcgcucugucuccugcccagcuucaccgggcuagagccugugcgcccccuuccgaggggcugcuguuccgcugggaucccggagcccuggacgucaccccgagccugcucccuacaguguggguucggcugcuuugccccgugccuucugaagagugucccaccuggaacccuggccccagauccgaagggagcgagcugugccucgaaccgcagccuuuucuguguugcuaccgcacagagcccuaucggagacuucaggacgcucaauccuggcccggccaggaugucauuucucgggugaaugcccuggcuaacgacaucguccuccugccugauccgcugagcgaggugcauggagcccucucccccgccgaagcuagcucuuuccugggccuucuggagcacguucucgcgauggaaauggccccucuggggcccgcugcccugcuugccgugguccgcuuucucaagagagugguugcucugggagccggcgacccugagcugcuccugaccgggcccugggaacagcuuucccagggaguggucagcguggcgucucuggugcucgaggagcaaguugcugauacguggcugagccugcgggaagucauuggcgggccuauggcccuuguggccuccgugcagagacucgcuccccugcugucuacaagcaugaccuccgagcgcccgcggaugagaauccagcaccgccaugccggccucagcggagucacagugauucacucuugguucaccuccagaguuuuccagcauacccuggaaggcccugaccuugagccccaagcgccugcuagcucugaagaggccaaucgggugcagcgcuuucuguccacacaggucgggagcgccaucaucuccucugaggugugggauguuacgggagaagugaacgucgcuaugaccuuccaccuccagcauagagcccaaagcccccuguuuccgccucaucccccuucccccuacacaggcggggcuugggccaccacaggauguucuguggcggcccuguaucuugacagcaccgcuugcuucugcaaucacuccacgagcuuugccauucuccugcagaucuacgagguucagcggggccccgaagaggagucucugcuccgcacacuguccuucgugggguguggcgucagcuuuugcgcucuuaccaccacauuccugcucuuucugguggccggagugccuaaaucugaaagaaccacaguccacaagaaccugacguucucccuugccagcgcugagggcuuucucaugaccucugaaugggcgaaagccaaugagguugcuuguguggccgugacagucgccaugcacuuccuguuucugguggcuuucagcuggaugcucguugaagggcugcuucuguggcggaagguggucgccguguccaugcauccgggacccggcaugcgccucuaucacgcgaccggguggggaguuccugugggcauugucgcugugacacuggccaugcugccccacgauuacguugccccugggcauugcuggcuuaacgugcacaccaaugcuaucugggccuucgucggccccgugcuguuugugcucacggcgaacaccuguauucuggcuagagucguuaugaucacagugagcucugcccggcgcagagcccggaugcucuccccucaaccgugccugcagcagcagauuuggacccaaaucugggcuacagugaagcccguccuugugcugcucccuguucugggacugaccuggcuugccggcauccuggugcaucucagccccgcuugggccuaugcggccgucgggcucaauuccauucagggacucuacaucuuccugguguacgcugccuguaacgaggagguuagaucugcccuucagcgcauggcugagaaaaagguggccgaaguccugcgggcucucggcguguggggaggggcggccaaagaacacagccugccuuuuuccguccugccccuuuuccugccgccuaagcccucuacgcccagacauccucucaaagcucccgccuga

SEQ ID NO: 65548 - RNA, 2604 nt, Artificial Sequence
  derived and/or modified sequence opt5 from ADGRE1__Homo_sapiens__NP_001243181
augagaggcuucaaccugcuccuguuuugggggugcugugugaugcacagcugggagggacauauccggcccacccgcaagccuaauacaaaaggcaacaauugcagagacuccacgcuuuguccggccuacgcuaccugcacaaacaccgucgauucuuauuacugugccugcaagcagggguuccugagcuccaauggacaaaaccacuuuaaagaccccggcguucgguguaaggauauuaaugaaugccucacaucuagcguguguccugagcauuccgacugcgugaacucuauggggagcuauuccuguagcugccaggucggauucaucucucgcaauuccacaugcgaagauguggacgagugugcggaucccagagcuugcccugaacacgccaccuguaacaauaccguuggcaacuacagcugcuuuuguaaucccggcuucgagucuuccagcgggcaucugucuuuucagggacuuaaagccuccugcgaggacauugaugaauguacggagaugugcccuaucaacagcaccuguacaaauaccccgggcuccuauuucugcacaugucaccccggguuugcuccuucuaacggacagcugaacuucaccgaccaaggcguggaaugccgggauauugacgagugccgccaggaucccagcacgugugggccuaauuccaucugcacaaacgcccucggaagcuacucuuguggcugcaucgcuggcuuucaccccaauccggaggggucccagaaggacggaaacuucagcugucagagaguccuguuuaagugcaaagaagacgugauuccugauaauaagcaaauccagcagugucaggagggcaccgccguuaaacccgcguaugugucuuucugcgcccaaauuaacaauaucuucagcguccuggacaaggugugugaaaacaaaacaaccguggucucccucaagaauaccacagagucuuuuguuccugugcugaagcagauuagcacguggaccaaauucacaaaggaagagaccuccagccuugcuacaguguuucuggagucugucgaauccaugacccucgccagcuucuggaaacccucugcuaacaucacgcccgccgugcggacagaguaccuggauauugaauccaagguuaucaauaaagagugcagcgaagagaacgugacccuugaccuggucgcgaagggggauaaaaugaagaucggauguuccaccauugaggaaucugagagcacagaaaccacaggcguggccuuuguuuccuucguggggauggagucuguccucaaugaacgcuuuuucaaggaccaucaggcuccucugacgaccagcgagaucaaacugaagaugaacuccagaguggucggaggcauuaugacaggcgagaaaaaggauggguuuagcgacccgaucauuuacacccucgaaaauauccaacccaaacagaaguucgagcggccuaucugcgugucuugguccacagauguuaagggaggccgcuggaccagcuuugggugcgugauucuggaagccucugagacguauaccaucuguuccugcaaccagauggcuaaccuugccgucauuauggccagcggagagcugacaauggacuucucucucuacaucauuagccacgugggcaucaucauuucccugguuugucuugugcuggcuaucgcgaccuuucuccugugcagaagcauucggaaucauaacacauaucugcaccuccaccugugugucugccuucugcucgccaaaacccuguuccuugcugggauccauaagacggauaauaaaaugggcugugccauuaucgccggauuccugcacuaccucuuucuggcuugcuucuuuuggaugcugguggaagccgugauucucuuccugaugguucgcaaccuuaaggucgugaauuauuuuucuuccagaaacaucaaaaugcugcauaucugugcguucggcuacgggcuccccaugcugguggucgugauuagcgcuuccguucagccucaaggauauggcaugcacaaucggugcuggcugaacacagagaccggguuuaucuggucuuuccuuggacccguguguacagucauugugguuagcaaguacuacaauucccucgccaagugcgugcugaaagaggaacagggcgaccugagagaccucgaauuuccggggaccugcgccgcugagcgcaucaacucucugcuucugaccuggacacucuggauucugcggcagagacugagcuccgucaaugccgaggugucuacgcuuaaggauacccgccuccugacauucaaggcuuuugcccagcuguucauccucggcuguagcuggguucugggaaucuuucaaauuggcccuguggcgggggucauggccuaucuuuucaccaucauuaacucccugcagggagcuuucaucuuucucauucauugccugcugaauggccaggugcgggaagaguacaaaagauggaucacagggaaaaccaagcccagcucucagucccaaacgagccgcauccuucucucuuccaugccuagcgccucuaagacaggauga

SEQ ID NO: 65549 - RNA, 2298 nt, Artificial Sequence
  derived and/or modified sequence opt5 from ADGRE2__Homo_sapiens__NP_001257981
augggcgggagaguguuccuggucuuucucgccuucugcguuuggcugacccuucccggagcugagacacaggacagccggggcugugcccgcuggugcccucaggauuccucuugugugaacgcgacggcuugcagauguaauccgggguuuagcuccuucucugaaaucauuaccacacccauggagaccugcgacgauaucaacgaaugugccacacugagcaagguguccugcggaaaauuuucugacuguuggaauaccgagggcagcuacgauugcgucuguuccccuggguaugaacccgugagcggagccaagacauucaaaaacgagucugagaauaccugccaggacguugaugaaugccagcagaacccucggcucuguaaguccuacggcacgugcgugaauacccugggcagcuauacaugucaaugccuucccggguuuaaacugaagccugaggacccgaagcucuguaccgaugucaacgaaugcacaucuggacagaaucccugucacuccagcacccauugccugaacaaugugggcucuuaccagugucgcugcagaccuggguggcagcccauuccuggaucccccaacggcccgaauaacacgguuugugaggacguggaugagugcagcuccgggcaacaccagugcgacucuagcacagucuguuucaauaccgugggauccuauagcugccggugucgcccuggcuggaaacccagacauggcaucccuaacaaccagaaggauacagugugcgaagacaugaccuuuucuaccuggacacccccucccgggguccacucccagacgcugagccgguucuuugacaaaguucaagaucucggacgcgacuacaagccgggccuggcuaauaacaccauucagucuauccuucaggcccuggaugagcuccuggaagcucccggggaccuugagacacugccuagacuccaacagcauuguguggccagccaucugcuggauggacucgaagacgugcugcggggccuuuccaaaaaucugucuaacgggcuccugaauuucagcuaucccgcgggaaccgagcuuucccuggagguccagaaacagguggaucgcagcguuacacucagacaaaaccaggccgugaugcagcuggacuggaaucaggcucaaaagucuggcgauccuggccccuccgucguggggcugguuagcaucccgggaaugggcaagcuccuggccgaagcuccucuugugcuggagcccgaaaagcagaugcuccugcacgagacccaccaggggcuucugcaggacggaucuccuauucuccuguccgaugucaucagcgccuuucuguccaacaaugacacgcaaaaccucucuagccccgugacauucaccuucucccaccgggaagaggacccuguccugaccgugauuacauacaugggccuuucuguuagccugcucugccugcugcuugcggcccucaccuuucugcuguguaaagcuauccagaauacauccacgagccuccaucugcagcuuucucugugccucuuccuggcccaucugcuuuuucucguggcuauugaucagaccgggcacaagguccuguguuccaucauugccggcacacugcacuaccucuaucuggccacccuuacauggaugcugcucgaggcucuguaccuguuccuuaccgcgcgcaaccucacggugguuaauuauagcucuaucaacagauuuaugaaaaagcugauguuccccgugggauacggcgucccggccgugaccguggcuaucuccgccgccagccggccucaccuguaugggacacccucuagaugcuggcuccaacccgaaaaaggauuuauuuggggcuuccuggggccuguuugugcuaucuuuagcgucaaucuugugcuguuccucgugacccuguggauucugaagaaccgccuuuccagccucaacucugaggucuccacacugcggaauaccagaaugcuggccuuuaaggcgacggcucagcuguucauccugggaugcacauggugccuuggcauucuccagguggggccggccgcccgcguuauggcuuaccucuuuaccaucaucaacagccugcaaggcguguucauuuuccuggucuauugucuucugucccaacaggugcgggaacaguacggaaaauggucuaagggcaucagaaaacucaagacagagagcgaaaugcauacccuguccucuagcgccaaagcugacaccuccaagcccucuacaguuaauuga

SEQ ID NO: 65550 - RNA, 2361 nt, Artificial Sequence
  derived and/or modified sequence opt5 from ADGRE5__Homo_sapiens__NP_001020331
augggcgggagaguguuccuggccuuuugcgucuggcucacccugcccggagcugagacacaggacagccggggcugugcccgcuggugcccucaaaacuccucuuguguuaaugcgacggcuugcagauguaacccgggguucagcuccuuuucugaaaucauuaccacacccaccgagacaugcgaugacaucaaugaaugugccaccccuagcaagguguccugcggaaaauucucugauuguuggaacacagagggcagcuacgacugcguguguucccccggguaugaaccugucagcggagccaagaccuuuaaaaaugagucugagaacacgugccaggauguggacgaaugccagcagaauccccggcuuuguaaguccuacgggaccugcguuaacacacugggcagcuauaccugucaaugccucccuggcuucaaauuuauuccggaggaucccaagguguguacagacgucgaugaauguucuuccggacagcaccagugcgacagcucuaccgugugcuucaauacgguuggcuccuacagcugucgcugcagaccuggguggaagccccggcauggaaucccuaacaaucagaaagauacagugugugaggacaugaccuuuuccacauggacacccccgccuggcguccacucucaaacccugagccgcuucuuugauaaggugcaggaccuugggagagacuccaaaaccagcucugcugaggugacgauucagaacgucaucaagcugguugaugaacucauggaggcccccggagacguggaagcucuggccccucccgugcggcaucugaucgcgacccagcuccuguccaaucuugaggauauuaugcgcauccuggccaaaagccuccccaagggcccuuucacauauauuucuccgagcaacaccgaacugacacuuaugauccaagagagaggcgacaagaaugucaccauggggcaguccucugcucggaugaaacugaacugggccguggcugccggagcggaggaucccggcccugccguugcugggauucucagcauccagaacaugacgacacugcuggccaaugcuucccucaaccugcacagcaagaaacaagccgaacuugaggaaauuuacgagucuuccauccgcggagugcagcugagacggcucagcgccgucaauucuaucuuucugucccauaacaauaccaaggaacuuaacagccccauucuguucgcuuucucccaccucgagucuagcgacggcgaggcggggcgcgauccucccgccaaagacgugaugccgggaccuagacaggaacugcugugcgcuuuuuggaaguccgauucugaccggggcggccacugggccaccgaggggugccagguucucggaagcaaaaauggcuccacaaccugucaaugcagccaucugucuuccuucgccauccuuauggcucacuaugauguggaagacuggaagcugacacucauuacgagagucgggcuggcccuuagccuguuuugucuccugcugugcauccucaccuuccugcuugugcgccccauucagggaucucggacaaccauccaucugcaccucuguaucugccuguuugucggcuccacaauuuuccuggcggggaucgagaacgaaggcggacaggugggccuuagaugucgccucguugcugggcugcugcacuacugcuuucucgccgccuucuguuggaugagccuggagggacuugagcuguacuuucucgugguccggguguuccagggccaagggcugucuaccagauggcugugccuuauuggauauggcguuccucuccugaucgugggggucagcgcugccauuuacuccaagggcuauggacgcccccgguacuguuggcuggacuuugaacagggcuuccucuggagcuuucuggggccugugacguucaucauccuuugcaaugcugugauuuucguuaccacagucuggaaacugacccagaaguuuucugagaucaaccccgauaugaaaaagcucaaaaaggccagagcgcugacaauuaccgccaucgcucagcuguuccuucucggaugcacguggguguuuggccuguucauuuuugacgaucgcucccuggugcucacauaugucuucaccauccugaauugucuucaaggggccuuucuguaccuccugcauugccugcuuaacaagaaagugcgggaagaguauagaaagugggcuugucucguugccggaggcagcaaauacuccgaguucacaucuaccaccagcgggacaggccacaaucagacgcgcgcgcugcgggccuccgaaucuggaauuuga

SEQ ID NO: 65551 - RNA, 4041 nt, Artificial Sequence
  derived and/or modified sequence opt5 from ADGRF5__Homo_sapiens__NP_056049
augaaaagccccagacggaccacacugugccucauguucaucgugauuuacuccucuaaggccgcucugaacuggaauuaugagagcacgauccacccucuuucccugcaugaacacgagccggccggcgaagaggcgcuccgccagaagagagcugucgccaccaaaucucccacagccgaagaguacaccguuaacauugagaucagcuuugaaaaugcuuccuuccuggacccuauuaaggccuaucuuaacucucugagcuuucccauccaugggaauaacacagaucaaaucaccgacauucucuccaucaaugugacaaccgugugucggccugcuggaaacgagauuuggugcagcugugaaacgggcuacggguggccccgcgagagaugccugcacaaucugaucugucaggagcgggaugucuuccucccuggacaucacugcucuugucugaaagaacuuccgcccaacggcccuuuuugccugcuccaggaggacgugacccugaauaugcgcguuagacuuaacgugggguuccaggaagaucugaugaauacauccagcgcccucuaucggucuuacaagaccgaccuggagacagcguuucgcaagggauauggcauucugcccggcuucaaaggggucaccgugacgggauuuaaguccggcagcguuguggucacauacgaagugaaaaccacaccucccucucucgagcugauccacaaggccaacgagcaagugguccagucccuuaaucagaccuacaaaauggauuauaacagcuuccaggcuguuaccauuaacgaauccaacuuuuucgugacaccggagaucaucuuugaaggggacacggugucucuggucugugagaaggaagugcucagcuccaauguuagcuggagauacgaggagcaacagcuggaaauucagaauagcucccgguucagcaucuauaccgcccuuuucaacaauaugacaucugugagcaagcugaccauucauaacaucacaccuggagaugcuggcgaguacgucugcaaacucauucuggacaucuuugaauaugaguguaagaaaaagaucgaugugaugcccauucagauccuggccaaugaagagaugaaaguuaugugcgacaacaauccugugucccucaacugcuguucucaagggaaugucaacuggagcaagguggaguggaaacaggaaggaaagauuaauauccccggcacccccgagacggauauugacuccagcugcucucgcuacacacugaaggcggacggcacccaguguccuuccgggagcucuggaaccacagucaucuauaccugcgaguucaucuccgccuacggcgcuagagggagcgccaacauuaaagugacauuuaucuccguugcuaaucuuacgauuaccccggaucccaucucugugagcgagggacaaaacuucuccauuaaguguaucucugacgucagcaacuacgaugagguguauuggaauacauccgccggcauuaaaaucuaccagcgguuuuauaccacacgcagauaccuggacggggccgaaagcguucucaccgugaagacgucuacccgggaguggaacggaacauaucacugcaucuucagauacaaaaauuccuauagcauugcuaccaaggaugucaucgugcauccucugccccuuaagcugaacauuaugguggacccucucgaagcgacaguuucuuguuccggcagccaccacaucaaaugcuguauugaggaagauggcgacuacaaggucaccuuucauacggggucuagcucccugcccgccgcuaaagaggugaauaagaaacaggugugcuacaagcacaacuucaaugccagcucugucuccugguguagcaagacaguggauguuugcugccauuuuaccaacgccgcuaauaacuccguguggucuccgagcaugaaacugaaucucgucccuggagagaacaucacaugucaggaccccgugaucggcguuggggaaccuggaaaggugauucaaaaacugugccgcuucuccaauguccccucuagcccugagucccccaucggcgggaccauuaccuauaagugugugggcucucagugggaagagaaacggaacgauugcaucagcgccccgauuaauucccuucugcagauggcgaaggcucucaucaagagcccuucucaggacgaaaugcugcccacauaccugaaagaccuuuccaucagcauugauaaggccgagcacgagaucucuuccagccccggaucucucggcgccauuaucaacauucuggaccugcucuccacgguuccuacccaagugaacagcgaaaugaugacacauguccuguccaccgugaaugugauccuugggaaaccgguccugaacacauggaagguucuccagcagcaguggaccaaucaaagcucucagcugcugcacagcguggagagauuuucccaggcucugcagucuggagauucucccccucucuccuucucucaaacgaacgugcagaugagcuccauggucaucaaaucuagccaccccgaaacauaucagcaacgcuuuguguucccuuacuucgaccuguggggcaauguugugauugauaaguccuaucuggagaaccuccagagcgacucuuccaucgucaccauggccuuucccacccugcaggcuauucuugcccaggauauccaagaaaauaacuucgcggagagccuggugaugacaaccacaguuucucauaauacgaccaugccuuuucggauuuccaugacauucaaaaacaauagccccuccgggggagagaccaaguguguguuuuggaacuucagacucgccaauaacacaggcgggugggacucuagcggcugcuacgucgaagagggagauggcgacaaugugaccuguaucugcgaucaccugacguccuuuagcauucugaugucuccggacuccccugaucccagcucucuucucgggauccugcuggacaucauuagcuauguuggagugggcuucuccauccucucucuggcugccugucuugucguggaagcuguggucuggaaaagcguuaccaagaaccgcacauccuacaugcggcauaccugcauugugaacaucgccgcgucucugcucguggccaauacaugguuuauugucguggcugccauccaggacaacagauacauccuguguaagaccgcuugcguugccgccacauucuuuauucacuucuuuuaucugagcguguucuucuggaugcuuacccucgggcugaugcuguuuuaccgccucgucuucauccugcacgagacgucccggagcacacagaaagcuauugcguuuugccuuggauauggcuguccucuggccaucucugugauuacccucggggcuacccagcccagagagguuuacacacgcaagaaugugugcuggcugaacugggaagauaccaaagcccugcuugccuucgcuaucccggcccugaucauugucguggucaauaucacgauuacaaucgugguuauuaccaagauccuccggccuuccauuggcgacaagcccuguaaacaagaaaagagcucccuguuucagaucucuaaaagcaucggagugcucacaccucugcuuggccugaccuggggguucggacucacaaccgucuuucccggcacgaaccugguguuccauauuaucuuugcgauucugaauguuuuccaggggcuuuuuauccuucucuucggaugccugugggaucucaaggugcaggaagcucugcuuaacaaauucucccugucuagauggagcucccaacacagcaagucuaccucccucggcagcucuacacccgucuuuuccaugagcucuccuauuagccggcgcuucaauaaccuguuugggaagaccggcacauauaauguguccaccccggaggccacgucuagcucccuggaaaacagcuccucugccagcucccuucugaauuga

SEQ ID NO: 65552 - RNA, 1572 nt, Artificial Sequence
  derived and/or modified sequence opt5 from ADGRG1__Homo_sapiens__NP_001277071
augacaccccagagccugcuccaaaccacgcuguuccuucugucccuccuguuucuugugcagggcgcccacgggagaggacaucgggaggacuuccgcuuuugcucucagcagcugcaaagccucgaauccaagcugaccucugucagauucaugggcgauaugguuagcuuugaggaagaccggaucaacgcuacaguguggaaacugcagccuaccgccgggcuccaggaucugcacauucauucccgccaggaggaggaacaaucugagaucauggaauacagcgugcuucugccgagaacacucuuccagcggaccaagggacgcuccggcgaggcggaaaagagacugcuucuggucgacuuuagcucucaggcucucuuccaggauaaaaauuccagccaagugcugggggagaaaguucugggaauugugguccagaacacaaagguggccaaucucaccgagcccguugugcugacguuucagcaccaacuucagccuaagaacgucacccugcaguguguguucuggguggaagaccccacacucucuuccccuggccauuggagcucugccggcugcgagaccguccggcgcgaaacacagaccuccuguuuuugcaaucaccugacguauuucgcuguucuuauggugagcuccguggaggucgaugccgugcacaaacauuaccugucucuccugagcuauguuggguguguggucuccgcucuggccugccucgugacaaucgcggccuaccuguguagcagaguuccccuuccuugccggcgcaagccgagagacuauaccauuaaagugcacaugaaccugcuccuggcugucuuucuucuggauacaucuuuccuccuguccgaacccguggcccugaccggaagcgaggcuggcugucgggccucugcgaucuuccuccauuuuagccugcuuaccugccuguccuggauggggcucgagggauacaaucuguaucgccuggucguggaaguuuucggcacauacgugccuggguaccuucucaagcugucugccaugggauggggcuuucccaucuuccuggucacgcucguggcucugguugacguggauaacuauggcccuauuauccuugccguccacagaacccccgagggggugauuuacccgagcauguguuggauccgggacucccuggugagcuauauuacaaaucucggacuguuuucucugguuuuccuuuuuaacauggcuaugcucgccaccauggucgugcaaauccugagacugcgcccucacacacagaaauggucccaugugcucacccugcuuggccugagccucguccuggggcugcccugggcccuuauuuucuuuucuuucgcuuccggaacguuucagcucgugguucuguaccuguucagcaucaucacauccuuucagggcuuccucauuuucaucugguauuggucuaugcggcugcaagcgagagggggaccuagcccccuuaaguccaauucugauagcgcccgccugcccauuuccagcggcucuaccuccagcucucggaucuga

SEQ ID NO: 65553 - RNA, 3054 nt, Artificial Sequence
  derived and/or modified sequence opt5 from ADGRG2__Homo_sapiens__NP_001073327
augguguucagcgucagacagugcggccacguugggcggaccgaggaagugcugcucacauuuaagaucuuccuggugauuaucugucuucaugucgugcugguuacgucccucgaggaagacaccgauaacucuagccuguccccucccccggccaaacuuucuguggucagcuuugcucccuccucuaauggaacaccugagguggaaaccacaagccugaacgacguuacccucucccugcugcccagcaaugagacagagaagaccaaaauuacgaucgugaagaccuucaacgccucuggcgucaaaccucaacgcaauauuugcaaccucuccagcaucuguaaugauucugcguuuuucagaggggaaaucauguuucaguacgacaaggaguccacagugccccagaaccagcacauuaccaauggaacacugaccggcgugcuuagccugucugaacucaagcgguccgagcugaacaaaacgcuucaaacacugagcgagaccuauuucaucaugugcgcuacagccgaagcccaguccacccucaauuguaccuuuacaauuaagcugaacaauacgaugaacgcuugcgccgucaucgcugcccuggagcgcguuaaaauuagaccuauggaacauuguugcuguucugugcggaucccgugccccagcuccccugaggaacucgagaagcugcagugugaucuucaggaccccauugugugccuggcggaucacccucgcgggcccccguucagcagcucccaaagcaucccugucgugcccagagccaccguucucucucaggugccuaaagcuaccagcuuugccgagccucccgacuacucccccgucacacauaaugugccgucucccaucggagaaauucagccucugagcccccagccuuccgcucccaucgccagcucuccggcgauugauaugccuccccaauccgagacaaucagcucuccuaugccccagacccacguuuccggcacgccucccccggugaaggccagcuucuccucuccuacagucagcgcucccgccaacgugaacaccaccuccgcucccccuguccagacagacauugugaauaccucuagcaucuccgaucuugaaaaccaaguucugcagauggagaaggcccucagccugggcucucuggaaccgaaucucgccggggagaugaucaaccaggugucccggcugcuucacucucccccugacaugcuggcuccccucgcgcagcgccugcuuaaagucguggaugacauuggacugcaacucaauuuuucuaacacaacgaucucccugaccagcccuucucuggcccucgcuguuauuagagugaaugccagcuccuucaacacaaccacauucgucgcccaggaccccgcuaaucuucaggugagccuggagacccaggccccugaaaacucuaucggcacgauuacccugcccuccagccucaugaauaaccugccggcgcaugauauggagcuggcuucccgggugcaauuuaauuucuuugaaaccccugcccuuuuccaggaccccucucucgagaaccugagccugaucuccuauguuaucucuagcuccgucgccaaucucacagugcgcaaccugacaagaaacgugaccgucacgcuuaagcacauuaauccuucucaggaugaacugacagugcggugcguguuuugggaccucgggcgcaacggaggcagagggggauggagcgauaauggcuguuccguuaaagaccggagacugaacgagaccaucugcacauguagccaucugaccucuuucggcguccuucucgaucugucccgcaccagcgugcugcccgcucagaugauggcccucacauuuauuacguacaucgggugcggacugucuuccauuuuccuuagcguuacccuggugacauauaucgcuuuugagaagauucggagagacuacccgucuaaaauccucauccaacugugugccgcgcugcuucuccugaaucuggucuuccuccuggauuccuggauugcccuuuauaagaugcagggccugugcaucagcguggcuguuuuucuccacuacuuccugcugguguccuuuaccuggauggggcuugaagccuuccacauguaccucgcucuggucaaaguguucaacacauauauucgcaaguacauccugaaguuuuguauugugggauggggcgucccugccguuguggugaccaucauccucacgauuagccccgacaauuaugggcugggaucuuacggcaaauucccuaacggcagccccgaugacuuuugcuggaucaauaacaaugcggucuucuauauuacagugguuggguacuuuugugugaucuuccuucugaacgucuccauguuuauugugguucucgugcagcugugccggaucaagaaaaagaaacagcugggagcccaaagaaagaccucuauccaggaccuucgcagcauugcuggccugaccuuccuccuggggaucacauggggauuugccuucuuugcuuggggccccgucaaugugaccuucauguaucucuuugccauuuucaacacacugcagggguucuuuaucuucaucuuuuacuguguugccaaggagaaugugcggaaacaauggagacgcuaccuuugcugcggcaagcugcggcucgcugaaaacuccgauuggucuaaaacggcgaccaacggacugaagaaacagacagucaaucagggcgugagcuccucuagcaacucccugcagucuagcuccaauagcaccaacucuacaacccuucuggugaauaacgacuguuccguccaugccagcgggaauggaaacgcuuccacggagagaaauggcguuucuuucagcgugcaaaacggggaugugugccuccacgacuuuaccggaaagcagcauauguucaaugagaaggaagauuccuguaacggcaaagggcgcauggcccugcggagaacaagcaagcggggcucucuccacuuuauugagcagauguga

SEQ ID NO: 65554 - RNA, 1650 nt, Artificial Sequence
  derived and/or modified sequence opt5 from ADGRG3__Homo_sapiens__NP_740746
auggccacccccagaggccugggggcucuccugcuucugcuccugcuuccuacaagcggacaggagaagccgacggaaggcccccggaauaccugccugggguccaacaacauguacgacaucuucaaucucaacgauaaagcccuguguuuuacaaagugccgccaaucuggaagcgacuccuguaauguggagaaccugcagagauauuggcucaauuacgaagcgcaccugaugaaagagggccuuacccagaaggucaacacaccuuuccugaaagcucucguucagaaucugucuaccaacacagccgaagauuuuuauuucagccuugagcccucccaagugccucgccaggugaugaaggacgaggauaagcccccugaccgggucagacugccgaaaucucucuuucggagccugcccgggaaucgcuccgugguuagacuggccgugaccauucucgauaucggaccuggcacgcuguucaagggcccccggcuugggcugggagacggcagcgggguccucaacaaucgccuggugggacuuucuguuggccagaugcaugugaccaaacuggcugaaccucucgagauugucuuuucccaccagagacccccgccuaacaugacacugaccugcguguucugggaugugacaaaggggaccacgggagacuggagcucugaaggcuguuccacagagguccggcccgagggcaccguuugcuguugcgaucaucugacauuuuucgcccuccugcuucgcccuacccuggaccaaagcaccgugcacauccucacaagaauuucucaggcuggguguggaguguccaugaucuuucuggccuucacgaucauucuuuacgcguuucugcggcucagccgcgaaagauucaaauccgaggaugcccccaagauccaugucgcucugggcgggucucuguuccuccugaaucuugccuuucuggugaacguuggaagcggcuccaaggggagcgacgcugccugcugggcgcggggagccguguuccacuauuuucuccugugugcuuucaccuggaugggccuggaagccuuucaccuuuaccuccuggcugucagaguguucaacacauauuuuggccauuacuuccugaaacucucucugguuggguggggacuucccgcccugauggugauuggcaccggguccgccaauagcuacggacucuauacaauccgcgaccgggagaacagaaccucucuggaacugugcugguuucgcgagggcacgacaauguacgcucuuuauauuaccguccacggguacuuccucaucaccuuucuguucggcauggugguccuggcgcucgugguuuggaagauuuuuacacugagccgggccaccgcugugaaagagagaggaaagaaucgcaaaaagguccuuacacugcucggccuguccucucugguggggguuacguggggacuugccaucuucaccccucucggccugagcacaguguauaucuucgcccuguuuaacucccuccagggggucuucauuugcuguugguuuaccauccuguaccuuccgagccagucuacaaccguguccagcucuacggcucggcuggaucaagcccauuccgcgagccaggaauga

SEQ ID NO: 65555 - RNA, 3582 nt, Artificial Sequence
  derived and/or modified sequence opt5 from ADGRG6__Homo_sapiens__NP_001027566
augauguucagaagcgaccggaugugguccugccacuggaaguggaaacccucuccucugcucuuucuguucgcccuuuacaucaugugugugccgcauagcgucuggggcugcgcuaacugucgcguugugcuguccaaucccucugggaccuuuacaagcccuugcuaucccaacgauuacccuaauucccaggccuguauguggacgcucagagcgcccaccggauauauuauccaaauuacauucaacgacuuugauaucgaggaagcuccuaauugcauuuacgacucucugagccuugauaacggcgagucccagaccaaguucuguggggccacagccaaaggacugagcuuuaauucuuccgcuaacgaaaugcacgugagcuucucuuccgacuuuagcauccagaagaaaggcuucaaugccucuuauauccgggucgcugugucccuccgcaaccagaagguuauucugccgcaaaccagcgaugccuaccagguguccgucgcgaagucuaucagcauucccgagcuguccgccuuuacacucugcuucgaagcuaccaaaguggggcaugaggacagcgauuggacggccuuuucuuauuccaaugcuagcuucacccagcugcuuucuuucggaaaggccaaaagcggcuacuuucuguccaucucugacagcaagugucuccugaacaaugcgcuuccuguuaaagagaaggaagauauuuucgccgaguccuuugaacagcugugccucguguggaacaauagccugggcucuaucggggucaacuucaagagaaacuacgagacagugcccugugacuccaccauuagcaaagugaucccuggaaauggcaagcugcuccuggggucuaaccaaaaugagaucgucucccuuaaaggagauauuuauaacuuucggcuguggaauuucacaaugaacgcuaagauccucagcaaucuguccugcaacguuaaaggcaaugugguggacuggcagaacgacuuuuggaauauucccaaccuugcccugaaggcugaaucuaaucucagcugcggguccuaccugaucccgcugccugccgccgagcucgcuucuugugcggaucugggaacccuuugccaggacggcauuaucuaucgcaucagcgucgugauucagaacauccugagacaccccgaaguuaaagugcaauccaaggucgccgaguggcucaauagcacguuccagaacuggaacuacacaguguauguugugaauauuucuuuucaucuguccgcuggcgaagauaagaucaaagucaagcggagccuugaggacgagccucgccuggugcucugggcccugcuggucuacaacgccaccaauaacacaaaucucgaagggaaaauuauccagcaaaagcugcuuaaaaacaaugagucucuggaugaaggacucagacugcacaccgugaacguucggcagcugggccacugucuugcuauggaggaacccaagggguauuacuggcccuccauccagccuagcgaguacgugcucccgugccccgacaagccuggauucucugccagccgcauuuguuuuuauaaugcgaccaacccccuggucacauacuggggcccuguggauaucuccaauugccugaaagaggcuaacgaaguugccaaucagauucucaaccugacggccgacgggcaaaaucuuaccagcgcuaacaucacaaacauuguggagcaggucaagagaaucgugaauaaagaagagaacauugauaucacccugggaucuacacucaugaauaucuucuccaacauucugagcuccucugacagcgaucugcuugaauccucuagcgaggcccucaagaccaucgacgagcuggcuuuuaaaauugaccugaauagcacgucucaugugaacaucacaacccggaaucucgcccugagcguuuccagccuucugcccggcaccaacgcgauuucuaauuucuccaucggccucccgagcaacaaugaaucuuauuuccagauggauuuugaguccgggcaggucgacccucuggccagcgugauccugcccccuaaccuucucgaaaaucugucucccgaggauuccgugcugguccgcagagcucaauucacauuuuucaacaagaccggacucuuucaggacgugggcccucagcggaagacacugguuagcuacgugauggccuguuccauugggaauaucacgauucagaaccuuaaagaucccguccaaaucaagauuaaacacaccagaacacaggaggugcaucacccgaucugcgcuuucugggaccugaacaagaauaaauccuuuggaggcuggaacaccucuggguguguugcccaccgcgauagcgacgcguccgaaacagugugccucuguaaucauuucacccacuuuggcguccugauggaucugccucggucugccagccagcuugacgcuagaaacacgaaggugcucaccuucaucuccuauauuggaugcggcaucucugccauuuuuagcgcugccacacugcugaccuacguugccuucgagaagcuccgccgggauuaucccuccaaaauccugaugaaucuuucuacagcucugcucuuucugaaccugcuuuuccugcucgacggguggauuaccagcuucaauguggauggacugugcaucgcggucgccgugcuccugcacuuuuuccuucuggcuacguuuacauggaugggccucgaagccauccauauguacauugcccuggugaaggucuucaacaccuacaucagacgcuauauucugaaauuuuguaucauuggguggggacuucccgcucugguuguguccgugguccucgccagccggaauaacaaugagguguacggcaaggaaucuuaugggaaagagaagggcgacgaguucugcuggauccaggacccuguuaucuuuuacgugacaugugcgggauauuucggcgucauguuuuuccugaacauugcuauguuuaucgugguuauggugcaaauuugcgggagaaauggaaaacgcuccaaccggacccucagagaagagguccugcgcaaucuucggagcgugguuucucugaccuuccuccugggcaugacauggggguucgccuuuuucgccuggggaccgcugaacauccccuuuauguaccuuuucuccauuuuuaauagccugcagggccucuucaucuuuauuuuccauugugcuaugaaggaaaacgugcagaagcaauggagacggcaccugugcugugggcgcuuuagacucgccgauaacuccgacuggucuaaaacggcgaccaauaucaucaagaaaagcuccgauaaccugggcaagagccuuucuuccagcucuauuggaagcaauuccacauaucugaccucuaaaagcaaguccucuagcacaaccuacuucaagcggaacucccacacggacaaugucagcuacgagcauucuuuuaacaaauccggcagccugagacagugcuuccacggacaggugcucgugaagacagggccuuguuga

SEQ ID NO: 65556 - RNA, 2394 nt, Artificial Sequence
  derived and/or modified sequence opt5 from ADGRG7__Homo_sapiens__NP_116176
auggccagcugcagagcuuggaaccugcgggugcucgucgccguuguguguggccugcuuaccgggaucauucugggacucggcaucuggcgcauugugauccggauucagagagggaaguccacaucuagcuccucuacgcccaccgaguucugccgcaauggaggcacaugggaaaacgggagauguaucugcaccgaggaauggaaaggacugcgguguacaaucgcgaauuuuugcgagaacagcaccuacaugggcuucacauuugcucgcauuccugucggcagauaugggccgucccuucaaaccuguggaaaggacacgcccaaugccggcaacccuauggccgugcggcugugcucucucagccuguacggggaaaucgagcugcagaaaguuaccauuggaaauuguaacgagaaucucgaaacacuggagaaacaggugaaagaugucaccgcuccccuuaacaauaucuccagcgaagugcagauucugacaucugacgccaacaagcucaccgcugagaauaucacguccgccacacgcguugugggccaaauuuucaacaccagcagaaaugcgucuccugaggccaagaaagucgcuaucgugacagugucccagcugcuugaugccagcgaagacgcuuuucagcgggucgccgcgaccgccaacgaugacgcucugaccacacucaucgagcagauggaaacguauucucugucccuggggaaccaaagcguuguggagcccaauauugccauccaguccgcuaacuucucuagcgaaaaugccgugggaccuuccaacguccgcuuuagcgugcagaagggcgccucuuccagccucguuucuagcuccaccuucauucacacaaauguggauggccugaacccggacgcucagaccgagcuucaaguccugcucaauaugacaaagaacuacaccaagacgugcggguuugugguuuaucagaaugauaaacuguuccagucuaagacauuuaccgcgaaaagcgacuucucccaaaagaucauuagcucuaagaccgaugagaacgaacaggaccaguccgccagcguggauauggucuuuucucccaaauacaaucagaaggaguuccaacuuuauuccuacgcuuguguguacuggaaccugagcgccaaagacugggacacauauggaugccagaaggauaaaggcaccgacggguuccucagaugccgguguaaucauacaacgaacuuugccguccugaugaccuucaagaaggauuaccaguauccuaaaucccuggacauccucucuaaugugggaugcgcucugagcguuacaggccuugcccugaccgugaucuuucagauugucacacgcaaggugagaaaaaccuccguuacgugggugcucgucaaccuguguaucucuaugcuuauuuucaaccugcucuuuguguucgggaucgaaaauagcaacaagaaucugcaaaccuccgauggagacauuaacaauaucgauuuugacaacaaugauaucccccggacagacaccauuaacaucccuaaucccaugugcacagcgauugcugcccugcuccacuacuuccugcuugugaccuuuacguggaacgcccugagcgcugcccagcucuauuaccugcugaucagaacaaugaaaccgcuuccucgccauuucauucucuuuaucucucugauuggcuggggcguucccgcuaucgucguggccaucaccgugggggucauuuauucccagaauggaaacaauccucagugggagcuggauuaccggcaagaaaagaucuguuggcucgcgauucccgagcccaacggcgugaucaagagcccucugcuuuggucuuucauuguuccggugacaaucauccugauuuccaaugucgugauguuuaucaccauuagcaucaaaguucucuggaagaacaaccagaaucugaccucuacgaaaaaggugagcuccaugaaaaagauugucagcacacugucuguggccguuguguucgggaucaccuggauccuugcuuaccucaugcuggucaacgacgacuccauuagaaucguguucagcuauaucuuuugccuguucaauacaacccagggacuccagauuuuuauucuguacacagugcgcaccaaggucuuccaauccgaggccucuaaaguucuuaugcugcucagcuccaucggccggagaaagucucugcccagcgugacgcgcccucggcugagagugaaaauguauaacuuucuucgcucccuccccacacugcacgaacgguucagacugcucgagaccucuccuagcaccgaagagaucacacuguccgaaagcgauaaugcuaaggagucuauuuga

SEQ ID NO: 65557 - RNA, 4425 nt, Artificial Sequence
  derived and/or modified sequence opt5 from ADGRL1__Homo_sapiens__NP_001008701
auggccagacuggcugccgugcucuggaaccugugcgucaccgcgguucuugugacaagcgcuacgcagggccugucccgggccgggcuccccuucggacugaugcgcagagagcuugccugugaaggcuacccuaucgagcugcggugcccggggucugacgugauuauggucgaaaaugcuaacuauggacgcaccgaugacaagaucugugaugccgaccccuuucaaauggagaaugugcagugcuaccucccugaugcuuucaaaauuaugagccagagauguaacaaucggacacagugcguuguggucgccggcuccgacgcguuucccgauccuugucccgggaccuauaaguaccuggaagugcaauaugacugcguuccuuacaaaguggagcagaaggucuucguguguccgggaacacugcagaaagugcucgagcccaccucuacacacgaaagcgagcaucaguccggcgccuggugcaaggauccucugcaagcuggcgaccgcaucuaugucaugcccuggauuccuuacagaaccgauacgcuuaccgaauacgccucuugggaggacuauguugcugcccggcacacaaccacauaccgccugcccaacagaguggaugggaccggauuuguggucuaugacggcgcgguguucuacaauaaggagcggacgcgcaacaucguuaaauaugaccucagaacacggaucaagagcggggaaaccgugauuaauacagccaacuaccaugauaccuccccguaucgcuggggaggcaaaaccgacaucgaucuggcugucgacgagaaugggcuuugggugauuuacgccacagaaggaaacaauggcagacugguugugagccagcucaacccuuacacgcugcgguuugagggcaccugggaaacaggguaugauaagagaucugcuuccaaugccuucauggucuguggagugcuguacguccuccgcagcguguauguugacgaugacucugaggccgcuggcaaccggguggauuacgcguuuaacaccaaugccaacagagaggaacccgucucccugacauucccuaaucccuaucaguuuaucagcucuguggacuacaacccccgcgauaaucagcuuuauguuuggaacaauuacuucgugguccgguacucccuggaguuugggccuccggaccccagcgcuggaccugccaccucucccccucucuccacgacaaccaccgccagacccacaccgcugaccagcacagcuuccccugccgcgacgacaccccuucgccgggcuccucugaccacccaccccgugggcgccauuaaccaacucgggccugaccugcccccggccacagcuccugugcccagcaccagacggcccccugccccgaaucugcauguuucucccgaacucuucugcgagccucgcgaagucagacgcgugcaguggcccgcuacgcagcaaggaaugcugguggagcggccuugccccaaaggcaccagaggcaucgccuccuuccagugucuuccugcgcuggggcucuggaacccccggggaccggaucugagcaauugcacaucuccuugggucaaccagguggcccagaagauuaagagcggcgagaaugcugccaacaucgcuuccgaacuugcccgccacaccagagggucuaucuaugcgggagacguuagcuccagcgugaaacugauggagcaacuccuggauauucuggacgcccagcuccaggcucugcggcccaucgaaagagagucugccggcaagaauuacaacaaaaugcacaagcgcgaacggacauguaaagauuauauuaaggcugucguggagaccguugacaaccuucugagaccugaggcccucgaauccuggaaagauaugaaugccacggaacaggugcauacagcuaccaugcugcuggacguccuugaggagggggcguuucuccuggccgauaacgugcgcgagcccgcuagauuccuggccgccaaggaaaauguugugcucgaggucacagugcugaacaccgaaggccaagugcaggagcuugucuuuccgcaggaagaguacccucggaagaauagcauccagcugucugcuaaaaccauuaagcaaaacucccgcaauggaguugugaaaguggucuucauccucuauaacaaucugggccuguuucuuagcacagagaacgccacggugaagcucgcgggggaagcuggacccggcgggccuggaggcgccucccugguugucaauucucaggugaucgccgcuagcauuaacaaagaguccucuagaguguuccugauggaccccguuaucuuuaccguggcccaccucgaagauaagaaucauuucaacgcgaauugcagcuuuuggaacuacuccgagcggagcaugcugggguauuggucuacacagggcugucgccuugucgaauccaacaagacccacacaaccugcgcuuguagccaccugacgaauuucgccgugcucauggcccauagagagauuuaccagggacggaucaacgagcugcugcuuucuguuauuacaugggugggcaucgucaucucccucgugugccuggcuauuuguaucagcaccuuuugcuuccugcgcgggcuccaaaccgacagaaauacaauucacaaaaaccuguguaucaaucuuuuucuggccgaacuccuguuccuggugggaauugauaagacccaguacgagaucgcuugccccauuuucgccggccuucuccauuacuuuuuccuggcggccuuuucuuggcugugccucgaagggguccaccuguaucuucugcucguugagguguucgaaagcgaguauucccggacaaaauacuauuaccugggaggcuauuguuuuccugcucugguggucgggaucgccgcugccaucgacuaccgcagcuacggcacggagaaggccugcuggcuuagaguggacaacuauuucauuuggucuuuuaucggaccgguuuccuucgugauugucgugaaucugguuuuucucauggugacccugcauaaaaugauccggagcuccucuguccucaagcccgauagcuccagacuggacaacauuaagucuugggcucuuggcgcgaucgcccuccuguuccugcuggggcuuacaugggcuuuuggacuccuguucaucaauaaagaaagcguggucauggccuaccuguuuaccacauucaacgccuuccagggcguguuuauuuucguuuuucacugugcucuccaaaagaaagugcacaaggaguauuccaaaugccugcgccauucuuacuguugcauccggagcccucccgggggaacccacggcucccuuaagacgagcgccaugagaucuaauacccgcuauuacacagggacccagucccggauuagacgcauguggaacgauacaguccggaagcagaccgaaagcucuuucauggcgggcgacaucaauuccacaccuacccugaacagaggaacgaugggcaaucaucuccugacaaaccccgugcugcagccucgcgggggaaccagcccguauaacacccuuauugcugagucuguuggcuuuaaucccuccagcccucccguguucaacuccccugggagcuaccgggagcccaaacacccgcugggaggcagagaagccuguggcauggauacacucccucugaaugggaacuuuaauaacucuuacagccuccgguccggagacuucccucccggcgaugggggacccgagcccccucgcggcagaaaucuggccgacgcugccgcguuugaaaagaugaucaucucugagcuuguccacaacaaucugcgggggagcuccucugcugccaaaggaccgcccccucccgaaccucccgugccgccugugcccggcggcgggggagaggaggaagccggcgggccuggaggcgcugaucgcgccgagauugaacugcucuauaaggcucuggaggaaccccuucugcucccuagagcccaaagcguucuguaccaguccgaccucgaugagucugagagcugcaccgcggaagacggggccacgucccggccccugagcucuccgccuggaagagauucccuuuaugcuagcggcgccaaccugcgcgacucucccuccuaccccgacagcuccccugagggcccgucugaagcucugcccccucccccucccgccccuccggggcccccugagaucuauuacacaagccggcccccugcccucgucgcuagaaauccccugcagggauauuaccaggugcgccggccgucccaugaaggcuaccuugcggccccugggcuggagggacccggccccgauggggacggacaaaugcagcucgugaccagccuguga

SEQ ID NO: 65558 - RNA, 4410 nt, Artificial Sequence
  derived and/or modified sequence opt5 from ADGRL3__Homo_sapiens__NP_056051
auguggcccagccagcugcucaucuucaugaugcugcuugccccuauuauccacgcuuuuuccagagccccgauucccauggcggugguccggcgcgagcugucuugcgaaagcuacccuaucgagcucagaugucccggcaccgacguuauuaugaucgaauccgcuaacuaugggcggaccgaugacaagaucugcgauucugacccugcccaaauggagaauauucgcuguuaccugcccgaugccuauaaaaucaugagccagagaugcaacaaucggacgcagugugcugugguggccggaccugacgucuucccggaucccugcccuggcaccuacaaguaucuugaagugcaguacgaguguguucccuauaaaguggagcaaaaggucuuucugugcccugggcuccugaaaggaguguaccaguccgaacaucuguucgagucugaccaccagagcggcgcuugguguaaggauccccuccaggccuccgacaagauuuacuauaugccguggacaccuuaccgcaccgauacacugaccgaauauagcucuaaagacgauuuuaucgcggggagacccacaaccacguacaaacuuccucaucggguugacggaaccggcuucguggucuaugacggcgcccuguuuuucaacaaggagcgcacaagaaauauugugaaguuugaucuccggacccgcaucaaauccggggaggcuauuaucgccaacgcuaauuaccacgacacaagccccuauagauggggaggcaagucugauaucgaccuggccguggaugaaaacgggcuuugggucauuuacgcgaccgagcaaaauaacggaaagaucguuauuucccagcugaaucccuacacgcuccggaucgaaggcacaugggacaccgccuaugauaaacgcagcgcuucuaacgccuucaugauuugcgggauccuguacguggugaaguccgucuaugaggacgaugacaaugaagcuacaggaaacaaaaucgauuacauuuauaauaccgaccagagcaaggacucccugguggauguuccuuuuccgaacucuuaccaguauaucgccgccguggacuacaaccccagagauaaucuccuguacgucuggaacaauuaucaugugguuaaauacagccuugacuucggcccucuggauucccggagcggccaagcucaccacggccaggugucuuauauuuccccucccauccaucucgacagcgagcuggagagacccucugucaaggauauuagcaccacaggaccgcuuggcaugggguccacgaccacaucuaccacacugcgcaccacgacacucagcccuggacgguccaccacccccagcgugucuggcagacgcaaccgguccacaagcaccccuucucccgcggucgaagugcuggacgauaugacaacgcaucugccuuccgccagcucccagauccccgcucucgaggaaucuugugaggccguugaagccagagagaucaugugguuuaaaacccgccaagggcagauugcuaagcagccgugcccugccggaacaaucggcgugagcaccuaccugugccuugcgcccgacggcauuugggauccccaggggccugaccuguccaauuguucuagcccgugggucaaccacaucacacaaaagcucaaauccggagagaccgcugccaauauugcccgggaacuggcugagcagacgagaaaccaccuuaaugccggcgauaucaccuauagcgugcgcgcuauggaccagcugguugggcuccuggacgugcagcugcggaaccucacacccggaggcaaggauucugccgcgagaucccugaauaaacuucaaaagcgcgaacggagcugcagagccuacguccaggcuaugguggagaccgugaacaaucugcuccagccucaggcccugaacgcuuggcgggaccugacaaccucugaucaacuucgcgccgcgacgaugcuccugcacacaguugaagaguccgccuucguccuggcugacaaucuccugaaaaccgauauugugagagagaacacagacaacaucaaacuugaaguggcccggcugagcaccgaggggaaucucgaagaucugaaguuccccgagaacaugggccauggaucuaccauccagcugagcgcuaauacacuuaagcagaacggcagaaauggggagauucgcgucgccuuugugcucuauaacaaucugggaccuuaccuguccacggaaaacgccagcaugaagcucggcaccgaggcucugucuacaaaucacuccguuaucgugaacagccccgucauuaccgcggccaucaauaaagaguucuccaacaagguguaccuugcugacccuguuguguuuacagucaaacauauuaagcagucugaagaaaauuucaaccccaauuguagcuuuugguccuauucuaagcggaccaugacgggguacuggagcacacaaggaugcagacugcucaccaccaacaaaacacacaccacauguuccugcaaccaucugacgaauuucgccgugcugauggcccacguugaggugaagcacucugaugcuguccaugaccuucuccuggaugugaucaccugggugggcauccugcucagccuggucugucuucugauuugcaucuuuacauucugcuuuuuccgcgggcuccaguccgacagaaacaccauucacaaaaaucuguguaucagccuguuuguugccgagcuucucuuccugauuggcaucaaccggacagaucagccgaucgcgugugcuguguuugccgcccugcuccauuucuucuuucuggcugccuucaccuggauguuucuugaaggagugcaacuguauauuaugcucgucgagguguucgaaucugagcacucccgcagaaaguacuuuuaucugguuggcuacgggaugccugcgcugaucguggcugucagcgccgccguggacuaucggucuuacggaacggacaaaguuugcuggcuucgccuggauaccuacuucauuugguccuuuaucggccccgcuacacucauuaucaugcugaaugugaucuuccucgggauugcccuguauaagauguuucaccauaccgcuauccuuaagccugaaagcggaugccuggacaacauuaauuacgaggauaacagacccuucaucaaaucuugggucauuggcgccaucgcgcuccugugucugcuugggcugacaugggccuuuggccucauguauauuaaugaguccaccgugaucauggcuuaccuguucacaaucuuuaacagccuccagggaauguucauuuucaucuuucacugcguucugcagaagaaagugcggaaggaauauggcaaaugucuucgcacccauugcuguuccggaaagagcacggagucuagcauuggguccggcaaaacaucugggagcagaaccccgggacgguacuccaccggcucucagagccgcaucagacggauguggaaugacacagucagaaagcaauccgaaucuagcuucauuaccggggauaucaacuccagcgccucucugaaucgcgagggccuccugaacaaugcucgggacacguccgugauggauacacugccucuuaacggaaaccacggcaauagcuauucuaucgccuccggggaauaccugagcaacugcgugcagauuaucgacagaggauacaaucauaacgagaccgcccucgagaagaaaauucugaaggaacucacauccaauuauauccccucuuaccugaacaaucacgagcgcagcuccgaacagaaccggaaucuuaugaacaaacuggucaauaaccugggcagcgggagagaggaugacgcuauuguucucgaugacgcgaccucuuuuaaucacgaggaaucccugggacuugagcugauccaugaagagagcgacgccccucuccugccuccccgcguguauucuacagaaaaccaccagccccaucacuacacccggagacgcaucccgcaagaucauagcgaguccuucuuuccccuccugacgaaugagcacaccgaagaccuucagucuccucaccgggauagccuguauacauccaugcccacccuggcuggcguggccgccacagagucugucaccacgagcacacagaccgaaccucccccugcuaaguguggcgacgccgaggauguguacuauaaauccaugccgaaccucgggagcagaaaucauguucaccagcugcauacauacuaccaacuuggacgggggucuuccgacggguucauugugcccccuaacaaggauggaacacccccugaaggcagcuccaaggggcccgcgcaccuggucaccucucucuga

SEQ ID NO: 65559 - RNA, 18921 nt, Artificial Sequence
  derived and/or modified sequence opt5 from ADGRV1__Homo_sapiens__NP_115495
augagcguguuccugggacccgggaugccuuccgcgucucuccuggugaaccuucugagcgcucuccugauccuuuuuguuuucggagaaacagaaauuagauuuacgggccagacggaguucguggugaaugaaaccuccacaaccguuauccggcugauuaucgaacgcauuggggaaccggccaacgugacagcgaucguuucucucuacggagaagaugcuggcgacuuuuucgacaccuaugccgccgcuuuuauccccgccggggagacaaauagaaccguguacauugcugucugcgaugacgaucugccugaacccgacgagacguucaucuuucaccugacccuccagaagccuagcgccaacgugaaacugggauggccccggacaguuaccgugacaauucuuuccaaugauaacgcguucggcaucauuucuuuuaauaugcugccuagcaucgccgucuccgaaccgaagggccgcaacgagagcaugccccucacccugauuagagagaaagggacguauggaauggugauggugacauucgaagucgagggcgggccuaaucccccugacgaagaucuuucucccguuaagggaaacaucaccuuuccgccuggccgggcuacagugaucuacaaucugaccgugcucgacgaugagguccccgaaaacgacgagauuuuccugauccagcugaaauccguggaagggggagccgaaauuaauaccagccgcaacucuaucgagauuaucaucaagaagaaugauuccccuguuagauuccuccagagcauuuaucuggugcccgaagaggaccacauccuuauuauccccgucgugcggggcaaagacaacaacggcaaucugauugggucugaugaauacgagguuuccaucagcuaugcugugacaacgggaaacuccaccgcccacgcgcagcaaaaucucgacuuuaucgaucugcagccuaacacaaccgucguguucccgcccuuuauucacgagucucaccuuaaguuccagaucgucgacgauacaauuccugaaaucgccgagagcuuucauauuaugcugcucaaagacacccugcagggcgaugcugugcugaucucccccagcguugugcaagucacgauuaagccuaaugacaaacccuacggggugcucucuuucaacuccguucuguuugaacgcacagugaucaucgaugaggacagaauuagccgguacgaagagaucaccgucgugcgcaauggaggcacccacgggaacgugucugccaauuggguucuuacaagaaacagcaccgauccguccccugucacagcugacauucggcccucuagcggagugcugcacuucgcccagggccagaugcucgccacgaucccucugaccguggucgacgaugaccuucccgaggaagcugaggcguaucugcuccagauucugccucauacaauccgcggcggggccgaaguguccgagcccgcugagcugcucuuuuacauccaagauagcgacgauguuuauggacugauuaccuucuuuccgauggaaaaucagaagaucgagucuuccccuggcgaaagauaccuuagccugucuuucacacggcucgggggaaccaagggcgacgugagacugcuguauuccguccuuuacauucccgccggggccguggauccccuccaggcuaaagagggcauccugaacauuagccgccggaaugaccugaucuuuccugaacaaaagacgcagguuaccacaaaacucccgaucagaaacgaugccuuccugcagaauggagcgcacuuccuugugcagcuggagaccgucgagcuccugaacauuaucccccugauuccucccaucuccccucgcuuuggcgaaauuuguaacaucucucuucucgugacacccgcuaucgccaauggggagauuggauuccugagcaaccugccuaucauucuccaugaacccgaggacuuugccgcugaaguuguguauaucccgcugcaccgggauggcaccgacgggcaagccacggucuacuggucccuuaagccuucuggauucaauagcaaagcugugacacccgaugacauuggcccuuuuaacggguccgugcuguuccucagcggccagucugacaccacaaucaauauuaccaucaagggagaugacauccccgagaugaacgagaccgucacacugucccuggauagaguuaauguggaaaaccaggugcuuaaaagcggcuacacgucucgcgaccucauuauccuggagaaugaugaccccgggggagucuuugaguucuccccugccagccggggccccuaugugauuaaggagggggaaucuguugagcugcacaucauuagaagccgcggaucccucgugaagcaguuucugcauuaccgggucgagccuagagauagcaacgaguucuauggcaauaccggggugcuugaguuuaaacccggcgaacgcgagaucguuaucacacugcucgcgcggcuggacggcauuccggagcuggaugaacacuacugggugguccuuucuucccauggagagagagaaagcaagcucggguccgccaccaucgugaacauuacaauccugaaaaaugacgauccucacggaauuaucgaguucguuucugacggccugaucgugaugauuaacgaaagcaagggggaugcuaucuauuccgccgucuacgacguggugcggaaucgcggaaacuuuggcgacgucucuguuagcugggugguguccccggauuucacccaagacgucuuccccgugcaggggacgguuguguuuggcgaucaggaguucucuaaaaacauuacaaucuauagccucccugacgagauucccgaagagauggaagaguuuaccgucauccugcuuaauggaaccggcggggcuaaggugggaaacagaacaaccgccacacugcggauuagacgcaaugaugacccuaucuacuucgcggaaccccggguugugagaguccaggagggcgagacggccaacuuuaccgugcuccgcaauggguccgucgaugugacaugcaugguucaauacgcuaccaaggacggaaaagccacagcuagagaacgggauuucaucccuguggagaagggcgaaacccugauuuuugaggucggcagccgccagcagucuaucuccauuuucgugaacgaagacgggaucccggagacggaugagcccuuuuauauuauccugcuuaauagcaccggagacacaguuguguaccaguauggcgucgccaccgugaucauugaagccaacgacgauccuaaugggaucuucucucuggagcccauugacaaagcuguggaagagggaaagacaaacgcguuuuggauccucagacaucggggcuacuucggguccguuagcgucucuuggcaacuguuccagaaugauuccgcccuccagccuggacaagaguuuuaugaaaccagcggcacagugaacuucauggacggcgaggaagcuaaacccauuauccugcacgccuuuccggauaagaucccugaguucaaugaauuuuacuuccuuaagcuggugaacauuuccgggggaagccccggccccgggggacagcucgccgagaccaaucugcaggucacggugaugguuccuuuuaacgacgaucccuucggcguguuuauccuggacccugagugucuugaacgcgaggucgcugaagaugugcugucugaggacgauaugagcuauauuacaaacuucaccauccucagacagcaagggguuuuuggagacgugcagcugggcugggaaauucucuccucugaguucccggccggccugcccccuaugaucgauuuucuucuggucgggauuuuccccaccacagugcaccuccagcagcauaugcggcgccaccauagcggaaccgacgcgcuguacuucacgggccuggagggggcuuuuggaacaguuaauccuaaauaccaccccuccagaaacaauaccaucgccaacuucacauuuucugccugggugaugccgaaugcuaacaccaauggcuucaucauugccaaggacgaugggaacggaagcaucuauuacggcgucaaaauucaaacaaaugaaucccacgugacccuuucucugcauuauaagacgcucggcagcaacgcgaccuacaucgcuaaaacaaccgugaugaaguaucuggaggaauccgucuggcuccaucugcuuauuauccuggaggacgggaucauugaauuuuaccuggauggaaaugccaugccucggggcaucaagagccucaaaggggaggccauuacagacggacccggcauccugcgcauuggggcuggaaucaacggcaaugauagauucaccggccuuaugcaggacguucggucuuaugagagaaagcugacgcucgaagagaucuacgaacugcaugccaugccugcuaaauccgaucuccaccccauuagcggguaccuggaguuucgccagggagagacaaacaagucuuucaucauuuccgcccgggacgauaaugacgaagagggcgaagaacuuuuuauccugaaacuggugagcguguaugggggagcgagaauuuccgaagagaacaccacagcccgccucaccauccagaagucugauaaugcuaacggccuguucggguuuaccggagccugcauuccugagaucgcugaagagggcagcacaaucuccugugucguggaacggacgagaggcgcccuugacuacguucauguguucuauaccauuagccaaaucgagacagaugggauuaacuaccuggucgacgacuuugccaaugcuucuggaaccaucacauuccuccccuggcagcgcuccgaagugcugaacauuuauguucucgaugacgauaucccggagcugaaugaguacuuccgggugacccuugucagcgcgaucccuggcgacgggaaacugggaucuacgcccacaagcggcgccuccauugaucccgaaaaggagaccaccgacaucacaauuaaggcuucugaucacccuuaugggcugcuccaguuuagcaccggacugccgccccaaccuaaagacgccaugacacuucccgccuccucugugccucacaucacggucgaagaggaagauggcgagauuagacugcucgugauccgcgcucagggccugcucgggcggguuaccgccgaguucagaacagugagccugaccgcguuuucccccgaagacuaccagaacguggcuggaacacuugaguuccagccuggcgaacgguacaaguauaucuuuauuaauaucaccgauaacagcauuccggagcuggagaaaucuuucaaggucgaacugcucaaucuggaagggggaguugccgaacuuuuucgcguggacggcuccgggagcggcgacggagauauggaguucuuucugcccacgauccauaaaagagccucccucggcguggcuucucaaauucuggucaccaucgccgcgagcgaccacgcucaugggguguucgaauuuuccccugagucucuguucguuagcggaacagagcccgaagauggcuacuccaccgugacacucaacgucauucggcaccaugggacccuuagcccugugacacugcacuggaauaucgacucugaucccgacggagaucuggccuuuacguccggcaacaucaccuucgagauugggcagacaagcgccaauaucaccgucgaaauucucccggacgaggauccugaacuggacaaggcuuucucuguguccguucuuagcgugucuagcggcucccugggagcccacaucaacgcuacccucacaguccuggccucugaugaccccuauggcauuuuuaucuucagcgagaagaaucgccccgugaaaguugaggaagcgacgcagaacaucacccuguccauuaucagacucaaggggcuuaugggaaaagugcuggucagcuacgccacacuggaugacauggagaagccucccuauuuuccuccgaaucucgcucgggccacccagggcagagacuacauucccgcuuccggguucgcccuguuuggagccaaccaaucugaagcuacaaucgcgauuagcauccuugaugacgaugagccugaacgcuccgagucuguguucaucgagcugcucaacagcacccugguggccaaaguucagucccggucuauucccaauagcccuagacugggccccaaggucgaaacgaucgcucagcucauuaucauugccaacgacgaugccuuugggacacuucagcuguccgcuccgaucgugcgcguggccgagaaucaugucggcccuaucauuaacguuacccggaccggaggcgcguucgcugacgugagcgugaaguuuaaagccguccccaucacagccauugcuggggaagauuauucuaucgccuccagcgacgugguucugcucgagggagagaccucuaaggcggugccuauuuacgucaucaaugauauuuaccccgaacuggaggaauccuuccuugugcaacugaugaacgagacaaccggcggggccagacucggagcucugacggaagccguuaucaucauugaggcuagcgacgauccuuauggccuguuuggcuuccagaucacaaaacucauuguggaggaacccgaguuuaauucugucaaggugaaccuuccgaucauucgcaauuccgggacccugggaaacgugacaguccaguggguugccaccaucaauggccagcuggcuacgggggaccuccggguggugagcggaaacgucaccuucgccccuggcgaaacaauccaaacccugcuucuggaggugcucgcggacgauguucccgaaauugaggaggugauccagguccagcugacagacgccuccgggggaggcaccauuggccuggauagaaucgcuaauauuaucauccccgccaacgacgauccuuacgggacaguggcuuucgcccaaaugguuuaucgcgugcaggaaccgcucgagagaagcucuugcgccaauauuaccguccggcgcagcggaggccacuuugggagacuucugcuguucuacuccacgucugacaucgaugugguugcucucgcgauggaagagggacaggaccugcuuagcuauuacgaaucccccauucagggcgugccugauccccuguggcggacauggaugaacgucucugccgugggggagccucucuauaccugugcuacccugugccugaaagagcaagccuguagcgccuuuuccuucuuuucugcuagcgaaggaccccagugcuucuggaugacauccuggaucagcccugccgucaacaauucugacuuuuggaccuaccgcaagaacaugacaagaguggcgucccucuucagcggccaggccguugcuggcucugauuacgagcccgugacgcggcagugggccauuaugcaagaaggggacgaguuugcuaaucuuaccgucuccauccugccggaugacuucccugagauggacgagagcuuucugauuucccuccuggaagugcaucuuaugaacaucucugccagccugaagaaucagcccacaaucggacagccuaacauuuccaccgugguuaucgcgcucaauggcgaugccuucgggguguuugucauuuauaacaucagccccaauacaucugaagacggacuguucguggagguucaggaacaaccgcagacccugguggagcucaugauucacagaacgggcgggucccuuggacaggucgcuguggaguggcgcgucgugggcggcaccgccacagaagggcuggauuucaucggagcuggcgagauccugaccuuugccgaaggggagaccaagaaaaccguuauucucacgauccuggacgauagcgaaccugaggacgaugagucuauuaucgugagccuugucuacacagaaggaggcucccggauucugcccucuagcgacaccgugagaguuaacauccucgcuaaugauaacguggccgggaucgucuccuuccaaacagcgucucgcagcgugauuggacacgagggcgaaauccugcaguuucaugugauucggaccuuccccggcagagggaauguuaccgucaacuggaaaaucauuggacagaaucuggagcucaacuuugccaacuucuccggccagcucuuuuucccugaagggagccugaauacaacgcuguuugugcaccuccuggacgauaacauccccgaggagaaggaaguguaucaagucauucuuuacgacgugcggacccagggaguuccuccggcuggcaucgcccugcucgaugcucagggguaugccgccgugcugacagucgaggcgucugacgaaccccauggagugcugaauuucgcucucuccagccgcuuuguucuucugcaggaggccaacaucaccauucaacuguucaucaauagagaguuuggcucccucggcgcuauuaacgugacauacaccacggucccugggaugcugucucuuaaaaaucagacagugggaaaccuggccgaacccgagguugacuucgugccuaucauuggcuuccucauccuggaagagggggaaaccgccgcugccaucaauauuaccauccuggaggaugacguccccgagcucgaagaguauuuucuggugaaccuuacauacgugggacugaccauggcggccagcacauccuucccuccgcggcucgauucugaaggccugacggcucaggucauuaucgacgccaaugauggggcucgcggaguuauugaguggcagcaaagcagauuugaagugaacgagacccacggcucccuuacacugguggcccagcggagccgcgagccccucggccaugucucucuguucguguacgcgcagaaucuggaagcccagguugggcucgacuauaucuuuaccccuaugauccugcacuucgcugauggagagagauacaagaacgugaauauuaugauccuugacgaugacauucccgaaggcgaugagaaauuucaacugauccucacaaacccuucccccgggcuggaacuuggaaagaacaccauugcccugaucauuguccucgcuaaugacgacggcccgggggugcugagcuucaacaauucugagcacuuuuuccugcgggagccuacggcccucuauguucaggaauccguggcuguccuguacaucgugcgcgagcccgcccagggccuuuuuggaaccgucacagugcaauucaucguuaccgaagugaacagcucuaaugaguccaaggaucugacacccagcaaaggcuauauuguccucgaggaaggggugagauucaaggcgcugcagaucucugccauucuugacaccgagccugaaauggaugaguacuuuguuuguacacuguucaaccccaccggaggcgcucggcucggggugcauguccagacgcugaucacagugcugcagaaucaagccccucucggacuguuuagcauuuccgcuguggaaaacagagccaccagcaucgacaucgaggaggccaaucgcaccguuuaucuuaacgucucccggacaaauggcauugaucuggcggugucugugcagugggaaacggucagcgagaccgcuuucgggaugagaggcauggacguggucuuuagcguguuccagucuuuucucgaugaaagcgccuccggauggugcuucuuuacacuggagaaccuuaucuacggcauuaugcugcgcaaaucuagcgucaccguguaccgguggcaggggaucuucauuccgguugaagaccucaauaucgagaaccccaagacaugcgaggccuuuaauaucggauucuccccuuauuuugugauuacccacgaagagagaaacgaagagaaacccagccugaacucugucuucacauucaccuccggcuuuaagcuguuccucgugcaaacgaucauuauccuggaaagcucucaggugcgcuacuuuaccuccgauagccaggacuaucuuauuaucgcuucucagcgggaugacuccgagcugacacaaguuuucagauggaaugggggcagcuuuguccuccaucagaagcugccugugcgcggcgugcuuaccgucgcccuguucaacaaagggggcucuguuuuucucgcuauuucccaggccaaugcgcggcugaacagccuccuguucagauggagcggauccggcuuuaucaauuuccaagaggugcccgugucugggacaaccgaagucgaggcccugagcuccgcuaacgauaucuaccuuauuuuugccgaaaauguguuccugggagaccagaacucuaucgacauuuuuaucugggagaugggccagagcuccuuccgcuauuuccagucuguugauuuugcugccgugaaucggauucacagcuucacgccggcguccgggaucgcccacauccuccugauuggacaagacaugagcgcucuuuacuguuggaacucugagagaaaucaguuuuccuucguccuggaagugccuagcgccuaugauguugcuucugugacagucaagucccucaacagcuccaaaaaucugaucgcccuggugggcgcucauucucacauuuacgagcucgccuacaucagcucccauucugacuuuauucccagcuccggggaacugaucuucgagccuggcgaacgcgaggcgaccaucgccgugaacauucuugaugacacaguccccgagaaggaagagagcuuuaaaguucagcugaagaauccgaagggaggcgcugaaaucgggauuaacgauucugugaccaucacgauucucuccaacgacgaugccuauggaaucguggccuucgcucagaauagccuguacaaacaagucgaggaaauggagcaggacucucuuguuacccugaacguggagagacucaagggcacauaugggcggaucaccauugccugggaagcggauggaagcaucuccgacauuuuuccuacaucuggcgugauccuguucaccgagggccagguccugagcacaauuacccuuacgauccuggcugauaauauucccgaacucuccgaggugguuaucgugacacugacccgcaucaccacagaaggggucgaggacagcuacaaaggagccaccauugaccaggauagaucuaaguccgugaucacaacgcuccccaacgacagcccuuuuggccugguuggguggcgggccgcuuccguguucauuagagucgccgagcccaaagaaaauaccacaacccuucaacugcagaucgcucgggauaagggacugcucggcgacauugccauccaucugcgcgcgcagccuaacuuucuucugcauguggauaaucaagccacagagaacgaagacuauguccuccaggagaccaucauuaucaugaaggagaauauuaaagaagcucacgccgaggugucuauccugccggaugaccuccccgaacuggaggaaggguucauuguuacgaucaccgaggugaaccuggucaauagcgauuucuccacaggacagccuucugugagacggcccggcauggagaucgcugaaauuaugaucgaggaaaacgacgauccucgcggcauuuuuauguuccacgugaccagaggggccggagagguuaucacagcguacgaagugcccccuccgcuuaaugugcugcagguccccguuguccggcucgccggcagcuuuggggcugugaacguguauuggaaggccuccccugacucugcuggacuggaggacuucaaacccagccauggcauucuugaguuugccgauaagcaagucaccgccaugaucgaaauuacgaucaucgacgaugcugaguucgaacugacagagaccuuuaauauuucccucaucagcguggccgggggaggccgccugggcgacgauguuguggucacagugguuauuccucagaacgacucucccuucgggguguuuggauucgaagagaaaaccgucaugaucgaugagucccucagcucugacgauccggacuccuacgugacccugacagugguuagaagcccuggcgggaagggaacgguccggcuggaauggaccauugaugagaaggccaaacacaaccuuucuccccugaauggcacacuccauuuugacgaaaccgagagccagaagacaaucgugcugcacacccuucaggauacggugcuggaggaagaccgcagauucacaauccaacucauuuccaucgacgaggucgaaauuagccccgugaaaggguccgcuucuaucauuauccggggagauaagcgcgccagcggcgagguuggcaucgccccuuccucuagacacauucugaucggggaacccagcgcuaaauacaacggaaccgccauuaucucccuggugcggggcccugggauucucggagaggucaccguguuuuggcgcaucuucccgcccucuguuggcgaguucgcggaaacaagcgggaagcugaccaugagagacgagcaguccgcugugauugucgugauccaggcccuuaaugaugacaucccugaagaaaagagcuuuuaugaguuccagcugacagccguuucugagggaggcgugcucuccgaguccucuuccacggcuaacauuaccgucguggccagcgauucucccuacggccgguuugcuuucucccaugaacaacugagagugagcgaggcccagcgcgucaauaucacaauuauccggucuuccggggacuuuggacacguuagacuuugguauaagaccaugagcggcacagcggaagccgggcuggauuucgugccugcugccggagagcuccuguuugaagcuggcgagaugcgcaagucccugcauguggagauucucgacgaugacuaccccgaagggccggaggaguucagccugaccaucacgaaagucgagcuucagggacggggcuaugauuuuaccauccaggagaacggccugcaaauugaccagccucccgaaaucgggaauauuucuaucgugagaauuaucaucaugaagaacgauaaugccgagggaauuaucgaguucgacccuaaauacacagcguuugagguugaagaggacgugggccucauuaugauccccgucgugcgccugcacgggaccuauggauacguuacagccgauuucauuagccaguccucuagcgcuuccccuggcgggguggacuacauccuucauggaucuaccgucacauuucaacacggccagaaccugagcuucauuaauaucuccaucauugaugacaacgagagcgaguucgaggaacccaucgagauucuccugaccggcgccacagggggagcugugcugggccggcaccucgucucuagaaucauuaucgccaaguccgauagcccguuuggggugauccgcuuccugaaucagucuaaaauuuccaucgccaaccccaauagcacaaugauucuuucucugguucucgaacggaccggaggccugcuuggggagauccaggugaacugggagaccgucggcccuaauucccaagaagcucugcucccccagaacagagacauugcggauccugugagcggacuguuuuauuucggcgagggggaaggaggcguucgcacaaucauccugacgauuuacccgcaugaggaaaucgagguggaggaaaccuuuauuaucaagcuccaccuggucaagggggaggccaaacuugacucccgggcuaaggaugugacacugaccauucaggaguucggagaccccaacggcgugguucaguuugccccugagacacucucuaaaaagaccuauagcgagccccuggcccuugaagggccucugcucaucacauucuuugucagacgggugaaaggcaccuucggagagaucaugguguacugggaacuguccagcgaguuugauauuacggaagacuuccugucuaccuccggcuuuuucacaaucgcugacggggagagcgaggccucuuucgauguccaucuccugcccgacgaagugccugagauugaagaggauuauguuauccaacuugugagcgucgaaggaggcgcggagcuggaccucgagaaguccauuaccugguuuucuguguacgcuaaugaugacccccacgggguuuucgcccuguauagcgauagacaguccauccuuauuggacagaaccugauccgcagcauccagauuaauaucacacggcucgccggcaccuuuggggacguggcugucggccugagaauuucuuccgaucauaaggaacaaccgaucgugacggagaacgccgaacgccagcugguugugaaagacggagcuacauacaaggucgauguggugccuauuaaaaaucaggucuuccucagccugggcucuaacuuuacccuucaacugguuacagugaugcucgucgggggaagauucuacggcaugcccaccauccugcaggaggccaaguccgcgguccugccugugagcgaaaaagccgcuaauucccagguuggguuugagucuaccgccuuccagcucaugaacaucacagcuggaacgagccacgugaugauuucccggcgcggcaccuauggggcccuuucugucgcguggacaaccggcuacgcccccggacuggagaucccggaauuuauugugguuggcaauaugacaccuacccuggggagccucuccuucagccacggagagcaaagaaagggcguguuucuguggacguuccccucucccggguggccugaggcuuucguccuucaucuguccggagugcagagcucugcccccggcggcgcucagcuccgguccggguuuaucguggccgagauugagccuaugggagucuuccaguuuagcacaucuucccgcaacaucaucguuagcgaagacacccaaaugauuagacugcacgugcagcggcuguucggcuuucauagcgaucuuaucaagguguccuaucagaccacagccgggucugcuaaaccgcucgaggacuucgaacccguccagaauggagagcuguuuuuccaaaaguuucagaccgaaguugacuucgagauuacaaucauuaacgaucagcugagcgagaucgaagaguuuuucuacauuaaucucacguccguggaaauccgcggccugcagaaauuugacgugaacuggucuccuagacuuaaucuggauuucagcgucgcggugaucaccauucucgacaacgaugaccuggccgggauggauaucuccuuccccgagacaaccguugcuguggccgucgacacaacccugauuccuguggaaacggagucuaccacauaucuuagcaccuccaagacaaccacaauccuccaacccacgaacguuguggccauugucaccgaggcuacaggagugucugccaucccggaaaaacuggucacccugcacggcaccccugcggugagcgagaagcccgauguugcuacagugacggccaaugucuccauccacggcaccuuuagccucgggccuucuauuguguacaucgaagaggaaaugaaaaacggaacauucaauaccgccgaggugcugauucggcgcacaggcggguuuaccggaaacguuuccaucacggucaagacauucggcgagagaugcgcucagauggaacccaaugcccuuccuuuucgggggauuuacggaaucagcaaccugaccugggcuguggaggaagaggacuucgaggaacagacccucacacugaucuuucuggauggcgagcgcgaaagaaaggugucuguucaaauucuugacgaugacgagcccgaaggccaggaguucuuuuaugucuuccucaccaauccgcaagggggagcccagaucguggaggaaaaagacgauacaggcuuugcggccuucgcuauggugauuaucacgggguccgaccugcauaacggaauuaucggcuuuagcgaggaaucucaauccgggcuggagcuccgggaaggagccgucaugagacgccugcaccuuauugugacccggcagcccaauagagcuuucgaggauguuaagguguucuggcgcgucacacugaacaaaaccgugguugugcuccagaaggacggcgucaaucugguggaggaacugcagagcguguccggcacaaccacguguaccauggggcaaacaaaaugcuuuaucagcaucgagcuuaagccugaaaagguuccccaggucgagguguacuucuuuguggaacucuaugaggccaccgcgggagccgcuauuaacaauucugcccgguucgcucagaucaaaauucuggagagcgaugaaucccagucucuggucuacuuuagcguuggcuccagacucgccguggcgcauaagaaagccacacugaucucucuucaaguggcucgcgacagcgggaccggacugaugauguccgucaacuucucuacacaggagcuccggagcgccgaaaccauuggcagaacgaucaucuccccugcuauuagcgggaaggauuuugugaucacagagggaacccugguuuucgagcccggccagcgcucuaccgugcuggacgucauucuuacaccugaaaccggcucccucaauagcuuuccgaaacgguuccaaaucgugcuguuugaucccaaagggggagccagaauugacaagguuuauggcacagccaacaucacgcuggugucugaugcugacucccaggccaucugggggcucgcggaccagcugcaccagccugucaacgaugacauucuuaaucgggugcugcauaccaucagcaugaaaguggcuacagagaacaccgaugaacaacucuccgccaugaugcaccugauugagaagaucacaaccgaaggaaaaauucaggccuucucugucgcuagccgcacgcuguuuuacgagauccuuuguucccucauuaaucccaagagaaaagacacccggggcuucagccacuucgccgagguuacagaaaacuuugcguucucucugcugaccaaugugacaugcggguccccuggagagaaaagcaagaccauccucgauucuugucccuaucuguccauccuugcucugcauugguacccgcagcagauuaacggccacaaauuugaaggcaaggaaggggacuacauccgcauuccugaaagacuccuggaugugcaagacgccgagaucauggccggaaaaagcacgugcaagcugguccaguucacagaguauucuagccagcagugguuuauuuccggcaauaaccuucccacccucaaaaauaaggugcugucucugagcguuaaagggcaauccagccagcuccugacaaacgauaaugaagugcuuuaccggaucuaugcugccgagccuagaaucauuccccagaccucucugugucuccuguggaaccaagcugccgcguccuggcugagcgacucccaguucugcaaggucguggaagagaccgccgauuacguugaaugugcuugcucucauaugagcguguaugccgucuacgcucgcacagacaaucuuuccucuuauaacgaggccuuuuucacgagcggauuuaucugcauuuccggccucugucuggcggugcugagccacaucuucugcgcccgguacucuauguuugcugccaagcuccugacccacaugauggcugccucccuugggacacagauucuguuccucgccagcgcuuacgccucuccgcagcuggcggaggaauccuguagcgcuauggccgccgucacccauuaucuguaccuuugccaauuuucuuggaugcucauccaguccgugaauuucugguauguucuggugaugaacgaugagcacacagaaagacgcuaccugcuuuucuuucugcuuagcuggggacugccugcuuucgucgugauccuccugauuguuauccugaaaggcauuuaucaucagucuaugagccagaucuacggccuuauucacggggaccucuguuuuauccccaacguguaugccgcgcuguucaccgcugcccuggucccccucacgugccugguggugguuuuugucguguucauucaugccuaccaagugaagccucaguggaaggcuuacgacgaugucuuucggggaagaacaaaugccgcugagaucccccuuauccuguaucucuucgcccugauuuccgugaccuggcuguggggcgggcuucacauggcguaccgccacuuuuggaugcucguucuguucgugaucuuuaacagccugcagggacucuaugucuucaugguguacuuuauucugcauaaucagauguguugcccuaugaaggccuccuauaccguugagaugaacggccacccggggcccucuacagcuuucuucaccccuggcagcggaaugcccccugccggcggggaaaucuccaaaucuacacaaaaucuuauuggagcuauggaggaagugcccccugacugggagagagccagcuuucagcagggcucccaggcgucuccggaucugaagcccagcccucaaaacggggccacguuccccuccagcggaggcuacgggcagggcucucucaucgcugacgaagagucccaggaguuugaugaccugaucuucgcccugaagaccggagcuggccuuagcgucucugauaaugaauccgggcaaggaagccaggagggcgggacacugaccgacucucagauuguggaacuccggcgcaucccuauugccgauacacaucuguga

SEQ ID NO: 65560 - RNA, 1128 nt, Artificial Sequence
  derived and/or modified sequence opt5 from ADH1A__Homo_sapiens__NP_000658
augagcaccgccggcaaggugaucaaaugcaaggcugccguccugugggagcucaaaaagcccuucuccauugaagagguugaaguggcgccuccgaaagcucacgaggugagaaucaagauggucgccguggggauuuguggaacagacgaucauguugugucuggcacgauggucacaccccugccugugauccuugggcacgaagccgcuggaauuguugagagcgugggcgagggggucaccaccgugaagcccggagacaaagugaucccucuggccaucccccagugcggcaagugucggauuugcaaaaacccugaauccaauuacugucucaagaacgaugucucuaauccgcaaggcacacugcaggacgggaccagccgcuuuacaugcagacggaaacccauccaucacuuccuuggaauuuccaccuuuucucaguauacgguuguggaugagaacgcuguggccaagaucgacgcggccagcccucuggaaaaggucugucucauuggcugcggguucuccaccggauacggcagcgcugugaauguugccaaagugacacccgggucuaccugugcugucuuuggacugggcggcguggggcuguccgccaucaugggaugcaaggcggccggcgcugcccgcauuaucgcuguugauaucaacaaagacaaguucgccaaagccaaggagcucggggcuacagaguguauuaauccucaggauuauaaaaagcccauccaagaagugcugaaggagaugaccgacggaggcgucgauuuuagcuucgaagugauugggagacuugacacgaugauggcgucucugcucugcugccaugaggccuguggaacauccgucaucgugggcguuccgccugauagccagaaccugucuaugaaucccaugcuucugcucaccggccggacauggaaaggggcuauucugggaggcuuuaaguccaaagaaugcgugccuaagcuggucgccgacuucauggccaaaaaguuuagccucgacgcucugaucacccacgugcuucccuucgagaagaucaacgagggguuugaucugcuccacuccggaaaaucuauucgcaccauccugauguucuga

SEQ ID NO: 65561 - RNA, 1128 nt, Artificial Sequence
  derived and/or modified sequence opt5 from ADH1B__Homo_sapiens__NP_000659
augagcaccgccggcaaggugaucaaaugcaaggcugccguccugugggagguuaaaaagcccuucuccauugaagacguggagguggcgccuccgaaggcuuacgaagucagaaucaaaaugguggccguugggauuugucacacagaugaccauguggucucuggaaaccucgugacgccccugccuguuauccuuggccacgaggccgcugggauuguggaaagcgucggagagggcgugaccacagugaagcccggggauaaagucaucccucuguuuacaccccagugcggaaagugucggguuugcaaaaauccugaguccaacuauugucucaagaaugaccugggcaacccgcgcggcacccuucaagaugggaccagacgguucacaugccgcggaaaacccauccaucacuuucugggcaccucuacguucagccaguacaccgugguggacgaaaaugccgucgcuaagauugaugccgcguccccucucgagaaggugugucugaucgggugcggauuuucuacaggcuaugggagcgccguuaacguggcuaaagucacccccggauccacaugugccguguucggccugggcgggguuggacucagcgcugugaugggcugcaaggccgcgggggccgcuagaauuaucgccgucgacauuaauaaagauaaguuugcuaaagccaaggaacugggagccaccgaguguaucaacccucaggacuacaaaaagcccauucaggaggugcuuaaggaaaugacggauggcggggucgacuucucuuuugaggugaucggacggcuggauacaaugauggcuucccuccugugcugccaugaagcguguggcaccagcguuaucgugggcgucccgccugccucucaaaaucuuuccauuaaccccaugcugcuccugacagggcgcaccuggaaaggagcuguguauggcggguucaagagcaaagagggaaucccuaagcugguugccgacuuuauggccaaaaaguucucucucgacgcucugauuacccacgugcuucccuuugaaaagaucaaugagggcuucgaucugcuccacuccgggaaaagcauuagaacaguccugacguucuga

SEQ ID NO: 65562 - RNA, 1143 nt, Artificial Sequence
  derived and/or modified sequence opt5 from ADH4__Homo_sapiens__NP_000661
augggcaccaaggggaaagugaucaagugcaaagccgcuauugccugggaggcgggaaagccccuguguaucgaagaggucgaaguugcuccuccgaaagcccacgaggugcggauucagaucauugccacaagccucugccauacggacgcuaccgugaucgauuccaaguucgaaggccuggccuuucccgucaucguggggcacgaggcugccggaauuguugagucuaucggcccuggggugacaaacgucaagcccggagacaaagugauuccucuuuacgcgccccuguguagaaagugcaaauucugucucagcccucugaccaaucuuugcggcaagaucuccaaccugaaaucuccggccagcgaucaacagcucauggaagacaagacaucccgcuuuaccuguaagggcaaacccguuuaucauuucuuugggacaucuaccuucagccaguacacgguggucuccgauauuaaucuggcuaagaucgacgaugacgccaaccuggagagagugugccuccugggauguggcuuuagcaccggguauggagcugccauuaauaacgcgaaagugacaccuggcucuaccugcgccgucuucgggcuuggaggcguuggccuguccgcugugaugggguguaaggccgcuggagccagccggaucaucggcauugauaucaauucugaaaaauuugugaaggccaaagcucucggggcgacagacugccugaacccccgcgaucuucacaagccuauucaggaggucaucauugagcugaccaagggaggcguggacuucgcccucgauugcgcugggggauccgaaacgaugaaagccgcccuggacuguacaaccgcuggcuggggcagcugcacauuuaucgggguugccgcgggaucuaagggccugaccaucuuccccgaggaacucauuaucgggagaaccauuaauggaacauuuuucggcggguggaaauccguggacagcaucccgaagcuggucacggauuacaaaaacaagaaguucaaucuugacgcucuggugacccauacacucccuuuugauaaaauuuccgaggccuucgaccugaugaaccaaggcaagucuguucggaccauccuuaucuuuuga

SEQ ID NO: 65563 - RNA, 1125 nt, Artificial Sequence
  derived and/or modified sequence opt5 from ADH5__Homo_sapiens__NP_000662
auggccaacgaggugaucaagugcaaagcugccgucgcgugggaagcuggcaagccccugagcauugaggaaaucgagguugccccuccgaaagcccacgaagugagaauuaagaucauugcuaccgccgugugucauacagacgcuuacacgcucuccggggccgaucccgagggaugcuucccugucauccugggccacgagggggcgggaaucguggaaucuguuggcgagggggugaccaaacuuaaggccggagacacagucauuccccuguauaucccucaguguggcgaaugcaaguuuugucucaaucccaaaaccaaccugugccaaaagauucgggugacacagggcaaagggcuuaugccugauggaaccagccgcuucacauguaagggcaaaaccauccugcauuacauggggacguccaccuuuucugaguauacaguuguggcugacauuagcgucgccaagaucgauccgcucgcuccccuggacaaggugugccugcucggauguggcauuuccaccggguacggagccgcggugaauacagccaaacuggagccuggcucugucugcgcuguuuucggccuugggggagugggccuggccgugaucaugggguguaaggucgcuggagccagcagaaucauuggcguggauaucaacaaagacaaguuugcccgggcuaaagaguucggggcgaccgaaugcauuaauccccaggauuuuuccaagccuauccaggaaguucucauugagaugacggacggaggcguggauuauagcuucgaaugcaucggcaacgucaaagugaugcgcgccgcucuggaggccugucacaagggguggggaguuucuguggucgugggcgucgccgcuuccggggaggaaaucgccacaagacccuuucaacuugugaccggacggacauggaagggcaccgcguucgggggcuggaaaagcguugagucugugccgaagcuggucuccgaauacaugagcaaaaagauuaaaguggacgaguuuguuacccauaaucucucuuucgaugaaaucaacaaggcuuuugagcugaugcacuccggaaagagcauucgcacaguggucaaaaucuga

SEQ ID NO: 65564 - RNA, 1107 nt, Artificial Sequence
  derived and/or modified sequence opt5 from ADH6__Homo_sapiens__NP_000663
augagcaccacaggccaggugaucagaugcaaggccgcuauucuguggaaacccggggccccuuucuccaucgaggaagucgagguugcgccgcccaaggcuaaagaagugcggauuaagguggucgccacgggacucuguggcaccgagaugaaagugcuggggucuaagcaccuugaccugcucuacccuacaauccugggacaugaaggcgccgggauuguugagagcaucggagagggcguguccaccgucaagcccggcgauaaagugaucacacuuuuucugccucaaugcggggaauguaccucuugccucaacagcgagggaaauuucuguauucaguuuaagcaguccaaaacacagcugaugucugacggcaccagccgcuucacgugcaaggggaaauccaucuaucacuuuggaaacaccagcacauucugugaauacaccguuauuaaggagaucucuguggcuaagauugaugccgucgcuccccuggagaaagugugccucaucuccuguggcuuuagcacaggguucggagccgcgauuaauaccgccaaggugacgccuggcucuacaugcgcugucuuuggccuugggggaguuggccuguccguggugaugggguguaaagccgcuggagccgcgagaaucaucggcgucgacgugaacaaggaaaaauucaagaaagcccaagagcugggggcuaccgaaugccucaauccgcaggaucugaagaagcccauucaggagguucuuuuugacaugacagaugccggaaucgacuucugcuuugaagcuauuggcaaccuggaugugcucgccgccgcucuggcgagcuguaaugagucuuauggcgucugcgugguuguggggguccugccugccuccgugcagcucaaaaucagcggacaacuguucuucuccggccggucucuuaaggggagcgucuuuggaggcuggaaaucccgccagcauauucccaagcugguggcugacuacauggccgagaaacucaaccuggauccucuuaucacccacacccugaaucucgacaagaucaacgaagccguugagcugaugaagacagggaaaugguga

SEQ ID NO: 65565 - RNA, 1161 nt, Artificial Sequence
  derived and/or modified sequence opt5 from ADH7__Homo_sapiens__NP_000664
auguucgccgagauccagauucaagacaaggauagaaugggcaccgcugggaaagugaucaagugcaaagccgcgguccugugggaacagaagcagcccuuuagcauugaggaaaucgagguugcuccuccgaaaacaaaggaagugcggauuaagauccucgccacgggaaucugucgcaccgacgaucacgugauuaaaggcacaauggucuccaaguuccccgugaucguugggcaugaggccaccggaauuguggagucuaucggcgaaggggucacaaccgugaaaccuggagacaagguuauuccccuguuucuuccucagugcagagaguguaacgcuugccggaaucccgauggcaaccuguguauccgcagcgacauuacaggcagaggggugcucgccgauggaaccacgcgguuuaccugcaaaggcaagccuguccaccauuucaugaauacauccaccuucacagaauacaccgugguggacgagucuagcgucgcuaagaucgaugacgccgcgccgcccgagaaaguuugucugaucgggugcggauuuuccacgggcuauggggccgcugugaagacaggaaaagugaagccuggcucuaccugugucguguucggccuugggggaguuggccugagcgugauuauggggugcaaauccgccggagcuagccgcaucauuggcaucgaucucaacaaggacaaauuugaaaaggccauggcggucggggccacagaguguauuucucccaaggauuccaccaaaccuaucagcgaagugcugucugagaugaccggaaauaacguuggcuacacauucgaagugaucggccaccuggagacgaugauugacgcucucgccuccugccauaugaauuaugggaccagcgucguggucggagugcccccgucugcuaagaugcugacauacgacccuaugcuucuguuuaccggcagaacauggaaagggugcguuuucggaggccucaagucccgggaugacgugcccaaacuggucaccgaguuucuugccaagaaguucgaucuggaccaacucaucacgcacgugcugccuuucaaaaagauuagcgaaggguuugagcugcucaacuccggccagucuauccgcacaguucugaccuucuga

SEQ ID NO: 65566 - RNA, 1404 nt, Artificial Sequence
  derived and/or modified sequence opt5 from ADHFE1__Homo_sapiens__NP_653251
auggccgcugccgcgagagcucggguggccuaccugcuccgccagcugcaaagagccgcuugccagugucccacccacagccauacauauucccaggccccuggccuuucuccgagcgggaagacgaccgacuacgcuuucgagauggccgucuccaacauccgguauggagcggccguuacaaaagaagugggcauggaucugaagaauaugggggcuaaaaacgugugccucaugaccgacaagaaucugucuaaacuucccccuguccagguggccauggauagccugguuaagaacgggauucccuuuacaguguacgacaauguccgcguggagccuaccgauuccucuuucauggaagcuaucgaguuugcccaaaagggcgcguucgacgccuauguugcugugggaggaggcagcacaauggauaccuguaaagccgcuaaccucuacgccuccagcccccacucugacuuucuggauuaugucuccgccccuauuggcaaggggaaaccggugagcgugccccugaagccucucaucgcuguccccacgaccucuggaacaggcuccgaaaccacagggguugcgauuuucgacuacgagcaucugaaagugaagaucggaaucaccagcagagccauuaagccuacgcuuggccugaucgauccccuccacacacugcauaugccggcucggguggucgccaauucuggguuugacgugcuuugccacgcccuggaguccuacaccacacucccuuaucaucugcgcagccccuguccuuccaaccccauuaccagacccgcuuaccagggaucuaauccuaucagcgauauuugggccauccacgcgcugcggauuguugcuaaauaucucaagcgcgccgugagaaacccggacgaccuggaagcccggucccacaugcaucuugcuagcgccuucgcuggcaucggcuuugggaaugccggaguccaccugugccacggcaugucuuaccccaucuccgggcucgugaaaauguauaaggcgaaagauuacaacguugaccauccucuggugccccacggacuuagcgucgugcugaccucuccugccgucuucacauuuacggcucagauguuccccgagcgccaucucgaaauggccgagauucugggcgcugauaccagaacagcccggauccaggacgcggggcuggugcucgccgauacccugcgcaaguuucuuuucgaccuggauguugacgauggacucgcugccgugggcuauagcaaagcugacauuccggcccuggucaagggcacacuuccucaagagagagugaccaagcuggcccccuguccucaguccgaagaggaucucgcugcgcuguucgaagccucuaugaaacuguacuga

SEQ ID NO: 65567 - RNA, 540 nt, Artificial Sequence
  derived and/or modified sequence opt5 from ADI1__Homo_sapiens__NP_060739
auggugcaggccugguacauggacgaugcucccggcgacccuagacaaccgcaccggcccgauccugggcgccccgucggacuggagcagcucagacggcugggcguucuuuauuggaagcuggacgccgauaaauacgaaaacgacccugagcucgaaaagauccgcagagagcggaauuauagcuggauggauauuaucaccauuugcaaagacaagcugcccaacuacgaagagaaaaucaagauguucuaugaggaacaucuucaccuggaugacgagauucgcuacauccucgauggguccggauauuuugacgugagagauaaggaagaccaguggauccggauuuucauggagaaaggcgacauggugacacugccugcggggaucuaccaucgcuuuacggucgaugagaagaauuacaccaaagcuaugagacuguucgugggagaaccgguuuggacagccuauaaccggcccgccgaccacuuugaggcucgcggccaguacgugaaguuccucgcccaaaccgcuuga

SEQ ID NO: 65568 - RNA, 243 nt, Artificial Sequence
  derived and/or modified sequence opt5 from ADIG__Homo_sapiens__NP_001018092
augaaguacccccugaugccucucgugaacgaccugaccuucagcuuucuugucuucugguuuugccugccgguuggccuccugcuucugcucaucauuuggcugagauuccugcucucccaggauucugaggaaaaugacagcuccgugugucuggauugggagcccuggucuaaagggccugccgaauuuugcuggaagggaacacuucacggccaagagaaagaacggcccuguugguga

SEQ ID NO: 65569 - RNA, 735 nt, Artificial Sequence
  derived and/or modified sequence opt5 from ADIPOQ__Homo_sapiens__NP_001171271
augcugcuccugggcgccgugcuucugcuccuggcccuucccgggcacgaccaggagaccacaacgcaaggaccuggcguccugcucccgcugcccaagggggcuugcaccggauggauggcgggcaucccugggcaucccggacacaacggcgcuccuggcagagaugggcgggacggaacacccggcgaaaaaggggagaagggagauccuggccugauugggccgaaaggagacaucggcgaaaccggcguucccggggccgagggaccucgcggcuuccccgggauucagggaagaaagggcgaaccuggggagggagccuacguguaucggagcgcuuuuuccgugggccucgagacauacgucaccauccccaauaugccgauucgcuucacaaaaaucuuuuauaaccagcagaaucauuacgauggcucuaccgggaaguuccacuguaacaucccuggacuguauuacuuugccuaucauauuacgguguacaugaaggacguuaaagugagccuuuucaagaaagauaaggcuaugcuguuuaccuacgaccaauaucaggaaaauaacgucgaucaggccuccggcucugugcuccugcaccuugagguuggggaccagguguggcugcaagucuacggagaaggcgagagaaaugggcucuaugcggauaacgacaaugauagcacauucaccggcuuucugcuguaccacgacacaaacuga

SEQ ID NO: 65570 - RNA, 1128 nt, Artificial Sequence
  derived and/or modified sequence opt5 from ADIPOR1__Homo_sapiens__NP_001277558
augagcucccacaagggcucuguggucgcccaggggaacggagcucccgccagcaauagagaagcggacaccguugaacuggcugagcucggcccucugcuugaagagaaagggaagcgggugaucgccaacccgcccaaagccgaagaggagcaaacaugcccugugccccaggaagaggaagaggagguccgcgugcugacgcucccucugcaggcucaucacgccauggaaaagauggaggaguucguuuacaaagugugggagggaagauggcgggucauucccuaugaugugcuuccugacuggcugaaggauaaugacuaccuccugcauggccaccgcccgcccaugccuuccuuuagagcuuguuucaagucuaucuuucggauucauaccgaaacagggaacaucuggacccaucugcucggauucguucuguuucuuuuccugggcauucucacaaugcugcgccccaauauguauuuuauggccccucuucaggagaaaguggucuucggcauguuuuuccugggggcggugcucugccugagcuuuuccuggcuguuccacaccguguacugucacucugagaaggucagcagaacauuuuccaaacucgauuauagcggaaucgcccugcuuaucaugggcucuuucguucccuggcuguacuauuccuucuacugcagcccgcaaccucggcucauuuaccugucuaucgugugugugcuugggauuuccgcuaucauugucgcccagugggaccgcuuugcuacccccaagcacagacagacgcgggccggaguguuccugggccucgggcugagcggaguugugccuaccaugcauuuuacaaucgcggaaggcuucgucaaagccaccacagugggccagauggggugguuuuuccugauggcuguuauguauauuaccggagccggccucuacgcugcccgcauccccgagagauuuuuccccgggaaguuugauaucugguuccaaucucaccagauuuuucacgugcuggucguggccgcugcguucguccauuuuuauggaguguccaaccuucaggaguuccgguacggccuggaagggggaugcacggacgauacacuccuguga

SEQ ID NO: 65571 - RNA, 1161 nt, Artificial Sequence
  derived and/or modified sequence opt5 from ADIPOR2__Homo_sapiens__XP_006719081
augaacgagcccaccgaaaauagacugggcugcagccggacaccugagccggacauccgccucagaaaggggcaccagcuggauggaacgcggcgcggcgacaacgauucccaucaaggggaccuugaacccauucuggaggccucugugcucagcucccaccauaaaaagucuagcgaagaacacgaguacuccgaugaagcuccucaggaggacgaaggauucaugggcaugucuccccugcuucaggcccaucacgcgauggagaaaauggaggaauuugucuguaagguuugggaggggagauggcgggugaucccucacgaugugcugcccgacuggcucaaagauaaugacuuccugcugcauggacaccgcccuccgaugcccagcuuuagagcuugcuucaaguccauuuuucggauccauaccgaaacaggcaacauuuggacccaccuccugggcugugucuucuuucuuugccuggggaucuucuauauguuucgcccuaauaucagcuucguggcuccccuccaggagaagguuguguuuggacuguucuuucuuggcgccauucugugucucucuuucuccuggcuguuccacacagucuacugccauagcgaaggggugucuagacuguuuuccaaacucgauuauagcggaaucgcccugcuuauuaugggcucuuucguuccuuggcuguacuauuccuuuuacuguaacccccaaccgugcuucaucuaucucauugugaucuguguccuggggauugccgcuaucaucgugagccagugggacauguuugccaccccucaguaccggggagugcgcgcgggcgucuuccuuggccuggggcucuccggaauuauccccacacugcacuacguuauuucugagggcuuucugaaggccgcuaccaucgggcagauuggauggcucaugcugauggccagccuuuauaucacgggcgcugcccuguacgcggccagaaucccugagcgguucuuucccgggaaaugcgauauuugguuccauucccaccaacucuuucauaucuucgugguggcuggagccuuuguccacuuccacggcgugagcaaucugcaggaguuccgcuuuaugauuggcgggggauguucugaggaagacgcucuuuga

SEQ ID NO: 65572 - RNA, 231 nt, Artificial Sequence
  derived and/or modified sequence opt5 from ADIRF__Homo_sapiens__NP_006820
auggccagcaagggccugcaggaccucaaacaacagguggaggggaccgcucaggaagccgucuccgcggcuggagccgccgcucagcaaguuguggaucaggccacagaggcuggccagaaggccauggaccagcuggcgaaaacgacccaagaaacaaucgauaagaccgccaaccaggcuucugacacauucagcgggauuggcaaaaaguuuggacuucugaaguga

SEQ ID NO: 65573 - RNA, 1038 nt, Artificial Sequence
  derived and/or modified sequence opt5 from ADK__Homo_sapiens__NP_001114
augaccagcgugagagagaacauccuguucggcauggggaauccccuccuggacauuuccgccgucguugauaaggacuuucuugauaaauacucucugaagccuaacgaccagauccucgcugaagauaaacacaaggagcuguucgacgaacuugugaaaaaguuuaagguggaguaucaugccggaggcagcacacaaaauuccauuaaagucgcgcaguggaugauccagcagccgcacaaggcugccacguucuuugggugcauuggaaucgauaaauucggcgaaauccugaagcggaaagccgcugaggcccauguggacgcucacuacuaugagcaaaacgaacagcccaccgggacaugugccgcgugcauuaccggagauaaucgcucucucaucgccaaccuggcugccgcuaauuguuacaagaaggagaaacaucuggaccucgaaaagaacuggaugcugguugagaaagccagagugugcuauauugcgggcuuuuuccuuacagucagcccugaguccgugcugaagguugcccaccacgcuucugaaaauaaccggaucuuuacccucaaucugagcgcccccuucauuucccaguuuuacaaagagagccuuaugaaggugaugccuuaugucgauauccuguucggcaacgaaacagaggcugccaccuuugcccgcgaacagggguucgagacgaaagacauuaaggagaucgcuaagaaaacccaagcgcuccccaagaugaacucuaaaagacagcggaucgugauuuucacacagggacgcgaugacaccaucauggccacagaauccgaggugaccgcuuuugccguccuggaccaggaucaaaaggaaauuaucgacacgaauggcgccggggaugcuuucguuggaggcuuucugagccagcucgugucugacaaaccucugacagaguguauuagagccgggcauuacgcggcuuccaucaucauucggcgcaccggaugcacauucccggaaaagcccgauuuucacuga

SEQ ID NO: 65574 - RNA, 447 nt, Artificial Sequence
  derived and/or modified sequence opt5 from ADM2__Homo_sapiens__NP_001240774
auggccagaauccccaccgcugcccugggcugcauuagccuccugugucuucagcugccugggucccucucucggagccugggaggcgacccgcgccccgugaagccuagagagcccccugcgcggucccccucuagcucccuucaaccucgccacccggcucccagaccugucguuuggaaacugcaucgggcccuccaggcccagcgcggggcuggacuggcccccgugaugggccagccucugagagaugggggacggcaacacucuggcccccgcagacauagcggcccgcggcgcacacaggcucagcuccugagaguggggugcguccuuggaacgugucaggugcaaaaccugucccaccggcucuggcagcugaugggcccugccgggcgccaggacagcgcgcccguugauccuucuagcccccauuccuacggauga

SEQ ID NO: 65575 - RNA, 558 nt, Artificial Sequence
  derived and/or modified sequence opt5 from ADM__Homo_sapiens__NP_001115
augaagcuggugagcgucgcccucauguaccugggcucccuugcuuuccugggggccgacaccgcgagacucgauguugcuucugaguuucggaaaaaguggaacaaaugggcccugagccgcggaaagagagaacuucggauguccucuagcuaucccacaggccuggccgacgugaaagcugggccugcccagacgcucauccgcccgcaagauaugaagggagcuuccagaucucccgaggacagcuccccugaugccgcgcggauucgcgugaagagauaccggcagagcaugaauaacuuccagggccugcgcucuuuugggugcagauucggaaccuguacaguccagaaacuggcccaccaaaucuaucaguuuaccgacaaggauaaagacaauguggcuccccgguccaagauuagcccucagggcuacggccgcagacggcgcagaucucuccccgaagccgggccuggacggacacugguuuccagcaaaccgcaggcucauggcgcccccgcgccucccucuggguccgccccucacuuccuuuga

SEQ ID NO: 65576 - RNA, 3309 nt, Artificial Sequence
  derived and/or modified sequence opt5 from ADNP__Homo_sapiens__XP_011527049
auguuccagcugcccgugaacaaucucggcagccugagaaaggcccggaaaaccgucaagaaaauccuuuccgacauugggcuggaguacugcaaggaacacaucgaggauuuuaaacaauucgaaccuaacgacuuuuaucucaagaauacaacgugggaggauguuggacugugggacccgucucuuaccaagaaccaggauuaccgcacaaaacccuucuguugcagcgcuuguccuuuuuccucuaaguucuuuagcgccuauaaaucccauuucagaaaugugcacucugaagacuuugagaaccggauucugcucaauugccccuacuguaccuucaacgcggauaagaaaacacuggagacccauaucaagauuuuucacgcuccuaaugccagcgcccccuccagcucucuguccacauucaaggacaaaaacaagaaugauggccucaaaccuaagcaggcugacagcguggaacaggccgucuauuacugcaaaaaguguaccuaucgcgauccgcuguacgagaucgugagaaaacauaucuaccgggaacacuuucaacacguugcugcccccuauauugcgaaggccggggagaagucucuuaacggagcugugccucugggcuccaaugcccgcgaggaaagcucuauccauugcaaaagaugucucuucaugcccaaguccuacgaggcucugguccagcacgugauugaagaccaugagcggaucggguaucagguuacggccaugauuggacacaccaacguggucgugccucgcagcaaaccccuuaugcugaucgcgccgaagccucaggauaaaaaguccaugggccugcccccuagaauuggcucucuggccagcgggaaugugcggucccugcccagccaacagauggucaaccgccucucuauccccaagccuaaccucaauuccacaggaguuaacaugaugagcucugugcaccuucagcagaauaacuacggcgugaaaagcgucgggcaaggauauuccgugggccagucuaugagacuggggcucggaggcaaugcuccgguuagcaucccccagcaaucccagagcgugaagcagcugcuuccuucuggcaacgggcgguccuacggacugggcagcgaacagcgcucucaagcccccgcuagauauucccuccagagcgccaaugccuccucucugagcuccgggcagcugaaaucuccuagccucucccagagccaggcuucucggguccugggacaauccagcucuaagcccgcggccgcugccaccggcccgccucccgggaacacauccagcacccagaaauggaagauuugcacgaucuguaaugagcuuuucccugagaacguguacucuguucauuuugaaaaggagcacaaagccgaaaaggugcccgcugucgccaauuacauuaugaaaauccauaacuucacaagcaagugccuguauugcaauagauaccucccuaccgacacacugcuuaaccacaugcugauucauggacucuccugucccuauugccgcagcaccuuuaaugacguggagaaaauggcggcucacaugcggaugguccacaucgaugaagagaugggcccgaagaccgacucuacacuguccuucgaucugacgcuccagcaaggcagccauaccaacauccaucugcuugugacaaccuacaaccugagagacgccccugccgaguccguugcuuaucacgcccagaauaacccucccgugcccccgaagccccagccuaaaguccaggaaaaggcugauauucccgugaaaucuagcccucaagccgcgguucccuacaagaaagacguggggaagacacucuguccucugugcuuuuccauccugaaaggacccauuucugaugcccuugcucaccaccuccgcgagcggcaucaggucauccagaccgugcacccgguggaaaagaagcugacguauaaauguauucauugccugggcguuuacacaagcaauaugaccgccuccaccaucacacuccaccugguccauuguagaggggugggaaagacccaaaacggccaggacaaaacaaaugcuccuucucgccuuaaccagagccccucccuggccccugugaagcggacguacgagcagauggaguucccccuccugaaaaagagaaagcuggaugacgauagcgacucuccguccuuuuucgaggagaaaccugaagaacccgucgugcuugcgcucgacccuaaggggcacgaagaugacagcuaugaggcccgcaaaucuuuucugaccaaguacuucaauaaacaacccuaucccacacggagagagaucgaaaagcuggcugccucccucuggcuguggaaaagcgauauugcuucucacuuuuccaacaagcgcaagaaaugcguucgggacugugagaaguacaaaccuggcgugcuucugggauucaauaugaaggaacucaacaaggucaaacaugagauggauuuugacgccgaauggcuguucgagaaucacgaugagaaggacagcagagugaacgccuccaaaaccgcugauaagaaacugaaucuuggcaaggaagacgauagcucuagcgacuccuucgagaaccucgaagaggaaucuaaugagagcggguccccguuugaucccguuuucgagguggaaccuaaaaucucuaacgacaaccccgaggaacauguccugaaggugauuccugaggacgcgagcgaauccgaggagaagcuggaucagaaagaagacggaucuaaguaugagacaauccaccucaccgaggaacccacgaaacugaugcauaaugccagcgauuccgagguugaccaggaugacguggucgaauggaaggauggcgcuagcccuucugaguccgggccgggaagccagcaagugucugacuuugaagauaauaccugcgagaugaaacccggcacaugguccgacgaaagcucccagucugaggaugcccggagcuccaagccugccgcuaagaaaaaggccaccaugcagggggaccgcgagcagcuuaaauggaagaacagcucuuacggcaaaguggaaggauucugguccaaggaucaaagccaguggaagaacgcgucugagaaugacgaaagacugagcaacccccagauugaguggcaaaauuccacaaucgacucugaagauggcgagcaguuugacaacaugaccgauggggucgcugagccuaugcacggaagccucgccggcguuaaacuguccucucagcaggccuga

SEQ ID NO: 65577 - RNA, 813 nt, Artificial Sequence
  derived and/or modified sequence opt5 from ADO__Homo_sapiens__NP_116193
augcccagagacaacauggccagccugauccagcggauugcucgccaagccugccucaccuucagaggcuccgggggaggccgcggggcgucugaucgggacgcugccagcggaccugaggccccgaugcagcccggcuuuccugaaaaucuguccaagcucaaaucucugcucacacagcugagagcugaggaucuuaacaucgcuccccggaaggccacgcugcagccucuucccccuaaucugccgcccgugaccuacaugcacauuuaugaaacagacggguucagccugggagucuuucuccugaaauccggcaccucuaucccucuucaugaucaccccggcaugcaugggaugcugaagguucucuacggaacagugcgcauuagcuguauggacaaacuggaugccggcgggggacaaagaccucgggcgcuucccccggagcagcaguucgaaccuccccugcagccucgcgagagagaggccgugcggcccggcguccuccgcuccagagcugaauauaccgaggccagcgggcccugcauccugacaccucaccgggacaaccugcaucaaaucgaugcuguggaaggaccggccgcguuucucgacauucuggcucccccuuacgaucccgacgauggccgcgacugucacuauuacagaguucuugagccugugcggcccaaggaggccucuuccagcgccugcgaccugccgagagaagucuggcuccuggagaccccucaggcugaugacuucuggugugaaggcgagcccuauccugggcccaagguguuuccuuga

SEQ ID NO: 65578 - RNA, 981 nt, Artificial Sequence
  derived and/or modified sequence opt5 from ADORA1__Homo_sapiens__NP_000665
augcccccuagcaucuccgccuuccaggcugccuacauuggcaucgaggugcugauugcgcucgucucuguuccggggaacgugcuggugaucugggcugucaaggugaaucaagcccuuagagacgccaccuuuugcuucauuguuagccuggcuguggccgaugucgcugugggagcccucguuaucccccuggcgauccuuauuaacaucggcccucagacauauuuucacacgugucugaugguggccugccccguccucauucugacccaguccucuauccuggcucuccuggccauugcuguggaccgguaccuucgcgugaaaaucccucugagauauaagauggucguuacaccccggcgcgccgcgguggccauugcuggguguuggauccucagcuucguggucggacugaccccuauguuuggcuggaauaaccuuuccgccguggaaagagcuugggccgccaaugggucuaugggagagccgguuaucaaaugcgaauuugagaaggugauuagcauggaauacauggucuauuuuaacuucuuuguguggguucugcccccucuccugcugauggugcucaucuaccuggaggucuucuaucuuauucggaaacagcugaauaagaagguguccgcuagcucuggcgauccccaaaaauacuacggcaaggagcucaaaaucgcgaagucccuggcccuuauucuguuucucuucgcucugagcuggcugccucuccauauccugaacuguaucacacuuuucugccccucuugucacaaaccguccauucugaccuauaucgccauuuuccucacacaugggaauagcgccaugaacccuaucgucuacgcuuuccgcauucagaaguuuagagugaccuuccugaagaucuggaaugaccacuuucggugccagcccgccccucccaucgaugaagaccuucccgaggaacgcccugaugacuga

SEQ ID NO: 65579 - RNA, 1239 nt, Artificial Sequence
  derived and/or modified sequence opt5 from ADORA2A__Homo_sapiens__NP_001265429
augcccaucaugggcagcuccguguacauuaccgucgagcuggccaucgcuguucucgccauucuggggaacgugcuugugugcugggcggucuggcucaauucuaaccugcagaaugugacaaacuauuucguugugagccuggcugccgccgacaucgcugucggagugcuugccauuccuuuugcuaucacgaucuccaccggcuucugugccgcgugccacgggugucuguuuauugccugcuucguucucgugcugacacaaucuagcaucuuuucccugcucgcuauugccaucgauagauacauugcuauccggauuccgcugcgcuauaauggacuugucaccggcacaagagccaaggggaucaucgcgauuuguugggugcugucuuucgccaucggacucacccccaugcugggcuggaacaauugcggccagccuaaagaagggaagaaccauagccagggauguggcgagggacagguggcuugccuuuuugaagacgucguucccaugaauuacaugguguauuucaacuuuuucgccugugugcuggucccucuccugcugaugcucgggguguaccugcggauuuuucuugcugcccgcagacaacugaaacagauggagucccagccccucccuggcgaacgggcccgcagcacacugcagaaggagguucacgcugcgaaaucucuugccaucauuguggggcuguucgcucucugcuggcugccgcugcauaucaucaauuguuuuaccuucuucugccccgauugcucccacgccccucucuggcugauguaucuugccauuguccugagccauacgaacucugugguuaaucccuuuaucuacgcuuaccggauuagagaguuccgccaaaccuuuagaaagaucauucggucccacgugcuccgccagcaggaaccuuucaaggccgcgggaacaagcgcuagaguccuggccgcccacggcucugacggcgaacaggugucccuucggcugaacgggcaucccccgggagucugggcuaauggcagcgccccucaccccgagcgcagaccuaacggguaugcucucggacugguguccggcgggucugcccaagagagccagggaaacaccggccugcccgauguugagcuccugucccaugaacuuaaaggcgugugucccgagccuccggggcuggacgauccccucgcgcaggacggagccggcgucagcuga

SEQ ID NO: 65580 - RNA, 999 nt, Artificial Sequence
  derived and/or modified sequence opt5 from ADORA2B__Homo_sapiens__NP_000667
augcugcucgagacccaggacgcccuguacguggcucuugaacuggucaucgccgcgcucagcguugcuggcaacgugcuggugugcgccgccgucgggacagcuaauacgcuucaaacccccacaaacuauuuccuggugucccucgccgcugccgauguugcggugggacuguuugccauuccuuucgcuaucaccauuucucugggcuuuuguacagacuucuacgggugccucuuucuggccuguuucguccuugugcugacccagagcuccaucuuuucucuccuggcuguugccguggauagauaucuugcgauuugcgucccgcugcgguacaagagccucgugacaggaacccgcgccagaggcgugaucgcuguccuguggguucuggccuucgggaucggacucacgcccuuucugggcuggaacuccaaagacucugcuaccaauaauuguacagagccuugggauggcaccacaaacgaaagcugcugucuugugaagugccuguucgagaaugugguccccauguccuauaugguguacuuuaacuucuuuggguguguucucccuccccugcuuauuaugcuggugaucuauauuaaaaucuuccucgucgccugccggcagcugcagcgcaccgaacugauggaccacagcagaacgacacuccaacgggagauucaugccgcuaagucucuggcgaugaucgugggaauuuucgcccuuuguuggcugccuguucacgcugugaauugcgucacccucuuucagccggcccagggcaaaaacaagcccaagugggccaugaauauggcuauccugcuuucccaugccaacagcguggucaauccuaucguguacgcguaccgcaacagagauuuccgguauacauuucacaaaauuaucucucgcuaccugcucugccaggcugacguuaaguccgggaauggacaagccggcgugcagcccgcccugggggucggacuguga

SEQ ID NO: 65581 - RNA, 1491 nt, Artificial Sequence
  derived and/or modified sequence opt5 from ADPGK__Homo_sapiens__NP_112574
auggcccuguggagaggcagcgcuuacgccggguuccucgcgcuggcugugggaugcgucuuucuucuggagcccgaacucccuggcuccgcccugcggucucuuuggagcucccugugucucgggccggcccccgcuccucccggaccuguuucucccgagggccgccuggccgcugccugggacgcgcugaucgugagaccugugcggcgcuggagacgggucgccguggggguuaacgcuugcguggaugucgugcucagcggaguuaagcugcuucaggcccugggccucuccccgggcaaugggaaagaccacucuauucugcauagccgcaacgaucuugaagaggcuuucauccacuuuaugggaaagggcgccgcggccgaaagauucuuuuccgacaaagagaccuuccaugauauugcucaaguggccagcgaguuucccggggcucagcacuaugucggaggcaaugccgcccugaucgggcagaaguucgcugcgaacucugaccucaaagugcugcuguguggaccugugggccccaagcuccaugaacugcuugaugacaaugucuuuguuccucccgagucccugcaggaaguggaugaguuccaccucauucuggaguaccaagccggcgaagagugggggcagcuuaaggcuccgcacgccaaccgguuuaucuucagccaugaccugucuaauggagccaugaacaugcucgaaguguuugucuccagccuggaggaauuucagccugaucuggugguucucucuggccugcacaugauggaggggcaguccaaagagcuucaacgcaagagacugcucgaaguggucacaagcaucuccgacauucccacgggaaucccugugcaucuggagcuugcuucuaugaccaaucgggaacugaugagcuccauuguucaccagguguuccccgccgucacaagccucggccugaacgagcaggaacugcucuuucugacccagucugcguccgggccccacagcucucuuagcuccuggaauggagugccugaugucggcauggugucugacauccuguucuggauucucaaagagcauggccgcagcaaguccagagcuagcgaccugacacggauccacuuucauacccugguuuaucacauucuugccacaguggaugggcauugggccaaccaacucgcugccgucgcugccggagcgcgcguggccggcacccaggcuugcgccacggagaccaucgacacaucuagaguuucccugcgggcuccgcaggaguucaugaccagccacucugaagccggguccagaaucgugcugaaucccaacaaaccugucguggaauggcaccgcgagggaauuagcuuucauuucacacccgugcucguuuguaaggauccuauccggaccgucggccugggggacgcgauuuccgccgaaggccuuuucuacucugaggugcacccccauuauuga

SEQ ID NO: 65582 - RNA, 1074 nt, Artificial Sequence
  derived and/or modified sequence opt5 from ADPRH__Homo_sapiens__NP_001278878
auggagaaguacguggccgcuaugguccugagcgccgcgggcgacgcucucggguauuacaacggaaaaugggaguuccugcaggauggcgaaaagauccacagacaacuugcccagcucgggggacuggacgcccuggauguuggccgguggcgcguguccgacgauaccgugaugcaucuugcuacagccgaagcucuggucgaggccgggaaagcgcccaagcucacgcagcuguauuaccugcucgccaaacacuaucaggacugcauggaagauauggacgggagagcuccuggcggcgccucugugcauaaugcuaugcaacugaagccggggaagcccaacggauggcggauuccuuuuaauagccacgagggcggguguggagccgcgaugcgcgccaugugcaucggccuuagauucccccaucacucccagcuggauacccucauucagguuucuaucgagagcgggcggaugacacaccaucacccuaccggauaccugggcgcucuugccuccgcucuguuuacagccuaugccgugaacucuagacccccucuccaguggggcaaagggcugauggaacugcucccggaggcuaagaaauacauuguccaaagcggauacuucguggaagagaaucugcagcauugguccuauuuucagaccaagugggagaacuaccuuaaacugcgcggcauccucgacggggaaagcgcgcccacauucccugagucuuuuggaguuaaggaacgggaucaguucuauaccucccugagcuacucuggcuggggaggauccagcggccacgacgcccccaugaucgcuuaugaugccgugcuugccgcuggcgacucuuggaaggagcuggcccaccgcgcguuuuuccaugggggagacuccgauagcacggcugccauugccggcuguugguggggagucauguacggguuuaaaggcguguccccuucuaauuaugaaaagcucgaguacagaaaccggcuggaggaaaccgcucgcgcccuguacagccucggguccaaagaggacacagugaucagccuguga

SEQ ID NO: 65583 - RNA, 1065 nt, Artificial Sequence
  derived and/or modified sequence opt5 from ADPRHL1__Homo_sapiens__NP_612439
auggagaaguucaaagccgcuaugcugcucggcagcgugggggacgcccugggauacagaaacgucugcaaggaaaauuccaccguuggcaugaaaauccaggaggaacuucaacggucugggggacuggaucaccucgugcugagccccggcgaguggccuguguccgacaacacaauuaugcauaucgcgacggcugaagcccuuaccacagauuauuggugucuggacgaucucuaccgcgagauggucagaugcuauguggagauuguugaaaagcugccggagcggcgccccgacccugccaccaucgaagggugugcucagcugaaacccaauaacuaccuccuggccuggcacacaccuuuuaaugagaagggaucuggcuucggcgcugccaccaaggcgaugugcauugggcuuagauauuggaaacccgagcggcuggaaacacucaucgaggugagcgucgaauguggacgcaugacccauaaccacccuacgggcuuucuggggucccuuugcaccgcccuguucgugucuuuugcugcccagggaaagccgcucguucaguggggcagagauaugcugcgggcugugccccuggccgaggaauacugucgcaaaacaaucagacauaccgcggaguaucaagagcacugguucuacuuugaagccaaguggcaguucuaccucgaggaacggaaaauuagcaaggacuccgagaauaaggcuaucuuuccugauaacuaugacgccgaggaacgcgagaaaacauacagaaaguggagcucugaagggcggggaggccgcagaggccacgaugcucccaugauugccuaugacgcccugcuugcugcgggaaauuccuggaccgagcugugccaucgggccauguuccacgggggcgaaagcgcugccacggggacaaucgccggaugucucuuuggccugcuuuacgggcuggaucucgucccuaaaggacuguaucaggaccuggaggacaaggaaaaacucgaggaucugggcgcugcccuuuacagacugucuaccgaggaaaaguga

SEQ ID NO: 65584 - RNA, 630 nt, Artificial Sequence
  derived and/or modified sequence opt5 from ADPRHL2__Homo_sapiens__XP_011539938
augagaguggccggcaucagccuggcuuacuccucuguccaggacguucaaaaguucgcccggcucagcgcgcagcugacccacgcuuccucucuuggguauaacggagccauucugcaggcccucgcugugcaucuggcccuucagggcgagagcuccucugaacacuuucugaaacaacuccuggggcauauggaggaucuggaaggagacgcucagagcgugcucgaugcccgcgagcugggcauggaagagagacccuacuccagccggcuuaagaaaaucggggagcugcucgaccaggcgucugucacacgcgaagaggugguuuccgaacugggaaauggcauugccgcuuucgagagcgugccuacggccaucuauugcuuucuuagauguauggagccggaucccgaaauuccuucugcuuucaacucccugcagcggacccucaucuacagcaucucucugggcggggacacagauaccauugccacaauggcgggagccaucgcuggcgccuauuacgggauggaccaaguccccgaguccuggcagcagagcugcgaaggauaugaggaaaccgauauucuggcucagucccuccaccgcguguuucaaaagucuuga

SEQ ID NO: 65585 - RNA, 1401 nt, Artificial Sequence
  derived and/or modified sequence opt5 from ADRA1A__Homo_sapiens__NP_000671
augguguuccugagcggcaacgccuccgacucuagcaauugcacccagcccccugcuccggucaacaucuccaaggccauucuccuggggguuauccuuggaggccugauucucuuuggggugcugggaaauauccuugugauucugucugucgcgugucacagacaucuccacagcgugacacauuacuauaucguuaaccuggcuguggccgaucugcuccugacguccaccguccuucccuucucugccaucuuugaggugcugggcuacugggcuuucgggcggguguuuugcaauauuugggccgcuguugacguccucuguugcacagccagcaucaugggacuguguauuaucuccauugaucgcuauaucggcgugagcuacccucuuagauaucccaccauugugacacaacggcgcggccugauggcgcuccugugcgucugggcccugucucucguuaucuccaucgggccucuguucggauggagacagcccgcuccugaagacgagaccauuugucagaucaacgaggagccgggcuacgugcuuuuuagcgcccuggggucuuucuaucucccccuggcuauuauccuugugauguacugccgggucuacgugguugccaaacgcgaauccagaggacucaagagcggccugaaaacagauaagucugacuccgaacaggugacccugcggauucaccgcaaaaaugcgccugccgggggaagcggcauggcuuccgccaagacgaagacccauuuuucugucagacugcucaaauucagccgggagaagaaagcugccaagacacugggcaucgugguuggguguuuugugcuuugcuggcugcccuucuuucucgucaugccuaucggauccuucuuccccgauuuuaaaccgagcgaaaccguguucaagauugucuuuuggcugggcuaucuuaacucuuguaucaauccuauuaucuaccccugcuccagccaagaguucaagaaagccuuucagaacgugcugcgcauucagugccucuguagaaagcagucuagcaaacacgcucugggguauacacugcacccucccucccaagcgguugaaggacagcauaaggacauggugcggauccccgucggcucucgcgagaccuucuacagaaucagcaaaacggauggggugugcgaguggaaguuuuucuccagcaugccucggggaucugccagaauuacaguuuccaaagaccagagcucuuguaccacagcucgcgugcgguccaagagcuuucuccaggucugcuguugcgugggcccguccacccccucucuggauaagaaucaccaagugccuaccaucaaaguucauacaauuagccuuuccgaaaacggcgaggaagucuga

SEQ ID NO: 65586 - RNA, 1563 nt, Artificial Sequence
  derived and/or modified sequence opt5 from ADRA1B__Homo_sapiens__NP_000670
augaaccccgaccuggauaccggccacaauacaagcgccccugcucauuggggagagcucaagaacgccaauuucacgggaccgaaccagaccuccucuaauagcacacugccccaacuugacaucaccagagcgauuuccgugggccugguccucggggcuuuuauccuguucgccauuguuggaaacauccuugugauucugucuguggccugcaaucggcaccuccgcacaccuaccaacuacuuuaucgucaaucuggcuauggccgaucugcuccugagcuucacagugcuucccuuuuccgcugcccuggaaguucucggcuauugggugcuggggagaaucuucugugacauuugggcggccgucgaugugcuuugcuguaccgcuucuauccugagccucugcgccauuuccaucgaccgguacauuggaguucgcuauagccugcaguacccuacgcuggugaccagacggaaagcuauccucgcccugcuuucugucugggugcuguccacagugauuagcaucggcccccuccugggcuggaaggagccugcgccgaacgaugacaaagaauguggggucaccgaggaacccuuuuaugcccuuuucucuucccuggggagcuuuuacaucccucucgcuguuauucuggugauguauugccgcguguacaucgucgccaagagaacaaccaaaaaucuggaggcuggcgugaugaaggagaugucuaacuccaaggaacucacgcugcggauucauagcaaaaauuuccacgaggauacacuuuccucuaccaaggccaaagggcauaacccccgcagcuccaucgccguuaagcuguuuaaauucagcagagaaaagaaggcugcgaaaacacucggaauuguggucggcauguuuauccuguguuggcuuccuuucuucaucgcccugccccucgggucucuguuuuccacccugaagccgccugacgcuguguucaaaguuguguuuuggcucggauacuucaauagcugccugaaccccauuaucuauccuuguucuagcaaggaguuuaaacgggccuucguccgcauucuuggcugccaguguagaggccgggggcgcagacggagacgccggagacgccggcugggaggcugcgccuacaccuauagacccuggacacgcgggggaucccucgagcggucucagagcagaaaggauucccuggacgauagcggcucuugccuguccgggagccaacgcacgcuucccucugcuuccccuagcccgggauaccucggccggggcgcgcccccucccguggaacugugugccuuuccugaguggaaagcucccggggcccugcucucccugccggccccugaacccccuggaagacgcggccggcacgacucugggccccuuuucaccuuuaagcugcucacagagccugaaagccccggaaccgacggcggggcuuccaacggcggaugcgaggccgcugccgaugucgcgaauggccagccgggguucaagucuaacaugccucuggcccccggacaguuuuga

SEQ ID NO: 65587 - RNA, 1719 nt, Artificial Sequence
  derived and/or modified sequence opt5 from ADRA1D__Homo_sapiens__NP_000669
augaccuucagagaccugcucagcguguccuuugagggcccccggccugauucuagcgccgggggauccucugcuggcgggggaggcgggagcgccggaggcgcggcuccguccgaaggccccgccgucgggggaguuccuggcggggccggaggcgggggaggcguggugggcgcugggucuggagaggacaaccgcagcuccgccggcgaacccgggagcgcuggagccggcggggaugucaauggaacagcggccgugggcggccugguugugucugcucagggggucggagugggcguuuuccuugccgcuuuuauccugauggccguggcggggaaccuccuggucauucuuuccguggccugcaauagacaucugcaaacggugaccaacuacuucaucgucaaucucgcuguugccgaccugcugcucagcgcuacagugcugccuuuuucugccaccauggaggugcuuggauucugggccuuuggccgggcuuucugugaugucugggcggccguggacguucugugcuguacagcuuccauucucagccugugcaccaucucuguggaucgcuaugucggggugagacacucccuuaaguaccccgccauuaugacagaacggaaagccgcugccauccuggcgcuccuguggguuguggcucuggucgugagcgucggcccucuccugggauggaaggagccggugcccccugacgagcgcuuuuguggcaucaccgaagaggccggguaugccguuuucuccucugugugcagcuuuuaccuucccauggcugucauugugguuauguauuguagaguguacgucguggcccgguccacgacccgcagccuggaagcuggagugaaaagagagcggggcaaggccucugagguuguccuccgcauccacugcagaggggcggccacaggagcugauggcgcccaugggaugcgguccgcuaaaggccacaccuuccgcagcucucugagcgugagacuucugaaguuuucccgggaaaagaaagccgcgaagacacucgccauuguggucggaguguucguucuguguugguucccuuucuucuuugugcugccccucggcucucuguucccgcagcuuaaaccuagcgagggggucuuuaaggugaucuucuggcugggauauuuuaacuccugcguuaauccccucauuuacccuuguagcucuagagaauuuaaacgcgcuuuucugcggcuucugagaugccagugccgccggagacgccggagacgcccccucuggcggguguacggccaucacuggagagccuccaccagcgggcugcgccaggacugugcucccucuuccggagaugccccuccgggcgcuccccuggcucucacggcgcugccugaccccgauccugagcccccggggacaccugaaaugcaagcccccgucgcuagccggagaaagccucccuccgccuuccgggaguggcgccuucugggcccuuuuagacggcccaccacacagcucagagccaaggugucuagccugucccacaaaauccgcgcuggaggcgcccagcgggcggaggcugccugcgcccagagaucugaaguugaggcugugagccugggggucccgcaugaaguggccgagggagcgaccugucaagccuaugaacuugccgacuacuccaaccuccgcgagaccgacauuuga

SEQ ID NO: 65588 - RNA, 1398 nt, Artificial Sequence
  derived and/or modified sequence opt5 from ADRA2A__Homo_sapiens__NP_000672
auguucagacaggagcaaccccuggccgaaggcagcuuugcuccuauggggucccuccagccggacgccggaaacgcgucuuggaauggcaccgaggcucccgggggaggcgcccgggccacaccuuacagccuucaggugacgcugacccuggucugccucgcugggcugcuuaugcugcucacaguuuucggaaacgugcuggugaucauugccgucuuuaccucccgcgcucugaaggcuccccagaaucucuuccuggugucucuugcgagcgccgauauccugguugcuacacucgugauuccuuuuucccuggccaacgaagucaugggcuauugguacuucggcaaagccuggugugagaucuaucuugcccuggacgugcucuuuugcaccucuagcauuguucaccugugugcgaucucccuggauagauacuggagcaucacacaagccauugaauauaaucucaagcggacgccccgcagaaucaaagcuauuaucauuaccgugugggucaucucugccgugauuuccuucccuccgcugaucagcaucgagaagaaagggggaggcgggggaccccagccugcugagccccggugcgaaauuaacgaccagaagugguacgugaucucuuccuguauuggcagcuuuuucgccccuugccuuaucaugauucuggucuauguucgcaucuaccagaucgccaagagacggacccgcgugcccccgucuagacgggggccugaugcuguggcggcucccccuggaggcacagagcgcagacccaauggccucgggcccgaacgguccgccggaccuggcggggccgaggccgagccgcugcccacccaacuuaacggagcuccuggcgaacccgccccugcggggccccgcgacacagaugcucuggaccucgaggaaagcuccucuagcgaucaugccgagagaccgccuggaccccggagaccugaacgcggcccccggggcaaagggaaggccagagcuucccaggucaaaccuggagacagccugccccgccggggcccgggggccaccggaauuggcacgccugcugccgggcccggcgaggagagagugggagcggccaaggcuucucgcuggcggggcagacagaaucgcgaaaaacgguuuacauucguucuggccguggucaucgggguguuuguuguguguugguuccccuucuuuuucaccuacacacucaccgcugucggaugcuccgugccuagaacccuguuuaaguucuuuuucugguuuggcuauuguaacagcucucuuaauccggucauuuacacaaucuucaaccacgauuuucgccgggccuucaagaaaauucugugcagaggggaccggaagcgcaucguguga

SEQ ID NO: 65589 - RNA, 1353 nt, Artificial Sequence
  derived and/or modified sequence opt5 from ADRA2B__Homo_sapiens__NP_000673
auggaccaccaggaucccuacagcgugcaagccaccgcugccaucgcggcugccauuacauuccugauccucuuuacgauuuucggcaacgcccuggucauccuugcuguucugaccuccagaucucuccgggccccucagaaucuguuucuugugagccuggcugccgcggacauucucguggccacacugaucaucccguucucccuggcuaacgagcuccugggguauugguacuuucgcagaaccuggugcgaagucuaucuugcccuggauguucucuucuguacaucuagcauugugcaucugugcgcuaucucccuugaccgguacugggccgugucucgcgcgcuggaguauaauagcaagagaaccccucggcgcauuaaauguaucauucucacagucuggcugaucgccgcugugauuucccugccuccccucaucuacaagggagaucagggcccucagcccagagggcggccucaaugcaaacugaaccaggaagccugguauauccuugcuagcucuauuggauccuuuuucgccccgugucugaucaugauucucguuuaccugcgcaucuaccuuauugccaagagaagcaaucggcgcggccccagagcuaaagggggaccuggccagggcgagucuaagcagccccggccugaccacgggggagcgcuggccuccgcuaagcuccccgcccuggccagcguggcuucugcccgcgaagucaacggccauuccaaaagcaccggggagaaggaggaaggagagacgccggaagauaccggcacaagagcgcugccucccuccugggcugcccucccuaauucugggcaaggacagaaagagggcgugugcggcgccagccccgaggacgaagcugaggaagaggaagaggaggaagaggaagaggaagagugugagccccaggccgugccugucuccccggcuagcgccugcucucccccucugcagcaaccccaggggucccggguucuugcgacccugagaggacaggugcuccugggccgcggggugggagccaucggcgggcaaugguggcggagacgcgcucagcuuacacgggaaaagagauuuaccuucguccuggccgugguuaucggaguguuuguccucuguugguuccccuuuuucuucagcuauucucugggcgcuauuugccccaaacacuguaaggugccgcauggccuguuucaguucuuuuucuggaucggguacugcaacagcucccucaauccuguuauuuauacgaucuuuaaccaggauuuccgccgggccuuuagacgcauucugugccggcccuggacacaaaccgcgugguga

SEQ ID NO: 65590 - RNA, 1389 nt, Artificial Sequence
  derived and/or modified sequence opt5 from ADRA2C__Homo_sapiens__NP_000674
auggccagccccgcucuggccgcggcucucgccguggccgcugccgcuggcccuaacgccuccggggcgggagagagaggcucugggggagucgccaaugcuagcggcgccuccugggggccgccccggggacaguacucugcuggcgccguugcgggccuggccgcuguggugggguuccuuaucgucuuuaccgugguuggaaacgugcuggucgugauugccguucucacaagccgcgcucugagagccccucaaaaucuuuuccuggugucccucgccucugcugacauccuggucgcgacgcuggugaugcccuuuagccucgccaacgaacugauggcuuauugguacuucggccagguguggugcggggucuaucuugcccuggauguucucuuuuguaccuccagcauugugcaccugugcgccaucucucuugaccgguacugguccgugacacaggcugucgaguauaaucugaagcgcaccccuagacgggugaaagccacaauuguugcgguguggcucaucagcgcugucaucucuuuucccccucuggugucccuguaccgccagccggauggagccgccuauccccaauguggccucaacgacgaaaccugguacauucugagcucuugcaucggguccuucuucgcuccuugucuuauuaugggacugguuuacgccagaaucuaucggguggcuaagcuccgcacaagaacccugagcgagaaacgggcccccgucggcccugauggcgcgucccccacgaccgaaaaugggcuuggagccgcugccggcgcuggggagaacggacauugcgccccgccucccgcggacguggagccugaugaaucuagcgccgcugccgagcgcagacggcgcagaggcgcucugcggagagggggacgccggagagccggcgccgaaggcggggcuggaggcgcggacgggcagggagccggccccggggcugccgaguccggcgcccucacagcuagccgcucucccggaccuggcgggcggcuguccagagccagcucucgcagcgucgaguuuuuccugucccggagacgccgggcgagaucuagcgugugucgccggaagguugcucaggccagagaaaaacgguuuaccuucgugcucgccgucgugaugggaguuuuugugcugugcugguucccguucuuuuucuccuacagccuuuauggcauuugucgcgaggcuugccagguccccgggccucuguuuaaguucuuuuucuggaucggauacuguaauucuucccucaaccccgugauuuauacaguguuuaaucaagauuucagacggagcuuuaagcacauccuguucagacgccggagacgcggcuuuagacaguga

SEQ ID NO: 65591 - RNA, 1434 nt, Artificial Sequence
  derived and/or modified sequence opt5 from ADRB1__Homo_sapiens__NP_000675
augggcgccggggugcugguccucggagcuagcgagcccggcaaccuguccucugccgcgccucuuccggacggggcugccaccgccgcuagacugcucguucccgccagcccucccgcuucccugcuuccucccgccucugaaagcccugagccgcugucccagcaauggacagcgggaaugggccuccugauggcccugaucgugcuccugauuguggcugggaauguccuugugaucguugccauugcuaagacgccccggcugcagacccucacaaaccuguucaucaugucucuugccagcgcggaucuggugaugggacuccuggucgugccuuuuggcgccaccauuguuguguggggccgcugggaauacggguccuucuuuugcgagcuguggacaagcgucgacgugcucugugugaccgcuucuaucgaaacacugugcgucaucgcccuugauagauaucuggcuauuaccucccccuuccgguaccagagccuccugacgcgcgccagagcccggggacuuguuuguaccgugugggcuaucucugcgcugguguccuuucucccuauucugaugcacugguggcgcgccgagagcgacgaggcuagacggugcuauaaugaucccaaauguugcgacuucgucacaaaccgcgccuacgccaucgcuucuuccgugguuagcuuuuaugugccgcuguguauuauggccuucgucuaccucagaguguuucgggaagcgcagaagcaaguuaaaaagaucgauuccugcgagcgcagauuccugggcgggccugcucggcccccuucucccagccccuccccugugccggcccccgccccucccccuggacccccgcgcccugcugccgcugccgcgaccgcuccccuugccaauggcagagccgggaaacggagaccuagccgccuggucgcucuccgggaacagaaggcccugaagacacuuggaauuaucaugggcguguuuacccuguguuggcuccccuucuuucuggcgaacgucgugaaagccuuccauagagagcugguuccugaccgccucuucguguuuuucaauuggcugggcuaugcuaacucugccuuuaaucccaucauuuacugccgguccccggauuucagaaaggcuuuucaggggcuucuguguugcgcccgccgggccgcuagacgccggcacgcgacgcauggagacagaccucgcgccagcggcugccucgcucggcccgggcccccuccgucucccggagccgccagcgaugacgaugacgacgaugucgugggcgcuacaccucccgccagacugcuggagccuugggcgggguguaacggaggcgcugccgccgacuccgauucuagccuugacgaacccugccggccuggcuucgcuuccgagagcaaaguuuga

SEQ ID NO: 65592 - RNA, 1242 nt, Artificial Sequence
  derived and/or modified sequence opt5 from ADRB2__Homo_sapiens__NP_000015
augggccagcccgggaacggaagcgccuuccugcucgcuccuaauagaucccacgccccggaccaugaugugacccaacagcgggacgaggucuggguugugggcauggggaucgugaugucucugauuguccuugcgaucguguuuggaaacguucuggugauuacagcuaucgccaaguucgaacgccuccagacggucaccaauuacuuuauuacaagccuggccugcgcugaucuugugaugggccuggccguugugcccuucggggcugcccacauccucaugaaaauguggaccuuuggaaacuucuggugugaguuuuggacauccaucgacguccugugcgugaccgcgucuauugaaacacugugugugaucgccgucgauagauauuucgcuauuaccagcccuuuuaaguaccagucccuccugacgaaaaauaaggcccggguuaucauucuuaugguguggaucgugucuggccugaccagcuuccuccccauucaaaugcauugguaucgcgcuacacaccaggaggccaucaacugcuacgcgaaugaaaccuguugcgacuuuuucacaaaccaggccuaugcuaucgccuccagcauugucucuuuuuacgugccucugguuaucaugguguucgucuauuccagaguguuccaggaggcuaaacggcaacuucagaagauugauaagagcgagggccgcuuucauguucagaaucugucucagguggaacaagacgggagaaccggacacggccuccggcgcuccagcaaauucugucugaaggagcacaaagcccugaagacgcucgggaucauuaugggaacauuuacccugugcuggcuucccuucuuuaucgucaacaucgugcaugucauucaggauaaucugaucagaaaagaaguguacauucuccugaacuggaucggcuacguuaauucuggguucaacccucuuauuuauugucgguccccggacuuucgcaucgccuuccaggagcugcucugccugagacggagcucccugaaggcuuacggaaauggcuauucuagcaacggcaacacaggggagcaauccggauaccacguggaacaggagaaggaaaauaaacuccugugugaggaucuucccggcaccgaagacuuugucgggcaucagggaaccgugccuagcgauaacaucgacucucagggccgcaauugcuccacaaacgacagccugcucuga

SEQ ID NO: 65593 - RNA, 1227 nt, Artificial Sequence
  derived and/or modified sequence opt5 from ADRB3__Homo_sapiens__NP_000016
auggcccccuggccucacgagaacagcucccuggcuccguggcccgaccucccuacccuggcccccaauacagcgaacacgucuggccuuccuggggugcccugggaagcugcccuggccggagcucuccuggcccuugcuguccuggccaccguuggcgggaaucuccuggugaucguggcgauugccuggacaccuagacugcagaccaugacaaacgucuucgugaccagccucgcugccgcugaucugguuaugggacuucugguggucccgcccgccgcgacacucgcccugaccggccauuggccucuuggggcuacgggaugcgagcuguggaccuccguggacguucucugugugacagccucuaucgaaacccugugcgcucuggccgucgaucgguaccucgccgugacaaauccccugcgcuauggcgcucuugugaccaagagaugugcgcggacggccgucguucugguguggguggucagcgcugccguguccuuugccccuauuaugucucaaugguggcgcguuggcgcugacgccgaggcgcagagaugccacagcaacccccgguguugcgcuuucgccuccaauaugccguacgugcuccugucuagcuccgucagcuuuuaucuuccucugcucgugaugcuguucguuuacgcccgcguguuugucguggcuacaagacagcugcggcuccugcgcggggaacuuggaagauuucccccugaggagucuccucccgcccccucccggagccuggcuccggcccccgucggcaccugugcgccucccgaaggggugccugccugcggacgcagacccgcucggcuccugccgcuucgcgagcauagagcccuguguacacucggccugaucauggggaccuucacccugugcuggcucccuuucuuucuggcuaacguucuucgggcccugggaggccccucucucgugccuggccccgcguuccuggcccugaauuggcuuggguaugcuaacuccgccuuuaauccucucauuuacuguagaagccccgauuuccgcuccgcuuuucggagacugcugugccgcugcggacggagacucccgccugaacccugugccgccgcucgccccgcgcuguucccuucuggcgucccggccgcucggagcucccccgcccagccuagacuuugccaacgccuggacggggccagcuggggagugucuuga

SEQ ID NO: 65594 - RNA, 2070 nt, Artificial Sequence
  derived and/or modified sequence opt5 from ADRBK1__Homo_sapiens__NP_001610
auggccgaccuggaggcugugcucgccgaugucagcuaccugauggcgauggaaaaguccaaagcuacccccgccgccagagcuucuaagaaaauccuucugccugagccgagcauucgguccguuaugcagaaguaucucgaagaccgcggcgaggugacauucgaaaagaucuuuucucaaaagcugggguaccuucuguucagagauuuuugccucaaccaccuggaggaggcccggccccugguggaguucuaugaagaaauuaagaaauacgagaagcucgagacggaagaggaacgcgucgcuagaagccgggagaucuuugacuccuauauuaugaaagaacugcuugccuguucucauccuuucagcaaguccgcgaccgagcacgugcagggacaucugggcaaaaagcagguucccccugaucucuuucagcccuacaucgaggaaaucugccaaaaucugcgcggggacguguuccagaaguuuauugagagcgauaaauucacaagauuuugucaguggaagaacgucgaacuuaauauccaccugaccaugaacgacuucucugugcaucggauuaucggacgcggcggguuuggagagguuuauggcugcagaaaagccgauacaggcaagauguacgcuaugaaaugucucgacaagaaacggauuaagaugaagcagggggaaacccuggcccugaaugagcgcaucaugcucucccuggugagcacaggagauugcccuuucauugucuguaugucuuacgcuuuccacaccccggacaaacuuuccuuuauccuggaucucaugaacggcggggaccugcacuaucaucuuagccaacacggaguguucucugaggccgacaugagauuuuacgcggccgaaaucauucugggccucgagcauaugcacaaucgguucguggucuaucgcgaucugaagcccgcuaacauccugcucgacgaacacgggcauguuagaauuuccgaucugggacuugccugcgacuuuagcaaaaagaaaccucacgcuuccgugggcacgcauggcuacauggcccccgaggugcugcagaagggggucgccuaugauucuagcgcugacugguucucccucggauguaugcuguuuaaacuucugcggggccacagcccuuucagacagcauaaaaccaaggauaaacacgaaaucgaccgcaugacacucaccauggcgguggagcugcccgauucuuuuuccccggagcugcggagccuccuggaagggcuucugcagagagacguuaaucgccggcucggaugccugggcagaggggcccaagaggugaaggaaucuccuuucuuucgcagccuggauuggcagauggucuuccuucagaaauaucccccuccccucauucccccucggggagaggugaacgcugccgacgccuuugacaucggcuccuucgaugaggaagacacaaagggcaucaagcugcuggauucugaccaagagcucuacagaaauuucccgcugaccauuagcgaacgcuggcagcaggagguugcugaaacgguguuugauacaaucaacgccgagaccgaccggcuugaggcgcgcaaaaaggcuaaaaauaagcagcuggggcacgaagaggauuacgcccucggaaaagacuguauuaugcauggcuacauguccaagauggggaaccccuuccugacacaauggcagagacgguauuuuuaccuguucccuaauagacuugaauggcggggagagggcgaagcuccccagagccuccugaccauggaggagauccagucugucgaagagacccaaauuaaggaacgcaaaugccugcuccugaagaucagagggggcaaacaguuuauccuucagugcgauuccgacccugagcuggugcaguggaagaaagaacuccgggaugccuauagagaggcccaacagcugguccagcgcgugcccaagaugaaaaacaagccgcggagcccuguuguggagcugucuaaggucccccuugugcagagaggauccgcuaacggccucuga

SEQ ID NO: 65595 - RNA, 2067 nt, Artificial Sequence
  derived and/or modified sequence opt5 from ADRBK2__Homo_sapiens__NP_005151
auggccgaccuggaggcugugcucgccgaugucagcuaccugauggcgauggaaaaguccaaagcuacccccgccgccagagcuucuaagcggaucguucuuccugagccgagcauucgcuccgugaugcagaaauaucuggccgaaagaaacgagaucacauucgacaagauuuuuaaucagaaaaucggcuuccuccuguuuaaggauuucugccuuaacgaaauuaaugaggcugugccccaggucaaguuuuacgaggaaaucaaagaguaugaaaagcuggacaacgaggaggaucggcucugucgcucuagacagaucuacgacgccuauauuaugaaagaacugcugagcugcucccacccuuucucuaagcaggcgguggagcauguucaaagccaccucuccaaaaagcaagugacgagcacccuguuucagcccuacaucgaagagauuugugaaucucuucgcggggauaucuuccagaaguuuauggaguccgacaaauucacacgguuuugccaauggaagaaugucgagcugaacauucaucucaccaugaaugaguucagcgugcacagaaucauuggacggggcggguuuggagaaguuuauggcugucgcaaagccgauacagggaagauguacgcuaugaaaugccuggacaagaaaagaaucaagaugaagcagggagaaacccuugcccugaacgagcggaucaugcucucucugguguccacaggcgauuguccuuucauugucugcaugaccuacgcuuuccauacgcccgacaaacuguguuuuauccucgaucugaugaauggcggggaccuucacuaucaccugagccagcauggaguguucucugaaaaggagaugcgcuuuuacgccaccgagauuauccucggccuggaacacaugcauaacagauucguggucuaucgggaccuuaaaccugcgaauauucugcucgaugagcacgggcacgcccgcaucuccgaccugggacuggcuugcgauuuuagcaagaaaaagccgcaugccuccguuggcacacacggguacauggcucccgaagugcuccagaagggaaccgccuaugacucuagcgccgauugguucucccugggcuguaugcuuuuuaaacugcucagaggccauagcccuuuccggcaacacaagacaaaagacaagcaugagaucgauagaaugacccugacggugaacgucgaacuucccgacacauuuucuccugagcugaaaucccuccuggaggggcugcuccagcgcgaugugagcaagcggcugggaugccacggcgggggaucucaggaaguuaaggagcacagcuucuuuaaaggcguggacuggcaacaugucuaccuucagaaguaucccccgccucugauucccccuagaggggaagugaaugcugcggaugccuucgacaucggauccuuugacgaggaggauaccaaaggcauuaagcuccuggacugcgaucaggaacuguacaaaaacuucccccuuguuaucucugagcgcuggcagcaagaagugacagagaccgucuacgaagcugugaaugccgacaccgauaagauugaggcccggaagagagcuaaaaacaagcagcucggccacgaggaagacuaugcccuggggaaagauuguaucaugcauggauacaugcugaagcucggcaaccccuuccugacacaguggcagcgccgguauuuuuaccuuuucccuaauagacuggaguggcgcggggaaggagagagccggcaaaaccuccugacgauggaacagauccuguccgucgaggagacccagauuaaagacaagaaaugcauccuuuuuagaauuaagggcgggaagcaguucgugcuccaaugugaaagcgauccggaguuuguucaguggaaaaaggaacugaaugagacauucaaagaagcgcagcgccugcuccggagagcucccaaguuucugaacaaaccucggucuggcaccguggagcuucccaagccuucccugugccaccgcaauagcaacggacucuga

SEQ ID NO: 65596 - RNA, 1224 nt, Artificial Sequence
  derived and/or modified sequence opt5 from ADRM1__Homo_sapiens__XP_011526804
augaccacaagcggcgcccuguuccccucccucgugccugggucuagaggagcuagcaacaaguaccuggucgaguuucgggccggcaaaaugucccuuaaggggacgaccguuacaccggacaaacgcaagggacugguguauauccagcaaaccgaugacucucucauucacuucugcuggaaagauagaacaagcggcaauguggaagacgaucugaucauuuuucccgacgauugugaguucaagcgggucccucagugccccuccgggcgcguguacguucuuaaguuuaaagcgggaucuaagagacuguucuuuuggaugcaggaaccuaaaaccgaccaggaugaggaacauugucggaaggugaacgaguaucucaauaaucccccuaugccgggcgcucugggcgccagcggguccagcggacacgagcugucugcccucggcggggaaggaggccugcaaucccuucuggggaacaugagccauucucagcucaugcagcugaucggacccgcuggccuuggcgggcugggaggccucggggcccugacaggaccuggccuggcuucccuccuggggagcucuggacccccuggcuccagcuccucuagcuccagccgcucucaguccgccgcggucacccccagcucuacgaccagcuccacaagagccaccccggcuccuucugcccccgcugccgcgagcgccacauccccuagccccgcucccucuuccggcaacggggccagcaccgcugccucuccuacgcaaccgauucagcuuuccgaccugcagagcauccucgccacaaugaaugugcccgcuggaccugcgggcgggcagcaaguugaucuggccuccgugcuuacccccgagaucauggcuccuauucuggccaacgccgacguccaggaacggcuccugcccuaccugccgucuggagagagccucccucagacagcugaugagauccaaaauacccugaccucuccccaguuccagcaggcccuuggcauguuuuccgcggcucuggccagcgggcaacucggcccucugaugugccaguucggacuucccgccgaagcuguggaggccgcuaacaaaggcgacguggaagccuuugcgaaggccaugcagaauaacgcuaagccugagcagaaagaaggggacacaaaggauaaaaaggacgaggaggaagauaugucccuggacuga

SEQ ID NO: 65597 - RNA, 1455 nt, Artificial Sequence
  derived and/or modified sequence opt5 from ADSL__Homo_sapiens__NP_000017
auggccgcuggcggggaccacggaagccccgauuccuacagaucuccucuggccagccgguaugcguccccggagaugugcuucguguuuucugaccgcuacaaguucagaaccuggcggcagcucuggcuguggcuugcugaagccgagcaaacacugggccuccccaucacggaugaacagauucaggagaugaaaagcaaccuggaaaauaucgacuuuaagauggccgcugaggaggaaaaacgccuuagacacgaugucauggcccacguucauaccuucgggcacuguugcccuaaggcugccggaauuauccaucugggcgcgacauccuguuaugugggggacaacaccgaucucauuauccugcggaaugcccuggaccuccugcuucccaaacuggcucgcgugaucucuagacucgccgauuuugcuaaggagcgggccagccugccuacacuuggauucacccacuuucagcccgcgcaacugacaaccgucggcaagcgcugcugucucuggauucaggaccugugcauggaucugcagaaccucaaaagagugcgggacgaucugcgcuucagaggcguuaaggggacgaccggaacacaggccuccuuucuucaacuguucgaaggcgacgaccacaaaguggagcagcucgauaagauggucaccgagaaagcuggguuuaagcgggccuucaucauuacaggacagaccuacacgcgcaagguggacaucgaaguucugagcgugcuugcuucucugggcgccuccguccauaaaauuuguacagauaucagacuccuggccaaucugaaggagauggaggagccuuuugaaaaacagcaaauugggagcucugcuaugccguauaagcggaaccccaugagauccgagcgcugcuguagccucgcgcggcaccugaugacccuugugauggacccucugcagacagccucugugcagugguucgagagaacccucgaugacuccgcuaaucgccggaucugccuggccgaagccuuccuuaccgcugauacaauccugaacacgcuccaaaauauuagcgagggacuggucguuuaccccaaagugaucgaaagacgcauucggcaggagcugccuuuuauggccaccgaaaacaucauuauggcgauggugaaggcuggcggcuccagacaggacugucaugagaaaauccgcguccucucucagcaagccgccagcgugguuaagcaggaagggggagauaaugaccugaucgaacggauucagguggaugcuuauuucucccccauccacagccagcuugaccaucugcucgacccgucuuccuuuacaggcagagccagccaacagguccagcgcuuccuggaggaagagguguacccucugcuuaagcccuacgaaucuguuaugaaagugaaggcugagcucugccuguga

SEQ ID NO: 65598 - RNA, 1371 nt, Artificial Sequence
  derived and/or modified sequence opt5 from ADSS__Homo_sapiens__NP_001117
auggccuucgcugagaccuaccccgccgcgagcucccugccuaacggcgacugcgggagaccgcgggcucgccccggaggcaauagagugacagucguucucggggcccaguggggagaugaaggcaaggggaaagugguggaccugcuugcccaagaugcugacaucgucugucggugccagggaggcaacaaugccggccacacggugguuguggauucugucgaguaugacuuucaucugcucccuagcgggauuaucaaccccaaugugaccgcuuucauuggaaacggcguugugauccaucugccugggcuuuuugaagaggccgaaaagaauguccagaaaggaaagggccuggaggggugggagaaacgccucauuaucuccgauagagcgcacaucguguucgacuuucaccaggccgcugauggcauucaagaacagcagcggcaggagcaagccggaaagaaccugggcacaaccaagaaagggaucggacccguguacucuagcaaggcugcccgcuccggccugagaaugugugaccucgucucugauuucgacggguuuagcgaacgguucaaaguucuggcgaaucaguauaaguccauuuacccuacacuugagaucgauauugagggagaacugcagaaacucaagggcuauauggagaagaucaaaccgauggugcgcgacgggguguacuuucuguaugaagcccuucauggacccccuaagaaaauucuggucgagggcgcuaacgccgcucuccuggacaucgauuucggcaccuaccccuuugugacaagcucuaauugcaccguugggggaguguguacgggccuggggaugccuccccagaacgucggagaaguguacggcguugugaaggccuauaccacaagagucgggaucggcgccuucccgaccgagcaagacaaugagauuggagaacuccugcagacacggggccgcgaguuuggggugaccacgggaagaaaacggcgcugcggcuggcuugaucugguccuccugaaguacgcucacaugaucaacggguucacagcgcuugcccugaccaaacucgacauucuggauauguucacagaaaucaaggugggaguugcuuauaagcuggacggcgagauuaucccucacauccccgccaaucaggaagugcucaacaaagucgaggugcaauacaagacccugccuggguggaacaccgauauuuccaaugccagagcuuuuaaagagcuucccguuaacgcccagaauuaugugcgguucaucgaagacgagcugcagauucccgucaaguggaucggcgugggaaaaagcagagaaucuaugauucagcucuuuuga

SEQ ID NO: 65599 - RNA, 1374 nt, Artificial Sequence
  derived and/or modified sequence opt5 from ADSSL1__Homo_sapiens__NP_689541
augagcggcaccagagccuccaacgaccggcccccuggggcuggaggcgugaagcgcgggagacugcagcaagaggccgcggcuacaggaucucgggucacgguugugcucggcgcccaguggggagaugaagggaaaggcaagguggucgaccugcuugccaccgaugcugacaucauuagccgcugccagggcgggaauaacgccggacacacagugguuguggauggcaaagaguacgacuuccaucugcucccguccgggaucauuaauaccaaggcugucucuuuuaucggaaacggcgugguuauucaccuccccgggcuuuucgaagaggccgagaaaaaugaaaagaagggacugaaagauugggagaagagacucaucaucagcgaccgggcgcaucugguguuugauuuccaccaggccgucgacggccugcaagaagugcagcgccaggcucaggagggcaaaaacauugggacaaccaagaaaggaaucggcccuacauauuccucuaaggccgcuagaaccgggcuccggauuugugaucugcuuagcgacuuugaugaguucuccagccgcuuuaagaaucuggcccaucaacaccagucuauguuccccacgcucgaaaucgacauugagggacagcugaaaagacuuaagggcuuugcggaacggauccgcccuauggugagagacggggucuacuucauguaugaggcccugcacggacccccuaaaaagauucucguugaaggcgcuaacgccgcucugcuggauaucgacuuuggcaccuacccguucgugacauccagcaauugcaccgucgggggaguguguacaggccucgggauucccccucagaacaucggagauguguauggcguugugaaagccuacaccacgcgggucgggaucggcgccuuucccacagagcaaauuaaugaaaucggaggccugcuucagacccgcgggcaugaguggggagugacaaccggcagaaagcggagaugcggguggcuggaccucaugauucugcgcuaugcucacaugguuaacggauucaccgcgcuugcccugacaaaacucgauauccuggacgugcugggcgaggucaaggugggggucucuuacaagcucaauggcaaacggaucccuuacuuccccgcuaaccaggaaaugcugcaaaagguggagguugaauaugagacgcuuccgggauggaaagccgauaccacaggcgccagacgcugggaagaccugccuccccaggcucagaauuacauucgguuuguggagaaccaugucgggguggccguuaagugggugggagucggcaaauccagagagagcaugauccagcuguucuga

SEQ ID NO: 65600 - RNA, 747 nt, Artificial Sequence
  derived and/or modified sequence opt5 from ADTRP__Homo_sapiens__NP_001137420
augaccaagacaagcacgugcaucuaccacuuccuggugcucuccugguauaccuuucugaacuacuauauuucucaggaggggaaagacgaagucaagcccaaaauccuugccaauggggcuagauggaaguacaugacacugcucaaccugcuuaaaaaucggaccgccggauucgauauuuaucaaccuggcagcuuucgccagcugcuccagacaaucuucuacgggguuaccugucuggacgaugugcugaagagaacaaagggaggcaaagacauuaaguuucucaccgcguuccgggaucugcuuuuuacgacccuggcuuucccgguguccacauuugucuuccucgccuuuuggauccuguuccuuuauaaccgcgaccugaucuaccccaaagugcucgauaccguuauuccuguguggcugaaucaugccaugcacacauuuaucuuccccauuacccuggcugaggucgugcucagaccucauucuuaccccagcaagaaaacggggcugacacuucuggccgcugccuccaucgcguauauuucucggauccucuggcuguacuucgaaaccggaacauggguuuauccuguguuugccaaacuuagccugcucggccuggcugccuucuuuucccugagcuacgucuucauugcuucuaucuaucuccugggcgagaaacuuaaccacuggaaguggggcgacaugcgccagccgagaaagaagcggaaguga

SEQ ID NO: 65601 - RNA, 1554 nt, Artificial Sequence
  derived and/or modified sequence opt5 from AEBP2__Homo_sapiens__NP_001107648
auggcugcugccaucaccgacauggcggaucuggaggaacucagcagacugucuccccuuccuccgggcucccccgggagcgcugcccggggacgcgccgagccucccgaagaggaagaggaggaagaggaagaggaggaagaggcugaagccgaggcuguggccgcgcugcuccugaacggcggguccggaggcgggggaggcggcgggggaggcggggucggaggcggggaagccgagacaaugucugagccuagccccgaauccgcuucucaggccggagaggacgaagaugaggaagaggacgaugaggaagaggaagacgagagcuccagcucuggcggcggggaagaggaguccagcgcugaaucucuuguuggauccagcggcgggucuuccagcgaugagacgagaucccugucuccuggagccgcgagcuccagcucuggcgacggggauggaaaggaaggccucgaggagccgaaaggcccccgggggucccaaggaggcgggggaggcgggagcucuagcuccucuguggugagcuccggcggagacgaaggcuacgggaccggaggcgggggaagcucugccacauccggcgggcgcagaggcagccuggagaugucuuccgauggagaaccucugagccggauggacuccgaggauucuauuagcuccaccaucauggacgucgacucuacaauuagcuccggccgcagcacccccgcuaugaugaaugggcagggaucuacaaccuccagcucuaagaacaucgccuauaauugcuguugggaucagugccaggcuuguuucaacuccagcccugaccucgccgaucacauuagaucuauccauguggacggccaacgcgggggaguuuuugugugccuguggaaaggcuguaaggucuacaauacgcccagcaccucccagagcuggcuucagcggcacaugcugacacauucuggggauaaaccguucaagugcgugguuggcggauguaacgccuccuuugcuagccagggcgggcucgcgagacacgugccuacccauuucucccaacaaaauucuagcaaggucuccucucagcccaaagccaaggaagagagcccuuccaaagcuggaaugaacaagcggcgcaaacugaagaauaagagacggcgcucucuucccagaccccacgacuuuuucgaugcccagacacuggacgccauccggcacagagcuauuugcuuuaaccucagcgcccauaucgagucccugggcaaagggcacagcgugguguuccauucuaccgucauugcgaagcgcaaagaagauuccggaaagaucaaacugcuccugcacuggaugccugaggacauucuuccggauguuugggugaaugaaagcgagcggcaccagcugaagacgaaagugguccaucucucuaagcugcccaaggacacagcccuucugcucgacccuaacaucuauagaaccaugccccagaaacgccugaagcggacacugauuagaaaaguguuuaaucucuaccuguccaagcaguga

SEQ ID NO: 65602 - RNA, 978 nt, Artificial Sequence
  derived and/or modified sequence opt5 from AEN__Homo_sapiens__NP_073604
auggugcccagagaggccccugaaagcgcucagugccuguguccgucccucaccauccccaacgccaaggacguccugcggaaacgccacaagagacggucucgccaacaucagagauucauggcgcggaaagcccuucugcaggagcagggccuccugagcaugccucccgaaccuggguccucuccccuuccuacaccguuuggagcugccacggcuaccgaggccgcuagcuccggcaagcaaugccugcgcgccgggucuggaagcgcgcccuguuccagacggccugcccccggcaaagcuagcgggccucuccccucuaagugcguugccauugauugugaaauggugggaacaggcccgcgcggcagaguguccgagcuggcucggugcagcaucgucucuuaccacgggaaugugcuguaugacaaguacauucgcccugagaugcccaucgccgauuauagaacccggugguccggaauuacacgccagcauaugagaaaagcgguuccuuuccagguggcccagaaggaaauccucaaacugcuuaagggcaaagucgugguugggcacgcucugcauaacgacuuucaagcccucaaguacgugcacccccggagccagaccagagauacaaccuauguccccaauuuccugucugagccuggacuucacacgcgcgcucgggugucccugaaggaccucgcccugcagcugcuccauaaaaagauccaggugggccaacacgggcauagcuccgucgaagaugccaccacagcuauggagcuguacagacuuguugaggugcagugggaacagcaagaggcgcgcucucuguggaccuguccggaagaccgggagcccgauagcuccacagacauggaacaguauauggaggaucaguacuggccugacgaucucgcccacggaagcagaggcggcgcucgcgaggcccaggaccggagaaacuga

SEQ ID NO: 65603 - RNA, 795 nt, Artificial Sequence
  derived and/or modified sequence opt5 from AES__Homo_sapiens__NP_945320
augugccacaagaacggcuucccccaggaagggggaaucaccgccgcuuuucugcaaaagagaaagcuccggcugagcaaaaaucaucgcccugccagagcgaaggugacagagcacguccggggcacgcgcccggggagagcuaccgccggacccgccgcuuccacacgggccgcuggcucucuuuucuuugaccgcugggggaacagaggaccugccggcugucggggcagcucccaucugccccagcagcucaaauucaccacaucugauagcugcgaccgcauuaaggaugaguuucagcugcuucaagcgcaguaccacucccugaagcucgaaugugacaaacuggccucugagaaaagcgaaaugcagagacauuauguuauguacuaugagauguccuacgggcugaauaucgagaugcacaaacaggcugaaauugugaagcggcucaacggaaucugcgcccaagugcugccuuaucuuagccaggagcaccagcagcaaguccugggcgcuauugaacgcgccaaacaggugaccgcgcccgagcucaauucuaucaucagacagcaacugcaggcccaucagcuuucccagcugcaagcucucgcccugccucugacaccgcuccccguugggcugcagccucccagccuuccugcugugucugccggaaccggccugcucucccugagcgcccuugggucucaggcucaccuguccaaggaggauaagaacggacaugacggcgauacgcaccaggaagacgauggcgagaaaagcgacuga

SEQ ID NO: 65604 - RNA, 2445 nt, Artificial Sequence
  derived and/or modified sequence opt5 from AFAP1__Homo_sapiens__NP_001128119
auggaggaacugaucguggagcucagacuguuccuugaacugcucgaccacgaguaccugaccagcacaguccgggaaaagaaagccguuauuacgaacauccuucugcgcauucaguccucuaagggcuuugaugugaaagaccaugcucaaaagcaggagaccgccaauagccuccccgcgccuccgcagaugccccugccugagaucccccagccuuggcugcccccugauuccgggccgcccccucuccccacaucuagccugccugaaggauauuacgaggaagcugugccccuuuccccgggcaaagccccugaguauauuaccucuaacuacgacagcgaugccauguccagcucuuaugaguccuacgacgaagaggaagaggaugggaagggaaagaaaacaagacaccaauggcccagcgaagaggcuucuauggaccuggucaaggaugccaaaaucugcgcuuuccuccugcggaagaaacgcuuuggccaguggaccaaacuucugugugugaucaaggacacaaagcuccugugcuauaaguccagcaaagaucagcagccucaaauggagcugccccuccagggguguaauauuaccuacauccccaaggacucuaaaaagaaaaagcaugaacugaagauuacgcagcagggaaccgauccucuuguucuggccgugcaauccaaagagcaggcggaacaguggcucaaggucaucaaagaggccuacagcggcugcuccggcccgguggacucugaaugucccccucccccuagcucccccguucacaaggcugagcuggagaaaaagcugagcucugaaagaccguccagcgacggggagggaguggucgaaaacggcauuacaaccugcaaugggaaggagcaagugaaacggaagaaaucuagcaaguccgaagccaaaggaacagugucuaaggucaccggcaagaaaaucacgaagauuaucagccuugggaaaaagaaaccuuccacagaugagcagaccagcucugcugaggaagacguucccacauguggauaucucaacgugcuguccaauagccgcuggagagagcgguggugccgcgugaaggauaacaagcugaucuuccauaaagacagaaccgaucucaagacccacauugucucuaucccucugcggggcugugaagugauucccggccuugacuccaaacacccucugacauuucgccuccugagaaaugggcaggagguugccgugcuugaggcgagcuccucugaagauaugggacgguggaucggcauucugcucgccgagacggggagcuccaccgaccccgaagcucugcauuacgauuauaucgacgucgagaugucugccagcgugauccagacagcuaagcaaaccuucugcuuuaugaaccgcagaguuauuuccgccaauccguaccugggaggcacaagcaacggguaugcccacccuucuggaaccgcucuccauuacgaugacgugcccuguaucaauggcuccugggaacccgaggacggcuucccugcgagcugcucucgggggcugggagaggaaguccuuuaugauaacgccggccuguacgacaaucucccgcccccucacauuuuugcuagauacucccccgccgaucgcaaagccagccggcugucugcugacaagcugagcuccaaccacuauaaauacccugccagcgcgcagucugugacgaacacauccagcgucgggagagcuucccuuggacucaauucucagcugaagggcaagaaacccccuguggccagcaacgggguuaccggcaagggaaaaacccuguccucucagcccaagaaagccgauccggcugccguggucaagcgcacaggcagcaaugcugcccaauauaaguacgggaaaaaccggguggaggcggacgccaagagacuccagaccaaagaagaggaacugcuuaagcgcaaagaggcucugcggaauagacucgcccagcugcgcaaggagcggaaggaucugagagcugccaucgaaguuaacgcgggacgcaaaccucaggccauucuugaggaaaagcucaaacaacuggaggaagagugccggcagaaggaggcugaaagagugucccuggagcucgaacugacagaggucaaagagucucuuaagaaggcccuggcuggcggggugacgcucggacuggccaucgaacccaaaagcggcaccuccagcccucagucucccguguuccggcaucgcacacuggaaaauuccccgaucagcucuugugacaccuccgauacagaggggccuguucccgucaacagcgccgcugugcuuaagaaaucucaggcggccccuggcuccagccccugcagaggacacgugcuccggaaggcuaaagagugggaacugaagaauggcaccuga

SEQ ID NO: 65605 - RNA, 2178 nt, Artificial Sequence
  derived and/or modified sequence opt5 from AFAP1L1__Homo_sapiens__NP_001139809
auggacagaggccaggugcuggagcaacuccugcccgaacuuaccgggcugcucagccugcuugaucacgaguaccuguccgacacaacgcucgaaaagaaaauggccgucgcuucuauccugcagagccugcagccucucccggccaaggagguuuccuaucuguacgugaacaccgcggaucuucauucuggacccagcuucguggaaucccuguuugaggaguucgacugcgaucucucugaccugcgggauaugccugaagacgauggcgagcccagcaaaggggcuuccccugaacuugccaagagcccccgccugagaaaugccgcugaccucccuccgccccugccuaacaaacccccucccgaggauuauuacgaggaagcccugccgcucggaccuggcaagucucccgaguauauuuccagccacaauggguguucuccuucccauagcaucgucgacggauacuaugaagaugcugacucuuccuaccccgccacacgggugaacggcgagcuuaagagcuccuacaaugacucugaugcgaugagcuccagcuaugaaucuuacgacgaggaggaagaggaaggcaaaagcccccagccucgccaccaauggccgagcgaggaagccucuaugcaucuuguuagagagugccggauuugugcuuuucugcuccgcaagaaaagauucgggcagugggccaagcagcugaccgugauccgggaggaucagcuucugugcuauaaaagcuccaaggaccgccaaccccaccucagacuggcucuggauacauguucuauuaucuacgucccuaaggacagccggcacaaacgccaugaacucagauuuacccagggagccacagaggugcugguucuugcgcugcagucccgggaacaggccgaggaauggcucaaggugauccgcgaggucagcaaacccgugggcggggcugagggaguggaagucccuagaucucccguucugcuuugcaagcuggaucucgacaaacggcugucccaagagaagcagaccagcgauucugacuccgugggcgugggggauaacuguagcacgcugggaagacgcgaaaccugcgaccacggcaaaggcaagaaguccucucucgccgagcugaaagggagcaugucccgggcugccggaagaaagauuacacgcaucauuggcuucucuaaaaagaaaacccuugccgacgaucugcagacaagcuccaccgaggaagaggucccguguugcggguaucucaaugugcugguuaaccaaggauggaaggaacggugguguagacugaagugcaauacgcuuuacuuucauaaagaccacauggaucuccgcacacacgugaacgcuaucgcgcugcagggcugcgaggucgccccuggguucggaccccggcauccuuuugcuuuccggauucugcgcaaucggcaggaaguggccauccucgaggccagcuguucugaggacaugggcagauggcugggccuucugcucguugaaauggggucccgcgugacccccgaggcucugcacuaugauuacgucgacguggaaacacugaccagcauugucucugccggacggaacuccuuucuuuacgcgagaagcugccagaaucaauggccugagccccggguguaugaugacguuccguacgaaaagaugcaggaugaggagccugaacgccccaccggcgcucaggugaaaagacaugccucuagcuguuccgagaagucccaccgggucgacccccaggugaaaguuaagagacaugccucuuccgcuaaccaauauaaguacgggaaaaaucgcgccgaagaggaugcucggagauaucucguggaaaaggagaaacuggagaaggaaaaagagacaauccgcacggaacugaucgcccucagacaggagaagcgggagcugaaggaagcgauucgcagcuccccuggagccaaacuuaaggcucuggaggaagccgucgcuacccucgaggcccagugcagagcgaaagaagagagacgcaucgaccuggagcugaagcugguggccgugaaagaaagacuccagcaaucucuggcuggcgggccggcccugggccucagcguuuccucuaagcccaaaagcggagagugggaaaugaagaagacauga

SEQ ID NO: 65606 - RNA, 2457 nt, Artificial Sequence
  derived and/or modified sequence opt5 from AFAP1L2__Homo_sapiens__NP_001001936
auggagagauacaaggcccuggaacagcuccugaccgagcuugacgauuuccugaaaauccucgaccaagaaaaccugagcuccacagcucuugugaagaaaucuugccuggccgagcuccugcggcuguauacgaagucuuccucuagcgaugaagaguacauuuauaugaauaaagucaccaucaacaagcagcagaaugcggagucccagggcaaggcucccgaggaacaagggcuccugccuaacggagaaccgucucagcacagcuccgcuccccagaaaagccuuccugaccugcccccucccaagaugauuccugagcgcaaacagcucgccaucccgaagacagagucucccgaaggcuacuaugaggaagccgagccuuacgauaccucccugaaugaagacggggaggccguuagcagcuccuaugagagcuacgaugaagaggacggaucuaaaggcaaguccgcucccuaccaauggccuagccccgaagccgggauugagcuuaugagagaugcgcggaucugugccuuucuguggcgcaagaaauggcucggacagugggcuaagcagcugugcgugaucaaagacaacagacugcucuguuauaaguccucuaaagaucauagcccgcagcuggacgugaaucuucugggcuccagcgucauucacaaggaaaaacaagugcggaagaaggagcauaaacucaagaucacaccuaugaacgccgauguuauugugcugggccuucagucuaaagaccaggcugagcaauggcugcgcgucauccaggaaguguccgggcuccccagcgagggagccucugaaggcaaucaguacaccccugacgcgcagagauucaacugccaaaagcccgauauugccgagaaauaucugagcgcuuccgaauacgggucuagcguugacggacaccccgaggugccugagacaaaggaugucaagaaaaaguguuccgccggccugaaacucagcaaucugaugaaccuugggcggaagaaaucuaccucccuggaaccgguggagcgcagccucgaaacgucuuccuaucugaaugugcuugucaacagccaguggaaguccagauggugcucuguucgggacaaucaucugcacuuuuaccaggaucgcaacagaagcaagguggcucagcaaccccucucccuggugggaugugaggucgugccugaccccucuccugaucaccuguauagcuuccggauccuccauaaaggcgaggaacuggccaaacuugaggccaaguccagcgaagagaugggccacuggcuggggcuccugcugucugaauccggaagcaagaccgaccccgaggaguuuacauacgauuacguugacgcugaucgcgugucuugcauugucuccgcggccaaaaacagccuucuccugaugcagagaaaguucucugaaccgaauaccuauaucgacggccugccuagccaggaccggcaggaggaacucuacgaugacguggaucuguccgagcuuacagcugccguugaacccaccgaggaggccacgccuguggcugacgaucccaacgaaagagagagcgaccgcgucuaucuggaucucacaccugugaagucuuuucugcaugggcccuccagcgcccaagcgcaggcuuccucuccgacccugagcugucuugacaaugccacagaagcccucccugcugauuccggacccggccccaccccugacgagccgugcaucaaaugucccgaaaaccugggggagcagcagcuggagucucucgaaccugaggaucccagccugcggauuaccacagucaagauccaaacggaacagcagagaauuuccuucccucccucuugcccugacgccgugguugcuacacccccgggagccagcccucccgugaaagaucgccuucgggucacauccgcggagaucaagcugggcaaaaauagaaccgaggccgaagugaagcgcuacacagaggaaaaagagcggcucgaaaagaagaaagaggagauuagaggccaccuggcucaacugcgcaaggaaaaacgggagcuuaaggaaacccuccugaaaugcacggacaaggagguucuggccagccucgaacagaagcugaaagagaucgacgaggaauguagaggggaggaaucucgccggguggaucuugagcuguccaucauggaagucaaggacaaccucaaaaaggcugaggccggaccugugacacugggcaccaccguggauacaacccaccuggagaauguuagccccagaccgaaagcggucaccccugccucugcucccgacugcacgccugugaacuccgccaccacacuuaagaaucggccccucagcguggucgugaccgggaagggaacaguucugcagaaagcuaaggaaugggagaaaaagggcgccucuuga

SEQ ID NO: 65607 - RNA, 3657 nt, Artificial Sequence
  derived and/or modified sequence opt5 from AFF1__Homo_sapiens__NP_001160165
auggccuucaccgagagagugaacagcuccggcaauucucuguacaacgacgaucggaaucuccugcgcaucagagaaaaggagcggcgcaaccaggaagcucaccaagagaaagaagccuuucccgagaagauuccucuuuucggggagccguauaaaacagcgaagggagacgaacugagcuccagaauccagaauaugcucggcaacuacgaggaagucaaagaguuucugucuaccaagagccauacccaccggcuugaugcuuccgagaaucgccuggggaagcccaaauauccucucauucccgacaagggaucuagcaucccuuccagcucuuuccauacauccguucaccaucagagcauucacacccccgccucuggcccucuguccguggggaacaucagccacaauccgaaaauggcccagcccagaacagaaccuaugcccucucugcaugcuaaguccugcggaccucccgauagccaacaccucacccaggaccggcugggccaggagggcuuuggguccucucaucacaaaaagggagaucgcagagccgacggcgaucacugugcuagcgugacagacuccgccccggaacgggagcuuagcccucugaucucucuccccuccccugucccuccccugagccccauucauucuaaccagcaaacccuuccgcgcacgcaggggagcuccaaggugcacggaucuagcaauaacuccaaaggcuacugccccgccaagagcccuaaagaucuggccguuaaggugcaugacaaagaaacgccccaggauucucucgucgcuccugcccagcccccgucccaaacauucccucccccuagccugcccucuaaguccguggcuaugcagcagaaaccuaccgccuauguuagacccauggacgggcaagaccaggcgccgagcgaguccccugagcugaagccccuccccgaagauuaccggcagcagacauuugagaagaccgaccugaaagugccugccaaggcuaaacuuacgaagcugaaaaugccgucucaaagcgucgaacagacauauuccaaugaggugcacuguguggaagagauccucaaggagaugacccauucuuggcccccuccccugacagccauucacaccccuagcaccgcugaacccuccaaguucccuuuucccacaaaagauagccagcacgucucuuccguuacgcagaaccaaaagcaguacgacaccagcucuaaaacacauuccaauagccagcagggaaccucuagcaugcuugaggaugaccugcaacucuccgauagcgaagacucugauuccgagcagacaccggaaaagccucccagcuccucugccccucccagcgccccgcagucccugccugagcccguggcuucugcgcacagcuccucugccgagagcgaauccaccagcgacucugauuccagcucugacuccgagagcgaaucuuccagcuccgacagcgaggagaacgaaccucuggagacgcccgcucccgaaccugagccgcccacaaccaacaaauggcagcucgauaauuggcugaccaaggugucucaaccugccgcgcccccugaaggcccccgcagcacagagccuccgagacggcaucccgaguccaagggcucuagcgacuccgcuaccucucaggaacacagcgaguccaaagauccucccccuaagucuagcuccaaagcccccagagcgccgccugaagcuccccaccccgggaagcgcagcugccagaaaucuccugcccaacaggagcccccucagcggcagacagucggaacgaagcaaccgaagaaacccgugaaggccuccgcuagagccggcagccgcaccucucuucagggggaacgggagccuggacugcuccccuacggcuccagagaccagacaagcaaagauaagccuaaaguuaagaccaaagggcgcccccgggcugccgcguccaacgagccgaagccugccgugcccccuucuagcgaaaagaaaaagcauaaauccagccugcccgcuccuucuaaggcccuuuccggacccgagccggcuaaagacaaugucgaagauagaacaccugagcacuucgcccuggugccccucaccgaaagccagggacccccucauucuggcagcgggucccgcacgucuggaugucggcaagcgguugugguccaggaggacagcagaaaggaucgccugccgcugccccuccgggacaccaagcugcuuuccccucugagagauacacccccuccccagucucucauggugaaaaucacccuggaccugcuuagccggauuccucagccgcccggcaaggggucccgccaaagaaaagccgaggauaagcagccucccgcuggcaaaaagcacagcucugaaaagcgguccagcgacuccucuagcaaacucgccaagaaaagaaagggcgaggcugaacgcgacugcgauaacaaaaagauccggcuggagaaggagauuaaaucccagucuagcuccucuagcuccagccauaaggaaucuuccaaaacaaagccuagcagacccucuagccaauccucuaaaaaggagaugcugccgccuccucccgucagcuccagcucccagaaacccgccaagcccgcccucaagcgcucuagacgggaagcugacaccugugggcaggauccuccgaaaagcgcguccucuacaaagagcaaucacaaagacuccucuauccccaagcagcgcagaguggagggcaaaggaagccgguccagcucugaacacaagggcuccagcggggauacggccaacccuuuucccguuccuucucugcccaauggaaacuccaagccgggcaaaccucaagugaaguucgacaaacagcaggcugaucuucauaugcgcgaggccaagaaaaugaagcagaaggccgagcugaugaccgacagagucgggaaggcuuuuaaauaucucgaagccgugcugagcuucaucgagugcggaauugcgacagaaucugagucccaaagcuccaaaagcgcuuacucuguuuauagcgaaaccguggaucugaucaaguucauuaugucccuuaaaucuuuuagcgacgccaccgcccccacacaggagaagaucuucgcuguccucuguaugcggugccaguccauucugaauauggccauguuucgcuguaagaaagauaucgcgaucaaguacucuagaacgcugaacaaacacuucgagagcuccucuaagguggcucaggccccuagccccugcauugcccgguccaccggcacaccuagcccccucucuccgaugccuucccccgcuagcucuguggggucccaaagcuccgccggcucuguuggaagcuccggcgucgcugccaccaucagcacacccgugaccauucagaauaugacgucuuccuaugugacaaucaccagccauguccugaccgcguuugaccuuugggaacaggccgaggcucugacacgcaaaaacaaggaguucuuugccagacucucuaccaaugugugcacacuggcucugaacagcucccuuguugaucucgugcacuacacgcggcagggguuccaacagcugcaggaacugaccaagacaccuuga

SEQ ID NO: 65608 - RNA, 3831 nt, Artificial Sequence
  derived and/or modified sequence opt5 from AFF2__Homo_sapiens__NP_001162593
auggaccuguucgacuuuuucagagauugggaucucgagcagcaaugccacuacgaacaggaccggagcgcccugaagaaacgcgagugggaaagacggaaccaggaggugcagcaagaagaugaccuuuuuagcucuggcuucgaucuguuuggggagcccuauaagaccaauaaaggagacgcucucgccaaccgcguccagaauacacugggcaacuacgaugagaugaagaaucuucugacgaaccauagcaaucagaaccaccucguugggaucccuaaaaauuccgugccgcagaaccccaauaacaagaaugaaccuucuuucuuucccgagcaaaagaacagaauuaucccuccccaucaggacaauacccacccuagcgcgccgaugcccccucccuccguggucauucugaacucuacacugauccauagcaaccggaaauccaagccugaauggagccgcgauucucacaaucccuccaccgugcucgcuagccaggccucuggacagccgaacaaaaugcaaacacugacccaggaccagucccaagccaaacuugaggauuucuuuguuuauccugcugagcagccccagauuggcgaaguggaggaaagcaauccuucugccaaagaggacuccaaccccaauagcuccggggaagacgcuuucaaggagaucuuucagucuaacagccccgaggaauccgaguucgccguccaagcgccuggaagcccgcugguggccucuucccuccuggcucccagcucuggccuuagcguucagaauuuuccucccggccuguacuguaagacauccauggggcagcagaaaccuaccgccuaugugagacccauggauggacaagaccaggcuccggauaucucuccuacgcucaagcccagcauugaguucgaaaacuccuucggcaaucugagcuuugggacccugcucgacggaaaaccuucugccgcguccagcaagacaaaacugcccaaguucaccauccuucagacaucugaagucucccugccuagcgaucccuccugcguggaggagauucuccgggaaucucagcaccugaccccgggcuuuacgcuucaaaaauggaacgacccuacaacccgcgccagcacaaaguccgugucuuucaagagcaugcuggaggaugaccucaaacuguccagcgaugaagacgaucuggagcccgucaagacccucaccacacaguguacggcuaccgaacuguaccaggccguugagaaagcuaagcccagaaauaacccugugaauccgccccuugccacaccucagcccccucccgccgugcaggcuucugggggauccggcuccucuuccgagagcgaaucuagcuccgagagcgacucugacaccgaauccagcacaaccgauuccgagucuaacgaggcgccucgggucgccacgcccgaaccggagccucccagcacaaauaaauggcaacuggacaaguggcucaacaaggugaccucccagaacaaaucuuuuaucugcggccaaaaugaaaccccuauggagacaauuagccugcccccgccuaucauucagcccauggaaguucagaugaaggugaaaaccaacgcuucccaggucccugccgagcccaaggagcgcccccuucugucucucaucagagaaaaagcccggccucgcccgacacaaaagauccccgagacgaaggcucugaaacauaagcugagcaccacauccgaaaccgugagccagagaacaauugggaaaaagcagccuaaaaagguugagaagaauaccucuacggaugaguucaccuggcccaaaccuaacaucacauccagcacccccaaggaaaaagagucuguggaacuccacgacccuccgcggggaagaaauaaggccacagcgcauaaacccgcuccucgcaaggagccccggccuaacauuccccuggccccggaaaagaagaaguauagaggcccugggaaaaucguccccaagucccgcgaguuuauugaaaccgauagcucuacguccgacagcaauacagaucaggaggagacccuucaaaucaaagugcugcccccuuguaucauuuccggaggcaacacagccaagagcaaagaaaucugcggggcuucucucacccugagcacccugauguccucuagcggauccaauaacaaucuuucuauuagcaacgaggaacccacauucuccccuaucccggucaugcagacggagauucucucuccccugcgggaccacgagaaucugaagaaccucugggugaagaucgaucuggaccuucugagcagaguuccuggccacuccagccuccaugccgcucccgccaaaccugaucacaaggaaaccgcgacaaaacccaagcgccagaccgccgugacagcugucgagaaaccggccccuaagggcaagcggaaacauaagcccaucgaaguggcugagaaaauuccugaaaagaaacagagacuggaggaggccaccacgaucugucugcuucccccuugcauuucucccgcgccgccucacaagccucccaauacacgcgaaaacaacuccagccggagagccaaucgccggaaggaggaaaaacucuuucccccgccccugucuccucugcccgaggacccucccagacggcgcaacguuuccgggaauaacggaccuuucggccaagauaagaauaucgcuaugaccgggcagauuaccagcacaaaaccgaagagaaccgaaggaaaauuuugugccacauucaagggcaucuccgagggggacacgcccaaaaaggcuucuagcgccaccauuacagugaccaacacagccaucgcuaccgcgacggucaccgccacagcuaucgugaccacaaccgugacagccaccgccacggcuacagccaccaccacaaccacgacaaccacaauuuccaccaucacaagcaccauuacgaccggccucauggacucuucccaucuggagaugacaagcugggcggcccuuccucugcucucuagcuccucuaccaauguucggagacccaagcugacauuugaugacagcguccacaacgcugauuacuacaugcaggaagccaaaaagcugaaacacaaggcugacgcccuuuucgagaaauucggaaaggcggugaauuaugcugaugccgcccucuccuuuaccgaaugcggcaacgcuauggagcgcgacccucuggaagccaagucucccuacacgauguauagcgagacaguggagcugcuccgguacgcuaugagacugaaaaauuucgccuccccgcuugcgagcgauggggacaagaaacuggccguccucuguuaucgcugccugucucugcuuuaccucagaauguuuaagcugaaaaaggaucaugcuaugaaguauucccggagccugauggaauacuucaaacaaaacgccuccaagguggcucagaucccuucucccuggguuagcaauggaaagaacacccccuccccugugucucucaauaacgucagccccauuaacgccaugggcaauugcaacaaugggccugugacaaucccgcagcgcauccaccauauggccgcuucccacguuaacauuaccagcaaugugcugagaggauacgagcacugggacauggcggauaaacuuacccgggaaaacaaagaguuuuucggcgaccuggauacacucauggggccccugacgcagcauucuuccaugaccaaucugguccgcuaugugagacaaggccuuuguuggcugcggaucgacgcccaccuccuguga

SEQ ID NO: 65609 - RNA, 3756 nt, Artificial Sequence
  derived and/or modified sequence opt5 from AFF3__Homo_sapiens__NP_001020279
auggacagcuucgaucuggcccuccugcaggagugggaccuugaaucccuguggggcgaggauauccucaaccaaagaaaugacucucugguggucgaauuucagagcuccgcuucucggugccgcagcguuuacgagcccgauagaaacgcccuucggcgcaaggaaagagagcggcgcaaucaggagacccagcaagacgaugggacauucaacuccucuuauagccuguuuuccgaaccuuacaaaacgaauaagggagacgagcucagcaaccgcauucagaauacccugggcaacuaugaugaaaugaaagacuuccugacagaucggucuaaucagucccaccucgugggggugccgaagcccggagucccucagacccccgugaacaaaaucgacgagcauuuuguugcggauagccgcgcucaaaaucagccuucuuccauuuguagcacaaccacaucuacccccgccgccgugccuguccagcaguccaagagaggcacgaugggguggcaaaaggcuggacacccgcccagcgacggccagcagcgggccacccaacagggcucccugcgcacacuucugggggacggagugggcagacagcagccucgggcuaaacaaguuugcaacguggaggucgggcuccagacccaggaaagacccccugccauggcggccaagcauucuagcuccggacacugugugcagaauuuucccccgagccuggcuucuaaaccuucccuugugcaacagaagcccacagccuacgucagaccuauggauggccaggaccaggcucccgaugagagccccaaacugaagucuagcuccgaaaccucuguucauugcacgagcuauagaggggugccugccuccaagccggagcccgcgagagccaaagcuaagcucagcaaauucucuaucccuaagcaaggagaagagucccgcagcggcgagacaaacucuuguguggaagagauuauccgggaaaugaccuggcugcccccucuguccgccauccaggcucccggcaaagucgagccgacaaaguucccuuuucccaauaaagacagccagcucguguccucugggcacaacaacccuaagaagggagaugccgaacccgagagcccugacaauggcaccuccaacaccucuaugcuggaggaugaccuuaaacugagcuccgaugaagaggaaaaugagcagcaagccgcucagagaacagcgcuccgcgcccugagcgacucugcuguugugcagcaacccaacugccggacguccgucccgagcucuaagggguccagcucuagcuccagcucuggauccagcuccucuagcuccgauucugaaagcuccucuggcagcgacuccgagaccgagagcagcuccagcgaaucugagggguccaaaccuccccacuucagcucucccgaagccgagccugccuccagcaauaaguggcagcuugacaaauggcugaacaaggugaauccgcauaagcccccuauucucauccagaacgagucccacggaagcgaaucuaaucaguacuauaaccccguuaaagaggaugugcaagacuguggcaaggucccugaugugugccagcccagccugagagaaaaagagauuaaguccacauguaaagaggaacagcgcccucggaccgcuaauaaggcccccggcucuaagggggucaaacaaaagagcccgccugcggcuguggccguugccguguccgcugccgcucccccucccgccgucccgugcgcgccugccgagaacgcucccgccccugcuagacgcucugccggcaaaaagcccacacggagaaccgaacgcacgagcgcgggagacggggccaauugucaucggcccgaggaaccugcugccgcugaugcccugggaacauccgugguugugccgcccgagccuaccaaaaccagacccugcggcaacaaucgggccucucaccgcaaggaacucagaagcuccgucacaugcgagaagcggagaacccgcgggcugagccggaucgugccuaaaucuaaggaguuuauugaaacagaguccucuucuuccagcuccucuagcgacuccgaucuugaaagcgagcaggaagaguacccccugucuaaagcucagacgguggcggccuccgcuagcucuggcaacgaccagagacucaaggaggccgccgcuaacggaggcagcgggccucgcgccccgguuggauccaucaaugcgagaaccacaucugauauugcuaaagaacuggaggaacaguucuacacccuuguccccuuuggccggaacgagcugcucagcccucugaaggacuccgaugagauccgcucucugugggugaaaaucgaccucacacugcuuagccggauucccgaacaucugccucaagagcccggggugcucuccgccccggccaccaaggauagcgaaucugcuccucccucccacacgagcgacacccccgccgagaaggcgcugccuaaauccaagcggaaacgcaagugugacaaugaagaugacuauagagagaucaaaaagucucagggagagaaggauagcuccucucggcuggcuacaagcaccuccaacacacuuagcgccaaucacugcaacaugaauauuaacucugucgccauccccauuaauaaaaacgaaaagaugcuccgcuccccuaucagcccgcugucugacgcuuccaaacauaaguacaccagcgaggaucugacgucuagcuccagacccaauggcaacucucucuucacaagcgccuccagcuccaaaaagccuaaggcugacucucagcugcaaccccacgggggcgaucuuaccaaagccgcgcauaauaacagcgaaaauaucccucugcacaagucccggccccagacaaaaccguggucuccuggaagcaacggccaccgcgacuguaagagacagaaacucguguucgaugacaugccccgguccgccgauuauuuuaugcaggaggcuaagagaaugaagcauaaagccgacgcuaugguugaaaaguucgggaaagcccugaacuacgccgaggcugcgcugucuuuuauugagugcggaaaugccauggaacaaggcccuauggagagcaagucccccuauaccauguacagcgaaaccguggagcuuauccgcuaugcuaugcggcucaaaacacacucugggccuaacgccacgcccgaagauaagcagcuggccgcucuguguuacagaugccucgcccugcuuuacuggcgcauguuccggcugaaaagagaccaugcggucaaguauuccaaggcucucauugacuacuuuaaaaauagcucuaaggccgcccaggcuccguccccuuggggagccagcggcaaaucuaccgggacacccucccccaugagcccuaacccgucccccgcgagcucugugggcagccagggaucccugucuaaugcuagcgcccuguccccuucuaccaucguuagcauuccccaacgcauccaccagauggccgcuaaccacguguccaucacaaauucuauucuucauagcuaugauuacugggagauggccgacaaccucgcuaaggagaaucgggaguucuuuaacgaucuggaccugcucaugggcccugucacccugcacuccagcauggaacaucuugugcaguauucucagcaagggcugcacuggcucagaaauuccgcccaucugagcuga

SEQ ID NO: 65610 - RNA, 3492 nt, Artificial Sequence
  derived and/or modified sequence opt5 from AFF4__Homo_sapiens__NP_055238
augaacagagaggaccggaaugugcugcgcaugaaggaaagagagcggcgcaaccaggaaauccaacagggcgaggaugccuuucccccuagcuccccgcucuuugcugaacccuacaaagucaccucuaaggaggacaaacugagcucccggauucagucuaugcuugggaauuaugaugagaugaaggacuucaucggagauagaagcauuccuaaacugguugccauccccaagccuacagugcccccuuccgcggacgaaaagucuaacccgaauuucuucgagcagcgccacggcgggagccaucaauccagcaaauggacgcccgugggaccugcucccucuaccucccagagccagaagagaucuuccggccuccagagcgggcacucuucccaacggacaagcgccggauccucuagcggcaccaacuccagcggccagcgccaugauagagaaucuuacaauaacuccgggagcucuagccggaaaaagggacagcacggcuccgagcauucuaaaagccgcuccagcucuccugggaagccccaggccgucuccagccuuaauucuucccacagcagaucccacggaaacgaccaucacucuaaggagcaucaacggagcaaauccccgcgcgauccugacgcuaauugggauucucccagcagagugccuuuuuccagcggccagcacucuacacaguccuucccucccagccugaugucuaaguccaacagcaugcugcaaaaacccaccgccuauguucggccgauggacgggcaggaaucuauggagcccaagcucagcuccgaacacuacagcucucagucccauggaaauagcaugacagagcugaaaccuuccucuaaggcucaccugaccaaacucaagauucccagccagccucuggaugccuccgcgucuggcgacgugagcugcgucgacgaaauccuuaaggagaugacgcauuccuggcccccgccucugaccgccauccacacacccuguaaaaccgagccuucuaaguuucccuucccuacaaaagaaagccaacaguccaacuuuggcaccggggagcagaagagauauaaucccagcaaaacgucuaacggacaucaguccaagagcaugcucaaggaugaccugaaacuuucuuccagcgaagauucugacggcgagcaagauugcgacaagacaaugccgcgcuccaccccugggagcaacuccgaacccagccaccacaauucugagggagcugauaacagccgggacgauuccucuagccauuccggcucugagagcuccucugggagcgacuccgaaagcgagucuuccagcucugauuccgaagccaaugagcccagccaguccgcuucuccugaaccggagcccccucccacaaacaaauggcagcuggacaauuggcucaacaaggugaauccucacaaaguuagccccgccuccagcguggacucuaacauuccuuccagccagggauacaagaaggagggcagagaacaaggcaccggaaauucuuauaccgauacaagcgggcccaaagagacguccucugcgaccccgggccgcgacagcaagacaauccagaaaggguccgaaucuggacggggcagacaaaagagcccugcccaguccgauagcaccacacagcgccggaccgucgggaaaaagcagcccaagaaagcugagaaggccgcugccgaggaaccuagaggcggacugaaaauugagucugaaacgcccguggaccuggccuccagcaugccguccucucgccauaaggcugcgacaaaaggcagccggaagccuaacaucaaaaaggaguccaagucuagccccagaccuaccgccgagaaaaagaaauacaaguccaccagcaaaucuucccaaaagagccgcgaaauuaucgagacagauaccucuuccagcgacucugaugaaagcgagucccucccucccucuagccagacacccaaguacccggaauccaaucggacgcccgugaaaccuagcuccgucgaggaagaggacucuuucuuuagacagcggauguucagccccauggaggaaaaggagcugcuuuccccucugucugaacccgaugaccgcuauccucucauuguuaaaaucgaucugaaccuucugaccagaaucccggggaagcccuacaaagagacagaaccucccaagggagagaagaaaaaugugccugagaagcacacccgggaagcucagaaacaggccagcgagaagguguccaacaaaggcaagagaaagcacaaaaaugaagacgauaaccgcgccucugagagcaagaaacccaagacagaggacaaaaacuccgcugggcauaagccgagcucuaaucgggaauccagcaaacaaucugccgcgaaggagaaggaccuccugccuucccccgcuggacccgucccuagcaaagaucccaagaccgaacacggcucuagaaaacgcacgauuucccagagcuccagccugaagucuagcuccaacucuaauaaagagaccagcggguccucuaagaacagcuccucuacaagcaagcagaaaaagaccgaaggcaaaacauccucuagcuccaaggaggugaaagagaaggccccuucuagcuccagcaauuguccgcccuccgccccuacccucgacucuagcaagcccagacggacgaaacugguuuuugaugaccgcaacuauuccgcugaucauuaccuucaggaagccaagaaacugaagcacaaugcugacgcccucagcgauagauucgagaaagcgguguauuaccuggacgccgucgugucuuucaucgaaugcggaaacgcucuugagaagaaugcccaagaauccaagagcccuuuucccauguauucugagacaguugaucugauuaaauacaccaugaagcucaaaaacuaccuggcuccggacgccacagcggccgauaagcggcugaccgugcucugucugcgcugcgagagccuucuguaucucagacuguucaaacugaagaaggaaaaugcucuuaaauacuccaagacccucacagagcaucugaaaaacucuuauaauaacagccaggccccuucccccggccuggggucuaaggcugucggaaugccuagccccguguccccuaaacucagccccggcaauucugggaacuacuccagcggagccuccucugccagcgcuuccggcucuagcgucacgaucccgcagaagauucaccagauggcggccuccuaugugcaaguuaccagcaacuuucuguacgcuacagaaaucugggaccaggccgagcagcuuucuaaagaacaaaaggaguucuuugccgagcuggauaaggugauggggccucucaucuucaaugcuuccauuaugaccgaccugguccgguauacacgccagggccugcacuggcuuagacaggacgccaaacucaucagcuga

SEQ ID NO: 65611 - RNA, 2394 nt, Artificial Sequence
  derived and/or modified sequence opt5 from AFG3L2__Homo_sapiens__NP_006787
auggcccacagaugccugcggcucuggggccgcgggggauguuggcccagaggccugcagcaacuucuggugccugggggagucggcccgggggagcagcccugccuccggacccuguaccgcuucguuacaacgcaggcuagagccagccggaacucccuucugaccgacaucauugcggcuuaucagcgcuuuuguucuagaccucccaagggauucgaaaaauacuuuccuaauggcaagaacggcaaaaaggccagcgagcccaaagaagugaugggggagaagaaggaauccaaaccugccgcuacaacccggucuagcggaggcgggggaggcgggggaggcaagcgcggcgggaaaaaggaugacucccauugguggucuagauuccaaaaaggagauaucccgugggacgauaaggacuuucggauguucuuucucuggacagcccuguucuggggcggggugauguuuuaucugcuccugaagcgcagcggaagagagauuaccuggaaagauuucgucaauaacuaccuuuccaagggcgugguugaccggcuggagguggucaauaaacgcuuugugagaguuacauucacccccgggaagacgccuguggauggacaguaugucugguuuaacaucggcagcguggacaccuucgaacggaaucucgagacacugcagcaggaacuuggcauugagggggagaacagagugcccgucguuuacaucgcugaaucugauggauccuuccugcucagcaugcugccuaccgugcugaucauugccuuucuccuguauacaauccgccggggccccgcggggauuggaagaaccggccgcgggaugggcggacuuuucucugugggcgagacgacagccaaaguccugaaggacgaaaucgaugugaaauuuaaggacguugcugggugcgaggaagccaagcucgagauuauggaguucgugaauuuucugaaaaacccgaagcaauaccaggaccuuggagcuaaaaucccuaagggcgccauucugaccgggcccccuggaacaggcaaaacccuccuggcgaaggccaccgcuggggaagccaauguccccuucaucacaguguccggcagcgaguuucuggaaauguucguuggagugggccccgcucgggucagagaucucuuugcccuggcccgcaagaacgcuccuuguauccuuuucauugacgagaucgaugcgguggggcggaaaagaggacgcggcaauuuugggggacagucugaacaggagaacacgcugaaucaacuccuggucgagauggacggcuucaacaccacaaccaacgugguuauucuugccgggacaaaucggccggauauccuggaccccgcucuccugagaccuggccgcuuugaucggcagauuuucaucggacccccugacaucaagggcagagccuccauuuucaaagugcaccuucggccccucaagcuggauagcacccuugaaaaagacaagcuggcccgcaagcucgcuucccugacgccgggguuuucuggagccgaugucgcgaacgugugcaaugaggcugcccugaucgccgcuagacaucuuagcgacuccauuaaccagaaacacuucgaacaagccaucgagcggguuauuggcgggcucgaaaagaaaacacaggugcugcagccugaggagaagaaaaccgucgcuuaccaugaagccggacacgcgguggccggcugguaucuggagcacgcugacccccuccugaaggugagcaucaucccuagagggaagggccuuggauacgcccaguaucugcccaaagaacaauaccucuauaccaaggagcagcugcuggaucgcauguguaugacacuuggcgggcggguuucugaggaaaucuuuuucggaagaauuaccacaggcgcucaggacgaucuccgcaaagucacgcaguccgccuacgcgcaaauugugcaguuugggaugaaugagaaggugggacagaucagcuucgaccugccuagacagggcgauaugguccuggaaaaacccuauucugaggccaccgcucggcucauugacgaugaagugcgcauccugauuaacgacgccuacaagagaacaguugcucugcugaccgagaaaaaggccgauguggagaaggucgcccuccugcugcuugaaaaagaggugcucgacaagaaugauaugguugaacugcugggcccgcggccuuuugcugagaaaagcacauacgaagaguucguggaggggaccggaucccucgacgaagauacgucucugcccgagggccuuaaggacuggaacaaagaacgcgagaaggaaaaggaggagcccccuggggaaaaagucgcgaauuga

SEQ ID NO: 65612 - RNA, 1800 nt, Artificial Sequence
  derived and/or modified sequence opt5 from AFM__Homo_sapiens__NP_001124
augaagcugcucaaacugaccggcuucaucuuuuuccuguuuuuccuuacagagagccucacgcugcccacccagccuagagacauugaaaacuuuaauuccacacaaaaguucaucgaggauaacauugaauacaucaccauuaucgccuuugcucaguaugugcaggaggccacauucgaagagauggagaaacuugucaaggacaugguugaauacaaagaucggugcauggcggacaagacccugccggaguguucuaagcuccccaauaacgugcugcaggagaaaaucugcgcuauggaggggcugccucaaaagcacaauuuuagccauuguugcuccaaaguggaugcccagcgcagacucuguuucuuuuauaacaagaaaucugacgucggauuccugcccccuuuucccacacuugauccugaggaaaagugccaggccuacgagagcaaucgggaaucccugcucaaccacuuccuguaugagguggcucgcagaaauccguucguuuuugcccccacccuucugacgguggcuguccauuucgaagagguggccaagucuuguugcgaggaacagaacaaaguuaauugucuccaaacccgggcgauuccugugacacaguaccugaaggccuuuagcuccuaucagaaacacgucugcggcgcucugcucaaguucgggaccaaaguggugcauuuuaucuacauugccauccugagccagaaguuccccaaaauugaguuuaaggaacuuaucucucuggucgaggacguuuccagcaacuacgauggauguugcgaaggcgacguggugcaaugcauucgcgauacaucuaaggucaugaaucacaucuguuccaaacaggacagcaucucuuccaagauuaaagagugcugugagaagaaaaucccugaaagagggcagugcauuaucaacagcaauaaggaugaccggcccaaggaccucucccugcgcgagggaaaauucaccgauucugaaaacgugugucaagagagagacgcugauccggacacguuuuucgccaaguuuacauucgaauauagccggcgccacccugaucuuuccauucccgagcugcucagaaucguucagaucuacaaagaccugcugcggaacugcuguaauaccgagaacccucccggcugcuaucgcuacgcggaagauaaguuuaaugagacaaccgagaaaagccucaagauggugcagcaggaauguaagcauuuccaaaaccugggcaaagacgggcuuaaguaucacuaccugauuagacucaccaaaaucgcuccccagcugucuacagaggaacuugucucccugggagagaagauggugacggccuucaccacaugcuguacccucagcgaagaguuugccugcguugauaaucuggcugaccugguguucggcgaacucugcggggucaacgagaaucggacaauuaacccugccguggaucauuguugcaaaaccaauuuugccuucagacgcccguguuuugagucucugaaggcugacaagacguaugugcccccucccuucagccaggaccuuuuuacauuccacgcggauaugugccagucccaaaacgaagaacugcagcggaaaaccgacagauuucucgucaaucugguuaagcugaaacacgaacuuaccgaugaggaacuccagucucuguucacaaacuuugccaauguggucgacaaguguugcaaagcugagagcccugagguguguuucaacgaagagucccccaagaucggaaauuga

SEQ ID NO: 65613 - RNA, 1830 nt, Artificial Sequence
  derived and/or modified sequence opt5 from AFP__Homo_sapiens__NP_001125
augaaguggguggagagcaucuuccugauuuuucuccugaacuucaccgaauccagaacacuucaccggaaugaguacggcaucgccucuauucuggacagcuaucagugcacggcugaaaucucccucgccgaucuggcgaccauuuucuucgcucaauuuguccaggaggccacauacaaagaaguuucuaagauggugaaagacgcccuuaccgcuaucgagaagcccacaggggaugagcagagcuccggaugucuggaaaaccagcucccugccuuccuggaggaacugugccaugagaaagagauccucgaaaaguauggccacucugacuguugcagccaauccgaggaagggcgccauaauuguuuucuggcucacaagaaaccgacccccgccagcauuccucuuuuccaggugcccgagccugucacaucuugcgaagcguacgaggaggauagagaaaccuuuaugaacaaguucaucuaugagauugcccggcgccaucccuuucuguacgcuccuacgauccuccugugggccgcuagauaugacaaaauuaucccguccuguugcaaggccgaaaaugcgguggaguguuuccagaccaaagccgcuacaguuaccaaggaacuucgggagagcucucugcucaaccagcacgccugcgcugugaugaagaauuuuggaacacgcaccuuccaagccauuacggucacaaaacugucccagaaguucaccaaagugaacuuuacagagauccagaagcugguucucgauguggcccacguccaugaacacuguugcagaggcgacgugcuggauugccuucaggacggggagaaaaucaugagcuacauuuguucucaacaggauacccuguccaauaagaucaccgaaugcuguaaacucacaacgcuggagcggggacagugcauuauccaugcugaaaacgacgagaagcccgagggccuuagcccuaaucugaaccgcuuccucggcgauagagacuuuaaucaauucuccucuggggaaaagaacauuuuucuggcgagcuucgugcacgaguacucccggcgccacccccagcuggccgucagcguuauccucagaguggcuaaaggauaucaggaacugcuugagaaguguuuucagaccgagaauccucuggaaugccaagacaaaggcgaggaggaacuccagaaguacauccaggaaucucaggcccuggccaaacgguccugugggcuuuuccaaaagcugggagaguauuaccuccagaacgcuuuucugguggccuauacaaagaaagcgccccagcugaccagcucugagcucauggcuauuacacgcaagauggccgccaccgcugccacgugcugucagcugagcgaagauaaacuucuggcuugcggcgagggggccgcggacaucauuaucggacaucucuguauuagacacgaaaugacaccggucaacccuggcgugggccaaugcugcaccuccucuuacgccaaucggagacccuguuucagcucccugguuguggaugagaccuaugucccucccgcuuuuagcgacgauaaguucaucuuucauaaagaccugugccaggcccaggggguggcccuucagacaaugaagcaagaauuucucaucaaccugguuaagcagaaaccccagauuaccgaggagcaacuggaagcugugaucgcggauuucucuggacuccuggagaaguguugccagggccaggaacaggaggucuguuuugccgaagaggggcaaaaacuuauuuccaagacacgcgcugcccugggaguguga

SEQ ID NO: 65614 - RNA, 1041 nt, Artificial Sequence
  derived and/or modified sequence opt5 from AGA__Homo_sapiens__NP_000018
auggccagaaagagcaaccugcccgugcuccuggucccuuuccuucugugccaggcucucguucgguguuccucuccgcugccccuuguggugaauaccuggccuuuuaaaaacgccacagaggcggcuuggcgcgcccuggccagcggcggguccgcucucgacgccgucgaaucuggaugcgcuaugugugagagagaacaaugcgauggcagcgugggguucggaggcucccccgacgagcugggggaaacgacccuggaugccaugaucauggacggaacaaccauggauguuggcgcggugggcgaccuccggcgcauuaagaaugccaucggggucgcuagaaaagugcuggagcacacaacccauacacuucugguuggagagucugccaccacguuugcucagagcaugggcuucauuaacgaagaucucuccaccacagccagccaggcgcugcacucugacuggcuugcccggaauugucagccuaacuacuggcgcaaugugauccccgauccuuccaaguauugcgggccguacaaacccccuggcauucugaagcaagacauccccauccauaaggagaccgaagaugacagaggacacgauacaauugggauggucgugauccauaaaaccggacacauugcugccggcacgagcacaaacggcaucaaguuuaaaauucacgggcgggugggagacucuccuauccccggcgcuggggccuaugccgacgauaccgcuggagcggccgcugccacaggcaauggggacauucucaugcgcuuccugccguccuaccaggccgucgaguauaugagacggggagaggauccuaccaucgcuugucagaagguuaucagccgcauucagaaacauuuucccgaguucuuuggcgccgugaucugcgcgaacgugaccggcucuuacggggcugccuguaauaagcuguccacauucacgcaauuuagcuucauggucuauaacuccgaaaagaaucagccuaccgaagagaaaguggacugcauuuga

SEQ ID NO: 65615 - RNA, 2574 nt, Artificial Sequence
  derived and/or modified sequence opt5 from AGAP1__Homo_sapiens__NP_001032208
augaacuaccagcaacagcuggccaauagcgcugccaucagagcggagauucagcgguucgaauccgugcaccccaacaucuauucuauuuacgagcuccuggaacgcgucgaggaaccuguucuucagaaucaaaucagagagcaugugauugcuaucgaggacgccuuugugaacagccaggaauggacccugucccggucugucccggagcucaaggugggcaucguugggaaucuggccagcggaaaauccgcucuugugcaccgcuaucugacaggcacguacguccaggaagagucucccgaagggggaagauucaagaaagaaauugugguugauggccagagcuaucuccugcugauccgggacgaagggggaccucccgaagcccaauuugcuauguggguggaugccgucauuuucguguuuucccucgaggacgaaaucagcuuccagaccguguaccauuauuacucucgcauggcgaacuacagaaauacauccgagauuccucugguccuuguuggcacccaggaugccaucagcucugcuaacccccgggugauugacgaugcccgcgcuagaaagcuguccaaugaccucaaacggugcacauauuacgagaccugugccacauauggccugaacguggaacgcgucuuucaggauguggcgcaaaagaucguugccaccagaaagaaacagcagcuuagcaucgggccuugcaagucucugcccaauucccccagccacuccucuguguguagcgcucaagucuccgccgugcauauuagccagacgucuaacggaggcgggucccucagcgacuacucuagcuccguuccuucuacccccagcacaucccagaaagagcugcggaucgaugugccucccaccgcuaauacaccgaccccuguccgcaagcagagcaaaagacggucuaaccuguucacguccagaaagggaagcgaccccgauaaggaaaagaagggccucgagucucgcgccgacuccauugggagcggacgggccaucccuauuaaacaaggcaugcugcuuaagagauccggcaaaucucugaauaaggaauggaaaaagaaguaugugacacucugcgacaacgggguccugaccuaccaccccagccuucacgauuauaugcagaacgugcauggaaaagagaucgaccugcuccgcacaaccguuaaggugcccggcaaacggccuccgagagcuaccuccgcgugugcccccaucucuagcccuaagacaaaugggcuguccaaagauaugagcucucugcacauuucccccaacagcggaaaugucacgucugcuuccggcagccagauggccucugggaucagccucguguccuuuaacagccgcccugacggaaugcaucagcggucuuacuccguuagcuccgccgaucaauggucugaggcuaccgugauugccaauagcgcgaucuccucugacacaggccugggcgauagcgucugcuccucucccagcauuuccagcaccacaucuccgaaacuugacccucccccuuccccgcacgcuaacagaaagaaacaccgccggaagaaaagcaccucuaauuucaaggccgaugggcuguccggaacggccgaggagcaggaagagaacuuugaguucaucaucgugagccucacaggccagaccuggcauuuugaggcuaccacauacgaggaaagagacgccugggugcaggcuauugagucucaaauccuggccucccuucagagcugugaauccagcaaaaauaagucucgccugaccagccaguccgaggcgauggcccuccagucuauucggaacaugagagggaauagccacugcguugauugugagacacaaaacccuaauugggcuucccugaaccugggagcccucaugugcaucgaauguucuggcauucaucggaaucuggggacgcaccuuagccgcgucagaucccuggaccucgacgauuggcccguggagcugaucaaggugaugucuagcauuggcaacgaacuggcuaacuccgucugggaggaaagcucucagggacggaccaaaccguccguggacagcacaagagaggagaaggaacgcuggauccgggccaaauaugagcagaaacuuuuccucgcgccucugcccugcaccgaacugucucucggccaacaucugcuuagagccacagcugaugaggaccugcgcaccgccauccuccugcuggcucacggguccagagaugaaguuaaugagacgugcggagagggcgacgggcggaccgcccuucaccucgccugucgcaagggaaacgugguccuggcucagcugcucauuugguacggcguggauguuacagcgagagacgcccaugggaauaccgcucuggccuaugcccggcaggcuagcucccaggaaugcaucgaugugcuucugcaauacggcugucccgacgagcgcuucguccucauggccacaccuaaccugucuagacggaauaacaaucgcaacaauagcuccggaagagugccgaccauuaucuga

SEQ ID NO: 65616 - RNA, 3579 nt, Artificial Sequence
  derived and/or modified sequence opt5 from AGAP2__Homo_sapiens__NP_001116244
augagcagaggcgccggggcucugcagcggcgcaccacaacguaccucaucucccugacccuugugaagcuggagucuguucccccuccgcccccuagccccuccgccgcggcugccggagccgcuggcgccagagggucugaaacaggagacccuggcagcccccgcggggcugaggaaccuggcaaaaagcggcacgagagacucuuccaucggcaagaugcccuguggauuuccaccucuagcgcgggcacaggcggggccgaaccgcccgcucuuuccccugcccccgcuagcccugcccgccccgucucuccggcgccuggaagacggcugucccucugggccgugcccccuggcccuccccugagcgggggacugucucccgacccgaaacccggcggggcuccuaccuccagccgcagaccccuccugucuuccccuagcuggggaggccccgagccggagggccgggccgggggaggcaucccuggguccucuagcccccacccuggaacaggcucccgcagacuuaagguggcucccccucccccggccccuaaacccugcaagaccgucacgaccagcggggccaaggcuggaggcggcaaaggggcgggaucucggcuguccuggcccgaaagcgagggcaagccucgcgugaaagggucuaagagcuccgccggaacaggcgcuucuguuagcgccgccgcuaccgccgcggcugccgggggcggaggcuccacagccagcaccucugggggagugggcgcuggggccggagcuagaggcaaacucuccccgcggaagggcaagagcaaaacgcuggauaacucugaccuucaucccgggccucccgccggauccccucccccucugacacugcccccgaccccuagccccgcgacagccgucaccgcugccuccgcucagccucccggcccggccccucccauuacccuggaaccucccgcgcccgggcugaagagaggacgcgagggcgggcgggccucuacaagagaucgcaaaaugcucaaguuuaucagcggaauuuucacgaaauccaccggcgggccuccgggcucuggaccccugccuggacccccuagccuuuccagcgggucuggaucccgggagcugcucggcgcugaacugagagccagccccaaggcugugaucaauucucaggaguggacacuuucccgcagcaucccugaacugcggcucgggguucugggagacgccagaucuggcaaaagcucccugauucaccgcuuucucaccgggagcuaucaggugcuggagaagacagaaucugagcaauacaagaaagagaugcuugucgauggccagacccaucuggugcucauccgggaagaggccggagcuccggacgcgaaguucuccggcugggccgaugcugugauuuuugucuucagccuggaagacgagaacuccuuucaggccguuucuagacuucacgggcagcugagcucccuccgcggagaaggcagagggggacuggcccuggcucucgugggcacgcaagaucggaucucugccagcagcccccggguggucggcgacgcgcgcgcuagagcccugugugccgauaugaaacggugcucuuauuacgagacaugugcuaccuaugggcuuaauguggacagaguuuuccaggagguggcccagaaggucgugacccugcgcaaacagcaacagcuccuggcggcuugcaagagccugccuuccagccccucucacuccgccgccagcacaccuguugcuggacaggccucuaacggcgggcauaccuccgacuacuccucuucccuucccagcuccccgaaugugggacaccgggaacucagagcugaggccgcggccgucgcuggccugagcacaccugggucucugcaucgcgccgcuaagagacggacgagccucuuugccaaccgcagaggauccgauucugaaaaacggagccuggacucccgcggcgagaccacaggcucugggagagccauucccaucaagcagagcuuccuucugaaacgguccggaaauucucucaacaaggaauggaaaaagaaguaugugacccugagcuccaauggcuuucugcuuuaccaccccagcauuaacgauuacauccacucuacacaugggaaagagauggaccuccugcgcaccacggucaaggugccuggaaaaagacccccucgggcuaucuccgcguucggcccgagcgccucuauuaaugggcugguuaaggauauguccaccgugcaaaugggagagggccucgaagcuacaacccccaugccuagccccuccccuucucccagcucccugcagccgccucccgaccagacaagcaaacaccuucugaagccugaucgcaaccucgccagagcccugucuaccgacuguacgcccuccggcgaucugagcccucuuucucgggagcccccgccuagccccauggucaagaaacaaagacgcaagaaacucacaacccccuccaagacagaagggucugcuggacaggccgaggcgaaacggaagauguggaaacucaagagcuuuggcucccugagaaauaucuauaaggcugaggaaaacuucgaguuccucauugugucuagcaccgggcagaccuggcauuuugaagccgccuccuucgaggaacgcgacgcuuggguucaggccaucgagagccaaauucuggcgucucuucagugcugugaguccagcaaagugaagcugcggacagauucccagucugaagcugucgccauccaggccaucagaaaugcuaaaggaaacagcauuugcguggacuguggcgccccuaacccgacgugggcuucccucaaucugggggcccugaucugcauugaguguucuggaauccaccgcaaccuuggcacccaucucagccgggugagaucccuggaccuggaugacuggccccgcgaacucacacugguucuuaccgcgauuggcaaugauacagccaaccgggucugggagagcgacaccagagggcgggcuaagccuucucgcgauuccagcagagaggaacgggagucuuggauccgcgccaaauacgaacaacugcucuuucuggcuccccuguccacgagcgaggaaccucuuggaagacagcugugggccgccgugcaggcucaggacguggcgacaguccuccugcuccuggcccacgcucggcacggcccccuugauaccucuguggaggacccucaacugagaagcccgcuccaucuggccgccgaacuggcucacguugugaucacccagcuucugcucugguauggggccgaugucgcggcucgcgacgcccagggacggacagcccuguucuacgcuagacaagccggcucccagcucugcgcggauauucugcuucagcaugggugccccggagagggcggcucugccgcuaccacaccuagcgccgcuacgacccccuccaucacagccaccccuagcccccgccggagauccucugcugccagcguggggcgcgcggacgccccgguugcucugguguga

SEQ ID NO: 65617 - RNA, 1191 nt, Artificial Sequence
  derived and/or modified sequence opt5 from AGAP3__Homo_sapiens__NP_001036000
augaacuuccaggccggcgggggacaaagcccccagcagcagcaaucccuggcugccccuggcgggggaggcgcggcugcccagcagcucgugugcgggggacaguuuggcggcgccgggccgggagcuggcgggggaggcgggcccucucaacagcuggccggaggcccuccccagcaguucgcucuuagcaauuccgccgcgaucagagccgagauucaacgguuugaaucuguccacccuaacaucuacgcuauuuaugaccugaucgagcgcauugaagaucucgcccugcagaaucagaucagagagcauguuaucagcauugaagacuccuucgugaacucucaagaguggacccuuagccgguccgugcccgagcugaaggucggcaucguggggaaucucagcucuggaaaauccgcucugguucaccgcuaccugacaggcacguaugugcaggaagagagcccugaagggggaagauuuaagaaagagauugucguggauggccagucuuaccuccugcuuauccgggacgaagggggaccgcccgagcugcaguucgccgcguggguugaugccguggucuuuguguucucccucgaggacgaaauuagcuuucaaaccguguauaacuacuuccugcgccuuuguucuuuuagaaaugcuuccgaggucccuaugguucuggugggcacacaggaugccaucagcgcugccaacccccgggugauugacgauucccgcgccagaaagcucucuaccgaccugaaacggugcacauauuacgaaaccugugcuacauacggccugaaugucgagcgcguguuccaggauguugcgcagaagguggucgcccucagaaagaaacaacagcuggcuaucgggccuugcaagagccuucccaacuccccgagccauucugccguguccgccgcuagcaucccugccguucacauuaaucaggcgaccaacggaggcgggucugcuuuuagcgacuauuccucuagcgugcccuccacgccuagcaucucucagcgggagcugcgcauugaaaccaucgccgccuccagcacacccacccccauuagaaaacaaucuaagcggagauccaauaucuucacaaucugugcuaccgucagcaacuucuccucuacgaaacgcccuuuucagcuccugccgaauuga

SEQ ID NO: 65618 - RNA, 1992 nt, Artificial Sequence
  derived and/or modified sequence opt5 from AGAP4__Homo_sapiens__NP_597703
augggcaacauccugaccugcagagugcaccccagcgucucccucgaguucgaccagcaacaggggucuguuuguccuagcgaauccgagauuuacgaagccggagcuggcgaucggauggccggggcgccgauggcugccgccgugcagcccgcugaggugacagucgaagugggagaggaccugcauaugcaccauguucgcgauagagagaugccugaagcccuugaguuuaaucccucugcuaacccugaagccagcacgaucuuccagcgcaauucccaaaccgacguggucgagauucggagaucuaacugcacaaaucacgugagcaccguucgguuuucccagcaguauagccuguguucuacaaucuuccucgaugacuccaccgcgauucagcauuaccugacaaugaccaucaucagcgugacgcuugagauuccccaccacaucacccaacgcgaugccgacagaucucuguccauuccugaugaacagcuccauagcuuugcugucucuacagugcacaucaugaagaaacggaacggcgggggaucccugaauaacuauagcuccucuauuccgagcacccccuccacaagccaggaggacccucaguucucugugcccccuaccgccaauacgcccacaccggucugcaagcgcuccaugagauggagcaaccuguuuaccucugaaaaaggcagcgauccugacaaggagcggaaagcucccgaaaaucaugccgauacaaucggcuccgggcgcgcgauuccuaucaagcaaggaaugcuccugaagagaucuggcaaauggcuuaagaccuggaaaaagaaauacguuacccuguguagcaacggggugcucacauauuacuccagccugggagacuauaugaagaauauccacaagaaagagauugaccuucagacgucuaccaucaaggugcccggcaaauggcccucccuggccacaagcgcuugcaccccuauuucuacauccaagagcaacgggcucuccaaagauauggacaccggacugggcgauucuaucuguuucagcccguccauuucuagcacgacaucccccaagcugaauccucccccuagcccccacgccaacaaaaagaagcaucucaaaaagaaaucuaccaacaauuuuaugaucgucuccgcuaccggccagacauggcacuucgaggccaccacauacgaggaacgggacgccugggugcaagcuauccagagccagauucuggcgucucuucaguccugcgaaagcucuaagagcaaaucccaacugacgagccagucuaaggccauggcucuccaguccauccagaacaugcgcgggaaugcccauuguguugauugcgagacccaaaacccgaagugggccagccugaaucuuggagugcugauguguauugaaugcuccggcauccacagaucucucgggacacggcugagcagaguccgcucccuggagcucgacgauuggccuguggagcugcggaaaguuaugucuagcauuggaaacgaccuugcuaauuccaucugggaaggcucuagccaggggcagaccaagcccuccgagaaaagcacaagagaagagaaggaacgcuggauccggucuaaauacgaggagaagcuguuucucgccccucugcccugcaccgaacuuucccugggacagcaacuccugagagcgacggcugaugaggaccugcagaccgccauucuccugcuugcccauggcagccgcgaagaggugaacgagacauguggcgaaggggauggaugcaccgcucugcaccucgccugucggaagggcaaugucgugcuggcucagcugcuuaucugguauggggucgacgugauggccagagacgcgcacggaaacacagcccucaccuacgcucgccaggccucuucccaagagugcauuaauguucugcugcaguauggcuguccugauaaaugcguguga

SEQ ID NO: 65619 - RNA, 3201 nt, Artificial Sequence
  derived and/or modified sequence opt5 from AGBL1__Homo_sapiens__NP_689549
augaucagcaagggcggguccgaggcccugcuccagacccugguggacacagcuagaacggcucccccugauuacgacauucuucugccccucuuccggcugcuugcgaaagucggacugcgcgauaagaaaaucggcagaaaggcucucgaacuggaggcccuggacguuacccucauucuggcccggaaaaaccuuucucacgggcaaaaucugcuccauugccugugggcucugcgcguguuugccagcuccgugucuaugggagcuaugcugggcaucaacggggccauggaacuccuguucaaggucauuacacccuauaccagaaagcggacacaggcgauccgcgccgcuaccgaggugcuggccgcucuccugaaaagcaaguccaauggaagacgggccguuaaccgcggcuacgugacaucucuucugggccuccaccaggauuggcauagccacgacaccgcgaaugccuauguccagaucagacgggggcugcuucugugucuccgccauauugcugcccugagauccggacgggaagccuuucuggccgcccaaggcauggagauccucuucagcacgacccagaacugccuggaugacaaaucuauggagccugugauuuccguugugcuucagauccugcgccaguguuaccccacaagcccucucccccuggucaccgcuucuuccgcguaugccuuuccugugccggggugcauuacaaccgaacccccucacgaucuucccgaggaagacuucgaggaugacggagaugacgagguggacaaggauagcgacacggaagauggcaaagucgaggacgaugaccuggaaacagauguuaauaagcucucuuccaagccugggcuggacagacccgaggaggagcugaugcaauacgaggugaugugucucgaacugagcuauuccuuugaggaacuucagucuaaacugggagaugaccucaacagcgagaagacccaguacgcuaaucaccaucacaucccggccgccgcuuccagcaaacagcauugcuacucuaaggaucaauccagcuguggccaggaacgggaguaugccgugcagacaucucugcugugcagagucaaaaccggccgcagcaccgugcaccuuggguccaagaaaaacccuggaguuaaucucuaccaaaacgugcagucuaauagccugcggagagacuccagcgagucugaaauucccgacauccaggcguccccuaaggcugaugccugggacgucgaugccaucuucuguccccgcaugagcgcuucuuuuuccaacagcacacggacgagagaggugguuaaggugauugacaaacugcuccagacccaccugaagcgcguccccuuccaugauccuuaucuuuacauggccaaagcucggagaacauccucuguggucgacuuuaagaugauggccuucccggauguguggggccacugcccgccucccaccacacaaccuaugcuggaacgcaaaugugggguucagcggaucagaauuuuugaggacauccgccggcucauucagcccagcgaugugaucaauaaggucguguucucccuggacgaaccguggccucugcaggauaacgcgucuaacugccuuagauucuuuagcaaguucgaguccggaaaucuccggaaagccauccaaguucgcgaguuugaauaugaccugcuggugaacgcugaugucaauagcacccagcaucagcagugguucuacuuuaaggugucuggcaugcaagccgcuauucccuaucacuucaacaucauuaauugcgagaaaccuaacucccaguuuaauuacgggaugcagcccacgcucuacagcgugaaggaagcccugcuuggaaaaccuacauggaucagaaccggccaugagauuuguuauuacaagaaccacuaucggcagucuaccgcgguugccggcggggcuuccggaaagugcuacuauacacugaccuucgccgucacauuuccccacagcgaggacguguguuaccucgcuuaucauuacccguacacguauaccgcccugaugacacaccuggacauccuugaaaaaucugugaaucucaaggaggucuacuucagacaagaugugcugugccagacccugggcgggaacccuuguccccucguuacaaucaccgccaugcccgaaagcaauuccgacgagcaucuggaacaguuucgccaccggccuuaucaagugauuacggcuagaguccacccgggagagagcaacgcgucuugggugaugaaaggcacccuugaguuccugguuuccagcgaucccguggcccgccuccugagagaaaauuuuaucuucaagauuaucccuaugcugaaccccgacggggucauuaauggcaaccaucggugcucccuuucuggagaggaucucaaccgccaguggcugagcccuuccgcucaucugcagcccacaaucuaccacgccaaaggccuccuguaucaccuuucuagcauugggagauccccugugguuuucugugacuuucauggacacucucagaagaagaauguguuccuguacggcugcagcaucaaagaaacccucuggcaagccgcuuguacagucgggaccuccacgauccuggaggaagugaacuaucggacacugcccaagauucuugauaaacuggccccggcguuuaccaugagcucuugcuccuuccucguggaaaagagccgcgcuucuacagccagagucguuguguggcgggagaugggagugucccgcagcuacaccauggaaucuuccuacuguggcugcaaucaggggccuuaucagugcacccagagacugcucgagcggacgaaaaacgaacgcgcccaccccgucgacggccugcaaggacuucaguuuggcacaagagagcuggaagagaugggggcuauguucugucucggacugcugauccuugagcuuaagagcgccuccugcagccaucagcuccuggcgcaggcugccacccuccugucugccgaagaggaugcucuugaccaacaucugcagcggcucaaaagcuccaauuuucugccuaagcacauuugguucgccuaccacuuuuucgcuaucacaaacuuuuucaagaugaaucugcuucugcaugugucucccguuugugauaccuga

SEQ ID NO: 65620 - RNA, 2709 nt, Artificial Sequence
  derived and/or modified sequence opt5 from AGBL2__Homo_sapiens__NP_079059
auguuccccgcccuggagacccaccucaagcagacaaucccugacccguacgaagauuuuauguauagacaucugcaauacuauggcuacuucaaagcucagcgggggagccuucccaacuccgccacgcaccagcaugugcgcaagaauaacccucagugccugcucaauggaucucugggcgagaaagacgaucuuauucccgacacccugcaaaaggaaaaacuccuguggccuaucagccuguccucugcgguccacagacagauugaggcuaucaaccgggauuuucauagcugucucggguggaugcaguggcgcggacuguccucucuucagcccccuccgcccagauucaaggacagcccugccuccgccuuucggguugcuggcauuacagauagccacaugcugucucucccccaucugcgcuccagacaacuucuguaugacgaacucgaugaggugaauccucggcugcgcgagccccaggaacuguucagcauccucucuaccaagagaccgcugcaggccccucgguggcccaucgagugcgaagugauuaaagagaacauccaccacauugagugggcuccuccccagcccgaauacuuuuaucaaccuaaggggaaugagaaagucccggaaaucgugggagagaagaaaggcacaguuguguaccagcuugacuccguccccauugaaggcagcuacuucaccucuucccgcguugggggaaagagaggcaucgugaaggagcuggccgugacacuccaggggccugaggauaacacccugcuuuuugaaagccgguucgaguccggaaaucugcaaaaagcgguccgcguggacacguaugaauacgagcucacccugagaacagaucuguauaccaacaagcauacacagugguuuuacuuccgggugcagaauaccagaaaagacgccacguaucgcuuuacaauugucaaccuccugaagcccaaaucucuuuacaccguuggcaugaagccucugcucuauagccagcuggacgcuaauacacggaacaucggguggagacgcgaaggaaaugagaucaaauacuacaagaacaacaccgaugacggccaacagcccuucuauugucuuaccuggacaauucaguucccguacgaucaggacacgugcuuuuucgcccacuuuuauccuuacaccuauacagaucugcaauguuaccuccuguccguggcuaauaaccccauccagagccaguucugcaagcugcagacccucugucggucucuggccggcaauacaguguaucuucugaccauuacgaacccuucccaaacaccccaggaggcggccgcuaaaaaggccgucgugcucagcgcuagaguucacccuggggaaucuaauggaagcugggugaugaaaggcuuucuggacuucauccuguccaacucucccgaugcccagcuucuccgcgacauuuuugucuucaaggugcugccgaugcugaauccugaugggguuaucgugggaaacuaccggugcagccucgccggcagagaccugaaucgccauuacaaaaccauccuuaaggaguccuuucccuguauuugguauacccggaacaugaucaagagacugcucgaggaacgcgaaguccugcuguacugcgauuuccacgggcauagccggaaaaauaacauuuuucuuuauggauguaauaacaauaacagaaaguacuggcuccacgagcggguguucccccugaugcugugcaaaaacgcuccugacaaguuuucuuuccauuccugcaauuucaaaguccagaaguguaaggagggcacaggccgcgugguuauguggagaauggggauccucaacagcuauaccauggaaucuacauuuggaggcuccacgcuggggaauaaacgggacacccacuucacaauugaggaucuuaagagccugggauaccacgugugcgacacccuccuggauuuuugugacccggaucaaaugaaauucacacagugccuggcggaacuuaaggagcuccugagacaggagauccauaaaaaguuucacgaacugggccaagacgucgaucucgagggguccuggucugacaucagccuguccgauauugaaucuagcaccuccggcagcgacucuucccuuagcgauggacugcccgugcaucucgccaacaucgcugacgagcugacgcagaagaaaaagauguucaaaaagaaaaagaaaaagucucugcagacccgcaagcagcggaaugaacaauaucagaaaaagaaccuuaugcagaaacucaagcugacagaggauaccuccgagaaagccggcuuugccagcacacugcagaagcaaccuaccuucuuuaaaaauucugaaaacagcuccuuccuccccaugaagaaugagaacccuagacugaaugaaacgaaccuuaaucgcagagacaaggacacaccccuggauccuagcauggcuacccucauucugcccaaaaacaaggggcggaugcagaauaaaaagccgggauuuacaguuucuuguuccccuaagcgcaccaucaacagcucccaggagcccgccccuggcaugaaacccaacuggccgagaucucgguacccugcgaccaagcgcgggugcgcugccauggccgcuuaccccagccugcacauuuauacauacccuuga

SEQ ID NO: 65621 - RNA, 2763 nt, Artificial Sequence
  derived and/or modified sequence opt5 from AGBL3__Homo_sapiens__NP_848658
augagcgaggacuccgaaaaggaggauuacucugacagaaccaucagcgaugaagacgaguccgaugaagacauguucaugaaauuugugucugaggaucugcaccggugcgcccuccugacagcugacagcuucggcgaucccuuuuucccucgcacgacccagauucuucuggaguaucaacucgggagaugggucccgcggcugcgcgaacccagagaccuuuacggaguuuccucuagcggcccucugucccccacacgguggccuuaucauugugaggugaucgaugaaaaggugcagcacauugacuggacccccagcugcccugagccggucuacauccccacagggcucgagaccgaaccucuguaucccgauucuaaagaggccacagugguuuaccuggcggaagacgcuuauaaggagccuuguuuuguguacucccgcgucggaggcaacagaacaccccucaaacagccgguggacuaccgggauaauacgcugauguucgaagcccgcuuugagagcgggaaccuucagaagguugugaaggucgccgaguaugaauaccaacugaccgugagaccugaccucuucacaaauaaacauacccagugguauuacuuucaggugacaaacaugcgggcuggaauugucuaucgcuucaccaucguuaauuuuacgaagcccgccucucuguacuccagaggcaugcggccucuuuucuauagcgagaaagaagcuaaggcccaccauaucggcuggcagcgcauuggggaucaaaucaaauacuacagaaacaaucccggacaggacggccggcacuauuuuucucugacauggaccuuccaguucccccacaacaaggauacaugcuacuuugcgcauuguuauccuuacaccuauaccaaucuccaggaguaccuguccgggauuaacaaugacccggugagaagcaaguucugcaaaauccgcgugcugugucacacacucgcccggaacauggucuauauucugacgaucaccacaccccuuaaaaauuccgauucuagaaaacgcaaggcugugauucugaccgcccggguucauccuggagaaacaaacagcuccuggaucaugaaaggcuuucucgacuacauccuggggaauagcucugaugcucaacuucugagagacaccuucguguuuaaggucgugcccaugcucaacccugauggaguuauugugggcaacuaccgcugcucccuggccggccgggaccugaauagaaacuauacgagccuccugaaagagucuuuccccagcgucugguacacacgcaauauggugcaccggcuuauggagaagagagaagucauccuguauugugaccuccacgggcauucccgcaaggagaacauuuuuauguacggaugcgauggcucugaccggagcaaaacccuguaucuucagcagagaaucuucccgcugaugcucuccaagaauuguccugauaaauuuagcuucucugcgugcaaguuuaacgugcaaaaauccaaggaagggaccggacggguugugauguggaagaugggcauucgcaauagcuucacaauggaggccaccuuuugcgggucuacacugggaaacaaaagaggcacgcacuucuccaccaaggaccuggaaagcaugggcuaccauuucugugauucccuccuggacuauugcgaucccgaccggacaaaauacuacagaugucuuaaggagcuggaggaaauggagcgccacaucacccucgaaaaagucuuugaggauucugacacaccugugaucgauauuacccuggacguugagagcuccucucgggggagcgauuccagcgaaucuaucgacucccugacguaucuucucaagcugaccagccagaagaaacaucugaagacaaagaaggagagaaauucuaccauugcuucccaccagaacgcccgcggacaggaaguguacgacagaggccaccuccugcaacggcauacacagagcaauucugaugucaaagacacccgccccaacgagccugaugacuauaugguggauuacuucagacggcagcuucccaaucaggggcuggaccuccaccauaaccuuaagagcaagaucaaagaaugcauuuccuuucaaagcaagaaaacgggaaucaauuggacagaugacgagaagcgcucuuauaaagauaagggcaucgugcagacccaggagauucugcaguaccugcucccgaucguucacuccaccaaaaacaugcaaaccacccagauuaagcagcuguucaacccuagaacaaauuuucagauccaacaccagcugaaccccgcuacgugucggaauauuaagaaauauagcaccuccuggacagcuccccgcaaccauccuuucgucauccagggggacgugauggccaauucuagcgaaugggugcaauccaagccgcacagaucucucgagagccugagcccccuuaaaggcccuaagaaaaacaagcauucucagauuugggccaucaagaaugaagauaucaaaccccugagcuccaagugggagaccgcguccucuuccuuuggaauggacgccaacguccucaaauacaagagccugcaggcugaagagacaaaucagcaaucuuccaaacacaccgcccugcaucuuacgaagaacaaggaugagcaggccaauaaaaacgacggccagccuacacucuaccugaaguuccagcgggaaagcuga

SEQ ID NO: 65622 - RNA, 1521 nt, Artificial Sequence
  derived and/or modified sequence opt5 from AGBL4__Homo_sapiens__XP_011540611
auggccgagggcagccaguccgcucccgaagccgggaacgacaugggaaaugaugacgcgaucggcgggaacgugucuaaguacauuguccugccuaccggauauugcggccaaccgaaaaaggggcaccucaucuucgaugcuuguuuugagagcggaaaucugggcagaguugaccagguguccgaguucgaguacgaucuuuuuauucggcccgacacaugcaacccucgcuucagagugugguuuaauuucacggucgaaaacgugaaagagucucagguucgggagaucguggauaccuuucgcgucgugcugagaguuauuuucaauaucgugaacuuuagcaagacaaaaucccucuaucgggacggcauggcccccauggucaagucuaccagccgcccuaaguggcagagacugcccccuaaaaauguguacuauuaccgguguccggaucaucgcaagaacuaugugauguccuucgccuuuugcuucgacagagaagaggauaucuaccaauuugcuuacuguuaucccuacacauauacccgguuccagcacuaccuugacagccugcagaaacgcaauauggauuauuucuuuagagaacagcucgggcaaucuguccagcagcggaagcuggaccugcucacaauuaccuccccugacaaccugcgcgagggagccgagcagaaaguuguguucaucacgggcagagugcaucccggggaaaccccuagcucuuuugucugccaaggaauuaucgauuuccuugugucccagcaccccauugcuuguguucugcgggaguaccucguguuuaagaucgccccgaugcugaauccugacggcgucuaucuugggaacuacagaugcagccugaugggauucgaucucaaucgccauuggcuggaccccucuccuugggugcaccccacacugcacggcguuaagcagcucauugugcaaauguacaacgaucccaaaaccucccuggaauuuuauaucgacauccaugcgcacagcacaaugaugaacggcuucauguacgggaauauuuuugaggaugaagaacgguuccagagacaggccaucuuuccuaaacuucugugucagaacgcugaggacuucuccuauucuagcaccuccuuuaaucgcgaugccgucaaggcuggaacgggccggagauuccucgggggacugcuugaccauacaagcuacugcuauacccuggaagugucuuucuacuccuauauuaucagcggcacaaccgccgcggucccguacaccgaggaagccuacaugaagcucgggcgcaacguggcucggacauuucuggauuauuacagacugaaucccguuguggagaaagucgccauuccuaugccccgccuccggaaggaaaaaucuccucccuauaagcacccgcugcuuagaggaccugcuagcaacuaccccaauuccaagggcgacaaaaagucuagcgugaaccacaaagacccuuccacgcccuucuga

SEQ ID NO: 65623 - RNA, 1215 nt, Artificial Sequence
  derived and/or modified sequence opt5 from AGER__Homo_sapiens__NP_001127
auggccgcuggcaccgccgugggggcguggguccugguucucagccuguggggagcuguggugggcgcccagaacaucacagccagaauuggggagccccuuguccugaagugcaaaggagcuccuaagaaaccgccccaacggcucgaauggaagcugaauacgggccgcaccgaggccuggaaagugcuuuccccucaagggggaggccccugggacucuguugcuagagugcugccuaacggcagccucuuccugcccgccgucgggauccaggaugaaggaauuuuucggugucaggcgaugaaucgcaacggcaaggagacaaaguccaauuacagagugcggguuuaucagaucccugggaaaccggaaauuguggacucugccagcgagcugaccgcuggaguccccaacaaggugggcacaugcguguccgaggggucuuacccugccggaacccucagcuggcaccuggauggcaaaccccuugucccuaaugaaaagggcguuuccgugaaagagcagacacgcagacaucccgaaaccgggcuguucacgcuccagagcgagcugauggugaccccggcucggggaggcgacccucgccccacauuuucuuguuccuucagcccugggcuucccagacaccgggcccugcgcaccgcgcccauccagccuagagucugggagccggugccccucgaagagguucaacugguggucgaaccugagggaggcgccguggcucccgggggaacaguuacccugacgugcgaagugccugcccagcccucuccgcagauccauuggaugaaggauggcgucccucucccccugccucccuccccugugcuuauucugcccgagaucggcccgcaggaccaagggacauauagcugugucgcuacccacucuucccauggaccucaggagagccgggccguguccauuucuaucauugaacccggcgaggaagggcccacagccggaagcguuggcggguccggccucggaacccuggcucuugcgcugggcauccucgggggacugggcaccgccgcucugcucauuggggugauccuguggcagcgcagacaacggagaggagaggaacgcaaggccccugagaaccaggaggaagaggaggaacgggccgaacuuaaucagagcgaggagccggaagcuggcgagucuuccacagggggccccuga

SEQ ID NO: 65624 - RNA, 1755 nt, Artificial Sequence
  derived and/or modified sequence opt5 from AGFG1__Homo_sapiens__NP_001128659
auggccgcuagcgccaagagaaaacaggaggaaaagcaccugaaaaugcuccgggacaugaccggccugccccauaaccgcaagugcuucgauugugaccaaagagggccuacauacgugaauaugacggucggauccuuuguuugcaccucuuguagcggcucccuucgggggcugaacccgccccaccgcgugaaaucuaucagcaugacaaccuucacacagcaggagauugaauuucuccagaagcauggaaaugaggugugcaagcaaaucuggcugggccuuuucgaugacagauccucugcgauuccugauuuucgggacccccagaaagucaaggaguuccugcaggaaaaauaugagaagaaacgcugguacgugccucccgaacaggcuaagguuguggccagcguccacgccuccaucagcgggucuuccgcuagcucuaccuccagcacaccugaggugaagccgcucaaaucucugcugggagauuccgcccccacccuccaucugaacaagggcacgccuagccaaucccccguugugggcagaucucaggggcagcagcaagagaaaaagcaguuugaccuucugagcgaucucggauccgacauuuucgcugccccugcgccccagagcaccgccacagcuaauuuugccaacuucgcucacuuuaauucucacgccgcgcaaaacuccgccaaugcugauuucgccaacuuugacgcuuucggccagagcucugggagcuccaauuucggaggcuuuccgaccgccucucauagcccuuuccagccccagacaaccgccuuucggaugcuguccagcucuuguuccuucggggaauuuacgagcgcuuucccucuucaagcgacacacucuggauccgccgcuagcgucaacgccaauuuugcccauuucgauaacuuucccaaauccucuagcgcugacuucggcaccuuuaauacaucccagucucaccagaccgccagcgcgguguccaaggugagcaccaacaaagcuggccugcagacagccgacaaguaugccgcucucgccaaccuggauaauaucuucucugcugggcaaggaggcgaccagggguccggauuuggcacgaccgggaaggcccccgucggaagcguugugucugugccuucccagagcucugcgagcuccgauaaauacgccgcucuggccgagcucgacagcgucuucucuuccgcugccacaagcuccaacgcguauaccucuacaagcaaugccuccucuaacguguucggcaccguuccgguggucgcuagcgcccagacgcaacccgcuuccucuagcgugccugcccccuuuggcgccacaccuuccaccaaucccuucguugcugcggccgggccgagcguggcuucuuccaccaacccuuuucagacaaaugcccgcggagccaccgcugccacauucggcacggcgagcaugucuaugcccaccggguuuggaacacccgcuccuuacucccugccuaccagcuucucuggcuccuuucagcagcccgccuucccggcccaagcugccuuuccucagcagacagcguucagccaacagcccaacggguuugcugccuucggccagaccaagcccgucgugacgccuuuuggacaggucgccgcugccggcguguccagcaauccguucaugaccggggcucccacaggacaauucccuaccggcucuagcuccacaaaccccuuucuuuga

SEQ ID NO: 65625 - RNA, 1446 nt, Artificial Sequence
  derived and/or modified sequence opt5 from AGFG2__Homo_sapiens__NP_006067
auggugauggccgcuaagaaaggccccgggccuggaggcggggucagcggaggcaaggccgaggcggaagcugccuccgagguuuggugcagacgggugcgcgaacucgggggauguucucaggccggcaacagacacugcuucgagugugcucaacggggcgugaccuacgucgacaucacaguggggagcuuuguuugcacgaccuguuccggacugcugcgcggccuuaauccgccccauagagugaaaucuauuagcaugacaaccuucacagaaccugaggucguguuucugcagucccgggggaacgagguuugccgcaagaucuggcucggacuguucgaugccagaaccucucuugugcccgacagccgggauccucagaaagucaaggaauuucugcaggagaaguaugagaaaaagcgcugguacgugcccccugaccaagugaaaggcccgacauauaccaagggguccgcuagcacgcccguccagggaucuauuccugaaggcaaaccccucagaacccugcugggcgauccugcccccucccucagcguugcggccucuacauccagccagccggugucucagucccacgcucggaccagccaagcccgcuccacacagccucccccucauucuagcgugaagaaggcuuccaccgaccugcuugccgauaucgggggagaccccuucgcggcuccccagauggccccugccuuugcugccuucccggccuuuggcgggcagacgcccagccaaggaggcuucgcuaauuuugaugcguucucuuccgggccuagcucuagcgucuuuggaucccugcccccugccggccaggcuucuuuccaggcccaacccacaccggccggcagcucccaggggaccccuuucggagcuacaccccucgccccugcgagccagcccaacucucuggcugacgugggcuccuuucuugggccuggaguucccgccgccggcgugccgagcucucuguucgggauggcuggccaggucccuccccuccaauccgugaccaugggaggcgggggaggcagcuccaccgggcuggccuuuggagcuuucacaaaucccuuuacggccccugcggcccagucuccgcugcccagcaccaacccuuuccagcccaauggccucgcuccugggcccggcuuuggaauguccucugccggcccuggguucccccaggcuguuccgccuacaggagccuuugcgagcuccuuccccgccccucuguuucccccgcaaaccccucuugugcagcagcagaacggcagcucuuucggggaucugggauccgcuaaacucggccaaagaccccugagccagccugccgggauuucuacaaaucccuuuaugaccggccccuccagcucuccuuucgcuagcaagccgcccacgacaaacccuuuccuuuga

SEQ ID NO: 65626 - RNA, 2145 nt, Artificial Sequence
  derived and/or modified sequence opt5 from AGGF1__Homo_sapiens__NP_060516
auggccagcgaggcucccuccccuccgagaucucccccucccccuaccagccccgaaccugagcuggcccagcuccggcgcaagguggaaaaacuggagagagaacuucgguccugcaagcgccaagucagagagaucgagaaacugcuccaccauacagaacggcuguaccagaacgcggagucuaauaaccaggaacuucgcacgcagguugaggagcugagcaagauucuccaaagaggccggaaugaagacaacaaaaaguccgauguggaggugcagaccgaaaaucacgcuccguggucuaucagcgacuauuucuaccagacauauuacaacgaugucucccugcccaauaaggugaccgagcugagcgaccagcaagaucaggccauugaaacaucuauccucaacuccaaagaccaucugcagguugagaaugaugccuauccugggaccgaccgcacagagaacgugaaguacagacaggucgaucacuuugcuagcaauucucaagaacccgccuccgcucuugccaccgaggacacgagccuggaaggaucuucccucgcggagagccugcgggccgcugccgaagcugccgugucccagaccggcuucucuuaugaugagaacacagggcuuuacuuugaccauagcaccggauucuacuaugauuccgagaaucagcuguacuaugacccuagcacaggcauuuacuauuacugugacguugaaucugggcgcuaucaauuucacuccagaguggaucuccagcccuacccgaccagcucuacgaaacagagcaaggacaaaaagcugaagaaaaagcggaaagauccugacuccucugcgacaaacgaggaaaaggaucugaauagcgaggaccagaaagccuucuccgucgaacacaccagcugcaacgaggaggaaaacuuugcuaauaugaagaaaaaggccaagaucggaauccaucacaaaaacucucccccuaaggugacagugcccaccuccggcaauaccauugagagcccccuccaugaaaacaucucuaauuccacgagcuucaaagaugagaagauuauggagacagacuccgaaccugaggaaggcgagaucaccgauucucaaacagaagacagcuacgaugaggcuauuaccuccgaggggaacgucacagccgaagacucugaggacgaagaugaggacaaaaucuggccgcccuguauucgcguuaucgugaucagaagcccugugcugcagauuggaucccuuuuuaucauuaccgccgucaaucccgcuacgaucggccgggaaaaggauauggagcacacacugcgcauuccugagguggggguuagcaaguuccacgcggaaaucuauuuugaccaugaucuccagucuuacgugcuggucgaccagggaucccaaaacggcaccaucgugaaugggaaacagauucuucagcccaagaccaaaugcgauccguauguucuggagcacggagacgaagugaagaucggcgagacaguccucagcuuccauauucacccuggcucugauaccugugacgggugcgaacccggacaggugagagcccaucugcggcuggauaaaaaggacgaguccuuugucggcccuacacucagcaaggaggaaaaagagcuggaaagacgcaaggagcuuaaaaagauccgggugaaauacgggcugcaaaacacggaguaugaagaugagaagacccucaagaaucccaaauacaaggacagagcuggaaaacgccgggaacagguuggcucugaggggacauuccagagagacgaugccccugccagcgugcacuccgaaauuaccgacagcaacaagggacgcaaaaugcuggagaagaugggcuggaaaaagggcgaggggcuuggaaaggauggcgggggaaugaaaacacccauccagcugcaacuccggagaacccacgcuggccuggggacgggcaagccgucuuccuucgaagacguccaucugcuccagaauaaaaacaagaaaaauugggauaaggcccgcgagcgguuuaccgaaaacuucccugagacaaagccccagaaagacgaucccggaaccaugccuugggugaagggcacacuggaauga

SEQ ID NO: 65627 - RNA, 1053 nt, Artificial Sequence
  derived and/or modified sequence opt5 from AGK__Homo_sapiens__XP_005250080
augaccguguucuuuaagacacugagaaaccacuggaaaaagacgaccgccggccucugccugcuuacauggggaggacauuggcuguacggcaaacacugugacaaucuccugcggcgcgcugccugccaggaggcgcaagucuucgggaaccagcuuauucccccuaaugcucagguuaagaaagccaccguguuucugaacccggccgcuuguaagggaaaggccagaacacucuucgagaaaaaugcugcccccauccugcaucugagcggcauggaugugaccaucgucaagacagacuaugaagggcaggcgaaaaagcuccuggaacuuauggagaacaccgaugugauuaucguugccggaggcgacggcacgcugcaagaaguggucaccggggugcuccggcgcacagaugaggcuaccuuuuccaaaauuccuaucggauucaucccccugggcgagacaucuagccuuucccacacccuguuugccgaaucugggaauaagguucagcauauuacggacgcuacacucgccaucgugaagggagagaccgucccucuggaugugcugcagauuaaaggcgaaaaggagcagcccguguucgcgaugacagggcucagaugggggagcuuucgggacgccggcgucaaaguuuccaaguacugguaucugggcccucuuaaaaucaaggcugcccacuucuuuucuacccugaaagaguggccgcaaacccaccaggcuagcauuuccuacacagggcccacggaacgcccucccaacgagccugaagagacccccgugcagagaccgagccucuaucggcgcauccugagacggcuugccucuuacugggcccagccucaagaugcucugucccaggaagugagccccgaggucuggaaggacgugcagcucucuacaauugagcuguccaucaccacacgcaauaaccaacuggauccuaccagcaaggaagacuuccucaauaucugcauugagcccgauacgaucucuaaaggagacuuuauuacaaucggcaaguga

SEQ ID NO: 65628 - RNA, 1338 nt, Artificial Sequence
  derived and/or modified sequence opt5 from AGMO__Homo_sapiens__NP_001004320
augaagaaccccgaggcccagcaagacgugagcgucucccagggguucagaaugcuguuuuacaccaugaaaccuucugaaacaucuuuccagacgcucgaggaaguuccggauuaugugaagaaagcuacccccuuuuucaucucccugaugcuucuggagcucguggucucuuggauucugaaggggaaaccucccggacggcuugacgaugcccugacaagcaucuccgcgggcgugcucucucgccugccuagccuguuuuucagauccauugaacucaccagcuacaucuauauuugggagaauuaccggcuguuuaaccuucccugggacucuccuuggacaugguauuccgcuuuccuggggguugauuuuggauacuauugguuccaccgcauggcccaugaggugaauaucaugugggccggccaccagacccaucacagcucugaagacuacaaccucuccacagcucugagacaaagcguccuucagaucuacaccucuuggaucuuuuauuccccgcuggcccucuucauucccccuagcguguacgcuguucaucugcaguuuaaucugcucuaucaguucuggauucacacggaggugaucaacaaucuggggccccuugaacugauucucaacaccccuucccaccaucggguccaccauggacgcaauagauacugcaucgauaagaacuaugccggcgugcugauuaucugggacaagaucuucggcacauuugaggcggagaaugaaaaaguggucuacgggcuuacccaccccauuaacacauucgagccgaucaagguucaauuucaccaucuguucucuauuuggaccacguuuugggccacaccuggauucuuuaauaaauucagcgugaucuuuaagggccccggguggggaccuggcaaaccccggcucgggcuguccgaagagauucccgaagugaccggaaaggaggucccuuucagcagcuccagcucucagcugcucaagaucuauacagugguucaguuugcucugaugcuugccuucuacgaggaaaccuuugcugauaccgccgcgcugagccaggugacacuccugcuucgcgucuguuucaucauucugacgcucaccuccaucggcuuccugcuggaccaaagaccgaaagccgcuauuauggagacacuccggugccugauguuucuuaugcuguaccgcuucggccaccucaagccccuggugccuucucugagcuccgccuuugaaaucguuuucagcauuuguaucgcuuuuuggggcgugagaucuaugaaacagcuuaccucccaucccuggaaguga

SEQ ID NO: 65629 - RNA, 2478 nt, Artificial Sequence
  derived and/or modified sequence opt5 from AGO2__Homo_sapiens__NP_001158095
auguacagcggcgccgggcccgcucuggccccuccggcgcccccucccccuauccagggauaugcuuucaagcccccuccgagacccgacuuuggcaccuccgggcggacaauuaaacuccaagccaacuucuuugagauggauaucccuaagauugacaucuaccacuaugaacuggauauuaaacccgagaagugcccucgcagagugaaucgggaaaucgucgagcauaugguucagcacuucaaaacgcagaucuuuggagaccgcaagcccguguucgauggcagaaagaaccuuuacaccgccaugccgcugccuauugggcgggacaaaguggaacucgaggucacacugcccggagagggcaaggaucgcaucuuuaaagugucuauuaaguggguuagcugugugucccuucaggcucugcaugacgcccucucuggcagacugccuagcguccccuucgaaaccauccaagcucuggaugugguuaugcggcaccuccccuccaugcgcuauacaccuguggggagaucuuucuuuaccgccagcgagggaugcuccaauccgcugggcgggggacgggaagucugguuuggcuuccaucagagcgugcgccccucucuuuggaaaaugaugcugaacauugacguguccgcgacagccuuuuacaaggcucagccugucaucgaguucguuugugaggugcucgauuucaagagcauugaggaacagcaaaaaccccugaccgacucucagagagugaaguuuacgaaagaaaucaaggggcuuaaagucgagaucacccacugcggacagaugaagcggaaauaucgcguguguaauguuacaagacggccugccucccaccagaccuucccccugcaacaggaaagcggccagacaguggagugcaccgucgcucaauacuuuaaggauagacauaagcucgugcugcgcuacccgcaucugccuugucuccagguuggccaggagcagaaacacacguaucugccccuugaagugugcaacauugucgccgggcaacgguguaucaagaaacugacagacaaucagaccucuacaaugauuagagcgaccgcccgcuccgcuccugaccggcaggaggaaaucagcaagcucaugagauccgccucuuucaacaccgaucccuacgugcgcgaguuuggaauuauggucaaagacgaaaugacagaugugacgggccggguucugcagccucccagcauccuuuaugggggaagaaauaaggcuaucgccaccccggugcaaggcgucugggacaugcgcaacaagcaguuccacacagggauugagaucaaagugugggccauugcuugcuuugcgccucagcggcaguguaccgagguucaccugaaguccuucacagaacaacucagaaaaaucagccgcgaugccggaaugcccauucagggccagcccugcuuuugcaaguacgcucagggcgccgacucuguggagccuauguuccggcaucugaaaaauaccuaugccgggcugcaacucgucguggugauccugccgggaaagacgcccguuuacgcugaagucaagagagugggcgauacagugcuugggauggccacccaguguguccagaugaaaaacgugcaacggaccacaccucagacccuguccaaucucugccugaagaucaacguuaaacuuggaggcgugaauaacauucugcucccccaggggcgcccucccgucuuucagcaaccugugaucuuccugggcgcggacguuacacaucccccggcuggagauggcaagaaaccuagcauugccgccguggucgggucuauggacgcucaccccaacagauauugugccacggugcggguucagcagcacagacaggagaucauucaagaucuggcugccauggugcgcgaacuccugauccaguuuuacaagagcacccgguucaagccuacaagaauuaucuucuaccgcgacggagucuccgagggccaguuucagcaagugcuucaucacgagcugcucgcgaucagagaagccugcauuaaacuggagaaggacuaucagcccgggaucaccuucauugugguccagaaacggcaccauacacgccuguuuuguaccgauaagaaugaaagaggaacgucucggccgagccacuaccauguucuuugggacgauaaccgcuucuccagcgacgagcuccaaauccugaccuaucagcugugccacacauacgugagauguacccggucuguguccauuccugcucccgccuauuacgcucaccucgucgccuuucgcgcgagauaucaucugguggauaaagagcacgacagcgccgaaggcucucauacauccgggcagagcaauggccgggaucaccaggcucuugccaaggcuguucaagugcaucaggacacccugcgcacgauguacuucgccuga

SEQ ID NO: 65630 - RNA, 864 nt, Artificial Sequence
  derived and/or modified sequence opt5 from AGPAT1__Homo_sapiens__XP_005248862
augguggcccggauggaccuguggcccggcgcuuggaugcuccugcuucuccuguuccugcuucugcucuuucugcugccuacccucugguucugcagcccguccgccaaguacuuuuucaaaauggcguuuuauaacggguggauccuguuccuugcuguccuggccauucccguuugugccgugcggggacgcaauguggagaacaugaagauccucagacugaugcuucugcacauuaaauaccucuauggcauccgggucgaagugcgcggggcucaucacuuuccucccucucagccuuacguuguggucagcaaucaucaauccucucuggaucugcucggaaugauggaggugcugcccggcagaugcguuccuauugccaagcgggaacuucugugggcugggagcgccggacucgcguguuggcuggccggcgugaucuucaucgaccgcaaaagaacaggcgaugcuauuuccgucaugucugagguggcccagacgcuucugacccaggacgugcgggucuggguuuuuccggaagggacacgcaaccacaauggaagcaugcuccccuucaagagaggcgcuuuucaucuggccgugcaggcgcaagugccuaucguccccauugugauguccagcuaucaggauuucuacugcaagaaagagcggcgcuuuaccucugggcagugucagguuagagugcugccucccgucccgacagagggacucaccccugacgaugugcccgcccuggcugaccggguucgccacuccaugcuuacaguguucagagaaaucagcaccgauggcagagggggaggcgacuaucugaagaaaccuggcgggggaggcuga

SEQ ID NO: 65631 - RNA, 741 nt, Artificial Sequence
  derived and/or modified sequence opt5 from AGPAT2__Homo_sapiens__NP_001012745
auggagcuguggcccugccucgccgcugcccugcuucugcuccugcuucuggugcagcucagcagagcggcugaguucuacgccaaggucgcccuguauugugcucugugcuuuaccguuuccgccguggcuucucucgugugucugcuucggcacggcgggcgcacagucgaaaacaugagcaucauuggaugguucgugagauccuuuaaauacuucuauggccugcgguuugaaguucgcgacccuagacggcuccaagaggcccgcccgugcgugaucgucucuaaucaucagagcauucuggauaugauggggcuuauggaagugcugcccgagagauguguucagaucgcgaagcgggagcuccuguuccugggaccugugggccucauuauguaccuugggggagucuuuuucaucaaccgccagagauccucuacggccaugaccgugauggcugaccugggcgaacggauggugcgcgagaauguccccaucguuccugugguguauagcuccuuuagcucuuucuacaacaccaaaaagaaauuuuucacauccggcacagucaccgugcaaguucuggaagccauucccacaagcgggcucaccgcugccgaugugccugcgcuggucgacacgugccacagagccaugcggaccacauuucuucauaucucuaagaccccgcaggagaauggagcuacagccggcuccggggugcagcccgcucaguga

SEQ ID NO: 65632 - RNA, 1131 nt, Artificial Sequence
  derived and/or modified sequence opt5 from AGPAT3__Homo_sapiens__XP_006724093
augggccugcucgccuuccugaagacccaguuugugcuucaucugcucgucggguucguuuuuguggugagcggacuggucaucaacuucgugcaacuuugcacacuggcucucuggcccguuuccaaacagcuguacagacggcugaauugucgccucgccuauucucuguggagccagcuugugaugcugcucgaguggugguccugcacggaauguacccuguuuacagaccaggcgaccgucgagagauucggcaaggaacacgcugugauuauccuuaaccacaauuuugagauugauuuccugugcggguggacaaugugugaacgguuuggaguucucggcucuagcaaagugcuggccaagaaagagcugcucuacgucccucugaucggguggaccugguauuuccuugagauuguguuuugcaagcgcaagugggaagaggacagagauacaguggucgaaggacugcggcgccucuccgacuacccggaguauaugugguuccugcuuuacugugagggcaccagauuuacggaaaccaaacaucggguuucuauggagguggccgcugccaagggccugcccgugcucaaauaucaucugcugccucgcacaaagggguucaccacagcugucaaaugccucagaggaaccguggccgcgguuuacgaugugacgcugaacuuccggggcaauaagaaccccagccuucuggggauccucuacggaaagaaauaugaagccgacauguguguccgcagauuuccucuggaggauaucccccuugacgaaaaggaggcugcccaauggcugcacaaacucuaccaggagaaggaugcucugcaggaaauuuauaaucagaaaggcauguucccuggggagcaauuuaagccggcccggcgccccuggacacugcucaacuuccuguccugggcgaccauccuucugagcccucucuuuucuuucgugcugggaguuuuugccuccggcagcccccugcuuauucucacauuccugggcuuugugggggcugccucuuucggagucagacggcugaucggcgugaccgaaauugagaaaggguccagcuacggaaaucaggaauuuaagaagaaagaguga

SEQ ID NO: 65633 - RNA, 1137 nt, Artificial Sequence
  derived and/or modified sequence opt5 from AGPAT4__Homo_sapiens__NP_064518
auggaccuggccggccuccuuaagagccaguuccuuugccaccugguguuuuguuacgucuucaucgcuuccgggcucauuaucaacaccauucaacuguuuacacuucugcucuggcccaucaauaaacagcuguucagaaagauuaacugccggcugucuuauuguaucagcucccagcucguuaugcugcuugagugguggucuggaacggaaugcaccaucuuuacagauccucgcgccuaccugaaauauggcaaggagaaugcgauuguggugcucaaccauaaauucgaaaucgacuuucuguguggguggagccuuuccgagagauucggacugcucggcgggucuaagguccuggcuaagaaagaacuggccuacgugccgauuaucggauggaugugguauuuuaccgagaugguuuucugcagccggaagugggagcaggaucgcaaaacaguggccaccucccuccaacaccugagagacuaccccgaaaaguacuuuuuccuuauucauugugagggcacacgguuuaccgaaaagaagcacgagaucagcaugcaggucgcucgcgccaagggccugccuagacucaaacaucaucugcuuccccggacgaagggguucgcuauuaccgugcgcucucugagaaauguuguguccgccgucuaugauugcacacucaacuuccggaauaacgagaauccuacccugcugggagugcucaacggcaaaaaguaccacgcggaccuguaugugcgcagaaucccccuugaagauaucccugaggacgaugacgaauguagcgccuggcugcacaaacucuaccaggagaaggaugcuuuucaggaagaguauuaccggacagggaccuucccggagacgcccauggucccuccccgcagaccuuggacacugguuaauuggcuguuuugggccucucuggugcucuaucccuucuuucaauuccugguguccaugauucggagcggaucuucccugacccucgcuagcuuuauccuggucuucuuuguggccuccguuggcgugagauggaugauuggggucacagaaaucgacaaaggaucugcguacggcaacagcgauuccaagcagaaacuuaaugacuga

SEQ ID NO: 65634 - RNA, 1305 nt, Artificial Sequence
  derived and/or modified sequence opt5 from AGPAT9__Homo_sapiens__NP_001243350
auggagggcgccgaacuggcugggaagauccucagcaccuggcugacacuugugcugggauucauucuccugcccuccgucuuuggcguuucucuugggaucagcgagauuuacaugaaaauccuggugaagacgcucgaaugggccaccauuagaaucgagaaaggaacaccuaaggaauccauccugaaaaacucugcgagcgugggcauuauccagcgggacgaguccccgauggagaaggggcugucuggacuccgcggcagagauuucgaacugagcgacgucuuuuauuucuccaagaaaggccuugaggcuauuguggaagaugagguuacccaacgguuuagcucugaggaacugguguccuggaaucuccugacacgcaccaacgucaauuuccaguacaucagccuuagacugacaaugguguggguucucggggugauuguccgguauugcgugcugcugccccuccgcgugacccuggccuuuaucggaauuucucuucuggucaucggcacgacccucguugggcagcugccugacuccagccuuaagaacuggcugucugagcucgugcaccugacauguugcagaaucugugugcgggcccuguccggaaccauucauuaccacaauaaacaguaucgcccccaaaagggcgggaucugcgucgcuaaccauacaagcccuauugaugugcucauccugaccacggacggauguuacgccaugguuggccaggugcacggcgggcuuaugggaauuauccagagagcuauggucaaagccugcccccaugugugguucgaacgguccgagaugaaggaucgccaccugguuacaaagagacucaaagaacacaucgcggacaagaaaaagcugccuauucuuaucuuuccggagggcaccuguauuaauaacacaucugugaugauguucaaaaaggggagcuuugagaucggaggcaccauucaucccgucgccaucaaauauaauccucaguucggggaugcuuuuuggaacuccagcaaguacaauauggugucuuaccugcuccggaugaugaccuccugggccaucgucugcgacgugugguauaugcccccuaugacacgcgaagagggagaagaugcuguucaauucgccaacagagucaagagcgcgauugccauccagggcggccugacggagcugcccugggacgggggacucaaacgggcuaaggugaaagauauuuucaaggaggaacagcagaaaaauuacucuaagaugaucgugggcaacgggagccuguccuga

SEQ ID NO: 65635 - RNA, 1977 nt, Artificial Sequence
  derived and/or modified sequence opt5 from AGPS__Homo_sapiens__NP_003650
auggccgaggcugccgcggcugccggcgggaccggacugggcgccggggcuagcuacggauccgccgcugacagagaucgggaccccgauccugaccgcgccggcagacggcuccgcgugcugucugggcaccuucugggaagaccgcgggaagcgcucagcacaaacgagugcaaggcccgcagagcugccuccgcugccacggcggcccccaccgcuaccccugccgcucaggaaucuggcaccauccccaaaaagcggcaagaggucaugaaauggaauggcuggggguauaacgauagcaaguucauuuuuaauaaaaagggacagaucgaacugacaggcaagcgcuacccucuuuccgggaugggacugcccaccuucaaagaguggauucagaacacacucggcguuaauguggagcauaagaccacgucuaaagccagccugaacccuuccgacaccccgcccagcguggucaaugaagauuuucugcacgaccucaaggagacaaacaucucuuauucccaggaagccgaugacagaguguuccgggcucaugggcacugucugcaugagauuuuucuucugcgcgagggaauguucgaaagaaucccugauaucguucucuggccuaccugccacgacgauguggucaaaauugugaaucuggcguguaaguacaaccuuugcaucauucccaucggcggcgggacaagcguuucuuauggacugaugugucccgccgacgagacccggacgauuaucucccucgacacaagccaaaugaaucgcauucuguggguggaugaaaacaaucugaccgcucacgucgaggccggcaucacagggcaggaacucgagagacagcugaaggagucuggauacugcaccggccaugaaccggacucccuugaguuuagcaccgucgggggauggguguccacacgggccucuggcaugaaaaagaacaucuauggcaauauugaagaucuggugguucacaucaaaauggugacgccuagagggauuaucgaaaagagcugucagggaccccgcauguccaccggcccugacauucaucacuucaucauggggagcgagggaacacucggcgugaucaccgaggcuacaauuaaaauccggcccguccccgaguaccaaaaguacgggucuguggccuuuccuaacuucgaacagggcguugcgugccugagagagauugcuaaacagcgcugugccccggccuccauccggcuuauggauaacaagcaguuucaauucggacacgcucugaagccccaggugagcucuauuuuuaccagcuuccucgacggccugaaaaaguucuauaucacgaaauuuaagggguucgauccuaaucagcuguccgucgccacacuccuguuugaaggagacagagagaaagugcuucaacaugaaaagcagguuuacgauaucgcugccaaguucggcgggcuggcggccggagaggacaacggccagcgcggguaucuccugaccuacgugauugcuuauauccgggaucuugcccuggaguacuauguccucggcgaaucuuuugagaccagcgcucccugggacagaguggucgaccugugccgcaaugugaaagaacggauuacaagagaguguaaggagaaaggaguucaguucgccccuuuuuccacaugccgcgugacacaaacguacgaugcgggcgccugcaucuacuucuauuuugcuuucaacuaccgggggauuagcgacccccugaccgucuuugaacagacagaggccgcugccagagaagagauccucgccaauggaggcucucugucccaccaucacggggugggaaaacuucggaagcaguggcugaaggaaagcauuucugauguuggcuucgggaugcucaaguccgugaaagaguaugucgacccgaacaauaucuuuggcaaccgcaaucugcuguga

SEQ ID NO: 65636 - RNA, 528 nt, Artificial Sequence
  derived and/or modified sequence opt5 from AGR2__Homo_sapiens__NP_006399
auggagaagauccccgugagcgccuuccugcuccuggucgcucuuuccuacacccuggccagagacacaacgguuaaaccuggcgcgaagaaagauaccaaggacucucggccgaaacucccccagacacugagccgcggguggggagaucaacuuauuuggacccagacauaugaagaggcucuguacaaguccaagaccucuaacaaaccucucaugaucauucaccaucuggacgaaugcccccacagccaggcccugaagaaaguguuugccgagaauaaggaaauccagaaacucgcugagcaauucgugcugcuuaaccuggucuaugagacaaccgauaagcaucucuccccugacggccaguacgugcccagaauuauguuuguugauccuucucugacggugcgggccgacaucaccgggcgcuauagcaauagacuuuacgcuuaugaaccggccgauacagcgcugcuccuggacaacaugaagaaagcccugaagcuccugaaaaccgagcuuuga

SEQ ID NO: 65637 - RNA, 501 nt, Artificial Sequence
  derived and/or modified sequence opt5 from AGR3__Homo_sapiens__NP_789783
augaugcugcacagcgcccucggccugugccuucugcucgugaccgucuccucuaaccuggcuaucgccauuaagaaagagaagagacccccucagacacuuagccggggguggggagacgauaucacguggguucaaaccuacgaagagggccuguucuaugcgcagaaauccaagaaaccgcucauggugauucaucaccuggaagacugucaguacucucaggcucugaagaagguguuugcccaaaaugaggaaauccaggagauggcccagaacaaauucauuaugcucaaucugaugcaugagacaaccgauaagaaccuuagccccgacgggcaguaugucccucgcaucauguuuguggaucccucccugacaguuagagcugacaucgccggacgguacucuaaucgccucuauaccuacgaaccuagagaucugccccuucugauugagaacaugaaaaaggcucuccggcugauccaaagcgaacuguga

SEQ ID NO: 65638 - RNA, 4416 nt, Artificial Sequence
  derived and/or modified sequence opt5 from AGRN__Homo_sapiens__XP_011539733
augcugcacgugcacgccugcacccaccagaucagccuccaugucgcuuccgccggccccugugagacaugcggggacgcgguuugugcuuucggagccgugugcucugccggccaaugugugugcccuagaugugaacacccgcccccugggcccgucugcggaagcgauggcgugacguacggguccgcuugugagcugcgggaagccgcuugccuucagcagacccagauugaggaagcccgcgcgggaccuugugagcaagccgagugcggcucuggcgggagcggauccggcgaagacggggauugcgagcaggaacuguguagacagcggggaggcaucugggacgaggauucugaggacgggcccugcguuugugauuuuagcugccaguccgugccuggaagcccggucuguggcucugacggcgugacauauuccaccgaaugcgagcucaagaaagcucgcugugaaagccaaagagggcuguacguugccgcucagggagccugccggggccccacauucgcgccucuucccccuguggcuccccugcauugugcccagaccccguaugggugcugucaggauaacauuacagccgcucgcggagucggccucgccgggugcccuucugccugccaauguaauccccacggauccuacggcgggaccugcgacccugcuacgggccaguguagcugcagacccggagugggcgggcugcggugugaucgcugcgagcccggauuuuggaacuucagaggcaucgugaccgacgggcggucuggcuguacaccuugcuccugugauccgcagggagcgguccgcgacgacugcgaacaaaugaccggccuguguagcugcaagcccgggguugccggaccuaaaugcggccagugucccgaugggagagcucucggaccugccggcugcgaggccgacgcuuccgcccccgcgacaugugcugagaugcggugcgaauuuggggcccgcuguguggaggaaucuggcagcgcccacugcguguguccgaugcugaccugcccugaggcuaaugccacgaaggucuguggauccgauggcgugacauaugggaacgaaugccagcuuaaaaccauugcuuguagacagggacugcaaaucagcauccagucucucggccccugccaggaggccguugcgccuuccacacaucccaccagcgccucugugaccgucacaacgccugggcugcuucugagccaggcucuccccgccccgccuggagcucugccccuggcccccuccucuaccgcgcacagccaaacaaccccuccgcccuccagccggccuagaacaaccgccucugugccccgcacgacaguuuggccugugcucaccgugcccccuaccgcucccuccccggccccuagccuggucgcuucugccuucggcgaguccgggagcacagacggcuccucugaugaggagcuuagcggagaccaggaagccuccggcgggggaucuggcgggcuggagccccucgaaggaagcuccgucgcuaccccugggcccccgguggagcgggcgagcugcuacaauucugcccugggcuguugcuccgauggcaagacaccuagccuugacgcugagggaucuaacugucccgccacgaagguuuuucagggcgugcuggaacucgagggggucgaaggacaggagcuguucuauaccccugagauggccgaucccaaauccgaacuguuuggcgagacagcuagaagcauugaaucuacccucgacgaucuguuccgcaauagcgacgugaagaaagacuuucgguccguuagacuucgcgaucuggggcccggaaagagcgugcgggccaucgucgacgugcauuucgauccuacaaccgcguuuagagcuccggacguggcccgcgcccuccugcggcaaauucagguuucuagacgccggucccuuggcgucagacggccccugcaggagcacgugcgcuucauggauuucgacugguuuccugcuuucaucacgggcgccaccagcggggcgauugcugccggagccacagcuagagccaccacagcuucccggcuccccucuagcgccgugaccccuagagcgccccacccuucccauacgucucagccggucgccaaaacaaccgcugcccccacaacccgccggccucccaccacagcuccuagcagagugcccggccgcagaccgccugcuccccaacagcccccuaagcccugcgauucccagccuuguuuucacgggggaacgugccaagacugggcccugggcgggggauucaccuguucuugcccggccggccggggcggggcgguuugugaaaaggugcugggagcccccgucccugcuuuugagggccgcagcuuccucgccuuucccacacugagagccuaccauacccuucggcuggcucucgaguuccgcgcccuggaaccucaggggcugcuucucuacaacggaaaugcgagaggcaaagauuuucuggcucuggcccuccuggacgggcgggugcagcuucgcuucgauacaggauccggccccgccguucugaccagcgcugugccggucgagccuggccaguggcacagacucgaacugucucggcauuggcgcagagggacgcuguccguggacggagagacacccguucuuggcgaaagcccuucugggaccgauggacucaaccuggacaccgaccuguuugugggcgggguccccgaggaucaagccgcgguggcucucgagcggacauucgugggagccggccugagaggcugcauccgccuucuggacgucaauaaccagcggcucgaacuggggauuggaccuggcgccgcuaccagaggguccggaguuggcgaguguggggaucaccccugccugccgaauccuugccacggaggcgcccccugucagaaccuugaagcuggccgcuuucauugccagugucccccugggcgggugggaccgacaugcgccgacgaaaagagccccugucaaccuaaucccugccacggcgcggccccuuguagagugcuccccgaagggggagcucagugcgaguguccucugggccgcgaggggacguucugccagaccgccucuggacaggauggcuccggcccguuccuggcugacuuuaacggguucagccaucucgaacugcggggacuucacacauuugccagagaucugggcgagaaaauggcccucgaagucguguuccuggcucgcgggcccuccggacugcuucucuauaacggccaaaagaccgacgggaaaggagauuuuguuagccuggcgcugcgggacagacggcucgaguuccgcuacgaucugggcaagggcgccgcugugaucagaucucgggagccugucacacuuggggccuggacccgcgugagccuggaaagaaauggacggaaaggcgcccucagaguuggggacggaccccgcgugcugggcgaguccccuaagucucggaaggucccccacacggugcugaaccuuaaagaaccgcuguauguugggggcgcuccugauuuuagcaagcucgccagagcggcugccguguccucuggauucgacggcgccauccagcuggucagccucgggggacgccagcugcuuacccccgagcaugugcugcggcaaguggacgucacauccuuugcuggccaccccuguaccagagccucugggcauccuugccucaauggagcgagcugcguuccccgcgaagccgcuuacgugugucugugcccuggcggguucuccggcccgcacugugagaaaggacugguggaaaagagcgccggcgaugucgacacacuugcuuuugaugggcggaccuucguggaguaucugaacgccguuacagagucugaaaaagcucuccaguccaaucauuuugagcugagccucagaaccgaagccacgcagggacuggugcuuuggucuggcaaggcgacagagcgcgccgacuacgucgcucuggccauuguggaugggcaccuccagcuguccuauaaccugggaagccaacccguugugcuuagauccaccgucccugugaauaccaaccgguggcugcgcgucguggcucacagagagcagcgggaaggcucucuccagguugggaaugaggcccccgugacaggcagcuccccucugggagccacccagcucgacacggauggcgcucuguggcuugggggacugcccgaacugccggucggcccugcgcuccccaaggccuacgggacaggauucgugggcugccugcgcgacguuguggucggcagacauccucuucaucugcucgaggaugcugugaccaaacccgaacugcggccuugucccacaccguga

SEQ ID NO: 65639 - RNA, 399 nt, Artificial Sequence
  derived and/or modified sequence opt5 from AGRP__Homo_sapiens__XP_011521229
augcugaccgccgcugugcucagcugcgcccugcuucuggcgcuccccgcuacaagaggcgcccagauggggcuggccccuauggagggaauccggcgcccggaccaggcccuucugcccgaacucccuggccuggggcugagagcuccccucaagaaaacgaccgcugagcaggccgaagaggaucugcuucaggaagcgcaggcccuggcugagguccucgaccugcaagaucgggagccucgcuccucuagacgguguguucgccuucacgaaagcugccugggacaacaggugcccuguugcgacccuugugccacaugcuacuguagauucuuuaacgcuuucugcuauugucggaagcucggcaccgccaugaauccgugcucccgcacauga

SEQ ID NO: 65640 - RNA, 1458 nt, Artificial Sequence
  derived and/or modified sequence opt5 from AGT__Homo_sapiens__NP_000020
augagaaagcgggcuccccagagcgagauggcuccugccggcgugucccugcgcgcgaccauccucugccugcuugcuugggccgggcuggccgcuggagacagagucuacauucacccguuccaucucguuauccacaacgaaucuacaugugagcaacuggccaaagcuaaugccggcaagcccaaagauccuacguuuauucccgcgccuauccaggccaagaccagccccguggacgaaaaagcccuucaggaucagcuggugcucgucgccgcuaagcuggacacagaggauaagcugcgggccgcgaugguggggaugcucgccaacuuccugggauuucgcauuuauggcaugcauuccgaacuuuggggaguugugcacggggcuaccguccugucuccuacagccguguucggcacccucgcuagccuguaccuuggcgcccuggaccauacagccgauagacuccaagcuauccuggggguuccguggaaagacaagaauugcaccucccggcuggaugcgcacaaagugcucucugcccugcaggcuguccagggacuucugguggcccagggccgcgccgacagccaagcucagcuccugcuuuccacgguggucgggguuuuuaccgcccccggacugcaccucaagcagccuuucgugcagggccuggcgcuguauacacccgugguccucccuagaagccuggauuuuaccgagcuugacguggcugccgagaaaaucgaucgguucaugcaagccguuacaggguggaagaccggauguucucugaugggcgcuuccguggacagcacgcucgccuuuaacacauacguccauuuccagggcaagaugaaaggguuuucucugcuugcugaaccccaggaguucuggguggacaauuccaccagcguuucugugccgaugcuguccggaaugggcacauuucaacacuggagcgauauucaggacaacuucuccgucacccaggugccuuucaccgaaucugccugccuccugcugauccagccccauuaugcgagcgaucucgacaaggucgaggggcugacauuucaacaaaauucccuuaacuggaugaaaaagcugagcccucgcacgauucaccucaccaugccccagcuggugcugcagggaucuuacgaucuucaggaccuccuggcccaggcugagcugcccgccauccuccacacagaacugaaucuucagaaacuguccaacgaucggauuagaguuggcgaggugcucaauagcaucuucuuugaacuggaggcugacgaacgcgagccuaccgagucuacacagcaacugaacaagccggaaguccuugaggugacccucaauagacccuuccuguuugccguuuaugaucagagcgcgacggcccugcauuuccucgggcggguggcuaacccucuguccacagccuga

SEQ ID NO: 65641 - RNA, 3837 nt, Artificial Sequence
  derived and/or modified sequence opt5 from AGTPBP1__Homo_sapiens__NP_001273644
augagaaccggcagcgccgcuuccucugccgcggcugccgccgcugccgcugccgcgagcgccucccccgcuacaggggugugcaugaagacgccuggaggcgggcggcgcggaaucagacgggacccgggcgccgagcccggggcugccgcgcugcgcggaccuagacagcggcccauucucucucgccugaccaacaauagcagaaucgucggccuucuggcccaacucgaaaagauuaacgcugagccuuccgaaucugauacagcccgguacguuaccagcaagauccugcaccuugcucagucccaggagaaaacacgcagagaaaugaccgccaagggcagcacagggauggagauucugcucucuacccuggagaauacgaaagaccugcagaccacacucaacauccuguccauccuuguggaacuggugagcgccggaggcgggcggcgcgucucuuuccucgugaccaagggaggcucccaaauucugcuucagcugcucaugaaugcuagcaaggagucucccccucaugaagaucugaugguucagauccacuccauucuggcgaaaaucgggccgaaggacaaaaaguuuggagugaaagccagaauuaacggcgcucucaauaucacacugaaccuugucaagcagaaucugcaaaaccaucggcucgugcugcccugucuucagcugcuccgcguuuauagcgccaauuccgugaacucugucagccugggcaagaauggggugguggagcugauguucaaaauuaucggaccuuuuuccaagaaaaacagcucucucaucaaggucgcccuggauacccuugcugcccugcucaaauccaagacgaaugcgagacgggcuguugacagaggcuacguccaggugcugcuuacaauuuauguggauuggcaccgccaugacaaccggcacagaaacaugcugauccgcaaagggauucuccagagccugaagucugugaccaauaucaagcugggacggaaagccuucauugaugccaacggcaugaagauccucuacaauacaagccaagagugccuggcuguuagaacccuugacccccuggugaacaccuccucucucaucaugcgcaaauguuuuccuaagaaucggcugccccugccgacaauuaaaagcuccuuccacuuucagcuuccugucauccccgugacggggccuguugcccagcucuauagccugccucccgaaguggaugacgucguggaugagucugacgacaacgaugacauugaugucgaagcugagaaugaaaccgagaacgaggacgaucuggaccaaaauuucaagaacgaugacaucgaaacagauauuaauaagcucaaaccccagcaggagccgggaagaaccaucgaagaccugaagauguacgagcaucuuuuucccgaacugguggaugacuuccaggacuaugaucucaucuccaaagagccuaagcccuuuguuuucgagggcaaagugcgcggcccuauugucgugcccacagccggggaagagaccagcggaaacucuggcaaucugcggaagguugugaugaaggaaaacaucuccagcaaaggggacgagggagaaaagaaauccacguuuauggaucuggcgaaggaggacauuaaagauaaugacagaacacuucaacagcagccgggcgaucagaaccgcaccaucucuagcguccacgggcucaacaaugacauugugaaggcccuggaucggaucacccugcaaaacauuccuucccagacagcucccggcuucaccgccgagaugaagaaagacugcucucucccucugacagugcuuacgugugcuaaggccugcccccauauggcgaccuguggaaauguucuguucgaaggcagaacaguccagcucgggaaacugugcuguaccggaguggagacagaagaugacgaggauaccgagagcaacuccagcguggaacaggccucugucgaggugccugacggccccacgcugcacgacccggaucuuuacaucgaaaucguuaagaauaccaaauccgugccugaguacagcgaagucgcuuaucccgacuacuuugggcacauucccccuccguucaaggagcccauccucgagcggccuuauggagugcaacgcacaaaaauugcccaggauaucgaaagacugauucaucagucugacaucaucgaucggguuguguacgaccuggauaaccccaauuauaccauuccugaggaaggcgacauccucaaguuuaacuccaaguucgagagcgggaaucugagaaaagucauucagauccgcaagaacgaauacgaucuuauucucaauucugacaucaacagcaaucacuaucaucaaugguuuuacuucgagguguccggcaugcggcccggaguugcuuacagauuuaacaucauuaauugcgagaaaagcaacucucaguucaacuauggcaugcagccucugauguacuccgugcaagaagcccugaaugcccgccccugguggaucagaauggggacagauauuuguuauuacaagaaccacuuuagccgguccucugucgcugcgggaggccagaaagggaaaagcuauuacaccaucacguucacagugaauuuuccgcauaaggacgaugugugcuauuucgccuaccacuacccuuauaccuacuccacacugcagaugcaccuucagaaacucgagucugcucauaacccccaacagauuuauuuucgcaaggacguccugugcgaaacccugagcggaaauuccuguccucucguuaccaucacagccaugcccgagucuaacuacuaugaacacaucugccauuucagaaaucggccguacguguuccugagcgcccgcgugcacccuggcgagacgaacgcuuccugggucaugaaagggacccuugaguaucugaugagcaauaaccccacagcccagucucucagagaauccuacauuuuuaagaucgugccuaugcugaaucccgacggcguuauuaacggaaaucaccgguguagccugucuggcgaggaucuuaaccgccaguggcaaucccccagcccugaccugcauccgaccaucuaccacgcgaaagggcuccugcaguaucucgcugccgugaagagacugccccuugucuacugcgauuaucauggacacucucggaagaaaaauguguucauguacggcuguuccauuaaggaaacaguuuggcauaccaacgacaacgccacgagcugcgauguggucgaggacacaggguaucgcacccugccuaaaauccucucccacauugcucccgccuuuuguaugagcucuugcagcuucgugguugagaaguccaaagaaucuaccgcgagaguggucguguggcgggagaucggagugcagagaagcuacacaauggaauccacccuguguggcugcgaucaggggaaguauaagggccugcaaaucggaacacgcgagcuugaagagaugggcgcuaaauuuugugucgggcugcuccggcugaagagacucacgucuccucuggaguacaaucuucccagcucccugcucgacuucgaaaacgaucugauugagucuagcugcaaaguuaccuccccuacaaccuacgugcuggacgaagaugagccgcgcuuucuugaagagguggacuauagcgccgagucuaaugacgaacuggauaucgagcucgccgaaaacgucggagacuacgagcccuccgcucaggaagaggugcugagcgauucugagcucucccggacauaucugccuuga

SEQ ID NO: 65642 - RNA, 1185 nt, Artificial Sequence
  derived and/or modified sequence opt5 from AGTR1__Homo_sapiens__NP_004826
augaagaaaaugaaccacaagagcacagacucccccaaagccccucagcugagaggcgggguguucgauaucgucuuugcuacaaauucuacgcaaguuauuaagaugauccucaacagcuccaccgaggacggaauuaaacggauccaggaugacugcccgaaggccggccgccauaauuacauuuucgugaugauccccacacuguauucuaucauuuuuguggucgggaucuucggaaacagccuugugguuauugugaucuacuuuuauaugaagcugaaaaccgucgcguccguguuccuccugaaucuugcucuggccgaucucuguuuucugcugacacucccucugugggccguuuacaccgcuauggaauauagauggcccuucggcaacuaccuuugcaagauugccucugcuagcguguccuuuaaucuguaugccagcgucuuccuccugacaugucuuucuaucgaccgguaccuggcgauugugcacccuaugaaaucccgccucagacggaccaugcugguggccaaggucacgugcaucaucauuuggcugcucgcugggcuggccagccuucccgcuaucauucaucgcaacguguuuuucaucgagaauaccaacauuacaguuugugccuuucacuacgaaucucagaauagcacccugccuaucggacucggccugaccaaaaacauccuuggcuuccuguucccguuucucauuauccugacaagcuauacgcugauuuggaaggcgcucaagaaagccuacgagauccagaagaauaaacccagaaacgaugacauuuucaagaucaucauggcuauugugcuguuuuucuuuuucucuuggaucccucaucaaauuuuuacauuccuugauguccugauccagcucgggauuauccgggacugccgcauugccgauaucguggacaccgcuaugcccaucacaauuuguaucgccuauuuuaauaacugccugaacccucuuuucuacggauuucugggcaaaaaguucaaaagauauuuucuccagcugcugaaguacauucccccgaaggccaaaucccacagcaaucucuccaccaagaugucuacccugagcuaucggccuuccgauaacguuuccucuuccaccaaaaagcccgcuccuuguuucgaaguggaguga

SEQ ID NO: 65643 - RNA, 1092 nt, Artificial Sequence
  derived and/or modified sequence opt5 from AGTR2__Homo_sapiens__XP_011535835
augaagggcaacagcacccuggccacaacguccaaaaauaucaccucugggcuccacuucggacuggugaacauuagcggcaauaacgaguccacacuuaauugcucucagaagcccagcgacaaacaucuggaugcuaucccuauucucuacuauaucauuuuugucaucggguuccugguuaacaucgugguggucacccuguuuuguugccaaaagggaccgaaaaagguguccucuauuuacaucuucaaucuugccguugcggaccuccugcugcucgcuacacugccccuuugggccaccuauuacagcuauagauacgauuggcuguuuggcccugugauguguaaggucuucggguccuuucucacacugaacauguucgccagcaucuuuuucauuaccugcaugucuguggaccgguaucaguccguuauuuaccccuuucuuagccagcgcagaaauccuuggcaggcuucuuacaucgugccccuggucugguguauggccugccucuccagccugccuacguucuauuuucgggaugugcgcaccauugaauaccugggagugaacgcuuguaucauggccuucccgcccgagaaauaugcgcaauggucugccggcaucgcucucaugaagaauauucugggcuucaucauuccucuuaucuuuauugccacaugcuacuucgggaucagaaaacaucugcucaagaccaacuccuauggcaaaaaucggaucacacgcgaccagguccugaagauggcugccgcgguugugcuugccuuuauuaucuguuggcugcccuuccacgugcucaccuuucuggaugcucuggccuggaugggagucauuaacagcugcgaagugaucgcuguuauugaccucgcccugccuuucgccauccuucugggguuuacgaauagcugugugaaccccuuccucuacugcuuugucggaaacagauuccagcagaagcugcggucuguguuucgcguuccgaucacauggcuucaaggcaaaagagagagcauguccugccggaaguccucuucccugcgcgaaauggagaccuucgugagcuga

SEQ ID NO: 65644 - RNA, 1545 nt, Artificial Sequence
  derived and/or modified sequence opt5 from AGXT2__Homo_sapiens__NP_114106
augacccugaucuggagacaccuccugcggccccuuugccuggugacaagcgccccucgcauucucgagaugcauccguuccugucccuuggcacgucuagaaccagcgucacaaagcugucccuccacaccaaaccccggaugccucccugugacuuuaugccugaacgcuaccagucucugggguauaacagaguucuggagauccauaaggaacaccucagccccguggugacagcuuacuuccaaaaaccucugcuucugcaucagggacacauggaguggcucuuugaugccgaaggcucccgguaucuggacuucuuuucugggauugucaccgugagcguuggacacugccauccgaaggugaaugcggucgcucagaaacagcuuggccgccuguggcacacauccaccguguucuuucaucccccuaugcacgaguacgccgagaagcucgccgcucugcugcccgaaccucucaagguuaucuuccuggugaacagcgggucugaggccaaugaacuugcuaugcugauggccagagcgcacuccaacaauauugauaucaucagcuuucggggagccuaucauggcuguucucccuacacgcucggccugaccaacgucgggacauauaaaauggagcuuccgggaggcaccgggugccaaccuacaaugugucccgacguguuccgcggaccuuggggcgggucccacugcagagauagccccgugcagaccauucggaaguguucuugcgcucccgacuguugccaggccaaagaucaguacaucgagcaauuuaaggacacgcuguccacaagcgucgcuaaauccauugccggauucuuugcggaaccuauccagggcguuaauggcguggugcaguacccgaagggguuccucaaggaggccuucgaacugguccgcgcuagaggaggcguguguauugccgaugagguucagaccggguuuggacggcugggcucucauuucuggggguuucaaacacacgacgugcuccccgauaucgucaccauggcuaaaggaauuggcaacggcuucccuauggccgccgugaucaccacacccgaaaucgcuaagagccuggcgaaaugccuucagcauuuuaauacguucgggggaaacccuauggccugcgcuauuggcuccgccguucuggaggugaucaaggaggaaaaucuccaggagaacagccaagaagucgggaccuauaugcugcuuaaauuugccaagcugcgcgacgaguucgaaauugugggagaugucagaggcaaagggcucaugaucggcauugagauggugcaggacaagaucucuugucggccccugccgagagaggaaguuaaucagauccacgaggacugcaagcacaugggacugcucgugggccgcggguccauuuuuagccagacauuccggaucgcuccuucuauguguauuaccaaacccgaagucgauuuugccguggagguuuucagaagcgcgcugacacaacauauggaacgccgggcuaaguga

SEQ ID NO: 65645 - RNA, 1179 nt, Artificial Sequence
  derived and/or modified sequence opt5 from AGXT__Homo_sapiens__NP_000021
auggccagccacaaacugcucgugacacccccuaaggcucugcuuaagccgcuguccauccccaaccagcuccugcuuggcccugggcccucuaaucugccucccagaauuauggccgcgggaggccuccaaaugaucgggagcauguccaaagacauguaccagauuauggaugagaucaaggaagggauucaguaugucuuccagacccggaacccucugacgcugguuaucucuggcagcgggcauugcgcucucgaggccgcccuggugaaugugcuugaaccgggagacuccuuucuggucggcgcuaacggcaucugggggcaacgcgccguggauauuggagagagaaucggcgcucggguucaccccaugaccaaagacccugggggacauuacacacuccaggaaguggaggagggccuggcccagcacaagcccguccuucuguuccucacccauggggaaucuagcacaggagugcugcagccucuggauggcuuuggcgagcucugucaccgcuauaagugccugcuucugguugacuccguggcgagccucgggggaacaccccuguacauggauagacaaggcauugacauccuuuauucugggucccagaaagcccugaaugcuccgccuggaaccagccucauuucuuucuccgauaaggccaaaaagaaaauguacagccggaagaccaagcccuuuucuuucuaucuggacaucaaauggcuggcuaacuuuuggggcugugaugaccagccucgcauguaccaccauacgauucccgucaucucccucuacagccugagagaaucccuugcccugaucgcggagcaggggcucgaaaauucuuggcggcaacaccgcgaggccgcugccuaucugcauggaagacuucaggcucugggccuccagcuguucgugaaggaucccgcccugcggcucccuaccgugacaaccgucgccguuccggcuggcuacgacuggcgcgacauugugagcuaugugaucgaucacuuugacauugagaucaugggaggacugggccccuccacagggaaaguccuuagaauuggacugcucggcugcaacgcgacccgggaaaauguggaucgcguuacggaggcccugagagcugcccugcaacacuguccuaagaagaaacuuuga

SEQ ID NO: 65646 - RNA, 1299 nt, Artificial Sequence
  derived and/or modified sequence opt5 from AHCY__Homo_sapiens__NP_000678
augagcgacaagcugcccuacaaaguggccgauaucggccucgcugccugggggagaaaggcgcuggacauugcugagaacgaaaugccuggacuuaugcggaugcgcgagagauauuccgccucuaaaccgcugaagggcgcccggaucgcugggugccuccacaugaccgucgaaacagccguucugauugagacgcuugugacccugggagcugaagugcaguggagcuccuguaauaucuucucuacacaagaucaugccgcggccgcuauugccaaagcuggcauccccgucuacgccuggaagggggagaccgacgaggaauaucucuggugcaucgagcagacacuguacuuuaaggauggaccucugaacaugauucucgacgauggcggcgaccugaccaaucuuauccacacaaaauauccccagcugcucccugggauucgcggaaucagcgaagagaccacgaccggcgugcauaaccuguacaagaugauggcgaaugggauucuuaaaguucccgccaucaacgugaaugauuccgucacaaagucuaaauucgacaaccuguauggauguagagagagccucauugauggcaucaagcgggcuaccgacgugaugaucgccgggaagguugcuguggucgccggauacggcgaugugggcaaagggugcgcccaggcucugcgcggauuuggcgcgagagugauuaucacagaaauugacccuaucaaugcccugcaagcugccauggagggguacgaagucaccacgauggacgaggccugucaggaaggaaacauuuucguuacaaccacaggcugcaucgauaucauucucgggcggcacuuugagcagaugaaggacgaugcuaucguguguaauauuggacauuucgacguggagaucgaugucaaauggcugaacgaaaaugccguggagaagguuaacauuaaaccccagguggaccgcuauagacuuaagaauggccggcgcaucauccugcucgcggaaggcagacuggucaaccuugggugcgcuaugggacacccguccuuugugaugagcaacucuuucaccaaucaaguuauggcccagauugagcuguggacccacccugauaaauaccccgugggcguccauuuucucccuaagaagcuggacgaagccguggcugaggcccaccuggggaaacucaacgucaagcugacaaaacuuacggagaagcaggcucaguaucugggaauguccugugauggccccuucaaaccggaccauuaccgguauuga

SEQ ID NO: 65647 - RNA, 1833 nt, Artificial Sequence
  derived and/or modified sequence opt5 from AHCYL2__Homo_sapiens__NP_001124192
augagcgugcaggucguuuccgccgcugccgcggcuaaggugcccgagguggaacugaaagaccucucuccuagcgaggccgaaucccaacugggccuuucuaccgccgcugucggggccauggcuccgcccgccggaggcggggauccugaggcgcccgccccugcugccgaaagacccccugugccgggacccggcagcgggccugcugccgcgcugucccccgccgcuggaaagguuccucaggccucugcuaugaaacggagcgacccccaccaucagcaccagcgccauagagauggcggcgaggcccucguguccccggacgggacagucacggaggccccucggaccgugaagaaaauccaauucgcugaucagaagcaggaauuuaacaagcgccccacaaaaauuggaagacggagccugucucgcuccaucagccagucuuccaccgacagcuacucuuccgcggccagcuauacagauuccucugacgaugagaccagcccuagagacaagcaacagaaaaauuccaagggcagcucugauuucugcguuaaaaacauuaagcaggcugaauuugggcggcgcgagaucgagauugccgaacaggagaugcccgcccuuauggcucugagaaagcgggcccaaggagaaaaaccccucgcgggcgcuaagaucgugggguguacacacaucaccgcccagacggccguccugauggagacccugggagcucucggcgcccagugccgcugggcugccuguaauauuuacuccacacugaacgaaguggcggccgcucuugccgagagcggcuucccuguguuugcuuggaaaggggagucugaagacgauuucugguggugcaucgacagaugugucaauguugagggauggcaaccgaacaugauucuggacgauggcggggaccucacccauuggaucuauaagaaauaccccaauauguuuaagaaaauuaagggaaucguggaagagagcgugacaggcguccaccggcuguaucagcuuuccaaggccgggaaacugugcgugccugcgaugaacguuaaugauucugugaccaagcagaaauucgacaaccucuacuguugccgcgaaagcauucuggauggacugaagagaacgacagacaugauguuuggcggcaaacaggucgugguuuguggguauggagaggugggcaaggggugcugugccgcucucaaggccaugggauccaucgucuacgugaccgagaucgaucccauuugcgcucugcaagccugcauggacggcuuccggcuugucaaacugaaugaagugaucagacagguugauauugugaucacauguaccgggaacaagaaugucgugacccgcgagcaccucgaccggaugaaaaacagcugcauuguuuguaauaugggccauucuaacacagaaaucgauguggccucccugagaacgccugagcuuaccugggaacgcguccggagccagguggaccacgugaucuggcccgacggaaagagaauuguucugcucgcugagggccgccugcugaaccucucuugcuccacagucccgaccuuugugcugagcaucacagcgaccacgcaggcccuugcucugauugagcucuacaaugccccugaagggcgguauaaacaagauguguaccugcuucccaagaagauggacgaguaugucgccucccugcaucucccuacauucgaugcucaccugaccgaacugaccgacgagcaggccaaauaccucggacugaacaagaauggccccuuuaaaccuaacuauuacagauauuga

SEQ ID NO: 65648 - RNA, 3162 nt, Artificial Sequence
  derived and/or modified sequence opt5 from AHI1__Homo_sapiens__NP_001128304
augcccaccgccgagagcgaagcuaaggugaaaacaaaggucagauucgaggaacugcucaaaacgcacuccgaccugaugcgggagaagaagaaacuuaaaaagaagcugguucgcucugaagagaacaucagcccugauaccauuagauccaaucuccauuacaugaaagagacaaccucugacgauccggacacaauccggagcaaccugccccacauuaaggaaaccacauccgaugacgugucugccgcgaauaccaacaaucuuaaaaagagcacgcgcgugaccaagaacaaacugagaaauacacagcucgcuaccgagaacccuaauggcgaugccuccgucgaagaggacaagcaagggaaacccaacaagaaagugaucaagacaguuccucagcugaccacgcaggaucugaaacccgagacaccugaaaauaagguggacagcacccaucagaagacacacaccaaaccgcaacccggagucgaucaucagaagucugagaaagccaacgaaggccgggaggaaaccgaccucgaggaggaugaggaacugaugcaggcuuaucagugccacgugacagaagagauggccaaggaaauuaaacgcaagaucagaaagaaacuuaaggagcaacugacguacuuuccuuccgacacccucuuccacgacgauaaacugagcucugagaagcggaaaaagaagaaagaaguucccguguuuuccaaggcugagacaagcacccuuacaaucucuggggacaccgucgaaggagagcagaaaaaggaauccagcgugcgcuccgugucuagcgauucccaucaggacgaugagauuagcucuauggagcaguccacggaagacagcaugcaagaugacacaaaaccuaagcccaagaaaaccaagaaaaagaccaaagccgucgcggauaauaacgaggacguugauggcgacggggugcacgaaaucacaucuagagacagcccgguguauccuaagugucugcucgaugacgaucugguccugggaguguacauucaucggaccgaccgccucaaauccgauuucaugaucucucaccccaugguuaagauucacguggucgacgagcauacaggccaguaugugaagaaagaugacagcggcagaccuguuuccagcuacuaugagaaggaaaauguggauuacauccugcccauuaugacgcagcccuacgacuuuaaacaacuuaagucucggcugccugagugggaggaacagaucgucuucaacgaaaacuuuccguaucuccugcgcggguccgaugagagccccaaagugauccuuuucuuugagauucuggacuuccucucugucgaugaaaucaagaauaacuccgaggugcagaaucaggaaugcggauuuagaaagauugccugggcuuuccugaaacugcucggcgccaacgggaaugcuaacaucaauagcaagcugcggcuucaacuguacuauccucccaccaaaccuagaucuccccucuccguuguggaggccuuugaaugguggagcaaguguccgcgcaaccacuacccuuccacacuguaugucaccgugcggggacuuaaaguucccgacugcauuaagccuucuuacagaagcaugauggcgcugcaggaggagaagggcaaacccgugcauugugaacgccaccaugaguccagcucugucgacacagaaccugggcucgaggaauccaaggaggugaucaaauggaagcggcugcccggacaggccugcagaaucccgaauaaacaccuguucagccucaacgcuggcgagcgcggcuguuucugccuggauuuuucucacaaugggcggauucuugccgcugccugugccuccagagacggauauccuaucauucuguacgaaauccccagcggccgcuucaugcgggagcucugcgggcaucugaacauuaucuacgaucugucuuggagcaaggacgaucacuauauccuuaccuccagcucugacggaacggcuagaauuuggaagaaugaaaucaacaauaccaacacauuucgcgugcucccccauccuuccuucguuuacaccgcgaaauuucacccggccguccgggagcugguggugacaggcuguuaugauagcaugauuagaaucuggaaggucgagaugcgggaagacuccgcuauucuggugcgccaguucgauguucacaaaucuuuuaucaacagccucugcuucgacaccgaggggcaucacauguacuccggagauugcacgggcgugauugucguguggaauacauauguuaagaucaacgaccuggaacauucugugcaccauuggaccaucaauaaagagauuaaggaaacagaguuuaaaggcauccccauuagcuaccuugagauccacccuaacgggaagagacugcucauucacaccaaggauuccacccugcggaucauggaccugagaauccuugucgcccgcaaauucgugggagccgcuaauuaucgggaaaagauucauucuacacucacgcccuguggcaccuuucuguucgccgggagcgaggacggaaucguuuacguguggaacccugaaacaggcgagcaagucgcgauguacuccgaucugcccuuuaaaagcccuauuagagacaucucuuaucaccccuucgaaaauaugguggcuuucugcgccuuugggcagaacgagccgauucuccuguacaucuaugauuuccauguggcccagcaggaggcugaaauguuuaagcgcuacaauggcaccuucccucuucccggaauccaccaaucccaggacgcccuguguacaugcccuaaacucccccaucagggcagcuuucagauugaugaguucguccacaccgaaucuuccagcacgaagaugcaacugguuaagcagagacuggagacagugaccgaagugauccggucuugugcugccaaagucaacaagaaucuuuccuuuaccagcccgccugcgguguccagccagcaaucuaaacucaagcagagcaacaugcugacagcccaggagauucugcaccaguucggguuuacccaaacagacucccauuucgcugaguuuaauacgugcauccucugguggaaaaagcacuga

SEQ ID NO: 65649 - RNA, 450 nt, Artificial Sequence
  derived and/or modified sequence opt5 from AHNAK__Homo_sapiens__NP_076965
auggagaaggaagagaccacaagagaacugcuccugcccaacuggcagggcagcgggucccacggacuuacgaucgcccaacgggacgauggcguguucguccaggagguuacccaaaauucuccugcugcccgcacagggguggugaaagaaggagaccagauugucggcgcgaccaucuacuuugauaaccugcagagcggggaggugacacagcuccugaauaccaugggacaucacacaguuggccuuaagcugcauagaaaaggcgaccgguccccggagcccgggcagaccuggacgcgcgaaguguucucuagcugcuccucugaggucgugcucaacaccccucagcccagcgcucuggaauguaaggaucaaaauaaacagaaggaggccuccagccaggccggagcuguuucuguguccacaccuaacgccggccuguga

SEQ ID NO: 65650 - RNA, 2547 nt, Artificial Sequence
  derived and/or modified sequence opt5 from AHR__Homo_sapiens__NP_001612
augaacagcuccucugccaauaucaccuacgcuagcagaaagcggcgcaaacccgugcagaagacagucaaaccuauuccggccgagggcaucaaguccaaccccucuaaaagacaccgggaccgccugaauacggaacucgauagacuggcgagccuucugccuuucccccaagacguuauuaacaagcucgauaagcuguccgugcuucggcugucugugagcuaucuccgcgcuaaauccuuuuucgacgucgcccucaagagcucuccuaccgagagaaaugggggacaggauaacugccgggccgcuaauuuucgcgaaggccugaaccugcaggagggggaguuccugcuucaggcccugaauggauuugugcucguugugacaaccgacgcucuggucuucuacgccuccagcacaauccaagauuaucuuggcuuucagcagucugacgugauucaucaguccguuuacgaacugauccacaccgaggauagagcggaguuccaacggcagcuccauugggcccugaaccccagccaguguacagaaucugggcagggaaucgaagaggcuaccggccugccucaaacgguggucugcuauaauccggaccagauucccccugagaacagcccccucauggaacgcuguuuuaucugcagacugcggugucuucuggauaauagcuccggcuuccucgccaugaacuuucaggggaaacugaaguaccuucacggacaaaagaagaagggcaaagacgggucuauucugccuccccagcucgcucuguucgccaucgcgaccccgcugcagccucccagcauucucgagauccgcacaaagaauuuuauuuucagaaccaaacauaagcuggauuucacaccuaucggaugcgacgccaaaggccggaucgugcuuggguauaccgaagcugagcuguguacgagaggauccggcuaccaguuuauucacgccgcugacaugcucuacugcgccgaaagccacauccgcaugauuaagacaggcgagucugggaugaucguguuccggcugcuuaccaaaaacaacagauggacauggguccaauccaaugcccgccugcucuauaagaacggacggcccgauuacauuaucguuacccagagaccccugaccgacgaggaaggcacagagcaucugcgcaagcggaauacgaaacucccuuuuauguucaccacaggggaagcugugcuguaugaggcgaccaacccguuucccgccaucauggauccucuuccccugagaacaaagaauggaaccagcggcaaagacucugcuacgacaagcacccucuccaaggauucucugaacccuagcucccugcuugccgccaugaugcagcaggacgaaagcauuuaccucuaucccgcuucuuccaccagcucuacagccccguucgagaauaacuuuuucaaugaguccaugaacgaaugucgcaauuggcaagauaacaccgcgccuauggggaaugacacaauccugaaacacgagcagauugaucagccccaggacgugaacagcuuugcuggaggccauccuggccuguuccaagauuccaaaaauucugaccucuacagcaucaugaagaaccuggggauugacuuugaagauauccggcacaugcagaacgagaaauucuuuagaaaugacuucuccggagaagucgauuuccgcgacaucgaucuuacggacgagauucugaccuaugugcaggauucucucagcaagucccccuuuaucccuagcgacuaccagcaacagcagucucuggcccugaacuccagcugcaugguucaagagcaccuucaucucgaacagcagcagcaacaccaucagaaacagguggucguggagccccagcaacagcugugucagaagaugaaacacaugcagguuaauggcauguucgaaaacuggaacucuaaucaauuugugccguucaauugcccucagcaggauccccaacaguacaacgucuuuacagaccugcaugggauuucccaggaguuccccuauaagagcgagauggauucuaugccuuacacccagaauuuuaucagcugcaaccaaccggugcucccccagcacuccaaguguacagaacuggacuauccuaugggauccuucgagcccucuccuuaccccaccacguccagccuugaagauuuugugaccugccugcagcucccugagaaucagaaacacggccugaacccccaauccgccauuaucacaccgcagaccuguuaugcuggggccgucucuauguaccagugccagccugaaccccaacauacacacguuggccagaugcaguauaauccugugcugcccggacagcaggcuuuccuuaacaaguuucaaaauggcguccucaacgagaccuacccggccgagcugaacaauauuaacaauacgcagacaaccacacaucugcaaccucuccaccaccccagcgaagcgcggccuuuccccgaccugaccuccucuggguuucuuuga

SEQ ID NO: 65651 - RNA, 2106 nt, Artificial Sequence
  derived and/or modified sequence opt5 from AHRR__Homo_sapiens__NP_001229341
augcccagaaccaugaucccuccgggcgagugcacauacgccgggcggaagcgcagacggccccugcagaaacaacgcccugcugugggagccgaaaagagcaaccccuccaaaagacaccgggaccgccucaaugcggagcuggaucaucuugcuucucugcucccuuuucccccugacauuaucagcaagcuggauaaacuuuccguccugagacucucuguuagcuaucugcgggugaaguccuucuuccaggugguccaggaacagucuagccgccaaccggccgccggcgcucccuccccuggggacagcuguccccuggccggaucugcugugcucgagggcagacugcuucuggaaucccucaacggguuugcccugguugugagcgcggagggaacgauuuucuacgccucugcuaccaucgucgauuaucuuggcuuucaccagacagacgugaugcaucagaauauuuacgauuauauccacguugacgaucggcaggacuucugccgccaacugcauugggccauggauccuccccagguggucuuuggccagccgccuccccucgagaccggggacgaugcuauccugggaagacugcuccgggcccaggaauggggcacagggaccccuacagaguacuccgcguuccugacccgcuguuuuauuugcagagugcggugucuucuggacagcacgucuggauuccucaccaugcaauuucagggcaagcugaaauuccuuuuugggcagaagaaaaaggcccccuccggagcuaugcugcccccuagacucagccuguucugcaucgccgcuccggugcugcuccccuccgccgccgaaaugaaaaugcgcucugcucugcuucgggcgaagccuagagccgacacagcugccaccgccgaugcuaaggucaaagccacaaccagccugugugaguccgagcuccacggcaagcccaacuauagcgcgggccggucuucccgggaaagcgggguucuggugcuuagagagcaaacggacgcuggacgcugggcccaggugccugcccgggcucccugccugugucucagaggcgggccggaucugguccuggacccuaaaggaggcucuggggaucgcgaagaggaacagcaccggaugcucagcagagccuccggagugacaggccgccgggagacccccggcccuacaaagccccugccuuggaccgcugggaaacauucugaggacggagccagaccccggcuucagccgagcaagaaugauccucccucccugcgccccaugccuagaggcagcugccucccgugucccugcguucaagggaccuuccggaacucuccuauuucccaucccccuagccccucuccuuccgcguacagcuccagaacaucucgccccaugcgggacgugggagaagaucagguccacccgccucugugccacuuuccccagagaagccugcagcaccaacuuccucagcccggcgcccagcgcuucgcuacgagaggguacccgauggaggacaugaaacuccagggcgugccuaugcccccuggagaucuguguggccccacccugcuccuggacguuuccaucaagauggaaaaggacucugggugcgagggagccgcugauggcugugugcccagccaagucuggcuuggggccuccgaccggagccauccugcgacauuuccgacccgcaugcaccugaaaacagaacccgauucuagacaacagguguauauuucccaucucggacacggcguccgcggggcccagccucauggccgcgcuaccgccggaagaagccgggagcugacgcccuuccacccugcucacugcgccugucuggagcccacagacggccuuccucagucugaaccgccccaucagcucugcgcccgcgggagaggagagcaguccuguaccugccgggcugcggaagccgcuccugugguuaagcgcgagccccuggauagcccucaaugggccacccacucucagggcauggugcccgggaugcugccgaaaagcgcccucgcuacacuggucccuccccaggccuccggauguaccuuucuucccuga

SEQ ID NO: 65652 - RNA, 1017 nt, Artificial Sequence
  derived and/or modified sequence opt5 from AHSA1__Homo_sapiens__NP_036243
auggccaaguggggcgagggggaccccagauggaucguggaagaacgggcugaugccaccaacgucaauaacuggcacuggacagaacgcgacgcgagcaauugguccacggauaaacugaagacccucuuccuggcuguucaggugcaaaacgaggaaggaaaaugcgaggugacagaggucucuaaacuugacggcgaagccagcauuaauaacagaaaggggaagcugaucuuuuucuacgagugguccgugaagcucaauuggaccggaacaucuaaaagcggcguucaguauaaggggcauguggaaauuccuaaccuguccgaugaaaauucugucgacgagguggaaaucagcguuucccuugccaaagaugagccggacaccaaccugguggcucucaugaaggaagagggagucaaacugcugcgggaagccaugggcauuuacaucagcacacucaagaccgaguuuacgcagggcaugauccugcccaccaugaauggggagucuguggauccugugggacagcccgcucuuaagacagaggagcgcaaagccaagccugcgcccuccaaaacccaagccagaccugucggcguuaagauuccgacauguaaaaucacccugaaggaaacguuccucacaagccccgaggaacuguaucggguguuuaccacacaggagcuugugcaggcuuucacccacgccccugcuacccuggaggccgaccgcgggggaaaauuucauauggucgauggcaacgugucuggggaguucacagaccucguucccgagaagcacauugugaugaaguggagauuuaaauccuggccugaaggacauuucgcgacgaucacccugacauuuauugauaagaauggcgagaccgaacugugcauggagggccgggggauccccgccccggaggaggaacgcacaagacagggauggcaacgguacuauuucgaaggcauuaaacagaccuuuggguacggagcucgccucuucuga

SEQ ID NO: 65653 - RNA, 414 nt, Artificial Sequence
  derived and/or modified sequence opt5 from AHSA2__Homo_sapiens__NP_689605
augauccugcccaccaaggccauggcuacccaggagcucacggugaaaagaaagcugagcggcaacacccuucaaguccaggccuccucuccuguugcgcugggggugcggauuccgacaguggcucuccacaugauggaacuguucgacaccacagucgagcagcuuuacagcaucuuuaccgugaaagaacugacaaauaagaaaauuaucaugaaguggcgcugcggaaacuggcccgaggaacauuaugccaugguugcccucaauuucgugccuacccugggccagacggagcugcaacucaaggaguuucuguccauuuguaaagaagagaacaugaaguucugcuggcagaaacagcacuuugaagagaucaaggggucucuucagcugacaccccucaauggauga

SEQ ID NO: 65654 - RNA, 1104 nt, Artificial Sequence
  derived and/or modified sequence opt5 from AHSG__Homo_sapiens__NP_001613
augaaaagccuggugcuccugcuuugccuggcccagcucuggggcugucacuccgcuccccaugggccuggacugaucuacagacaaccgaacugcgacgaucccgagaccgaagaggccgcgcuugucgcuauugacuauaucaaucagaaccugccuuggggcuacaagcacacacucaaucagauugaugaaguuaagguguggccccagcaaccuucuggggagcuguucgaaaucgagauugacacgcuggagaccacaugucaugugcucgaucccaccccugucgcccggugcagcgugcgccagcugaaagaacacgccguugagggagacugugauuuucagcuucugaagcucgacggcaaauucuccguggucuaugcuaagugcgauucuagcccggacuccgccgaagaugugagaaagguuugucaggacugcccccugcuugcuccucugaacgauacacgggugguccaugccgcgaaagccgcucucgccgcuuuuaaugcccaaaacaaugggucuaacuuccagcuggaggagaucagccgcgcgcagcuggugccccucccucccuccaccuacguggaauuuacagucagcggaaccgacuguguugccaaggaggcuacggaagccgcuaaaugcaaucugcuugccgagaagcaguauggcuucuguaaagccacccugucugaaaagcucggcggggcugagguggcggugacaugcauggucuuucaaacccagccgguguccagccagccucaacccgagggagccaacgaagcuguuccuacacccguggucgaccccgaugccccuccgucucccccucugggcgcccccgggcuuccucccgcuggauccccgccugacagccacgugcugcucgccgcgcccccuggccaccagcugcauagagcucacuacgaucugcggcauaccuucauggggguugugucucucggaucccccagcggcgaggucucccacccucgcaagacgagaacagugguccagcccucugugggcgccgccgcugggccgguugugccucccugccccggacggauccgccacuuuaaagucuga

SEQ ID NO: 65655 - RNA, 597 nt, Artificial Sequence
  derived and/or modified sequence opt5 from AICDA__Homo_sapiens__NP_065712
auggacagccugcucaugaacagacggaaguuccuguaccaguuuaaaaaugugcgcugggccaagggcagacgggagaccuaucuuugcuacgucguuaaacgcagagauuccgcuacaucuuucagccuggacuuuggguaucuccggaacaagaauggaugucacguggaacugcuuuuccugcgcuacaucuccgauugggaccucgaucccggcagaugcuaucgggugacgugguuuaccucuuggagcccuuguuacgacugcgcccgccaugucgcggauuuccugagagggaacccgaaucugucccuccggauuuuuacagcucgccuguauuucugugaggacagaaaagccgaacccgagggacuucggcgccugcacagagccggcgugcaaaucgcuauuaugaccuuuaaggauuacuucuacugcuggaacacauuuguugaaaaucaugagcggaccuucaaggccugggaggggcuccacgaaaacucugugagacugagccgccagcuucggagaauccugcucccucuguaugaggucgacgaucugcgcgacgcuuuucggacacucggacuguga

SEQ ID NO: 65656 - RNA, 921 nt, Artificial Sequence
  derived and/or modified sequence opt5 from AIDA__Homo_sapiens__NP_073742
augagcgaggugaccagaucccugcuccagcgguggggcgccucuuuccgcagaggggcugacuuugauagcuggggacaacuggucgaagccaucgacgaguaccagauucuugcgcggcaccuucagaaggaagcucaggcccaacauaacaauuccgaguucacagaggaacagaaaaagacgaucggcaaaauugcuaccugccucgagcugcgcucugccgcccuucagagcacacagucccaagaagaguuuaagcuggaagaucucaaaaagcuggagcccauccugaagaacauucucaccuauaauaaagaguucccuuuugacguucagccggugccccugagacggauccuugcuccuggggaagaggaaaaccuggaguucgaagaggaugaggaagagggaggcgccggggcgggaucucccgacagcuuuccugcccgcgugcccggcacacuccugccuagacuuccguccgaacccggcaugacccugcucacaauccggauugagaagaucgggcugaaagaugcuggacaguguauugacccuuacaucaccgucagcgugaaggaucugaauggcauugaccucacgcccguucaggauaccccuguggccucucgcaaagaagacacauauguccacuucaacguggauaucgagcugcaaaagcauguugagaagcugaccaaaggggcugccaucuuuuucgaauuuaagcacuacaaacccaagaaaagauucacauccaccaagugcuuugcguucauggagauggacgaaauuaaaccgggaccuaucgugauugagcuguauaagaagcccacggacuucaaacggaagaaacuccagcugcuuacaaagaaaccucuguaccuccaucugcaccagacccugcacaaggaauga

SEQ ID NO: 65657 - RNA, 444 nt, Artificial Sequence
  derived and/or modified sequence opt5 from AIF1__Homo_sapiens__NP_001614
augagccagaccagagaccugcaaggcgggaaggccuucggacuccugaaagcucagcaggaggaacggcuugaugagaucaacaagcaguuucuggacgaucccaaauacuccucugacgaagaucucccuagcaagcuggagggcuucaaagaaaaguauauggaguuugaccuuaaugggaacggagauauugacaucaugucccugaagcgcaugcucgagaaacugggcgugccgaagacacaccuggaacucaaaaagcugauuggggaggucucuagcggauccggcgaaacguucucuuaccccgauuuucuuagaaugaugcugggcaaacggagcgccauccucaagaugauucugauguaugaggagaaggcgcgcgaaaaagagaagccuaccgggcccccugcuaaaaaggccaucuccgaacuucccuga

SEQ ID NO: 65658 - RNA, 825 nt, Artificial Sequence
  derived and/or modified sequence opt5 from AIFM1__Homo_sapiens__NP_001124318
augggcaagauccugcccgaguaccucagcaacuggaccauggaaaaagugagacgggagggggucaagguuaugccuaaugccauugugcaguccgugggagucucuagcggcaaacugcuuaucaagcugaaagacgggcgcaagguggaaacagaucacauuguugcugccgugggacucgagccgaacgucgaacuggcgaagacgggcgggcuugagaucgacuccgauuucggaggcuuuagagugaaugcugagcugcaagcccggucuaacauuuggguugccggcgacgcugccugcuucuaugauaucaaacucgggcgcagacggguggaacaucacgaccaugcugucgugagcggacgccuggccggcgagaauaugaccggggcggccaagcccuacuggcaccaguccauguuuuggucugaucugggaccugacgugggcuaugaagcuaucgggcucgucgauagcucccugcccacaguuggaguguucgccaaagcuaccgcccaggacaacccuaagagcgcgacagagcagucuggcaccggcauuagauccgagagcgaaacagagucugaagccuccgagaucaccauucccccuagcacgccggcugugccccaagccccuguccagggggaagauuacggaaaaggcgugaucuuuuaucuucgggacaagguuguggucgggauugugcuguggaauaucuucaaccgcaugcccauugcuagaaagaucaucaaagauggagagcagcaugaggaccucaaugaaguugccaagcuguuuaacauucacgaggacuga

SEQ ID NO: 65659 - RNA, 1122 nt, Artificial Sequence
  derived and/or modified sequence opt5 from AIFM2__Homo_sapiens__NP_001185625
augggcagccagguguccgucgagucuggggcccugcacguugugaucgugggaggcggguucggaggcauugcugccgcgagccaacuccaggcucugaacguccccuuuaugcuuguggacaugaaggauuccuuccaucacaauguugccgcccugagagcuucuguggaaaccggguuugccaaaaagacauucaucagcuacuccgucacguuuaaagacaacuuccggcagggacucgugguuggcauugaucugaagaaucagauggugcuucugcaaggcggggaggcucucccuuuuucucaucugauccuggccaccggaagcacaggcccguuccccgggaaauuuaacgaagucuccagccagcaggcggccauucaggcuuaugaggacauggugcgccaagugcagagaucucgguucaucgucguugugggaggcggguccgccggaguggaaauggcugccgagaucaagaccgaguacccugaaaaggaggucacacucauucacagccagguggcgcuggccgauaaagaacuucugcccucuguucgccaggaggugaaggagauccuccugagaaaaggcguccaacuucugcucuccgaacgggugagcaaucuggaggaacugccucucaacgaguaucgcgaauacauuaagguucagaccgacaaaggcacagagguggcuaccaaucuggucauccuuugcacggggauuaagaucaacucuuccgccuauagaaaggcuuuugagagccggcuggccuccucuggagcccuccgcgugaaugaacaucugcaggucgagggccacagcaacguguacgcuauuggggauugugcggacguuagaacccccaaaauggccuaucuugcuggacugcacgccaauaucgccguggcuaacaucgucaauuccgugaagcaacggccucuccaggccuacaaaccgggcgcgcugacauuccugcucagcauggggcgcaacgauggaguuggccagauuucuggcuuuuacguggggagacugaugguccggcuuaccaagucccgcgaccuguucgugagcacaucuuggaaaaccaugagacagagcccucccuga

SEQ ID NO: 65660 - RNA, 1797 nt, Artificial Sequence
  derived and/or modified sequence opt5 from AIFM3__Homo_sapiens__NP_001018070
augggcgggugcuucagcaagcccaaaccuguggagcugaagaucgaagucguucucccggagaaagaaagaggaaaggaggaacuguccgccucuggcaaagggagcccccgggcuuaccagggaaacggcaccgcccgccacuuucauacagaggagagacuuuccacgccucaccccuauccuucuccccaagacuguguggaagcggcugugugccaugucaaggaucuggagaaugggcagaugcgggaaguggagcucggauggggcaagguucugcuugugaaagacaacggcgaguuccacgcccuggggcauaaguguccucacuacggagccccgcucgucaaaggcgugcugagccgcgggagaguucggugccccuggcacggagcuuguuuuaauauuuccaccggcgaucuggaagacuucccugggcucgauucucugcauaaguuucaggugaaaaucgagaaggaaaaggucuaugugcgcgccagcaaacaggcucugcaacugcagagacggacaaaggugauggccaaaugcauuucccccagcgcgggauacucuuccagcaccaacguccucaucguuggcgccggcgcugccgggcuggugugugcugagacacuucgccaggaaggauucucugacagaauugugcugugcacccucgaucggcaccuuccuuaugaccgccccaagcuguccaaaagccucgauacacagccggagcaacuggcccuuagaccuaaggaguuuuuccgggcguacggcaucgaaguccugaccgaggcccaggugguuacgguggacguccgcaccaaaaaggugguuuuuaaggauggguucaaacucgaauauucuaagcugcuucuggcucccggauccagcccuaaaacacucuccuguaagggcaaagagguggaaaaugucuuuaccaucagaacacccgaggacgccaaccggguggucagacuggcucgcgggcggaaugugguuguggucggagccggcuuccugggcauggagguggccgcuuaccucaccgaaaaggcgcauucuguuagcguggucgagcuggaagagacgcccuuuagacgcuuccuuggggaacgggugggcagagcccugaugaagauguucgagaacaaucgcgugaaauuuuacaugcagacagagguuuccgaacuccggggacaggaggggaagcugaaagaagucgugcuuaagagcucuaaaguggucagagcugaugugugcguugugggaauuggcgccgucccugccaccggguuccugcgccaauccggcaucggacucgacagccggggcuuuauuccggugaacaagaugaugcagacaaauguucccgggguguucgcugccggagacgcggucaccuuuccucuggcuuggagaaacaaucgcaaggugaacaucccccacuggcagauggcccacgcccaaggccggguugcugcccagaauaugcuggcucaggaggccgagaugucuaccgugccuuaucucuggacagcgauguucgggaaaagccugagauacgccggauauggcgaaggguuugaugacgucauuauccagggcgaucuugaggaacugaaguucguggcuuuuuacacgaaaggagacgaggugauugccgucgcuuccaugaacuaugaucccaucguuucuaagguggccgaagugcucgcgagcggccgggccauccgcaaaagagaggucgagaccggggacauguccuggcugacaggaaagggcagcuga

SEQ ID NO: 65661 - RNA, 687 nt, Artificial Sequence
  derived and/or modified sequence opt5 from AIG1__Homo_sapiens__NP_001273516
auggccauccugcucagcuacugcuccauucuguguaacuauaaggcuaucgagaugcccucucaccagaccuacggcgggagcuggaaauuccuuacauuuauugaccuggugauccaagccgucuucuuuggaauuugcguucucacggaucuguccucucuucugaccagaggcagcgggaaucaggaacaggagcggcagcucaagaaacugaucucccugcgcgacuggaugcucgcggugcuggcuuucccugugggagucuuugugguugccguguucuggaucauuuaugccuacgauagagaaaugaucuauccgaagcugcuugacaacuuuauucccggcuggcucaaucaugggaugcacacaaccguccugccuuucauccuuauugagaugcggacaucucaucaccaauaccccagccgcuccagcggacugaccgcuaucuguacauuuucugugggcuauauucucuggguuugcugggugcaucacgucaccggcauguggguguacccuuuccuggaacacaucgggcccggagccagaaucaucuuuuucggcuccacgaccauucugaugaacuuucucuaccugcuuggggaggugcugaauaacuauauuugggauacacagaaaagcauggaggaagagaaggaaaagccuaaacucgaguga

SEQ ID NO: 65662 - RNA, 5172 nt, Artificial Sequence
  derived and/or modified sequence opt5 from AIM1__Homo_sapiens__NP_001615
auggaaaagagaagcuccggacggcgcucugggagacggcgcggaagccagaaauccaccgacucucccggcgccgaugcugaacugccugaaagcgccgcgagagacgaugcuguguucgacgaugaagucgccccgaacgccgcuuccgacaaugccucugcugagaagaaaguuaagagcccccgggccgcccucgaugggggaguggccuccgcugccagcccugaaucuaaacccuccccuggcaccaaggggcaacugcgcggagagagcgacagaucuaagcagcccccuccggcuuccagccccacgaaacggaagggccgcucuagagcccuugaggcggugccugcgcccccugcuuccggcccccgggccccggcuaaagaaagcccucccaagcgcgucccugaucccucccccgugaccaaagggacagccgccgagucuggagaagaggcugcgagagccaucccucgggagcugccgguuaagagcuccagccuccugcccgaaauuaagccugagcacaaacgcggcccccuuccuaaccacuuuaaugggagagcugaaggaggccggucuagagagcuggggcgcgccgccggagcucccggcgccuccgacgcggauggccucaagccgcggaaccacuucggggugggaagaagcaccgucacaaccaaagugacacugccugcuaagcccaaacauguugaacugaaucucaagaccccuaaaaaccuggacucucuuggcaaugagcacaaccccuuuagccagccugugcauaaggggaauacggccaccaagaucucccuguucgagaacaaacgcacaaauucuagcccccggcacaccgauauuagaggacagcgcaacacaccggccuccagcaagaccuuugucggccgggcuaaacucaaucuggccaagaaagcuaaggaaauggagcaaccugaaaagaaagugaugcccaacucuccccagaauggggugcuugucaaggagacggccaucgaaacaaaaguuaccguguccgaggaggaaauucugccugcgacaagaggaaugaacggcgacagcucugagaaccaggcccucggcccgcagcccaaucaagacgauaaggcugacgugcagaccgaugccgggugccuguccgaaccugucgcuagcgcccugauccccgugaaagaccacaagcuccuggagaaggaagauuccgaggcggccgacucuaaaagccuuguucuggagaacgugaccgauacagcucaggacaucccuacgaccgucgauacaaaggaccugcccccuaccgccaugcccaaaccgcagcauacauucuccgauucucaaagcccugcugaauccagccccggaccuucucugucccuuagcgcccccgccccgggcgacgugccuaaggauaccugcguucagucucccauuuccagcuuuccuugcacggaccugaaagugucugagaaucacaagggguguguccuccccgugagccgccagaacaaugaaaagaugccccugcuggagcucggaggcgagacaaccccuccgcuguccaccgaacggagccccgaggcugucgggucugaaugcccuuccagagugcuuguucaagugcgcagcuucguccugcccguggaguccacacaggacguuucuagccaggugaucccugaauccucugagguccgggaggugcagcuccccaccugucauagcaacgaaccugaggugguuuccgucgcgucuugcgccccgccccaagaagaggugcugggcaaugaacacagccacuguacagcugagcuugccgccaaauccggaccucaggugauucccccugcuagcgagaagacgcugcccauccaggcccagucucaaggcuccagaaccccgcucauggcggaaagcucuccuacaaacucccccagcucugggaaucaucuggcuacaccccagcggccugaucagacagucaccaacggacaggacucccccgccagccugcucaauauuuccgccggcagcgaugacucuguguuugauagcuccucugacauggagaaauucacggaaaucauuaagcaaauggauagcgcuguuugcaugccuaugaaacgcaagaaagccagaaugccgaacucccccgcgccucacuuugcuaugcccccuauccaugaggaccaccuggaaaagguguucgaucccaaggucuuuaccuucgggcuuggcaaaaagaaagagucucagccggagaugagcccugcccugcaucucaugcagaaucuggacacaaaguccaaacugcggcccaagagagccucugcugaacagagcgugcuuuucaagucccuccacaccaacacaaauggcaacagcgagccucugguuaugcccgaaaucaacgauaaagagaaucgcgacgugaccaacgggggcauuaagcggucuagacuggagaaauccgcccucuuuagcucucugcuuuccagccugccucaagacaagaucuucucccccucugucacgagcgugaauacaaugaccacagcuuuuuccaccagccagaacggaucucucucccagagcucuguuagccaaccgaccacagaaggcgccccucccugugggcugaauaaagagcaguccaaccugcuucccgauaauucucucaagguguucaacuuuaauagcuccucuacgagccacuccagccugaagucuccuucccauauggaaaaauacccgcagaaggagaaaaccaaggaagaccuggauagccgcuccaaccuccaccuccccgagacaaaauucucugagcuuagcaagcugaagaaugacgauauggaaaaagcgaaccauauugaguccgucaucaagucuaaucucccuaacugcgccaauagcgacaccgauuuuaugggacuguucaaauccagcagauaugaccccucuauuuccuuuagcggcaugucucuguccgauacaaugacccuucgggggagcgugcagaacaagcucaacccucgccccggaaaaguggucaucuacucugaaccugacguuagcgagaaguguaucgaaguguucuccgauauucaagacugcucuagcuggucccugagcccggugauccugauuaaagucgugagaggcugcuggauccucuaugagcagcccaauuuugaggggcacuccauuccucuggaagagggcgaacuugagcugucuggacucuggggcaucgaagauauccuggagcggcacgaggaagcugagagcgacaagcccguugugauuggguccauccgccaugucgugcaggacuacagaguuucucacauugaucuguucacggaaccugagggacuuggcauccucagcuccuauuuugacgauacagaggaaaugcagggguucggagugaugcaaaagaccuguucuaugaaaguccauuggggcaccuggcugauuuacgaggaacccggguuccagggcgugccguuuauccuggagccuggagaauaucccgaccucagcuucugggauacagaggaggccuacauuggcuccaugcggccccugaagaugggagggcgcaaaguugaauuuccuaccgaccccaagguggucguguacgagaaaccuuucuuugaaggcaagugcguggagcuugaaacagggauguguagcuucgucauggagggaggcgagacggaagaggcuaccggcgaugaccaucugccguuuacaucuguuggguccaugaaggugcucagaggaaucuggguggccuaugaaaaacccggcuucaccgggcaucaguaccugcuggaggaaggagaguaucgggauuggaaggccuggggcggguacaacggagagcuucagagccugcgcccuauccucggcgacuuuucuaaugcucacaugauuauguauuccgagaaaaacuucggcagcaaggggucuuccaucgauguccugggaauuguggcgaaucucaaagagacaggcuacgggguuaagacccaaagcaucaacgugcuguccggagucuggguggccuaugaaaaucccgacuuuacgggcgagcaguacauucuugacaagggguucuacaccagcuuugaggauuggggaggcaaaaacugcaagaucucuagcguucagccuaucugucuggacuccuucacaggccccagacggagaaaucaaauucaccucuucucugaaccgcaguuucaggggcauagccaguccuucgaggaaaccacaucucaaaucgaugacagcuuuuccaccaaaucuugccgcgugagcggaggcuccugggucguguaugauggggagaacuucacaggaaaucaguacguccuggaagagggccacuauccuugucugagcgcuauggggugucccccuggagccaccuuuaagucucuucgguucauugacguggaguuuuccgaacccacgaucauucuguucgagagagaagauuuuaaaggcaagaagaucgagcucaacgccgaaacaguuaaucugcgcagccucggcuucaacacccagauccggucugugcaggucauugggggaaucugggugaccuacgaguauggcuccuacagagggcgccaauuucugcuuagcccugcugagguucccaauugguaugaguucuccggaugucggcagauuggcucucugagaccguucgugcagaaacgcaucuacuuucggcucagaaacaaggccacagggcuguucaugagcaccaacggaaaucuggaggaccuuaaacugcuccggauucaggucauggaagaugugggcgcggacgaucaaaucuggaucuaccaggagggcugcauuaagugucgcaucgcugaagacugcugccugacgauuguggggucccucguuacaagcggaucuaaacugggccuugcccuggaucagaacgccgacucccaguuuuggagccugaagucugacgggagaaucuauagcaagcucaaaccuaaucugguccuugauauuaagggaggcacccaauacgaccagaaccauaucauucugaauacaguguccaaagagaaguucacccaggugugggaggcuaugguccucuauacauga

SEQ ID NO: 65663 - RNA, 1032 nt, Artificial Sequence
  derived and/or modified sequence opt5 from AIM2__Homo_sapiens__NP_004824
auggagagcaaguacaaagaaauccugcuccugaccggccuugacaacauuacagaugaggaacuggacagauucaaguuuuuccucuccgaugaguuuaauaucgccacggggaaacugcacaccgcuaaccggauucagguggccacacuuaugauccaaaaugcgggagcugucucugccguuaugaagaccauucgcaucuuccagaaacugaacuauaugcuccuggccaagagacugcaggaagagaaggagaaaguggacaagcaguacaaaagcgugacaaagcccaaaccucucucccaagcugaaaugucuccggccgcuagcgccgcgauccggaaugaugucgccaagcagcgcgcugcccccaagguguccccucauguuaaacccgagcagaagcagaugguggcucaacaggaaucuauuagagagggcuuucagaaacggugccugccugucauggugcuuaaggccaaaaagcccuucaccuuugagacacaggaagggaaacaagagauguuccacgcgaccguugccacggaaaaggaguuuuucuuugugaaggucuucaacacccugcucaaagacaaguuuaucccuaaacgcauuaucauuaucgcuagauauuaccggcauagcggauuccuggaagucaauuccgccagccgcgugcuugaugcugagucugaccagaaggugaacguuccgcugaauauuaucagaaaagccggcgagacacccaagaucaacacccuccagacacaaccucuggggaccauugugaauggacuguucgugguccagaaggugacggagaaaaagaaaaacauccucuuugaucuguccgacaauacaggcaagauggaaguucuuggcgugcggaacgaagauaccaugaaauguaaggagggggacaagguccgccugacauucuuuacccucagcaaaaauggagaaaagcugcagcuuaccucuggcgugcacuccacaauuaaaguuaucaaggccaaaaagaagacguga

SEQ ID NO: 65664 - RNA, 939 nt, Artificial Sequence
  derived and/or modified sequence opt5 from AIMP1__Homo_sapiens__NP_001135887
auggccaacaaugacgcugugcugaagagacucgagcagaaaggcgccgaagcggaucaaaucauugaguaccugaagcagcaggucagccuucugaaagaaaaggcuauccuccaggccacccugcgggaggaaaagaaacuucgcguugagaacgccaagcugaaaaaggagauugaggaacucaaacaagaacugauccaggcugagauucagaauggggugaagcagauccccuucccuuccggaacaccgcugcacgccaacucuauggugagcgagaaugucauccaauccacggcugugaccacaguuucuagcggcaccaaagaacagauuaaagggggaacaggcgacgagaagaaagccaaggaaaagaucgagaagaaaggggaaaagaaagagaagaagcagcaguccauugcgggaucugccgauagcaaacccaucgacguguccagacucgaucugcggauuggcugcaucauuaccgcucgcaagcauccugacgccgauagccuuuaugucgaggaaguggacguuggcgagaucgcucccagaacaguggucucugggcuggugaaccacgugccucucgaacaaaugcagaaucggauggucauccugcuuuguaaccugaaacccgccaagaugcgcggaguucucucccaggcgauggugaugugcgccagcucuccugagaaaauugaaauccuggcuccgcccaauggcuccgugccuggggauagaauuaccuuugacgccuuccccggagagccugauaaggagcugaaccccaagaaaaagaucugggaacaaauucagccggaccuccauacgaaugaugagugugucgcuaccuacaaaggcgugccuuuugaaguuaaggggaaaggagugugccgggcccagacaaugagcaacucuggcaucaaguga

SEQ ID NO: 65665 - RNA, 963 nt, Artificial Sequence
  derived and/or modified sequence opt5 from AIMP2__Homo_sapiens__NP_006294
augcccauguaccaggugaagccuuaucacggcgggggagccccgcugagagucgagcucccuaccugcauguaccggcugcccaacguucauggccgcagcuaugggcccgcuccuggagccggccacgugcaagaagaguccaaucuuucucugcaggcgcucgaaagcagacaggacgauauccugaaacggcuuuacgagcugaaggcugccguggacgggcucuccaaaaugauucagacacccgaugccgaccuggaugucacgaacaucauucaagcugacgaaccuaccacacugaccacaaaugcccucgaucugaacucugugcuuggaaaggacuauggcgcucugaaagauaucguuauuaaugccaacccggcgucucccccucucucccugcuugugcugcaucgccuccugugugagcacuucagaguccugucuaccgugcauacacacagcuccguuaagagcgugcccgagaaucuccugaagugcuuuggcgaacagaacaaaaagcagccucggcaggacuaccaacuuggguucacccugaucuggaaaaauguccccaagacgcagaugaaauuuucuauccagaccauguguccgauugagggagaaggcaacaucgcccgcuuccucuuuucccuguucgggcagaagcacaaugcugugaacgccacacuuauugauagcuggguggacaucgcuauuuuucaacugaaggagggaucuuccaaagagaaggccgcggucuucagaagcaugaauagcgcccucggcaaauccccuuggcuggcugggaacgaacugaccguugccgauguggugcucuggagcguccugcagcagaucggaggcugcuccgugacaguucccgcuaaugugcaacgguggaugcgcucuugugagaaccuugccccuuuuaacaccgcccugaagcuccugaaauga

SEQ ID NO: 65666 - RNA, 993 nt, Artificial Sequence
  derived and/or modified sequence opt5 from AIP__Homo_sapiens__NP_003968
auggccgacaucauugcuagacugcgggaggauggcauccagaagcgcgugauucaagaagggagaggagagcuccccgacuuccaggauggcaccaaagccacauuucacuaccggacgcugcauagcgacgaugaagggaccguccuugacgauucccgcgcgagaggaaagccuauggagcugaucauuggcaaaaaguucaaacucccgguuugggaaacaaucgugugcaccaugcgggagggggagaucgcucaguuucugugugacauuaagcacgugguccuuuauccccugguggccaagucucuccgcaacaucgccguuggaaaagauccucuggaaggccagagacauugcuguggcguggcucaaaugcgggagcacagcucccuggggcaugccgaccucgaugcucugcagcagaauccccagccucuuauuuuccacauggaaaugcugaaggucgagucucccggaacauaccaacaggacccuugggccaugaccgaugaggaaaaagcgaaggccgugccgcucauccaccaggagggcaaccgccuguauagagaagggcauguuaaagaggcugccgcuaaguacuaugacgccauugcgugccuuaagaaucugcagaugaaagaacaacccggaagcccugaguggauccagcucgaccagcaaauuacaccccugcugcucaacuacugucagugcaagcugguggucgaggaauauuacgaggugcuugaucacuguuccucuauccugaauaaauacgacgauaacgugaaggccuauuuuaaacggggcaaggcucaugccgcugucuggaaugcccaggaagcccaggcugacuucgcgaaaguucucgagcuggauccugcccuugcucccguggugagccgcgaacugagagcccucgaggcccggauccgccaaaaggacgaggaagauaaggcuagauuucgggggauuuucucccacuga

SEQ ID NO: 65667 - RNA, 966 nt, Artificial Sequence
  derived and/or modified sequence opt5 from AIPL1__Homo_sapiens__NP_001028226
auggacgccgcucugcuccugaacguggagggcgucaagaaaaccauccuucacgggggaacaggcgaacugcccaauuucauuacggggagcagaguuaucuuucauuuccggaccaugaagugcgaugaggaacgcacagugauugacgauuccagacaggugggacaaccuaugcacaucauuaucggcaacauguuuaaacucgaggucugggaaauccugcuuaccucuaugcgggugcaugagguugccgaguucuggugugacacaauuguggaugcgccgagcgacuaccagcgcgaaaccuggaaucuguccaaccacgagaagaugaaagcuguccccgugcuccauggggaaggaaauagacuguuuaagcugggccgguaugaggaggccucuagcaaguaccaggaagccaucauuugccuccgcaaccugcagacaaaagagaagccuugggaaguucaauggcuuaaacuggagaagaugaucaauacccucauucugaacuauugucagugccuucugaaaaaggaagaguacuaugaggugcucgaacacacguccgauauccugagacaccaucccggcauugucaaggcuuacuaugugcgggcccgcgcucacgccgagguguggaaugaagcggaggccaaagcugaccugcagaagguccucgaacuggagccuucuaugcagaaagccguuagacgggagcuucgccugcucgaaaacagaauggcugagaagcaagaagaggaacggcugcgcuguagaaauaugcuuagccagggggccacccagcccccugcggagccgcccacagagccucccgcccaguccagcaccgaaccucccgcugagccgccuacagcccccucugcugaacuguccgccggaccucccgccgagcccgcuaccgagccuccgcccagcccuggccauucucuccaacacuga

SEQ ID NO: 65668 - RNA, 1638 nt, Artificial Sequence
  derived and/or modified sequence opt5 from AIRE__Homo_sapiens__NP_000374
auggccaccgacgcugcccugagacggcuccugcgccuucacagaacagagaucgcgguggcugucgauagcgccuucccccugcuccaugcccuggcugaccacgauguugugccugaagacaaguuucaggagacgcuucaucugaaagaaaaggagggcugcccgcaagccuuccacgcucuccuguccuggcugcucacccaggauucuacagccauucuggacuuuuggcgggugcuuuucaaagauuacaaccuggaacgcuaugggagacuccagcccauccuggacagcuuuccuaaggaugucgaccuuucccagccccggaaaggacgcaagccucccgcggugccuaaggcccugguuccgcccccuagacuccccaccaaacggaaggcuucugaggaggcccgcgcugccgcgccugccgcucugacacccagaggcaccgccagcccggggucccaacugaaagcuaagccucccaaaaagccugaaucuagcgccgagcagcagcggcucccccugggaaauggcauucagacaauguccgccagcgugcaacgcgcugucgcgaugucuuccggggaugugcccggagccagaggcgcuguugaaggcauccuuauucaacagguguucgagagcgggggaucuaagaaauguauccaggucggcggggaguuuuacaccccuuccaaguucgaagacagcggaucuggcaaaaacaaggcccgguccagcuccgggccgaaaccccuggugcgcgccaagggagcucagggcgccgcgccuggcgggggagaggcuagacucggccagcaggggucugugcccgccccucuggcccuucccagcgauccgcaacugcaucagaaaaaugaagacgagugcgcugucugucgggacggaggcgaacucaucugcugugaugggugcccuagagccuuucaccuggcuugucugucucccccucuccgcgagauucccagcggaacguggcggugcuccuccugucugcaggccaccguucaggaggugcaaccuagagcggaggaaccccgcccgcaggaaccucccguggagacaccccuuccuccgggccugcggagcgccggcgaagaggucagagggcccccuggagagccccucgcuggcauggacaccacacugguguauaagcaccuuccugccccuccuucugcugcgccccugccggggcucgauagcuccgcccugcauccucugcucugcguuggacccgaaggccagcagaaccuggccccuggggcucgcuguggcgugugcggagacggcaccgauguccuucggugcacgcacugugccgcugccuuccauuggagaugccacuuucccgccgggacaucucgcccgggaaccggccugcgguguagaagcugcuccggggacgugacacccgcucccguugagggagugcucgcgccuagccccgcccgccuggcucccggcccugccaaggaugacaccgccucucacgaaccggcucugcaucgggaugaccuugagucccuccugagcgaacacaccuucgaugggauccugcaaugggccauucagucuauggcgagacccgcugccccuuuucccuccuga

SEQ ID NO: 65669 - RNA, 1236 nt, Artificial Sequence
  derived and/or modified sequence opt5 from AJAP1__Homo_sapiens__XP_011540088
auguggauccagcaacugcucggccugagcuccaugucuauuagauggcccgggcggccucuuggaagccacgccuggauccugauugcuauguuccagcucgccguggaccugccggcgugcgaggcucuuggccccgggccugaauuuuggcugcucccccgcuccccucccagaccuccgcggcuguggucuuuccgcagcggacagcccgccagagucccugcccccguuugguccccucggcccccgcgcguggagagaauccauggccagaugcaaaugccucgggcucgcagagcccaccggccccgcgaucaggcugccgcgcuggugccuaaggccgggcucgcuaaaccucccgccgcugccaagucuagccccucccuggcgagcagcuccucuucuuccagcucugccgucgcuggaggcgccccggaacagcaggcccuucugagacggggcaaacgccaucuccaaggggacggacuguccagcuuugauuccagaggcucucggcccaccacagagacggaguucauugcuugggggccuaccggagacgaagaggcccuugaaagcaacacauuucccggcguguacgggccuaccacaguuuccauccugcagaccagaaagacaaccguggcugcgacgaccacaaccacaaccacggccacacccaugacccuccagacaaaaggauucaccgagagccuggauccgcgccggagaaucccuggcggcgucucuaccacagaacccuccacgagcccuucuaauaacggggaggugacccagcccccucgcauucugggagaggcuagcggccucgccguucaccaaaucauuacaaucaccgugucccugauuauggucaucgccgcucuuauuacaacccuggugcucaagaauuguugcgcccagucugggaacacgcggagaaauagccaucagcgcaagacaaaccaacaggaagaguccugucagaaucugaccgacuuucccagcgcgcgggugccgucuucccuugauaucuucaccgcuuauaacgaaacacugcagugcagccacgagugugucagagccucuguuccuguguacaccgacgaaacacuccacuccacgaccggagaguauaaaagcacauuuaauggcaaccgccccuccucuagcgaucggcaucugauccccguggccuucgucuccgagaagugguuugaaauuucuugcuga
